United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 89

SEQ ID NO: 3174695 - RNA, 16 nt, Mycobacterium bovis subsp bovis AF2122/97
acgaucaaccggguca

SEQ ID NO: 3174696 - RNA, 24 nt, Mycobacterium bovis subsp bovis AF2122/97
acgaucaccccgccaugcggcgcg

SEQ ID NO: 3174697 - RNA, 12 nt, Mycobacterium bovis subsp bovis AF2122/97
acgaucacccgc

SEQ ID NO: 3174698 - RNA, 13 nt, Mycobacterium bovis subsp bovis AF2122/97
acgaucacccgca

SEQ ID NO: 3174699 - RNA, 11 nt, Mycobacterium bovis subsp bovis AF2122/97
acgaucacgau

SEQ ID NO: 3174700 - RNA, 19 nt, Mycobacterium bovis subsp bovis AF2122/97
acgaucagcacgucgcggc

SEQ ID NO: 3174701 - RNA, 20 nt, Mycobacterium bovis subsp bovis AF2122/97
acgaucagcacgucgcggcc

SEQ ID NO: 3174702 - RNA, 17 nt, Mycobacterium bovis subsp bovis AF2122/97
acgaucagcgaguagcc

SEQ ID NO: 3174703 - RNA, 19 nt, Mycobacterium bovis subsp bovis AF2122/97
acgaucagcgugaucugca

SEQ ID NO: 3174704 - RNA, 23 nt, Mycobacterium bovis subsp bovis AF2122/97
acgaucagcuugugggcgacggc

SEQ ID NO: 3174705 - RNA, 18 nt, Mycobacterium bovis subsp bovis AF2122/97
acgaucaggccgucgccg

SEQ ID NO: 3174706 - RNA, 23 nt, Mycobacterium bovis subsp bovis AF2122/97
acgaucagggugucgaagagcag

SEQ ID NO: 3174707 - RNA, 14 nt, Mycobacterium bovis subsp bovis AF2122/97
acgaucaguccaug

SEQ ID NO: 3174708 - RNA, 19 nt, Mycobacterium bovis subsp bovis AF2122/97
acgaucaguugccccacuu

SEQ ID NO: 3174709 - RNA, 19 nt, Mycobacterium bovis subsp bovis AF2122/97
acgaucauauggccgccga

SEQ ID NO: 3174710 - RNA, 23 nt, Mycobacterium bovis subsp bovis AF2122/97
acgaucaucucgucgucgcggcc

SEQ ID NO: 3174711 - RNA, 14 nt, Mycobacterium bovis subsp bovis AF2122/97
acgauccacggcga

SEQ ID NO: 3174712 - RNA, 23 nt, Mycobacterium bovis subsp bovis AF2122/97
acgauccagcccaacucggccag

SEQ ID NO: 3174713 - RNA, 13 nt, Mycobacterium bovis subsp bovis AF2122/97
acgauccagcugu

SEQ ID NO: 3174714 - RNA, 20 nt, Mycobacterium bovis subsp bovis AF2122/97
acgaucccgugauccgccga

SEQ ID NO: 3174715 - RNA, 22 nt, Mycobacterium bovis subsp bovis AF2122/97
acgaucccgugauccgccgaca

SEQ ID NO: 3174716 - RNA, 17 nt, Mycobacterium bovis subsp bovis AF2122/97
acgauccgcacccggcc

SEQ ID NO: 3174717 - RNA, 20 nt, Mycobacterium bovis subsp bovis AF2122/97
acgauccgcgguagcagcag

SEQ ID NO: 3174718 - RNA, 20 nt, Mycobacterium bovis subsp bovis AF2122/97
acgaucgacagccccgcggc

SEQ ID NO: 3174719 - RNA, 21 nt, Mycobacterium bovis subsp bovis AF2122/97
acgaucgacagccccgcggcc

SEQ ID NO: 3174720 - RNA, 23 nt, Mycobacterium bovis subsp bovis AF2122/97
acgaucgagcccggagcggucag

SEQ ID NO: 3174721 - RNA, 14 nt, Mycobacterium bovis subsp bovis AF2122/97
acgaucgaugaccu

SEQ ID NO: 3174722 - RNA, 16 nt, Mycobacterium bovis subsp bovis AF2122/97
acgaucgcgccgucgu

SEQ ID NO: 3174723 - RNA, 22 nt, Mycobacterium bovis subsp bovis AF2122/97
acgcacgauccgcacccggccg

SEQ ID NO: 3174724 - RNA, 23 nt, Mycobacterium bovis subsp bovis AF2122/97
acgcacgauccgcacccggccgc

SEQ ID NO: 3174725 - RNA, 17 nt, Mycobacterium bovis subsp bovis AF2122/97
acgcacgcagccccucg

SEQ ID NO: 3174726 - RNA, 16 nt, Mycobacterium bovis subsp bovis AF2122/97
acgcacgccgcgugcc

SEQ ID NO: 3174727 - RNA, 23 nt, Mycobacterium bovis subsp bovis AF2122/97
acgcacgcgguucaccacgucgu

SEQ ID NO: 3174728 - RNA, 17 nt, Mycobacterium bovis subsp bovis AF2122/97
acgcacucccgagccac

SEQ ID NO: 3174729 - RNA, 20 nt, Mycobacterium bovis subsp bovis AF2122/97
acgcacucccgagccacaaa

SEQ ID NO: 3174730 - RNA, 15 nt, Mycobacterium bovis subsp bovis AF2122/97
acgcacugccccgca

SEQ ID NO: 3174731 - RNA, 17 nt, Mycobacterium bovis subsp bovis AF2122/97
acgcacugccccgcauc

SEQ ID NO: 3174732 - RNA, 23 nt, Mycobacterium bovis subsp bovis AF2122/97
acgcagaagcccccaaaccggcg

SEQ ID NO: 3174733 - RNA, 18 nt, Mycobacterium bovis subsp bovis AF2122/97
acgcagaaucgcacgcga

SEQ ID NO: 3174734 - RNA, 17 nt, Mycobacterium bovis subsp bovis AF2122/97
acgcagaaucgcaugau

SEQ ID NO: 3174735 - RNA, 20 nt, Mycobacterium bovis subsp bovis AF2122/97
acgcagaaucgcccaauuuc

SEQ ID NO: 3174736 - RNA, 15 nt, Mycobacterium bovis subsp bovis AF2122/97
acgcagaccguccag

SEQ ID NO: 3174737 - RNA, 17 nt, Mycobacterium bovis subsp bovis AF2122/97
acgcagaccguccagca

SEQ ID NO: 3174738 - RNA, 18 nt, Mycobacterium bovis subsp bovis AF2122/97
acgcagaccguccagcaa

SEQ ID NO: 3174739 - RNA, 19 nt, Mycobacterium bovis subsp bovis AF2122/97
acgcagaccguccagcaac

SEQ ID NO: 3174740 - RNA, 20 nt, Mycobacterium bovis subsp bovis AF2122/97
acgcagaccguccagcaaca

SEQ ID NO: 3174741 - RNA, 22 nt, Mycobacterium bovis subsp bovis AF2122/97
acgcagagucgcacugcgccgg

SEQ ID NO: 3174742 - RNA, 15 nt, Mycobacterium bovis subsp bovis AF2122/97
acgcagcacccugcg

SEQ ID NO: 3174743 - RNA, 13 nt, Mycobacterium bovis subsp bovis AF2122/97
acgcagcacggca

SEQ ID NO: 3174744 - RNA, 20 nt, Mycobacterium bovis subsp bovis AF2122/97
acgcagcacggcacccaccc

SEQ ID NO: 3174745 - RNA, 14 nt, Mycobacterium bovis subsp bovis AF2122/97
acgcagccagcgcc

SEQ ID NO: 3174746 - RNA, 15 nt, Mycobacterium bovis subsp bovis AF2122/97
acgcagccccucguc

SEQ ID NO: 3174747 - RNA, 24 nt, Mycobacterium bovis subsp bovis AF2122/97
acgcagccgauacaggccacgcac

SEQ ID NO: 3174748 - RNA, 18 nt, Mycobacterium bovis subsp bovis AF2122/97
acgcagccgaugucgcgc

SEQ ID NO: 3174749 - RNA, 19 nt, Mycobacterium bovis subsp bovis AF2122/97
acgcagcucgugaccgccg

SEQ ID NO: 3174750 - RNA, 21 nt, Mycobacterium bovis subsp bovis AF2122/97
acgcaggaaaaccccggccac

SEQ ID NO: 3174751 - RNA, 16 nt, Mycobacterium bovis subsp bovis AF2122/97
acgcaggugaacgccg

SEQ ID NO: 3174752 - RNA, 18 nt, Mycobacterium bovis subsp bovis AF2122/97
acgcagucgggcagcgcu

SEQ ID NO: 3174753 - RNA, 19 nt, Mycobacterium bovis subsp bovis AF2122/97
acgcagugcccgaucgcuu

SEQ ID NO: 3174754 - RNA, 15 nt, Mycobacterium bovis subsp bovis AF2122/97
acgcauaaccggcgc

SEQ ID NO: 3174755 - RNA, 21 nt, Mycobacterium bovis subsp bovis AF2122/97
acgcauaucgcuugaacgcau

SEQ ID NO: 3174756 - RNA, 15 nt, Mycobacterium bovis subsp bovis AF2122/97
acgcaucgccgucaa

SEQ ID NO: 3174757 - RNA, 15 nt, Mycobacterium bovis subsp bovis AF2122/97
acgcaucgucagcga

SEQ ID NO: 3174758 - RNA, 13 nt, Mycobacterium bovis subsp bovis AF2122/97
acgcaugagggca

SEQ ID NO: 3174759 - RNA, 19 nt, Mycobacterium bovis subsp bovis AF2122/97
acgcaugcgagaacgucga

SEQ ID NO: 3174760 - RNA, 15 nt, Mycobacterium bovis subsp bovis AF2122/97
acgcaugggccaggu

SEQ ID NO: 3174761 - RNA, 23 nt, Mycobacterium bovis subsp bovis AF2122/97
acgcaugggccaggucagccgcg

SEQ ID NO: 3174762 - RNA, 13 nt, Mycobacterium bovis subsp bovis AF2122/97
acgcaugucgggc

SEQ ID NO: 3174763 - RNA, 17 nt, Mycobacterium bovis subsp bovis AF2122/97
acgcauguuggugauca

SEQ ID NO: 3174764 - RNA, 17 nt, Mycobacterium bovis subsp bovis AF2122/97
acgcauuccagcaggcc

SEQ ID NO: 3174765 - RNA, 18 nt, Mycobacterium bovis subsp bovis AF2122/97
acgccaaaacggucgacc

SEQ ID NO: 3174766 - RNA, 15 nt, Mycobacterium bovis subsp bovis AF2122/97
acgccaacaccggca

SEQ ID NO: 3174767 - RNA, 14 nt, Mycobacterium bovis subsp bovis AF2122/97
acgccaacgccagc

SEQ ID NO: 3174768 - RNA, 15 nt, Mycobacterium bovis subsp bovis AF2122/97
acgccaacgccagcg

SEQ ID NO: 3174769 - RNA, 21 nt, Mycobacterium bovis subsp bovis AF2122/97
acgccaacgugacgccggcca

SEQ ID NO: 3174770 - RNA, 23 nt, Mycobacterium bovis subsp bovis AF2122/97
acgccaacgugacgccggccagu

SEQ ID NO: 3174771 - RNA, 15 nt, Mycobacterium bovis subsp bovis AF2122/97
acgccaagcucggcc

SEQ ID NO: 3174772 - RNA, 19 nt, Mycobacterium bovis subsp bovis AF2122/97
acgccaaguacgcgaccgc

SEQ ID NO: 3174773 - RNA, 21 nt, Mycobacterium bovis subsp bovis AF2122/97
acgccaaguacgcgaccgcga

SEQ ID NO: 3174774 - RNA, 22 nt, Mycobacterium bovis subsp bovis AF2122/97
acgccaaguacgcgaccgcgau

SEQ ID NO: 3174775 - RNA, 15 nt, Mycobacterium bovis subsp bovis AF2122/97
acgccaaguccgcuc

SEQ ID NO: 3174776 - RNA, 12 nt, Mycobacterium bovis subsp bovis AF2122/97
acgccaccaccu

SEQ ID NO: 3174777 - RNA, 18 nt, Mycobacterium bovis subsp bovis AF2122/97
acgccaccaccuccgcgu

SEQ ID NO: 3174778 - RNA, 19 nt, Mycobacterium bovis subsp bovis AF2122/97
acgccaccauccccggcaa

SEQ ID NO: 3174779 - RNA, 22 nt, Mycobacterium bovis subsp bovis AF2122/97
acgccacccccaaccgccggcc

SEQ ID NO: 3174780 - RNA, 23 nt, Mycobacterium bovis subsp bovis AF2122/97
acgccacccccaaccgccggcca

SEQ ID NO: 3174781 - RNA, 20 nt, Mycobacterium bovis subsp bovis AF2122/97
acgccaccgagaucggacag

SEQ ID NO: 3174782 - RNA, 21 nt, Mycobacterium bovis subsp bovis AF2122/97
acgccaccgccaccacccagg

SEQ ID NO: 3174783 - RNA, 23 nt, Mycobacterium bovis subsp bovis AF2122/97
acgccaccgccaccacccaggcc

SEQ ID NO: 3174784 - RNA, 13 nt, Mycobacterium bovis subsp bovis AF2122/97
acgccaccgcggu

SEQ ID NO: 3174785 - RNA, 13 nt, Mycobacterium bovis subsp bovis AF2122/97
acgccaccggcaa

SEQ ID NO: 3174786 - RNA, 15 nt, Mycobacterium bovis subsp bovis AF2122/97
acgccaccggcaauc

SEQ ID NO: 3174787 - RNA, 22 nt, Mycobacterium bovis subsp bovis AF2122/97
acgccaccggcaaucggcggca

SEQ ID NO: 3174788 - RNA, 15 nt, Mycobacterium bovis subsp bovis AF2122/97
acgccacgaccgccg

SEQ ID NO: 3174789 - RNA, 12 nt, Mycobacterium bovis subsp bovis AF2122/97
acgccacgacgc

SEQ ID NO: 3174790 - RNA, 14 nt, Mycobacterium bovis subsp bovis AF2122/97
acgccacgacgccc

SEQ ID NO: 3174791 - RNA, 13 nt, Mycobacterium bovis subsp bovis AF2122/97
acgccacgacguc

SEQ ID NO: 3174792 - RNA, 14 nt, Mycobacterium bovis subsp bovis AF2122/97
acgccacgacgucg

SEQ ID NO: 3174793 - RNA, 20 nt, Mycobacterium bovis subsp bovis AF2122/97
acgccacggacgugacgucg

SEQ ID NO: 3174794 - RNA, 19 nt, Mycobacterium bovis subsp bovis AF2122/97
acgccacggcaucggccac

SEQ ID NO: 3174795 - RNA, 13 nt, Mycobacterium bovis subsp bovis AF2122/97
acgccacugccag

SEQ ID NO: 3174796 - RNA, 14 nt, Mycobacterium bovis subsp bovis AF2122/97
acgccacugccagc

SEQ ID NO: 3174797 - RNA, 15 nt, Mycobacterium bovis subsp bovis AF2122/97
acgccacugccagcc

SEQ ID NO: 3174798 - RNA, 23 nt, Mycobacterium bovis subsp bovis AF2122/97
acgccagaacguggccauccucg

SEQ ID NO: 3174799 - RNA, 14 nt, Mycobacterium bovis subsp bovis AF2122/97
acgccagaccgccg

SEQ ID NO: 3174800 - RNA, 22 nt, Mycobacterium bovis subsp bovis AF2122/97
acgccagcaaugcccgcaccgc

SEQ ID NO: 3174801 - RNA, 19 nt, Mycobacterium bovis subsp bovis AF2122/97
acgccagcaccagcgucgc

SEQ ID NO: 3174802 - RNA, 22 nt, Mycobacterium bovis subsp bovis AF2122/97
acgccagcaccagcgucgcggc

SEQ ID NO: 3174803 - RNA, 12 nt, Mycobacterium bovis subsp bovis AF2122/97
acgccagccgcg

SEQ ID NO: 3174804 - RNA, 13 nt, Mycobacterium bovis subsp bovis AF2122/97
acgccagccgcgc

SEQ ID NO: 3174805 - RNA, 12 nt, Mycobacterium bovis subsp bovis AF2122/97
acgccagccggu

SEQ ID NO: 3174806 - RNA, 16 nt, Mycobacterium bovis subsp bovis AF2122/97
acgccagcucgccggc

SEQ ID NO: 3174807 - RNA, 18 nt, Mycobacterium bovis subsp bovis AF2122/97
acgccagcugcccgacgu

SEQ ID NO: 3174808 - RNA, 17 nt, Mycobacterium bovis subsp bovis AF2122/97
acgccaggaucugggua

SEQ ID NO: 3174809 - RNA, 12 nt, Mycobacterium bovis subsp bovis AF2122/97
acgccgagcgcc

SEQ ID NO: 3174810 - RNA, 23 nt, Mycobacterium bovis subsp bovis AF2122/97
acgccgauacuaaacaggccgcc

SEQ ID NO: 3174811 - RNA, 21 nt, Mycobacterium bovis subsp bovis AF2122/97
acgccgaucaacaugccgguc

SEQ ID NO: 3174812 - RNA, 13 nt, Mycobacterium bovis subsp bovis AF2122/97
acgccgauccggu

SEQ ID NO: 3174813 - RNA, 23 nt, Mycobacterium bovis subsp bovis AF2122/97
acgccgauccgguggcuggccgc

SEQ ID NO: 3174814 - RNA, 22 nt, Mycobacterium bovis subsp bovis AF2122/97
acgccgaugauggacaccagcc

SEQ ID NO: 3174815 - RNA, 23 nt, Mycobacterium bovis subsp bovis AF2122/97
acgccgaugccgaacuccgcgga

SEQ ID NO: 3174816 - RNA, 13 nt, Mycobacterium bovis subsp bovis AF2122/97
acgccgaugcggu

SEQ ID NO: 3174817 - RNA, 16 nt, Mycobacterium bovis subsp bovis AF2122/97
acgccgauggcuuggu

SEQ ID NO: 3174818 - RNA, 20 nt, Mycobacterium bovis subsp bovis AF2122/97
acgccgauggcuuggugccc

SEQ ID NO: 3174819 - RNA, 19 nt, Mycobacterium bovis subsp bovis AF2122/97
acgccgcagcguccgcgga

SEQ ID NO: 3174820 - RNA, 15 nt, Mycobacterium bovis subsp bovis AF2122/97
acgccgccacccggc

SEQ ID NO: 3174821 - RNA, 16 nt, Mycobacterium bovis subsp bovis AF2122/97
acgccgccacccggcg

SEQ ID NO: 3174822 - RNA, 14 nt, Mycobacterium bovis subsp bovis AF2122/97
acgccgccagcacc

SEQ ID NO: 3174823 - RNA, 23 nt, Mycobacterium bovis subsp bovis AF2122/97
acgccgccagcaccucggccagc

SEQ ID NO: 3174824 - RNA, 13 nt, Mycobacterium bovis subsp bovis AF2122/97
acgccgccagcag

SEQ ID NO: 3174825 - RNA, 12 nt, Mycobacterium bovis subsp bovis AF2122/97
acgccgccagcc

SEQ ID NO: 3174826 - RNA, 22 nt, Mycobacterium bovis subsp bovis AF2122/97
acgccgccagguccgccggugc

SEQ ID NO: 3174827 - RNA, 19 nt, Mycobacterium bovis subsp bovis AF2122/97
acgccgccccugcgcggcc

SEQ ID NO: 3174828 - RNA, 21 nt, Mycobacterium bovis subsp bovis AF2122/97
acgccgccccugcgcggccac

SEQ ID NO: 3174829 - RNA, 11 nt, Mycobacterium bovis subsp bovis AF2122/97
acgccgccgac

SEQ ID NO: 3174830 - RNA, 13 nt, Mycobacterium bovis subsp bovis AF2122/97
acgccgccgacgu

SEQ ID NO: 3174831 - RNA, 15 nt, Mycobacterium bovis subsp bovis AF2122/97
acgccgccgaucacc

SEQ ID NO: 3174832 - RNA, 13 nt, Mycobacterium bovis subsp bovis AF2122/97
acgccgccgcugc

SEQ ID NO: 3174833 - RNA, 14 nt, Mycobacterium bovis subsp bovis AF2122/97
acgccgccgcugcc

SEQ ID NO: 3174834 - RNA, 12 nt, Mycobacterium bovis subsp bovis AF2122/97
acgccgccggca

SEQ ID NO: 3174835 - RNA, 14 nt, Mycobacterium bovis subsp bovis AF2122/97
acgccgccggccgc

SEQ ID NO: 3174836 - RNA, 18 nt, Mycobacterium bovis subsp bovis AF2122/97
acgccgccggccgccagc

SEQ ID NO: 3174837 - RNA, 12 nt, Mycobacterium bovis subsp bovis AF2122/97
acgccgccggcg

SEQ ID NO: 3174838 - RNA, 14 nt, Mycobacterium bovis subsp bovis AF2122/97
acgccgccguugcc

SEQ ID NO: 3174839 - RNA, 15 nt, Mycobacterium bovis subsp bovis AF2122/97
acgccgccguugccg

SEQ ID NO: 3174840 - RNA, 20 nt, Mycobacterium bovis subsp bovis AF2122/97
acgccgcgagagccggcggc

SEQ ID NO: 3174841 - RNA, 15 nt, Mycobacterium bovis subsp bovis AF2122/97
acgccgcgcagccgg

SEQ ID NO: 3174842 - RNA, 16 nt, Mycobacterium bovis subsp bovis AF2122/97
acgccgcgcagccggc

SEQ ID NO: 3174843 - RNA, 18 nt, Mycobacterium bovis subsp bovis AF2122/97
acgccgcgcagccggccc

SEQ ID NO: 3174844 - RNA, 21 nt, Mycobacterium bovis subsp bovis AF2122/97
acgccgcgccgaaucgcgggc

SEQ ID NO: 3174845 - RNA, 15 nt, Mycobacterium bovis subsp bovis AF2122/97
acgccgcgccgcaga

SEQ ID NO: 3174846 - RNA, 13 nt, Mycobacterium bovis subsp bovis AF2122/97
acgccgcgccguu

SEQ ID NO: 3174847 - RNA, 20 nt, Mycobacterium bovis subsp bovis AF2122/97
acgccgcgguuuucgccgga

SEQ ID NO: 3174848 - RNA, 19 nt, Mycobacterium bovis subsp bovis AF2122/97
acgccgcuggagaucacgc

SEQ ID NO: 3174849 - RNA, 19 nt, Mycobacterium bovis subsp bovis AF2122/97
acgccggauggucggccac

SEQ ID NO: 3174850 - RNA, 21 nt, Mycobacterium bovis subsp bovis AF2122/97
acgccggauggucggccacgc

SEQ ID NO: 3174851 - RNA, 13 nt, Mycobacterium bovis subsp bovis AF2122/97
acgccggcaccga

SEQ ID NO: 3174852 - RNA, 15 nt, Mycobacterium bovis subsp bovis AF2122/97
acgccggcaccgacg

SEQ ID NO: 3174853 - RNA, 11 nt, Mycobacterium bovis subsp bovis AF2122/97
acgccggcauc

SEQ ID NO: 3174854 - RNA, 15 nt, Mycobacterium bovis subsp bovis AF2122/97
acgccggcaucgcgc

SEQ ID NO: 3174855 - RNA, 18 nt, Mycobacterium bovis subsp bovis AF2122/97
acgccggcaucgcgcgcg

SEQ ID NO: 3174856 - RNA, 19 nt, Mycobacterium bovis subsp bovis AF2122/97
acgccggcaucgucgacgc

SEQ ID NO: 3174857 - RNA, 12 nt, Mycobacterium bovis subsp bovis AF2122/97
acgccggccagc

SEQ ID NO: 3174858 - RNA, 12 nt, Mycobacterium bovis subsp bovis AF2122/97
acgccggccgcg

SEQ ID NO: 3174859 - RNA, 18 nt, Mycobacterium bovis subsp bovis AF2122/97
acgccggccucgccgaag

SEQ ID NO: 3174860 - RNA, 14 nt, Mycobacterium bovis subsp bovis AF2122/97
acgccggccuggcc

SEQ ID NO: 3174861 - RNA, 13 nt, Mycobacterium bovis subsp bovis AF2122/97
acgccggcgacgg

SEQ ID NO: 3174862 - RNA, 14 nt, Mycobacterium bovis subsp bovis AF2122/97
acgccggcgacggc

SEQ ID NO: 3174863 - RNA, 15 nt, Mycobacterium bovis subsp bovis AF2122/97
acgccggcgccgcca

SEQ ID NO: 3174864 - RNA, 18 nt, Mycobacterium bovis subsp bovis AF2122/97
acgccggcggguggcccc

SEQ ID NO: 3174865 - RNA, 19 nt, Mycobacterium bovis subsp bovis AF2122/97
acgccgggaauuucgacac

SEQ ID NO: 3174866 - RNA, 20 nt, Mycobacterium bovis subsp bovis AF2122/97
acgccgggcaaggccaccgu

SEQ ID NO: 3174867 - RNA, 21 nt, Mycobacterium bovis subsp bovis AF2122/97
acgccgggcuguucggccaug

SEQ ID NO: 3174868 - RNA, 24 nt, Mycobacterium bovis subsp bovis AF2122/97
acgccggggaaccuugaccgacca

SEQ ID NO: 3174869 - RNA, 22 nt, Mycobacterium bovis subsp bovis AF2122/97
acgccgggucguacaacacggg

SEQ ID NO: 3174870 - RNA, 16 nt, Mycobacterium bovis subsp bovis AF2122/97
acgccgggugccgcca

SEQ ID NO: 3174871 - RNA, 19 nt, Mycobacterium bovis subsp bovis AF2122/97
acgccgggugccgccacgu

SEQ ID NO: 3174872 - RNA, 17 nt, Mycobacterium bovis subsp bovis AF2122/97
acgccggguucgccgga

SEQ ID NO: 3174873 - RNA, 14 nt, Mycobacterium bovis subsp bovis AF2122/97
acgccgguccccgc

SEQ ID NO: 3174874 - RNA, 19 nt, Mycobacterium bovis subsp bovis AF2122/97
acgccgguccccgccggcg

SEQ ID NO: 3174875 - RNA, 14 nt, Mycobacterium bovis subsp bovis AF2122/97
acgccggucgcggu

SEQ ID NO: 3174876 - RNA, 15 nt, Mycobacterium bovis subsp bovis AF2122/97
acgccggugccggcc

SEQ ID NO: 3174877 - RNA, 23 nt, Mycobacterium bovis subsp bovis AF2122/97
acgccggugccggccagacucgc

SEQ ID NO: 3174878 - RNA, 23 nt, Mycobacterium bovis subsp bovis AF2122/97
acgccgguggcacggccccugcc

SEQ ID NO: 3174879 - RNA, 23 nt, Mycobacterium bovis subsp bovis AF2122/97
acgccguagcaucgggcgagcuc

SEQ ID NO: 3174880 - RNA, 15 nt, Mycobacterium bovis subsp bovis AF2122/97
acgccguagccggcc

SEQ ID NO: 3174881 - RNA, 19 nt, Mycobacterium bovis subsp bovis AF2122/97
acgccguagcgcagcgccu

SEQ ID NO: 3174882 - RNA, 20 nt, Mycobacterium bovis subsp bovis AF2122/97
acgccguagcgcagcgccuc

SEQ ID NO: 3174883 - RNA, 14 nt, Mycobacterium bovis subsp bovis AF2122/97
acgccguaucggcg

SEQ ID NO: 3174884 - RNA, 23 nt, Mycobacterium bovis subsp bovis AF2122/97
acgccguaucggcgugucucguc

SEQ ID NO: 3174885 - RNA, 15 nt, Mycobacterium bovis subsp bovis AF2122/97
acgccgucagcggcc

SEQ ID NO: 3174886 - RNA, 16 nt, Mycobacterium bovis subsp bovis AF2122/97
acgccgucaugcccau

SEQ ID NO: 3174887 - RNA, 15 nt, Mycobacterium bovis subsp bovis AF2122/97
acgccguccacgccg

SEQ ID NO: 3174888 - RNA, 17 nt, Mycobacterium bovis subsp bovis AF2122/97
acgccguccacgccgac

SEQ ID NO: 3174889 - RNA, 21 nt, Mycobacterium bovis subsp bovis AF2122/97
acgccguccacgccgacggca

SEQ ID NO: 3174890 - RNA, 19 nt, Mycobacterium bovis subsp bovis AF2122/97
acgccguccgguguggcgc

SEQ ID NO: 3174891 - RNA, 15 nt, Mycobacterium bovis subsp bovis AF2122/97
acgccguccucgcua

SEQ ID NO: 3174892 - RNA, 15 nt, Mycobacterium bovis subsp bovis AF2122/97
acgccgucgaccggc

SEQ ID NO: 3174893 - RNA, 16 nt, Mycobacterium bovis subsp bovis AF2122/97
acgccgucgacgcggc

SEQ ID NO: 3174894 - RNA, 19 nt, Mycobacterium bovis subsp bovis AF2122/97
acgccgucgacgcggccgg

SEQ ID NO: 3174895 - RNA, 21 nt, Mycobacterium bovis subsp bovis AF2122/97
acgccgucgacgcggccggcc

SEQ ID NO: 3174896 - RNA, 19 nt, Mycobacterium bovis subsp bovis AF2122/97
acgcgcgcagccgggcacc

SEQ ID NO: 3174897 - RNA, 18 nt, Mycobacterium bovis subsp bovis AF2122/97
acgcgcgcaggccgccgc

SEQ ID NO: 3174898 - RNA, 20 nt, Mycobacterium bovis subsp bovis AF2122/97
acgcgcgcaggccgccgcca

SEQ ID NO: 3174899 - RNA, 16 nt, Mycobacterium bovis subsp bovis AF2122/97
acgcgcgcgaccucgc

SEQ ID NO: 3174900 - RNA, 19 nt, Mycobacterium bovis subsp bovis AF2122/97
acgcgcgcucgcucaccgg

SEQ ID NO: 3174901 - RNA, 22 nt, Mycobacterium bovis subsp bovis AF2122/97
acgcgcgcucgcucaccggcug

SEQ ID NO: 3174902 - RNA, 16 nt, Mycobacterium bovis subsp bovis AF2122/97
acgcgcggaucggcgg

SEQ ID NO: 3174903 - RNA, 18 nt, Mycobacterium bovis subsp bovis AF2122/97
acgcgcggaucggcggcc

SEQ ID NO: 3174904 - RNA, 13 nt, Mycobacterium bovis subsp bovis AF2122/97
acgcgcggccagc

SEQ ID NO: 3174905 - RNA, 13 nt, Mycobacterium bovis subsp bovis AF2122/97
acgcgcgucgggu

SEQ ID NO: 3174906 - RNA, 14 nt, Mycobacterium bovis subsp bovis AF2122/97
acgcgcucaccgac

SEQ ID NO: 3174907 - RNA, 23 nt, Mycobacterium bovis subsp bovis AF2122/97
acgcgcucgcgcaagcggacccg

SEQ ID NO: 3174908 - RNA, 12 nt, Mycobacterium bovis subsp bovis AF2122/97
acgcgcucgggc

SEQ ID NO: 3174909 - RNA, 16 nt, Mycobacterium bovis subsp bovis AF2122/97
acgcgcucggugccgc

SEQ ID NO: 3174910 - RNA, 19 nt, Mycobacterium bovis subsp bovis AF2122/97
acgcgcugaaucaccccgg

SEQ ID NO: 3174911 - RNA, 16 nt, Mycobacterium bovis subsp bovis AF2122/97
acgcgcuugguguggc

SEQ ID NO: 3174912 - RNA, 22 nt, Mycobacterium bovis subsp bovis AF2122/97
acgcggaaaccaucgccagccg

SEQ ID NO: 3174913 - RNA, 18 nt, Mycobacterium bovis subsp bovis AF2122/97
acgcggaaaggcuuccgc

SEQ ID NO: 3174914 - RNA, 12 nt, Mycobacterium bovis subsp bovis AF2122/97
acgcggacaccg

SEQ ID NO: 3174915 - RNA, 14 nt, Mycobacterium bovis subsp bovis AF2122/97
acgcggacaccgcg

SEQ ID NO: 3174916 - RNA, 17 nt, Mycobacterium bovis subsp bovis AF2122/97
acgcggacaccgcggcg

SEQ ID NO: 3174917 - RNA, 22 nt, Mycobacterium bovis subsp bovis AF2122/97
acgcggacgaacccguuuuggg

SEQ ID NO: 3174918 - RNA, 22 nt, Mycobacterium bovis subsp bovis AF2122/97
acgcggaguucgcugacggcca

SEQ ID NO: 3174919 - RNA, 13 nt, Mycobacterium bovis subsp bovis AF2122/97
acgcggaucgcgc

SEQ ID NO: 3174920 - RNA, 18 nt, Mycobacterium bovis subsp bovis AF2122/97
acgcggaucgggcacccc

SEQ ID NO: 3174921 - RNA, 17 nt, Mycobacterium bovis subsp bovis AF2122/97
acgcggcaccacgucga

SEQ ID NO: 3174922 - RNA, 13 nt, Mycobacterium bovis subsp bovis AF2122/97
acgcggccaccga

SEQ ID NO: 3174923 - RNA, 18 nt, Mycobacterium bovis subsp bovis AF2122/97
acgcggccaccgaccgca

SEQ ID NO: 3174924 - RNA, 15 nt, Mycobacterium bovis subsp bovis AF2122/97
acgcggccgaggucg

SEQ ID NO: 3174925 - RNA, 18 nt, Mycobacterium bovis subsp bovis AF2122/97
acgcggccucgucgaguu

SEQ ID NO: 3174926 - RNA, 17 nt, Mycobacterium bovis subsp bovis AF2122/97
acgcggccuugcgcaca

SEQ ID NO: 3174927 - RNA, 21 nt, Mycobacterium bovis subsp bovis AF2122/97
acgcggccuugcgcacaggcg

SEQ ID NO: 3174928 - RNA, 16 nt, Mycobacterium bovis subsp bovis AF2122/97
acgcggcgaccgucga

SEQ ID NO: 3174929 - RNA, 22 nt, Mycobacterium bovis subsp bovis AF2122/97
acgcggcggacaugcaccucga

SEQ ID NO: 3174930 - RNA, 21 nt, Mycobacterium bovis subsp bovis AF2122/97
acgcggcggucguugccgacc

SEQ ID NO: 3174931 - RNA, 18 nt, Mycobacterium bovis subsp bovis AF2122/97
acgcgggaacgaugccgc

SEQ ID NO: 3174932 - RNA, 22 nt, Mycobacterium bovis subsp bovis AF2122/97
acgcgggcacugguggcgaucc

SEQ ID NO: 3174933 - RNA, 23 nt, Mycobacterium bovis subsp bovis AF2122/97
acgcgggcacugguggcgauccg

SEQ ID NO: 3174934 - RNA, 23 nt, Mycobacterium bovis subsp bovis AF2122/97
acgcgggcguuggccagcagguu

SEQ ID NO: 3174935 - RNA, 20 nt, Mycobacterium bovis subsp bovis AF2122/97
acgcgggcuaucgguucagc

SEQ ID NO: 3174936 - RNA, 15 nt, Mycobacterium bovis subsp bovis AF2122/97
acgcggggccggccg

SEQ ID NO: 3174937 - RNA, 21 nt, Mycobacterium bovis subsp bovis AF2122/97
acgcggggcucaaccccgucc

SEQ ID NO: 3174938 - RNA, 18 nt, Mycobacterium bovis subsp bovis AF2122/97
acgcggggucaaagcccg

SEQ ID NO: 3174939 - RNA, 18 nt, Mycobacterium bovis subsp bovis AF2122/97
acgcgggugccgacgucg

SEQ ID NO: 3174940 - RNA, 16 nt, Mycobacterium bovis subsp bovis AF2122/97
acgcgggugccgggca

SEQ ID NO: 3174941 - RNA, 23 nt, Mycobacterium bovis subsp bovis AF2122/97
acgcggucccacucgucgucggu

SEQ ID NO: 3174942 - RNA, 16 nt, Mycobacterium bovis subsp bovis AF2122/97
acgcgguccucgagcc

SEQ ID NO: 3174943 - RNA, 18 nt, Mycobacterium bovis subsp bovis AF2122/97
acgcgguccucgagccga

SEQ ID NO: 3174944 - RNA, 19 nt, Mycobacterium bovis subsp bovis AF2122/97
acgcggucggcagcgacgc

SEQ ID NO: 3174945 - RNA, 15 nt, Mycobacterium bovis subsp bovis AF2122/97
acgcggucggcggcc

SEQ ID NO: 3174946 - RNA, 19 nt, Mycobacterium bovis subsp bovis AF2122/97
acgcggucugcuccaggcg

SEQ ID NO: 3174947 - RNA, 22 nt, Mycobacterium bovis subsp bovis AF2122/97
acgcggugacgauugccaccaa

SEQ ID NO: 3174948 - RNA, 23 nt, Mycobacterium bovis subsp bovis AF2122/97
acgcguagagccgaucaccgccg

SEQ ID NO: 3174949 - RNA, 13 nt, Mycobacterium bovis subsp bovis AF2122/97
acgcguaucccag

SEQ ID NO: 3174950 - RNA, 16 nt, Mycobacterium bovis subsp bovis AF2122/97
acgcguauucggcauc

SEQ ID NO: 3174951 - RNA, 18 nt, Mycobacterium bovis subsp bovis AF2122/97
acgcguauucggcaucgc

SEQ ID NO: 3174952 - RNA, 21 nt, Mycobacterium bovis subsp bovis AF2122/97
acgcguauucggcaucgccga

SEQ ID NO: 3174953 - RNA, 14 nt, Mycobacterium bovis subsp bovis AF2122/97
acgcgucagcggcg

SEQ ID NO: 3174954 - RNA, 14 nt, Mycobacterium bovis subsp bovis AF2122/97
acgcgucccgccgc

SEQ ID NO: 3174955 - RNA, 20 nt, Mycobacterium bovis subsp bovis AF2122/97
acgcgucccgccgcaccgcc

SEQ ID NO: 3174956 - RNA, 15 nt, Mycobacterium bovis subsp bovis AF2122/97
acgcgucgccgacgc

SEQ ID NO: 3174957 - RNA, 16 nt, Mycobacterium bovis subsp bovis AF2122/97
acgcgucggcgacgcg

SEQ ID NO: 3174958 - RNA, 19 nt, Mycobacterium bovis subsp bovis AF2122/97
acgcgucggucgcggacag

SEQ ID NO: 3174959 - RNA, 23 nt, Mycobacterium bovis subsp bovis AF2122/97
acgcgucgguugauugugcccag

SEQ ID NO: 3174960 - RNA, 20 nt, Mycobacterium bovis subsp bovis AF2122/97
acgcgucuggaacgugaugc

SEQ ID NO: 3174961 - RNA, 20 nt, Mycobacterium bovis subsp bovis AF2122/97
acgcgugucugggaccccgc

SEQ ID NO: 3174962 - RNA, 12 nt, Mycobacterium bovis subsp bovis AF2122/97
acgcgugugcgc

SEQ ID NO: 3174963 - RNA, 21 nt, Mycobacterium bovis subsp bovis AF2122/97
acgcguuccauggcccgcucg

SEQ ID NO: 3174964 - RNA, 15 nt, Mycobacterium bovis subsp bovis AF2122/97
acgcguuccuccagc

SEQ ID NO: 3174965 - RNA, 18 nt, Mycobacterium bovis subsp bovis AF2122/97
acgcguuccuccagcagc

SEQ ID NO: 3174966 - RNA, 20 nt, Mycobacterium bovis subsp bovis AF2122/97
acgcguugcacagcagcggu

SEQ ID NO: 3174967 - RNA, 20 nt, Mycobacterium bovis subsp bovis AF2122/97
acgcguugugcccgccggcc

SEQ ID NO: 3174968 - RNA, 13 nt, Mycobacterium bovis subsp bovis AF2122/97
acgcguuucgucg

SEQ ID NO: 3174969 - RNA, 20 nt, Mycobacterium bovis subsp bovis AF2122/97
acgcguuucgucgaccgcgc

SEQ ID NO: 3174970 - RNA, 13 nt, Mycobacterium bovis subsp bovis AF2122/97
acgcuaaagcccc

SEQ ID NO: 3174971 - RNA, 13 nt, Mycobacterium bovis subsp bovis AF2122/97
acgcuaccgccgg

SEQ ID NO: 3174972 - RNA, 19 nt, Mycobacterium bovis subsp bovis AF2122/97
acgcucaacccgugcgacu

SEQ ID NO: 3174973 - RNA, 15 nt, Mycobacterium bovis subsp bovis AF2122/97
acgcucacccggcgu

SEQ ID NO: 3174974 - RNA, 13 nt, Mycobacterium bovis subsp bovis AF2122/97
acgcucacgcugc

SEQ ID NO: 3174975 - RNA, 17 nt, Mycobacterium bovis subsp bovis AF2122/97
acgcucaguuuggccug

SEQ ID NO: 3174976 - RNA, 14 nt, Mycobacterium bovis subsp bovis AF2122/97
acgcucaugaccgc

SEQ ID NO: 3174977 - RNA, 17 nt, Mycobacterium bovis subsp bovis AF2122/97
acgcuccagcucggcca

SEQ ID NO: 3174978 - RNA, 19 nt, Mycobacterium bovis subsp bovis AF2122/97
acgcuccagcucggccagu

SEQ ID NO: 3174979 - RNA, 22 nt, Mycobacterium bovis subsp bovis AF2122/97
acgcuccagcucggccagugcc

SEQ ID NO: 3174980 - RNA, 21 nt, Mycobacterium bovis subsp bovis AF2122/97
acgcuccaggccuaguccggc

SEQ ID NO: 3174981 - RNA, 22 nt, Mycobacterium bovis subsp bovis AF2122/97
acgcuccgccggguuggcgccg

SEQ ID NO: 3174982 - RNA, 18 nt, Mycobacterium bovis subsp bovis AF2122/97
acggaugccggucggcgu

SEQ ID NO: 3174983 - RNA, 17 nt, Mycobacterium bovis subsp bovis AF2122/97
acggaugcgauggccga

SEQ ID NO: 3174984 - RNA, 22 nt, Mycobacterium bovis subsp bovis AF2122/97
acggaugugcucaggucgcaga

SEQ ID NO: 3174985 - RNA, 20 nt, Mycobacterium bovis subsp bovis AF2122/97
acggauucccgcccagcagc

SEQ ID NO: 3174986 - RNA, 21 nt, Mycobacterium bovis subsp bovis AF2122/97
acggauuuucgcaguccgguu

SEQ ID NO: 3174987 - RNA, 20 nt, Mycobacterium bovis subsp bovis AF2122/97
acggcaagaaacagguaagc

SEQ ID NO: 3174988 - RNA, 13 nt, Mycobacterium bovis subsp bovis AF2122/97
acggcaagcacgg

SEQ ID NO: 3174989 - RNA, 18 nt, Mycobacterium bovis subsp bovis AF2122/97
acggcaagcacgguggcc

SEQ ID NO: 3174990 - RNA, 15 nt, Mycobacterium bovis subsp bovis AF2122/97
acggcaagccauuca

SEQ ID NO: 3174991 - RNA, 16 nt, Mycobacterium bovis subsp bovis AF2122/97
acggcaagccauucac

SEQ ID NO: 3174992 - RNA, 17 nt, Mycobacterium bovis subsp bovis AF2122/97
acggcaagcuaccggcc

SEQ ID NO: 3174993 - RNA, 19 nt, Mycobacterium bovis subsp bovis AF2122/97
acggcaagggcauacagca

SEQ ID NO: 3174994 - RNA, 16 nt, Mycobacterium bovis subsp bovis AF2122/97
acggcaagucuggcgg

SEQ ID NO: 3174995 - RNA, 19 nt, Mycobacterium bovis subsp bovis AF2122/97
acggcaauacccgccgcga

SEQ ID NO: 3174996 - RNA, 20 nt, Mycobacterium bovis subsp bovis AF2122/97
acggcaauacccgccgcgau

SEQ ID NO: 3174997 - RNA, 16 nt, Mycobacterium bovis subsp bovis AF2122/97
acggcaaugcggggca

SEQ ID NO: 3174998 - RNA, 23 nt, Mycobacterium bovis subsp bovis AF2122/97
acggcaauucgggauaggacacc

SEQ ID NO: 3174999 - RNA, 18 nt, Mycobacterium bovis subsp bovis AF2122/97
acggcacaaucggcgccu

SEQ ID NO: 3175000 - RNA, 16 nt, Mycobacterium bovis subsp bovis AF2122/97
acggcaccaccaagcu

SEQ ID NO: 3175001 - RNA, 18 nt, Mycobacterium bovis subsp bovis AF2122/97
acggcacccacccguucg

SEQ ID NO: 3175002 - RNA, 13 nt, Mycobacterium bovis subsp bovis AF2122/97
acggcacccccga

SEQ ID NO: 3175003 - RNA, 21 nt, Mycobacterium bovis subsp bovis AF2122/97
acggcacccccgacgagauac

SEQ ID NO: 3175004 - RNA, 22 nt, Mycobacterium bovis subsp bovis AF2122/97
acggcacccgaaaacugacccc

SEQ ID NO: 3175005 - RNA, 18 nt, Mycobacterium bovis subsp bovis AF2122/97
acggcacccugcggcacc

SEQ ID NO: 3175006 - RNA, 12 nt, Mycobacterium bovis subsp bovis AF2122/97
acggcaccgcgc

SEQ ID NO: 3175007 - RNA, 19 nt, Mycobacterium bovis subsp bovis AF2122/97
acggcaccgcgcccaccag

SEQ ID NO: 3175008 - RNA, 12 nt, Mycobacterium bovis subsp bovis AF2122/97
acggcaccggcc

SEQ ID NO: 3175009 - RNA, 14 nt, Mycobacterium bovis subsp bovis AF2122/97
acggcaccggccca

SEQ ID NO: 3175010 - RNA, 14 nt, Mycobacterium bovis subsp bovis AF2122/97
acggcacuagcccg

SEQ ID NO: 3175011 - RNA, 19 nt, Mycobacterium bovis subsp bovis AF2122/97
acggcacuggguccacgcg

SEQ ID NO: 3175012 - RNA, 19 nt, Mycobacterium bovis subsp bovis AF2122/97
acggcacugugcguccgca

SEQ ID NO: 3175013 - RNA, 13 nt, Mycobacterium bovis subsp bovis AF2122/97
acggcagacacgc

SEQ ID NO: 3175014 - RNA, 14 nt, Mycobacterium bovis subsp bovis AF2122/97
acggcagaccaugg

SEQ ID NO: 3175015 - RNA, 13 nt, Mycobacterium bovis subsp bovis AF2122/97
acggcagccaccg

SEQ ID NO: 3175016 - RNA, 13 nt, Mycobacterium bovis subsp bovis AF2122/97
acggcagccagcc

SEQ ID NO: 3175017 - RNA, 22 nt, Mycobacterium bovis subsp bovis AF2122/97
acggcagcccaaagcgccagca

SEQ ID NO: 3175018 - RNA, 14 nt, Mycobacterium bovis subsp bovis AF2122/97
acggcagcccgggc

SEQ ID NO: 3175019 - RNA, 15 nt, Mycobacterium bovis subsp bovis AF2122/97
acggcagcccgggcg

SEQ ID NO: 3175020 - RNA, 12 nt, Mycobacterium bovis subsp bovis AF2122/97
acggcagcccgu

SEQ ID NO: 3175021 - RNA, 14 nt, Mycobacterium bovis subsp bovis AF2122/97
acggcagccgggcg

SEQ ID NO: 3175022 - RNA, 16 nt, Mycobacterium bovis subsp bovis AF2122/97
acggcagcgccggucg

SEQ ID NO: 3175023 - RNA, 15 nt, Mycobacterium bovis subsp bovis AF2122/97
acggcaggcagggca

SEQ ID NO: 3175024 - RNA, 20 nt, Mycobacterium bovis subsp bovis AF2122/97
acggcaggcagggcagcccg

SEQ ID NO: 3175025 - RNA, 11 nt, Mycobacterium bovis subsp bovis AF2122/97
acggcaggcgg

SEQ ID NO: 3175026 - RNA, 14 nt, Mycobacterium bovis subsp bovis AF2122/97
acggcaggcggccg

SEQ ID NO: 3175027 - RNA, 21 nt, Mycobacterium bovis subsp bovis AF2122/97
acggcaggcucgggcaaggcc

SEQ ID NO: 3175028 - RNA, 22 nt, Mycobacterium bovis subsp bovis AF2122/97
acggcauagcagccagcgucca

SEQ ID NO: 3175029 - RNA, 18 nt, Mycobacterium bovis subsp bovis AF2122/97
acggcaucaacgcgggcg

SEQ ID NO: 3175030 - RNA, 17 nt, Mycobacterium bovis subsp bovis AF2122/97
acggcauguaccgaccg

SEQ ID NO: 3175031 - RNA, 16 nt, Mycobacterium bovis subsp bovis AF2122/97
acggcauucgaccuca

SEQ ID NO: 3175032 - RNA, 20 nt, Mycobacterium bovis subsp bovis AF2122/97
acggccaagaucggcgcccc

SEQ ID NO: 3175033 - RNA, 17 nt, Mycobacterium bovis subsp bovis AF2122/97
acggccacaccgucacg

SEQ ID NO: 3175034 - RNA, 22 nt, Mycobacterium bovis subsp bovis AF2122/97
acggccacaccgucacgccacc

SEQ ID NO: 3175035 - RNA, 17 nt, Mycobacterium bovis subsp bovis AF2122/97
acggccacaugccacag

SEQ ID NO: 3175036 - RNA, 18 nt, Mycobacterium bovis subsp bovis AF2122/97
acggccacaugccacagc

SEQ ID NO: 3175037 - RNA, 12 nt, Mycobacterium bovis subsp bovis AF2122/97
acggccaccccg

SEQ ID NO: 3175038 - RNA, 18 nt, Mycobacterium bovis subsp bovis AF2122/97
acggccaccggggucacc

SEQ ID NO: 3175039 - RNA, 15 nt, Mycobacterium bovis subsp bovis AF2122/97
acggccacgguggag

SEQ ID NO: 3175040 - RNA, 13 nt, Mycobacterium bovis subsp bovis AF2122/97
acggccagaaacc

SEQ ID NO: 3175041 - RNA, 16 nt, Mycobacterium bovis subsp bovis AF2122/97
acggccagcaggauga

SEQ ID NO: 3175042 - RNA, 12 nt, Mycobacterium bovis subsp bovis AF2122/97
acggccagccca

SEQ ID NO: 3175043 - RNA, 13 nt, Mycobacterium bovis subsp bovis AF2122/97
acggccagcccag

SEQ ID NO: 3175044 - RNA, 14 nt, Mycobacterium bovis subsp bovis AF2122/97
acggccagcgcguc

SEQ ID NO: 3175045 - RNA, 14 nt, Mycobacterium bovis subsp bovis AF2122/97
acggccaggucgac

SEQ ID NO: 3175046 - RNA, 16 nt, Mycobacterium bovis subsp bovis AF2122/97
acggccaggucgacgg

SEQ ID NO: 3175047 - RNA, 19 nt, Mycobacterium bovis subsp bovis AF2122/97
acggccaggucgacgggca

SEQ ID NO: 3175048 - RNA, 17 nt, Mycobacterium bovis subsp bovis AF2122/97
acggccagugccaucgc

SEQ ID NO: 3175049 - RNA, 21 nt, Mycobacterium bovis subsp bovis AF2122/97
acggccagugcgcagaacacc

SEQ ID NO: 3175050 - RNA, 23 nt, Mycobacterium bovis subsp bovis AF2122/97
acggccagugucagcacgacgac

SEQ ID NO: 3175051 - RNA, 19 nt, Mycobacterium bovis subsp bovis AF2122/97
acggccaguugguagccgc

SEQ ID NO: 3175052 - RNA, 22 nt, Mycobacterium bovis subsp bovis AF2122/97
acggccauauugggaguccggc

SEQ ID NO: 3175053 - RNA, 15 nt, Mycobacterium bovis subsp bovis AF2122/97
acggccaucgccagc

SEQ ID NO: 3175054 - RNA, 16 nt, Mycobacterium bovis subsp bovis AF2122/97
acggccaucgccagcc

SEQ ID NO: 3175055 - RNA, 13 nt, Mycobacterium bovis subsp bovis AF2122/97
acggccaucgugc

SEQ ID NO: 3175056 - RNA, 21 nt, Mycobacterium bovis subsp bovis AF2122/97
acggcccgagccgcgugggcc

SEQ ID NO: 3175057 - RNA, 13 nt, Mycobacterium bovis subsp bovis AF2122/97
acggcccgauccc

SEQ ID NO: 3175058 - RNA, 18 nt, Mycobacterium bovis subsp bovis AF2122/97
acggcccgaucccgaucg

SEQ ID NO: 3175059 - RNA, 24 nt, Mycobacterium bovis subsp bovis AF2122/97
acggcccgaucccgaucgaucagc

SEQ ID NO: 3175060 - RNA, 14 nt, Mycobacterium bovis subsp bovis AF2122/97
acggcccgccgucc

SEQ ID NO: 3175061 - RNA, 23 nt, Mycobacterium bovis subsp bovis AF2122/97
acggcccgccguccggcgcccac

SEQ ID NO: 3175062 - RNA, 13 nt, Mycobacterium bovis subsp bovis AF2122/97
acggcccggcacc

SEQ ID NO: 3175063 - RNA, 17 nt, Mycobacterium bovis subsp bovis AF2122/97
acggccgacaacccggc

SEQ ID NO: 3175064 - RNA, 21 nt, Mycobacterium bovis subsp bovis AF2122/97
acggccgacaacccggccggg

SEQ ID NO: 3175065 - RNA, 23 nt, Mycobacterium bovis subsp bovis AF2122/97
acggccgacaacccggccgggcc

SEQ ID NO: 3175066 - RNA, 19 nt, Mycobacterium bovis subsp bovis AF2122/97
acggccgcauaaaacucgc

SEQ ID NO: 3175067 - RNA, 16 nt, Mycobacterium bovis subsp bovis AF2122/97
acggccgccagcagcu

SEQ ID NO: 3175068 - RNA, 21 nt, Mycobacterium bovis subsp bovis AF2122/97
acggccgcucgggccagcgau

SEQ ID NO: 3175069 - RNA, 21 nt, Mycobacterium bovis subsp bovis AF2122/97
acggcgggcgauuucggcgcc

SEQ ID NO: 3175070 - RNA, 14 nt, Mycobacterium bovis subsp bovis AF2122/97
acggcgggcggccg

SEQ ID NO: 3175071 - RNA, 14 nt, Mycobacterium bovis subsp bovis AF2122/97
acggcggggaucgc

SEQ ID NO: 3175072 - RNA, 15 nt, Mycobacterium bovis subsp bovis AF2122/97
acggcggggccggcg

SEQ ID NO: 3175073 - RNA, 16 nt, Mycobacterium bovis subsp bovis AF2122/97
acggcggggccggcgg

SEQ ID NO: 3175074 - RNA, 18 nt, Mycobacterium bovis subsp bovis AF2122/97
acggcggggccggcggcu

SEQ ID NO: 3175075 - RNA, 18 nt, Mycobacterium bovis subsp bovis AF2122/97
acggcggggcggcggugg

SEQ ID NO: 3175076 - RNA, 16 nt, Mycobacterium bovis subsp bovis AF2122/97
acggcgguaccgccgc

SEQ ID NO: 3175077 - RNA, 18 nt, Mycobacterium bovis subsp bovis AF2122/97
acggcgguccggaugcgc

SEQ ID NO: 3175078 - RNA, 19 nt, Mycobacterium bovis subsp bovis AF2122/97
acggcggugcggguggugc

SEQ ID NO: 3175079 - RNA, 20 nt, Mycobacterium bovis subsp bovis AF2122/97
acggcguagacguccgcggu

SEQ ID NO: 3175080 - RNA, 14 nt, Mycobacterium bovis subsp bovis AF2122/97
acggcgucacccgc

SEQ ID NO: 3175081 - RNA, 14 nt, Mycobacterium bovis subsp bovis AF2122/97
acggcguccccgac

SEQ ID NO: 3175082 - RNA, 20 nt, Mycobacterium bovis subsp bovis AF2122/97
acggcguccccgacaacgaa

SEQ ID NO: 3175083 - RNA, 12 nt, Mycobacterium bovis subsp bovis AF2122/97
acggcgucgaaa

SEQ ID NO: 3175084 - RNA, 16 nt, Mycobacterium bovis subsp bovis AF2122/97
acggcgucgaccucgc

SEQ ID NO: 3175085 - RNA, 22 nt, Mycobacterium bovis subsp bovis AF2122/97
acggcgucgacugcgugccgca

SEQ ID NO: 3175086 - RNA, 17 nt, Mycobacterium bovis subsp bovis AF2122/97
acggcgucgaugucguc

SEQ ID NO: 3175087 - RNA, 20 nt, Mycobacterium bovis subsp bovis AF2122/97
acggcgucggcuucucgauc

SEQ ID NO: 3175088 - RNA, 22 nt, Mycobacterium bovis subsp bovis AF2122/97
acggcgucgggccguugugcgg

SEQ ID NO: 3175089 - RNA, 14 nt, Mycobacterium bovis subsp bovis AF2122/97
acggcgucugcggu

SEQ ID NO: 3175090 - RNA, 17 nt, Mycobacterium bovis subsp bovis AF2122/97
acggcgucugcgguggc

SEQ ID NO: 3175091 - RNA, 14 nt, Mycobacterium bovis subsp bovis AF2122/97
acggcgucuucgga

SEQ ID NO: 3175092 - RNA, 16 nt, Mycobacterium bovis subsp bovis AF2122/97
acggcguggucggcaa

SEQ ID NO: 3175093 - RNA, 17 nt, Mycobacterium bovis subsp bovis AF2122/97
acggcguugaucagugc

SEQ ID NO: 3175094 - RNA, 14 nt, Mycobacterium bovis subsp bovis AF2122/97
acggcguugccgcc

SEQ ID NO: 3175095 - RNA, 17 nt, Mycobacterium bovis subsp bovis AF2122/97
acggcguugccgccggc

SEQ ID NO: 3175096 - RNA, 19 nt, Mycobacterium bovis subsp bovis AF2122/97
acggcguugccgccggcuc

SEQ ID NO: 3175097 - RNA, 20 nt, Mycobacterium bovis subsp bovis AF2122/97
acggcguugccgccggcucc

SEQ ID NO: 3175098 - RNA, 21 nt, Mycobacterium bovis subsp bovis AF2122/97
acggcguugcggaaucagcac

SEQ ID NO: 3175099 - RNA, 23 nt, Mycobacterium bovis subsp bovis AF2122/97
acggcguugcggaaucagcaccc

SEQ ID NO: 3175100 - RNA, 14 nt, Mycobacterium bovis subsp bovis AF2122/97
acggcguugucgac

SEQ ID NO: 3175101 - RNA, 16 nt, Mycobacterium bovis subsp bovis AF2122/97
acggcguugucgacga

SEQ ID NO: 3175102 - RNA, 13 nt, Mycobacterium bovis subsp bovis AF2122/97
acggcuccgggcg

SEQ ID NO: 3175103 - RNA, 14 nt, Mycobacterium bovis subsp bovis AF2122/97
acggcuccuccggu

SEQ ID NO: 3175104 - RNA, 17 nt, Mycobacterium bovis subsp bovis AF2122/97
acggcuccuccgguauc

SEQ ID NO: 3175105 - RNA, 22 nt, Mycobacterium bovis subsp bovis AF2122/97
acggcucgggcagcgucacccu

SEQ ID NO: 3175106 - RNA, 14 nt, Mycobacterium bovis subsp bovis AF2122/97
acggcucgucgaac

SEQ ID NO: 3175107 - RNA, 17 nt, Mycobacterium bovis subsp bovis AF2122/97
acggcugaaccugcugg

SEQ ID NO: 3175108 - RNA, 13 nt, Mycobacterium bovis subsp bovis AF2122/97
acggcugaccggg

SEQ ID NO: 3175109 - RNA, 19 nt, Mycobacterium bovis subsp bovis AF2122/97
acggcugagacagaccggg

SEQ ID NO: 3175110 - RNA, 20 nt, Mycobacterium bovis subsp bovis AF2122/97
acggcugagacagaccgggc

SEQ ID NO: 3175111 - RNA, 22 nt, Mycobacterium bovis subsp bovis AF2122/97
acggcugagacagaccgggccc

SEQ ID NO: 3175112 - RNA, 14 nt, Mycobacterium bovis subsp bovis AF2122/97
acggcugccacgcg

SEQ ID NO: 3175113 - RNA, 18 nt, Mycobacterium bovis subsp bovis AF2122/97
acggcugcccaugguggc

SEQ ID NO: 3175114 - RNA, 15 nt, Mycobacterium bovis subsp bovis AF2122/97
acggcugcgccgaac

SEQ ID NO: 3175115 - RNA, 18 nt, Mycobacterium bovis subsp bovis AF2122/97
acggcugcgccgaacacc

SEQ ID NO: 3175116 - RNA, 21 nt, Mycobacterium bovis subsp bovis AF2122/97
acggcuuccaacucggcggcc

SEQ ID NO: 3175117 - RNA, 23 nt, Mycobacterium bovis subsp bovis AF2122/97
acggcuuccaacucggcggccag

SEQ ID NO: 3175118 - RNA, 21 nt, Mycobacterium bovis subsp bovis AF2122/97
acggcuucgcgguuggcggcg

SEQ ID NO: 3175119 - RNA, 14 nt, Mycobacterium bovis subsp bovis AF2122/97
acggcuucggcagc

SEQ ID NO: 3175120 - RNA, 16 nt, Mycobacterium bovis subsp bovis AF2122/97
acggcuucggcgagcg

SEQ ID NO: 3175121 - RNA, 20 nt, Mycobacterium bovis subsp bovis AF2122/97
acggcuucggcgagcgcauc

SEQ ID NO: 3175122 - RNA, 19 nt, Mycobacterium bovis subsp bovis AF2122/97
acggcuugcgauuggcugg

SEQ ID NO: 3175123 - RNA, 15 nt, Mycobacterium bovis subsp bovis AF2122/97
acggcuuggcugccu

SEQ ID NO: 3175124 - RNA, 19 nt, Mycobacterium bovis subsp bovis AF2122/97
acggcuuugcggcgcgacc

SEQ ID NO: 3175125 - RNA, 20 nt, Mycobacterium bovis subsp bovis AF2122/97
acgggaaacuccgcggcgcg

SEQ ID NO: 3175126 - RNA, 12 nt, Mycobacterium bovis subsp bovis AF2122/97
acgggacgacgg

SEQ ID NO: 3175127 - RNA, 15 nt, Mycobacterium bovis subsp bovis AF2122/97
acgggacgacggcaa

SEQ ID NO: 3175128 - RNA, 17 nt, Mycobacterium bovis subsp bovis AF2122/97
acgggacgccgugugca

SEQ ID NO: 3175129 - RNA, 12 nt, Mycobacterium bovis subsp bovis AF2122/97
acgggagccggc

SEQ ID NO: 3175130 - RNA, 20 nt, Mycobacterium bovis subsp bovis AF2122/97
acgggauaaaacccggaauc

SEQ ID NO: 3175131 - RNA, 16 nt, Mycobacterium bovis subsp bovis AF2122/97
acgggaucgacccgcc

SEQ ID NO: 3175132 - RNA, 23 nt, Mycobacterium bovis subsp bovis AF2122/97
acgggaugaauucauguggcgcg

SEQ ID NO: 3175133 - RNA, 14 nt, Mycobacterium bovis subsp bovis AF2122/97
acgggaugccggcg

SEQ ID NO: 3175134 - RNA, 15 nt, Mycobacterium bovis subsp bovis AF2122/97
acgggaugccggcga

SEQ ID NO: 3175135 - RNA, 17 nt, Mycobacterium bovis subsp bovis AF2122/97
acgggaugccggcgaag

SEQ ID NO: 3175136 - RNA, 11 nt, Mycobacterium bovis subsp bovis AF2122/97
acgggcaaacc

SEQ ID NO: 3175137 - RNA, 18 nt, Mycobacterium bovis subsp bovis AF2122/97
acgggcacccgagccgca

SEQ ID NO: 3175138 - RNA, 22 nt, Mycobacterium bovis subsp bovis AF2122/97
acgggcacccgagccgcacagc

SEQ ID NO: 3175139 - RNA, 14 nt, Mycobacterium bovis subsp bovis AF2122/97
acgggcacgcggcg

SEQ ID NO: 3175140 - RNA, 23 nt, Mycobacterium bovis subsp bovis AF2122/97
acgggcaggagcagcacgucgaa

SEQ ID NO: 3175141 - RNA, 14 nt, Mycobacterium bovis subsp bovis AF2122/97
acgggcaggccgcu

SEQ ID NO: 3175142 - RNA, 17 nt, Mycobacterium bovis subsp bovis AF2122/97
acgggcccaggacagca

SEQ ID NO: 3175143 - RNA, 24 nt, Mycobacterium bovis subsp bovis AF2122/97
acgggcccaggacagcagccgccg

SEQ ID NO: 3175144 - RNA, 22 nt, Mycobacterium bovis subsp bovis AF2122/97
acgggccgcaucgucgccgcgc

SEQ ID NO: 3175145 - RNA, 20 nt, Mycobacterium bovis subsp bovis AF2122/97
acgggccgcgguacccaccu

SEQ ID NO: 3175146 - RNA, 22 nt, Mycobacterium bovis subsp bovis AF2122/97
acgggccgcgguacccaccucc

SEQ ID NO: 3175147 - RNA, 18 nt, Mycobacterium bovis subsp bovis AF2122/97
acgggccggccgagcgca

SEQ ID NO: 3175148 - RNA, 21 nt, Mycobacterium bovis subsp bovis AF2122/97
acgggccggugcgcaccagag

SEQ ID NO: 3175149 - RNA, 13 nt, Mycobacterium bovis subsp bovis AF2122/97
acgggccgucgcc

SEQ ID NO: 3175150 - RNA, 17 nt, Mycobacterium bovis subsp bovis AF2122/97
acgggccgucgccgucc

SEQ ID NO: 3175151 - RNA, 18 nt, Mycobacterium bovis subsp bovis AF2122/97
acgggccucccccaaacu

SEQ ID NO: 3175152 - RNA, 17 nt, Mycobacterium bovis subsp bovis AF2122/97
acgggccuucagcucac

SEQ ID NO: 3175153 - RNA, 15 nt, Mycobacterium bovis subsp bovis AF2122/97
acgggccuucgccac

SEQ ID NO: 3175154 - RNA, 21 nt, Mycobacterium bovis subsp bovis AF2122/97
acgggcgcguccucgccgcac

SEQ ID NO: 3175155 - RNA, 13 nt, Mycobacterium bovis subsp bovis AF2122/97
acgggcgcgucgg

SEQ ID NO: 3175156 - RNA, 12 nt, Mycobacterium bovis subsp bovis AF2122/97
acggugcugccg

SEQ ID NO: 3175157 - RNA, 14 nt, Mycobacterium bovis subsp bovis AF2122/97
acgguggcaacgga

SEQ ID NO: 3175158 - RNA, 15 nt, Mycobacterium bovis subsp bovis AF2122/97
acgguggccgagccg

SEQ ID NO: 3175159 - RNA, 20 nt, Mycobacterium bovis subsp bovis AF2122/97
acgguggccgagccgcgguc

SEQ ID NO: 3175160 - RNA, 23 nt, Mycobacterium bovis subsp bovis AF2122/97
acgguggccgagccgcggucacc

SEQ ID NO: 3175161 - RNA, 23 nt, Mycobacterium bovis subsp bovis AF2122/97
acgguggccgcaucgacgcucau

SEQ ID NO: 3175162 - RNA, 19 nt, Mycobacterium bovis subsp bovis AF2122/97
acgguggccgcugccagcc

SEQ ID NO: 3175163 - RNA, 15 nt, Mycobacterium bovis subsp bovis AF2122/97
acgguggcgccgaac

SEQ ID NO: 3175164 - RNA, 20 nt, Mycobacterium bovis subsp bovis AF2122/97
acgguggcgccgaacgcaac

SEQ ID NO: 3175165 - RNA, 17 nt, Mycobacterium bovis subsp bovis AF2122/97
acgguggcuucgacggc

SEQ ID NO: 3175166 - RNA, 21 nt, Mycobacterium bovis subsp bovis AF2122/97
acgguggcuucgacggcggcc

SEQ ID NO: 3175167 - RNA, 22 nt, Mycobacterium bovis subsp bovis AF2122/97
acggugggcgccgacaccggcu

SEQ ID NO: 3175168 - RNA, 18 nt, Mycobacterium bovis subsp bovis AF2122/97
acgguggggauggcgccc

SEQ ID NO: 3175169 - RNA, 19 nt, Mycobacterium bovis subsp bovis AF2122/97
acggugggugggcgccgca

SEQ ID NO: 3175170 - RNA, 19 nt, Mycobacterium bovis subsp bovis AF2122/97
acgguggucccccgcagcc

SEQ ID NO: 3175171 - RNA, 16 nt, Mycobacterium bovis subsp bovis AF2122/97
acgguggugaccgcgg

SEQ ID NO: 3175172 - RNA, 12 nt, Mycobacterium bovis subsp bovis AF2122/97
acgguggugcgg

SEQ ID NO: 3175173 - RNA, 22 nt, Mycobacterium bovis subsp bovis AF2122/97
acgguggugggcuaggucgcgc

SEQ ID NO: 3175174 - RNA, 19 nt, Mycobacterium bovis subsp bovis AF2122/97
acgguguacaggucgccgg

SEQ ID NO: 3175175 - RNA, 22 nt, Mycobacterium bovis subsp bovis AF2122/97
acgguguaccagguggaccggc

SEQ ID NO: 3175176 - RNA, 17 nt, Mycobacterium bovis subsp bovis AF2122/97
acgguguagccgccggc

SEQ ID NO: 3175177 - RNA, 20 nt, Mycobacterium bovis subsp bovis AF2122/97
acgguguagccgccggcagu

SEQ ID NO: 3175178 - RNA, 21 nt, Mycobacterium bovis subsp bovis AF2122/97
acgguguagccgccggcagug

SEQ ID NO: 3175179 - RNA, 20 nt, Mycobacterium bovis subsp bovis AF2122/97
acgguguauugggguggcag

SEQ ID NO: 3175180 - RNA, 13 nt, Mycobacterium bovis subsp bovis AF2122/97
acggugucccgcg

SEQ ID NO: 3175181 - RNA, 22 nt, Mycobacterium bovis subsp bovis AF2122/97
acggugucgcgaugcuucccgg

SEQ ID NO: 3175182 - RNA, 23 nt, Mycobacterium bovis subsp bovis AF2122/97
acggugucuugccaccacgcaug

SEQ ID NO: 3175183 - RNA, 22 nt, Mycobacterium bovis subsp bovis AF2122/97
acgguguugguggccgggucga

SEQ ID NO: 3175184 - RNA, 22 nt, Mycobacterium bovis subsp bovis AF2122/97
acgguguugguguucgggucga

SEQ ID NO: 3175185 - RNA, 13 nt, Mycobacterium bovis subsp bovis AF2122/97
acgguuaccgcga

SEQ ID NO: 3175186 - RNA, 18 nt, Mycobacterium bovis subsp bovis AF2122/97
acgguucgacccccgcau

SEQ ID NO: 3175187 - RNA, 15 nt, Mycobacterium bovis subsp bovis AF2122/97
acgguucggccgggg

SEQ ID NO: 3175188 - RNA, 21 nt, Mycobacterium bovis subsp bovis AF2122/97
acgguugaugaucuuggugaa

SEQ ID NO: 3175189 - RNA, 17 nt, Mycobacterium bovis subsp bovis AF2122/97
acgguugccccggcgac

SEQ ID NO: 3175190 - RNA, 15 nt, Mycobacterium bovis subsp bovis AF2122/97
acgguugccgcgauc

SEQ ID NO: 3175191 - RNA, 16 nt, Mycobacterium bovis subsp bovis AF2122/97
acgguugccgcgaucg

SEQ ID NO: 3175192 - RNA, 17 nt, Mycobacterium bovis subsp bovis AF2122/97
acgguugccgcgaucgg

SEQ ID NO: 3175193 - RNA, 13 nt, Mycobacterium bovis subsp bovis AF2122/97
acgguugccggcg

SEQ ID NO: 3175194 - RNA, 15 nt, Mycobacterium bovis subsp bovis AF2122/97
acgguugccggcggc

SEQ ID NO: 3175195 - RNA, 16 nt, Mycobacterium bovis subsp bovis AF2122/97
acgguugccggcggcg

SEQ ID NO: 3175196 - RNA, 20 nt, Mycobacterium bovis subsp bovis AF2122/97
acgguugcucguccaagccg

SEQ ID NO: 3175197 - RNA, 22 nt, Mycobacterium bovis subsp bovis AF2122/97
acgguugguccgccgucgacca

SEQ ID NO: 3175198 - RNA, 21 nt, Mycobacterium bovis subsp bovis AF2122/97
acgguuguuguagaucugcgc

SEQ ID NO: 3175199 - RNA, 17 nt, Mycobacterium bovis subsp bovis AF2122/97
acgguuuagcgccgguu

SEQ ID NO: 3175200 - RNA, 17 nt, Mycobacterium bovis subsp bovis AF2122/97
acgguuucgaccaccac

SEQ ID NO: 3175201 - RNA, 13 nt, Mycobacterium bovis subsp bovis AF2122/97
acguaacggucgg

SEQ ID NO: 3175202 - RNA, 17 nt, Mycobacterium bovis subsp bovis AF2122/97
acguaccgucauggcga

SEQ ID NO: 3175203 - RNA, 15 nt, Mycobacterium bovis subsp bovis AF2122/97
acguacgcggcugcg

SEQ ID NO: 3175204 - RNA, 16 nt, Mycobacterium bovis subsp bovis AF2122/97
acguacggggucgccg

SEQ ID NO: 3175205 - RNA, 19 nt, Mycobacterium bovis subsp bovis AF2122/97
acguacuccaccgcgccgu

SEQ ID NO: 3175206 - RNA, 15 nt, Mycobacterium bovis subsp bovis AF2122/97
acguacugggcgaua

SEQ ID NO: 3175207 - RNA, 19 nt, Mycobacterium bovis subsp bovis AF2122/97
acguagaaguaggcggcga

SEQ ID NO: 3175208 - RNA, 16 nt, Mycobacterium bovis subsp bovis AF2122/97
acguagaagucgaucg

SEQ ID NO: 3175209 - RNA, 20 nt, Mycobacterium bovis subsp bovis AF2122/97
acguagacgacgucggccgc

SEQ ID NO: 3175210 - RNA, 17 nt, Mycobacterium bovis subsp bovis AF2122/97
acguagacgguccgguc

SEQ ID NO: 3175211 - RNA, 20 nt, Mycobacterium bovis subsp bovis AF2122/97
acguagaugguggucaccac

SEQ ID NO: 3175212 - RNA, 15 nt, Mycobacterium bovis subsp bovis AF2122/97
acguagauguugccg

SEQ ID NO: 3175213 - RNA, 17 nt, Mycobacterium bovis subsp bovis AF2122/97
acguagcgaccgcgguc

SEQ ID NO: 3175214 - RNA, 15 nt, Mycobacterium bovis subsp bovis AF2122/97
acguagcgcccaccg

SEQ ID NO: 3175215 - RNA, 15 nt, Mycobacterium bovis subsp bovis AF2122/97
acguaggacugccag

SEQ ID NO: 3175216 - RNA, 16 nt, Mycobacterium bovis subsp bovis AF2122/97
acguaggacugccagc

SEQ ID NO: 3175217 - RNA, 19 nt, Mycobacterium bovis subsp bovis AF2122/97
acguaggcaccccggugcc

SEQ ID NO: 3175218 - RNA, 19 nt, Mycobacterium bovis subsp bovis AF2122/97
acguaggcggcggcccgca

SEQ ID NO: 3175219 - RNA, 14 nt, Mycobacterium bovis subsp bovis AF2122/97
acguagucgccgau

SEQ ID NO: 3175220 - RNA, 15 nt, Mycobacterium bovis subsp bovis AF2122/97
acguaguggaagccg

SEQ ID NO: 3175221 - RNA, 15 nt, Mycobacterium bovis subsp bovis AF2122/97
acguaguugccggcu

SEQ ID NO: 3175222 - RNA, 19 nt, Mycobacterium bovis subsp bovis AF2122/97
acguauccacggucgacca

SEQ ID NO: 3175223 - RNA, 16 nt, Mycobacterium bovis subsp bovis AF2122/97
acguaucgccgcgggc

SEQ ID NO: 3175224 - RNA, 21 nt, Mycobacterium bovis subsp bovis AF2122/97
acguaugacgcccaccgacaa

SEQ ID NO: 3175225 - RNA, 16 nt, Mycobacterium bovis subsp bovis AF2122/97
acguauuucgcccccu

SEQ ID NO: 3175226 - RNA, 16 nt, Mycobacterium bovis subsp bovis AF2122/97
acgucaaacgcaaaga

SEQ ID NO: 3175227 - RNA, 16 nt, Mycobacterium bovis subsp bovis AF2122/97
acgucaagaagaacuc

SEQ ID NO: 3175228 - RNA, 19 nt, Mycobacterium bovis subsp bovis AF2122/97
acgucacccccuucacccu

SEQ ID NO: 3175229 - RNA, 20 nt, Mycobacterium bovis subsp bovis AF2122/97
acgucacccccuucacccuc

SEQ ID NO: 3175230 - RNA, 17 nt, Mycobacterium bovis subsp bovis AF2122/97
acgucaccggguccggu

SEQ ID NO: 3175231 - RNA, 19 nt, Mycobacterium bovis subsp bovis AF2122/97
acgucacguggucggccac

SEQ ID NO: 3175232 - RNA, 17 nt, Mycobacterium bovis subsp bovis AF2122/97
acgucacguucggcgca

SEQ ID NO: 3175233 - RNA, 20 nt, Mycobacterium bovis subsp bovis AF2122/97
acgucagcguugaccgcauc

SEQ ID NO: 3175234 - RNA, 13 nt, Mycobacterium bovis subsp bovis AF2122/97
acgucagugcccc

SEQ ID NO: 3175235 - RNA, 14 nt, Mycobacterium bovis subsp bovis AF2122/97
acgucagugccccg

SEQ ID NO: 3175236 - RNA, 18 nt, Mycobacterium bovis subsp bovis AF2122/97
acgucaucuggcgcugcu

SEQ ID NO: 3175237 - RNA, 13 nt, Mycobacterium bovis subsp bovis AF2122/97
acgucaugcaggg

SEQ ID NO: 3175238 - RNA, 15 nt, Mycobacterium bovis subsp bovis AF2122/97
acguccagggccacg

SEQ ID NO: 3175239 - RNA, 17 nt, Mycobacterium bovis subsp bovis AF2122/97
acguccagggccacgau

SEQ ID NO: 3175240 - RNA, 24 nt, Mycobacterium bovis subsp bovis AF2122/97
acguccaguccaugugcccagguc

SEQ ID NO: 3175241 - RNA, 17 nt, Mycobacterium bovis subsp bovis AF2122/97
acguccaucaccggcgg

SEQ ID NO: 3175242 - RNA, 23 nt, Mycobacterium bovis subsp bovis AF2122/97
acgugacaacugcgccggugccg

SEQ ID NO: 3175243 - RNA, 16 nt, Mycobacterium bovis subsp bovis AF2122/97
acgugaccgacgccgu

SEQ ID NO: 3175244 - RNA, 21 nt, Mycobacterium bovis subsp bovis AF2122/97
acgugaccggcaaugccacgg

SEQ ID NO: 3175245 - RNA, 15 nt, Mycobacterium bovis subsp bovis AF2122/97
acgugagugccggcg

SEQ ID NO: 3175246 - RNA, 16 nt, Mycobacterium bovis subsp bovis AF2122/97
acgugaguuucaccac

SEQ ID NO: 3175247 - RNA, 20 nt, Mycobacterium bovis subsp bovis AF2122/97
acgugauauccuuugccgcc

SEQ ID NO: 3175248 - RNA, 22 nt, Mycobacterium bovis subsp bovis AF2122/97
acgugauauccuuugccgccga

SEQ ID NO: 3175249 - RNA, 23 nt, Mycobacterium bovis subsp bovis AF2122/97
acgugauggugacuucgguggcg

SEQ ID NO: 3175250 - RNA, 19 nt, Mycobacterium bovis subsp bovis AF2122/97
acgugcaaccauggcggcu

SEQ ID NO: 3175251 - RNA, 15 nt, Mycobacterium bovis subsp bovis AF2122/97
acgugcacaggcauc

SEQ ID NO: 3175252 - RNA, 17 nt, Mycobacterium bovis subsp bovis AF2122/97
acgugcacgaaaaccgg

SEQ ID NO: 3175253 - RNA, 18 nt, Mycobacterium bovis subsp bovis AF2122/97
acgugcacgaaaaccggu

SEQ ID NO: 3175254 - RNA, 13 nt, Mycobacterium bovis subsp bovis AF2122/97
acgugcacggcga

SEQ ID NO: 3175255 - RNA, 17 nt, Mycobacterium bovis subsp bovis AF2122/97
acgugcacggucaacga

SEQ ID NO: 3175256 - RNA, 15 nt, Mycobacterium bovis subsp bovis AF2122/97
acgugcaucugugag

SEQ ID NO: 3175257 - RNA, 16 nt, Mycobacterium bovis subsp bovis AF2122/97
acgugcccgcgcggcg

SEQ ID NO: 3175258 - RNA, 17 nt, Mycobacterium bovis subsp bovis AF2122/97
acgugcccgcgcggcgc

SEQ ID NO: 3175259 - RNA, 21 nt, Mycobacterium bovis subsp bovis AF2122/97
acgugcccgguguucaucacg

SEQ ID NO: 3175260 - RNA, 18 nt, Mycobacterium bovis subsp bovis AF2122/97
acgugcccugacgccccg

SEQ ID NO: 3175261 - RNA, 20 nt, Mycobacterium bovis subsp bovis AF2122/97
acgugcccugacgccccgcc

SEQ ID NO: 3175262 - RNA, 21 nt, Mycobacterium bovis subsp bovis AF2122/97
acgugccgaacgccagaccgc

SEQ ID NO: 3175263 - RNA, 15 nt, Mycobacterium bovis subsp bovis AF2122/97
acgugccgggucacc

SEQ ID NO: 3175264 - RNA, 13 nt, Mycobacterium bovis subsp bovis AF2122/97
acgugccgguccc

SEQ ID NO: 3175265 - RNA, 15 nt, Mycobacterium bovis subsp bovis AF2122/97
acgugccgguccccc

SEQ ID NO: 3175266 - RNA, 18 nt, Mycobacterium bovis subsp bovis AF2122/97
acgugccucucuccgcgc

SEQ ID NO: 3175267 - RNA, 14 nt, Mycobacterium bovis subsp bovis AF2122/97
acgugccuuccucg

SEQ ID NO: 3175268 - RNA, 17 nt, Mycobacterium bovis subsp bovis AF2122/97
acgugcgagcccaccug

SEQ ID NO: 3175269 - RNA, 20 nt, Mycobacterium bovis subsp bovis AF2122/97
acgugcgagggcacggcggu

SEQ ID NO: 3175270 - RNA, 21 nt, Mycobacterium bovis subsp bovis AF2122/97
acgugcgagggcacggcggug

SEQ ID NO: 3175271 - RNA, 13 nt, Mycobacterium bovis subsp bovis AF2122/97
acgugcggcggcc

SEQ ID NO: 3175272 - RNA, 16 nt, Mycobacterium bovis subsp bovis AF2122/97
acgugcggcggccucg

SEQ ID NO: 3175273 - RNA, 13 nt, Mycobacterium bovis subsp bovis AF2122/97
acgugcgguggcu

SEQ ID NO: 3175274 - RNA, 17 nt, Mycobacterium bovis subsp bovis AF2122/97
acgugcgucggcccggu

SEQ ID NO: 3175275 - RNA, 13 nt, Mycobacterium bovis subsp bovis AF2122/97
acgugcugccgau

SEQ ID NO: 3175276 - RNA, 18 nt, Mycobacterium bovis subsp bovis AF2122/97
acgugcugccgauagcgc

SEQ ID NO: 3175277 - RNA, 18 nt, Mycobacterium bovis subsp bovis AF2122/97
acguggacugaccucguc

SEQ ID NO: 3175278 - RNA, 19 nt, Mycobacterium bovis subsp bovis AF2122/97
acguggacugaccucguca

SEQ ID NO: 3175279 - RNA, 15 nt, Mycobacterium bovis subsp bovis AF2122/97
acguggcccuccucg

SEQ ID NO: 3175280 - RNA, 16 nt, Mycobacterium bovis subsp bovis AF2122/97
acguggcccuccucgg

SEQ ID NO: 3175281 - RNA, 17 nt, Mycobacterium bovis subsp bovis AF2122/97
acguggcccuccucggu

SEQ ID NO: 3175282 - RNA, 18 nt, Mycobacterium bovis subsp bovis AF2122/97
acguggcgaccggcgacc

SEQ ID NO: 3175283 - RNA, 21 nt, Mycobacterium bovis subsp bovis AF2122/97
acguggcuugaguuucggcgc

SEQ ID NO: 3175284 - RNA, 22 nt, Mycobacterium bovis subsp bovis AF2122/97
acguggcuugaguuucggcgca

SEQ ID NO: 3175285 - RNA, 17 nt, Mycobacterium bovis subsp bovis AF2122/97
acgugggccaacgacgc

SEQ ID NO: 3175286 - RNA, 18 nt, Mycobacterium bovis subsp bovis AF2122/97
acgugggccaacgacgcc

SEQ ID NO: 3175287 - RNA, 21 nt, Mycobacterium bovis subsp bovis AF2122/97
acguggggccggggucggccc

SEQ ID NO: 3175288 - RNA, 19 nt, Mycobacterium bovis subsp bovis AF2122/97
acguggguacgcaucucga

SEQ ID NO: 3175289 - RNA, 20 nt, Mycobacterium bovis subsp bovis AF2122/97
acguggguacgcaucucgag

SEQ ID NO: 3175290 - RNA, 16 nt, Mycobacterium bovis subsp bovis AF2122/97
acgugguagccggcga

SEQ ID NO: 3175291 - RNA, 17 nt, Mycobacterium bovis subsp bovis AF2122/97
acguggucggagcgggu

SEQ ID NO: 3175292 - RNA, 18 nt, Mycobacterium bovis subsp bovis AF2122/97
acguggucggagcgggug

SEQ ID NO: 3175293 - RNA, 14 nt, Mycobacterium bovis subsp bovis AF2122/97
acguggucggccac

SEQ ID NO: 3175294 - RNA, 15 nt, Mycobacterium bovis subsp bovis AF2122/97
acguggucggccacc

SEQ ID NO: 3175295 - RNA, 17 nt, Mycobacterium bovis subsp bovis AF2122/97
acguggugggcuuggcu

SEQ ID NO: 3175296 - RNA, 22 nt, Mycobacterium bovis subsp bovis AF2122/97
acgugguguaucgacggcggcc

SEQ ID NO: 3175297 - RNA, 15 nt, Mycobacterium bovis subsp bovis AF2122/97
acgugucaucacggu

SEQ ID NO: 3175298 - RNA, 14 nt, Mycobacterium bovis subsp bovis AF2122/97
acgugucggcugcu

SEQ ID NO: 3175299 - RNA, 20 nt, Mycobacterium bovis subsp bovis AF2122/97
acgugucgggugugcaggcc

SEQ ID NO: 3175300 - RNA, 22 nt, Mycobacterium bovis subsp bovis AF2122/97
acgugucguaacugcccgcggc

SEQ ID NO: 3175301 - RNA, 18 nt, Mycobacterium bovis subsp bovis AF2122/97
acgugugcaccaucauca

SEQ ID NO: 3175302 - RNA, 21 nt, Mycobacterium bovis subsp bovis AF2122/97
acgugugcaccaucaucaccu

SEQ ID NO: 3175303 - RNA, 23 nt, Mycobacterium bovis subsp bovis AF2122/97
acgugugcggaagcaucggcugc

SEQ ID NO: 3175304 - RNA, 15 nt, Mycobacterium bovis subsp bovis AF2122/97
acguguugaccgggu

SEQ ID NO: 3175305 - RNA, 22 nt, Mycobacterium bovis subsp bovis AF2122/97
acguuacgccgagaugcugcac

SEQ ID NO: 3175306 - RNA, 22 nt, Mycobacterium bovis subsp bovis AF2122/97
acguuagcauugaguucggcca

SEQ ID NO: 3175307 - RNA, 14 nt, Mycobacterium bovis subsp bovis AF2122/97
acguuauucaugcc

SEQ ID NO: 3175308 - RNA, 18 nt, Mycobacterium bovis subsp bovis AF2122/97
acguucaguuccgcggcg

SEQ ID NO: 3175309 - RNA, 14 nt, Mycobacterium bovis subsp bovis AF2122/97
acguucggcgacgc

SEQ ID NO: 3175310 - RNA, 13 nt, Mycobacterium bovis subsp bovis AF2122/97
acguucgguggcg

SEQ ID NO: 3175311 - RNA, 16 nt, Mycobacterium bovis subsp bovis AF2122/97
acguucgguggcgaug

SEQ ID NO: 3175312 - RNA, 16 nt, Mycobacterium bovis subsp bovis AF2122/97
acguucucaccaccag

SEQ ID NO: 3175313 - RNA, 18 nt, Mycobacterium bovis subsp bovis AF2122/97
acguugacguccaacagc

SEQ ID NO: 3175314 - RNA, 23 nt, Mycobacterium bovis subsp bovis AF2122/97
acguugacguccaacagcgcucg

SEQ ID NO: 3175315 - RNA, 19 nt, Mycobacterium bovis subsp bovis AF2122/97
acguugauccccagcuccg

SEQ ID NO: 3175316 - RNA, 22 nt, Mycobacterium bovis subsp bovis AF2122/97
acguugauccgcgcaacuucca

SEQ ID NO: 3175317 - RNA, 18 nt, Mycobacterium bovis subsp bovis AF2122/97
acguugcaccgagaaagu

SEQ ID NO: 3175318 - RNA, 15 nt, Mycobacterium bovis subsp bovis AF2122/97
acguugcagccggca

SEQ ID NO: 3175319 - RNA, 15 nt, Mycobacterium bovis subsp bovis AF2122/97
acguugccgaucccg

SEQ ID NO: 3175320 - RNA, 19 nt, Mycobacterium bovis subsp bovis AF2122/97
acguugccggaguugucga

SEQ ID NO: 3175321 - RNA, 22 nt, Mycobacterium bovis subsp bovis AF2122/97
acguugccggaguugucgacgg

SEQ ID NO: 3175322 - RNA, 20 nt, Mycobacterium bovis subsp bovis AF2122/97
acguugcgcauaggcgaucg

SEQ ID NO: 3175323 - RNA, 19 nt, Mycobacterium bovis subsp bovis AF2122/97
acguugcguagcaggucga

SEQ ID NO: 3175324 - RNA, 20 nt, Mycobacterium bovis subsp bovis AF2122/97
acguugcguagcaggucgac

SEQ ID NO: 3175325 - RNA, 22 nt, Mycobacterium bovis subsp bovis AF2122/97
acguugcuggcuggguggcccc

SEQ ID NO: 3175326 - RNA, 14 nt, Mycobacterium bovis subsp bovis AF2122/97
acguuggcagcccu

SEQ ID NO: 3175327 - RNA, 15 nt, Mycobacterium bovis subsp bovis AF2122/97
acguuggcagcccuc

SEQ ID NO: 3175328 - RNA, 11 nt, Mycobacterium bovis subsp bovis AF2122/97
acuccagcacc

SEQ ID NO: 3175329 - RNA, 14 nt, Mycobacterium bovis subsp bovis AF2122/97
acuccagcaccagc

SEQ ID NO: 3175330 - RNA, 18 nt, Mycobacterium bovis subsp bovis AF2122/97
acuccagcaccagcacgg

SEQ ID NO: 3175331 - RNA, 15 nt, Mycobacterium bovis subsp bovis AF2122/97
acuccagcacccgcu

SEQ ID NO: 3175332 - RNA, 11 nt, Mycobacterium bovis subsp bovis AF2122/97
acuccagcagc

SEQ ID NO: 3175333 - RNA, 14 nt, Mycobacterium bovis subsp bovis AF2122/97
acuccagcagcucg

SEQ ID NO: 3175334 - RNA, 17 nt, Mycobacterium bovis subsp bovis AF2122/97
acuccagcagcucgccg

SEQ ID NO: 3175335 - RNA, 13 nt, Mycobacterium bovis subsp bovis AF2122/97
acuccagcgcccg

SEQ ID NO: 3175336 - RNA, 21 nt, Mycobacterium bovis subsp bovis AF2122/97
acuccaguccuaucagugagc

SEQ ID NO: 3175337 - RNA, 20 nt, Mycobacterium bovis subsp bovis AF2122/97
acuccaucaccacaccggca

SEQ ID NO: 3175338 - RNA, 18 nt, Mycobacterium bovis subsp bovis AF2122/97
acuccaucagcgcgaccg

SEQ ID NO: 3175339 - RNA, 13 nt, Mycobacterium bovis subsp bovis AF2122/97
acuccauggcauu

SEQ ID NO: 3175340 - RNA, 12 nt, Mycobacterium bovis subsp bovis AF2122/97
acuccccagaca

SEQ ID NO: 3175341 - RNA, 14 nt, Mycobacterium bovis subsp bovis AF2122/97
acuccccgccgggc

SEQ ID NO: 3175342 - RNA, 15 nt, Mycobacterium bovis subsp bovis AF2122/97
acuccccggucgccg

SEQ ID NO: 3175343 - RNA, 15 nt, Mycobacterium bovis subsp bovis AF2122/97
acucccgagccacaa

SEQ ID NO: 3175344 - RNA, 12 nt, Mycobacterium bovis subsp bovis AF2122/97
acucccgcgauc

SEQ ID NO: 3175345 - RNA, 14 nt, Mycobacterium bovis subsp bovis AF2122/97
acucccgcgcgggc

SEQ ID NO: 3175346 - RNA, 23 nt, Mycobacterium bovis subsp bovis AF2122/97
acucccgcgcgggcggaucgccg

SEQ ID NO: 3175347 - RNA, 19 nt, Mycobacterium bovis subsp bovis AF2122/97
acucccggauauugccauc

SEQ ID NO: 3175348 - RNA, 14 nt, Mycobacterium bovis subsp bovis AF2122/97
acucccggcucggc

SEQ ID NO: 3175349 - RNA, 19 nt, Mycobacterium bovis subsp bovis AF2122/97
acucccggcucggccagcc

SEQ ID NO: 3175350 - RNA, 24 nt, Mycobacterium bovis subsp bovis AF2122/97
acucccggcucggccagccagcgg

SEQ ID NO: 3175351 - RNA, 23 nt, Mycobacterium bovis subsp bovis AF2122/97
acucccucgaucacggcggcccc

SEQ ID NO: 3175352 - RNA, 19 nt, Mycobacterium bovis subsp bovis AF2122/97
acuccgcggaacccagcac

SEQ ID NO: 3175353 - RNA, 12 nt, Mycobacterium bovis subsp bovis AF2122/97
acuccgcggcga

SEQ ID NO: 3175354 - RNA, 12 nt, Mycobacterium bovis subsp bovis AF2122/97
acuccgcggcgc

SEQ ID NO: 3175355 - RNA, 14 nt, Mycobacterium bovis subsp bovis AF2122/97
acuccgcggcgcgc

SEQ ID NO: 3175356 - RNA, 19 nt, Mycobacterium bovis subsp bovis AF2122/97
acuccgcggcgcgcaacac

SEQ ID NO: 3175357 - RNA, 15 nt, Mycobacterium bovis subsp bovis AF2122/97
acuccggcaagcaca

SEQ ID NO: 3175358 - RNA, 15 nt, Mycobacterium bovis subsp bovis AF2122/97
acuccggcaccggca

SEQ ID NO: 3175359 - RNA, 19 nt, Mycobacterium bovis subsp bovis AF2122/97
acuccggcaccggcaacau

SEQ ID NO: 3175360 - RNA, 12 nt, Mycobacterium bovis subsp bovis AF2122/97
acuccggcaggc

SEQ ID NO: 3175361 - RNA, 20 nt, Mycobacterium bovis subsp bovis AF2122/97
acuccggcaggcccgacggc

SEQ ID NO: 3175362 - RNA, 19 nt, Mycobacterium bovis subsp bovis AF2122/97
acuccgggcucggcgucgc

SEQ ID NO: 3175363 - RNA, 20 nt, Mycobacterium bovis subsp bovis AF2122/97
acuccgggcucggcgucgcc

SEQ ID NO: 3175364 - RNA, 17 nt, Mycobacterium bovis subsp bovis AF2122/97
acuccggucaacacccg

SEQ ID NO: 3175365 - RNA, 16 nt, Mycobacterium bovis subsp bovis AF2122/97
acuccggucagcgcgg

SEQ ID NO: 3175366 - RNA, 17 nt, Mycobacterium bovis subsp bovis AF2122/97
acuccggucagcgcggc

SEQ ID NO: 3175367 - RNA, 22 nt, Mycobacterium bovis subsp bovis AF2122/97
acuccggucagcgcggcgaccu

SEQ ID NO: 3175368 - RNA, 17 nt, Mycobacterium bovis subsp bovis AF2122/97
acuccgugcuuccauuc

SEQ ID NO: 3175369 - RNA, 16 nt, Mycobacterium bovis subsp bovis AF2122/97
acuccucagccgccug

SEQ ID NO: 3175370 - RNA, 20 nt, Mycobacterium bovis subsp bovis AF2122/97
acuccucggugugcucgccg

SEQ ID NO: 3175371 - RNA, 22 nt, Mycobacterium bovis subsp bovis AF2122/97
acuccugagaugcggccaugaa

SEQ ID NO: 3175372 - RNA, 20 nt, Mycobacterium bovis subsp bovis AF2122/97
acuccuggguuugccgaugg

SEQ ID NO: 3175373 - RNA, 17 nt, Mycobacterium bovis subsp bovis AF2122/97
acuccuuaucgucgacg

SEQ ID NO: 3175374 - RNA, 23 nt, Mycobacterium bovis subsp bovis AF2122/97
acucgaagcgggcuugagcgccg

SEQ ID NO: 3175375 - RNA, 13 nt, Mycobacterium bovis subsp bovis AF2122/97
acucgaagcggug

SEQ ID NO: 3175376 - RNA, 16 nt, Mycobacterium bovis subsp bovis AF2122/97
acucgaagucgcccag

SEQ ID NO: 3175377 - RNA, 17 nt, Mycobacterium bovis subsp bovis AF2122/97
acucgacaccgacucgc

SEQ ID NO: 3175378 - RNA, 16 nt, Mycobacterium bovis subsp bovis AF2122/97
acucgaccaccgccgg

SEQ ID NO: 3175379 - RNA, 17 nt, Mycobacterium bovis subsp bovis AF2122/97
acucgaccaccgccggc

SEQ ID NO: 3175380 - RNA, 18 nt, Mycobacterium bovis subsp bovis AF2122/97
acucgaccaccgccggcc

SEQ ID NO: 3175381 - RNA, 19 nt, Mycobacterium bovis subsp bovis AF2122/97
acucgaccaccgccggccc

SEQ ID NO: 3175382 - RNA, 15 nt, Mycobacterium bovis subsp bovis AF2122/97
acucgaccaggaccg

SEQ ID NO: 3175383 - RNA, 16 nt, Mycobacterium bovis subsp bovis AF2122/97
acucgaccgcgacggc

SEQ ID NO: 3175384 - RNA, 22 nt, Mycobacterium bovis subsp bovis AF2122/97
acucgaccgcgagcaugauguc

SEQ ID NO: 3175385 - RNA, 23 nt, Mycobacterium bovis subsp bovis AF2122/97
acucgacguaagugugcccugcu

SEQ ID NO: 3175386 - RNA, 18 nt, Mycobacterium bovis subsp bovis AF2122/97
acucgacgucaugcaggg

SEQ ID NO: 3175387 - RNA, 21 nt, Mycobacterium bovis subsp bovis AF2122/97
acucgacgucgucgucgacgg

SEQ ID NO: 3175388 - RNA, 15 nt, Mycobacterium bovis subsp bovis AF2122/97
acucgagcgcucaca

SEQ ID NO: 3175389 - RNA, 18 nt, Mycobacterium bovis subsp bovis AF2122/97
acucgaggaccugcucgg

SEQ ID NO: 3175390 - RNA, 18 nt, Mycobacterium bovis subsp bovis AF2122/97
acucgaguagucgcuggc

SEQ ID NO: 3175391 - RNA, 21 nt, Mycobacterium bovis subsp bovis AF2122/97
acucgaguggcgaacggguga

SEQ ID NO: 3175392 - RNA, 22 nt, Mycobacterium bovis subsp bovis AF2122/97
acucgaguggcgaacgggugag

SEQ ID NO: 3175393 - RNA, 22 nt, Mycobacterium bovis subsp bovis AF2122/97
acucgauauaacccggcuccag

SEQ ID NO: 3175394 - RNA, 17 nt, Mycobacterium bovis subsp bovis AF2122/97
acucgauaugcagcucg

SEQ ID NO: 3175395 - RNA, 22 nt, Mycobacterium bovis subsp bovis AF2122/97
acucgcagcgccgucaucgugc

SEQ ID NO: 3175396 - RNA, 18 nt, Mycobacterium bovis subsp bovis AF2122/97
acucgccacucagcccga

SEQ ID NO: 3175397 - RNA, 21 nt, Mycobacterium bovis subsp bovis AF2122/97
acucgccacucagcccgacac

SEQ ID NO: 3175398 - RNA, 17 nt, Mycobacterium bovis subsp bovis AF2122/97
acucgccgacgucgacg

SEQ ID NO: 3175399 - RNA, 22 nt, Mycobacterium bovis subsp bovis AF2122/97
acucgccgacgucgacgccggc

SEQ ID NO: 3175400 - RNA, 21 nt, Mycobacterium bovis subsp bovis AF2122/97
acucgccgucauagcaggccu

SEQ ID NO: 3175401 - RNA, 22 nt, Mycobacterium bovis subsp bovis AF2122/97
acucgccgucauagcaggccuc

SEQ ID NO: 3175402 - RNA, 22 nt, Mycobacterium bovis subsp bovis AF2122/97
acucgccugcacccggcgauug

SEQ ID NO: 3175403 - RNA, 15 nt, Mycobacterium bovis subsp bovis AF2122/97
acucgcgcagguagc

SEQ ID NO: 3175404 - RNA, 14 nt, Mycobacterium bovis subsp bovis AF2122/97
acucgcggccggcg

SEQ ID NO: 3175405 - RNA, 15 nt, Mycobacterium bovis subsp bovis AF2122/97
acucgcggcgcggcc

SEQ ID NO: 3175406 - RNA, 23 nt, Mycobacterium bovis subsp bovis AF2122/97
acucgcgggcgaccaccgcggca

SEQ ID NO: 3175407 - RNA, 18 nt, Mycobacterium bovis subsp bovis AF2122/97
acucgcguggcaccgaca

SEQ ID NO: 3175408 - RNA, 19 nt, Mycobacterium bovis subsp bovis AF2122/97
acucgcguggcaccgacag

SEQ ID NO: 3175409 - RNA, 21 nt, Mycobacterium bovis subsp bovis AF2122/97
acucgcguggcaccgacagca

SEQ ID NO: 3175410 - RNA, 20 nt, Mycobacterium bovis subsp bovis AF2122/97
acucgcuccgaccgguggcg

SEQ ID NO: 3175411 - RNA, 14 nt, Mycobacterium bovis subsp bovis AF2122/97
acucggaaucggcg

SEQ ID NO: 3175412 - RNA, 18 nt, Mycobacterium bovis subsp bovis AF2122/97
acucggacccacccuggu

SEQ ID NO: 3175413 - RNA, 13 nt, Mycobacterium bovis subsp bovis AF2122/97
acucggcaccgcg

SEQ ID NO: 3175414 - RNA, 14 nt, Mycobacterium bovis subsp bovis AF2122/97
acugccgcaggaag

SEQ ID NO: 3175415 - RNA, 21 nt, Mycobacterium bovis subsp bovis AF2122/97
acugccgccgguuccgccggc

SEQ ID NO: 3175416 - RNA, 22 nt, Mycobacterium bovis subsp bovis AF2122/97
acugccgccgguuccgccggcc

SEQ ID NO: 3175417 - RNA, 19 nt, Mycobacterium bovis subsp bovis AF2122/97
acugccggacagccacgca

SEQ ID NO: 3175418 - RNA, 20 nt, Mycobacterium bovis subsp bovis AF2122/97
acugccggacuaccgccggc

SEQ ID NO: 3175419 - RNA, 16 nt, Mycobacterium bovis subsp bovis AF2122/97
acugccggcagcgccc

SEQ ID NO: 3175420 - RNA, 22 nt, Mycobacterium bovis subsp bovis AF2122/97
acugccggcagcgcccccggac

SEQ ID NO: 3175421 - RNA, 16 nt, Mycobacterium bovis subsp bovis AF2122/97
acugccguugccgccg

SEQ ID NO: 3175422 - RNA, 17 nt, Mycobacterium bovis subsp bovis AF2122/97
acugccguugccgccgg

SEQ ID NO: 3175423 - RNA, 20 nt, Mycobacterium bovis subsp bovis AF2122/97
acugccguugccgccggugc

SEQ ID NO: 3175424 - RNA, 18 nt, Mycobacterium bovis subsp bovis AF2122/97
acugccuuaaccgagccg

SEQ ID NO: 3175425 - RNA, 15 nt, Mycobacterium bovis subsp bovis AF2122/97
acugcgaacccugcg

SEQ ID NO: 3175426 - RNA, 16 nt, Mycobacterium bovis subsp bovis AF2122/97
acugcgaaucuccgcg

SEQ ID NO: 3175427 - RNA, 14 nt, Mycobacterium bovis subsp bovis AF2122/97
acugcgaaucucgu

SEQ ID NO: 3175428 - RNA, 17 nt, Mycobacterium bovis subsp bovis AF2122/97
acugcgaaugcugggcc

SEQ ID NO: 3175429 - RNA, 18 nt, Mycobacterium bovis subsp bovis AF2122/97
acugcgaccgguucggcg

SEQ ID NO: 3175430 - RNA, 18 nt, Mycobacterium bovis subsp bovis AF2122/97
acugcgaccgucccggcc

SEQ ID NO: 3175431 - RNA, 12 nt, Mycobacterium bovis subsp bovis AF2122/97
acugcgagcgca

SEQ ID NO: 3175432 - RNA, 17 nt, Mycobacterium bovis subsp bovis AF2122/97
acugcgagggcacgcgc

SEQ ID NO: 3175433 - RNA, 18 nt, Mycobacterium bovis subsp bovis AF2122/97
acugcgagggcacgcgca

SEQ ID NO: 3175434 - RNA, 20 nt, Mycobacterium bovis subsp bovis AF2122/97
acugcgagggcacgcgcaca

SEQ ID NO: 3175435 - RNA, 15 nt, Mycobacterium bovis subsp bovis AF2122/97
acugcgaucgcgagc

SEQ ID NO: 3175436 - RNA, 14 nt, Mycobacterium bovis subsp bovis AF2122/97
acugcgccaccggu

SEQ ID NO: 3175437 - RNA, 23 nt, Mycobacterium bovis subsp bovis AF2122/97
acugcgcccauagcugccggccc

SEQ ID NO: 3175438 - RNA, 14 nt, Mycobacterium bovis subsp bovis AF2122/97
acugcgccgccggc

SEQ ID NO: 3175439 - RNA, 16 nt, Mycobacterium bovis subsp bovis AF2122/97
acugcgccggccggcg

SEQ ID NO: 3175440 - RNA, 14 nt, Mycobacterium bovis subsp bovis AF2122/97
acugcgccguucgc

SEQ ID NO: 3175441 - RNA, 20 nt, Mycobacterium bovis subsp bovis AF2122/97
acugcgccguucgcuccccc

SEQ ID NO: 3175442 - RNA, 14 nt, Mycobacterium bovis subsp bovis AF2122/97
acugcggcauggca

SEQ ID NO: 3175443 - RNA, 16 nt, Mycobacterium bovis subsp bovis AF2122/97
acugcggcccgacccg

SEQ ID NO: 3175444 - RNA, 15 nt, Mycobacterium bovis subsp bovis AF2122/97
acugcggccugcucg

SEQ ID NO: 3175445 - RNA, 21 nt, Mycobacterium bovis subsp bovis AF2122/97
acugcggcgcugggacggucg

SEQ ID NO: 3175446 - RNA, 15 nt, Mycobacterium bovis subsp bovis AF2122/97
acugcggucgcccag

SEQ ID NO: 3175447 - RNA, 18 nt, Mycobacterium bovis subsp bovis AF2122/97
acugcguaguugauggcc

SEQ ID NO: 3175448 - RNA, 15 nt, Mycobacterium bovis subsp bovis AF2122/97
acugcgucggcggcu

SEQ ID NO: 3175449 - RNA, 15 nt, Mycobacterium bovis subsp bovis AF2122/97
acugcgugccgcacc

SEQ ID NO: 3175450 - RNA, 19 nt, Mycobacterium bovis subsp bovis AF2122/97
acugcgugccgcaccgccu

SEQ ID NO: 3175451 - RNA, 17 nt, Mycobacterium bovis subsp bovis AF2122/97
acugcguuccaucgccg

SEQ ID NO: 3175452 - RNA, 19 nt, Mycobacterium bovis subsp bovis AF2122/97
acugcguuccaucgccgac

SEQ ID NO: 3175453 - RNA, 20 nt, Mycobacterium bovis subsp bovis AF2122/97
acugcuccuugggucgguca

SEQ ID NO: 3175454 - RNA, 15 nt, Mycobacterium bovis subsp bovis AF2122/97
acugcucgacgaggc

SEQ ID NO: 3175455 - RNA, 14 nt, Mycobacterium bovis subsp bovis AF2122/97
acugcucggauccg

SEQ ID NO: 3175456 - RNA, 15 nt, Mycobacterium bovis subsp bovis AF2122/97
acugcugcggcagcg

SEQ ID NO: 3175457 - RNA, 18 nt, Mycobacterium bovis subsp bovis AF2122/97
acugcugcuugagcucgc

SEQ ID NO: 3175458 - RNA, 15 nt, Mycobacterium bovis subsp bovis AF2122/97
acugcugggcuucga

SEQ ID NO: 3175459 - RNA, 21 nt, Mycobacterium bovis subsp bovis AF2122/97
acugcugggggucaaucgggu

SEQ ID NO: 3175460 - RNA, 11 nt, Mycobacterium bovis subsp bovis AF2122/97
acuggaaagca

SEQ ID NO: 3175461 - RNA, 17 nt, Mycobacterium bovis subsp bovis AF2122/97
acuggaaagcagcagcg

SEQ ID NO: 3175462 - RNA, 13 nt, Mycobacterium bovis subsp bovis AF2122/97
acuggaagccaag

SEQ ID NO: 3175463 - RNA, 12 nt, Mycobacterium bovis subsp bovis AF2122/97
acuggaaggcgg

SEQ ID NO: 3175464 - RNA, 20 nt, Mycobacterium bovis subsp bovis AF2122/97
acuggaauggaucucggcgu

SEQ ID NO: 3175465 - RNA, 20 nt, Mycobacterium bovis subsp bovis AF2122/97
acuggaauggcucacgcucc

SEQ ID NO: 3175466 - RNA, 17 nt, Mycobacterium bovis subsp bovis AF2122/97
acuggacaagcuccucg

SEQ ID NO: 3175467 - RNA, 21 nt, Mycobacterium bovis subsp bovis AF2122/97
acuggacucuucggaccggcu

SEQ ID NO: 3175468 - RNA, 16 nt, Mycobacterium bovis subsp bovis AF2122/97
acuggauggcucgccg

SEQ ID NO: 3175469 - RNA, 19 nt, Mycobacterium bovis subsp bovis AF2122/97
acuggcacacggucaccgg

SEQ ID NO: 3175470 - RNA, 13 nt, Mycobacterium bovis subsp bovis AF2122/97
acuggcaccgcca

SEQ ID NO: 3175471 - RNA, 18 nt, Mycobacterium bovis subsp bovis AF2122/97
acuggcaggguugccccg

SEQ ID NO: 3175472 - RNA, 18 nt, Mycobacterium bovis subsp bovis AF2122/97
acuggcauccgccccgcc

SEQ ID NO: 3175473 - RNA, 19 nt, Mycobacterium bovis subsp bovis AF2122/97
acuggcauuucagcuggug

SEQ ID NO: 3175474 - RNA, 20 nt, Mycobacterium bovis subsp bovis AF2122/97
acuggcccccacaccacgcu

SEQ ID NO: 3175475 - RNA, 20 nt, Mycobacterium bovis subsp bovis AF2122/97
acuggccccgccagcggcag

SEQ ID NO: 3175476 - RNA, 18 nt, Mycobacterium bovis subsp bovis AF2122/97
acuggccccgguggugcu

SEQ ID NO: 3175477 - RNA, 17 nt, Mycobacterium bovis subsp bovis AF2122/97
acuggcccggacaugcg

SEQ ID NO: 3175478 - RNA, 15 nt, Mycobacterium bovis subsp bovis AF2122/97
acuggccgcccggcg

SEQ ID NO: 3175479 - RNA, 17 nt, Mycobacterium bovis subsp bovis AF2122/97
acuggccguuucggcgc

SEQ ID NO: 3175480 - RNA, 23 nt, Mycobacterium bovis subsp bovis AF2122/97
acuggccguuucggcgccgucgc

SEQ ID NO: 3175481 - RNA, 18 nt, Mycobacterium bovis subsp bovis AF2122/97
acuggcgccggugccgcc

SEQ ID NO: 3175482 - RNA, 22 nt, Mycobacterium bovis subsp bovis AF2122/97
acuggcgccggugccgccgggu

SEQ ID NO: 3175483 - RNA, 17 nt, Mycobacterium bovis subsp bovis AF2122/97
acuggcgcugaucgccu

SEQ ID NO: 3175484 - RNA, 18 nt, Mycobacterium bovis subsp bovis AF2122/97
acuggcgguccgaugcgc

SEQ ID NO: 3175485 - RNA, 20 nt, Mycobacterium bovis subsp bovis AF2122/97
acuggcgguccgaugcgcgc

SEQ ID NO: 3175486 - RNA, 12 nt, Mycobacterium bovis subsp bovis AF2122/97
acuggcggugca

SEQ ID NO: 3175487 - RNA, 17 nt, Mycobacterium bovis subsp bovis AF2122/97
acuggcguugccaccgg

SEQ ID NO: 3175488 - RNA, 15 nt, Mycobacterium bovis subsp bovis AF2122/97
acuggcuauccaccu

SEQ ID NO: 3175489 - RNA, 18 nt, Mycobacterium bovis subsp bovis AF2122/97
acuggcuguaguccgcua

SEQ ID NO: 3175490 - RNA, 16 nt, Mycobacterium bovis subsp bovis AF2122/97
acuggcuuugacggga

SEQ ID NO: 3175491 - RNA, 13 nt, Mycobacterium bovis subsp bovis AF2122/97
acugggacgacgc

SEQ ID NO: 3175492 - RNA, 15 nt, Mycobacterium bovis subsp bovis AF2122/97
acugggcaccggcgg

SEQ ID NO: 3175493 - RNA, 15 nt, Mycobacterium bovis subsp bovis AF2122/97
acugggccgagcgcg

SEQ ID NO: 3175494 - RNA, 20 nt, Mycobacterium bovis subsp bovis AF2122/97
acugggcgaucgacaccgug

SEQ ID NO: 3175495 - RNA, 21 nt, Mycobacterium bovis subsp bovis AF2122/97
acugggcgaucgacaccguga

SEQ ID NO: 3175496 - RNA, 18 nt, Mycobacterium bovis subsp bovis AF2122/97
acugggcgcccaagcgcg

SEQ ID NO: 3175497 - RNA, 16 nt, Mycobacterium bovis subsp bovis AF2122/97
acugggcgcuggaggc

SEQ ID NO: 3175498 - RNA, 21 nt, Mycobacterium bovis subsp bovis AF2122/97
acugggcggccuggucggcca

SEQ ID NO: 3175499 - RNA, 22 nt, Mycobacterium bovis subsp bovis AF2122/97
acugggcuggccagcacgcccg

SEQ ID NO: 3175500 - RNA, 19 nt, Mycobacterium bovis subsp bovis AF2122/97
acugggcuuuucaaugccg

SEQ ID NO: 3175501 - RNA, 16 nt, Mycobacterium bovis subsp bovis AF2122/97
acuuuucgguggcggc

SEQ ID NO: 3175502 - RNA, 22 nt, Mycobacterium bovis subsp bovis AF2122/97
acuuuucgguggcggcagcagc

SEQ ID NO: 3175503 - RNA, 18 nt, Mycobacterium bovis subsp bovis AF2122/97
agaaaacauugcggcccu

SEQ ID NO: 3175504 - RNA, 21 nt, Mycobacterium bovis subsp bovis AF2122/97
agaaaacauugcggcccucga

SEQ ID NO: 3175505 - RNA, 16 nt, Mycobacterium bovis subsp bovis AF2122/97
agaaaacccucgcugc

SEQ ID NO: 3175506 - RNA, 14 nt, Mycobacterium bovis subsp bovis AF2122/97
agaaaaccgccgca

SEQ ID NO: 3175507 - RNA, 23 nt, Mycobacterium bovis subsp bovis AF2122/97
agaaaaucugcuagcuuggcggc

SEQ ID NO: 3175508 - RNA, 21 nt, Mycobacterium bovis subsp bovis AF2122/97
agaaaccaggacccaucgcca

SEQ ID NO: 3175509 - RNA, 13 nt, Mycobacterium bovis subsp bovis AF2122/97
agaaacccggcga

SEQ ID NO: 3175510 - RNA, 16 nt, Mycobacterium bovis subsp bovis AF2122/97
agaaacccggcgacca

SEQ ID NO: 3175511 - RNA, 14 nt, Mycobacterium bovis subsp bovis AF2122/97
agaaacccugcugc

SEQ ID NO: 3175512 - RNA, 15 nt, Mycobacterium bovis subsp bovis AF2122/97
agaaacccugcugcg

SEQ ID NO: 3175513 - RNA, 17 nt, Mycobacterium bovis subsp bovis AF2122/97
agaaacgccgagcgcca

SEQ ID NO: 3175514 - RNA, 22 nt, Mycobacterium bovis subsp bovis AF2122/97
agaaacgcgaugguggccgcca

SEQ ID NO: 3175515 - RNA, 16 nt, Mycobacterium bovis subsp bovis AF2122/97
agaaacggcgacucga

SEQ ID NO: 3175516 - RNA, 13 nt, Mycobacterium bovis subsp bovis AF2122/97
agaaagaucgguu

SEQ ID NO: 3175517 - RNA, 18 nt, Mycobacterium bovis subsp bovis AF2122/97
agaaaucgguggugcggu

SEQ ID NO: 3175518 - RNA, 14 nt, Mycobacterium bovis subsp bovis AF2122/97
agaacaacaucgcc

SEQ ID NO: 3175519 - RNA, 20 nt, Mycobacterium bovis subsp bovis AF2122/97
agaacaacgggauccgcgcg

SEQ ID NO: 3175520 - RNA, 12 nt, Mycobacterium bovis subsp bovis AF2122/97
agaacaccaccg

SEQ ID NO: 3175521 - RNA, 16 nt, Mycobacterium bovis subsp bovis AF2122/97
agaacaccaccgccag

SEQ ID NO: 3175522 - RNA, 21 nt, Mycobacterium bovis subsp bovis AF2122/97
agaacauguaggucgccgcuu

SEQ ID NO: 3175523 - RNA, 11 nt, Mycobacterium bovis subsp bovis AF2122/97
agaaccacgac

SEQ ID NO: 3175524 - RNA, 22 nt, Mycobacterium bovis subsp bovis AF2122/97
agaaccggguaaugcgacgccg

SEQ ID NO: 3175525 - RNA, 18 nt, Mycobacterium bovis subsp bovis AF2122/97
agaaccggucgcagugca

SEQ ID NO: 3175526 - RNA, 19 nt, Mycobacterium bovis subsp bovis AF2122/97
agaaccggucgcagugcac

SEQ ID NO: 3175527 - RNA, 14 nt, Mycobacterium bovis subsp bovis AF2122/97
agaacgacgccacc

SEQ ID NO: 3175528 - RNA, 17 nt, Mycobacterium bovis subsp bovis AF2122/97
agaacgauguccgcgcg

SEQ ID NO: 3175529 - RNA, 22 nt, Mycobacterium bovis subsp bovis AF2122/97
agaacgcaucggucccacugcc

SEQ ID NO: 3175530 - RNA, 18 nt, Mycobacterium bovis subsp bovis AF2122/97
agaacgcccgcugcagac

SEQ ID NO: 3175531 - RNA, 18 nt, Mycobacterium bovis subsp bovis AF2122/97
agaacggcguugcggaau

SEQ ID NO: 3175532 - RNA, 23 nt, Mycobacterium bovis subsp bovis AF2122/97
agaacggcguugcggaaucagca

SEQ ID NO: 3175533 - RNA, 20 nt, Mycobacterium bovis subsp bovis AF2122/97
agaacgguggcgcggugccg

SEQ ID NO: 3175534 - RNA, 15 nt, Mycobacterium bovis subsp bovis AF2122/97
agaacguagcgccca

SEQ ID NO: 3175535 - RNA, 20 nt, Mycobacterium bovis subsp bovis AF2122/97
agaacgucaaacccagcgac

SEQ ID NO: 3175536 - RNA, 13 nt, Mycobacterium bovis subsp bovis AF2122/97
agaacgugcuggu

SEQ ID NO: 3175537 - RNA, 20 nt, Mycobacterium bovis subsp bovis AF2122/97
agaacgugcuggugggccgg

SEQ ID NO: 3175538 - RNA, 20 nt, Mycobacterium bovis subsp bovis AF2122/97
agaacguuuucgucacccca

SEQ ID NO: 3175539 - RNA, 15 nt, Mycobacterium bovis subsp bovis AF2122/97
agaacuccgccacca

SEQ ID NO: 3175540 - RNA, 16 nt, Mycobacterium bovis subsp bovis AF2122/97
agaacuccgccaccau

SEQ ID NO: 3175541 - RNA, 13 nt, Mycobacterium bovis subsp bovis AF2122/97
agaacuggcugcu

SEQ ID NO: 3175542 - RNA, 15 nt, Mycobacterium bovis subsp bovis AF2122/97
agaagaacucggcgu

SEQ ID NO: 3175543 - RNA, 15 nt, Mycobacterium bovis subsp bovis AF2122/97
agaagacaccgcgcu

SEQ ID NO: 3175544 - RNA, 20 nt, Mycobacterium bovis subsp bovis AF2122/97
agaagaccuggcggugccgg

SEQ ID NO: 3175545 - RNA, 17 nt, Mycobacterium bovis subsp bovis AF2122/97
agaagaugaucgcgaac

SEQ ID NO: 3175546 - RNA, 21 nt, Mycobacterium bovis subsp bovis AF2122/97
agaagcagggauucuggaugc

SEQ ID NO: 3175547 - RNA, 23 nt, Mycobacterium bovis subsp bovis AF2122/97
agaagcaugauuggcucggggug

SEQ ID NO: 3175548 - RNA, 16 nt, Mycobacterium bovis subsp bovis AF2122/97
agaagccagagaucga

SEQ ID NO: 3175549 - RNA, 14 nt, Mycobacterium bovis subsp bovis AF2122/97
agaagcccaggacg

SEQ ID NO: 3175550 - RNA, 21 nt, Mycobacterium bovis subsp bovis AF2122/97
agaagcccaggacggcuacca

SEQ ID NO: 3175551 - RNA, 12 nt, Mycobacterium bovis subsp bovis AF2122/97
agaagcccgaag

SEQ ID NO: 3175552 - RNA, 14 nt, Mycobacterium bovis subsp bovis AF2122/97
agaagcgcuccagc

SEQ ID NO: 3175553 - RNA, 14 nt, Mycobacterium bovis subsp bovis AF2122/97
agaaggaccgcucg

SEQ ID NO: 3175554 - RNA, 19 nt, Mycobacterium bovis subsp bovis AF2122/97
agaagugcucacauccggu

SEQ ID NO: 3175555 - RNA, 14 nt, Mycobacterium bovis subsp bovis AF2122/97
agaaucacggucau

SEQ ID NO: 3175556 - RNA, 13 nt, Mycobacterium bovis subsp bovis AF2122/97
agaaucagcagca

SEQ ID NO: 3175557 - RNA, 15 nt, Mycobacterium bovis subsp bovis AF2122/97
agaaucaggcucgcc

SEQ ID NO: 3175558 - RNA, 13 nt, Mycobacterium bovis subsp bovis AF2122/97
agaauccaggugg

SEQ ID NO: 3175559 - RNA, 22 nt, Mycobacterium bovis subsp bovis AF2122/97
agaaucccgggcucugcugcca

SEQ ID NO: 3175560 - RNA, 15 nt, Mycobacterium bovis subsp bovis AF2122/97
agaauccggcccacc

SEQ ID NO: 3175561 - RNA, 19 nt, Mycobacterium bovis subsp bovis AF2122/97
agaaucgaagcggcugcug

SEQ ID NO: 3175562 - RNA, 18 nt, Mycobacterium bovis subsp bovis AF2122/97
agaaucgccugcgacagc

SEQ ID NO: 3175563 - RNA, 16 nt, Mycobacterium bovis subsp bovis AF2122/97
agaaucggcucagcaa

SEQ ID NO: 3175564 - RNA, 22 nt, Mycobacterium bovis subsp bovis AF2122/97
agaaugacaucgucgccagggc

SEQ ID NO: 3175565 - RNA, 20 nt, Mycobacterium bovis subsp bovis AF2122/97
agaaugcugacggugcagga

SEQ ID NO: 3175566 - RNA, 20 nt, Mycobacterium bovis subsp bovis AF2122/97
agaauggacugaacaccaaa

SEQ ID NO: 3175567 - RNA, 13 nt, Mycobacterium bovis subsp bovis AF2122/97
agaauucggcgcg

SEQ ID NO: 3175568 - RNA, 22 nt, Mycobacterium bovis subsp bovis AF2122/97
agaauucguucagcgccagcgc

SEQ ID NO: 3175569 - RNA, 13 nt, Mycobacterium bovis subsp bovis AF2122/97
agacaaaggugcc

SEQ ID NO: 3175570 - RNA, 13 nt, Mycobacterium bovis subsp bovis AF2122/97
agacaacaacacg

SEQ ID NO: 3175571 - RNA, 15 nt, Mycobacterium bovis subsp bovis AF2122/97
agacaacaacacggg

SEQ ID NO: 3175572 - RNA, 12 nt, Mycobacterium bovis subsp bovis AF2122/97
agacaccggcgu

SEQ ID NO: 3175573 - RNA, 16 nt, Mycobacterium bovis subsp bovis AF2122/97
agacacgagucgccag

SEQ ID NO: 3175574 - RNA, 22 nt, Mycobacterium bovis subsp bovis AF2122/97
agacacgcccuaacccugcccu

SEQ ID NO: 3175575 - RNA, 12 nt, Mycobacterium bovis subsp bovis AF2122/97
agacacuggucg

SEQ ID NO: 3175576 - RNA, 15 nt, Mycobacterium bovis subsp bovis AF2122/97
agacacuggucgcgg

SEQ ID NO: 3175577 - RNA, 17 nt, Mycobacterium bovis subsp bovis AF2122/97
agacagcgccaugcccu

SEQ ID NO: 3175578 - RNA, 12 nt, Mycobacterium bovis subsp bovis AF2122/97
agacagcgcggg

SEQ ID NO: 3175579 - RNA, 23 nt, Mycobacterium bovis subsp bovis AF2122/97
agacagcgcgggacacgucgcgc

SEQ ID NO: 3175580 - RNA, 19 nt, Mycobacterium bovis subsp bovis AF2122/97
agacaggauugccgagcgu

SEQ ID NO: 3175581 - RNA, 14 nt, Mycobacterium bovis subsp bovis AF2122/97
agacaucgcgacga

SEQ ID NO: 3175582 - RNA, 13 nt, Mycobacterium bovis subsp bovis AF2122/97
agacaugggugaa

SEQ ID NO: 3175583 - RNA, 18 nt, Mycobacterium bovis subsp bovis AF2122/97
agaccaagcccgucgucg

SEQ ID NO: 3175584 - RNA, 16 nt, Mycobacterium bovis subsp bovis AF2122/97
agaccaaggcgaaggu

SEQ ID NO: 3175585 - RNA, 11 nt, Mycobacterium bovis subsp bovis AF2122/97
agaccaagucc

SEQ ID NO: 3175586 - RNA, 17 nt, Mycobacterium bovis subsp bovis AF2122/97
agaccaagugucgccgc

SEQ ID NO: 3175587 - RNA, 21 nt, Mycobacterium bovis subsp bovis AF2122/97
agaccacaacgccucgccauc

SEQ ID NO: 3175588 - RNA, 12 nt, Mycobacterium bovis subsp bovis AF2122/97
agacgcggcagg

SEQ ID NO: 3175589 - RNA, 22 nt, Mycobacterium bovis subsp bovis AF2122/97
agacgcgggucuuggcacacag

SEQ ID NO: 3175590 - RNA, 23 nt, Mycobacterium bovis subsp bovis AF2122/97
agacgcguuucgucgaccgcgcc

SEQ ID NO: 3175591 - RNA, 22 nt, Mycobacterium bovis subsp bovis AF2122/97
agacgcuaaagcccccgcacgc

SEQ ID NO: 3175592 - RNA, 15 nt, Mycobacterium bovis subsp bovis AF2122/97
agacgcucgaccugc

SEQ ID NO: 3175593 - RNA, 19 nt, Mycobacterium bovis subsp bovis AF2122/97
agacgcugcccaaaagcgc

SEQ ID NO: 3175594 - RNA, 13 nt, Mycobacterium bovis subsp bovis AF2122/97
agacgcugcgcgc

SEQ ID NO: 3175595 - RNA, 16 nt, Mycobacterium bovis subsp bovis AF2122/97
agacgcuuuccgccgc

SEQ ID NO: 3175596 - RNA, 17 nt, Mycobacterium bovis subsp bovis AF2122/97
agacgcuuuccgccgca

SEQ ID NO: 3175597 - RNA, 12 nt, Mycobacterium bovis subsp bovis AF2122/97
agacggcacccc

SEQ ID NO: 3175598 - RNA, 13 nt, Mycobacterium bovis subsp bovis AF2122/97
agacggcaccccc

SEQ ID NO: 3175599 - RNA, 17 nt, Mycobacterium bovis subsp bovis AF2122/97
agacggcacccccgacg

SEQ ID NO: 3175600 - RNA, 15 nt, Mycobacterium bovis subsp bovis AF2122/97
agacggcggcaucgg

SEQ ID NO: 3175601 - RNA, 20 nt, Mycobacterium bovis subsp bovis AF2122/97
agacggcguugauccgcacc

SEQ ID NO: 3175602 - RNA, 13 nt, Mycobacterium bovis subsp bovis AF2122/97
agacggcugccac

SEQ ID NO: 3175603 - RNA, 16 nt, Mycobacterium bovis subsp bovis AF2122/97
agacggggucgcccgg

SEQ ID NO: 3175604 - RNA, 19 nt, Mycobacterium bovis subsp bovis AF2122/97
agacggggucgcccggggc

SEQ ID NO: 3175605 - RNA, 15 nt, Mycobacterium bovis subsp bovis AF2122/97
agacgguccggucgc

SEQ ID NO: 3175606 - RNA, 15 nt, Mycobacterium bovis subsp bovis AF2122/97
agacggucgaucaca

SEQ ID NO: 3175607 - RNA, 17 nt, Mycobacterium bovis subsp bovis AF2122/97
agacggugaagccgagc

SEQ ID NO: 3175608 - RNA, 13 nt, Mycobacterium bovis subsp bovis AF2122/97
agacggugcgggc

SEQ ID NO: 3175609 - RNA, 19 nt, Mycobacterium bovis subsp bovis AF2122/97
agacggugucacccucgcg

SEQ ID NO: 3175610 - RNA, 19 nt, Mycobacterium bovis subsp bovis AF2122/97
agacguaaaagcccccgca

SEQ ID NO: 3175611 - RNA, 17 nt, Mycobacterium bovis subsp bovis AF2122/97
agacguaaccgcuggcc

SEQ ID NO: 3175612 - RNA, 12 nt, Mycobacterium bovis subsp bovis AF2122/97
agacgucgccgc

SEQ ID NO: 3175613 - RNA, 13 nt, Mycobacterium bovis subsp bovis AF2122/97
agacgucgccgca

SEQ ID NO: 3175614 - RNA, 20 nt, Mycobacterium bovis subsp bovis AF2122/97
agacgugccaaugauucggc

SEQ ID NO: 3175615 - RNA, 14 nt, Mycobacterium bovis subsp bovis AF2122/97
agacguuuugcggc

SEQ ID NO: 3175616 - RNA, 17 nt, Mycobacterium bovis subsp bovis AF2122/97
agacguuuugcggcccg

SEQ ID NO: 3175617 - RNA, 19 nt, Mycobacterium bovis subsp bovis AF2122/97
agacuagccgauccagcag

SEQ ID NO: 3175618 - RNA, 20 nt, Mycobacterium bovis subsp bovis AF2122/97
agacuccagcaaggccagca

SEQ ID NO: 3175619 - RNA, 20 nt, Mycobacterium bovis subsp bovis AF2122/97
agacucgauaugcagcucgc

SEQ ID NO: 3175620 - RNA, 14 nt, Mycobacterium bovis subsp bovis AF2122/97
agacucgccaccgc

SEQ ID NO: 3175621 - RNA, 17 nt, Mycobacterium bovis subsp bovis AF2122/97
agacucgucgaugcggu

SEQ ID NO: 3175622 - RNA, 12 nt, Mycobacterium bovis subsp bovis AF2122/97
agacugccgccg

SEQ ID NO: 3175623 - RNA, 14 nt, Mycobacterium bovis subsp bovis AF2122/97
agacugcgccgccg

SEQ ID NO: 3175624 - RNA, 18 nt, Mycobacterium bovis subsp bovis AF2122/97
agacugggcgcuggaggc

SEQ ID NO: 3175625 - RNA, 21 nt, Mycobacterium bovis subsp bovis AF2122/97
agacuuccucggauugcagcg

SEQ ID NO: 3175626 - RNA, 16 nt, Mycobacterium bovis subsp bovis AF2122/97
agacuucuucgacgcg

SEQ ID NO: 3175627 - RNA, 13 nt, Mycobacterium bovis subsp bovis AF2122/97
agacuugccgagu

SEQ ID NO: 3175628 - RNA, 14 nt, Mycobacterium bovis subsp bovis AF2122/97
agacuugccgagug

SEQ ID NO: 3175629 - RNA, 15 nt, Mycobacterium bovis subsp bovis AF2122/97
agacuugcugcuccu

SEQ ID NO: 3175630 - RNA, 23 nt, Mycobacterium bovis subsp bovis AF2122/97
agacuugcuggcccgcacgaacc

SEQ ID NO: 3175631 - RNA, 19 nt, Mycobacterium bovis subsp bovis AF2122/97
agagaaggcggcgucgagc

SEQ ID NO: 3175632 - RNA, 23 nt, Mycobacterium bovis subsp bovis AF2122/97
agagaaggcggcgucgagcaccu

SEQ ID NO: 3175633 - RNA, 18 nt, Mycobacterium bovis subsp bovis AF2122/97
agagacaugucgcugccg

SEQ ID NO: 3175634 - RNA, 11 nt, Mycobacterium bovis subsp bovis AF2122/97
agagaccaagg

SEQ ID NO: 3175635 - RNA, 13 nt, Mycobacterium bovis subsp bovis AF2122/97
agagacuugccga

SEQ ID NO: 3175636 - RNA, 16 nt, Mycobacterium bovis subsp bovis AF2122/97
agagaucgucgaccca

SEQ ID NO: 3175637 - RNA, 13 nt, Mycobacterium bovis subsp bovis AF2122/97
agagauugcugug

SEQ ID NO: 3175638 - RNA, 15 nt, Mycobacterium bovis subsp bovis AF2122/97
agagcaggcccauac

SEQ ID NO: 3175639 - RNA, 17 nt, Mycobacterium bovis subsp bovis AF2122/97
agagcaguacgucugcg

SEQ ID NO: 3175640 - RNA, 16 nt, Mycobacterium bovis subsp bovis AF2122/97
agagcaugguccagca

SEQ ID NO: 3175641 - RNA, 21 nt, Mycobacterium bovis subsp bovis AF2122/97
agagcaugguccagcacaucg

SEQ ID NO: 3175642 - RNA, 21 nt, Mycobacterium bovis subsp bovis AF2122/97
agagcauucgggcgcccucau

SEQ ID NO: 3175643 - RNA, 17 nt, Mycobacterium bovis subsp bovis AF2122/97
agagccccgaccagcag

SEQ ID NO: 3175644 - RNA, 18 nt, Mycobacterium bovis subsp bovis AF2122/97
agagccccgaccagcaga

SEQ ID NO: 3175645 - RNA, 19 nt, Mycobacterium bovis subsp bovis AF2122/97
agagccccggcaagcgcag

SEQ ID NO: 3175646 - RNA, 13 nt, Mycobacterium bovis subsp bovis AF2122/97
agagccgaucacc

SEQ ID NO: 3175647 - RNA, 11 nt, Mycobacterium bovis subsp bovis AF2122/97
agagccggcgg

SEQ ID NO: 3175648 - RNA, 13 nt, Mycobacterium bovis subsp bovis AF2122/97
agagccggcggcg

SEQ ID NO: 3175649 - RNA, 14 nt, Mycobacterium bovis subsp bovis AF2122/97
agagccggcggcga

SEQ ID NO: 3175650 - RNA, 19 nt, Mycobacterium bovis subsp bovis AF2122/97
agagccggcggcgaccaga

SEQ ID NO: 3175651 - RNA, 13 nt, Mycobacterium bovis subsp bovis AF2122/97
agagccugcucgc

SEQ ID NO: 3175652 - RNA, 21 nt, Mycobacterium bovis subsp bovis AF2122/97
agagcgaacccccgccgcgca

SEQ ID NO: 3175653 - RNA, 14 nt, Mycobacterium bovis subsp bovis AF2122/97
agagcgucgaacac

SEQ ID NO: 3175654 - RNA, 18 nt, Mycobacterium bovis subsp bovis AF2122/97
agagcuccgucgcggccg

SEQ ID NO: 3175655 - RNA, 17 nt, Mycobacterium bovis subsp bovis AF2122/97
agaggauaucgccgaga

SEQ ID NO: 3175656 - RNA, 14 nt, Mycobacterium bovis subsp bovis AF2122/97
agaggauggucagc

SEQ ID NO: 3175657 - RNA, 12 nt, Mycobacterium bovis subsp bovis AF2122/97
agaggcccgaaa

SEQ ID NO: 3175658 - RNA, 12 nt, Mycobacterium bovis subsp bovis AF2122/97
agaggcccgcgg

SEQ ID NO: 3175659 - RNA, 22 nt, Mycobacterium bovis subsp bovis AF2122/97
agaggcgcaagaaugccgccga

SEQ ID NO: 3175660 - RNA, 15 nt, Mycobacterium bovis subsp bovis AF2122/97
agagggugucgcccu

SEQ ID NO: 3175661 - RNA, 15 nt, Mycobacterium bovis subsp bovis AF2122/97
agagguagagcagau

SEQ ID NO: 3175662 - RNA, 14 nt, Mycobacterium bovis subsp bovis AF2122/97
agaggucgagcgcc

SEQ ID NO: 3175663 - RNA, 18 nt, Mycobacterium bovis subsp bovis AF2122/97
agaguccuuaaacgucgu

SEQ ID NO: 3175664 - RNA, 22 nt, Mycobacterium bovis subsp bovis AF2122/97
agaguggccucguccagcucgg

SEQ ID NO: 3175665 - RNA, 18 nt, Mycobacterium bovis subsp bovis AF2122/97
agauacgcguguggcaga

SEQ ID NO: 3175666 - RNA, 21 nt, Mycobacterium bovis subsp bovis AF2122/97
agauacgcguguggcagaugu

SEQ ID NO: 3175667 - RNA, 14 nt, Mycobacterium bovis subsp bovis AF2122/97
agauacggccacca

SEQ ID NO: 3175668 - RNA, 21 nt, Mycobacterium bovis subsp bovis AF2122/97
agauacucgaguggcgaacgg

SEQ ID NO: 3175669 - RNA, 21 nt, Mycobacterium bovis subsp bovis AF2122/97
agauagacguuguugaaggcu

SEQ ID NO: 3175670 - RNA, 16 nt, Mycobacterium bovis subsp bovis AF2122/97
agauauggaccgccgc

SEQ ID NO: 3175671 - RNA, 13 nt, Mycobacterium bovis subsp bovis AF2122/97
agaucaccgccac

SEQ ID NO: 3175672 - RNA, 13 nt, Mycobacterium bovis subsp bovis AF2122/97
agaucaccgccag

SEQ ID NO: 3175673 - RNA, 14 nt, Mycobacterium bovis subsp bovis AF2122/97
agaucaccgccagc

SEQ ID NO: 3175674 - RNA, 18 nt, Mycobacterium bovis subsp bovis AF2122/97
agaucaccucccgcggca

SEQ ID NO: 3175675 - RNA, 20 nt, Mycobacterium bovis subsp bovis AF2122/97
agauugccgggccgccgagc

SEQ ID NO: 3175676 - RNA, 22 nt, Mycobacterium bovis subsp bovis AF2122/97
agauugccgggccgccgagcgg

SEQ ID NO: 3175677 - RNA, 21 nt, Mycobacterium bovis subsp bovis AF2122/97
agauugccugggcggccgggc

SEQ ID NO: 3175678 - RNA, 16 nt, Mycobacterium bovis subsp bovis AF2122/97
agauuggcgcugcccg

SEQ ID NO: 3175679 - RNA, 20 nt, Mycobacterium bovis subsp bovis AF2122/97
agauugguggcccgggccac

SEQ ID NO: 3175680 - RNA, 17 nt, Mycobacterium bovis subsp bovis AF2122/97
agauugugagcaauggc

SEQ ID NO: 3175681 - RNA, 22 nt, Mycobacterium bovis subsp bovis AF2122/97
agauuguuuuccuugcgguagg

SEQ ID NO: 3175682 - RNA, 14 nt, Mycobacterium bovis subsp bovis AF2122/97
agcaaaauggccac

SEQ ID NO: 3175683 - RNA, 20 nt, Mycobacterium bovis subsp bovis AF2122/97
agcaaaauggccaccggcgg

SEQ ID NO: 3175684 - RNA, 18 nt, Mycobacterium bovis subsp bovis AF2122/97
agcaaacacgccucgccg

SEQ ID NO: 3175685 - RNA, 21 nt, Mycobacterium bovis subsp bovis AF2122/97
agcaaacaucgcaggcacccc

SEQ ID NO: 3175686 - RNA, 13 nt, Mycobacterium bovis subsp bovis AF2122/97
agcaaagccagcg

SEQ ID NO: 3175687 - RNA, 17 nt, Mycobacterium bovis subsp bovis AF2122/97
agcaaagccagcgcagc

SEQ ID NO: 3175688 - RNA, 18 nt, Mycobacterium bovis subsp bovis AF2122/97
agcaacaccagaugcacc

SEQ ID NO: 3175689 - RNA, 15 nt, Mycobacterium bovis subsp bovis AF2122/97
agcaacaccagggcc

SEQ ID NO: 3175690 - RNA, 13 nt, Mycobacterium bovis subsp bovis AF2122/97
agcaacaggccca

SEQ ID NO: 3175691 - RNA, 21 nt, Mycobacterium bovis subsp bovis AF2122/97
agcaacccgccguugccaccg

SEQ ID NO: 3175692 - RNA, 22 nt, Mycobacterium bovis subsp bovis AF2122/97
agcaacgacccgaagccgaccg

SEQ ID NO: 3175693 - RNA, 15 nt, Mycobacterium bovis subsp bovis AF2122/97
agcaacgccacgccg

SEQ ID NO: 3175694 - RNA, 17 nt, Mycobacterium bovis subsp bovis AF2122/97
agcaacgccacgccgau

SEQ ID NO: 3175695 - RNA, 21 nt, Mycobacterium bovis subsp bovis AF2122/97
agcaacgcccaacgucgccag

SEQ ID NO: 3175696 - RNA, 16 nt, Mycobacterium bovis subsp bovis AF2122/97
agcaacgcggugccgg

SEQ ID NO: 3175697 - RNA, 16 nt, Mycobacterium bovis subsp bovis AF2122/97
agcaacgcugcggcag

SEQ ID NO: 3175698 - RNA, 13 nt, Mycobacterium bovis subsp bovis AF2122/97
agcaacggcaucc

SEQ ID NO: 3175699 - RNA, 18 nt, Mycobacterium bovis subsp bovis AF2122/97
agcaacggcggcaggccg

SEQ ID NO: 3175700 - RNA, 13 nt, Mycobacterium bovis subsp bovis AF2122/97
agcaacgucggua

SEQ ID NO: 3175701 - RNA, 17 nt, Mycobacterium bovis subsp bovis AF2122/97
agcaacucguccagcag

SEQ ID NO: 3175702 - RNA, 21 nt, Mycobacterium bovis subsp bovis AF2122/97
agcaacucguccagcagugcg

SEQ ID NO: 3175703 - RNA, 22 nt, Mycobacterium bovis subsp bovis AF2122/97
agcaacucguccagcagugcga

SEQ ID NO: 3175704 - RNA, 15 nt, Mycobacterium bovis subsp bovis AF2122/97
agcaacugccgcacc

SEQ ID NO: 3175705 - RNA, 24 nt, Mycobacterium bovis subsp bovis AF2122/97
agcaacugggcggccuggucggcc

SEQ ID NO: 3175706 - RNA, 23 nt, Mycobacterium bovis subsp bovis AF2122/97
agcaagacgaugacagacaucgc

SEQ ID NO: 3175707 - RNA, 14 nt, Mycobacterium bovis subsp bovis AF2122/97
agcaagaucggcag

SEQ ID NO: 3175708 - RNA, 15 nt, Mycobacterium bovis subsp bovis AF2122/97
agcaagaucggcagc

SEQ ID NO: 3175709 - RNA, 14 nt, Mycobacterium bovis subsp bovis AF2122/97
agcaaggcccgaaa

SEQ ID NO: 3175710 - RNA, 14 nt, Mycobacterium bovis subsp bovis AF2122/97
agcaaguccaccgg

SEQ ID NO: 3175711 - RNA, 13 nt, Mycobacterium bovis subsp bovis AF2122/97
agcaaguccugca

SEQ ID NO: 3175712 - RNA, 20 nt, Mycobacterium bovis subsp bovis AF2122/97
agcaagucgccgaggcaacc

SEQ ID NO: 3175713 - RNA, 12 nt, Mycobacterium bovis subsp bovis AF2122/97
agcaagucugcc

SEQ ID NO: 3175714 - RNA, 19 nt, Mycobacterium bovis subsp bovis AF2122/97
agcaauaccugagcgcgcg

SEQ ID NO: 3175715 - RNA, 18 nt, Mycobacterium bovis subsp bovis AF2122/97
agcaauccaaggcucagc

SEQ ID NO: 3175716 - RNA, 15 nt, Mycobacterium bovis subsp bovis AF2122/97
agcaauccgcacagc

SEQ ID NO: 3175717 - RNA, 16 nt, Mycobacterium bovis subsp bovis AF2122/97
agcaauccgcacagcg

SEQ ID NO: 3175718 - RNA, 17 nt, Mycobacterium bovis subsp bovis AF2122/97
agcaauccgcacagcga

SEQ ID NO: 3175719 - RNA, 14 nt, Mycobacterium bovis subsp bovis AF2122/97
agcaaugacccgcg

SEQ ID NO: 3175720 - RNA, 13 nt, Mycobacterium bovis subsp bovis AF2122/97
agcaaugccaacg

SEQ ID NO: 3175721 - RNA, 24 nt, Mycobacterium bovis subsp bovis AF2122/97
agcaaugcgguaccaaccugcgcg

SEQ ID NO: 3175722 - RNA, 13 nt, Mycobacterium bovis subsp bovis AF2122/97
agcaauggugcgg

SEQ ID NO: 3175723 - RNA, 14 nt, Mycobacterium bovis subsp bovis AF2122/97
agcacaaacccagu

SEQ ID NO: 3175724 - RNA, 14 nt, Mycobacterium bovis subsp bovis AF2122/97
agcacaauccagac

SEQ ID NO: 3175725 - RNA, 17 nt, Mycobacterium bovis subsp bovis AF2122/97
agcacacaacacccaac

SEQ ID NO: 3175726 - RNA, 20 nt, Mycobacterium bovis subsp bovis AF2122/97
agcacacccagaugcaggcu

SEQ ID NO: 3175727 - RNA, 13 nt, Mycobacterium bovis subsp bovis AF2122/97
agcacaccgccag

SEQ ID NO: 3175728 - RNA, 17 nt, Mycobacterium bovis subsp bovis AF2122/97
agcacaccgccagcggc

SEQ ID NO: 3175729 - RNA, 12 nt, Mycobacterium bovis subsp bovis AF2122/97
agcacaccgccc

SEQ ID NO: 3175730 - RNA, 15 nt, Mycobacterium bovis subsp bovis AF2122/97
agcacaccgcccgca

SEQ ID NO: 3175731 - RNA, 20 nt, Mycobacterium bovis subsp bovis AF2122/97
agcacaccgguugacagcuc

SEQ ID NO: 3175732 - RNA, 15 nt, Mycobacterium bovis subsp bovis AF2122/97
agcacaccgucgacg

SEQ ID NO: 3175733 - RNA, 23 nt, Mycobacterium bovis subsp bovis AF2122/97
agcacacguccggcgaugaccag

SEQ ID NO: 3175734 - RNA, 18 nt, Mycobacterium bovis subsp bovis AF2122/97
agcacacuccuagccaac

SEQ ID NO: 3175735 - RNA, 23 nt, Mycobacterium bovis subsp bovis AF2122/97
agcacacucucgucguauugccu

SEQ ID NO: 3175736 - RNA, 18 nt, Mycobacterium bovis subsp bovis AF2122/97
agcacacuggccacaauc

SEQ ID NO: 3175737 - RNA, 12 nt, Mycobacterium bovis subsp bovis AF2122/97
agcacagcagca

SEQ ID NO: 3175738 - RNA, 15 nt, Mycobacterium bovis subsp bovis AF2122/97
agcacagcagcaacg

SEQ ID NO: 3175739 - RNA, 14 nt, Mycobacterium bovis subsp bovis AF2122/97
agcacagcccggcg

SEQ ID NO: 3175740 - RNA, 15 nt, Mycobacterium bovis subsp bovis AF2122/97
agcacagcccggcga

SEQ ID NO: 3175741 - RNA, 20 nt, Mycobacterium bovis subsp bovis AF2122/97
agcacagcgcagccugcagc

SEQ ID NO: 3175742 - RNA, 18 nt, Mycobacterium bovis subsp bovis AF2122/97
agcacauccugcagcucg

SEQ ID NO: 3175743 - RNA, 13 nt, Mycobacterium bovis subsp bovis AF2122/97
agcacaucgccgg

SEQ ID NO: 3175744 - RNA, 14 nt, Mycobacterium bovis subsp bovis AF2122/97
agcacaucgccgga

SEQ ID NO: 3175745 - RNA, 21 nt, Mycobacterium bovis subsp bovis AF2122/97
agcacaugcucgacgcccgcc

SEQ ID NO: 3175746 - RNA, 18 nt, Mycobacterium bovis subsp bovis AF2122/97
agcacaugguccaaccag

SEQ ID NO: 3175747 - RNA, 16 nt, Mycobacterium bovis subsp bovis AF2122/97
agcacauucugcagcg

SEQ ID NO: 3175748 - RNA, 18 nt, Mycobacterium bovis subsp bovis AF2122/97
agcaccaaaagcccggua

SEQ ID NO: 3175749 - RNA, 20 nt, Mycobacterium bovis subsp bovis AF2122/97
agcaccaaaugccccgaacc

SEQ ID NO: 3175750 - RNA, 17 nt, Mycobacterium bovis subsp bovis AF2122/97
agcaccaagaccguucg

SEQ ID NO: 3175751 - RNA, 15 nt, Mycobacterium bovis subsp bovis AF2122/97
agcaccaaggucuuc

SEQ ID NO: 3175752 - RNA, 16 nt, Mycobacterium bovis subsp bovis AF2122/97
agcaccacaacgucgg

SEQ ID NO: 3175753 - RNA, 17 nt, Mycobacterium bovis subsp bovis AF2122/97
agcaccacaacgucggc

SEQ ID NO: 3175754 - RNA, 13 nt, Mycobacterium bovis subsp bovis AF2122/97
agcaccaccaccc

SEQ ID NO: 3175755 - RNA, 14 nt, Mycobacterium bovis subsp bovis AF2122/97
agcaccaccagcag

SEQ ID NO: 3175756 - RNA, 13 nt, Mycobacterium bovis subsp bovis AF2122/97
agcaccaccccag

SEQ ID NO: 3175757 - RNA, 23 nt, Mycobacterium bovis subsp bovis AF2122/97
agcaccaccccagcggccaccga

SEQ ID NO: 3175758 - RNA, 16 nt, Mycobacterium bovis subsp bovis AF2122/97
agcaccacccgggccu

SEQ ID NO: 3175759 - RNA, 20 nt, Mycobacterium bovis subsp bovis AF2122/97
agcaccacccgggccucggc

SEQ ID NO: 3175760 - RNA, 18 nt, Mycobacterium bovis subsp bovis AF2122/97
agcaccaccgcggugugc

SEQ ID NO: 3175761 - RNA, 20 nt, Mycobacterium bovis subsp bovis AF2122/97
agcaccaccggaaccaccag

SEQ ID NO: 3175762 - RNA, 15 nt, Mycobacterium bovis subsp bovis AF2122/97
agcaccacggccagc

SEQ ID NO: 3175763 - RNA, 13 nt, Mycobacterium bovis subsp bovis AF2122/97
agcaccacggcgc

SEQ ID NO: 3175764 - RNA, 14 nt, Mycobacterium bovis subsp bovis AF2122/97
agcaccacgugcga

SEQ ID NO: 3175765 - RNA, 13 nt, Mycobacterium bovis subsp bovis AF2122/97
agcaccagcagca

SEQ ID NO: 3175766 - RNA, 14 nt, Mycobacterium bovis subsp bovis AF2122/97
agcaccagcagcac

SEQ ID NO: 3175767 - RNA, 14 nt, Mycobacterium bovis subsp bovis AF2122/97
agcaccagccaaau

SEQ ID NO: 3175768 - RNA, 13 nt, Mycobacterium bovis subsp bovis AF2122/97
agcaccagccacg

SEQ ID NO: 3175769 - RNA, 13 nt, Mycobacterium bovis subsp bovis AF2122/97
agcaccagccagc

SEQ ID NO: 3175770 - RNA, 14 nt, Mycobacterium bovis subsp bovis AF2122/97
agcaccagccagcc

SEQ ID NO: 3175771 - RNA, 15 nt, Mycobacterium bovis subsp bovis AF2122/97
agcaccagccagccu

SEQ ID NO: 3175772 - RNA, 18 nt, Mycobacterium bovis subsp bovis AF2122/97
agcaccagccagccugcu

SEQ ID NO: 3175773 - RNA, 16 nt, Mycobacterium bovis subsp bovis AF2122/97
agcaccagcgucgcgg

SEQ ID NO: 3175774 - RNA, 18 nt, Mycobacterium bovis subsp bovis AF2122/97
agcaccagcgucgcggcc

SEQ ID NO: 3175775 - RNA, 16 nt, Mycobacterium bovis subsp bovis AF2122/97
agcaccaguucccuac

SEQ ID NO: 3175776 - RNA, 20 nt, Mycobacterium bovis subsp bovis AF2122/97
agcaccaguuugugccgccg

SEQ ID NO: 3175777 - RNA, 21 nt, Mycobacterium bovis subsp bovis AF2122/97
agcaccaguuugugccgccgc

SEQ ID NO: 3175778 - RNA, 15 nt, Mycobacterium bovis subsp bovis AF2122/97
agcacccaacccggc

SEQ ID NO: 3175779 - RNA, 17 nt, Mycobacterium bovis subsp bovis AF2122/97
agcacccaacccggcgg

SEQ ID NO: 3175780 - RNA, 19 nt, Mycobacterium bovis subsp bovis AF2122/97
agcacccaacccggcggca

SEQ ID NO: 3175781 - RNA, 17 nt, Mycobacterium bovis subsp bovis AF2122/97
agcacccaaugccaccg

SEQ ID NO: 3175782 - RNA, 22 nt, Mycobacterium bovis subsp bovis AF2122/97
agcacccaaugccaccgcggcc

SEQ ID NO: 3175783 - RNA, 19 nt, Mycobacterium bovis subsp bovis AF2122/97
agcacccacaucagccgca

SEQ ID NO: 3175784 - RNA, 17 nt, Mycobacterium bovis subsp bovis AF2122/97
agcacccaccgaagcga

SEQ ID NO: 3175785 - RNA, 18 nt, Mycobacterium bovis subsp bovis AF2122/97
agcacccacgccgguggc

SEQ ID NO: 3175786 - RNA, 14 nt, Mycobacterium bovis subsp bovis AF2122/97
agcacccacggcga

SEQ ID NO: 3175787 - RNA, 19 nt, Mycobacterium bovis subsp bovis AF2122/97
agcaccccauggccaccga

SEQ ID NO: 3175788 - RNA, 14 nt, Mycobacterium bovis subsp bovis AF2122/97
agcaccccgagguc

SEQ ID NO: 3175789 - RNA, 15 nt, Mycobacterium bovis subsp bovis AF2122/97
agcaccccgccgggg

SEQ ID NO: 3175790 - RNA, 17 nt, Mycobacterium bovis subsp bovis AF2122/97
agcaccccgccgggggc

SEQ ID NO: 3175791 - RNA, 15 nt, Mycobacterium bovis subsp bovis AF2122/97
agcacccgaaccggg

SEQ ID NO: 3175792 - RNA, 17 nt, Mycobacterium bovis subsp bovis AF2122/97
agcacccgaaccgggga

SEQ ID NO: 3175793 - RNA, 18 nt, Mycobacterium bovis subsp bovis AF2122/97
agcacccgagcgaugcga

SEQ ID NO: 3175794 - RNA, 14 nt, Mycobacterium bovis subsp bovis AF2122/97
agcacccgcaaugc

SEQ ID NO: 3175795 - RNA, 23 nt, Mycobacterium bovis subsp bovis AF2122/97
agcacccgcgccaguaacgccca

SEQ ID NO: 3175796 - RNA, 13 nt, Mycobacterium bovis subsp bovis AF2122/97
agcacccgcgcga

SEQ ID NO: 3175797 - RNA, 12 nt, Mycobacterium bovis subsp bovis AF2122/97
agcacccgcucc

SEQ ID NO: 3175798 - RNA, 22 nt, Mycobacterium bovis subsp bovis AF2122/97
agcacccgcuccagcucggcgg

SEQ ID NO: 3175799 - RNA, 14 nt, Mycobacterium bovis subsp bovis AF2122/97
agcacccggccacc

SEQ ID NO: 3175800 - RNA, 15 nt, Mycobacterium bovis subsp bovis AF2122/97
agcacccggccaccg

SEQ ID NO: 3175801 - RNA, 15 nt, Mycobacterium bovis subsp bovis AF2122/97
agcacccggcuucgc

SEQ ID NO: 3175802 - RNA, 23 nt, Mycobacterium bovis subsp bovis AF2122/97
agcacccgggccacgucgagcac

SEQ ID NO: 3175803 - RNA, 21 nt, Mycobacterium bovis subsp bovis AF2122/97
agcacccguugaucgcggaca

SEQ ID NO: 3175804 - RNA, 15 nt, Mycobacterium bovis subsp bovis AF2122/97
agcacccugauguga

SEQ ID NO: 3175805 - RNA, 19 nt, Mycobacterium bovis subsp bovis AF2122/97
agcacccugaugugagucc

SEQ ID NO: 3175806 - RNA, 15 nt, Mycobacterium bovis subsp bovis AF2122/97
agcaccgaacccgcc

SEQ ID NO: 3175807 - RNA, 19 nt, Mycobacterium bovis subsp bovis AF2122/97
agcaccgaacccgccaccg

SEQ ID NO: 3175808 - RNA, 15 nt, Mycobacterium bovis subsp bovis AF2122/97
agcaccgacagcccg

SEQ ID NO: 3175809 - RNA, 20 nt, Mycobacterium bovis subsp bovis AF2122/97
agcaccgacagcccgaacga

SEQ ID NO: 3175810 - RNA, 22 nt, Mycobacterium bovis subsp bovis AF2122/97
agcaccgacuucagcaacgcau

SEQ ID NO: 3175811 - RNA, 14 nt, Mycobacterium bovis subsp bovis AF2122/97
agcaccgccgcgcc

SEQ ID NO: 3175812 - RNA, 15 nt, Mycobacterium bovis subsp bovis AF2122/97
agcaccgccgcgccg

SEQ ID NO: 3175813 - RNA, 21 nt, Mycobacterium bovis subsp bovis AF2122/97
agcaccgccgcgccggcggcc

SEQ ID NO: 3175814 - RNA, 13 nt, Mycobacterium bovis subsp bovis AF2122/97
agcaccgccggcg

SEQ ID NO: 3175815 - RNA, 12 nt, Mycobacterium bovis subsp bovis AF2122/97
agcaccgccggu

SEQ ID NO: 3175816 - RNA, 15 nt, Mycobacterium bovis subsp bovis AF2122/97
agcaccgccggugcg

SEQ ID NO: 3175817 - RNA, 18 nt, Mycobacterium bovis subsp bovis AF2122/97
agcaccgccggugcggcc

SEQ ID NO: 3175818 - RNA, 20 nt, Mycobacterium bovis subsp bovis AF2122/97
agcaccgcgacgacgagguc

SEQ ID NO: 3175819 - RNA, 12 nt, Mycobacterium bovis subsp bovis AF2122/97
agcaccgcgccg

SEQ ID NO: 3175820 - RNA, 13 nt, Mycobacterium bovis subsp bovis AF2122/97
agcaccgcgccga

SEQ ID NO: 3175821 - RNA, 18 nt, Mycobacterium bovis subsp bovis AF2122/97
agcaccggauacagccac

SEQ ID NO: 3175822 - RNA, 19 nt, Mycobacterium bovis subsp bovis AF2122/97
agcaccggauacagccacg

SEQ ID NO: 3175823 - RNA, 13 nt, Mycobacterium bovis subsp bovis AF2122/97
agcaccggcaccc

SEQ ID NO: 3175824 - RNA, 22 nt, Mycobacterium bovis subsp bovis AF2122/97
agcaccggcugcggggcgaucc

SEQ ID NO: 3175825 - RNA, 21 nt, Mycobacterium bovis subsp bovis AF2122/97
agcaccgggaugugcggcugc

SEQ ID NO: 3175826 - RNA, 21 nt, Mycobacterium bovis subsp bovis AF2122/97
agcaccggggacagcccggca

SEQ ID NO: 3175827 - RNA, 19 nt, Mycobacterium bovis subsp bovis AF2122/97
agcaccguacggcgguccg

SEQ ID NO: 3175828 - RNA, 11 nt, Mycobacterium bovis subsp bovis AF2122/97
agcaccgucgg

SEQ ID NO: 3175829 - RNA, 20 nt, Mycobacterium bovis subsp bovis AF2122/97
agcaccgucggcaccagcag

SEQ ID NO: 3175830 - RNA, 22 nt, Mycobacterium bovis subsp bovis AF2122/97
agcaccgucggcaccagcagcc

SEQ ID NO: 3175831 - RNA, 19 nt, Mycobacterium bovis subsp bovis AF2122/97
agcaccgucgggcccagcc

SEQ ID NO: 3175832 - RNA, 16 nt, Mycobacterium bovis subsp bovis AF2122/97
agcaccgugacccuga

SEQ ID NO: 3175833 - RNA, 17 nt, Mycobacterium bovis subsp bovis AF2122/97
agcaccguucgcagcac

SEQ ID NO: 3175834 - RNA, 20 nt, Mycobacterium bovis subsp bovis AF2122/97
agcaccguucgcagcaccac

SEQ ID NO: 3175835 - RNA, 17 nt, Mycobacterium bovis subsp bovis AF2122/97
agcaccuagucgcggcc

SEQ ID NO: 3175836 - RNA, 19 nt, Mycobacterium bovis subsp bovis AF2122/97
agcaccuccaccgcgccgg

SEQ ID NO: 3175837 - RNA, 15 nt, Mycobacterium bovis subsp bovis AF2122/97
agcaccucgaagugc

SEQ ID NO: 3175838 - RNA, 15 nt, Mycobacterium bovis subsp bovis AF2122/97
agcaccucgaugaug

SEQ ID NO: 3175839 - RNA, 17 nt, Mycobacterium bovis subsp bovis AF2122/97
agcaccucgucgaucgc

SEQ ID NO: 3175840 - RNA, 14 nt, Mycobacterium bovis subsp bovis AF2122/97
agcaccugcaccgc

SEQ ID NO: 3175841 - RNA, 15 nt, Mycobacterium bovis subsp bovis AF2122/97
agcaccugcaccgca

SEQ ID NO: 3175842 - RNA, 21 nt, Mycobacterium bovis subsp bovis AF2122/97
agcaccugccgaucgggcuca

SEQ ID NO: 3175843 - RNA, 21 nt, Mycobacterium bovis subsp bovis AF2122/97
agcacgaagcuggcgugcagc

SEQ ID NO: 3175844 - RNA, 23 nt, Mycobacterium bovis subsp bovis AF2122/97
agcacgacgacgucgggggcuuc

SEQ ID NO: 3175845 - RNA, 18 nt, Mycobacterium bovis subsp bovis AF2122/97
agcacgacgugcgucggc

SEQ ID NO: 3175846 - RNA, 20 nt, Mycobacterium bovis subsp bovis AF2122/97
agcacgaugucgaugccgug

SEQ ID NO: 3175847 - RNA, 22 nt, Mycobacterium bovis subsp bovis AF2122/97
agcacgccaacguugcgccagc

SEQ ID NO: 3175848 - RNA, 15 nt, Mycobacterium bovis subsp bovis AF2122/97
agcacgccagcccca

SEQ ID NO: 3175849 - RNA, 13 nt, Mycobacterium bovis subsp bovis AF2122/97
agcagcagacgac

SEQ ID NO: 3175850 - RNA, 13 nt, Mycobacterium bovis subsp bovis AF2122/97
agcagcagcgccg

SEQ ID NO: 3175851 - RNA, 13 nt, Mycobacterium bovis subsp bovis AF2122/97
agcagcagcggcg

SEQ ID NO: 3175852 - RNA, 16 nt, Mycobacterium bovis subsp bovis AF2122/97
agcagcagcggcggcg

SEQ ID NO: 3175853 - RNA, 22 nt, Mycobacterium bovis subsp bovis AF2122/97
agcagcagcgugaccaccgccg

SEQ ID NO: 3175854 - RNA, 13 nt, Mycobacterium bovis subsp bovis AF2122/97
agcagcagguaca

SEQ ID NO: 3175855 - RNA, 13 nt, Mycobacterium bovis subsp bovis AF2122/97
agcagcagugcca

SEQ ID NO: 3175856 - RNA, 16 nt, Mycobacterium bovis subsp bovis AF2122/97
agcagcagugccaccg

SEQ ID NO: 3175857 - RNA, 22 nt, Mycobacterium bovis subsp bovis AF2122/97
agcagcauccggccgucaucug

SEQ ID NO: 3175858 - RNA, 14 nt, Mycobacterium bovis subsp bovis AF2122/97
agcagcaucggcac

SEQ ID NO: 3175859 - RNA, 19 nt, Mycobacterium bovis subsp bovis AF2122/97
agcagcaucggcacgucgu

SEQ ID NO: 3175860 - RNA, 16 nt, Mycobacterium bovis subsp bovis AF2122/97
agcagcaucugggggu

SEQ ID NO: 3175861 - RNA, 12 nt, Mycobacterium bovis subsp bovis AF2122/97
agcagccacgau

SEQ ID NO: 3175862 - RNA, 21 nt, Mycobacterium bovis subsp bovis AF2122/97
agcagccacgauccuuggcgu

SEQ ID NO: 3175863 - RNA, 22 nt, Mycobacterium bovis subsp bovis AF2122/97
agcagccacgauccuuggcgua

SEQ ID NO: 3175864 - RNA, 12 nt, Mycobacterium bovis subsp bovis AF2122/97
agcagccagcaa

SEQ ID NO: 3175865 - RNA, 14 nt, Mycobacterium bovis subsp bovis AF2122/97
agcagccagcaaca

SEQ ID NO: 3175866 - RNA, 17 nt, Mycobacterium bovis subsp bovis AF2122/97
agcagccagcaacacca

SEQ ID NO: 3175867 - RNA, 18 nt, Mycobacterium bovis subsp bovis AF2122/97
agcagccagcaacaccag

SEQ ID NO: 3175868 - RNA, 13 nt, Mycobacterium bovis subsp bovis AF2122/97
agcagccagccac

SEQ ID NO: 3175869 - RNA, 14 nt, Mycobacterium bovis subsp bovis AF2122/97
agcagccagccacc

SEQ ID NO: 3175870 - RNA, 15 nt, Mycobacterium bovis subsp bovis AF2122/97
agcagccagccaccg

SEQ ID NO: 3175871 - RNA, 15 nt, Mycobacterium bovis subsp bovis AF2122/97
agcagccagcccagc

SEQ ID NO: 3175872 - RNA, 18 nt, Mycobacterium bovis subsp bovis AF2122/97
agcagccagcguccaugg

SEQ ID NO: 3175873 - RNA, 12 nt, Mycobacterium bovis subsp bovis AF2122/97
agcagcccggcg

SEQ ID NO: 3175874 - RNA, 15 nt, Mycobacterium bovis subsp bovis AF2122/97
agcagccgaaccggc

SEQ ID NO: 3175875 - RNA, 14 nt, Mycobacterium bovis subsp bovis AF2122/97
agcagccgagcuca

SEQ ID NO: 3175876 - RNA, 14 nt, Mycobacterium bovis subsp bovis AF2122/97
agcagccgaugcug

SEQ ID NO: 3175877 - RNA, 13 nt, Mycobacterium bovis subsp bovis AF2122/97
agcagccgccgau

SEQ ID NO: 3175878 - RNA, 14 nt, Mycobacterium bovis subsp bovis AF2122/97
agcagccgccggcc

SEQ ID NO: 3175879 - RNA, 17 nt, Mycobacterium bovis subsp bovis AF2122/97
agcagccugcgccgcgc

SEQ ID NO: 3175880 - RNA, 15 nt, Mycobacterium bovis subsp bovis AF2122/97
agcagcgacgcugcc

SEQ ID NO: 3175881 - RNA, 20 nt, Mycobacterium bovis subsp bovis AF2122/97
agcagcgacgcugccgccag

SEQ ID NO: 3175882 - RNA, 14 nt, Mycobacterium bovis subsp bovis AF2122/97
agcagcgacgguca

SEQ ID NO: 3175883 - RNA, 17 nt, Mycobacterium bovis subsp bovis AF2122/97
agcagcgcaacggccag

SEQ ID NO: 3175884 - RNA, 14 nt, Mycobacterium bovis subsp bovis AF2122/97
agcagcgccagcag

SEQ ID NO: 3175885 - RNA, 15 nt, Mycobacterium bovis subsp bovis AF2122/97
agcagcgccagcagc

SEQ ID NO: 3175886 - RNA, 18 nt, Mycobacterium bovis subsp bovis AF2122/97
agcagcgccucauccucc

SEQ ID NO: 3175887 - RNA, 13 nt, Mycobacterium bovis subsp bovis AF2122/97
agcagcgcgccgu

SEQ ID NO: 3175888 - RNA, 17 nt, Mycobacterium bovis subsp bovis AF2122/97
agcagcgcgccguucgc

SEQ ID NO: 3175889 - RNA, 15 nt, Mycobacterium bovis subsp bovis AF2122/97
agcagcgcggccaga

SEQ ID NO: 3175890 - RNA, 21 nt, Mycobacterium bovis subsp bovis AF2122/97
agcagcgcggccagagccgcg

SEQ ID NO: 3175891 - RNA, 17 nt, Mycobacterium bovis subsp bovis AF2122/97
agcagcgcgggaucuga

SEQ ID NO: 3175892 - RNA, 20 nt, Mycobacterium bovis subsp bovis AF2122/97
agcagcgcuucggcggucgc

SEQ ID NO: 3175893 - RNA, 19 nt, Mycobacterium bovis subsp bovis AF2122/97
agcagcggcggaaggacgg

SEQ ID NO: 3175894 - RNA, 17 nt, Mycobacterium bovis subsp bovis AF2122/97
agcagcggcggcgacga

SEQ ID NO: 3175895 - RNA, 22 nt, Mycobacterium bovis subsp bovis AF2122/97
agcagcggcucuauccggcgca

SEQ ID NO: 3175896 - RNA, 20 nt, Mycobacterium bovis subsp bovis AF2122/97
agcagcgggcugcgcuaccc

SEQ ID NO: 3175897 - RNA, 14 nt, Mycobacterium bovis subsp bovis AF2122/97
agcagcggugcagc

SEQ ID NO: 3175898 - RNA, 16 nt, Mycobacterium bovis subsp bovis AF2122/97
agcagcggugcagccc

SEQ ID NO: 3175899 - RNA, 17 nt, Mycobacterium bovis subsp bovis AF2122/97
agcagcggugcagcccg

SEQ ID NO: 3175900 - RNA, 15 nt, Mycobacterium bovis subsp bovis AF2122/97
agcagcgucggugcc

SEQ ID NO: 3175901 - RNA, 16 nt, Mycobacterium bovis subsp bovis AF2122/97
agcagcgucggugcca

SEQ ID NO: 3175902 - RNA, 19 nt, Mycobacterium bovis subsp bovis AF2122/97
agcagcgugaccaccgccg

SEQ ID NO: 3175903 - RNA, 22 nt, Mycobacterium bovis subsp bovis AF2122/97
agcagcgugaccaccgccgaca

SEQ ID NO: 3175904 - RNA, 20 nt, Mycobacterium bovis subsp bovis AF2122/97
agcagcucaaugucgaagac

SEQ ID NO: 3175905 - RNA, 12 nt, Mycobacterium bovis subsp bovis AF2122/97
agcagcucgccg

SEQ ID NO: 3175906 - RNA, 16 nt, Mycobacterium bovis subsp bovis AF2122/97
agcagcucgccggcac

SEQ ID NO: 3175907 - RNA, 18 nt, Mycobacterium bovis subsp bovis AF2122/97
agcagcucgccggcacgc

SEQ ID NO: 3175908 - RNA, 21 nt, Mycobacterium bovis subsp bovis AF2122/97
agcagcugaaaauaggccggg

SEQ ID NO: 3175909 - RNA, 19 nt, Mycobacterium bovis subsp bovis AF2122/97
agcagcugggcaucaccgc

SEQ ID NO: 3175910 - RNA, 12 nt, Mycobacterium bovis subsp bovis AF2122/97
agcagcuggucg

SEQ ID NO: 3175911 - RNA, 16 nt, Mycobacterium bovis subsp bovis AF2122/97
agcagcuguuggcgug

SEQ ID NO: 3175912 - RNA, 17 nt, Mycobacterium bovis subsp bovis AF2122/97
agcagcuugacaucggu

SEQ ID NO: 3175913 - RNA, 15 nt, Mycobacterium bovis subsp bovis AF2122/97
agcaggaucggcagc

SEQ ID NO: 3175914 - RNA, 21 nt, Mycobacterium bovis subsp bovis AF2122/97
agcaggaugcgaucgucacgc

SEQ ID NO: 3175915 - RNA, 13 nt, Mycobacterium bovis subsp bovis AF2122/97
agcaggcauuccc

SEQ ID NO: 3175916 - RNA, 13 nt, Mycobacterium bovis subsp bovis AF2122/97
agcaggcccauac

SEQ ID NO: 3175917 - RNA, 16 nt, Mycobacterium bovis subsp bovis AF2122/97
agcaggccgggacagc

SEQ ID NO: 3175918 - RNA, 18 nt, Mycobacterium bovis subsp bovis AF2122/97
agcaggccgggacagcgc

SEQ ID NO: 3175919 - RNA, 16 nt, Mycobacterium bovis subsp bovis AF2122/97
agcaggcgaugcgcca

SEQ ID NO: 3175920 - RNA, 13 nt, Mycobacterium bovis subsp bovis AF2122/97
agcaggcgcacca

SEQ ID NO: 3175921 - RNA, 14 nt, Mycobacterium bovis subsp bovis AF2122/97
agcaggcggcugaa

SEQ ID NO: 3175922 - RNA, 20 nt, Mycobacterium bovis subsp bovis AF2122/97
agcaggcggcugaacggcag

SEQ ID NO: 3175923 - RNA, 20 nt, Mycobacterium bovis subsp bovis AF2122/97
agcaggcucgaaccgacgcg

SEQ ID NO: 3175924 - RNA, 16 nt, Mycobacterium bovis subsp bovis AF2122/97
agcagggauucuggau

SEQ ID NO: 3175925 - RNA, 14 nt, Mycobacterium bovis subsp bovis AF2122/97
agcagggccaccac

SEQ ID NO: 3175926 - RNA, 17 nt, Mycobacterium bovis subsp bovis AF2122/97
agcagggccaccaccac

SEQ ID NO: 3175927 - RNA, 13 nt, Mycobacterium bovis subsp bovis AF2122/97
agcagggcgcgca

SEQ ID NO: 3175928 - RNA, 14 nt, Mycobacterium bovis subsp bovis AF2122/97
agcagggcggcgaa

SEQ ID NO: 3175929 - RNA, 15 nt, Mycobacterium bovis subsp bovis AF2122/97
agcagggcggcgaac

SEQ ID NO: 3175930 - RNA, 16 nt, Mycobacterium bovis subsp bovis AF2122/97
agcagggcggcgaacu

SEQ ID NO: 3175931 - RNA, 18 nt, Mycobacterium bovis subsp bovis AF2122/97
agcaggggacgggcggcc

SEQ ID NO: 3175932 - RNA, 17 nt, Mycobacterium bovis subsp bovis AF2122/97
agcaggggaucguccgg

SEQ ID NO: 3175933 - RNA, 20 nt, Mycobacterium bovis subsp bovis AF2122/97
agcagggugccggcgccgcc

SEQ ID NO: 3175934 - RNA, 17 nt, Mycobacterium bovis subsp bovis AF2122/97
agcagggugugcgucug

SEQ ID NO: 3175935 - RNA, 20 nt, Mycobacterium bovis subsp bovis AF2122/97
agcagguacaucaccacgau

SEQ ID NO: 3175936 - RNA, 14 nt, Mycobacterium bovis subsp bovis AF2122/97
agcagguacucgcc

SEQ ID NO: 3175937 - RNA, 22 nt, Mycobacterium bovis subsp bovis AF2122/97
agccacgcaugggccaggucag

SEQ ID NO: 3175938 - RNA, 20 nt, Mycobacterium bovis subsp bovis AF2122/97
agccacgccagccaggcgaa

SEQ ID NO: 3175939 - RNA, 21 nt, Mycobacterium bovis subsp bovis AF2122/97
agccacgcccacaggggcagc

SEQ ID NO: 3175940 - RNA, 18 nt, Mycobacterium bovis subsp bovis AF2122/97
agccacgcugucccgcgg

SEQ ID NO: 3175941 - RNA, 16 nt, Mycobacterium bovis subsp bovis AF2122/97
agccacggcuucgccg

SEQ ID NO: 3175942 - RNA, 23 nt, Mycobacterium bovis subsp bovis AF2122/97
agccacggcuucgccgcgggaca

SEQ ID NO: 3175943 - RNA, 17 nt, Mycobacterium bovis subsp bovis AF2122/97
agccacguuacgcucgc

SEQ ID NO: 3175944 - RNA, 14 nt, Mycobacterium bovis subsp bovis AF2122/97
agccacucgaucac

SEQ ID NO: 3175945 - RNA, 14 nt, Mycobacterium bovis subsp bovis AF2122/97
agccacucgcgcac

SEQ ID NO: 3175946 - RNA, 22 nt, Mycobacterium bovis subsp bovis AF2122/97
agccagaccaacaugaacguca

SEQ ID NO: 3175947 - RNA, 14 nt, Mycobacterium bovis subsp bovis AF2122/97
agccagaucagccg

SEQ ID NO: 3175948 - RNA, 18 nt, Mycobacterium bovis subsp bovis AF2122/97
agccagcaacaccagaug

SEQ ID NO: 3175949 - RNA, 22 nt, Mycobacterium bovis subsp bovis AF2122/97
agccagcaacaccagaugcacc

SEQ ID NO: 3175950 - RNA, 23 nt, Mycobacterium bovis subsp bovis AF2122/97
agccagcaccuagucgcggccgu

SEQ ID NO: 3175951 - RNA, 20 nt, Mycobacterium bovis subsp bovis AF2122/97
agccagcacugccaucgcgg

SEQ ID NO: 3175952 - RNA, 20 nt, Mycobacterium bovis subsp bovis AF2122/97
agccagcaucggcagcagcg

SEQ ID NO: 3175953 - RNA, 13 nt, Mycobacterium bovis subsp bovis AF2122/97
agccagccaccga

SEQ ID NO: 3175954 - RNA, 13 nt, Mycobacterium bovis subsp bovis AF2122/97
agccagccaccgg

SEQ ID NO: 3175955 - RNA, 22 nt, Mycobacterium bovis subsp bovis AF2122/97
agccagccaccggggaagaucu

SEQ ID NO: 3175956 - RNA, 17 nt, Mycobacterium bovis subsp bovis AF2122/97
agccagcccagccgcca

SEQ ID NO: 3175957 - RNA, 22 nt, Mycobacterium bovis subsp bovis AF2122/97
agccagccgaaacauugcccgu

SEQ ID NO: 3175958 - RNA, 13 nt, Mycobacterium bovis subsp bovis AF2122/97
agccagccugcug

SEQ ID NO: 3175959 - RNA, 15 nt, Mycobacterium bovis subsp bovis AF2122/97
agccagcgcagccag

SEQ ID NO: 3175960 - RNA, 19 nt, Mycobacterium bovis subsp bovis AF2122/97
agccagcgcagccaggcug

SEQ ID NO: 3175961 - RNA, 14 nt, Mycobacterium bovis subsp bovis AF2122/97
agccagcggcgaag

SEQ ID NO: 3175962 - RNA, 18 nt, Mycobacterium bovis subsp bovis AF2122/97
agccagcggcugcccauc

SEQ ID NO: 3175963 - RNA, 16 nt, Mycobacterium bovis subsp bovis AF2122/97
agccagcgggcgauga

SEQ ID NO: 3175964 - RNA, 22 nt, Mycobacterium bovis subsp bovis AF2122/97
agccagcgggcgaugagcgcga

SEQ ID NO: 3175965 - RNA, 22 nt, Mycobacterium bovis subsp bovis AF2122/97
agccagcgguagcugcccagcg

SEQ ID NO: 3175966 - RNA, 17 nt, Mycobacterium bovis subsp bovis AF2122/97
agccagcguccaugguc

SEQ ID NO: 3175967 - RNA, 20 nt, Mycobacterium bovis subsp bovis AF2122/97
agccagcgucucaaggccuu

SEQ ID NO: 3175968 - RNA, 17 nt, Mycobacterium bovis subsp bovis AF2122/97
agccagcguuggcggcg

SEQ ID NO: 3175969 - RNA, 14 nt, Mycobacterium bovis subsp bovis AF2122/97
agccagcugaacac

SEQ ID NO: 3175970 - RNA, 18 nt, Mycobacterium bovis subsp bovis AF2122/97
agccagcuugcgcaacgu

SEQ ID NO: 3175971 - RNA, 18 nt, Mycobacterium bovis subsp bovis AF2122/97
agccaggaagcgguggcc

SEQ ID NO: 3175972 - RNA, 17 nt, Mycobacterium bovis subsp bovis AF2122/97
agccaggcaaccgguca

SEQ ID NO: 3175973 - RNA, 12 nt, Mycobacterium bovis subsp bovis AF2122/97
agccaggccagu

SEQ ID NO: 3175974 - RNA, 19 nt, Mycobacterium bovis subsp bovis AF2122/97
agccaggccagugccaccu

SEQ ID NO: 3175975 - RNA, 15 nt, Mycobacterium bovis subsp bovis AF2122/97
agccaggcccggcuu

SEQ ID NO: 3175976 - RNA, 11 nt, Mycobacterium bovis subsp bovis AF2122/97
agccaggcgaa

SEQ ID NO: 3175977 - RNA, 14 nt, Mycobacterium bovis subsp bovis AF2122/97
agccaggcgauugc

SEQ ID NO: 3175978 - RNA, 21 nt, Mycobacterium bovis subsp bovis AF2122/97
agccaggcgcgcuaccagcuc

SEQ ID NO: 3175979 - RNA, 17 nt, Mycobacterium bovis subsp bovis AF2122/97
agccaggcggcaaggac

SEQ ID NO: 3175980 - RNA, 19 nt, Mycobacterium bovis subsp bovis AF2122/97
agccaggcggcaaggacgg

SEQ ID NO: 3175981 - RNA, 21 nt, Mycobacterium bovis subsp bovis AF2122/97
agccagggauuuccagcagug

SEQ ID NO: 3175982 - RNA, 14 nt, Mycobacterium bovis subsp bovis AF2122/97
agccaggucgauac

SEQ ID NO: 3175983 - RNA, 22 nt, Mycobacterium bovis subsp bovis AF2122/97
agccaggucgauaccggcgugc

SEQ ID NO: 3175984 - RNA, 20 nt, Mycobacterium bovis subsp bovis AF2122/97
agccaggugucgucgaucgc

SEQ ID NO: 3175985 - RNA, 16 nt, Mycobacterium bovis subsp bovis AF2122/97
agccaguaccagguac

SEQ ID NO: 3175986 - RNA, 21 nt, Mycobacterium bovis subsp bovis AF2122/97
agccaguaccagguacgggag

SEQ ID NO: 3175987 - RNA, 13 nt, Mycobacterium bovis subsp bovis AF2122/97
agccagucggcca

SEQ ID NO: 3175988 - RNA, 15 nt, Mycobacterium bovis subsp bovis AF2122/97
agccagucggccacc

SEQ ID NO: 3175989 - RNA, 22 nt, Mycobacterium bovis subsp bovis AF2122/97
agccaguguugcaguggcgacg

SEQ ID NO: 3175990 - RNA, 18 nt, Mycobacterium bovis subsp bovis AF2122/97
agccauagugcggcagcg

SEQ ID NO: 3175991 - RNA, 13 nt, Mycobacterium bovis subsp bovis AF2122/97
agccaucaccgca

SEQ ID NO: 3175992 - RNA, 19 nt, Mycobacterium bovis subsp bovis AF2122/97
agccaugccgcucggcaac

SEQ ID NO: 3175993 - RNA, 18 nt, Mycobacterium bovis subsp bovis AF2122/97
agccauguggcgucgcuc

SEQ ID NO: 3175994 - RNA, 20 nt, Mycobacterium bovis subsp bovis AF2122/97
agccauguggcgucgcucgu

SEQ ID NO: 3175995 - RNA, 19 nt, Mycobacterium bovis subsp bovis AF2122/97
agccauucgguguggccgu

SEQ ID NO: 3175996 - RNA, 17 nt, Mycobacterium bovis subsp bovis AF2122/97
agccauuuccuuggcgc

SEQ ID NO: 3175997 - RNA, 18 nt, Mycobacterium bovis subsp bovis AF2122/97
agcccaaaaagaccgccg

SEQ ID NO: 3175998 - RNA, 17 nt, Mycobacterium bovis subsp bovis AF2122/97
agcccaagccgaucggu

SEQ ID NO: 3175999 - RNA, 15 nt, Mycobacterium bovis subsp bovis AF2122/97
agcccaaggggcagc

SEQ ID NO: 3176000 - RNA, 21 nt, Mycobacterium bovis subsp bovis AF2122/97
agcccaaggggcagcgacggc

SEQ ID NO: 3176001 - RNA, 21 nt, Mycobacterium bovis subsp bovis AF2122/97
agcccaauccgcaacagcucg

SEQ ID NO: 3176002 - RNA, 21 nt, Mycobacterium bovis subsp bovis AF2122/97
agcccacacgcucacgggcuc

SEQ ID NO: 3176003 - RNA, 15 nt, Mycobacterium bovis subsp bovis AF2122/97
agcccacaggcggcg

SEQ ID NO: 3176004 - RNA, 16 nt, Mycobacterium bovis subsp bovis AF2122/97
agcccacaggcggcgc

SEQ ID NO: 3176005 - RNA, 13 nt, Mycobacterium bovis subsp bovis AF2122/97
agcccaccacuag

SEQ ID NO: 3176006 - RNA, 15 nt, Mycobacterium bovis subsp bovis AF2122/97
agcccacccauggcc

SEQ ID NO: 3176007 - RNA, 18 nt, Mycobacterium bovis subsp bovis AF2122/97
agcccacccauggccucc

SEQ ID NO: 3176008 - RNA, 20 nt, Mycobacterium bovis subsp bovis AF2122/97
agcccacccauggccuccca

SEQ ID NO: 3176009 - RNA, 18 nt, Mycobacterium bovis subsp bovis AF2122/97
agcccaccggcgccgccg

SEQ ID NO: 3176010 - RNA, 17 nt, Mycobacterium bovis subsp bovis AF2122/97
agcccacgacgaagucg

SEQ ID NO: 3176011 - RNA, 14 nt, Mycobacterium bovis subsp bovis AF2122/97
agcccacgaucgcg

SEQ ID NO: 3176012 - RNA, 14 nt, Mycobacterium bovis subsp bovis AF2122/97
agcccacgcgccac

SEQ ID NO: 3176013 - RNA, 18 nt, Mycobacterium bovis subsp bovis AF2122/97
agcccacucgucgaacac

SEQ ID NO: 3176014 - RNA, 14 nt, Mycobacterium bovis subsp bovis AF2122/97
agcccagaucuugc

SEQ ID NO: 3176015 - RNA, 22 nt, Mycobacterium bovis subsp bovis AF2122/97
agcccagcagguuccacggcca

SEQ ID NO: 3176016 - RNA, 17 nt, Mycobacterium bovis subsp bovis AF2122/97
agcccagccgcgggccg

SEQ ID NO: 3176017 - RNA, 17 nt, Mycobacterium bovis subsp bovis AF2122/97
agcccagccgggcaccc

SEQ ID NO: 3176018 - RNA, 19 nt, Mycobacterium bovis subsp bovis AF2122/97
agcccagccguucgucgcg

SEQ ID NO: 3176019 - RNA, 16 nt, Mycobacterium bovis subsp bovis AF2122/97
agcccagcgccuccag

SEQ ID NO: 3176020 - RNA, 15 nt, Mycobacterium bovis subsp bovis AF2122/97
agcccaggugggccg

SEQ ID NO: 3176021 - RNA, 17 nt, Mycobacterium bovis subsp bovis AF2122/97
agcccaugccgaugccc

SEQ ID NO: 3176022 - RNA, 19 nt, Mycobacterium bovis subsp bovis AF2122/97
agcccaugccgaugcccau

SEQ ID NO: 3176023 - RNA, 16 nt, Mycobacterium bovis subsp bovis AF2122/97
agcccggcgcuuccgc

SEQ ID NO: 3176024 - RNA, 16 nt, Mycobacterium bovis subsp bovis AF2122/97
agcccggcggcagcug

SEQ ID NO: 3176025 - RNA, 14 nt, Mycobacterium bovis subsp bovis AF2122/97
agcccggcggccgc

SEQ ID NO: 3176026 - RNA, 22 nt, Mycobacterium bovis subsp bovis AF2122/97
agcccggcggccgcuucggcgg

SEQ ID NO: 3176027 - RNA, 13 nt, Mycobacterium bovis subsp bovis AF2122/97
agcccggcggcgg

SEQ ID NO: 3176028 - RNA, 17 nt, Mycobacterium bovis subsp bovis AF2122/97
agcccggcggcggucac

SEQ ID NO: 3176029 - RNA, 17 nt, Mycobacterium bovis subsp bovis AF2122/97
agcccggcguuguugac

SEQ ID NO: 3176030 - RNA, 18 nt, Mycobacterium bovis subsp bovis AF2122/97
agcccgggauaccgcuca

SEQ ID NO: 3176031 - RNA, 12 nt, Mycobacterium bovis subsp bovis AF2122/97
agcccgggcagc

SEQ ID NO: 3176032 - RNA, 12 nt, Mycobacterium bovis subsp bovis AF2122/97
agcccggggaga

SEQ ID NO: 3176033 - RNA, 19 nt, Mycobacterium bovis subsp bovis AF2122/97
agcccggggagacgagcac

SEQ ID NO: 3176034 - RNA, 15 nt, Mycobacterium bovis subsp bovis AF2122/97
agcccggggaugccu

SEQ ID NO: 3176035 - RNA, 23 nt, Mycobacterium bovis subsp bovis AF2122/97
agcccgggugaaacgauggcgau

SEQ ID NO: 3176036 - RNA, 15 nt, Mycobacterium bovis subsp bovis AF2122/97
agcccgguacgccgc

SEQ ID NO: 3176037 - RNA, 18 nt, Mycobacterium bovis subsp bovis AF2122/97
agcccgguacgccgcgcc

SEQ ID NO: 3176038 - RNA, 19 nt, Mycobacterium bovis subsp bovis AF2122/97
agcccgguacgccgcgccg

SEQ ID NO: 3176039 - RNA, 20 nt, Mycobacterium bovis subsp bovis AF2122/97
agcccgguacgccgcgccga

SEQ ID NO: 3176040 - RNA, 23 nt, Mycobacterium bovis subsp bovis AF2122/97
agcccgguacgccgcgccgaauc

SEQ ID NO: 3176041 - RNA, 17 nt, Mycobacterium bovis subsp bovis AF2122/97
agcccgguaucgucccg

SEQ ID NO: 3176042 - RNA, 20 nt, Mycobacterium bovis subsp bovis AF2122/97
agcccgguaucgucccggcg

SEQ ID NO: 3176043 - RNA, 18 nt, Mycobacterium bovis subsp bovis AF2122/97
agcccggucauggucagc

SEQ ID NO: 3176044 - RNA, 20 nt, Mycobacterium bovis subsp bovis AF2122/97
agcccggucgcugauccggg

SEQ ID NO: 3176045 - RNA, 19 nt, Mycobacterium bovis subsp bovis AF2122/97
agcccggugcuaccggcuu

SEQ ID NO: 3176046 - RNA, 18 nt, Mycobacterium bovis subsp bovis AF2122/97
agcccguagccgaucagu

SEQ ID NO: 3176047 - RNA, 17 nt, Mycobacterium bovis subsp bovis AF2122/97
agcccgucagcuccccg

SEQ ID NO: 3176048 - RNA, 21 nt, Mycobacterium bovis subsp bovis AF2122/97
agcccgucagcuccccgucgg

SEQ ID NO: 3176049 - RNA, 16 nt, Mycobacterium bovis subsp bovis AF2122/97
agcccguccggccccc

SEQ ID NO: 3176050 - RNA, 14 nt, Mycobacterium bovis subsp bovis AF2122/97
agcccgucgcggcc

SEQ ID NO: 3176051 - RNA, 17 nt, Mycobacterium bovis subsp bovis AF2122/97
agcccgucgcggccggc

SEQ ID NO: 3176052 - RNA, 19 nt, Mycobacterium bovis subsp bovis AF2122/97
agcccgucgcggccggcgg

SEQ ID NO: 3176053 - RNA, 20 nt, Mycobacterium bovis subsp bovis AF2122/97
agcccgucgcggccggcggc

SEQ ID NO: 3176054 - RNA, 23 nt, Mycobacterium bovis subsp bovis AF2122/97
agcccgucgcggccggcggccgc

SEQ ID NO: 3176055 - RNA, 13 nt, Mycobacterium bovis subsp bovis AF2122/97
agcccgucgucgg

SEQ ID NO: 3176056 - RNA, 16 nt, Mycobacterium bovis subsp bovis AF2122/97
agcccguucgaaguuc

SEQ ID NO: 3176057 - RNA, 16 nt, Mycobacterium bovis subsp bovis AF2122/97
agcccguugaccugcg

SEQ ID NO: 3176058 - RNA, 22 nt, Mycobacterium bovis subsp bovis AF2122/97
agcccguugguagccggugacc

SEQ ID NO: 3176059 - RNA, 14 nt, Mycobacterium bovis subsp bovis AF2122/97
agcccuaucagccg

SEQ ID NO: 3176060 - RNA, 15 nt, Mycobacterium bovis subsp bovis AF2122/97
agcccuaucagccga

SEQ ID NO: 3176061 - RNA, 21 nt, Mycobacterium bovis subsp bovis AF2122/97
agcccuaucagccgagacacc

SEQ ID NO: 3176062 - RNA, 13 nt, Mycobacterium bovis subsp bovis AF2122/97
agcccuccgagca

SEQ ID NO: 3176063 - RNA, 15 nt, Mycobacterium bovis subsp bovis AF2122/97
agcccuccgagcaca

SEQ ID NO: 3176064 - RNA, 16 nt, Mycobacterium bovis subsp bovis AF2122/97
agcccugaccggggug

SEQ ID NO: 3176065 - RNA, 23 nt, Mycobacterium bovis subsp bovis AF2122/97
agcccugcgccucggcggccagc

SEQ ID NO: 3176066 - RNA, 17 nt, Mycobacterium bovis subsp bovis AF2122/97
agcccuguuugacugcg

SEQ ID NO: 3176067 - RNA, 19 nt, Mycobacterium bovis subsp bovis AF2122/97
agcccuucagcgaagccgg

SEQ ID NO: 3176068 - RNA, 20 nt, Mycobacterium bovis subsp bovis AF2122/97
agcccuucagcgaagccggg

SEQ ID NO: 3176069 - RNA, 18 nt, Mycobacterium bovis subsp bovis AF2122/97
agcccuucagcguccugg

SEQ ID NO: 3176070 - RNA, 21 nt, Mycobacterium bovis subsp bovis AF2122/97
agcccuuguagcacaccgaca

SEQ ID NO: 3176071 - RNA, 14 nt, Mycobacterium bovis subsp bovis AF2122/97
agccgaacaccguc

SEQ ID NO: 3176072 - RNA, 17 nt, Mycobacterium bovis subsp bovis AF2122/97
agccgaacaccgucagc

SEQ ID NO: 3176073 - RNA, 14 nt, Mycobacterium bovis subsp bovis AF2122/97
agccgaacccaagg

SEQ ID NO: 3176074 - RNA, 14 nt, Mycobacterium bovis subsp bovis AF2122/97
agccgaacgacagc

SEQ ID NO: 3176075 - RNA, 15 nt, Mycobacterium bovis subsp bovis AF2122/97
agccgaagaaccggu

SEQ ID NO: 3176076 - RNA, 17 nt, Mycobacterium bovis subsp bovis AF2122/97
agccgaagaaccggucg

SEQ ID NO: 3176077 - RNA, 21 nt, Mycobacterium bovis subsp bovis AF2122/97
agccgaagaaccggucgcagu

SEQ ID NO: 3176078 - RNA, 13 nt, Mycobacterium bovis subsp bovis AF2122/97
agccgaagccgaa

SEQ ID NO: 3176079 - RNA, 14 nt, Mycobacterium bovis subsp bovis AF2122/97
agccgaagcgcccg

SEQ ID NO: 3176080 - RNA, 15 nt, Mycobacterium bovis subsp bovis AF2122/97
agccgaagcgcccgg

SEQ ID NO: 3176081 - RNA, 19 nt, Mycobacterium bovis subsp bovis AF2122/97
agccgaagcgcccguuggc

SEQ ID NO: 3176082 - RNA, 17 nt, Mycobacterium bovis subsp bovis AF2122/97
agccgaaggggaacgcg

SEQ ID NO: 3176083 - RNA, 21 nt, Mycobacterium bovis subsp bovis AF2122/97
agccgacaacgacgucgccga

SEQ ID NO: 3176084 - RNA, 19 nt, Mycobacterium bovis subsp bovis AF2122/97
agccgacagauggucgguc

SEQ ID NO: 3176085 - RNA, 19 nt, Mycobacterium bovis subsp bovis AF2122/97
agccgacagcucaucgauc

SEQ ID NO: 3176086 - RNA, 13 nt, Mycobacterium bovis subsp bovis AF2122/97
agccgacaucggc

SEQ ID NO: 3176087 - RNA, 17 nt, Mycobacterium bovis subsp bovis AF2122/97
agccgacaucggcggcc

SEQ ID NO: 3176088 - RNA, 18 nt, Mycobacterium bovis subsp bovis AF2122/97
agccgacaucggcggccc

SEQ ID NO: 3176089 - RNA, 16 nt, Mycobacterium bovis subsp bovis AF2122/97
agccgaccaccgccgg

SEQ ID NO: 3176090 - RNA, 12 nt, Mycobacterium bovis subsp bovis AF2122/97
agccgaccagcg

SEQ ID NO: 3176091 - RNA, 13 nt, Mycobacterium bovis subsp bovis AF2122/97
agccgaccaggac

SEQ ID NO: 3176092 - RNA, 17 nt, Mycobacterium bovis subsp bovis AF2122/97
agccgaccaggaccacc

SEQ ID NO: 3176093 - RNA, 18 nt, Mycobacterium bovis subsp bovis AF2122/97
agccgaccaggaccaccg

SEQ ID NO: 3176094 - RNA, 12 nt, Mycobacterium bovis subsp bovis AF2122/97
agccgacccgac

SEQ ID NO: 3176095 - RNA, 14 nt, Mycobacterium bovis subsp bovis AF2122/97
agccgacccgacgc

SEQ ID NO: 3176096 - RNA, 16 nt, Mycobacterium bovis subsp bovis AF2122/97
agccgacccgcccgaa

SEQ ID NO: 3176097 - RNA, 12 nt, Mycobacterium bovis subsp bovis AF2122/97
agccgaccgacc

SEQ ID NO: 3176098 - RNA, 15 nt, Mycobacterium bovis subsp bovis AF2122/97
agccgaccgaccgca

SEQ ID NO: 3176099 - RNA, 23 nt, Mycobacterium bovis subsp bovis AF2122/97
agccgaccgaccuggucggugac

SEQ ID NO: 3176100 - RNA, 14 nt, Mycobacterium bovis subsp bovis AF2122/97
agccgaccggcagc

SEQ ID NO: 3176101 - RNA, 14 nt, Mycobacterium bovis subsp bovis AF2122/97
agccgaccggcggc

SEQ ID NO: 3176102 - RNA, 22 nt, Mycobacterium bovis subsp bovis AF2122/97
agccgaccguaccgauccaguu

SEQ ID NO: 3176103 - RNA, 16 nt, Mycobacterium bovis subsp bovis AF2122/97
agccgaccucacggca

SEQ ID NO: 3176104 - RNA, 16 nt, Mycobacterium bovis subsp bovis AF2122/97
agccgaccucgagugc

SEQ ID NO: 3176105 - RNA, 17 nt, Mycobacterium bovis subsp bovis AF2122/97
agccgacgaacgacggg

SEQ ID NO: 3176106 - RNA, 17 nt, Mycobacterium bovis subsp bovis AF2122/97
agccgacgaccagcaga

SEQ ID NO: 3176107 - RNA, 16 nt, Mycobacterium bovis subsp bovis AF2122/97
agccgacgauccacgg

SEQ ID NO: 3176108 - RNA, 17 nt, Mycobacterium bovis subsp bovis AF2122/97
agccgacgauccacggc

SEQ ID NO: 3176109 - RNA, 22 nt, Mycobacterium bovis subsp bovis AF2122/97
agccgacgauccacggcgaugc

SEQ ID NO: 3176110 - RNA, 18 nt, Mycobacterium bovis subsp bovis AF2122/97
agccgccggugccgccgg

SEQ ID NO: 3176111 - RNA, 18 nt, Mycobacterium bovis subsp bovis AF2122/97
agccgccgucgccggugc

SEQ ID NO: 3176112 - RNA, 19 nt, Mycobacterium bovis subsp bovis AF2122/97
agccgccgucgccggugcc

SEQ ID NO: 3176113 - RNA, 20 nt, Mycobacterium bovis subsp bovis AF2122/97
agccgccgucgccggugccg

SEQ ID NO: 3176114 - RNA, 13 nt, Mycobacterium bovis subsp bovis AF2122/97
agccgccguugcc

SEQ ID NO: 3176115 - RNA, 17 nt, Mycobacterium bovis subsp bovis AF2122/97
agccgccguugccgccg

SEQ ID NO: 3176116 - RNA, 20 nt, Mycobacterium bovis subsp bovis AF2122/97
agccgccguugccgccggcg

SEQ ID NO: 3176117 - RNA, 23 nt, Mycobacterium bovis subsp bovis AF2122/97
agccgccguugccgccggcgccg

SEQ ID NO: 3176118 - RNA, 23 nt, Mycobacterium bovis subsp bovis AF2122/97
agccgccuaggacuucggugagc

SEQ ID NO: 3176119 - RNA, 13 nt, Mycobacterium bovis subsp bovis AF2122/97
agccgccucaaug

SEQ ID NO: 3176120 - RNA, 15 nt, Mycobacterium bovis subsp bovis AF2122/97
agccgccugucgggc

SEQ ID NO: 3176121 - RNA, 21 nt, Mycobacterium bovis subsp bovis AF2122/97
agccgcgaaauuacuucggcc

SEQ ID NO: 3176122 - RNA, 15 nt, Mycobacterium bovis subsp bovis AF2122/97
agccgcgacauccgc

SEQ ID NO: 3176123 - RNA, 22 nt, Mycobacterium bovis subsp bovis AF2122/97
agccgcgacauccgcggcaugc

SEQ ID NO: 3176124 - RNA, 15 nt, Mycobacterium bovis subsp bovis AF2122/97
agccgcgaccgcagc

SEQ ID NO: 3176125 - RNA, 16 nt, Mycobacterium bovis subsp bovis AF2122/97
agccgcgacgcggcgu

SEQ ID NO: 3176126 - RNA, 16 nt, Mycobacterium bovis subsp bovis AF2122/97
agccgcgcaucugucg

SEQ ID NO: 3176127 - RNA, 13 nt, Mycobacterium bovis subsp bovis AF2122/97
agccgcgccgacc

SEQ ID NO: 3176128 - RNA, 23 nt, Mycobacterium bovis subsp bovis AF2122/97
agccgcgccgaccucaucggcac

SEQ ID NO: 3176129 - RNA, 17 nt, Mycobacterium bovis subsp bovis AF2122/97
agccgcgccgcggcccg

SEQ ID NO: 3176130 - RNA, 13 nt, Mycobacterium bovis subsp bovis AF2122/97
agccgcgccgggu

SEQ ID NO: 3176131 - RNA, 19 nt, Mycobacterium bovis subsp bovis AF2122/97
agccgcgcgccaucgccuc

SEQ ID NO: 3176132 - RNA, 13 nt, Mycobacterium bovis subsp bovis AF2122/97
agccgcgcgccgg

SEQ ID NO: 3176133 - RNA, 15 nt, Mycobacterium bovis subsp bovis AF2122/97
agccgcgcgccggcc

SEQ ID NO: 3176134 - RNA, 16 nt, Mycobacterium bovis subsp bovis AF2122/97
agccgcgcgccggcca

SEQ ID NO: 3176135 - RNA, 13 nt, Mycobacterium bovis subsp bovis AF2122/97
agccgcgcgguac

SEQ ID NO: 3176136 - RNA, 20 nt, Mycobacterium bovis subsp bovis AF2122/97
agccgcgcgguacugcgcag

SEQ ID NO: 3176137 - RNA, 17 nt, Mycobacterium bovis subsp bovis AF2122/97
agccgcgcuagcucggc

SEQ ID NO: 3176138 - RNA, 22 nt, Mycobacterium bovis subsp bovis AF2122/97
agccgcggaucauccuucgccg

SEQ ID NO: 3176139 - RNA, 23 nt, Mycobacterium bovis subsp bovis AF2122/97
agccgcggaucauccuucgccgg

SEQ ID NO: 3176140 - RNA, 17 nt, Mycobacterium bovis subsp bovis AF2122/97
agccgcggcaacaccac

SEQ ID NO: 3176141 - RNA, 17 nt, Mycobacterium bovis subsp bovis AF2122/97
agccgcggcaccgccga

SEQ ID NO: 3176142 - RNA, 18 nt, Mycobacterium bovis subsp bovis AF2122/97
agccgcggcaccgccgag

SEQ ID NO: 3176143 - RNA, 19 nt, Mycobacterium bovis subsp bovis AF2122/97
agccgcggcaccgccgagc

SEQ ID NO: 3176144 - RNA, 22 nt, Mycobacterium bovis subsp bovis AF2122/97
agccgcggccacaaugcggccg

SEQ ID NO: 3176145 - RNA, 17 nt, Mycobacterium bovis subsp bovis AF2122/97
agccgcggccacaugau

SEQ ID NO: 3176146 - RNA, 13 nt, Mycobacterium bovis subsp bovis AF2122/97
agccgcggccacg

SEQ ID NO: 3176147 - RNA, 12 nt, Mycobacterium bovis subsp bovis AF2122/97
agccgcggcccu

SEQ ID NO: 3176148 - RNA, 17 nt, Mycobacterium bovis subsp bovis AF2122/97
agccgcggcccucgaug

SEQ ID NO: 3176149 - RNA, 22 nt, Mycobacterium bovis subsp bovis AF2122/97
agccgcggcgccauagccgcga

SEQ ID NO: 3176150 - RNA, 18 nt, Mycobacterium bovis subsp bovis AF2122/97
agccgcggcuaggccagc

SEQ ID NO: 3176151 - RNA, 21 nt, Mycobacterium bovis subsp bovis AF2122/97
agccgcggcuaggccagcacg

SEQ ID NO: 3176152 - RNA, 12 nt, Mycobacterium bovis subsp bovis AF2122/97
agccgcggucac

SEQ ID NO: 3176153 - RNA, 13 nt, Mycobacterium bovis subsp bovis AF2122/97
agccgcggucggc

SEQ ID NO: 3176154 - RNA, 17 nt, Mycobacterium bovis subsp bovis AF2122/97
agccgcggucggcgugc

SEQ ID NO: 3176155 - RNA, 21 nt, Mycobacterium bovis subsp bovis AF2122/97
agccgcggucggcgugcaggg

SEQ ID NO: 3176156 - RNA, 23 nt, Mycobacterium bovis subsp bovis AF2122/97
agccgcggucggcgugcaggguc

SEQ ID NO: 3176157 - RNA, 21 nt, Mycobacterium bovis subsp bovis AF2122/97
agccgcgugggccgcugcaua

SEQ ID NO: 3176158 - RNA, 18 nt, Mycobacterium bovis subsp bovis AF2122/97
agccgcguucgcgcaaau

SEQ ID NO: 3176159 - RNA, 21 nt, Mycobacterium bovis subsp bovis AF2122/97
agccgcguucgcgcaaaugcc

SEQ ID NO: 3176160 - RNA, 21 nt, Mycobacterium bovis subsp bovis AF2122/97
agccgcuacguuacgccgaga

SEQ ID NO: 3176161 - RNA, 20 nt, Mycobacterium bovis subsp bovis AF2122/97
agccgcuaggaucggauggc

SEQ ID NO: 3176162 - RNA, 22 nt, Mycobacterium bovis subsp bovis AF2122/97
agccgcucacccggucgcacuu

SEQ ID NO: 3176163 - RNA, 18 nt, Mycobacterium bovis subsp bovis AF2122/97
agccgcucaucgaucccg

SEQ ID NO: 3176164 - RNA, 21 nt, Mycobacterium bovis subsp bovis AF2122/97
agccgcuccgcccauucccag

SEQ ID NO: 3176165 - RNA, 15 nt, Mycobacterium bovis subsp bovis AF2122/97
agccgcucgauggcc

SEQ ID NO: 3176166 - RNA, 17 nt, Mycobacterium bovis subsp bovis AF2122/97
agccgcucgauggccug

SEQ ID NO: 3176167 - RNA, 17 nt, Mycobacterium bovis subsp bovis AF2122/97
agccgcugcacguggcc

SEQ ID NO: 3176168 - RNA, 23 nt, Mycobacterium bovis subsp bovis AF2122/97
agccgcugcacguggccacggca

SEQ ID NO: 3176169 - RNA, 13 nt, Mycobacterium bovis subsp bovis AF2122/97
agccgcugccaca

SEQ ID NO: 3176170 - RNA, 17 nt, Mycobacterium bovis subsp bovis AF2122/97
agccgcugcgccagguc

SEQ ID NO: 3176171 - RNA, 17 nt, Mycobacterium bovis subsp bovis AF2122/97
agccgcugcggcaccga

SEQ ID NO: 3176172 - RNA, 18 nt, Mycobacterium bovis subsp bovis AF2122/97
agccgcuuucccggcugg

SEQ ID NO: 3176173 - RNA, 19 nt, Mycobacterium bovis subsp bovis AF2122/97
agccggaccgcgacggcgc

SEQ ID NO: 3176174 - RNA, 22 nt, Mycobacterium bovis subsp bovis AF2122/97
agccggaugcgcuuccaucgcc

SEQ ID NO: 3176175 - RNA, 13 nt, Mycobacterium bovis subsp bovis AF2122/97
agccggauucggc

SEQ ID NO: 3176176 - RNA, 21 nt, Mycobacterium bovis subsp bovis AF2122/97
agccggauucggcugccaccg

SEQ ID NO: 3176177 - RNA, 22 nt, Mycobacterium bovis subsp bovis AF2122/97
agccggauucggcugccaccgc

SEQ ID NO: 3176178 - RNA, 14 nt, Mycobacterium bovis subsp bovis AF2122/97
agccggcaaccgac

SEQ ID NO: 3176179 - RNA, 14 nt, Mycobacterium bovis subsp bovis AF2122/97
agccggcagcagcg

SEQ ID NO: 3176180 - RNA, 20 nt, Mycobacterium bovis subsp bovis AF2122/97
agccggcagcagcgggcgcg

SEQ ID NO: 3176181 - RNA, 21 nt, Mycobacterium bovis subsp bovis AF2122/97
agccggcauagcggcccaucg

SEQ ID NO: 3176182 - RNA, 21 nt, Mycobacterium bovis subsp bovis AF2122/97
agccggccaauggccugcagc

SEQ ID NO: 3176183 - RNA, 22 nt, Mycobacterium bovis subsp bovis AF2122/97
agccggccacgcauuccagcag

SEQ ID NO: 3176184 - RNA, 18 nt, Mycobacterium bovis subsp bovis AF2122/97
agccggccauacgcgcgc

SEQ ID NO: 3176185 - RNA, 19 nt, Mycobacterium bovis subsp bovis AF2122/97
agccggccauacgcgcgcg

SEQ ID NO: 3176186 - RNA, 15 nt, Mycobacterium bovis subsp bovis AF2122/97
agccggcccgucgcg

SEQ ID NO: 3176187 - RNA, 23 nt, Mycobacterium bovis subsp bovis AF2122/97
agccggcccgucgcgucgaccgg

SEQ ID NO: 3176188 - RNA, 23 nt, Mycobacterium bovis subsp bovis AF2122/97
agccggcccugcucgccgucucg

SEQ ID NO: 3176189 - RNA, 24 nt, Mycobacterium bovis subsp bovis AF2122/97
agccggcccugcucgccgucucgg

SEQ ID NO: 3176190 - RNA, 13 nt, Mycobacterium bovis subsp bovis AF2122/97
agccggccgcgac

SEQ ID NO: 3176191 - RNA, 18 nt, Mycobacterium bovis subsp bovis AF2122/97
agccggccgcgaccgcga

SEQ ID NO: 3176192 - RNA, 17 nt, Mycobacterium bovis subsp bovis AF2122/97
agccggccgcuuggccg

SEQ ID NO: 3176193 - RNA, 16 nt, Mycobacterium bovis subsp bovis AF2122/97
agccggccugucccgc

SEQ ID NO: 3176194 - RNA, 12 nt, Mycobacterium bovis subsp bovis AF2122/97
agccggcgcagc

SEQ ID NO: 3176195 - RNA, 14 nt, Mycobacterium bovis subsp bovis AF2122/97
agccggcgcggcgg

SEQ ID NO: 3176196 - RNA, 18 nt, Mycobacterium bovis subsp bovis AF2122/97
agccgucucugacgaaug

SEQ ID NO: 3176197 - RNA, 14 nt, Mycobacterium bovis subsp bovis AF2122/97
agccgugauauccg

SEQ ID NO: 3176198 - RNA, 23 nt, Mycobacterium bovis subsp bovis AF2122/97
agccgugauauccguacagucca

SEQ ID NO: 3176199 - RNA, 15 nt, Mycobacterium bovis subsp bovis AF2122/97
agccgugcaccagcg

SEQ ID NO: 3176200 - RNA, 16 nt, Mycobacterium bovis subsp bovis AF2122/97
agccgugcccaagcuc

SEQ ID NO: 3176201 - RNA, 14 nt, Mycobacterium bovis subsp bovis AF2122/97
agccgugccguggu

SEQ ID NO: 3176202 - RNA, 15 nt, Mycobacterium bovis subsp bovis AF2122/97
agccgugccucgagg

SEQ ID NO: 3176203 - RNA, 16 nt, Mycobacterium bovis subsp bovis AF2122/97
agccgugcggcggcug

SEQ ID NO: 3176204 - RNA, 18 nt, Mycobacterium bovis subsp bovis AF2122/97
agccgugcggcggcugcc

SEQ ID NO: 3176205 - RNA, 14 nt, Mycobacterium bovis subsp bovis AF2122/97
agccgugcggucgc

SEQ ID NO: 3176206 - RNA, 15 nt, Mycobacterium bovis subsp bovis AF2122/97
agccgugcggucgcg

SEQ ID NO: 3176207 - RNA, 19 nt, Mycobacterium bovis subsp bovis AF2122/97
agccgugcggucgcgcccu

SEQ ID NO: 3176208 - RNA, 18 nt, Mycobacterium bovis subsp bovis AF2122/97
agccguggcagucgcacg

SEQ ID NO: 3176209 - RNA, 19 nt, Mycobacterium bovis subsp bovis AF2122/97
agccguggcagucgcacgg

SEQ ID NO: 3176210 - RNA, 16 nt, Mycobacterium bovis subsp bovis AF2122/97
agccguggcgcgacgu

SEQ ID NO: 3176211 - RNA, 12 nt, Mycobacterium bovis subsp bovis AF2122/97
agccguggcggc

SEQ ID NO: 3176212 - RNA, 15 nt, Mycobacterium bovis subsp bovis AF2122/97
agccgugggccacga

SEQ ID NO: 3176213 - RNA, 20 nt, Mycobacterium bovis subsp bovis AF2122/97
agccgugucaaccggucggu

SEQ ID NO: 3176214 - RNA, 17 nt, Mycobacterium bovis subsp bovis AF2122/97
agccguucccggugacc

SEQ ID NO: 3176215 - RNA, 14 nt, Mycobacterium bovis subsp bovis AF2122/97
agccguucgcagcu

SEQ ID NO: 3176216 - RNA, 17 nt, Mycobacterium bovis subsp bovis AF2122/97
agccguucgcgucgccg

SEQ ID NO: 3176217 - RNA, 15 nt, Mycobacterium bovis subsp bovis AF2122/97
agccguucggcaucu

SEQ ID NO: 3176218 - RNA, 12 nt, Mycobacterium bovis subsp bovis AF2122/97
agccguucgucg

SEQ ID NO: 3176219 - RNA, 16 nt, Mycobacterium bovis subsp bovis AF2122/97
agccguucucgcccac

SEQ ID NO: 3176220 - RNA, 21 nt, Mycobacterium bovis subsp bovis AF2122/97
agccguucucgcccacccgcu

SEQ ID NO: 3176221 - RNA, 15 nt, Mycobacterium bovis subsp bovis AF2122/97
agccguugaugcgua

SEQ ID NO: 3176222 - RNA, 22 nt, Mycobacterium bovis subsp bovis AF2122/97
agccguugccgccacgggcggc

SEQ ID NO: 3176223 - RNA, 14 nt, Mycobacterium bovis subsp bovis AF2122/97
agccguugccgccg

SEQ ID NO: 3176224 - RNA, 19 nt, Mycobacterium bovis subsp bovis AF2122/97
agccguugcgggccaggcc

SEQ ID NO: 3176225 - RNA, 21 nt, Mycobacterium bovis subsp bovis AF2122/97
agccguugcgggccaggcccu

SEQ ID NO: 3176226 - RNA, 22 nt, Mycobacterium bovis subsp bovis AF2122/97
agccguugcgggccaggcccuc

SEQ ID NO: 3176227 - RNA, 13 nt, Mycobacterium bovis subsp bovis AF2122/97
agccguuguacau

SEQ ID NO: 3176228 - RNA, 13 nt, Mycobacterium bovis subsp bovis AF2122/97
agccucaucugag

SEQ ID NO: 3176229 - RNA, 20 nt, Mycobacterium bovis subsp bovis AF2122/97
agccucgcgcgugugccuga

SEQ ID NO: 3176230 - RNA, 20 nt, Mycobacterium bovis subsp bovis AF2122/97
agccucgcgggcagggccuc

SEQ ID NO: 3176231 - RNA, 18 nt, Mycobacterium bovis subsp bovis AF2122/97
agccucggcaugcagccc

SEQ ID NO: 3176232 - RNA, 13 nt, Mycobacterium bovis subsp bovis AF2122/97
agccucggccauc

SEQ ID NO: 3176233 - RNA, 20 nt, Mycobacterium bovis subsp bovis AF2122/97
agccucggccaucugcucgu

SEQ ID NO: 3176234 - RNA, 22 nt, Mycobacterium bovis subsp bovis AF2122/97
agccucggccaucugcucgugg

SEQ ID NO: 3176235 - RNA, 17 nt, Mycobacterium bovis subsp bovis AF2122/97
agccucggcgagccgug

SEQ ID NO: 3176236 - RNA, 13 nt, Mycobacterium bovis subsp bovis AF2122/97
agccucggcggcg

SEQ ID NO: 3176237 - RNA, 22 nt, Mycobacterium bovis subsp bovis AF2122/97
agccugauaaagcccggcggca

SEQ ID NO: 3176238 - RNA, 17 nt, Mycobacterium bovis subsp bovis AF2122/97
agccugcaggccgccgg

SEQ ID NO: 3176239 - RNA, 21 nt, Mycobacterium bovis subsp bovis AF2122/97
agccugccagguacucagugu

SEQ ID NO: 3176240 - RNA, 13 nt, Mycobacterium bovis subsp bovis AF2122/97
agccugccgaacc

SEQ ID NO: 3176241 - RNA, 15 nt, Mycobacterium bovis subsp bovis AF2122/97
agccugccgaugacg

SEQ ID NO: 3176242 - RNA, 20 nt, Mycobacterium bovis subsp bovis AF2122/97
agccugccgaugacgauggc

SEQ ID NO: 3176243 - RNA, 21 nt, Mycobacterium bovis subsp bovis AF2122/97
agccugccgaugacgauggcc

SEQ ID NO: 3176244 - RNA, 23 nt, Mycobacterium bovis subsp bovis AF2122/97
agccugccgaugacgauggccgc

SEQ ID NO: 3176245 - RNA, 18 nt, Mycobacterium bovis subsp bovis AF2122/97
agccugcgccgacccgcg

SEQ ID NO: 3176246 - RNA, 24 nt, Mycobacterium bovis subsp bovis AF2122/97
agccugcgccgacccgcgcgccgg

SEQ ID NO: 3176247 - RNA, 19 nt, Mycobacterium bovis subsp bovis AF2122/97
agccugcgcuguucggcac

SEQ ID NO: 3176248 - RNA, 14 nt, Mycobacterium bovis subsp bovis AF2122/97
agccugcggcggcg

SEQ ID NO: 3176249 - RNA, 15 nt, Mycobacterium bovis subsp bovis AF2122/97
agccugcggcggcgu

SEQ ID NO: 3176250 - RNA, 19 nt, Mycobacterium bovis subsp bovis AF2122/97
agccugcggcggucauggg

SEQ ID NO: 3176251 - RNA, 21 nt, Mycobacterium bovis subsp bovis AF2122/97
agccugcggcggucaugggcg

SEQ ID NO: 3176252 - RNA, 15 nt, Mycobacterium bovis subsp bovis AF2122/97
agccugcgggccggc

SEQ ID NO: 3176253 - RNA, 19 nt, Mycobacterium bovis subsp bovis AF2122/97
agccugcucgcagcgggcg

SEQ ID NO: 3176254 - RNA, 21 nt, Mycobacterium bovis subsp bovis AF2122/97
agccugcugcacaucgcaucc

SEQ ID NO: 3176255 - RNA, 21 nt, Mycobacterium bovis subsp bovis AF2122/97
agccugcuggccgcggccucg

SEQ ID NO: 3176256 - RNA, 22 nt, Mycobacterium bovis subsp bovis AF2122/97
agccugcuucugggcuuucugc

SEQ ID NO: 3176257 - RNA, 23 nt, Mycobacterium bovis subsp bovis AF2122/97
agccuggcaaccacguccgcaac

SEQ ID NO: 3176258 - RNA, 14 nt, Mycobacterium bovis subsp bovis AF2122/97
agccuggccucgcc

SEQ ID NO: 3176259 - RNA, 16 nt, Mycobacterium bovis subsp bovis AF2122/97
agccuggcuguccgcg

SEQ ID NO: 3176260 - RNA, 22 nt, Mycobacterium bovis subsp bovis AF2122/97
agccugguguccgagcggcccu

SEQ ID NO: 3176261 - RNA, 16 nt, Mycobacterium bovis subsp bovis AF2122/97
agccuguccacgucca

SEQ ID NO: 3176262 - RNA, 12 nt, Mycobacterium bovis subsp bovis AF2122/97
agccugugcugc

SEQ ID NO: 3176263 - RNA, 15 nt, Mycobacterium bovis subsp bovis AF2122/97
agccugugcugccaa

SEQ ID NO: 3176264 - RNA, 23 nt, Mycobacterium bovis subsp bovis AF2122/97
agccuuacgcgggugaccaacac

SEQ ID NO: 3176265 - RNA, 17 nt, Mycobacterium bovis subsp bovis AF2122/97
agccuucggugucgccg

SEQ ID NO: 3176266 - RNA, 12 nt, Mycobacterium bovis subsp bovis AF2122/97
agccuugcagcg

SEQ ID NO: 3176267 - RNA, 15 nt, Mycobacterium bovis subsp bovis AF2122/97
agccuugcagcgccc

SEQ ID NO: 3176268 - RNA, 17 nt, Mycobacterium bovis subsp bovis AF2122/97
agccuugcagcgccccc

SEQ ID NO: 3176269 - RNA, 16 nt, Mycobacterium bovis subsp bovis AF2122/97
agccuuggacgugcgc

SEQ ID NO: 3176270 - RNA, 23 nt, Mycobacterium bovis subsp bovis AF2122/97
agccuuggacgugcgcgccaagu

SEQ ID NO: 3176271 - RNA, 16 nt, Mycobacterium bovis subsp bovis AF2122/97
agccuugguagccggc

SEQ ID NO: 3176272 - RNA, 20 nt, Mycobacterium bovis subsp bovis AF2122/97
agccuugguagccggccgcu

SEQ ID NO: 3176273 - RNA, 15 nt, Mycobacterium bovis subsp bovis AF2122/97
agccuuuccggccgc

SEQ ID NO: 3176274 - RNA, 16 nt, Mycobacterium bovis subsp bovis AF2122/97
agccuuucgugcaccg

SEQ ID NO: 3176275 - RNA, 22 nt, Mycobacterium bovis subsp bovis AF2122/97
agccuuucgugcaccgcgaccg

SEQ ID NO: 3176276 - RNA, 13 nt, Mycobacterium bovis subsp bovis AF2122/97
agcgaaacaccgg

SEQ ID NO: 3176277 - RNA, 17 nt, Mycobacterium bovis subsp bovis AF2122/97
agcgaaacgagccggug

SEQ ID NO: 3176278 - RNA, 19 nt, Mycobacterium bovis subsp bovis AF2122/97
agcgaaacgagccggugcg

SEQ ID NO: 3176279 - RNA, 14 nt, Mycobacterium bovis subsp bovis AF2122/97
agcgaaagugugga

SEQ ID NO: 3176280 - RNA, 12 nt, Mycobacterium bovis subsp bovis AF2122/97
agcgaaaucgga

SEQ ID NO: 3176281 - RNA, 19 nt, Mycobacterium bovis subsp bovis AF2122/97
agcgaaaugccggugccgg

SEQ ID NO: 3176282 - RNA, 21 nt, Mycobacterium bovis subsp bovis AF2122/97
agcgaaccaccggcgccgccg

SEQ ID NO: 3176283 - RNA, 14 nt, Mycobacterium bovis subsp bovis AF2122/97
agcgaguugcaguc

SEQ ID NO: 3176284 - RNA, 17 nt, Mycobacterium bovis subsp bovis AF2122/97
agcgaguuucugcucga

SEQ ID NO: 3176285 - RNA, 17 nt, Mycobacterium bovis subsp bovis AF2122/97
agcgauccgauccgcuc

SEQ ID NO: 3176286 - RNA, 16 nt, Mycobacterium bovis subsp bovis AF2122/97
agcgauccggcugcgg

SEQ ID NO: 3176287 - RNA, 12 nt, Mycobacterium bovis subsp bovis AF2122/97
agcgaucgccgg

SEQ ID NO: 3176288 - RNA, 16 nt, Mycobacterium bovis subsp bovis AF2122/97
agcgaucgccggccgc

SEQ ID NO: 3176289 - RNA, 15 nt, Mycobacterium bovis subsp bovis AF2122/97
agcgaucgggugcac

SEQ ID NO: 3176290 - RNA, 19 nt, Mycobacterium bovis subsp bovis AF2122/97
agcgaucgugcugcccgca

SEQ ID NO: 3176291 - RNA, 20 nt, Mycobacterium bovis subsp bovis AF2122/97
agcgaucgugcugcccgcaa

SEQ ID NO: 3176292 - RNA, 17 nt, Mycobacterium bovis subsp bovis AF2122/97
agcgaucuugguggccu

SEQ ID NO: 3176293 - RNA, 19 nt, Mycobacterium bovis subsp bovis AF2122/97
agcgaugaugucggccgcg

SEQ ID NO: 3176294 - RNA, 22 nt, Mycobacterium bovis subsp bovis AF2122/97
agcgaugaugucggccgcgggu

SEQ ID NO: 3176295 - RNA, 16 nt, Mycobacterium bovis subsp bovis AF2122/97
agcgaugcaccccaug

SEQ ID NO: 3176296 - RNA, 21 nt, Mycobacterium bovis subsp bovis AF2122/97
agcgaugcaccccaugaccgg

SEQ ID NO: 3176297 - RNA, 13 nt, Mycobacterium bovis subsp bovis AF2122/97
agcgaugcggcgu

SEQ ID NO: 3176298 - RNA, 18 nt, Mycobacterium bovis subsp bovis AF2122/97
agcgaugcggugucgggc

SEQ ID NO: 3176299 - RNA, 13 nt, Mycobacterium bovis subsp bovis AF2122/97
agcgauggcacca

SEQ ID NO: 3176300 - RNA, 21 nt, Mycobacterium bovis subsp bovis AF2122/97
agcgauggguguugcuggccg

SEQ ID NO: 3176301 - RNA, 21 nt, Mycobacterium bovis subsp bovis AF2122/97
agcgauucccaaccgguggcc

SEQ ID NO: 3176302 - RNA, 23 nt, Mycobacterium bovis subsp bovis AF2122/97
agcgauucccaaccgguggccgg

SEQ ID NO: 3176303 - RNA, 22 nt, Mycobacterium bovis subsp bovis AF2122/97
agcgauucgccuagcgagcgca

SEQ ID NO: 3176304 - RNA, 24 nt, Mycobacterium bovis subsp bovis AF2122/97
agcgauucugggcuucaucggcga

SEQ ID NO: 3176305 - RNA, 21 nt, Mycobacterium bovis subsp bovis AF2122/97
agcgauuuggcgucgccgagg

SEQ ID NO: 3176306 - RNA, 16 nt, Mycobacterium bovis subsp bovis AF2122/97
agcgcaaaaucaccgg

SEQ ID NO: 3176307 - RNA, 13 nt, Mycobacterium bovis subsp bovis AF2122/97
agcgcaacaucga

SEQ ID NO: 3176308 - RNA, 14 nt, Mycobacterium bovis subsp bovis AF2122/97
agcgcaacggccag

SEQ ID NO: 3176309 - RNA, 16 nt, Mycobacterium bovis subsp bovis AF2122/97
agcgcaacggccagcg

SEQ ID NO: 3176310 - RNA, 16 nt, Mycobacterium bovis subsp bovis AF2122/97
agcgcaaggucgacgg

SEQ ID NO: 3176311 - RNA, 14 nt, Mycobacterium bovis subsp bovis AF2122/97
agcgcaagguugcc

SEQ ID NO: 3176312 - RNA, 14 nt, Mycobacterium bovis subsp bovis AF2122/97
agcgcaaucgacca

SEQ ID NO: 3176313 - RNA, 18 nt, Mycobacterium bovis subsp bovis AF2122/97
agcgcaaucgaccacgac

SEQ ID NO: 3176314 - RNA, 15 nt, Mycobacterium bovis subsp bovis AF2122/97
agcgcaaugcaucgc

SEQ ID NO: 3176315 - RNA, 12 nt, Mycobacterium bovis subsp bovis AF2122/97
agcgcaaugcgc

SEQ ID NO: 3176316 - RNA, 16 nt, Mycobacterium bovis subsp bovis AF2122/97
agcgcaaugcggcccg

SEQ ID NO: 3176317 - RNA, 13 nt, Mycobacterium bovis subsp bovis AF2122/97
agcgcaccacggc

SEQ ID NO: 3176318 - RNA, 16 nt, Mycobacterium bovis subsp bovis AF2122/97
agcgcaccacggcggu

SEQ ID NO: 3176319 - RNA, 20 nt, Mycobacterium bovis subsp bovis AF2122/97
agcgcaccacggcggucaac

SEQ ID NO: 3176320 - RNA, 21 nt, Mycobacterium bovis subsp bovis AF2122/97
agcgcacccggucggcggcau

SEQ ID NO: 3176321 - RNA, 20 nt, Mycobacterium bovis subsp bovis AF2122/97
agcgcaccgcugaccgcaac

SEQ ID NO: 3176322 - RNA, 22 nt, Mycobacterium bovis subsp bovis AF2122/97
agcgcaccgcugaccgcaacgc

SEQ ID NO: 3176323 - RNA, 18 nt, Mycobacterium bovis subsp bovis AF2122/97
agcgcaccggcguucacc

SEQ ID NO: 3176324 - RNA, 19 nt, Mycobacterium bovis subsp bovis AF2122/97
agcgcacgauuucgagcgc

SEQ ID NO: 3176325 - RNA, 13 nt, Mycobacterium bovis subsp bovis AF2122/97
agcgcacugggga

SEQ ID NO: 3176326 - RNA, 22 nt, Mycobacterium bovis subsp bovis AF2122/97
agcgcagcaacugggcggccug

SEQ ID NO: 3176327 - RNA, 12 nt, Mycobacterium bovis subsp bovis AF2122/97
agcgcagcagcg

SEQ ID NO: 3176328 - RNA, 21 nt, Mycobacterium bovis subsp bovis AF2122/97
agcgcagcaucgucgccacga

SEQ ID NO: 3176329 - RNA, 14 nt, Mycobacterium bovis subsp bovis AF2122/97
agcgcagccgaucg

SEQ ID NO: 3176330 - RNA, 16 nt, Mycobacterium bovis subsp bovis AF2122/97
agcgcagccugcagcg

SEQ ID NO: 3176331 - RNA, 12 nt, Mycobacterium bovis subsp bovis AF2122/97
agcgcagcgccu

SEQ ID NO: 3176332 - RNA, 15 nt, Mycobacterium bovis subsp bovis AF2122/97
agcgcagcgccuccu

SEQ ID NO: 3176333 - RNA, 14 nt, Mycobacterium bovis subsp bovis AF2122/97
agcgcaggaccuga

SEQ ID NO: 3176334 - RNA, 16 nt, Mycobacterium bovis subsp bovis AF2122/97
agcgcaggagcgcgau

SEQ ID NO: 3176335 - RNA, 19 nt, Mycobacterium bovis subsp bovis AF2122/97
agcgcaguaacgucgucgc

SEQ ID NO: 3176336 - RNA, 21 nt, Mycobacterium bovis subsp bovis AF2122/97
agcgcagucugauuccacauc

SEQ ID NO: 3176337 - RNA, 19 nt, Mycobacterium bovis subsp bovis AF2122/97
agcgcaucagggugggcga

SEQ ID NO: 3176338 - RNA, 14 nt, Mycobacterium bovis subsp bovis AF2122/97
agcgcaucgagcac

SEQ ID NO: 3176339 - RNA, 17 nt, Mycobacterium bovis subsp bovis AF2122/97
agcgcaucgagcccgga

SEQ ID NO: 3176340 - RNA, 12 nt, Mycobacterium bovis subsp bovis AF2122/97
agcgcaucgcca

SEQ ID NO: 3176341 - RNA, 14 nt, Mycobacterium bovis subsp bovis AF2122/97
agcgcaucgccaau

SEQ ID NO: 3176342 - RNA, 22 nt, Mycobacterium bovis subsp bovis AF2122/97
agcgcaucgccgcuggccagca

SEQ ID NO: 3176343 - RNA, 13 nt, Mycobacterium bovis subsp bovis AF2122/97
agcgcaucggcca

SEQ ID NO: 3176344 - RNA, 17 nt, Mycobacterium bovis subsp bovis AF2122/97
agcgcaucggccagcag

SEQ ID NO: 3176345 - RNA, 17 nt, Mycobacterium bovis subsp bovis AF2122/97
agcgcauguugcaggcg

SEQ ID NO: 3176346 - RNA, 15 nt, Mycobacterium bovis subsp bovis AF2122/97
agcgcauuuguugcu

SEQ ID NO: 3176347 - RNA, 21 nt, Mycobacterium bovis subsp bovis AF2122/97
agcgcauuuguugcugcugcc

SEQ ID NO: 3176348 - RNA, 14 nt, Mycobacterium bovis subsp bovis AF2122/97
agcgccaaacccgg

SEQ ID NO: 3176349 - RNA, 19 nt, Mycobacterium bovis subsp bovis AF2122/97
agcgccaacgcccccaucc

SEQ ID NO: 3176350 - RNA, 13 nt, Mycobacterium bovis subsp bovis AF2122/97
agcgccaaggcga

SEQ ID NO: 3176351 - RNA, 23 nt, Mycobacterium bovis subsp bovis AF2122/97
agcgccacauacaccggccgguc

SEQ ID NO: 3176352 - RNA, 13 nt, Mycobacterium bovis subsp bovis AF2122/97
agcgccacccgcg

SEQ ID NO: 3176353 - RNA, 18 nt, Mycobacterium bovis subsp bovis AF2122/97
agcgccacccgguccggc

SEQ ID NO: 3176354 - RNA, 21 nt, Mycobacterium bovis subsp bovis AF2122/97
agcgccacccgguccggcccg

SEQ ID NO: 3176355 - RNA, 17 nt, Mycobacterium bovis subsp bovis AF2122/97
agcgccaccguuugcgc

SEQ ID NO: 3176356 - RNA, 15 nt, Mycobacterium bovis subsp bovis AF2122/97
agcgccacgccgagg

SEQ ID NO: 3176357 - RNA, 17 nt, Mycobacterium bovis subsp bovis AF2122/97
agcgccacgccgaggcg

SEQ ID NO: 3176358 - RNA, 21 nt, Mycobacterium bovis subsp bovis AF2122/97
agcgccagcagccacccgaca

SEQ ID NO: 3176359 - RNA, 22 nt, Mycobacterium bovis subsp bovis AF2122/97
agcgccagcgagcauaccgccg

SEQ ID NO: 3176360 - RNA, 15 nt, Mycobacterium bovis subsp bovis AF2122/97
agcgccagcgccagu

SEQ ID NO: 3176361 - RNA, 16 nt, Mycobacterium bovis subsp bovis AF2122/97
agcgccagcgggauga

SEQ ID NO: 3176362 - RNA, 13 nt, Mycobacterium bovis subsp bovis AF2122/97
agcgccaggccgc

SEQ ID NO: 3176363 - RNA, 16 nt, Mycobacterium bovis subsp bovis AF2122/97
agcgccaggccgcaca

SEQ ID NO: 3176364 - RNA, 19 nt, Mycobacterium bovis subsp bovis AF2122/97
agcgccaggccgcacagca

SEQ ID NO: 3176365 - RNA, 15 nt, Mycobacterium bovis subsp bovis AF2122/97
agcgccaggggugug

SEQ ID NO: 3176366 - RNA, 22 nt, Mycobacterium bovis subsp bovis AF2122/97
agcgccaggggugugccguggu

SEQ ID NO: 3176367 - RNA, 16 nt, Mycobacterium bovis subsp bovis AF2122/97
agcgccaggucagcuc

SEQ ID NO: 3176368 - RNA, 24 nt, Mycobacterium bovis subsp bovis AF2122/97
agcgccagugccucgcggggucug

SEQ ID NO: 3176369 - RNA, 19 nt, Mycobacterium bovis subsp bovis AF2122/97
agcgccaguucgcggcugc

SEQ ID NO: 3176370 - RNA, 18 nt, Mycobacterium bovis subsp bovis AF2122/97
agcgcgaaccugcucggc

SEQ ID NO: 3176371 - RNA, 17 nt, Mycobacterium bovis subsp bovis AF2122/97
agcgcgaacgccugcug

SEQ ID NO: 3176372 - RNA, 18 nt, Mycobacterium bovis subsp bovis AF2122/97
agcgcgaaggucagcgac

SEQ ID NO: 3176373 - RNA, 18 nt, Mycobacterium bovis subsp bovis AF2122/97
agcgcgaaguacgacgac

SEQ ID NO: 3176374 - RNA, 18 nt, Mycobacterium bovis subsp bovis AF2122/97
agcgcgaccgucaggguc

SEQ ID NO: 3176375 - RNA, 18 nt, Mycobacterium bovis subsp bovis AF2122/97
agcgcgacguccaccagc

SEQ ID NO: 3176376 - RNA, 16 nt, Mycobacterium bovis subsp bovis AF2122/97
agcgcgagcccgaacc

SEQ ID NO: 3176377 - RNA, 21 nt, Mycobacterium bovis subsp bovis AF2122/97
agcgcgagcccgaaccaccgc

SEQ ID NO: 3176378 - RNA, 14 nt, Mycobacterium bovis subsp bovis AF2122/97
agcgcgaucaccga

SEQ ID NO: 3176379 - RNA, 16 nt, Mycobacterium bovis subsp bovis AF2122/97
agcgcgaucgauuccg

SEQ ID NO: 3176380 - RNA, 19 nt, Mycobacterium bovis subsp bovis AF2122/97
agcgcgaucgauuccgcuc

SEQ ID NO: 3176381 - RNA, 21 nt, Mycobacterium bovis subsp bovis AF2122/97
agcgcgaucgauuccgcucgu

SEQ ID NO: 3176382 - RNA, 18 nt, Mycobacterium bovis subsp bovis AF2122/97
agcgcgaucgggccggcg

SEQ ID NO: 3176383 - RNA, 21 nt, Mycobacterium bovis subsp bovis AF2122/97
agcgcgaucugcucgccccau

SEQ ID NO: 3176384 - RNA, 14 nt, Mycobacterium bovis subsp bovis AF2122/97
agcgcgaugaccuc

SEQ ID NO: 3176385 - RNA, 16 nt, Mycobacterium bovis subsp bovis AF2122/97
agcgcgaugcagugcg

SEQ ID NO: 3176386 - RNA, 23 nt, Mycobacterium bovis subsp bovis AF2122/97
agcgcgaugcagugcgacccggg

SEQ ID NO: 3176387 - RNA, 12 nt, Mycobacterium bovis subsp bovis AF2122/97
agcgcgauggcc

SEQ ID NO: 3176388 - RNA, 16 nt, Mycobacterium bovis subsp bovis AF2122/97
agcgcgaugucgccgg

SEQ ID NO: 3176389 - RNA, 18 nt, Mycobacterium bovis subsp bovis AF2122/97
agcgcgcauagggcuggu

SEQ ID NO: 3176390 - RNA, 16 nt, Mycobacterium bovis subsp bovis AF2122/97
agcgcgccaaucgccc

SEQ ID NO: 3176391 - RNA, 18 nt, Mycobacterium bovis subsp bovis AF2122/97
agcgcgccaaucgcccag

SEQ ID NO: 3176392 - RNA, 19 nt, Mycobacterium bovis subsp bovis AF2122/97
agcgcgccaaucgcccagu

SEQ ID NO: 3176393 - RNA, 15 nt, Mycobacterium bovis subsp bovis AF2122/97
agcgcgccacccagc

SEQ ID NO: 3176394 - RNA, 12 nt, Mycobacterium bovis subsp bovis AF2122/97
agcgcgccacga

SEQ ID NO: 3176395 - RNA, 17 nt, Mycobacterium bovis subsp bovis AF2122/97
agcgcgcccaaccuggg

SEQ ID NO: 3176396 - RNA, 18 nt, Mycobacterium bovis subsp bovis AF2122/97
agcgcgcccaaccuggga

SEQ ID NO: 3176397 - RNA, 16 nt, Mycobacterium bovis subsp bovis AF2122/97
agcgcgcccgcggccg

SEQ ID NO: 3176398 - RNA, 22 nt, Mycobacterium bovis subsp bovis AF2122/97
agcgcgcccugcgcgugcuugg

SEQ ID NO: 3176399 - RNA, 21 nt, Mycobacterium bovis subsp bovis AF2122/97
agcgcgccgaucacggugggc

SEQ ID NO: 3176400 - RNA, 13 nt, Mycobacterium bovis subsp bovis AF2122/97
agcgcgccggcca

SEQ ID NO: 3176401 - RNA, 14 nt, Mycobacterium bovis subsp bovis AF2122/97
agcgcgccggccau

SEQ ID NO: 3176402 - RNA, 14 nt, Mycobacterium bovis subsp bovis AF2122/97
agcgcgccguugcc

SEQ ID NO: 3176403 - RNA, 18 nt, Mycobacterium bovis subsp bovis AF2122/97
agcgcgccucgcccagca

SEQ ID NO: 3176404 - RNA, 18 nt, Mycobacterium bovis subsp bovis AF2122/97
agcgcgcgccgagcccgg

SEQ ID NO: 3176405 - RNA, 17 nt, Mycobacterium bovis subsp bovis AF2122/97
agcgcgcgcgugaagaa

SEQ ID NO: 3176406 - RNA, 17 nt, Mycobacterium bovis subsp bovis AF2122/97
agcgcgcggguggcggc

SEQ ID NO: 3176407 - RNA, 18 nt, Mycobacterium bovis subsp bovis AF2122/97
agcgcgcggguggcggcg

SEQ ID NO: 3176408 - RNA, 22 nt, Mycobacterium bovis subsp bovis AF2122/97
agcgcgcuacagcaucaaccgu

SEQ ID NO: 3176409 - RNA, 14 nt, Mycobacterium bovis subsp bovis AF2122/97
agcgcgcucagguc

SEQ ID NO: 3176410 - RNA, 19 nt, Mycobacterium bovis subsp bovis AF2122/97
agcgcgcugcggaucgugg

SEQ ID NO: 3176411 - RNA, 18 nt, Mycobacterium bovis subsp bovis AF2122/97
agcgcgcuggccagcccg

SEQ ID NO: 3176412 - RNA, 19 nt, Mycobacterium bovis subsp bovis AF2122/97
agcgcgcuggccagcccgg

SEQ ID NO: 3176413 - RNA, 21 nt, Mycobacterium bovis subsp bovis AF2122/97
agcgcgcuggccagcccgguc

SEQ ID NO: 3176414 - RNA, 22 nt, Mycobacterium bovis subsp bovis AF2122/97
agcgcgcuggccagcccgguca

SEQ ID NO: 3176415 - RNA, 19 nt, Mycobacterium bovis subsp bovis AF2122/97
agcgcgcuggcuacccacc

SEQ ID NO: 3176416 - RNA, 17 nt, Mycobacterium bovis subsp bovis AF2122/97
agcgcgcuuuguccggu

SEQ ID NO: 3176417 - RNA, 21 nt, Mycobacterium bovis subsp bovis AF2122/97
agcgcggcaaaguuggccgcc

SEQ ID NO: 3176418 - RNA, 14 nt, Mycobacterium bovis subsp bovis AF2122/97
agcgcggcaaccgu

SEQ ID NO: 3176419 - RNA, 19 nt, Mycobacterium bovis subsp bovis AF2122/97
agcgcggcaacuccgguca

SEQ ID NO: 3176420 - RNA, 21 nt, Mycobacterium bovis subsp bovis AF2122/97
agcgcggcaacuccggucaac

SEQ ID NO: 3176421 - RNA, 16 nt, Mycobacterium bovis subsp bovis AF2122/97
agcgcggcaccagcac

SEQ ID NO: 3176422 - RNA, 22 nt, Mycobacterium bovis subsp bovis AF2122/97
agcgcggcaccagcaccgucgg

SEQ ID NO: 3176423 - RNA, 19 nt, Mycobacterium bovis subsp bovis AF2122/97
agcgcggcacggugugcgg

SEQ ID NO: 3176424 - RNA, 12 nt, Mycobacterium bovis subsp bovis AF2122/97
agcgcggccacc

SEQ ID NO: 3176425 - RNA, 21 nt, Mycobacterium bovis subsp bovis AF2122/97
agcgcggccaccagaucgcac

SEQ ID NO: 3176426 - RNA, 13 nt, Mycobacterium bovis subsp bovis AF2122/97
agcgcggccacgc

SEQ ID NO: 3176427 - RNA, 17 nt, Mycobacterium bovis subsp bovis AF2122/97
agcgcggccacgccgau

SEQ ID NO: 3176428 - RNA, 22 nt, Mycobacterium bovis subsp bovis AF2122/97
agcgcggccacgccgaucaaca

SEQ ID NO: 3176429 - RNA, 19 nt, Mycobacterium bovis subsp bovis AF2122/97
agcgcggccagcagcagau

SEQ ID NO: 3176430 - RNA, 15 nt, Mycobacterium bovis subsp bovis AF2122/97
agcgcggccgauacg

SEQ ID NO: 3176431 - RNA, 14 nt, Mycobacterium bovis subsp bovis AF2122/97
agcgcggccgggcg

SEQ ID NO: 3176432 - RNA, 17 nt, Mycobacterium bovis subsp bovis AF2122/97
agcgcggcgaagccggg

SEQ ID NO: 3176433 - RNA, 13 nt, Mycobacterium bovis subsp bovis AF2122/97
agcgcggcgacga

SEQ ID NO: 3176434 - RNA, 16 nt, Mycobacterium bovis subsp bovis AF2122/97
agcgcggcgcgacaga

SEQ ID NO: 3176435 - RNA, 22 nt, Mycobacterium bovis subsp bovis AF2122/97
agcgcggcgcgcaggaccugcg

SEQ ID NO: 3176436 - RNA, 22 nt, Mycobacterium bovis subsp bovis AF2122/97
agcgcggcgcgcggggccucgc

SEQ ID NO: 3176437 - RNA, 18 nt, Mycobacterium bovis subsp bovis AF2122/97
agcgcggcggagccgggu

SEQ ID NO: 3176438 - RNA, 21 nt, Mycobacterium bovis subsp bovis AF2122/97
agcgcggcggagccgggugag

SEQ ID NO: 3176439 - RNA, 13 nt, Mycobacterium bovis subsp bovis AF2122/97
agcgcggcggcgg

SEQ ID NO: 3176440 - RNA, 21 nt, Mycobacterium bovis subsp bovis AF2122/97
agcgcggcggucgagcgaacc

SEQ ID NO: 3176441 - RNA, 15 nt, Mycobacterium bovis subsp bovis AF2122/97
agcgcggcgucgccu

SEQ ID NO: 3176442 - RNA, 18 nt, Mycobacterium bovis subsp bovis AF2122/97
agcgcggcguguacgucg

SEQ ID NO: 3176443 - RNA, 19 nt, Mycobacterium bovis subsp bovis AF2122/97
agcgcggcguguacgucga

SEQ ID NO: 3176444 - RNA, 17 nt, Mycobacterium bovis subsp bovis AF2122/97
agcgcggcuacggucgc

SEQ ID NO: 3176445 - RNA, 17 nt, Mycobacterium bovis subsp bovis AF2122/97
agcgcgggacacgucgc

SEQ ID NO: 3176446 - RNA, 23 nt, Mycobacterium bovis subsp bovis AF2122/97
agcgcgggauguaccccggcccg

SEQ ID NO: 3176447 - RNA, 16 nt, Mycobacterium bovis subsp bovis AF2122/97
agcgcgggccuggccc

SEQ ID NO: 3176448 - RNA, 18 nt, Mycobacterium bovis subsp bovis AF2122/97
agcgcgggcucgguggcg

SEQ ID NO: 3176449 - RNA, 19 nt, Mycobacterium bovis subsp bovis AF2122/97
agcgcggguggcagcggcg

SEQ ID NO: 3176450 - RNA, 21 nt, Mycobacterium bovis subsp bovis AF2122/97
agcgcgguccaucccgagcuc

SEQ ID NO: 3176451 - RNA, 13 nt, Mycobacterium bovis subsp bovis AF2122/97
agcgcggugccgc

SEQ ID NO: 3176452 - RNA, 16 nt, Mycobacterium bovis subsp bovis AF2122/97
agcgcggugccgccac

SEQ ID NO: 3176453 - RNA, 17 nt, Mycobacterium bovis subsp bovis AF2122/97
agcgcggugccgccacc

SEQ ID NO: 3176454 - RNA, 18 nt, Mycobacterium bovis subsp bovis AF2122/97
agcgcggugccgccaccg

SEQ ID NO: 3176455 - RNA, 17 nt, Mycobacterium bovis subsp bovis AF2122/97
agcgcggugucggggcc

SEQ ID NO: 3176456 - RNA, 12 nt, Mycobacterium bovis subsp bovis AF2122/97
agcggcacaccc

SEQ ID NO: 3176457 - RNA, 17 nt, Mycobacterium bovis subsp bovis AF2122/97
agcggcacacccaucac

SEQ ID NO: 3176458 - RNA, 21 nt, Mycobacterium bovis subsp bovis AF2122/97
agcggcacacccaucaccgcc

SEQ ID NO: 3176459 - RNA, 22 nt, Mycobacterium bovis subsp bovis AF2122/97
agcggcacacccaucaccgcca

SEQ ID NO: 3176460 - RNA, 24 nt, Mycobacterium bovis subsp bovis AF2122/97
agcggcacaucaugggcgcugcca

SEQ ID NO: 3176461 - RNA, 14 nt, Mycobacterium bovis subsp bovis AF2122/97
agcggcaccaaugc

SEQ ID NO: 3176462 - RNA, 12 nt, Mycobacterium bovis subsp bovis AF2122/97
agcggcaccgcg

SEQ ID NO: 3176463 - RNA, 21 nt, Mycobacterium bovis subsp bovis AF2122/97
agcggcaccgcgccggcggaa

SEQ ID NO: 3176464 - RNA, 13 nt, Mycobacterium bovis subsp bovis AF2122/97
agcggcaccgcgg

SEQ ID NO: 3176465 - RNA, 15 nt, Mycobacterium bovis subsp bovis AF2122/97
agcggcaccgcggcc

SEQ ID NO: 3176466 - RNA, 17 nt, Mycobacterium bovis subsp bovis AF2122/97
agcggcaccgcggccag

SEQ ID NO: 3176467 - RNA, 19 nt, Mycobacterium bovis subsp bovis AF2122/97
agcggcaccgcggccagcg

SEQ ID NO: 3176468 - RNA, 15 nt, Mycobacterium bovis subsp bovis AF2122/97
agcggcacgaucggc

SEQ ID NO: 3176469 - RNA, 22 nt, Mycobacterium bovis subsp bovis AF2122/97
agcggcagaugaauugccgggc

SEQ ID NO: 3176470 - RNA, 23 nt, Mycobacterium bovis subsp bovis AF2122/97
agcggcagaugaauugccgggcg

SEQ ID NO: 3176471 - RNA, 14 nt, Mycobacterium bovis subsp bovis AF2122/97
agcggcagcaccgc

SEQ ID NO: 3176472 - RNA, 15 nt, Mycobacterium bovis subsp bovis AF2122/97
agcggcagcaccgca

SEQ ID NO: 3176473 - RNA, 18 nt, Mycobacterium bovis subsp bovis AF2122/97
agcggcagcaccgcacgg

SEQ ID NO: 3176474 - RNA, 16 nt, Mycobacterium bovis subsp bovis AF2122/97
agcggcagcggcgucg

SEQ ID NO: 3176475 - RNA, 18 nt, Mycobacterium bovis subsp bovis AF2122/97
agcggcaucggccagccg

SEQ ID NO: 3176476 - RNA, 21 nt, Mycobacterium bovis subsp bovis AF2122/97
agcggcaucggccagccguuc

SEQ ID NO: 3176477 - RNA, 19 nt, Mycobacterium bovis subsp bovis AF2122/97
agcggcaucggucaccgcg

SEQ ID NO: 3176478 - RNA, 19 nt, Mycobacterium bovis subsp bovis AF2122/97
agcggcaugcgaaccgagg

SEQ ID NO: 3176479 - RNA, 10 nt, Mycobacterium bovis subsp bovis AF2122/97
agcggccacc

SEQ ID NO: 3176480 - RNA, 13 nt, Mycobacterium bovis subsp bovis AF2122/97
agcggccaccgcc

SEQ ID NO: 3176481 - RNA, 14 nt, Mycobacterium bovis subsp bovis AF2122/97
agcggccaccgccg

SEQ ID NO: 3176482 - RNA, 17 nt, Mycobacterium bovis subsp bovis AF2122/97
agcggccaccgccgccg

SEQ ID NO: 3176483 - RNA, 18 nt, Mycobacterium bovis subsp bovis AF2122/97
agcggccaccgccgccgc

SEQ ID NO: 3176484 - RNA, 23 nt, Mycobacterium bovis subsp bovis AF2122/97
agcggccaccgccgccgccaccg

SEQ ID NO: 3176485 - RNA, 22 nt, Mycobacterium bovis subsp bovis AF2122/97
agcggccaccguagccagcagg

SEQ ID NO: 3176486 - RNA, 12 nt, Mycobacterium bovis subsp bovis AF2122/97
agcggccagcag

SEQ ID NO: 3176487 - RNA, 21 nt, Mycobacterium bovis subsp bovis AF2122/97
agcggccagcccagccgggag

SEQ ID NO: 3176488 - RNA, 15 nt, Mycobacterium bovis subsp bovis AF2122/97
agcggccauaucgcc

SEQ ID NO: 3176489 - RNA, 21 nt, Mycobacterium bovis subsp bovis AF2122/97
agcggccauaucgcccaccac

SEQ ID NO: 3176490 - RNA, 23 nt, Mycobacterium bovis subsp bovis AF2122/97
agcggccauaucgcccaccacga

SEQ ID NO: 3176491 - RNA, 19 nt, Mycobacterium bovis subsp bovis AF2122/97
agcggccauccggcggcgg

SEQ ID NO: 3176492 - RNA, 15 nt, Mycobacterium bovis subsp bovis AF2122/97
agcggcccgaucacc

SEQ ID NO: 3176493 - RNA, 15 nt, Mycobacterium bovis subsp bovis AF2122/97
agcggcccgucaccg

SEQ ID NO: 3176494 - RNA, 18 nt, Mycobacterium bovis subsp bovis AF2122/97
agcggcccgucaccgcgg

SEQ ID NO: 3176495 - RNA, 17 nt, Mycobacterium bovis subsp bovis AF2122/97
agcggccgaccgcgacc

SEQ ID NO: 3176496 - RNA, 19 nt, Mycobacterium bovis subsp bovis AF2122/97
agcggccgaccgcgacccg

SEQ ID NO: 3176497 - RNA, 21 nt, Mycobacterium bovis subsp bovis AF2122/97
agcggccgaccgcgacccggc

SEQ ID NO: 3176498 - RNA, 13 nt, Mycobacterium bovis subsp bovis AF2122/97
agcggccgccgcg

SEQ ID NO: 3176499 - RNA, 13 nt, Mycobacterium bovis subsp bovis AF2122/97
agcggccgcgaug

SEQ ID NO: 3176500 - RNA, 17 nt, Mycobacterium bovis subsp bovis AF2122/97
agcggccgcuccaccuc

SEQ ID NO: 3176501 - RNA, 22 nt, Mycobacterium bovis subsp bovis AF2122/97
agcggccgguacacguccagug

SEQ ID NO: 3176502 - RNA, 12 nt, Mycobacterium bovis subsp bovis AF2122/97
agcggccgucgg

SEQ ID NO: 3176503 - RNA, 20 nt, Mycobacterium bovis subsp bovis AF2122/97
agcggccgucgggacggcca

SEQ ID NO: 3176504 - RNA, 21 nt, Mycobacterium bovis subsp bovis AF2122/97
agcggccgucgggacggccaa

SEQ ID NO: 3176505 - RNA, 23 nt, Mycobacterium bovis subsp bovis AF2122/97
agcggccuaacgaguaggcggcu

SEQ ID NO: 3176506 - RNA, 21 nt, Mycobacterium bovis subsp bovis AF2122/97
agcggccuaggacgccgcccu

SEQ ID NO: 3176507 - RNA, 15 nt, Mycobacterium bovis subsp bovis AF2122/97
agcggccuccagcac

SEQ ID NO: 3176508 - RNA, 21 nt, Mycobacterium bovis subsp bovis AF2122/97
agcggccuccagcacccgguc

SEQ ID NO: 3176509 - RNA, 23 nt, Mycobacterium bovis subsp bovis AF2122/97
agcggccuccgggccaugugggg

SEQ ID NO: 3176510 - RNA, 21 nt, Mycobacterium bovis subsp bovis AF2122/97
agcggccugaccggcucgccg

SEQ ID NO: 3176511 - RNA, 14 nt, Mycobacterium bovis subsp bovis AF2122/97
agcggccugcucgg

SEQ ID NO: 3176512 - RNA, 19 nt, Mycobacterium bovis subsp bovis AF2122/97
agcggccugcucgggggcc

SEQ ID NO: 3176513 - RNA, 20 nt, Mycobacterium bovis subsp bovis AF2122/97
agcggcgaccgcauccgguc

SEQ ID NO: 3176514 - RNA, 13 nt, Mycobacterium bovis subsp bovis AF2122/97
agcggcgaccgcg

SEQ ID NO: 3176515 - RNA, 19 nt, Mycobacterium bovis subsp bovis AF2122/97
agcggcgaccgcggucgcc

SEQ ID NO: 3176516 - RNA, 23 nt, Mycobacterium bovis subsp bovis AF2122/97
agcggcgacuacccagccagccg

SEQ ID NO: 3176517 - RNA, 21 nt, Mycobacterium bovis subsp bovis AF2122/97
agcggcgaguuggccguggcg

SEQ ID NO: 3176518 - RNA, 12 nt, Mycobacterium bovis subsp bovis AF2122/97
agcggcgaucag

SEQ ID NO: 3176519 - RNA, 22 nt, Mycobacterium bovis subsp bovis AF2122/97
agcggcgaucggaggcccgcca

SEQ ID NO: 3176520 - RNA, 21 nt, Mycobacterium bovis subsp bovis AF2122/97
agcggcgauugauccgguggc

SEQ ID NO: 3176521 - RNA, 20 nt, Mycobacterium bovis subsp bovis AF2122/97
agcggcgcagcgugagugca

SEQ ID NO: 3176522 - RNA, 23 nt, Mycobacterium bovis subsp bovis AF2122/97
agcggcgccacguggucgagcag

SEQ ID NO: 3176523 - RNA, 23 nt, Mycobacterium bovis subsp bovis AF2122/97
agcggcgccaguauggccgccac

SEQ ID NO: 3176524 - RNA, 13 nt, Mycobacterium bovis subsp bovis AF2122/97
agcggcgcccgcc

SEQ ID NO: 3176525 - RNA, 14 nt, Mycobacterium bovis subsp bovis AF2122/97
agcggcgccgcaca

SEQ ID NO: 3176526 - RNA, 12 nt, Mycobacterium bovis subsp bovis AF2122/97
agcggcgccgcc

SEQ ID NO: 3176527 - RNA, 14 nt, Mycobacterium bovis subsp bovis AF2122/97
agcggcgccgcccu

SEQ ID NO: 3176528 - RNA, 15 nt, Mycobacterium bovis subsp bovis AF2122/97
agcggcgccgccugg

SEQ ID NO: 3176529 - RNA, 15 nt, Mycobacterium bovis subsp bovis AF2122/97
agcggcgcgggggug

SEQ ID NO: 3176530 - RNA, 18 nt, Mycobacterium bovis subsp bovis AF2122/97
agcggcggaaggacggca

SEQ ID NO: 3176531 - RNA, 23 nt, Mycobacterium bovis subsp bovis AF2122/97
agcggcggcaacccugcccggcc

SEQ ID NO: 3176532 - RNA, 18 nt, Mycobacterium bovis subsp bovis AF2122/97
agcggcggcaacgguggc

SEQ ID NO: 3176533 - RNA, 10 nt, Mycobacterium bovis subsp bovis AF2122/97
agcggcggcc

SEQ ID NO: 3176534 - RNA, 23 nt, Mycobacterium bovis subsp bovis AF2122/97
agcggcggcccuaaacaccgcga

SEQ ID NO: 3176535 - RNA, 18 nt, Mycobacterium bovis subsp bovis AF2122/97
agcggcggcgacgagcgc

SEQ ID NO: 3176536 - RNA, 20 nt, Mycobacterium bovis subsp bovis AF2122/97
agcggcggcggcacgcucgc

SEQ ID NO: 3176537 - RNA, 15 nt, Mycobacterium bovis subsp bovis AF2122/97
agcggcgggcgauga

SEQ ID NO: 3176538 - RNA, 17 nt, Mycobacterium bovis subsp bovis AF2122/97
agcggcgggggcgucgc

SEQ ID NO: 3176539 - RNA, 22 nt, Mycobacterium bovis subsp bovis AF2122/97
agcggcgggggcgucgccgccg

SEQ ID NO: 3176540 - RNA, 13 nt, Mycobacterium bovis subsp bovis AF2122/97
agcggcggggggu

SEQ ID NO: 3176541 - RNA, 20 nt, Mycobacterium bovis subsp bovis AF2122/97
agcggcggggggugaucgcc

SEQ ID NO: 3176542 - RNA, 17 nt, Mycobacterium bovis subsp bovis AF2122/97
agcgguugccgucugcg

SEQ ID NO: 3176543 - RNA, 12 nt, Mycobacterium bovis subsp bovis AF2122/97
agcgguugggcg

SEQ ID NO: 3176544 - RNA, 18 nt, Mycobacterium bovis subsp bovis AF2122/97
agcgguuguccggucgcc

SEQ ID NO: 3176545 - RNA, 23 nt, Mycobacterium bovis subsp bovis AF2122/97
agcgguuuccgcacgaucgcccg

SEQ ID NO: 3176546 - RNA, 19 nt, Mycobacterium bovis subsp bovis AF2122/97
agcgguuuuaggcagccca

SEQ ID NO: 3176547 - RNA, 18 nt, Mycobacterium bovis subsp bovis AF2122/97
agcguaacguggcugcga

SEQ ID NO: 3176548 - RNA, 19 nt, Mycobacterium bovis subsp bovis AF2122/97
agcguacccaacggagugu

SEQ ID NO: 3176549 - RNA, 13 nt, Mycobacterium bovis subsp bovis AF2122/97
agcguagcccgag

SEQ ID NO: 3176550 - RNA, 16 nt, Mycobacterium bovis subsp bovis AF2122/97
agcguagcccgaguug

SEQ ID NO: 3176551 - RNA, 23 nt, Mycobacterium bovis subsp bovis AF2122/97
agcguagcgaccucgccgcggcg

SEQ ID NO: 3176552 - RNA, 14 nt, Mycobacterium bovis subsp bovis AF2122/97
agcguaggccagcg

SEQ ID NO: 3176553 - RNA, 14 nt, Mycobacterium bovis subsp bovis AF2122/97
agcgucaaccgguc

SEQ ID NO: 3176554 - RNA, 15 nt, Mycobacterium bovis subsp bovis AF2122/97
agcgucaaccggucc

SEQ ID NO: 3176555 - RNA, 20 nt, Mycobacterium bovis subsp bovis AF2122/97
agcgucaggccuccaaaauc

SEQ ID NO: 3176556 - RNA, 22 nt, Mycobacterium bovis subsp bovis AF2122/97
agcgucaggccuccaaaaucgc

SEQ ID NO: 3176557 - RNA, 17 nt, Mycobacterium bovis subsp bovis AF2122/97
agcguccaggucaugcc

SEQ ID NO: 3176558 - RNA, 22 nt, Mycobacterium bovis subsp bovis AF2122/97
agcguccauggucgcgccaccc

SEQ ID NO: 3176559 - RNA, 17 nt, Mycobacterium bovis subsp bovis AF2122/97
agcguccccaugcagcg

SEQ ID NO: 3176560 - RNA, 14 nt, Mycobacterium bovis subsp bovis AF2122/97
agcguccgcgcccg

SEQ ID NO: 3176561 - RNA, 21 nt, Mycobacterium bovis subsp bovis AF2122/97
agcguccgcggaugcauguca

SEQ ID NO: 3176562 - RNA, 12 nt, Mycobacterium bovis subsp bovis AF2122/97
agcguccgcugc

SEQ ID NO: 3176563 - RNA, 21 nt, Mycobacterium bovis subsp bovis AF2122/97
agcguccgcugcagguccagg

SEQ ID NO: 3176564 - RNA, 15 nt, Mycobacterium bovis subsp bovis AF2122/97
agcguccgucgucgg

SEQ ID NO: 3176565 - RNA, 17 nt, Mycobacterium bovis subsp bovis AF2122/97
agcguccgucgucggcg

SEQ ID NO: 3176566 - RNA, 23 nt, Mycobacterium bovis subsp bovis AF2122/97
agcguccuggcguagugcagcug

SEQ ID NO: 3176567 - RNA, 11 nt, Mycobacterium bovis subsp bovis AF2122/97
agcguccuggu

SEQ ID NO: 3176568 - RNA, 17 nt, Mycobacterium bovis subsp bovis AF2122/97
agcgucgaacacgucgg

SEQ ID NO: 3176569 - RNA, 15 nt, Mycobacterium bovis subsp bovis AF2122/97
agcgucgacgucagc

SEQ ID NO: 3176570 - RNA, 13 nt, Mycobacterium bovis subsp bovis AF2122/97
agcgucgaucacc

SEQ ID NO: 3176571 - RNA, 14 nt, Mycobacterium bovis subsp bovis AF2122/97
agcgucgcggccac

SEQ ID NO: 3176572 - RNA, 15 nt, Mycobacterium bovis subsp bovis AF2122/97
agcgucgcggccacg

SEQ ID NO: 3176573 - RNA, 17 nt, Mycobacterium bovis subsp bovis AF2122/97
agcgucgcugcccgcgg

SEQ ID NO: 3176574 - RNA, 17 nt, Mycobacterium bovis subsp bovis AF2122/97
agcgucggugccaccac

SEQ ID NO: 3176575 - RNA, 20 nt, Mycobacterium bovis subsp bovis AF2122/97
agcgucguaaccgucgccug

SEQ ID NO: 3176576 - RNA, 13 nt, Mycobacterium bovis subsp bovis AF2122/97
agcgucguugcuc

SEQ ID NO: 3176577 - RNA, 13 nt, Mycobacterium bovis subsp bovis AF2122/97
agcgucucaaggc

SEQ ID NO: 3176578 - RNA, 21 nt, Mycobacterium bovis subsp bovis AF2122/97
agcgucucaaggccuuucaac

SEQ ID NO: 3176579 - RNA, 15 nt, Mycobacterium bovis subsp bovis AF2122/97
agcgucucgaucacc

SEQ ID NO: 3176580 - RNA, 17 nt, Mycobacterium bovis subsp bovis AF2122/97
agcgucucgaucaccuc

SEQ ID NO: 3176581 - RNA, 21 nt, Mycobacterium bovis subsp bovis AF2122/97
agcgucucgaucaccucgcgg

SEQ ID NO: 3176582 - RNA, 20 nt, Mycobacterium bovis subsp bovis AF2122/97
agcgucuggccgucgcuggu

SEQ ID NO: 3176583 - RNA, 21 nt, Mycobacterium bovis subsp bovis AF2122/97
agcgucuggcgacaucucggu

SEQ ID NO: 3176584 - RNA, 21 nt, Mycobacterium bovis subsp bovis AF2122/97
agcgucuggucagccgcggcg

SEQ ID NO: 3176585 - RNA, 16 nt, Mycobacterium bovis subsp bovis AF2122/97
agcgugaccaccgccg

SEQ ID NO: 3176586 - RNA, 18 nt, Mycobacterium bovis subsp bovis AF2122/97
agcgugacccgccggcga

SEQ ID NO: 3176587 - RNA, 18 nt, Mycobacterium bovis subsp bovis AF2122/97
agcgugagcgccgcggcg

SEQ ID NO: 3176588 - RNA, 21 nt, Mycobacterium bovis subsp bovis AF2122/97
agcgugauuucaacgucgcgu

SEQ ID NO: 3176589 - RNA, 16 nt, Mycobacterium bovis subsp bovis AF2122/97
agcgugcacacccgca

SEQ ID NO: 3176590 - RNA, 14 nt, Mycobacterium bovis subsp bovis AF2122/97
agcgugcacgggga

SEQ ID NO: 3176591 - RNA, 14 nt, Mycobacterium bovis subsp bovis AF2122/97
agcgugcagcggcg

SEQ ID NO: 3176592 - RNA, 21 nt, Mycobacterium bovis subsp bovis AF2122/97
agcgugcccgccaccggcgcg

SEQ ID NO: 3176593 - RNA, 23 nt, Mycobacterium bovis subsp bovis AF2122/97
agcgugccgaacagggaggucgc

SEQ ID NO: 3176594 - RNA, 20 nt, Mycobacterium bovis subsp bovis AF2122/97
agcgugccgcagcggcggca

SEQ ID NO: 3176595 - RNA, 23 nt, Mycobacterium bovis subsp bovis AF2122/97
agcgugccgcagcggcggcaacc

SEQ ID NO: 3176596 - RNA, 17 nt, Mycobacterium bovis subsp bovis AF2122/97
agcgugcgaugcagcgc

SEQ ID NO: 3176597 - RNA, 15 nt, Mycobacterium bovis subsp bovis AF2122/97
agcgugcggggcgcc

SEQ ID NO: 3176598 - RNA, 16 nt, Mycobacterium bovis subsp bovis AF2122/97
agcgugcggggcgccu

SEQ ID NO: 3176599 - RNA, 16 nt, Mycobacterium bovis subsp bovis AF2122/97
agcgugcugccgccuu

SEQ ID NO: 3176600 - RNA, 14 nt, Mycobacterium bovis subsp bovis AF2122/97
agcguggcaacgag

SEQ ID NO: 3176601 - RNA, 15 nt, Mycobacterium bovis subsp bovis AF2122/97
agcgugggcagcgcg

SEQ ID NO: 3176602 - RNA, 20 nt, Mycobacterium bovis subsp bovis AF2122/97
agcgugggcagcgcgaucac

SEQ ID NO: 3176603 - RNA, 17 nt, Mycobacterium bovis subsp bovis AF2122/97
agcguggggccgccacc

SEQ ID NO: 3176604 - RNA, 20 nt, Mycobacterium bovis subsp bovis AF2122/97
agcgugucgaugcgggcugu

SEQ ID NO: 3176605 - RNA, 20 nt, Mycobacterium bovis subsp bovis AF2122/97
agcgugucgcccuguucggc

SEQ ID NO: 3176606 - RNA, 17 nt, Mycobacterium bovis subsp bovis AF2122/97
agcgugucggccggcca

SEQ ID NO: 3176607 - RNA, 23 nt, Mycobacterium bovis subsp bovis AF2122/97
agcgugugcucgugggcgacgag

SEQ ID NO: 3176608 - RNA, 18 nt, Mycobacterium bovis subsp bovis AF2122/97
agcguguggagcucgcgg

SEQ ID NO: 3176609 - RNA, 14 nt, Mycobacterium bovis subsp bovis AF2122/97
agcguucaaggucu

SEQ ID NO: 3176610 - RNA, 13 nt, Mycobacterium bovis subsp bovis AF2122/97
agcguucccacac

SEQ ID NO: 3176611 - RNA, 22 nt, Mycobacterium bovis subsp bovis AF2122/97
agcguucuucagccaggguccc

SEQ ID NO: 3176612 - RNA, 14 nt, Mycobacterium bovis subsp bovis AF2122/97
agcguugaccgcgg

SEQ ID NO: 3176613 - RNA, 18 nt, Mycobacterium bovis subsp bovis AF2122/97
agcguugccaggugcugu

SEQ ID NO: 3176614 - RNA, 13 nt, Mycobacterium bovis subsp bovis AF2122/97
agcguugggacag

SEQ ID NO: 3176615 - RNA, 20 nt, Mycobacterium bovis subsp bovis AF2122/97
agcuacuaugccaacgacag

SEQ ID NO: 3176616 - RNA, 18 nt, Mycobacterium bovis subsp bovis AF2122/97
agcuagcccucagcuagc

SEQ ID NO: 3176617 - RNA, 23 nt, Mycobacterium bovis subsp bovis AF2122/97
agcuagcccucagcuagcgcggg

SEQ ID NO: 3176618 - RNA, 22 nt, Mycobacterium bovis subsp bovis AF2122/97
agcuagcgguggaaaaagcccg

SEQ ID NO: 3176619 - RNA, 13 nt, Mycobacterium bovis subsp bovis AF2122/97
agcuauacagcgg

SEQ ID NO: 3176620 - RNA, 21 nt, Mycobacterium bovis subsp bovis AF2122/97
agcuaucccaggggcaccgag

SEQ ID NO: 3176621 - RNA, 20 nt, Mycobacterium bovis subsp bovis AF2122/97
agcuauugcuauuccgcggc

SEQ ID NO: 3176622 - RNA, 21 nt, Mycobacterium bovis subsp bovis AF2122/97
agcucaaccaccucgccaaca

SEQ ID NO: 3176623 - RNA, 15 nt, Mycobacterium bovis subsp bovis AF2122/97
agcucaauuccaugc

SEQ ID NO: 3176624 - RNA, 21 nt, Mycobacterium bovis subsp bovis AF2122/97
agcucaauuccaugcaguugu

SEQ ID NO: 3176625 - RNA, 14 nt, Mycobacterium bovis subsp bovis AF2122/97
agcucaccacccgc

SEQ ID NO: 3176626 - RNA, 22 nt, Mycobacterium bovis subsp bovis AF2122/97
agcucaccacccgcacuccaag

SEQ ID NO: 3176627 - RNA, 11 nt, Mycobacterium bovis subsp bovis AF2122/97
agcucacccug

SEQ ID NO: 3176628 - RNA, 14 nt, Mycobacterium bovis subsp bovis AF2122/97
agcucggucagcgu

SEQ ID NO: 3176629 - RNA, 22 nt, Mycobacterium bovis subsp bovis AF2122/97
agcucggugacaagcggcccgc

SEQ ID NO: 3176630 - RNA, 20 nt, Mycobacterium bovis subsp bovis AF2122/97
agcucguaguguuccaacac

SEQ ID NO: 3176631 - RNA, 15 nt, Mycobacterium bovis subsp bovis AF2122/97
agcucgucgacgucg

SEQ ID NO: 3176632 - RNA, 16 nt, Mycobacterium bovis subsp bovis AF2122/97
agcucgucgagcgcgu

SEQ ID NO: 3176633 - RNA, 21 nt, Mycobacterium bovis subsp bovis AF2122/97
agcucgucgaggaagaucacc

SEQ ID NO: 3176634 - RNA, 20 nt, Mycobacterium bovis subsp bovis AF2122/97
agcucgucggcgauggccag

SEQ ID NO: 3176635 - RNA, 15 nt, Mycobacterium bovis subsp bovis AF2122/97
agcucgugaccgccg

SEQ ID NO: 3176636 - RNA, 22 nt, Mycobacterium bovis subsp bovis AF2122/97
agcucguugcuggcggccagca

SEQ ID NO: 3176637 - RNA, 19 nt, Mycobacterium bovis subsp bovis AF2122/97
agcucucggcacccggcag

SEQ ID NO: 3176638 - RNA, 13 nt, Mycobacterium bovis subsp bovis AF2122/97
agcucuucggaca

SEQ ID NO: 3176639 - RNA, 18 nt, Mycobacterium bovis subsp bovis AF2122/97
agcucuucggacacagcc

SEQ ID NO: 3176640 - RNA, 18 nt, Mycobacterium bovis subsp bovis AF2122/97
agcucuugcgggcagccg

SEQ ID NO: 3176641 - RNA, 19 nt, Mycobacterium bovis subsp bovis AF2122/97
agcugaaaauaggccgggc

SEQ ID NO: 3176642 - RNA, 23 nt, Mycobacterium bovis subsp bovis AF2122/97
agcugaacacgaauccggccacu

SEQ ID NO: 3176643 - RNA, 13 nt, Mycobacterium bovis subsp bovis AF2122/97
agcugaccgccag

SEQ ID NO: 3176644 - RNA, 19 nt, Mycobacterium bovis subsp bovis AF2122/97
agcugaccgccagcggccg

SEQ ID NO: 3176645 - RNA, 16 nt, Mycobacterium bovis subsp bovis AF2122/97
agcugacgagccggug

SEQ ID NO: 3176646 - RNA, 19 nt, Mycobacterium bovis subsp bovis AF2122/97
agcugacgagccgguggcg

SEQ ID NO: 3176647 - RNA, 19 nt, Mycobacterium bovis subsp bovis AF2122/97
agcugacgauggccaggcc

SEQ ID NO: 3176648 - RNA, 18 nt, Mycobacterium bovis subsp bovis AF2122/97
agcugacgccgagcuggu

SEQ ID NO: 3176649 - RNA, 13 nt, Mycobacterium bovis subsp bovis AF2122/97
agcugacgcugcu

SEQ ID NO: 3176650 - RNA, 15 nt, Mycobacterium bovis subsp bovis AF2122/97
agcugacgucaccac

SEQ ID NO: 3176651 - RNA, 17 nt, Mycobacterium bovis subsp bovis AF2122/97
agcugacgucaccacga

SEQ ID NO: 3176652 - RNA, 21 nt, Mycobacterium bovis subsp bovis AF2122/97
agcugacgucaccacgaucgc

SEQ ID NO: 3176653 - RNA, 12 nt, Mycobacterium bovis subsp bovis AF2122/97
agcugagccguc

SEQ ID NO: 3176654 - RNA, 16 nt, Mycobacterium bovis subsp bovis AF2122/97
agcugagccgucggcg

SEQ ID NO: 3176655 - RNA, 18 nt, Mycobacterium bovis subsp bovis AF2122/97
agcugagcggccggcaug

SEQ ID NO: 3176656 - RNA, 11 nt, Mycobacterium bovis subsp bovis AF2122/97
agcugaucacg

SEQ ID NO: 3176657 - RNA, 23 nt, Mycobacterium bovis subsp bovis AF2122/97
agcugauccggguggcgucaccg

SEQ ID NO: 3176658 - RNA, 14 nt, Mycobacterium bovis subsp bovis AF2122/97
agcugaucuuggca

SEQ ID NO: 3176659 - RNA, 19 nt, Mycobacterium bovis subsp bovis AF2122/97
agcugaugccuggucgcgg

SEQ ID NO: 3176660 - RNA, 23 nt, Mycobacterium bovis subsp bovis AF2122/97
agcugcaaugacuggaccgcggu

SEQ ID NO: 3176661 - RNA, 18 nt, Mycobacterium bovis subsp bovis AF2122/97
agcugcaccuccgacggc

SEQ ID NO: 3176662 - RNA, 20 nt, Mycobacterium bovis subsp bovis AF2122/97
agcugccccgccaccucgcc

SEQ ID NO: 3176663 - RNA, 16 nt, Mycobacterium bovis subsp bovis AF2122/97
agcugcccgacguugu

SEQ ID NO: 3176664 - RNA, 16 nt, Mycobacterium bovis subsp bovis AF2122/97
agcugcccgccagcgc

SEQ ID NO: 3176665 - RNA, 18 nt, Mycobacterium bovis subsp bovis AF2122/97
agcugcccgccagcgccg

SEQ ID NO: 3176666 - RNA, 21 nt, Mycobacterium bovis subsp bovis AF2122/97
agcugcccgccagcgccgccg

SEQ ID NO: 3176667 - RNA, 22 nt, Mycobacterium bovis subsp bovis AF2122/97
agcugcccgccagcgccgccgc

SEQ ID NO: 3176668 - RNA, 15 nt, Mycobacterium bovis subsp bovis AF2122/97
agcugccgcaccccc

SEQ ID NO: 3176669 - RNA, 21 nt, Mycobacterium bovis subsp bovis AF2122/97
agcugccgcacccccuccgcg

SEQ ID NO: 3176670 - RNA, 22 nt, Mycobacterium bovis subsp bovis AF2122/97
agcugccgcacccccuccgcga

SEQ ID NO: 3176671 - RNA, 14 nt, Mycobacterium bovis subsp bovis AF2122/97
agcugccgcggccg

SEQ ID NO: 3176672 - RNA, 17 nt, Mycobacterium bovis subsp bovis AF2122/97
agcugccgcggccggcg

SEQ ID NO: 3176673 - RNA, 12 nt, Mycobacterium bovis subsp bovis AF2122/97
agcugccggccc

SEQ ID NO: 3176674 - RNA, 17 nt, Mycobacterium bovis subsp bovis AF2122/97
agcugccggcccaccag

SEQ ID NO: 3176675 - RNA, 13 nt, Mycobacterium bovis subsp bovis AF2122/97
agcugccgucgcu

SEQ ID NO: 3176676 - RNA, 15 nt, Mycobacterium bovis subsp bovis AF2122/97
agcugccgucggugc

SEQ ID NO: 3176677 - RNA, 17 nt, Mycobacterium bovis subsp bovis AF2122/97
agcugccgucggugccg

SEQ ID NO: 3176678 - RNA, 17 nt, Mycobacterium bovis subsp bovis AF2122/97
agcugcgacgaugccgc

SEQ ID NO: 3176679 - RNA, 21 nt, Mycobacterium bovis subsp bovis AF2122/97
agcugcgacgaugccgccugg

SEQ ID NO: 3176680 - RNA, 22 nt, Mycobacterium bovis subsp bovis AF2122/97
agcugcgacgaugccgccuggu

SEQ ID NO: 3176681 - RNA, 18 nt, Mycobacterium bovis subsp bovis AF2122/97
agcugcgagucgucgcca

SEQ ID NO: 3176682 - RNA, 18 nt, Mycobacterium bovis subsp bovis AF2122/97
agcugcgcgaagccacca

SEQ ID NO: 3176683 - RNA, 19 nt, Mycobacterium bovis subsp bovis AF2122/97
agcugcgcgaagccaccag

SEQ ID NO: 3176684 - RNA, 17 nt, Mycobacterium bovis subsp bovis AF2122/97
agcugcggauacagccg

SEQ ID NO: 3176685 - RNA, 17 nt, Mycobacterium bovis subsp bovis AF2122/97
agcugcggauccaccac

SEQ ID NO: 3176686 - RNA, 13 nt, Mycobacterium bovis subsp bovis AF2122/97
agcugcggcggcc

SEQ ID NO: 3176687 - RNA, 19 nt, Mycobacterium bovis subsp bovis AF2122/97
agcugcggcuccggcggca

SEQ ID NO: 3176688 - RNA, 18 nt, Mycobacterium bovis subsp bovis AF2122/97
agcugcgggucagcgccg

SEQ ID NO: 3176689 - RNA, 23 nt, Mycobacterium bovis subsp bovis AF2122/97
agcugcgggucgugccccggcgc

SEQ ID NO: 3176690 - RNA, 17 nt, Mycobacterium bovis subsp bovis AF2122/97
agcugcgggucucgccg

SEQ ID NO: 3176691 - RNA, 21 nt, Mycobacterium bovis subsp bovis AF2122/97
agcugcggucgaacaucaucg

SEQ ID NO: 3176692 - RNA, 14 nt, Mycobacterium bovis subsp bovis AF2122/97
agcugcggucgcgg

SEQ ID NO: 3176693 - RNA, 14 nt, Mycobacterium bovis subsp bovis AF2122/97
agcugcucgccggc

SEQ ID NO: 3176694 - RNA, 15 nt, Mycobacterium bovis subsp bovis AF2122/97
agcugcucgccggcc

SEQ ID NO: 3176695 - RNA, 16 nt, Mycobacterium bovis subsp bovis AF2122/97
agcugcucgccggcca

SEQ ID NO: 3176696 - RNA, 21 nt, Mycobacterium bovis subsp bovis AF2122/97
agcugcucgccggccaacugg

SEQ ID NO: 3176697 - RNA, 19 nt, Mycobacterium bovis subsp bovis AF2122/97
agcugcucggucaggcggc

SEQ ID NO: 3176698 - RNA, 19 nt, Mycobacterium bovis subsp bovis AF2122/97
agcugcucgucggcgccgg

SEQ ID NO: 3176699 - RNA, 15 nt, Mycobacterium bovis subsp bovis AF2122/97
agcugcucgucgucg

SEQ ID NO: 3176700 - RNA, 16 nt, Mycobacterium bovis subsp bovis AF2122/97
agcugcucgucuuggc

SEQ ID NO: 3176701 - RNA, 14 nt, Mycobacterium bovis subsp bovis AF2122/97
agcugcugaugcgg

SEQ ID NO: 3176702 - RNA, 15 nt, Mycobacterium bovis subsp bovis AF2122/97
agcugcugaugcggu

SEQ ID NO: 3176703 - RNA, 23 nt, Mycobacterium bovis subsp bovis AF2122/97
agcugcugaugcgguagucgccg

SEQ ID NO: 3176704 - RNA, 22 nt, Mycobacterium bovis subsp bovis AF2122/97
agcugcugccgauacagcacau

SEQ ID NO: 3176705 - RNA, 16 nt, Mycobacterium bovis subsp bovis AF2122/97
agcugcugcugcuuga

SEQ ID NO: 3176706 - RNA, 21 nt, Mycobacterium bovis subsp bovis AF2122/97
agcugcuggaugucgucgacg

SEQ ID NO: 3176707 - RNA, 16 nt, Mycobacterium bovis subsp bovis AF2122/97
agcugcuggcgcgccu

SEQ ID NO: 3176708 - RNA, 13 nt, Mycobacterium bovis subsp bovis AF2122/97
agcuggacuccgg

SEQ ID NO: 3176709 - RNA, 17 nt, Mycobacterium bovis subsp bovis AF2122/97
agcuggcaacgccgcgc

SEQ ID NO: 3176710 - RNA, 22 nt, Mycobacterium bovis subsp bovis AF2122/97
agcuggccgauguaguccggcc

SEQ ID NO: 3176711 - RNA, 21 nt, Mycobacterium bovis subsp bovis AF2122/97
agcuggccgucagcgucggcg

SEQ ID NO: 3176712 - RNA, 12 nt, Mycobacterium bovis subsp bovis AF2122/97
agcuggcgcgcg

SEQ ID NO: 3176713 - RNA, 17 nt, Mycobacterium bovis subsp bovis AF2122/97
agcuggcgcgcggggug

SEQ ID NO: 3176714 - RNA, 19 nt, Mycobacterium bovis subsp bovis AF2122/97
aggaaccgggcaaaucaag

SEQ ID NO: 3176715 - RNA, 15 nt, Mycobacterium bovis subsp bovis AF2122/97
aggaaccgucgaaga

SEQ ID NO: 3176716 - RNA, 13 nt, Mycobacterium bovis subsp bovis AF2122/97
aggaacgccgggg

SEQ ID NO: 3176717 - RNA, 14 nt, Mycobacterium bovis subsp bovis AF2122/97
aggaacucggaccc

SEQ ID NO: 3176718 - RNA, 17 nt, Mycobacterium bovis subsp bovis AF2122/97
aggaacucggcccacac

SEQ ID NO: 3176719 - RNA, 20 nt, Mycobacterium bovis subsp bovis AF2122/97
aggaacucggcccacacggu

SEQ ID NO: 3176720 - RNA, 21 nt, Mycobacterium bovis subsp bovis AF2122/97
aggaacugaaacgcuuggccc

SEQ ID NO: 3176721 - RNA, 17 nt, Mycobacterium bovis subsp bovis AF2122/97
aggaagaucaccucccg

SEQ ID NO: 3176722 - RNA, 20 nt, Mycobacterium bovis subsp bovis AF2122/97
aggaagcccacgaucgcguc

SEQ ID NO: 3176723 - RNA, 12 nt, Mycobacterium bovis subsp bovis AF2122/97
aggaagccgaga

SEQ ID NO: 3176724 - RNA, 14 nt, Mycobacterium bovis subsp bovis AF2122/97
aggaagccgcggcc

SEQ ID NO: 3176725 - RNA, 18 nt, Mycobacterium bovis subsp bovis AF2122/97
aggaagccgcggccacgg

SEQ ID NO: 3176726 - RNA, 22 nt, Mycobacterium bovis subsp bovis AF2122/97
aggaagccgcggccacgguaga

SEQ ID NO: 3176727 - RNA, 14 nt, Mycobacterium bovis subsp bovis AF2122/97
aggaagcggccggu

SEQ ID NO: 3176728 - RNA, 17 nt, Mycobacterium bovis subsp bovis AF2122/97
aggaagcggcggcaacc

SEQ ID NO: 3176729 - RNA, 20 nt, Mycobacterium bovis subsp bovis AF2122/97
aggaaguagaugagcagacc

SEQ ID NO: 3176730 - RNA, 18 nt, Mycobacterium bovis subsp bovis AF2122/97
aggaagucccgggcaccg

SEQ ID NO: 3176731 - RNA, 22 nt, Mycobacterium bovis subsp bovis AF2122/97
aggaauacagcuugaucgccga

SEQ ID NO: 3176732 - RNA, 19 nt, Mycobacterium bovis subsp bovis AF2122/97
aggaaucccucggccgcag

SEQ ID NO: 3176733 - RNA, 21 nt, Mycobacterium bovis subsp bovis AF2122/97
aggaaucccucggccgcaggc

SEQ ID NO: 3176734 - RNA, 21 nt, Mycobacterium bovis subsp bovis AF2122/97
aggaauucgccauagcgggcg

SEQ ID NO: 3176735 - RNA, 16 nt, Mycobacterium bovis subsp bovis AF2122/97
aggacaagccgcugau

SEQ ID NO: 3176736 - RNA, 16 nt, Mycobacterium bovis subsp bovis AF2122/97
aggacaagugccggcg

SEQ ID NO: 3176737 - RNA, 18 nt, Mycobacterium bovis subsp bovis AF2122/97
aggacaauuuucgcaccu

SEQ ID NO: 3176738 - RNA, 15 nt, Mycobacterium bovis subsp bovis AF2122/97
aggacacauugacca

SEQ ID NO: 3176739 - RNA, 12 nt, Mycobacterium bovis subsp bovis AF2122/97
aggacaccaccg

SEQ ID NO: 3176740 - RNA, 15 nt, Mycobacterium bovis subsp bovis AF2122/97
aggacaccagcugga

SEQ ID NO: 3176741 - RNA, 14 nt, Mycobacterium bovis subsp bovis AF2122/97
aggacaccggcacc

SEQ ID NO: 3176742 - RNA, 17 nt, Mycobacterium bovis subsp bovis AF2122/97
aggacagcagccgccgg

SEQ ID NO: 3176743 - RNA, 22 nt, Mycobacterium bovis subsp bovis AF2122/97
aggacagcagccgccggccggc

SEQ ID NO: 3176744 - RNA, 13 nt, Mycobacterium bovis subsp bovis AF2122/97
aggaccaccuggu

SEQ ID NO: 3176745 - RNA, 17 nt, Mycobacterium bovis subsp bovis AF2122/97
aggaccagagcucgaag

SEQ ID NO: 3176746 - RNA, 14 nt, Mycobacterium bovis subsp bovis AF2122/97
aggaccagaggcgc

SEQ ID NO: 3176747 - RNA, 13 nt, Mycobacterium bovis subsp bovis AF2122/97
aggaccagcaccg

SEQ ID NO: 3176748 - RNA, 17 nt, Mycobacterium bovis subsp bovis AF2122/97
aggaccagcaccgccgc

SEQ ID NO: 3176749 - RNA, 19 nt, Mycobacterium bovis subsp bovis AF2122/97
aggaccagcaccgccgcgc

SEQ ID NO: 3176750 - RNA, 21 nt, Mycobacterium bovis subsp bovis AF2122/97
aggacccaucgccagcaucag

SEQ ID NO: 3176751 - RNA, 18 nt, Mycobacterium bovis subsp bovis AF2122/97
aggaccgcgcccagaccg

SEQ ID NO: 3176752 - RNA, 21 nt, Mycobacterium bovis subsp bovis AF2122/97
aggaccgcgccgaucaccacc

SEQ ID NO: 3176753 - RNA, 16 nt, Mycobacterium bovis subsp bovis AF2122/97
aggaccgcucugcggc

SEQ ID NO: 3176754 - RNA, 23 nt, Mycobacterium bovis subsp bovis AF2122/97
aggaccgggaucgucaggcccau

SEQ ID NO: 3176755 - RNA, 23 nt, Mycobacterium bovis subsp bovis AF2122/97
aggaccggugggucugcucagcg

SEQ ID NO: 3176756 - RNA, 14 nt, Mycobacterium bovis subsp bovis AF2122/97
aggaccucgucacc

SEQ ID NO: 3176757 - RNA, 21 nt, Mycobacterium bovis subsp bovis AF2122/97
aggaccucgucaccggucagc

SEQ ID NO: 3176758 - RNA, 16 nt, Mycobacterium bovis subsp bovis AF2122/97
aggaccugcucgggcg

SEQ ID NO: 3176759 - RNA, 16 nt, Mycobacterium bovis subsp bovis AF2122/97
aggaccugugcggccg

SEQ ID NO: 3176760 - RNA, 17 nt, Mycobacterium bovis subsp bovis AF2122/97
aggaccugugcggccga

SEQ ID NO: 3176761 - RNA, 19 nt, Mycobacterium bovis subsp bovis AF2122/97
aggacgaacaacgcgacga

SEQ ID NO: 3176762 - RNA, 16 nt, Mycobacterium bovis subsp bovis AF2122/97
aggacgaacgcgccgg

SEQ ID NO: 3176763 - RNA, 16 nt, Mycobacterium bovis subsp bovis AF2122/97
aggacgacgccgacga

SEQ ID NO: 3176764 - RNA, 12 nt, Mycobacterium bovis subsp bovis AF2122/97
aggacgcaccgc

SEQ ID NO: 3176765 - RNA, 13 nt, Mycobacterium bovis subsp bovis AF2122/97
aggacgcaccgcc

SEQ ID NO: 3176766 - RNA, 13 nt, Mycobacterium bovis subsp bovis AF2122/97
aggacgccagcaa

SEQ ID NO: 3176767 - RNA, 16 nt, Mycobacterium bovis subsp bovis AF2122/97
aggacgccagcaaugc

SEQ ID NO: 3176768 - RNA, 13 nt, Mycobacterium bovis subsp bovis AF2122/97
aggacgccgcgcc

SEQ ID NO: 3176769 - RNA, 14 nt, Mycobacterium bovis subsp bovis AF2122/97
aggacgccgcgccg

SEQ ID NO: 3176770 - RNA, 15 nt, Mycobacterium bovis subsp bovis AF2122/97
aggacggagcccaaa

SEQ ID NO: 3176771 - RNA, 21 nt, Mycobacterium bovis subsp bovis AF2122/97
aggacggcgcgagccgcacga

SEQ ID NO: 3176772 - RNA, 20 nt, Mycobacterium bovis subsp bovis AF2122/97
aggacggcguagacguccgc

SEQ ID NO: 3176773 - RNA, 13 nt, Mycobacterium bovis subsp bovis AF2122/97
aggacggcugccg

SEQ ID NO: 3176774 - RNA, 19 nt, Mycobacterium bovis subsp bovis AF2122/97
aggacggcuugagccgcag

SEQ ID NO: 3176775 - RNA, 23 nt, Mycobacterium bovis subsp bovis AF2122/97
aggacgguugagauggucaccgg

SEQ ID NO: 3176776 - RNA, 15 nt, Mycobacterium bovis subsp bovis AF2122/97
aggacgucaccguca

SEQ ID NO: 3176777 - RNA, 22 nt, Mycobacterium bovis subsp bovis AF2122/97
aggacgucggcgaauccgccgc

SEQ ID NO: 3176778 - RNA, 21 nt, Mycobacterium bovis subsp bovis AF2122/97
aggacguuucagccgggugcc

SEQ ID NO: 3176779 - RNA, 20 nt, Mycobacterium bovis subsp bovis AF2122/97
aggacguuugagaccccaac

SEQ ID NO: 3176780 - RNA, 13 nt, Mycobacterium bovis subsp bovis AF2122/97
aggacucacgcag

SEQ ID NO: 3176781 - RNA, 15 nt, Mycobacterium bovis subsp bovis AF2122/97
aggacucacgcagcg

SEQ ID NO: 3176782 - RNA, 18 nt, Mycobacterium bovis subsp bovis AF2122/97
aggacucacgcagcgcca

SEQ ID NO: 3176783 - RNA, 14 nt, Mycobacterium bovis subsp bovis AF2122/97
aggacuccggccgc

SEQ ID NO: 3176784 - RNA, 18 nt, Mycobacterium bovis subsp bovis AF2122/97
aggacucggacgcgccgg

SEQ ID NO: 3176785 - RNA, 17 nt, Mycobacterium bovis subsp bovis AF2122/97
aggacucuucggucagg

SEQ ID NO: 3176786 - RNA, 22 nt, Mycobacterium bovis subsp bovis AF2122/97
aggacugaacaguugcacaccg

SEQ ID NO: 3176787 - RNA, 22 nt, Mycobacterium bovis subsp bovis AF2122/97
aggacugaccgucugcgacccg

SEQ ID NO: 3176788 - RNA, 15 nt, Mycobacterium bovis subsp bovis AF2122/97
aggacugcgccaccg

SEQ ID NO: 3176789 - RNA, 16 nt, Mycobacterium bovis subsp bovis AF2122/97
aggacugcgccaccgg

SEQ ID NO: 3176790 - RNA, 17 nt, Mycobacterium bovis subsp bovis AF2122/97
aggacuggaaagcagca

SEQ ID NO: 3176791 - RNA, 17 nt, Mycobacterium bovis subsp bovis AF2122/97
aggacuggcaccgccag

SEQ ID NO: 3176792 - RNA, 18 nt, Mycobacterium bovis subsp bovis AF2122/97
aggacuucggugagcagg

SEQ ID NO: 3176793 - RNA, 21 nt, Mycobacterium bovis subsp bovis AF2122/97
aggacuucggugagcagggcg

SEQ ID NO: 3176794 - RNA, 14 nt, Mycobacterium bovis subsp bovis AF2122/97
aggacuucugcugc

SEQ ID NO: 3176795 - RNA, 20 nt, Mycobacterium bovis subsp bovis AF2122/97
aggacuugcacgucggcugc

SEQ ID NO: 3176796 - RNA, 19 nt, Mycobacterium bovis subsp bovis AF2122/97
aggacuuguccaucacauc

SEQ ID NO: 3176797 - RNA, 16 nt, Mycobacterium bovis subsp bovis AF2122/97
aggagaaccaaaccgc

SEQ ID NO: 3176798 - RNA, 22 nt, Mycobacterium bovis subsp bovis AF2122/97
aggagaauuaguuucgucccca

SEQ ID NO: 3176799 - RNA, 13 nt, Mycobacterium bovis subsp bovis AF2122/97
aggagaucagcac

SEQ ID NO: 3176800 - RNA, 15 nt, Mycobacterium bovis subsp bovis AF2122/97
aggagaucagcaccg

SEQ ID NO: 3176801 - RNA, 22 nt, Mycobacterium bovis subsp bovis AF2122/97
aggccgcuugccccgccuuggc

SEQ ID NO: 3176802 - RNA, 18 nt, Mycobacterium bovis subsp bovis AF2122/97
aggccggaagauccgggc

SEQ ID NO: 3176803 - RNA, 16 nt, Mycobacterium bovis subsp bovis AF2122/97
aggccggagucgacga

SEQ ID NO: 3176804 - RNA, 18 nt, Mycobacterium bovis subsp bovis AF2122/97
aggccggagucgacgacg

SEQ ID NO: 3176805 - RNA, 14 nt, Mycobacterium bovis subsp bovis AF2122/97
aggccggcaaggca

SEQ ID NO: 3176806 - RNA, 12 nt, Mycobacterium bovis subsp bovis AF2122/97
aggccggcaccc

SEQ ID NO: 3176807 - RNA, 16 nt, Mycobacterium bovis subsp bovis AF2122/97
aggccggcauggcggc

SEQ ID NO: 3176808 - RNA, 12 nt, Mycobacterium bovis subsp bovis AF2122/97
aggccggccacc

SEQ ID NO: 3176809 - RNA, 13 nt, Mycobacterium bovis subsp bovis AF2122/97
aggccggccacca

SEQ ID NO: 3176810 - RNA, 23 nt, Mycobacterium bovis subsp bovis AF2122/97
aggccggccaccgagucgaucac

SEQ ID NO: 3176811 - RNA, 17 nt, Mycobacterium bovis subsp bovis AF2122/97
aggccggcccgcaacgc

SEQ ID NO: 3176812 - RNA, 16 nt, Mycobacterium bovis subsp bovis AF2122/97
aggccggcgaccgggc

SEQ ID NO: 3176813 - RNA, 20 nt, Mycobacterium bovis subsp bovis AF2122/97
aggccggcggcggcgcucgg

SEQ ID NO: 3176814 - RNA, 17 nt, Mycobacterium bovis subsp bovis AF2122/97
aggccggcggcgguggu

SEQ ID NO: 3176815 - RNA, 15 nt, Mycobacterium bovis subsp bovis AF2122/97
aggccggcggucagc

SEQ ID NO: 3176816 - RNA, 22 nt, Mycobacterium bovis subsp bovis AF2122/97
aggccggcggucagcagcgccg

SEQ ID NO: 3176817 - RNA, 22 nt, Mycobacterium bovis subsp bovis AF2122/97
aggccggcgucgaucaacaaca

SEQ ID NO: 3176818 - RNA, 23 nt, Mycobacterium bovis subsp bovis AF2122/97
aggccggcuaccgcgcucccggc

SEQ ID NO: 3176819 - RNA, 17 nt, Mycobacterium bovis subsp bovis AF2122/97
aggccggcucgccgacc

SEQ ID NO: 3176820 - RNA, 17 nt, Mycobacterium bovis subsp bovis AF2122/97
aggccgggccggccacg

SEQ ID NO: 3176821 - RNA, 18 nt, Mycobacterium bovis subsp bovis AF2122/97
aggccggugaacgguagc

SEQ ID NO: 3176822 - RNA, 22 nt, Mycobacterium bovis subsp bovis AF2122/97
aggccggugcgucacagccggg

SEQ ID NO: 3176823 - RNA, 23 nt, Mycobacterium bovis subsp bovis AF2122/97
aggccggugcgucacagccgggu

SEQ ID NO: 3176824 - RNA, 14 nt, Mycobacterium bovis subsp bovis AF2122/97
aggccgguucccuu

SEQ ID NO: 3176825 - RNA, 18 nt, Mycobacterium bovis subsp bovis AF2122/97
aggccgguuugcacgcac

SEQ ID NO: 3176826 - RNA, 23 nt, Mycobacterium bovis subsp bovis AF2122/97
aggccgguuugcacgcaccacaa

SEQ ID NO: 3176827 - RNA, 15 nt, Mycobacterium bovis subsp bovis AF2122/97
aggccguacucgaug

SEQ ID NO: 3176828 - RNA, 16 nt, Mycobacterium bovis subsp bovis AF2122/97
aggccguacucgauga

SEQ ID NO: 3176829 - RNA, 16 nt, Mycobacterium bovis subsp bovis AF2122/97
aggccguagcccacga

SEQ ID NO: 3176830 - RNA, 19 nt, Mycobacterium bovis subsp bovis AF2122/97
aggccguagcccacgacga

SEQ ID NO: 3176831 - RNA, 18 nt, Mycobacterium bovis subsp bovis AF2122/97
aggccguccucggucagc

SEQ ID NO: 3176832 - RNA, 21 nt, Mycobacterium bovis subsp bovis AF2122/97
aggccgucgaguuccggccgg

SEQ ID NO: 3176833 - RNA, 13 nt, Mycobacterium bovis subsp bovis AF2122/97
aggccgucgccgg

SEQ ID NO: 3176834 - RNA, 16 nt, Mycobacterium bovis subsp bovis AF2122/97
aggccgucggcgucga

SEQ ID NO: 3176835 - RNA, 19 nt, Mycobacterium bovis subsp bovis AF2122/97
aggccgucguugccggcga

SEQ ID NO: 3176836 - RNA, 22 nt, Mycobacterium bovis subsp bovis AF2122/97
aggccgucguugccggcgacca

SEQ ID NO: 3176837 - RNA, 13 nt, Mycobacterium bovis subsp bovis AF2122/97
aggccguggcgga

SEQ ID NO: 3176838 - RNA, 15 nt, Mycobacterium bovis subsp bovis AF2122/97
aggccguggucgagg

SEQ ID NO: 3176839 - RNA, 21 nt, Mycobacterium bovis subsp bovis AF2122/97
aggccguugcuauucgccagc

SEQ ID NO: 3176840 - RNA, 14 nt, Mycobacterium bovis subsp bovis AF2122/97
aggccuaccaggcg

SEQ ID NO: 3176841 - RNA, 14 nt, Mycobacterium bovis subsp bovis AF2122/97
aggccuagcgcggc

SEQ ID NO: 3176842 - RNA, 22 nt, Mycobacterium bovis subsp bovis AF2122/97
aggccuaguccggcacugcggc

SEQ ID NO: 3176843 - RNA, 14 nt, Mycobacterium bovis subsp bovis AF2122/97
aggccuccaaaauc

SEQ ID NO: 3176844 - RNA, 22 nt, Mycobacterium bovis subsp bovis AF2122/97
aggccuccaaaaucgcggccac

SEQ ID NO: 3176845 - RNA, 14 nt, Mycobacterium bovis subsp bovis AF2122/97
aggccuccgcugcc

SEQ ID NO: 3176846 - RNA, 18 nt, Mycobacterium bovis subsp bovis AF2122/97
aggccuccgcugccgccc

SEQ ID NO: 3176847 - RNA, 15 nt, Mycobacterium bovis subsp bovis AF2122/97
aggccucggccagcg

SEQ ID NO: 3176848 - RNA, 23 nt, Mycobacterium bovis subsp bovis AF2122/97
aggccucggcgccgcccagcauc

SEQ ID NO: 3176849 - RNA, 16 nt, Mycobacterium bovis subsp bovis AF2122/97
aggccugcccccggcg

SEQ ID NO: 3176850 - RNA, 14 nt, Mycobacterium bovis subsp bovis AF2122/97
aggccuggccccgg

SEQ ID NO: 3176851 - RNA, 15 nt, Mycobacterium bovis subsp bovis AF2122/97
aggcgaaaaacaccu

SEQ ID NO: 3176852 - RNA, 13 nt, Mycobacterium bovis subsp bovis AF2122/97
aggcgaacaccag

SEQ ID NO: 3176853 - RNA, 14 nt, Mycobacterium bovis subsp bovis AF2122/97
aggcgaaccgcucc

SEQ ID NO: 3176854 - RNA, 13 nt, Mycobacterium bovis subsp bovis AF2122/97
aggcgaaccuggu

SEQ ID NO: 3176855 - RNA, 21 nt, Mycobacterium bovis subsp bovis AF2122/97
aggcgaagcgggacugcagcg

SEQ ID NO: 3176856 - RNA, 14 nt, Mycobacterium bovis subsp bovis AF2122/97
aggcgaagcgguga

SEQ ID NO: 3176857 - RNA, 20 nt, Mycobacterium bovis subsp bovis AF2122/97
aggcgaagguccgugccgau

SEQ ID NO: 3176858 - RNA, 17 nt, Mycobacterium bovis subsp bovis AF2122/97
aggcgacaucaccaccg

SEQ ID NO: 3176859 - RNA, 18 nt, Mycobacterium bovis subsp bovis AF2122/97
aggcgacaucaccaccga

SEQ ID NO: 3176860 - RNA, 20 nt, Mycobacterium bovis subsp bovis AF2122/97
aggcgaccccggccccgacg

SEQ ID NO: 3176861 - RNA, 17 nt, Mycobacterium bovis subsp bovis AF2122/97
aggcgaccggacgagcg

SEQ ID NO: 3176862 - RNA, 22 nt, Mycobacterium bovis subsp bovis AF2122/97
aggcgacgccgaaaaugccgcc

SEQ ID NO: 3176863 - RNA, 15 nt, Mycobacterium bovis subsp bovis AF2122/97
aggcgagaagcgucg

SEQ ID NO: 3176864 - RNA, 15 nt, Mycobacterium bovis subsp bovis AF2122/97
aggcgagccgccacc

SEQ ID NO: 3176865 - RNA, 14 nt, Mycobacterium bovis subsp bovis AF2122/97
aggcgagucaccgg

SEQ ID NO: 3176866 - RNA, 19 nt, Mycobacterium bovis subsp bovis AF2122/97
aggcgagucaccgggucca

SEQ ID NO: 3176867 - RNA, 20 nt, Mycobacterium bovis subsp bovis AF2122/97
aggcgaguuaggccgccagc

SEQ ID NO: 3176868 - RNA, 18 nt, Mycobacterium bovis subsp bovis AF2122/97
aggcgauaucgcacaugg

SEQ ID NO: 3176869 - RNA, 13 nt, Mycobacterium bovis subsp bovis AF2122/97
aggcgauaucgcc

SEQ ID NO: 3176870 - RNA, 23 nt, Mycobacterium bovis subsp bovis AF2122/97
aggcgauaucgcccggaacgaau

SEQ ID NO: 3176871 - RNA, 14 nt, Mycobacterium bovis subsp bovis AF2122/97
aggcgaucaccgcg

SEQ ID NO: 3176872 - RNA, 15 nt, Mycobacterium bovis subsp bovis AF2122/97
aggcgaucaccgcgc

SEQ ID NO: 3176873 - RNA, 16 nt, Mycobacterium bovis subsp bovis AF2122/97
aggcgaucaccgcgcc

SEQ ID NO: 3176874 - RNA, 17 nt, Mycobacterium bovis subsp bovis AF2122/97
aggcgaucaccgcgccg

SEQ ID NO: 3176875 - RNA, 22 nt, Mycobacterium bovis subsp bovis AF2122/97
aggcgaucaccgcgccggagau

SEQ ID NO: 3176876 - RNA, 16 nt, Mycobacterium bovis subsp bovis AF2122/97
aggcgauccagacggu

SEQ ID NO: 3176877 - RNA, 15 nt, Mycobacterium bovis subsp bovis AF2122/97
aggcgaucgucuccu

SEQ ID NO: 3176878 - RNA, 19 nt, Mycobacterium bovis subsp bovis AF2122/97
aggcgaucuggccgaacga

SEQ ID NO: 3176879 - RNA, 20 nt, Mycobacterium bovis subsp bovis AF2122/97
aggcgaugagcgugccgcag

SEQ ID NO: 3176880 - RNA, 18 nt, Mycobacterium bovis subsp bovis AF2122/97
aggcgaugcgccaggcug

SEQ ID NO: 3176881 - RNA, 20 nt, Mycobacterium bovis subsp bovis AF2122/97
aggcgaugcgccaggcugaa

SEQ ID NO: 3176882 - RNA, 16 nt, Mycobacterium bovis subsp bovis AF2122/97
aggcgauggucuccuc

SEQ ID NO: 3176883 - RNA, 22 nt, Mycobacterium bovis subsp bovis AF2122/97
aggcgauggucuccucggucac

SEQ ID NO: 3176884 - RNA, 19 nt, Mycobacterium bovis subsp bovis AF2122/97
aggcgauucugcgucugcu

SEQ ID NO: 3176885 - RNA, 20 nt, Mycobacterium bovis subsp bovis AF2122/97
aggcgauucugcgucugcuc

SEQ ID NO: 3176886 - RNA, 16 nt, Mycobacterium bovis subsp bovis AF2122/97
aggcgauugcgccgca

SEQ ID NO: 3176887 - RNA, 18 nt, Mycobacterium bovis subsp bovis AF2122/97
aggcucauccgccgggcc

SEQ ID NO: 3176888 - RNA, 24 nt, Mycobacterium bovis subsp bovis AF2122/97
aggcucauccgccgggccaggccg

SEQ ID NO: 3176889 - RNA, 23 nt, Mycobacterium bovis subsp bovis AF2122/97
aggcuccagcgcgcgccgcagcg

SEQ ID NO: 3176890 - RNA, 19 nt, Mycobacterium bovis subsp bovis AF2122/97
aggcuccggccggccagca

SEQ ID NO: 3176891 - RNA, 17 nt, Mycobacterium bovis subsp bovis AF2122/97
aggcuccuggucgccgu

SEQ ID NO: 3176892 - RNA, 17 nt, Mycobacterium bovis subsp bovis AF2122/97
aggcucgaaccgacgcg

SEQ ID NO: 3176893 - RNA, 12 nt, Mycobacterium bovis subsp bovis AF2122/97
aggcucgcagga

SEQ ID NO: 3176894 - RNA, 17 nt, Mycobacterium bovis subsp bovis AF2122/97
aggcucgcguggccgcc

SEQ ID NO: 3176895 - RNA, 15 nt, Mycobacterium bovis subsp bovis AF2122/97
aggcucgggcaaggc

SEQ ID NO: 3176896 - RNA, 23 nt, Mycobacterium bovis subsp bovis AF2122/97
aggcucgugcguguaccugccca

SEQ ID NO: 3176897 - RNA, 17 nt, Mycobacterium bovis subsp bovis AF2122/97
aggcucguggcgacggc

SEQ ID NO: 3176898 - RNA, 19 nt, Mycobacterium bovis subsp bovis AF2122/97
aggcucguggcgacggcgu

SEQ ID NO: 3176899 - RNA, 15 nt, Mycobacterium bovis subsp bovis AF2122/97
aggcugaccguggcg

SEQ ID NO: 3176900 - RNA, 21 nt, Mycobacterium bovis subsp bovis AF2122/97
aggcugaccguggcgccgguc

SEQ ID NO: 3176901 - RNA, 22 nt, Mycobacterium bovis subsp bovis AF2122/97
aggcugcagugccgcacccaga

SEQ ID NO: 3176902 - RNA, 20 nt, Mycobacterium bovis subsp bovis AF2122/97
aggcugccgaaguugaagaa

SEQ ID NO: 3176903 - RNA, 17 nt, Mycobacterium bovis subsp bovis AF2122/97
aggcugccgcugcgccg

SEQ ID NO: 3176904 - RNA, 21 nt, Mycobacterium bovis subsp bovis AF2122/97
aggcuggccgccuccgcggca

SEQ ID NO: 3176905 - RNA, 20 nt, Mycobacterium bovis subsp bovis AF2122/97
aggcuggcgauggccguccg

SEQ ID NO: 3176906 - RNA, 14 nt, Mycobacterium bovis subsp bovis AF2122/97
aggcuguaacaccc

SEQ ID NO: 3176907 - RNA, 16 nt, Mycobacterium bovis subsp bovis AF2122/97
aggcuguaacacccgg

SEQ ID NO: 3176908 - RNA, 19 nt, Mycobacterium bovis subsp bovis AF2122/97
aggcuguaacacccggccg

SEQ ID NO: 3176909 - RNA, 11 nt, Mycobacterium bovis subsp bovis AF2122/97
aggcuguccag

SEQ ID NO: 3176910 - RNA, 19 nt, Mycobacterium bovis subsp bovis AF2122/97
aggcugucgcgggccacca

SEQ ID NO: 3176911 - RNA, 14 nt, Mycobacterium bovis subsp bovis AF2122/97
aggcugugccggcc

SEQ ID NO: 3176912 - RNA, 16 nt, Mycobacterium bovis subsp bovis AF2122/97
aggcugugccggccau

SEQ ID NO: 3176913 - RNA, 15 nt, Mycobacterium bovis subsp bovis AF2122/97
aggcuguggccagca

SEQ ID NO: 3176914 - RNA, 17 nt, Mycobacterium bovis subsp bovis AF2122/97
aggcuguggccagcauc

SEQ ID NO: 3176915 - RNA, 21 nt, Mycobacterium bovis subsp bovis AF2122/97
aggcuuccagccacagcccgg

SEQ ID NO: 3176916 - RNA, 17 nt, Mycobacterium bovis subsp bovis AF2122/97
aggcuuccggcgcgacc

SEQ ID NO: 3176917 - RNA, 15 nt, Mycobacterium bovis subsp bovis AF2122/97
aggcuugacugcaca

SEQ ID NO: 3176918 - RNA, 18 nt, Mycobacterium bovis subsp bovis AF2122/97
aggcuugacugcacacca

SEQ ID NO: 3176919 - RNA, 14 nt, Mycobacterium bovis subsp bovis AF2122/97
aggcuugcggcacc

SEQ ID NO: 3176920 - RNA, 17 nt, Mycobacterium bovis subsp bovis AF2122/97
aggcuugcggcacccag

SEQ ID NO: 3176921 - RNA, 18 nt, Mycobacterium bovis subsp bovis AF2122/97
aggcuuuccggggaauga

SEQ ID NO: 3176922 - RNA, 23 nt, Mycobacterium bovis subsp bovis AF2122/97
agggaaccauugcccgacgaugc

SEQ ID NO: 3176923 - RNA, 15 nt, Mycobacterium bovis subsp bovis AF2122/97
agggaaggacgcgca

SEQ ID NO: 3176924 - RNA, 21 nt, Mycobacterium bovis subsp bovis AF2122/97
agggaccacccgguccugcuc

SEQ ID NO: 3176925 - RNA, 20 nt, Mycobacterium bovis subsp bovis AF2122/97
agggacccggcgccgucgau

SEQ ID NO: 3176926 - RNA, 22 nt, Mycobacterium bovis subsp bovis AF2122/97
agggaggccccccggggccgca

SEQ ID NO: 3176927 - RNA, 14 nt, Mycobacterium bovis subsp bovis AF2122/97
agggaggggccguc

SEQ ID NO: 3176928 - RNA, 14 nt, Mycobacterium bovis subsp bovis AF2122/97
agggagugccgcac

SEQ ID NO: 3176929 - RNA, 16 nt, Mycobacterium bovis subsp bovis AF2122/97
agggagugccgcacga

SEQ ID NO: 3176930 - RNA, 16 nt, Mycobacterium bovis subsp bovis AF2122/97
agggauagcagugcag

SEQ ID NO: 3176931 - RNA, 17 nt, Mycobacterium bovis subsp bovis AF2122/97
agggauagcagugcagc

SEQ ID NO: 3176932 - RNA, 18 nt, Mycobacterium bovis subsp bovis AF2122/97
agggaucaccccggccgg

SEQ ID NO: 3176933 - RNA, 20 nt, Mycobacterium bovis subsp bovis AF2122/97
agggaucacgccaccauccc

SEQ ID NO: 3176934 - RNA, 19 nt, Mycobacterium bovis subsp bovis AF2122/97
agggauccgaagagccagc

SEQ ID NO: 3176935 - RNA, 14 nt, Mycobacterium bovis subsp bovis AF2122/97
agggaucgcaggga

SEQ ID NO: 3176936 - RNA, 17 nt, Mycobacterium bovis subsp bovis AF2122/97
agggaucgcagggauca

SEQ ID NO: 3176937 - RNA, 18 nt, Mycobacterium bovis subsp bovis AF2122/97
agggauguagugcugcuc

SEQ ID NO: 3176938 - RNA, 13 nt, Mycobacterium bovis subsp bovis AF2122/97
agggcaacggcac

SEQ ID NO: 3176939 - RNA, 13 nt, Mycobacterium bovis subsp bovis AF2122/97
agggcacaucggg

SEQ ID NO: 3176940 - RNA, 14 nt, Mycobacterium bovis subsp bovis AF2122/97
agggcacgcgcaca

SEQ ID NO: 3176941 - RNA, 13 nt, Mycobacterium bovis subsp bovis AF2122/97
agggcacgucgag

SEQ ID NO: 3176942 - RNA, 16 nt, Mycobacterium bovis subsp bovis AF2122/97
agggcacugaaccggu

SEQ ID NO: 3176943 - RNA, 14 nt, Mycobacterium bovis subsp bovis AF2122/97
agggcagcagcccg

SEQ ID NO: 3176944 - RNA, 16 nt, Mycobacterium bovis subsp bovis AF2122/97
agggcagcagcccggg

SEQ ID NO: 3176945 - RNA, 19 nt, Mycobacterium bovis subsp bovis AF2122/97
agggcagccgcccacccgg

SEQ ID NO: 3176946 - RNA, 16 nt, Mycobacterium bovis subsp bovis AF2122/97
agggcauacagcaugu

SEQ ID NO: 3176947 - RNA, 14 nt, Mycobacterium bovis subsp bovis AF2122/97
agggcauccgagcg

SEQ ID NO: 3176948 - RNA, 16 nt, Mycobacterium bovis subsp bovis AF2122/97
agggcauccgagcggg

SEQ ID NO: 3176949 - RNA, 16 nt, Mycobacterium bovis subsp bovis AF2122/97
agggcauugcggcccg

SEQ ID NO: 3176950 - RNA, 14 nt, Mycobacterium bovis subsp bovis AF2122/97
agggccacggcugc

SEQ ID NO: 3176951 - RNA, 18 nt, Mycobacterium bovis subsp bovis AF2122/97
agggccacguagcagcag

SEQ ID NO: 3176952 - RNA, 22 nt, Mycobacterium bovis subsp bovis AF2122/97
agggccacguagcagcagacga

SEQ ID NO: 3176953 - RNA, 19 nt, Mycobacterium bovis subsp bovis AF2122/97
agggccagcagccgcgacg

SEQ ID NO: 3176954 - RNA, 20 nt, Mycobacterium bovis subsp bovis AF2122/97
agggccagcgccucggcauc

SEQ ID NO: 3176955 - RNA, 14 nt, Mycobacterium bovis subsp bovis AF2122/97
agggccagcggcag

SEQ ID NO: 3176956 - RNA, 21 nt, Mycobacterium bovis subsp bovis AF2122/97
agggccauaaaugcgcguucg

SEQ ID NO: 3176957 - RNA, 20 nt, Mycobacterium bovis subsp bovis AF2122/97
agggccccaccgagcgguga

SEQ ID NO: 3176958 - RNA, 14 nt, Mycobacterium bovis subsp bovis AF2122/97
agggcccuggcggc

SEQ ID NO: 3176959 - RNA, 18 nt, Mycobacterium bovis subsp bovis AF2122/97
agggccgagcagcuccuu

SEQ ID NO: 3176960 - RNA, 22 nt, Mycobacterium bovis subsp bovis AF2122/97
agggccgccgcgaacgggucgg

SEQ ID NO: 3176961 - RNA, 18 nt, Mycobacterium bovis subsp bovis AF2122/97
agggccgccgcugccgcc

SEQ ID NO: 3176962 - RNA, 21 nt, Mycobacterium bovis subsp bovis AF2122/97
agggccgcucgccucgauggc

SEQ ID NO: 3176963 - RNA, 14 nt, Mycobacterium bovis subsp bovis AF2122/97
agggccggcaccgc

SEQ ID NO: 3176964 - RNA, 17 nt, Mycobacterium bovis subsp bovis AF2122/97
agggccggcaccgcagc

SEQ ID NO: 3176965 - RNA, 11 nt, Mycobacterium bovis subsp bovis AF2122/97
agggccggcgu

SEQ ID NO: 3176966 - RNA, 14 nt, Mycobacterium bovis subsp bovis AF2122/97
agggccucgaccgc

SEQ ID NO: 3176967 - RNA, 17 nt, Mycobacterium bovis subsp bovis AF2122/97
agggccuugaucggcac

SEQ ID NO: 3176968 - RNA, 14 nt, Mycobacterium bovis subsp bovis AF2122/97
agggcgacagcggc

SEQ ID NO: 3176969 - RNA, 13 nt, Mycobacterium bovis subsp bovis AF2122/97
agggcgacggcca

SEQ ID NO: 3176970 - RNA, 19 nt, Mycobacterium bovis subsp bovis AF2122/97
agggcgccacugaccgcga

SEQ ID NO: 3176971 - RNA, 20 nt, Mycobacterium bovis subsp bovis AF2122/97
agggcgccacugaccgcgau

SEQ ID NO: 3176972 - RNA, 16 nt, Mycobacterium bovis subsp bovis AF2122/97
agggcgcccgccccgc

SEQ ID NO: 3176973 - RNA, 13 nt, Mycobacterium bovis subsp bovis AF2122/97
agggcgccgaucg

SEQ ID NO: 3176974 - RNA, 17 nt, Mycobacterium bovis subsp bovis AF2122/97
agguaggucgccgccgc

SEQ ID NO: 3176975 - RNA, 22 nt, Mycobacterium bovis subsp bovis AF2122/97
agguagucggcgcgucguugcc

SEQ ID NO: 3176976 - RNA, 22 nt, Mycobacterium bovis subsp bovis AF2122/97
agguagucgucgacuugcaggc

SEQ ID NO: 3176977 - RNA, 13 nt, Mycobacterium bovis subsp bovis AF2122/97
agguaugcccgga

SEQ ID NO: 3176978 - RNA, 16 nt, Mycobacterium bovis subsp bovis AF2122/97
agguauucguggucgg

SEQ ID NO: 3176979 - RNA, 16 nt, Mycobacterium bovis subsp bovis AF2122/97
agguauuugccgugcu

SEQ ID NO: 3176980 - RNA, 18 nt, Mycobacterium bovis subsp bovis AF2122/97
aggucaacgccacgccga

SEQ ID NO: 3176981 - RNA, 23 nt, Mycobacterium bovis subsp bovis AF2122/97
aggucaagaaggagaucgaucga

SEQ ID NO: 3176982 - RNA, 21 nt, Mycobacterium bovis subsp bovis AF2122/97
aggucaauggucuuuguccac

SEQ ID NO: 3176983 - RNA, 21 nt, Mycobacterium bovis subsp bovis AF2122/97
aggucacacguuggcagcccu

SEQ ID NO: 3176984 - RNA, 11 nt, Mycobacterium bovis subsp bovis AF2122/97
aggucacccau

SEQ ID NO: 3176985 - RNA, 10 nt, Mycobacterium bovis subsp bovis AF2122/97
aggucaccgg

SEQ ID NO: 3176986 - RNA, 15 nt, Mycobacterium bovis subsp bovis AF2122/97
aggucaccggccgcc

SEQ ID NO: 3176987 - RNA, 18 nt, Mycobacterium bovis subsp bovis AF2122/97
aggucaccggccgccgac

SEQ ID NO: 3176988 - RNA, 15 nt, Mycobacterium bovis subsp bovis AF2122/97
aggucaccggucacc

SEQ ID NO: 3176989 - RNA, 18 nt, Mycobacterium bovis subsp bovis AF2122/97
aggucaccggucaccgcg

SEQ ID NO: 3176990 - RNA, 20 nt, Mycobacterium bovis subsp bovis AF2122/97
aggucaccggucaccgcgca

SEQ ID NO: 3176991 - RNA, 22 nt, Mycobacterium bovis subsp bovis AF2122/97
aggucacuacuccggucccgca

SEQ ID NO: 3176992 - RNA, 15 nt, Mycobacterium bovis subsp bovis AF2122/97
aggucagcagggccg

SEQ ID NO: 3176993 - RNA, 14 nt, Mycobacterium bovis subsp bovis AF2122/97
aggucagcgcugcc

SEQ ID NO: 3176994 - RNA, 15 nt, Mycobacterium bovis subsp bovis AF2122/97
aggucagcgcugcca

SEQ ID NO: 3176995 - RNA, 16 nt, Mycobacterium bovis subsp bovis AF2122/97
aggucagcgggcuugc

SEQ ID NO: 3176996 - RNA, 20 nt, Mycobacterium bovis subsp bovis AF2122/97
aggucagcgguugggcgaaa

SEQ ID NO: 3176997 - RNA, 18 nt, Mycobacterium bovis subsp bovis AF2122/97
aggucauauugcggugca

SEQ ID NO: 3176998 - RNA, 15 nt, Mycobacterium bovis subsp bovis AF2122/97
aggucaucaugucga

SEQ ID NO: 3176999 - RNA, 13 nt, Mycobacterium bovis subsp bovis AF2122/97
agguccaccaccc

SEQ ID NO: 3177000 - RNA, 16 nt, Mycobacterium bovis subsp bovis AF2122/97
agguccaccggccagu

SEQ ID NO: 3177001 - RNA, 16 nt, Mycobacterium bovis subsp bovis AF2122/97
agguccaucuggcgcg

SEQ ID NO: 3177002 - RNA, 22 nt, Mycobacterium bovis subsp bovis AF2122/97
aggucccgugcgcgcgcagcug

SEQ ID NO: 3177003 - RNA, 23 nt, Mycobacterium bovis subsp bovis AF2122/97
aggucccgugcgcgcgcagcuga

SEQ ID NO: 3177004 - RNA, 19 nt, Mycobacterium bovis subsp bovis AF2122/97
agguccgaucgugugaggc

SEQ ID NO: 3177005 - RNA, 23 nt, Mycobacterium bovis subsp bovis AF2122/97
agguccgcacgaucugcaggccc

SEQ ID NO: 3177006 - RNA, 22 nt, Mycobacterium bovis subsp bovis AF2122/97
agguccgccccguugugucacc

SEQ ID NO: 3177007 - RNA, 16 nt, Mycobacterium bovis subsp bovis AF2122/97
agguccgccggugccg

SEQ ID NO: 3177008 - RNA, 18 nt, Mycobacterium bovis subsp bovis AF2122/97
agguccgccggugccgcc

SEQ ID NO: 3177009 - RNA, 19 nt, Mycobacterium bovis subsp bovis AF2122/97
agguccgcggccgcgguga

SEQ ID NO: 3177010 - RNA, 21 nt, Mycobacterium bovis subsp bovis AF2122/97
agguccgucgcgcgggcgagc

SEQ ID NO: 3177011 - RNA, 17 nt, Mycobacterium bovis subsp bovis AF2122/97
agguccgugccgaugcc

SEQ ID NO: 3177012 - RNA, 15 nt, Mycobacterium bovis subsp bovis AF2122/97
agguccucgucggcg

SEQ ID NO: 3177013 - RNA, 15 nt, Mycobacterium bovis subsp bovis AF2122/97
agguccugcgccgca

SEQ ID NO: 3177014 - RNA, 17 nt, Mycobacterium bovis subsp bovis AF2122/97
agguccugcgccgcacg

SEQ ID NO: 3177015 - RNA, 21 nt, Mycobacterium bovis subsp bovis AF2122/97
agguccuggguguagcaaguc

SEQ ID NO: 3177016 - RNA, 15 nt, Mycobacterium bovis subsp bovis AF2122/97
aggucgaaccgccgg

SEQ ID NO: 3177017 - RNA, 22 nt, Mycobacterium bovis subsp bovis AF2122/97
aggucgacaccgcggugccccg

SEQ ID NO: 3177018 - RNA, 14 nt, Mycobacterium bovis subsp bovis AF2122/97
aggucgacauaggc

SEQ ID NO: 3177019 - RNA, 23 nt, Mycobacterium bovis subsp bovis AF2122/97
aggucgacauaggccaccuccga

SEQ ID NO: 3177020 - RNA, 20 nt, Mycobacterium bovis subsp bovis AF2122/97
aggucgaccacccgcagggc

SEQ ID NO: 3177021 - RNA, 22 nt, Mycobacterium bovis subsp bovis AF2122/97
aggucgacccaacgcagaucag

SEQ ID NO: 3177022 - RNA, 16 nt, Mycobacterium bovis subsp bovis AF2122/97
aggucgacgccgacca

SEQ ID NO: 3177023 - RNA, 18 nt, Mycobacterium bovis subsp bovis AF2122/97
aggucgacgccgaccacc

SEQ ID NO: 3177024 - RNA, 14 nt, Mycobacterium bovis subsp bovis AF2122/97
aggucgacgggcac

SEQ ID NO: 3177025 - RNA, 14 nt, Mycobacterium bovis subsp bovis AF2122/97
aggucgagcgaccc

SEQ ID NO: 3177026 - RNA, 15 nt, Mycobacterium bovis subsp bovis AF2122/97
aggucgagcgccgcg

SEQ ID NO: 3177027 - RNA, 14 nt, Mycobacterium bovis subsp bovis AF2122/97
aggucgagcgccuu

SEQ ID NO: 3177028 - RNA, 23 nt, Mycobacterium bovis subsp bovis AF2122/97
aggucgauaccggcgugcaguac

SEQ ID NO: 3177029 - RNA, 16 nt, Mycobacterium bovis subsp bovis AF2122/97
aggucgaucugcgcca

SEQ ID NO: 3177030 - RNA, 12 nt, Mycobacterium bovis subsp bovis AF2122/97
aggucgaugccg

SEQ ID NO: 3177031 - RNA, 15 nt, Mycobacterium bovis subsp bovis AF2122/97
aggucgaugccggcu

SEQ ID NO: 3177032 - RNA, 17 nt, Mycobacterium bovis subsp bovis AF2122/97
aggucgaugcgggcgac

SEQ ID NO: 3177033 - RNA, 18 nt, Mycobacterium bovis subsp bovis AF2122/97
aggucgccagcucggcac

SEQ ID NO: 3177034 - RNA, 23 nt, Mycobacterium bovis subsp bovis AF2122/97
aggucgccagcucggcacccgcc

SEQ ID NO: 3177035 - RNA, 20 nt, Mycobacterium bovis subsp bovis AF2122/97
aggucgcccaacaccgcgcc

SEQ ID NO: 3177036 - RNA, 22 nt, Mycobacterium bovis subsp bovis AF2122/97
aggucgccgccgccacggcaau

SEQ ID NO: 3177037 - RNA, 22 nt, Mycobacterium bovis subsp bovis AF2122/97
aggucgccggccacgaccucuu

SEQ ID NO: 3177038 - RNA, 14 nt, Mycobacterium bovis subsp bovis AF2122/97
aggucgcgcaguug

SEQ ID NO: 3177039 - RNA, 12 nt, Mycobacterium bovis subsp bovis AF2122/97
aggucggccacc

SEQ ID NO: 3177040 - RNA, 13 nt, Mycobacterium bovis subsp bovis AF2122/97
aggucggccaccg

SEQ ID NO: 3177041 - RNA, 15 nt, Mycobacterium bovis subsp bovis AF2122/97
aggucggccaccgug

SEQ ID NO: 3177042 - RNA, 23 nt, Mycobacterium bovis subsp bovis AF2122/97
aggucggccagcagcagugccac

SEQ ID NO: 3177043 - RNA, 17 nt, Mycobacterium bovis subsp bovis AF2122/97
aggucggcgaucugcgc

SEQ ID NO: 3177044 - RNA, 13 nt, Mycobacterium bovis subsp bovis AF2122/97
aggucggcgauga

SEQ ID NO: 3177045 - RNA, 21 nt, Mycobacterium bovis subsp bovis AF2122/97
aggucggcgaugaugacggcg

SEQ ID NO: 3177046 - RNA, 13 nt, Mycobacterium bovis subsp bovis AF2122/97
aggucggcggcgc

SEQ ID NO: 3177047 - RNA, 13 nt, Mycobacterium bovis subsp bovis AF2122/97
aggucgggcauga

SEQ ID NO: 3177048 - RNA, 19 nt, Mycobacterium bovis subsp bovis AF2122/97
aggucgggcccccggcagc

SEQ ID NO: 3177049 - RNA, 16 nt, Mycobacterium bovis subsp bovis AF2122/97
aggucgguaccccagc

SEQ ID NO: 3177050 - RNA, 20 nt, Mycobacterium bovis subsp bovis AF2122/97
aggucgguaccccagcgcug

SEQ ID NO: 3177051 - RNA, 17 nt, Mycobacterium bovis subsp bovis AF2122/97
aggucggucaggucgag

SEQ ID NO: 3177052 - RNA, 19 nt, Mycobacterium bovis subsp bovis AF2122/97
aggucggucaggucgaggu

SEQ ID NO: 3177053 - RNA, 17 nt, Mycobacterium bovis subsp bovis AF2122/97
aggucggugcggucauc

SEQ ID NO: 3177054 - RNA, 17 nt, Mycobacterium bovis subsp bovis AF2122/97
aggucggugggcggcga

SEQ ID NO: 3177055 - RNA, 17 nt, Mycobacterium bovis subsp bovis AF2122/97
aggucggugugcaucgc

SEQ ID NO: 3177056 - RNA, 16 nt, Mycobacterium bovis subsp bovis AF2122/97
aggucgguucggccgg

SEQ ID NO: 3177057 - RNA, 16 nt, Mycobacterium bovis subsp bovis AF2122/97
aggucgucggcgucgc

SEQ ID NO: 3177058 - RNA, 17 nt, Mycobacterium bovis subsp bovis AF2122/97
aggucgucggcgucgcg

SEQ ID NO: 3177059 - RNA, 19 nt, Mycobacterium bovis subsp bovis AF2122/97
aggucgucggcgucgcgga

SEQ ID NO: 3177060 - RNA, 22 nt, Mycobacterium bovis subsp bovis AF2122/97
agguuguacaggaagucgcgga

SEQ ID NO: 3177061 - RNA, 18 nt, Mycobacterium bovis subsp bovis AF2122/97
agguuguagucagaaccg

SEQ ID NO: 3177062 - RNA, 17 nt, Mycobacterium bovis subsp bovis AF2122/97
agguuguaguccgcgcc

SEQ ID NO: 3177063 - RNA, 14 nt, Mycobacterium bovis subsp bovis AF2122/97
agguugucggcgau

SEQ ID NO: 3177064 - RNA, 18 nt, Mycobacterium bovis subsp bovis AF2122/97
agguuucccgggucccau

SEQ ID NO: 3177065 - RNA, 15 nt, Mycobacterium bovis subsp bovis AF2122/97
agguuugcgccgcgc

SEQ ID NO: 3177066 - RNA, 23 nt, Mycobacterium bovis subsp bovis AF2122/97
agguuugcgccgcgcagcgagga

SEQ ID NO: 3177067 - RNA, 15 nt, Mycobacterium bovis subsp bovis AF2122/97
aguaaccguccgcgg

SEQ ID NO: 3177068 - RNA, 22 nt, Mycobacterium bovis subsp bovis AF2122/97
aguaagcgaacagcggcacgau

SEQ ID NO: 3177069 - RNA, 12 nt, Mycobacterium bovis subsp bovis AF2122/97
aguaaugcccau

SEQ ID NO: 3177070 - RNA, 19 nt, Mycobacterium bovis subsp bovis AF2122/97
aguacacgaucuugcggaa

SEQ ID NO: 3177071 - RNA, 15 nt, Mycobacterium bovis subsp bovis AF2122/97
aguacacggcggccc

SEQ ID NO: 3177072 - RNA, 16 nt, Mycobacterium bovis subsp bovis AF2122/97
aguacacggcggcccg

SEQ ID NO: 3177073 - RNA, 14 nt, Mycobacterium bovis subsp bovis AF2122/97
aguacaggcgcagc

SEQ ID NO: 3177074 - RNA, 13 nt, Mycobacterium bovis subsp bovis AF2122/97
aguaccagcccac

SEQ ID NO: 3177075 - RNA, 18 nt, Mycobacterium bovis subsp bovis AF2122/97
aguaccccucgcacaaug

SEQ ID NO: 3177076 - RNA, 22 nt, Mycobacterium bovis subsp bovis AF2122/97
aguaccgauagccugcggcggc

SEQ ID NO: 3177077 - RNA, 18 nt, Mycobacterium bovis subsp bovis AF2122/97
aguaccgcacgcaauuca

SEQ ID NO: 3177078 - RNA, 11 nt, Mycobacterium bovis subsp bovis AF2122/97
aguaccgcgcg

SEQ ID NO: 3177079 - RNA, 13 nt, Mycobacterium bovis subsp bovis AF2122/97
aguaccggccagc

SEQ ID NO: 3177080 - RNA, 21 nt, Mycobacterium bovis subsp bovis AF2122/97
aguaccgucaucgcggugugc

SEQ ID NO: 3177081 - RNA, 16 nt, Mycobacterium bovis subsp bovis AF2122/97
aguacgcaagcucaag

SEQ ID NO: 3177082 - RNA, 21 nt, Mycobacterium bovis subsp bovis AF2122/97
aguacgcccuggaaugccgcc

SEQ ID NO: 3177083 - RNA, 16 nt, Mycobacterium bovis subsp bovis AF2122/97
aguacgcgaccgcgau

SEQ ID NO: 3177084 - RNA, 17 nt, Mycobacterium bovis subsp bovis AF2122/97
aguacgcgacgggccgc

SEQ ID NO: 3177085 - RNA, 16 nt, Mycobacterium bovis subsp bovis AF2122/97
aguacgcugcggcuca

SEQ ID NO: 3177086 - RNA, 12 nt, Mycobacterium bovis subsp bovis AF2122/97
aguacggcaggc

SEQ ID NO: 3177087 - RNA, 20 nt, Mycobacterium bovis subsp bovis AF2122/97
aguacggcgaugcggucggc

SEQ ID NO: 3177088 - RNA, 15 nt, Mycobacterium bovis subsp bovis AF2122/97
aguacgggagccggc

SEQ ID NO: 3177089 - RNA, 22 nt, Mycobacterium bovis subsp bovis AF2122/97
aguacgggcaggccgcugggcc

SEQ ID NO: 3177090 - RNA, 13 nt, Mycobacterium bovis subsp bovis AF2122/97
aguacgucgauca

SEQ ID NO: 3177091 - RNA, 14 nt, Mycobacterium bovis subsp bovis AF2122/97
aguacuccagccgc

SEQ ID NO: 3177092 - RNA, 14 nt, Mycobacterium bovis subsp bovis AF2122/97
aguacuggaauggc

SEQ ID NO: 3177093 - RNA, 20 nt, Mycobacterium bovis subsp bovis AF2122/97
aguacuggaauggcucacgc

SEQ ID NO: 3177094 - RNA, 19 nt, Mycobacterium bovis subsp bovis AF2122/97
aguacuggcguugccaccg

SEQ ID NO: 3177095 - RNA, 15 nt, Mycobacterium bovis subsp bovis AF2122/97
aguacuucgcggcgg

SEQ ID NO: 3177096 - RNA, 19 nt, Mycobacterium bovis subsp bovis AF2122/97
aguagaagauggcaccgcc

SEQ ID NO: 3177097 - RNA, 17 nt, Mycobacterium bovis subsp bovis AF2122/97
aguagauugcugacgag

SEQ ID NO: 3177098 - RNA, 17 nt, Mycobacterium bovis subsp bovis AF2122/97
aguagcacguugacguc

SEQ ID NO: 3177099 - RNA, 21 nt, Mycobacterium bovis subsp bovis AF2122/97
aguagccggucggcaccacca

SEQ ID NO: 3177100 - RNA, 18 nt, Mycobacterium bovis subsp bovis AF2122/97
aguagccguagccgccgu

SEQ ID NO: 3177101 - RNA, 16 nt, Mycobacterium bovis subsp bovis AF2122/97
aguagcgaugcacccc

SEQ ID NO: 3177102 - RNA, 15 nt, Mycobacterium bovis subsp bovis AF2122/97
aguagcggaucaggu

SEQ ID NO: 3177103 - RNA, 14 nt, Mycobacterium bovis subsp bovis AF2122/97
aguagcugaccauc

SEQ ID NO: 3177104 - RNA, 15 nt, Mycobacterium bovis subsp bovis AF2122/97
aguagcuguggcccg

SEQ ID NO: 3177105 - RNA, 16 nt, Mycobacterium bovis subsp bovis AF2122/97
aguaggcggcuccgau

SEQ ID NO: 3177106 - RNA, 21 nt, Mycobacterium bovis subsp bovis AF2122/97
aguaggcuucgaccguggugg

SEQ ID NO: 3177107 - RNA, 23 nt, Mycobacterium bovis subsp bovis AF2122/97
aguagguccacguucggcugcga

SEQ ID NO: 3177108 - RNA, 18 nt, Mycobacterium bovis subsp bovis AF2122/97
aguagguuuucggcggcu

SEQ ID NO: 3177109 - RNA, 15 nt, Mycobacterium bovis subsp bovis AF2122/97
aguagucgcuggcca

SEQ ID NO: 3177110 - RNA, 16 nt, Mycobacterium bovis subsp bovis AF2122/97
aguagucgcuggccag

SEQ ID NO: 3177111 - RNA, 20 nt, Mycobacterium bovis subsp bovis AF2122/97
aguagucggccgaugaaggc

SEQ ID NO: 3177112 - RNA, 20 nt, Mycobacterium bovis subsp bovis AF2122/97
aguagugaucgaucgcggcg

SEQ ID NO: 3177113 - RNA, 16 nt, Mycobacterium bovis subsp bovis AF2122/97
aguagugcaucggcag

SEQ ID NO: 3177114 - RNA, 12 nt, Mycobacterium bovis subsp bovis AF2122/97
aguagugguggg

SEQ ID NO: 3177115 - RNA, 17 nt, Mycobacterium bovis subsp bovis AF2122/97
aguaucgaggccgacga

SEQ ID NO: 3177116 - RNA, 19 nt, Mycobacterium bovis subsp bovis AF2122/97
aguaucgccggccgcgggc

SEQ ID NO: 3177117 - RNA, 15 nt, Mycobacterium bovis subsp bovis AF2122/97
aguauggccgccacc

SEQ ID NO: 3177118 - RNA, 19 nt, Mycobacterium bovis subsp bovis AF2122/97
agucaaacaaccgugaacu

SEQ ID NO: 3177119 - RNA, 16 nt, Mycobacterium bovis subsp bovis AF2122/97
agucaacaccgcggcc

SEQ ID NO: 3177120 - RNA, 18 nt, Mycobacterium bovis subsp bovis AF2122/97
agucaacaccgcggccga

SEQ ID NO: 3177121 - RNA, 19 nt, Mycobacterium bovis subsp bovis AF2122/97
agucaacaccgcggccgag

SEQ ID NO: 3177122 - RNA, 17 nt, Mycobacterium bovis subsp bovis AF2122/97
agucaacgaacgauggg

SEQ ID NO: 3177123 - RNA, 18 nt, Mycobacterium bovis subsp bovis AF2122/97
agucaagauugaccgcgg

SEQ ID NO: 3177124 - RNA, 22 nt, Mycobacterium bovis subsp bovis AF2122/97
agucaaucgcgucaucaacguu

SEQ ID NO: 3177125 - RNA, 18 nt, Mycobacterium bovis subsp bovis AF2122/97
agucaccggguccaccgc

SEQ ID NO: 3177126 - RNA, 20 nt, Mycobacterium bovis subsp bovis AF2122/97
agucacgcacucccgagcca

SEQ ID NO: 3177127 - RNA, 12 nt, Mycobacterium bovis subsp bovis AF2122/97
agucacggucgu

SEQ ID NO: 3177128 - RNA, 18 nt, Mycobacterium bovis subsp bovis AF2122/97
agucacggucguggugca

SEQ ID NO: 3177129 - RNA, 16 nt, Mycobacterium bovis subsp bovis AF2122/97
agucagaacggcggca

SEQ ID NO: 3177130 - RNA, 23 nt, Mycobacterium bovis subsp bovis AF2122/97
agucagaacggcggcagcggcgu

SEQ ID NO: 3177131 - RNA, 23 nt, Mycobacterium bovis subsp bovis AF2122/97
agucaggccuagcgcggcgacga

SEQ ID NO: 3177132 - RNA, 22 nt, Mycobacterium bovis subsp bovis AF2122/97
agucauccaggucgccuuccca

SEQ ID NO: 3177133 - RNA, 14 nt, Mycobacterium bovis subsp bovis AF2122/97
agucauccuugagg

SEQ ID NO: 3177134 - RNA, 16 nt, Mycobacterium bovis subsp bovis AF2122/97
agucauguccauagcc

SEQ ID NO: 3177135 - RNA, 20 nt, Mycobacterium bovis subsp bovis AF2122/97
agucauguccauagccggca

SEQ ID NO: 3177136 - RNA, 22 nt, Mycobacterium bovis subsp bovis AF2122/97
agucauucgcuccggucggguu

SEQ ID NO: 3177137 - RNA, 21 nt, Mycobacterium bovis subsp bovis AF2122/97
aguccaacgacuguggcgccg

SEQ ID NO: 3177138 - RNA, 21 nt, Mycobacterium bovis subsp bovis AF2122/97
aguccaagcugucaagcgggc

SEQ ID NO: 3177139 - RNA, 22 nt, Mycobacterium bovis subsp bovis AF2122/97
aguccaaucuucucgagccgcc

SEQ ID NO: 3177140 - RNA, 13 nt, Mycobacterium bovis subsp bovis AF2122/97
aguccaccgcgcg

SEQ ID NO: 3177141 - RNA, 22 nt, Mycobacterium bovis subsp bovis AF2122/97
aguccaccgcgcggcgcagcac

SEQ ID NO: 3177142 - RNA, 16 nt, Mycobacterium bovis subsp bovis AF2122/97
aguccagccgggugcc

SEQ ID NO: 3177143 - RNA, 18 nt, Mycobacterium bovis subsp bovis AF2122/97
aguccagcucgcugcgcg

SEQ ID NO: 3177144 - RNA, 16 nt, Mycobacterium bovis subsp bovis AF2122/97
aguccaggcagcuugc

SEQ ID NO: 3177145 - RNA, 18 nt, Mycobacterium bovis subsp bovis AF2122/97
aguccaggcagcuugcca

SEQ ID NO: 3177146 - RNA, 22 nt, Mycobacterium bovis subsp bovis AF2122/97
agucgccgucgugccaccguug

SEQ ID NO: 3177147 - RNA, 23 nt, Mycobacterium bovis subsp bovis AF2122/97
agucgcgaacucaugcccgacga

SEQ ID NO: 3177148 - RNA, 15 nt, Mycobacterium bovis subsp bovis AF2122/97
agucgcggacgucgc

SEQ ID NO: 3177149 - RNA, 17 nt, Mycobacterium bovis subsp bovis AF2122/97
agucgcgguaccaucac

SEQ ID NO: 3177150 - RNA, 19 nt, Mycobacterium bovis subsp bovis AF2122/97
agucgcgguaccaucaccg

SEQ ID NO: 3177151 - RNA, 20 nt, Mycobacterium bovis subsp bovis AF2122/97
agucgcgguaccaucaccgc

SEQ ID NO: 3177152 - RNA, 13 nt, Mycobacterium bovis subsp bovis AF2122/97
agucgcugggugg

SEQ ID NO: 3177153 - RNA, 16 nt, Mycobacterium bovis subsp bovis AF2122/97
agucgcugucggcaug

SEQ ID NO: 3177154 - RNA, 17 nt, Mycobacterium bovis subsp bovis AF2122/97
agucggagacccguccg

SEQ ID NO: 3177155 - RNA, 18 nt, Mycobacterium bovis subsp bovis AF2122/97
agucggagacccguccgg

SEQ ID NO: 3177156 - RNA, 17 nt, Mycobacterium bovis subsp bovis AF2122/97
agucggcaccggugccc

SEQ ID NO: 3177157 - RNA, 12 nt, Mycobacterium bovis subsp bovis AF2122/97
agucggcaucgc

SEQ ID NO: 3177158 - RNA, 17 nt, Mycobacterium bovis subsp bovis AF2122/97
agucggcaucgcgagcu

SEQ ID NO: 3177159 - RNA, 15 nt, Mycobacterium bovis subsp bovis AF2122/97
agucggccagcucgc

SEQ ID NO: 3177160 - RNA, 21 nt, Mycobacterium bovis subsp bovis AF2122/97
agucggccgaugaaggccggc

SEQ ID NO: 3177161 - RNA, 19 nt, Mycobacterium bovis subsp bovis AF2122/97
agucggcgccgccguccag

SEQ ID NO: 3177162 - RNA, 14 nt, Mycobacterium bovis subsp bovis AF2122/97
agucggcgcuggcc

SEQ ID NO: 3177163 - RNA, 16 nt, Mycobacterium bovis subsp bovis AF2122/97
agucggcgcuggccgu

SEQ ID NO: 3177164 - RNA, 15 nt, Mycobacterium bovis subsp bovis AF2122/97
agucggcggggcgga

SEQ ID NO: 3177165 - RNA, 23 nt, Mycobacterium bovis subsp bovis AF2122/97
agucgggccgguacuugaggguc

SEQ ID NO: 3177166 - RNA, 19 nt, Mycobacterium bovis subsp bovis AF2122/97
agucgguaucggcagaugg

SEQ ID NO: 3177167 - RNA, 13 nt, Mycobacterium bovis subsp bovis AF2122/97
agucgguccugcc

SEQ ID NO: 3177168 - RNA, 16 nt, Mycobacterium bovis subsp bovis AF2122/97
agucggucuggaucag

SEQ ID NO: 3177169 - RNA, 13 nt, Mycobacterium bovis subsp bovis AF2122/97
agucggugaaaug

SEQ ID NO: 3177170 - RNA, 15 nt, Mycobacterium bovis subsp bovis AF2122/97
agucggugaaaugac

SEQ ID NO: 3177171 - RNA, 22 nt, Mycobacterium bovis subsp bovis AF2122/97
agucggugcggugcacacugac

SEQ ID NO: 3177172 - RNA, 23 nt, Mycobacterium bovis subsp bovis AF2122/97
agucguacucccaggccgccgcc

SEQ ID NO: 3177173 - RNA, 16 nt, Mycobacterium bovis subsp bovis AF2122/97
agucguagacggcgaa

SEQ ID NO: 3177174 - RNA, 23 nt, Mycobacterium bovis subsp bovis AF2122/97
agucgucgacaguuuucaccgcg

SEQ ID NO: 3177175 - RNA, 19 nt, Mycobacterium bovis subsp bovis AF2122/97
agucgucgacuugcaggcg

SEQ ID NO: 3177176 - RNA, 14 nt, Mycobacterium bovis subsp bovis AF2122/97
agucgucggcaugg

SEQ ID NO: 3177177 - RNA, 20 nt, Mycobacterium bovis subsp bovis AF2122/97
agucgucggcaugggccggc

SEQ ID NO: 3177178 - RNA, 18 nt, Mycobacterium bovis subsp bovis AF2122/97
agucgugcuugcccgguu

SEQ ID NO: 3177179 - RNA, 13 nt, Mycobacterium bovis subsp bovis AF2122/97
agucgugggcugu

SEQ ID NO: 3177180 - RNA, 14 nt, Mycobacterium bovis subsp bovis AF2122/97
agucguugccgauc

SEQ ID NO: 3177181 - RNA, 14 nt, Mycobacterium bovis subsp bovis AF2122/97
agucguugcgcggu

SEQ ID NO: 3177182 - RNA, 15 nt, Mycobacterium bovis subsp bovis AF2122/97
agucuccggaaccac

SEQ ID NO: 3177183 - RNA, 20 nt, Mycobacterium bovis subsp bovis AF2122/97
agucuccggaaccacucgcu

SEQ ID NO: 3177184 - RNA, 15 nt, Mycobacterium bovis subsp bovis AF2122/97
agucuccggcgucgg

SEQ ID NO: 3177185 - RNA, 14 nt, Mycobacterium bovis subsp bovis AF2122/97
agucuggcgguauc

SEQ ID NO: 3177186 - RNA, 21 nt, Mycobacterium bovis subsp bovis AF2122/97
agucugggcgaucgcuucgca

SEQ ID NO: 3177187 - RNA, 16 nt, Mycobacterium bovis subsp bovis AF2122/97
agucuucaacgucgag

SEQ ID NO: 3177188 - RNA, 17 nt, Mycobacterium bovis subsp bovis AF2122/97
agucuucgucgucggaa

SEQ ID NO: 3177189 - RNA, 16 nt, Mycobacterium bovis subsp bovis AF2122/97
agucuuucccgccacc

SEQ ID NO: 3177190 - RNA, 17 nt, Mycobacterium bovis subsp bovis AF2122/97
agugaaaccaccggccg

SEQ ID NO: 3177191 - RNA, 19 nt, Mycobacterium bovis subsp bovis AF2122/97
agugaaagacaguggcgcg

SEQ ID NO: 3177192 - RNA, 18 nt, Mycobacterium bovis subsp bovis AF2122/97
agugaaaguucaugccau

SEQ ID NO: 3177193 - RNA, 19 nt, Mycobacterium bovis subsp bovis AF2122/97
agugaaauccgagccgcga

SEQ ID NO: 3177194 - RNA, 15 nt, Mycobacterium bovis subsp bovis AF2122/97
agugaagacaccagg

SEQ ID NO: 3177195 - RNA, 15 nt, Mycobacterium bovis subsp bovis AF2122/97
agugaccacgcugcu

SEQ ID NO: 3177196 - RNA, 18 nt, Mycobacterium bovis subsp bovis AF2122/97
agugaccgcagucccagc

SEQ ID NO: 3177197 - RNA, 16 nt, Mycobacterium bovis subsp bovis AF2122/97
agugaccucgucggcg

SEQ ID NO: 3177198 - RNA, 23 nt, Mycobacterium bovis subsp bovis AF2122/97
agugacgccacgaccgccgauac

SEQ ID NO: 3177199 - RNA, 13 nt, Mycobacterium bovis subsp bovis AF2122/97
agugacgccucga

SEQ ID NO: 3177200 - RNA, 19 nt, Mycobacterium bovis subsp bovis AF2122/97
agugacgccucgacaccca

SEQ ID NO: 3177201 - RNA, 21 nt, Mycobacterium bovis subsp bovis AF2122/97
agugacgccucgacacccagc

SEQ ID NO: 3177202 - RNA, 22 nt, Mycobacterium bovis subsp bovis AF2122/97
agugacgguccguucgaugcca

SEQ ID NO: 3177203 - RNA, 21 nt, Mycobacterium bovis subsp bovis AF2122/97
agugacucaccgugaaccgcc

SEQ ID NO: 3177204 - RNA, 23 nt, Mycobacterium bovis subsp bovis AF2122/97
agugacucaccgugaaccgcccg

SEQ ID NO: 3177205 - RNA, 15 nt, Mycobacterium bovis subsp bovis AF2122/97
agugacucgaucacc

SEQ ID NO: 3177206 - RNA, 20 nt, Mycobacterium bovis subsp bovis AF2122/97
agugagcaugcgacgucagg

SEQ ID NO: 3177207 - RNA, 18 nt, Mycobacterium bovis subsp bovis AF2122/97
agugaggccgaccagcac

SEQ ID NO: 3177208 - RNA, 18 nt, Mycobacterium bovis subsp bovis AF2122/97
agugaggcugugccccag

SEQ ID NO: 3177209 - RNA, 14 nt, Mycobacterium bovis subsp bovis AF2122/97
agugagggucccac

SEQ ID NO: 3177210 - RNA, 14 nt, Mycobacterium bovis subsp bovis AF2122/97
agugaucaccaacc

SEQ ID NO: 3177211 - RNA, 19 nt, Mycobacterium bovis subsp bovis AF2122/97
agugaucagcgcaucgccg

SEQ ID NO: 3177212 - RNA, 15 nt, Mycobacterium bovis subsp bovis AF2122/97
agugaucggguaccc

SEQ ID NO: 3177213 - RNA, 14 nt, Mycobacterium bovis subsp bovis AF2122/97
agugaugcgccccg

SEQ ID NO: 3177214 - RNA, 15 nt, Mycobacterium bovis subsp bovis AF2122/97
agugaugcgccccgg

SEQ ID NO: 3177215 - RNA, 17 nt, Mycobacterium bovis subsp bovis AF2122/97
agugcaaaauugcuugg

SEQ ID NO: 3177216 - RNA, 16 nt, Mycobacterium bovis subsp bovis AF2122/97
agugcacagacacggc

SEQ ID NO: 3177217 - RNA, 19 nt, Mycobacterium bovis subsp bovis AF2122/97
agugcacagccgggcucuc

SEQ ID NO: 3177218 - RNA, 17 nt, Mycobacterium bovis subsp bovis AF2122/97
agugcacgaaguccugg

SEQ ID NO: 3177219 - RNA, 18 nt, Mycobacterium bovis subsp bovis AF2122/97
agugcacgcucggcgccg

SEQ ID NO: 3177220 - RNA, 17 nt, Mycobacterium bovis subsp bovis AF2122/97
agugcacgucggcgggc

SEQ ID NO: 3177221 - RNA, 17 nt, Mycobacterium bovis subsp bovis AF2122/97
agugcacugcgaacccu

SEQ ID NO: 3177222 - RNA, 22 nt, Mycobacterium bovis subsp bovis AF2122/97
agugcagaagacaagugguggu

SEQ ID NO: 3177223 - RNA, 18 nt, Mycobacterium bovis subsp bovis AF2122/97
agugcagacaggcggcgg

SEQ ID NO: 3177224 - RNA, 23 nt, Mycobacterium bovis subsp bovis AF2122/97
agugcagcacgauccagcuguac

SEQ ID NO: 3177225 - RNA, 15 nt, Mycobacterium bovis subsp bovis AF2122/97
agugcagcgaucccg

SEQ ID NO: 3177226 - RNA, 16 nt, Mycobacterium bovis subsp bovis AF2122/97
agugcaggugcccggc

SEQ ID NO: 3177227 - RNA, 21 nt, Mycobacterium bovis subsp bovis AF2122/97
agugcaggugcccggccaaaa

SEQ ID NO: 3177228 - RNA, 23 nt, Mycobacterium bovis subsp bovis AF2122/97
agugcaggugcccggccaaaaug

SEQ ID NO: 3177229 - RNA, 15 nt, Mycobacterium bovis subsp bovis AF2122/97
agugcaucggcagcc

SEQ ID NO: 3177230 - RNA, 17 nt, Mycobacterium bovis subsp bovis AF2122/97
agugccacgaggacccg

SEQ ID NO: 3177231 - RNA, 21 nt, Mycobacterium bovis subsp bovis AF2122/97
agugccacgccugagccacca

SEQ ID NO: 3177232 - RNA, 18 nt, Mycobacterium bovis subsp bovis AF2122/97
aguggugggcguggcugg

SEQ ID NO: 3177233 - RNA, 19 nt, Mycobacterium bovis subsp bovis AF2122/97
agugguucgaaccguugcg

SEQ ID NO: 3177234 - RNA, 15 nt, Mycobacterium bovis subsp bovis AF2122/97
agugguugcggccgu

SEQ ID NO: 3177235 - RNA, 15 nt, Mycobacterium bovis subsp bovis AF2122/97
aguguccccccgcgc

SEQ ID NO: 3177236 - RNA, 14 nt, Mycobacterium bovis subsp bovis AF2122/97
aguguccccggcug

SEQ ID NO: 3177237 - RNA, 15 nt, Mycobacterium bovis subsp bovis AF2122/97
agugucggcgucugu

SEQ ID NO: 3177238 - RNA, 20 nt, Mycobacterium bovis subsp bovis AF2122/97
agugucuccggcaacagcac

SEQ ID NO: 3177239 - RNA, 22 nt, Mycobacterium bovis subsp bovis AF2122/97
agugucuccggcaacagcacca

SEQ ID NO: 3177240 - RNA, 17 nt, Mycobacterium bovis subsp bovis AF2122/97
agugucuuagccagcag

SEQ ID NO: 3177241 - RNA, 16 nt, Mycobacterium bovis subsp bovis AF2122/97
agugugacggcggcca

SEQ ID NO: 3177242 - RNA, 16 nt, Mycobacterium bovis subsp bovis AF2122/97
agugugagcagaccca

SEQ ID NO: 3177243 - RNA, 13 nt, Mycobacterium bovis subsp bovis AF2122/97
aguguggccgaaa

SEQ ID NO: 3177244 - RNA, 18 nt, Mycobacterium bovis subsp bovis AF2122/97
aguguggcgaugaccacg

SEQ ID NO: 3177245 - RNA, 17 nt, Mycobacterium bovis subsp bovis AF2122/97
agugugggggucagggg

SEQ ID NO: 3177246 - RNA, 19 nt, Mycobacterium bovis subsp bovis AF2122/97
aguguugcaguggcgacga

SEQ ID NO: 3177247 - RNA, 17 nt, Mycobacterium bovis subsp bovis AF2122/97
aguucaacgaggccgac

SEQ ID NO: 3177248 - RNA, 19 nt, Mycobacterium bovis subsp bovis AF2122/97
aguucaacgaggccgacga

SEQ ID NO: 3177249 - RNA, 16 nt, Mycobacterium bovis subsp bovis AF2122/97
aguucacccaucaucg

SEQ ID NO: 3177250 - RNA, 17 nt, Mycobacterium bovis subsp bovis AF2122/97
aguucacccaucaucgc

SEQ ID NO: 3177251 - RNA, 15 nt, Mycobacterium bovis subsp bovis AF2122/97
aguucacgcucgacg

SEQ ID NO: 3177252 - RNA, 20 nt, Mycobacterium bovis subsp bovis AF2122/97
aguucccgaaacccgaugug

SEQ ID NO: 3177253 - RNA, 23 nt, Mycobacterium bovis subsp bovis AF2122/97
aguucccugaugggcgaauugca

SEQ ID NO: 3177254 - RNA, 18 nt, Mycobacterium bovis subsp bovis AF2122/97
aguuccgcaccgaacgug

SEQ ID NO: 3177255 - RNA, 20 nt, Mycobacterium bovis subsp bovis AF2122/97
aguuccggucgacuccagca

SEQ ID NO: 3177256 - RNA, 17 nt, Mycobacterium bovis subsp bovis AF2122/97
aguuccucguggguccg

SEQ ID NO: 3177257 - RNA, 20 nt, Mycobacterium bovis subsp bovis AF2122/97
aguuccuugaugcggccgcg

SEQ ID NO: 3177258 - RNA, 22 nt, Mycobacterium bovis subsp bovis AF2122/97
aguucgacggcgucaaaggccu

SEQ ID NO: 3177259 - RNA, 21 nt, Mycobacterium bovis subsp bovis AF2122/97
aguucgacggugccgucugcg

SEQ ID NO: 3177260 - RNA, 14 nt, Mycobacterium bovis subsp bovis AF2122/97
aguucgagcugcca

SEQ ID NO: 3177261 - RNA, 20 nt, Mycobacterium bovis subsp bovis AF2122/97
aguucgcacccguucgugag

SEQ ID NO: 3177262 - RNA, 15 nt, Mycobacterium bovis subsp bovis AF2122/97
aguucgccagcaacg

SEQ ID NO: 3177263 - RNA, 15 nt, Mycobacterium bovis subsp bovis AF2122/97
aguucgcgccacgca

SEQ ID NO: 3177264 - RNA, 16 nt, Mycobacterium bovis subsp bovis AF2122/97
aguucgcgccguggcg

SEQ ID NO: 3177265 - RNA, 21 nt, Mycobacterium bovis subsp bovis AF2122/97
aguucgcggccaucgccgaca

SEQ ID NO: 3177266 - RNA, 13 nt, Mycobacterium bovis subsp bovis AF2122/97
aguucgcggcugc

SEQ ID NO: 3177267 - RNA, 18 nt, Mycobacterium bovis subsp bovis AF2122/97
aguucgcugaccgcuacc

SEQ ID NO: 3177268 - RNA, 13 nt, Mycobacterium bovis subsp bovis AF2122/97
aguucggccacca

SEQ ID NO: 3177269 - RNA, 18 nt, Mycobacterium bovis subsp bovis AF2122/97
aguucggcccgcaaacag

SEQ ID NO: 3177270 - RNA, 12 nt, Mycobacterium bovis subsp bovis AF2122/97
aguucggcggcc

SEQ ID NO: 3177271 - RNA, 18 nt, Mycobacterium bovis subsp bovis AF2122/97
aguucggcggccgccgcg

SEQ ID NO: 3177272 - RNA, 22 nt, Mycobacterium bovis subsp bovis AF2122/97
aguucggcgucuugcaucagcg

SEQ ID NO: 3177273 - RNA, 16 nt, Mycobacterium bovis subsp bovis AF2122/97
aguucgggcugcggca

SEQ ID NO: 3177274 - RNA, 18 nt, Mycobacterium bovis subsp bovis AF2122/97
aguucgggcugcggcagu

SEQ ID NO: 3177275 - RNA, 17 nt, Mycobacterium bovis subsp bovis AF2122/97
aguucgguagcgaucgu

SEQ ID NO: 3177276 - RNA, 18 nt, Mycobacterium bovis subsp bovis AF2122/97
aguucggugagccgggcg

SEQ ID NO: 3177277 - RNA, 22 nt, Mycobacterium bovis subsp bovis AF2122/97
aguucgguugcccccagggccg

SEQ ID NO: 3177278 - RNA, 16 nt, Mycobacterium bovis subsp bovis AF2122/97
aguucguagucggcau

SEQ ID NO: 3177279 - RNA, 16 nt, Mycobacterium bovis subsp bovis AF2122/97
aguucgucaccacgag

SEQ ID NO: 3177280 - RNA, 15 nt, Mycobacterium bovis subsp bovis AF2122/97
aguucgucagcggcc

SEQ ID NO: 3177281 - RNA, 19 nt, Mycobacterium bovis subsp bovis AF2122/97
aguucgucgguugccacgc

SEQ ID NO: 3177282 - RNA, 16 nt, Mycobacterium bovis subsp bovis AF2122/97
aguucuaccaccuugc

SEQ ID NO: 3177283 - RNA, 19 nt, Mycobacterium bovis subsp bovis AF2122/97
aguucuccucgugcagcac

SEQ ID NO: 3177284 - RNA, 14 nt, Mycobacterium bovis subsp bovis AF2122/97
aguucugcgaucac

SEQ ID NO: 3177285 - RNA, 20 nt, Mycobacterium bovis subsp bovis AF2122/97
aguucuugauuagccauuaa

SEQ ID NO: 3177286 - RNA, 11 nt, Mycobacterium bovis subsp bovis AF2122/97
aguugaagaag

SEQ ID NO: 3177287 - RNA, 18 nt, Mycobacterium bovis subsp bovis AF2122/97
aguugaaggugccggcgu

SEQ ID NO: 3177288 - RNA, 19 nt, Mycobacterium bovis subsp bovis AF2122/97
aguugaccuucaccuggaa

SEQ ID NO: 3177289 - RNA, 15 nt, Mycobacterium bovis subsp bovis AF2122/97
aguugacgcagcccg

SEQ ID NO: 3177290 - RNA, 16 nt, Mycobacterium bovis subsp bovis AF2122/97
aguugagcaugucguc

SEQ ID NO: 3177291 - RNA, 15 nt, Mycobacterium bovis subsp bovis AF2122/97
aguugagcgccaacc

SEQ ID NO: 3177292 - RNA, 11 nt, Mycobacterium bovis subsp bovis AF2122/97
aguugaggccg

SEQ ID NO: 3177293 - RNA, 21 nt, Mycobacterium bovis subsp bovis AF2122/97
aguugagggugugagguaguc

SEQ ID NO: 3177294 - RNA, 14 nt, Mycobacterium bovis subsp bovis AF2122/97
aguugaucaggccg

SEQ ID NO: 3177295 - RNA, 15 nt, Mycobacterium bovis subsp bovis AF2122/97
aguugcacaccggca

SEQ ID NO: 3177296 - RNA, 16 nt, Mycobacterium bovis subsp bovis AF2122/97
aguugcacaccggcac

SEQ ID NO: 3177297 - RNA, 20 nt, Mycobacterium bovis subsp bovis AF2122/97
aguugcacaccggcacugcc

SEQ ID NO: 3177298 - RNA, 22 nt, Mycobacterium bovis subsp bovis AF2122/97
aguugcaguacuagcagcgggc

SEQ ID NO: 3177299 - RNA, 15 nt, Mycobacterium bovis subsp bovis AF2122/97
aguugcccgacgccg

SEQ ID NO: 3177300 - RNA, 15 nt, Mycobacterium bovis subsp bovis AF2122/97
aguugccggucaggc

SEQ ID NO: 3177301 - RNA, 14 nt, Mycobacterium bovis subsp bovis AF2122/97
aguugcgcgacggc

SEQ ID NO: 3177302 - RNA, 22 nt, Mycobacterium bovis subsp bovis AF2122/97
aguugcgcggcaguggccagac

SEQ ID NO: 3177303 - RNA, 22 nt, Mycobacterium bovis subsp bovis AF2122/97
aguugcgggcuuugagcgcccg

SEQ ID NO: 3177304 - RNA, 15 nt, Mycobacterium bovis subsp bovis AF2122/97
aguugcgggugaugg

SEQ ID NO: 3177305 - RNA, 14 nt, Mycobacterium bovis subsp bovis AF2122/97
aguugcucggccga

SEQ ID NO: 3177306 - RNA, 22 nt, Mycobacterium bovis subsp bovis AF2122/97
aguugcucggcuucccuaggcu

SEQ ID NO: 3177307 - RNA, 22 nt, Mycobacterium bovis subsp bovis AF2122/97
aguugcucguugugcagguggc

SEQ ID NO: 3177308 - RNA, 13 nt, Mycobacterium bovis subsp bovis AF2122/97
aguuggaacugcc

SEQ ID NO: 3177309 - RNA, 17 nt, Mycobacterium bovis subsp bovis AF2122/97
aguuggaacugcccgau

SEQ ID NO: 3177310 - RNA, 13 nt, Mycobacterium bovis subsp bovis AF2122/97
aguuggcaccagc

SEQ ID NO: 3177311 - RNA, 18 nt, Mycobacterium bovis subsp bovis AF2122/97
aguuggcaccagccggug

SEQ ID NO: 3177312 - RNA, 19 nt, Mycobacterium bovis subsp bovis AF2122/97
aguuggccaguaugcggug

SEQ ID NO: 3177313 - RNA, 20 nt, Mycobacterium bovis subsp bovis AF2122/97
aguuggccaguaugcggugc

SEQ ID NO: 3177314 - RNA, 13 nt, Mycobacterium bovis subsp bovis AF2122/97
aguuggccgcccg

SEQ ID NO: 3177315 - RNA, 15 nt, Mycobacterium bovis subsp bovis AF2122/97
aguuggcgaccugcg

SEQ ID NO: 3177316 - RNA, 12 nt, Mycobacterium bovis subsp bovis AF2122/97
aguuggcgcccg

SEQ ID NO: 3177317 - RNA, 23 nt, Mycobacterium bovis subsp bovis AF2122/97
aguuggcgcccgaagccgggccc

SEQ ID NO: 3177318 - RNA, 23 nt, Mycobacterium bovis subsp bovis AF2122/97
aguuggcugagcagcgcggccag

SEQ ID NO: 3177319 - RNA, 20 nt, Mycobacterium bovis subsp bovis AF2122/97
auagacagggccgcucgccu

SEQ ID NO: 3177320 - RNA, 22 nt, Mycobacterium bovis subsp bovis AF2122/97
auagaccgcagucgcugggugg

SEQ ID NO: 3177321 - RNA, 19 nt, Mycobacterium bovis subsp bovis AF2122/97
auagacgaccccggugagc

SEQ ID NO: 3177322 - RNA, 15 nt, Mycobacterium bovis subsp bovis AF2122/97
auagacguuguugaa

SEQ ID NO: 3177323 - RNA, 16 nt, Mycobacterium bovis subsp bovis AF2122/97
auagcaacggugcucu

SEQ ID NO: 3177324 - RNA, 21 nt, Mycobacterium bovis subsp bovis AF2122/97
auagcaccaguuugugccgcc

SEQ ID NO: 3177325 - RNA, 20 nt, Mycobacterium bovis subsp bovis AF2122/97
auagccaagugagcgaucgg

SEQ ID NO: 3177326 - RNA, 21 nt, Mycobacterium bovis subsp bovis AF2122/97
auagccacucgaucaccggca

SEQ ID NO: 3177327 - RNA, 18 nt, Mycobacterium bovis subsp bovis AF2122/97
auagccaucacgacuccc

SEQ ID NO: 3177328 - RNA, 14 nt, Mycobacterium bovis subsp bovis AF2122/97
auagccgaacagcg

SEQ ID NO: 3177329 - RNA, 20 nt, Mycobacterium bovis subsp bovis AF2122/97
auagccgaccagguagacca

SEQ ID NO: 3177330 - RNA, 16 nt, Mycobacterium bovis subsp bovis AF2122/97
auagccgccgcgguca

SEQ ID NO: 3177331 - RNA, 21 nt, Mycobacterium bovis subsp bovis AF2122/97
auagccgguugucgcagcgca

SEQ ID NO: 3177332 - RNA, 20 nt, Mycobacterium bovis subsp bovis AF2122/97
auagccguugcgggccaggc

SEQ ID NO: 3177333 - RNA, 21 nt, Mycobacterium bovis subsp bovis AF2122/97
auagccucggcggcgccgaag

SEQ ID NO: 3177334 - RNA, 19 nt, Mycobacterium bovis subsp bovis AF2122/97
auagccugcgccgacccgc

SEQ ID NO: 3177335 - RNA, 13 nt, Mycobacterium bovis subsp bovis AF2122/97
auagcgaccgcgg

SEQ ID NO: 3177336 - RNA, 14 nt, Mycobacterium bovis subsp bovis AF2122/97
auagcgcacugccg

SEQ ID NO: 3177337 - RNA, 21 nt, Mycobacterium bovis subsp bovis AF2122/97
auagcgcggcaccagcaccgu

SEQ ID NO: 3177338 - RNA, 22 nt, Mycobacterium bovis subsp bovis AF2122/97
auagcggcggcggcacgcucgc

SEQ ID NO: 3177339 - RNA, 13 nt, Mycobacterium bovis subsp bovis AF2122/97
auagcugccggcc

SEQ ID NO: 3177340 - RNA, 20 nt, Mycobacterium bovis subsp bovis AF2122/97
auagcugcguccggaaccaa

SEQ ID NO: 3177341 - RNA, 21 nt, Mycobacterium bovis subsp bovis AF2122/97
auaggacaccgucaugccguu

SEQ ID NO: 3177342 - RNA, 17 nt, Mycobacterium bovis subsp bovis AF2122/97
auaggaccacgggaugc

SEQ ID NO: 3177343 - RNA, 13 nt, Mycobacterium bovis subsp bovis AF2122/97
auaggacugcgcc

SEQ ID NO: 3177344 - RNA, 16 nt, Mycobacterium bovis subsp bovis AF2122/97
auaggcaaggucaacc

SEQ ID NO: 3177345 - RNA, 15 nt, Mycobacterium bovis subsp bovis AF2122/97
auaggcaccaaggua

SEQ ID NO: 3177346 - RNA, 19 nt, Mycobacterium bovis subsp bovis AF2122/97
auaggcccgggcggccagc

SEQ ID NO: 3177347 - RNA, 17 nt, Mycobacterium bovis subsp bovis AF2122/97
auaggcgcggucaccgc

SEQ ID NO: 3177348 - RNA, 18 nt, Mycobacterium bovis subsp bovis AF2122/97
auaggcggccaucgacga

SEQ ID NO: 3177349 - RNA, 18 nt, Mycobacterium bovis subsp bovis AF2122/97
auagggccaccgccgccu

SEQ ID NO: 3177350 - RNA, 13 nt, Mycobacterium bovis subsp bovis AF2122/97
auagggcugguau

SEQ ID NO: 3177351 - RNA, 18 nt, Mycobacterium bovis subsp bovis AF2122/97
auagggcuuugucaccgg

SEQ ID NO: 3177352 - RNA, 16 nt, Mycobacterium bovis subsp bovis AF2122/97
auaguccgaaccgagc

SEQ ID NO: 3177353 - RNA, 17 nt, Mycobacterium bovis subsp bovis AF2122/97
auaguccuugcgccagc

SEQ ID NO: 3177354 - RNA, 15 nt, Mycobacterium bovis subsp bovis AF2122/97
auagucggccggcgg

SEQ ID NO: 3177355 - RNA, 18 nt, Mycobacterium bovis subsp bovis AF2122/97
auaguguguuuggugguu

SEQ ID NO: 3177356 - RNA, 16 nt, Mycobacterium bovis subsp bovis AF2122/97
auaguucuggcccgca

SEQ ID NO: 3177357 - RNA, 20 nt, Mycobacterium bovis subsp bovis AF2122/97
auauccgggagugcgccggc

SEQ ID NO: 3177358 - RNA, 20 nt, Mycobacterium bovis subsp bovis AF2122/97
auaucgaagcgucgggucgc

SEQ ID NO: 3177359 - RNA, 18 nt, Mycobacterium bovis subsp bovis AF2122/97
auaucgauaaccgcgacc

SEQ ID NO: 3177360 - RNA, 23 nt, Mycobacterium bovis subsp bovis AF2122/97
auaucgccgagaaccagcgaaau

SEQ ID NO: 3177361 - RNA, 16 nt, Mycobacterium bovis subsp bovis AF2122/97
auaucggcacggucac

SEQ ID NO: 3177362 - RNA, 23 nt, Mycobacterium bovis subsp bovis AF2122/97
auaucggcacggucacacgccag

SEQ ID NO: 3177363 - RNA, 12 nt, Mycobacterium bovis subsp bovis AF2122/97
auaucggcggcu

SEQ ID NO: 3177364 - RNA, 22 nt, Mycobacterium bovis subsp bovis AF2122/97
auaucgucgggcgucccggcgg

SEQ ID NO: 3177365 - RNA, 16 nt, Mycobacterium bovis subsp bovis AF2122/97
auaucucgccguacau

SEQ ID NO: 3177366 - RNA, 11 nt, Mycobacterium bovis subsp bovis AF2122/97
auaucugccac

SEQ ID NO: 3177367 - RNA, 14 nt, Mycobacterium bovis subsp bovis AF2122/97
auaucuugcgcaug

SEQ ID NO: 3177368 - RNA, 13 nt, Mycobacterium bovis subsp bovis AF2122/97
auauggaucaacg

SEQ ID NO: 3177369 - RNA, 20 nt, Mycobacterium bovis subsp bovis AF2122/97
auaugggugugcuccagcga

SEQ ID NO: 3177370 - RNA, 22 nt, Mycobacterium bovis subsp bovis AF2122/97
auauggucaccggacugcgccg

SEQ ID NO: 3177371 - RNA, 18 nt, Mycobacterium bovis subsp bovis AF2122/97
auauggugcgccauuccc

SEQ ID NO: 3177372 - RNA, 15 nt, Mycobacterium bovis subsp bovis AF2122/97
auauugcgcccggcc

SEQ ID NO: 3177373 - RNA, 20 nt, Mycobacterium bovis subsp bovis AF2122/97
aucaaaaacgaacccaggca

SEQ ID NO: 3177374 - RNA, 13 nt, Mycobacterium bovis subsp bovis AF2122/97
aucaaaccggcgg

SEQ ID NO: 3177375 - RNA, 15 nt, Mycobacterium bovis subsp bovis AF2122/97
aucaaagccagcacc

SEQ ID NO: 3177376 - RNA, 18 nt, Mycobacterium bovis subsp bovis AF2122/97
aucaacaggaccgggauc

SEQ ID NO: 3177377 - RNA, 15 nt, Mycobacterium bovis subsp bovis AF2122/97
aucaacaggccggcu

SEQ ID NO: 3177378 - RNA, 14 nt, Mycobacterium bovis subsp bovis AF2122/97
aucaacaggcgucc

SEQ ID NO: 3177379 - RNA, 17 nt, Mycobacterium bovis subsp bovis AF2122/97
aucaacaucggcccgcu

SEQ ID NO: 3177380 - RNA, 18 nt, Mycobacterium bovis subsp bovis AF2122/97
aucaacaugccggucauc

SEQ ID NO: 3177381 - RNA, 22 nt, Mycobacterium bovis subsp bovis AF2122/97
aucaaccccggugcagaugcgg

SEQ ID NO: 3177382 - RNA, 20 nt, Mycobacterium bovis subsp bovis AF2122/97
aucaacccgguccagccggu

SEQ ID NO: 3177383 - RNA, 17 nt, Mycobacterium bovis subsp bovis AF2122/97
aucaacccuacccgcau

SEQ ID NO: 3177384 - RNA, 18 nt, Mycobacterium bovis subsp bovis AF2122/97
aucaaccgcugucaccgu

SEQ ID NO: 3177385 - RNA, 16 nt, Mycobacterium bovis subsp bovis AF2122/97
aucaacgcgucgcccg

SEQ ID NO: 3177386 - RNA, 20 nt, Mycobacterium bovis subsp bovis AF2122/97
aucaacucgggcagcgcggc

SEQ ID NO: 3177387 - RNA, 14 nt, Mycobacterium bovis subsp bovis AF2122/97
aucaacucgugcgg

SEQ ID NO: 3177388 - RNA, 21 nt, Mycobacterium bovis subsp bovis AF2122/97
aucaacuuccgcagcgccacc

SEQ ID NO: 3177389 - RNA, 17 nt, Mycobacterium bovis subsp bovis AF2122/97
aucaagaaacgugguga

SEQ ID NO: 3177390 - RNA, 14 nt, Mycobacterium bovis subsp bovis AF2122/97
aucaagcacagccc

SEQ ID NO: 3177391 - RNA, 13 nt, Mycobacterium bovis subsp bovis AF2122/97
aucaagccgugau

SEQ ID NO: 3177392 - RNA, 15 nt, Mycobacterium bovis subsp bovis AF2122/97
aucaagcuggcccgc

SEQ ID NO: 3177393 - RNA, 13 nt, Mycobacterium bovis subsp bovis AF2122/97
aucaaggccaccu

SEQ ID NO: 3177394 - RNA, 14 nt, Mycobacterium bovis subsp bovis AF2122/97
aucaagggggucga

SEQ ID NO: 3177395 - RNA, 17 nt, Mycobacterium bovis subsp bovis AF2122/97
aucaaucuucccaccuu

SEQ ID NO: 3177396 - RNA, 14 nt, Mycobacterium bovis subsp bovis AF2122/97
aucaaugcgaugcg

SEQ ID NO: 3177397 - RNA, 14 nt, Mycobacterium bovis subsp bovis AF2122/97
aucaauugcccggc

SEQ ID NO: 3177398 - RNA, 15 nt, Mycobacterium bovis subsp bovis AF2122/97
aucaauugcccggca

SEQ ID NO: 3177399 - RNA, 12 nt, Mycobacterium bovis subsp bovis AF2122/97
aucacaauucca

SEQ ID NO: 3177400 - RNA, 16 nt, Mycobacterium bovis subsp bovis AF2122/97
aucacacccacgucga

SEQ ID NO: 3177401 - RNA, 15 nt, Mycobacterium bovis subsp bovis AF2122/97
aucacaccccaggca

SEQ ID NO: 3177402 - RNA, 12 nt, Mycobacterium bovis subsp bovis AF2122/97
aucacaccgcug

SEQ ID NO: 3177403 - RNA, 12 nt, Mycobacterium bovis subsp bovis AF2122/97
aucacauagccg

SEQ ID NO: 3177404 - RNA, 13 nt, Mycobacterium bovis subsp bovis AF2122/97
aucacaucaaagu

SEQ ID NO: 3177405 - RNA, 13 nt, Mycobacterium bovis subsp bovis AF2122/97
aucacauccacgc

SEQ ID NO: 3177406 - RNA, 14 nt, Mycobacterium bovis subsp bovis AF2122/97
aucagaaucaggcu

SEQ ID NO: 3177407 - RNA, 20 nt, Mycobacterium bovis subsp bovis AF2122/97
aucagaccaaugaccgccag

SEQ ID NO: 3177408 - RNA, 20 nt, Mycobacterium bovis subsp bovis AF2122/97
aucagacccagcgcggcaac

SEQ ID NO: 3177409 - RNA, 14 nt, Mycobacterium bovis subsp bovis AF2122/97
aucagacgauucgg

SEQ ID NO: 3177410 - RNA, 13 nt, Mycobacterium bovis subsp bovis AF2122/97
aucagacgcucga

SEQ ID NO: 3177411 - RNA, 20 nt, Mycobacterium bovis subsp bovis AF2122/97
aucagagcguucuucagcca

SEQ ID NO: 3177412 - RNA, 13 nt, Mycobacterium bovis subsp bovis AF2122/97
aucagaucgccga

SEQ ID NO: 3177413 - RNA, 12 nt, Mycobacterium bovis subsp bovis AF2122/97
aucagcaacagc

SEQ ID NO: 3177414 - RNA, 17 nt, Mycobacterium bovis subsp bovis AF2122/97
aucagcaacagcaggug

SEQ ID NO: 3177415 - RNA, 21 nt, Mycobacterium bovis subsp bovis AF2122/97
aucagcaagagccgcagccac

SEQ ID NO: 3177416 - RNA, 14 nt, Mycobacterium bovis subsp bovis AF2122/97
aucagcaccgacag

SEQ ID NO: 3177417 - RNA, 14 nt, Mycobacterium bovis subsp bovis AF2122/97
aucagcaccgacgg

SEQ ID NO: 3177418 - RNA, 12 nt, Mycobacterium bovis subsp bovis AF2122/97
aucagcaccgug

SEQ ID NO: 3177419 - RNA, 22 nt, Mycobacterium bovis subsp bovis AF2122/97
aucagcaccgugacagcggcau

SEQ ID NO: 3177420 - RNA, 16 nt, Mycobacterium bovis subsp bovis AF2122/97
aucagcacgucgcggc

SEQ ID NO: 3177421 - RNA, 22 nt, Mycobacterium bovis subsp bovis AF2122/97
aucagcagcagcgugaccaccg

SEQ ID NO: 3177422 - RNA, 12 nt, Mycobacterium bovis subsp bovis AF2122/97
aucagcaugcgg

SEQ ID NO: 3177423 - RNA, 15 nt, Mycobacterium bovis subsp bovis AF2122/97
aucagcaugcggcca

SEQ ID NO: 3177424 - RNA, 19 nt, Mycobacterium bovis subsp bovis AF2122/97
aucagccagaccaacauga

SEQ ID NO: 3177425 - RNA, 22 nt, Mycobacterium bovis subsp bovis AF2122/97
aucagcccgacaccguccagca

SEQ ID NO: 3177426 - RNA, 13 nt, Mycobacterium bovis subsp bovis AF2122/97
aucagcccgccgg

SEQ ID NO: 3177427 - RNA, 19 nt, Mycobacterium bovis subsp bovis AF2122/97
aucagcccgccggacccgc

SEQ ID NO: 3177428 - RNA, 16 nt, Mycobacterium bovis subsp bovis AF2122/97
aucagcccgcgcagca

SEQ ID NO: 3177429 - RNA, 22 nt, Mycobacterium bovis subsp bovis AF2122/97
aucagcccuucagcgaagccgg

SEQ ID NO: 3177430 - RNA, 17 nt, Mycobacterium bovis subsp bovis AF2122/97
aucagccgcaucuuguc

SEQ ID NO: 3177431 - RNA, 23 nt, Mycobacterium bovis subsp bovis AF2122/97
aucagccgccaaccgcaggccga

SEQ ID NO: 3177432 - RNA, 12 nt, Mycobacterium bovis subsp bovis AF2122/97
aucagccgccgc

SEQ ID NO: 3177433 - RNA, 20 nt, Mycobacterium bovis subsp bovis AF2122/97
aucagccgcgcgccaucgcc

SEQ ID NO: 3177434 - RNA, 15 nt, Mycobacterium bovis subsp bovis AF2122/97
aucagccgcugcgua

SEQ ID NO: 3177435 - RNA, 13 nt, Mycobacterium bovis subsp bovis AF2122/97
aucagccguggca

SEQ ID NO: 3177436 - RNA, 18 nt, Mycobacterium bovis subsp bovis AF2122/97
aucagcgacuccacccca

SEQ ID NO: 3177437 - RNA, 15 nt, Mycobacterium bovis subsp bovis AF2122/97
aucagcgacuugcug

SEQ ID NO: 3177438 - RNA, 20 nt, Mycobacterium bovis subsp bovis AF2122/97
aucagcgacuugcuggcgua

SEQ ID NO: 3177439 - RNA, 22 nt, Mycobacterium bovis subsp bovis AF2122/97
aucagcgaguggucccguucgc

SEQ ID NO: 3177440 - RNA, 14 nt, Mycobacterium bovis subsp bovis AF2122/97
aucagcgcgaacgc

SEQ ID NO: 3177441 - RNA, 15 nt, Mycobacterium bovis subsp bovis AF2122/97
aucagcgcggcgccc

SEQ ID NO: 3177442 - RNA, 17 nt, Mycobacterium bovis subsp bovis AF2122/97
aucagcggauccagaaa

SEQ ID NO: 3177443 - RNA, 21 nt, Mycobacterium bovis subsp bovis AF2122/97
aucagcggcagcaccgcacgg

SEQ ID NO: 3177444 - RNA, 21 nt, Mycobacterium bovis subsp bovis AF2122/97
aucagcgguacguaaucgagc

SEQ ID NO: 3177445 - RNA, 23 nt, Mycobacterium bovis subsp bovis AF2122/97
aucagcgguacguaaucgagcgc

SEQ ID NO: 3177446 - RNA, 15 nt, Mycobacterium bovis subsp bovis AF2122/97
aucagcguggcgccc

SEQ ID NO: 3177447 - RNA, 22 nt, Mycobacterium bovis subsp bovis AF2122/97
aucagcucagugaugcgccccg

SEQ ID NO: 3177448 - RNA, 15 nt, Mycobacterium bovis subsp bovis AF2122/97
aucagcucgaugccg

SEQ ID NO: 3177449 - RNA, 19 nt, Mycobacterium bovis subsp bovis AF2122/97
aucagcucgcgcacgucga

SEQ ID NO: 3177450 - RNA, 19 nt, Mycobacterium bovis subsp bovis AF2122/97
aucagcugcgcaucgccac

SEQ ID NO: 3177451 - RNA, 21 nt, Mycobacterium bovis subsp bovis AF2122/97
aucagcugcgcaucgccacca

SEQ ID NO: 3177452 - RNA, 18 nt, Mycobacterium bovis subsp bovis AF2122/97
aucagcuugugggcgacg

SEQ ID NO: 3177453 - RNA, 21 nt, Mycobacterium bovis subsp bovis AF2122/97
aucaggacgcgaucggcguca

SEQ ID NO: 3177454 - RNA, 20 nt, Mycobacterium bovis subsp bovis AF2122/97
aucaggccgaugacgaugcc

SEQ ID NO: 3177455 - RNA, 21 nt, Mycobacterium bovis subsp bovis AF2122/97
aucaggccgaugacgaugccg

SEQ ID NO: 3177456 - RNA, 15 nt, Mycobacterium bovis subsp bovis AF2122/97
aucaggccgaugcgg

SEQ ID NO: 3177457 - RNA, 17 nt, Mycobacterium bovis subsp bovis AF2122/97
aucaggcugggcagacc

SEQ ID NO: 3177458 - RNA, 20 nt, Mycobacterium bovis subsp bovis AF2122/97
aucagggccccaccgagcgg

SEQ ID NO: 3177459 - RNA, 16 nt, Mycobacterium bovis subsp bovis AF2122/97
aucagggcucgcucgc

SEQ ID NO: 3177460 - RNA, 23 nt, Mycobacterium bovis subsp bovis AF2122/97
aucagguccuaggugugcgacga

SEQ ID NO: 3177461 - RNA, 21 nt, Mycobacterium bovis subsp bovis AF2122/97
aucaggucgccgagaccggcc

SEQ ID NO: 3177462 - RNA, 20 nt, Mycobacterium bovis subsp bovis AF2122/97
aucaggugagaccagguucu

SEQ ID NO: 3177463 - RNA, 22 nt, Mycobacterium bovis subsp bovis AF2122/97
aucagguuggugcucagcggcu

SEQ ID NO: 3177464 - RNA, 15 nt, Mycobacterium bovis subsp bovis AF2122/97
aucaguacgcugcgg

SEQ ID NO: 3177465 - RNA, 16 nt, Mycobacterium bovis subsp bovis AF2122/97
aucaguagcagcggcu

SEQ ID NO: 3177466 - RNA, 20 nt, Mycobacterium bovis subsp bovis AF2122/97
aucaguccggcguucccgcc

SEQ ID NO: 3177467 - RNA, 21 nt, Mycobacterium bovis subsp bovis AF2122/97
aucagucugggcgaucgcuuc

SEQ ID NO: 3177468 - RNA, 15 nt, Mycobacterium bovis subsp bovis AF2122/97
aucagugaagacacc

SEQ ID NO: 3177469 - RNA, 15 nt, Mycobacterium bovis subsp bovis AF2122/97
aucagugcaagaccg

SEQ ID NO: 3177470 - RNA, 15 nt, Mycobacterium bovis subsp bovis AF2122/97
aucagugcagcgugg

SEQ ID NO: 3177471 - RNA, 22 nt, Mycobacterium bovis subsp bovis AF2122/97
aucagugcgugauggcggcgca

SEQ ID NO: 3177472 - RNA, 16 nt, Mycobacterium bovis subsp bovis AF2122/97
aucaguucccgaaccc

SEQ ID NO: 3177473 - RNA, 18 nt, Mycobacterium bovis subsp bovis AF2122/97
aucaguucccgaaccccg

SEQ ID NO: 3177474 - RNA, 19 nt, Mycobacterium bovis subsp bovis AF2122/97
aucaguucgugacgugcau

SEQ ID NO: 3177475 - RNA, 20 nt, Mycobacterium bovis subsp bovis AF2122/97
aucaguugcacaccgaucgg

SEQ ID NO: 3177476 - RNA, 12 nt, Mycobacterium bovis subsp bovis AF2122/97
aucaguugcccc

SEQ ID NO: 3177477 - RNA, 14 nt, Mycobacterium bovis subsp bovis AF2122/97
aucauagacagggc

SEQ ID NO: 3177478 - RNA, 20 nt, Mycobacterium bovis subsp bovis AF2122/97
aucauauccgccccagcugc

SEQ ID NO: 3177479 - RNA, 23 nt, Mycobacterium bovis subsp bovis AF2122/97
aucaucauauccgccccagcugc

SEQ ID NO: 3177480 - RNA, 16 nt, Mycobacterium bovis subsp bovis AF2122/97
aucauccacaccggau

SEQ ID NO: 3177481 - RNA, 22 nt, Mycobacterium bovis subsp bovis AF2122/97
aucaucgcccugggcgccggcg

SEQ ID NO: 3177482 - RNA, 18 nt, Mycobacterium bovis subsp bovis AF2122/97
aucaucgcugugcgcugg

SEQ ID NO: 3177483 - RNA, 18 nt, Mycobacterium bovis subsp bovis AF2122/97
aucaucgggagccgcacc

SEQ ID NO: 3177484 - RNA, 18 nt, Mycobacterium bovis subsp bovis AF2122/97
aucaucuuggugggaagc

SEQ ID NO: 3177485 - RNA, 16 nt, Mycobacterium bovis subsp bovis AF2122/97
aucaugaacgcaagca

SEQ ID NO: 3177486 - RNA, 15 nt, Mycobacterium bovis subsp bovis AF2122/97
aucaugagcagcacg

SEQ ID NO: 3177487 - RNA, 13 nt, Mycobacterium bovis subsp bovis AF2122/97
aucaugccggcga

SEQ ID NO: 3177488 - RNA, 20 nt, Mycobacterium bovis subsp bovis AF2122/97
aucauggugaaggcaaacac

SEQ ID NO: 3177489 - RNA, 20 nt, Mycobacterium bovis subsp bovis AF2122/97
aucauguccaucgcgcggcu

SEQ ID NO: 3177490 - RNA, 14 nt, Mycobacterium bovis subsp bovis AF2122/97
aucaugucgaagaa

SEQ ID NO: 3177491 - RNA, 18 nt, Mycobacterium bovis subsp bovis AF2122/97
aucaugucgaagaaccgg

SEQ ID NO: 3177492 - RNA, 18 nt, Mycobacterium bovis subsp bovis AF2122/97
aucccgacgaagguggca

SEQ ID NO: 3177493 - RNA, 23 nt, Mycobacterium bovis subsp bovis AF2122/97
aucccgaggggagugucagcgcc

SEQ ID NO: 3177494 - RNA, 19 nt, Mycobacterium bovis subsp bovis AF2122/97
aucccgauccugcccacca

SEQ ID NO: 3177495 - RNA, 14 nt, Mycobacterium bovis subsp bovis AF2122/97
aucccgaugcuggc

SEQ ID NO: 3177496 - RNA, 14 nt, Mycobacterium bovis subsp bovis AF2122/97
aucccgcaaaccgg

SEQ ID NO: 3177497 - RNA, 18 nt, Mycobacterium bovis subsp bovis AF2122/97
aucccgcaaaccgguccg

SEQ ID NO: 3177498 - RNA, 20 nt, Mycobacterium bovis subsp bovis AF2122/97
aucccgccacaccaacgucg

SEQ ID NO: 3177499 - RNA, 20 nt, Mycobacterium bovis subsp bovis AF2122/97
aucccgccaccgaacagucg

SEQ ID NO: 3177500 - RNA, 19 nt, Mycobacterium bovis subsp bovis AF2122/97
aucccgccaucugccugcc

SEQ ID NO: 3177501 - RNA, 22 nt, Mycobacterium bovis subsp bovis AF2122/97
aucccgcccaagguggcggcca

SEQ ID NO: 3177502 - RNA, 19 nt, Mycobacterium bovis subsp bovis AF2122/97
aucccgccccgggccacca

SEQ ID NO: 3177503 - RNA, 23 nt, Mycobacterium bovis subsp bovis AF2122/97
aucccgccgcccgcaucgcggca

SEQ ID NO: 3177504 - RNA, 20 nt, Mycobacterium bovis subsp bovis AF2122/97
aucccgcucccccgccaacc

SEQ ID NO: 3177505 - RNA, 14 nt, Mycobacterium bovis subsp bovis AF2122/97
aucccggaacgccg

SEQ ID NO: 3177506 - RNA, 17 nt, Mycobacterium bovis subsp bovis AF2122/97
aucccggaacgccgcca

SEQ ID NO: 3177507 - RNA, 13 nt, Mycobacterium bovis subsp bovis AF2122/97
aucccggaccgau

SEQ ID NO: 3177508 - RNA, 14 nt, Mycobacterium bovis subsp bovis AF2122/97
aucccggagccgcu

SEQ ID NO: 3177509 - RNA, 14 nt, Mycobacterium bovis subsp bovis AF2122/97
aucccggccagcuc

SEQ ID NO: 3177510 - RNA, 18 nt, Mycobacterium bovis subsp bovis AF2122/97
aucccggccaggggcgca

SEQ ID NO: 3177511 - RNA, 21 nt, Mycobacterium bovis subsp bovis AF2122/97
aucccggccgaguaccagccc

SEQ ID NO: 3177512 - RNA, 22 nt, Mycobacterium bovis subsp bovis AF2122/97
aucccggccgaguaccagccca

SEQ ID NO: 3177513 - RNA, 16 nt, Mycobacterium bovis subsp bovis AF2122/97
aucccggccgggucga

SEQ ID NO: 3177514 - RNA, 17 nt, Mycobacterium bovis subsp bovis AF2122/97
aucccggccgucgccgg

SEQ ID NO: 3177515 - RNA, 20 nt, Mycobacterium bovis subsp bovis AF2122/97
aucccggcgagcacccgcug

SEQ ID NO: 3177516 - RNA, 13 nt, Mycobacterium bovis subsp bovis AF2122/97
aucccgguggcag

SEQ ID NO: 3177517 - RNA, 22 nt, Mycobacterium bovis subsp bovis AF2122/97
aucccgguuccggcgaucaacg

SEQ ID NO: 3177518 - RNA, 18 nt, Mycobacterium bovis subsp bovis AF2122/97
aucccgugauccgccgac

SEQ ID NO: 3177519 - RNA, 20 nt, Mycobacterium bovis subsp bovis AF2122/97
aucccguucagcgaccaaug

SEQ ID NO: 3177520 - RNA, 14 nt, Mycobacterium bovis subsp bovis AF2122/97
aucccucaaggucu

SEQ ID NO: 3177521 - RNA, 14 nt, Mycobacterium bovis subsp bovis AF2122/97
aucccucggccgca

SEQ ID NO: 3177522 - RNA, 19 nt, Mycobacterium bovis subsp bovis AF2122/97
auccgaccugcucgauacg

SEQ ID NO: 3177523 - RNA, 20 nt, Mycobacterium bovis subsp bovis AF2122/97
auccgacgaccgcauugaac

SEQ ID NO: 3177524 - RNA, 22 nt, Mycobacterium bovis subsp bovis AF2122/97
auccgacgggauagacgacccc

SEQ ID NO: 3177525 - RNA, 15 nt, Mycobacterium bovis subsp bovis AF2122/97
auccgagccgcgauu

SEQ ID NO: 3177526 - RNA, 14 nt, Mycobacterium bovis subsp bovis AF2122/97
auccgagcgguggu

SEQ ID NO: 3177527 - RNA, 21 nt, Mycobacterium bovis subsp bovis AF2122/97
auccgaggauguugugccgau

SEQ ID NO: 3177528 - RNA, 20 nt, Mycobacterium bovis subsp bovis AF2122/97
auccgaguugucgccggagu

SEQ ID NO: 3177529 - RNA, 15 nt, Mycobacterium bovis subsp bovis AF2122/97
auccgaucacgacgu

SEQ ID NO: 3177530 - RNA, 13 nt, Mycobacterium bovis subsp bovis AF2122/97
auccgaucgccgc

SEQ ID NO: 3177531 - RNA, 15 nt, Mycobacterium bovis subsp bovis AF2122/97
auccgcaacaacgcc

SEQ ID NO: 3177532 - RNA, 18 nt, Mycobacterium bovis subsp bovis AF2122/97
auccgcaacagcucggcc

SEQ ID NO: 3177533 - RNA, 19 nt, Mycobacterium bovis subsp bovis AF2122/97
auccgcaacagcucggcca

SEQ ID NO: 3177534 - RNA, 21 nt, Mycobacterium bovis subsp bovis AF2122/97
auccgcaacagcucggccagg

SEQ ID NO: 3177535 - RNA, 19 nt, Mycobacterium bovis subsp bovis AF2122/97
auccgcaaggaccugugcg

SEQ ID NO: 3177536 - RNA, 15 nt, Mycobacterium bovis subsp bovis AF2122/97
auccgcacagcgacg

SEQ ID NO: 3177537 - RNA, 20 nt, Mycobacterium bovis subsp bovis AF2122/97
auccgcaccacgcccgacga

SEQ ID NO: 3177538 - RNA, 15 nt, Mycobacterium bovis subsp bovis AF2122/97
auccgcaggcccgcc

SEQ ID NO: 3177539 - RNA, 19 nt, Mycobacterium bovis subsp bovis AF2122/97
auccgcaguccggggcgca

SEQ ID NO: 3177540 - RNA, 18 nt, Mycobacterium bovis subsp bovis AF2122/97
auccgccagaccgcggcg

SEQ ID NO: 3177541 - RNA, 18 nt, Mycobacterium bovis subsp bovis AF2122/97
auccgccccagcugcggu

SEQ ID NO: 3177542 - RNA, 19 nt, Mycobacterium bovis subsp bovis AF2122/97
auccgccccgcccgcaccc

SEQ ID NO: 3177543 - RNA, 19 nt, Mycobacterium bovis subsp bovis AF2122/97
auccgcccuaaugaagccg

SEQ ID NO: 3177544 - RNA, 13 nt, Mycobacterium bovis subsp bovis AF2122/97
auccgcccuugcc

SEQ ID NO: 3177545 - RNA, 23 nt, Mycobacterium bovis subsp bovis AF2122/97
auccgccgacagcccacgaaugc

SEQ ID NO: 3177546 - RNA, 11 nt, Mycobacterium bovis subsp bovis AF2122/97
auccgccgccg

SEQ ID NO: 3177547 - RNA, 12 nt, Mycobacterium bovis subsp bovis AF2122/97
auccgccgccgg

SEQ ID NO: 3177548 - RNA, 14 nt, Mycobacterium bovis subsp bovis AF2122/97
auccgccgccgggu

SEQ ID NO: 3177549 - RNA, 13 nt, Mycobacterium bovis subsp bovis AF2122/97
auccgccggcaac

SEQ ID NO: 3177550 - RNA, 14 nt, Mycobacterium bovis subsp bovis AF2122/97
auccgcgccgcacc

SEQ ID NO: 3177551 - RNA, 22 nt, Mycobacterium bovis subsp bovis AF2122/97
auccgcgcgcuggaccugauga

SEQ ID NO: 3177552 - RNA, 13 nt, Mycobacterium bovis subsp bovis AF2122/97
auccgcggcaugc

SEQ ID NO: 3177553 - RNA, 19 nt, Mycobacterium bovis subsp bovis AF2122/97
auccgcggcaugcaaugcu

SEQ ID NO: 3177554 - RNA, 19 nt, Mycobacterium bovis subsp bovis AF2122/97
auccgcgggaaguucgccg

SEQ ID NO: 3177555 - RNA, 18 nt, Mycobacterium bovis subsp bovis AF2122/97
auccgcgguuggcagugg

SEQ ID NO: 3177556 - RNA, 19 nt, Mycobacterium bovis subsp bovis AF2122/97
auccgcgguuggcaguggc

SEQ ID NO: 3177557 - RNA, 23 nt, Mycobacterium bovis subsp bovis AF2122/97
auccgcguggugcugaccgcgcc

SEQ ID NO: 3177558 - RNA, 15 nt, Mycobacterium bovis subsp bovis AF2122/97
auccgcucacccgcc

SEQ ID NO: 3177559 - RNA, 16 nt, Mycobacterium bovis subsp bovis AF2122/97
auccgcucguggucgg

SEQ ID NO: 3177560 - RNA, 16 nt, Mycobacterium bovis subsp bovis AF2122/97
auccgcugcgccgagg

SEQ ID NO: 3177561 - RNA, 15 nt, Mycobacterium bovis subsp bovis AF2122/97
auccgcugggccggg

SEQ ID NO: 3177562 - RNA, 14 nt, Mycobacterium bovis subsp bovis AF2122/97
auccgcuguuccuc

SEQ ID NO: 3177563 - RNA, 17 nt, Mycobacterium bovis subsp bovis AF2122/97
auccgcuuacggguguc

SEQ ID NO: 3177564 - RNA, 20 nt, Mycobacterium bovis subsp bovis AF2122/97
auccggaauagcaacgcugc

SEQ ID NO: 3177565 - RNA, 22 nt, Mycobacterium bovis subsp bovis AF2122/97
auccggaguuuaagacgcccga

SEQ ID NO: 3177566 - RNA, 16 nt, Mycobacterium bovis subsp bovis AF2122/97
auccggaucccaccac

SEQ ID NO: 3177567 - RNA, 13 nt, Mycobacterium bovis subsp bovis AF2122/97
auccggaucggcc

SEQ ID NO: 3177568 - RNA, 14 nt, Mycobacterium bovis subsp bovis AF2122/97
auccggaucggccu

SEQ ID NO: 3177569 - RNA, 19 nt, Mycobacterium bovis subsp bovis AF2122/97
auccggcagaccggugcug

SEQ ID NO: 3177570 - RNA, 19 nt, Mycobacterium bovis subsp bovis AF2122/97
auccggcagcagccggcgg

SEQ ID NO: 3177571 - RNA, 12 nt, Mycobacterium bovis subsp bovis AF2122/97
auccggccacca

SEQ ID NO: 3177572 - RNA, 14 nt, Mycobacterium bovis subsp bovis AF2122/97
auccggccgagccg

SEQ ID NO: 3177573 - RNA, 23 nt, Mycobacterium bovis subsp bovis AF2122/97
auccggccgccaacuucaccacc

SEQ ID NO: 3177574 - RNA, 17 nt, Mycobacterium bovis subsp bovis AF2122/97
auccggcggcggccagg

SEQ ID NO: 3177575 - RNA, 15 nt, Mycobacterium bovis subsp bovis AF2122/97
auccggcgggugccg

SEQ ID NO: 3177576 - RNA, 23 nt, Mycobacterium bovis subsp bovis AF2122/97
auccggcgggugccgagcuggcg

SEQ ID NO: 3177577 - RNA, 15 nt, Mycobacterium bovis subsp bovis AF2122/97
auccggcucgguggc

SEQ ID NO: 3177578 - RNA, 14 nt, Mycobacterium bovis subsp bovis AF2122/97
auccggcugccguc

SEQ ID NO: 3177579 - RNA, 15 nt, Mycobacterium bovis subsp bovis AF2122/97
aucgagcaguggccg

SEQ ID NO: 3177580 - RNA, 18 nt, Mycobacterium bovis subsp bovis AF2122/97
aucgagcaguggccgccg

SEQ ID NO: 3177581 - RNA, 20 nt, Mycobacterium bovis subsp bovis AF2122/97
aucgagcaguuccagcucgc

SEQ ID NO: 3177582 - RNA, 16 nt, Mycobacterium bovis subsp bovis AF2122/97
aucgagcccggacgag

SEQ ID NO: 3177583 - RNA, 15 nt, Mycobacterium bovis subsp bovis AF2122/97
aucgagcccggagcg

SEQ ID NO: 3177584 - RNA, 14 nt, Mycobacterium bovis subsp bovis AF2122/97
aucgagccgacccg

SEQ ID NO: 3177585 - RNA, 15 nt, Mycobacterium bovis subsp bovis AF2122/97
aucgagcgccagcgc

SEQ ID NO: 3177586 - RNA, 15 nt, Mycobacterium bovis subsp bovis AF2122/97
aucgagcggcacauc

SEQ ID NO: 3177587 - RNA, 22 nt, Mycobacterium bovis subsp bovis AF2122/97
aucgagcugacgauggccaggc

SEQ ID NO: 3177588 - RNA, 17 nt, Mycobacterium bovis subsp bovis AF2122/97
aucgaggaacucggacc

SEQ ID NO: 3177589 - RNA, 21 nt, Mycobacterium bovis subsp bovis AF2122/97
aucgaggaacucggacccacc

SEQ ID NO: 3177590 - RNA, 17 nt, Mycobacterium bovis subsp bovis AF2122/97
aucgaggagaugccgac

SEQ ID NO: 3177591 - RNA, 19 nt, Mycobacterium bovis subsp bovis AF2122/97
aucgaggagaugccgacga

SEQ ID NO: 3177592 - RNA, 20 nt, Mycobacterium bovis subsp bovis AF2122/97
aucgaggaggcggucgauca

SEQ ID NO: 3177593 - RNA, 18 nt, Mycobacterium bovis subsp bovis AF2122/97
aucgaggugacggugacg

SEQ ID NO: 3177594 - RNA, 22 nt, Mycobacterium bovis subsp bovis AF2122/97
aucgaggugauguuggccgcca

SEQ ID NO: 3177595 - RNA, 19 nt, Mycobacterium bovis subsp bovis AF2122/97
aucgaguagcugaccgagc

SEQ ID NO: 3177596 - RNA, 14 nt, Mycobacterium bovis subsp bovis AF2122/97
aucgaguccaccac

SEQ ID NO: 3177597 - RNA, 15 nt, Mycobacterium bovis subsp bovis AF2122/97
aucgagucgaagaac

SEQ ID NO: 3177598 - RNA, 16 nt, Mycobacterium bovis subsp bovis AF2122/97
aucgaguggccgugaa

SEQ ID NO: 3177599 - RNA, 15 nt, Mycobacterium bovis subsp bovis AF2122/97
aucgaguuccgcauc

SEQ ID NO: 3177600 - RNA, 17 nt, Mycobacterium bovis subsp bovis AF2122/97
aucgaguugcucggccg

SEQ ID NO: 3177601 - RNA, 21 nt, Mycobacterium bovis subsp bovis AF2122/97
aucgaucaacaccaaucgggu

SEQ ID NO: 3177602 - RNA, 20 nt, Mycobacterium bovis subsp bovis AF2122/97
aucgaucagcaacucggcca

SEQ ID NO: 3177603 - RNA, 21 nt, Mycobacterium bovis subsp bovis AF2122/97
aucgaucccuugucgaaguac

SEQ ID NO: 3177604 - RNA, 12 nt, Mycobacterium bovis subsp bovis AF2122/97
aucgaucggauc

SEQ ID NO: 3177605 - RNA, 17 nt, Mycobacterium bovis subsp bovis AF2122/97
aucgaucugcggaggcg

SEQ ID NO: 3177606 - RNA, 15 nt, Mycobacterium bovis subsp bovis AF2122/97
aucgaugaccgucgc

SEQ ID NO: 3177607 - RNA, 22 nt, Mycobacterium bovis subsp bovis AF2122/97
aucgaugaccuuugagucgaga

SEQ ID NO: 3177608 - RNA, 19 nt, Mycobacterium bovis subsp bovis AF2122/97
aucgaugcggugaauccgu

SEQ ID NO: 3177609 - RNA, 14 nt, Mycobacterium bovis subsp bovis AF2122/97
aucgauuccgccgc

SEQ ID NO: 3177610 - RNA, 23 nt, Mycobacterium bovis subsp bovis AF2122/97
aucgauucgucgcggaucagccc

SEQ ID NO: 3177611 - RNA, 18 nt, Mycobacterium bovis subsp bovis AF2122/97
aucgauugcguagcgggu

SEQ ID NO: 3177612 - RNA, 20 nt, Mycobacterium bovis subsp bovis AF2122/97
aucgauuuggaucggcugcg

SEQ ID NO: 3177613 - RNA, 22 nt, Mycobacterium bovis subsp bovis AF2122/97
aucgcaagcgcggcgaagccgg

SEQ ID NO: 3177614 - RNA, 19 nt, Mycobacterium bovis subsp bovis AF2122/97
aucgcaaugaccugcagcg

SEQ ID NO: 3177615 - RNA, 18 nt, Mycobacterium bovis subsp bovis AF2122/97
aucgcacaccaacaccgc

SEQ ID NO: 3177616 - RNA, 12 nt, Mycobacterium bovis subsp bovis AF2122/97
aucgcacagcgc

SEQ ID NO: 3177617 - RNA, 16 nt, Mycobacterium bovis subsp bovis AF2122/97
aucgcacagcgcaggg

SEQ ID NO: 3177618 - RNA, 23 nt, Mycobacterium bovis subsp bovis AF2122/97
aucgcacagcgcaggguucgucg

SEQ ID NO: 3177619 - RNA, 16 nt, Mycobacterium bovis subsp bovis AF2122/97
aucgcacccaccacac

SEQ ID NO: 3177620 - RNA, 21 nt, Mycobacterium bovis subsp bovis AF2122/97
aucgcaccgugugggccccgc

SEQ ID NO: 3177621 - RNA, 17 nt, Mycobacterium bovis subsp bovis AF2122/97
aucgcacggaugaugcc

SEQ ID NO: 3177622 - RNA, 13 nt, Mycobacterium bovis subsp bovis AF2122/97
aucgcacugguca

SEQ ID NO: 3177623 - RNA, 15 nt, Mycobacterium bovis subsp bovis AF2122/97
aucgcagaacggacc

SEQ ID NO: 3177624 - RNA, 18 nt, Mycobacterium bovis subsp bovis AF2122/97
aucgcagacggcugccac

SEQ ID NO: 3177625 - RNA, 14 nt, Mycobacterium bovis subsp bovis AF2122/97
aucgcagauggcga

SEQ ID NO: 3177626 - RNA, 17 nt, Mycobacterium bovis subsp bovis AF2122/97
aucgcagucauguccau

SEQ ID NO: 3177627 - RNA, 14 nt, Mycobacterium bovis subsp bovis AF2122/97
aucgcauccgcggu

SEQ ID NO: 3177628 - RNA, 17 nt, Mycobacterium bovis subsp bovis AF2122/97
aucgcauggucuucgcg

SEQ ID NO: 3177629 - RNA, 17 nt, Mycobacterium bovis subsp bovis AF2122/97
aucgcauugggcgggcu

SEQ ID NO: 3177630 - RNA, 19 nt, Mycobacterium bovis subsp bovis AF2122/97
aucgccaaauccggugccc

SEQ ID NO: 3177631 - RNA, 22 nt, Mycobacterium bovis subsp bovis AF2122/97
aucgccaaauccggugcccgca

SEQ ID NO: 3177632 - RNA, 13 nt, Mycobacterium bovis subsp bovis AF2122/97
aucgccaaugcgg

SEQ ID NO: 3177633 - RNA, 18 nt, Mycobacterium bovis subsp bovis AF2122/97
aucgccacacccaaaccg

SEQ ID NO: 3177634 - RNA, 21 nt, Mycobacterium bovis subsp bovis AF2122/97
aucgccacagucgucgagcgc

SEQ ID NO: 3177635 - RNA, 13 nt, Mycobacterium bovis subsp bovis AF2122/97
aucgccaccaccg

SEQ ID NO: 3177636 - RNA, 13 nt, Mycobacterium bovis subsp bovis AF2122/97
aucgccaccgcgu

SEQ ID NO: 3177637 - RNA, 20 nt, Mycobacterium bovis subsp bovis AF2122/97
aucgccacgacaggucgccc

SEQ ID NO: 3177638 - RNA, 21 nt, Mycobacterium bovis subsp bovis AF2122/97
aucgccacuguugaagaagcc

SEQ ID NO: 3177639 - RNA, 22 nt, Mycobacterium bovis subsp bovis AF2122/97
aucgccacuguugaagaagccc

SEQ ID NO: 3177640 - RNA, 11 nt, Mycobacterium bovis subsp bovis AF2122/97
aucgccagcag

SEQ ID NO: 3177641 - RNA, 11 nt, Mycobacterium bovis subsp bovis AF2122/97
aucgccagcau

SEQ ID NO: 3177642 - RNA, 15 nt, Mycobacterium bovis subsp bovis AF2122/97
aucgccagccggcga

SEQ ID NO: 3177643 - RNA, 13 nt, Mycobacterium bovis subsp bovis AF2122/97
aucgccaggccga

SEQ ID NO: 3177644 - RNA, 20 nt, Mycobacterium bovis subsp bovis AF2122/97
aucgccauaccggccgccau

SEQ ID NO: 3177645 - RNA, 23 nt, Mycobacterium bovis subsp bovis AF2122/97
aucgccauaggagaacuccggga

SEQ ID NO: 3177646 - RNA, 21 nt, Mycobacterium bovis subsp bovis AF2122/97
aucgccaucgguugacccggc

SEQ ID NO: 3177647 - RNA, 22 nt, Mycobacterium bovis subsp bovis AF2122/97
aucgccaucguuucacccgggc

SEQ ID NO: 3177648 - RNA, 16 nt, Mycobacterium bovis subsp bovis AF2122/97
aucgcccaacaacgcu

SEQ ID NO: 3177649 - RNA, 18 nt, Mycobacterium bovis subsp bovis AF2122/97
aucgcccagugugcgccg

SEQ ID NO: 3177650 - RNA, 14 nt, Mycobacterium bovis subsp bovis AF2122/97
aucgcccgaugcgc

SEQ ID NO: 3177651 - RNA, 11 nt, Mycobacterium bovis subsp bovis AF2122/97
aucgcccgguu

SEQ ID NO: 3177652 - RNA, 18 nt, Mycobacterium bovis subsp bovis AF2122/97
aucgcccugacacccauc

SEQ ID NO: 3177653 - RNA, 16 nt, Mycobacterium bovis subsp bovis AF2122/97
aucgcccugacccgga

SEQ ID NO: 3177654 - RNA, 23 nt, Mycobacterium bovis subsp bovis AF2122/97
aucgcccugacccggagccgcca

SEQ ID NO: 3177655 - RNA, 13 nt, Mycobacterium bovis subsp bovis AF2122/97
aucgcccugggcg

SEQ ID NO: 3177656 - RNA, 14 nt, Mycobacterium bovis subsp bovis AF2122/97
aucgccgaaucggc

SEQ ID NO: 3177657 - RNA, 20 nt, Mycobacterium bovis subsp bovis AF2122/97
aucgccgaaucucaccguca

SEQ ID NO: 3177658 - RNA, 14 nt, Mycobacterium bovis subsp bovis AF2122/97
aucgccgacagcgc

SEQ ID NO: 3177659 - RNA, 16 nt, Mycobacterium bovis subsp bovis AF2122/97
aucgccgacagcgccu

SEQ ID NO: 3177660 - RNA, 13 nt, Mycobacterium bovis subsp bovis AF2122/97
aucgccgacccgc

SEQ ID NO: 3177661 - RNA, 15 nt, Mycobacterium bovis subsp bovis AF2122/97
aucgccgacgccaga

SEQ ID NO: 3177662 - RNA, 13 nt, Mycobacterium bovis subsp bovis AF2122/97
aucgccgacgccc

SEQ ID NO: 3177663 - RNA, 19 nt, Mycobacterium bovis subsp bovis AF2122/97
aucgccgagaaccagcgaa

SEQ ID NO: 3177664 - RNA, 16 nt, Mycobacterium bovis subsp bovis AF2122/97
aucgccgagaccgcgu

SEQ ID NO: 3177665 - RNA, 22 nt, Mycobacterium bovis subsp bovis AF2122/97
aucgccgaggcagcgucgucga

SEQ ID NO: 3177666 - RNA, 14 nt, Mycobacterium bovis subsp bovis AF2122/97
aucgcggccgcugg

SEQ ID NO: 3177667 - RNA, 14 nt, Mycobacterium bovis subsp bovis AF2122/97
aucgcggcgaacau

SEQ ID NO: 3177668 - RNA, 20 nt, Mycobacterium bovis subsp bovis AF2122/97
aucgcggcgaacaucaccgu

SEQ ID NO: 3177669 - RNA, 16 nt, Mycobacterium bovis subsp bovis AF2122/97
aucgcggcgcccagga

SEQ ID NO: 3177670 - RNA, 17 nt, Mycobacterium bovis subsp bovis AF2122/97
aucgcggcgcccaggaa

SEQ ID NO: 3177671 - RNA, 19 nt, Mycobacterium bovis subsp bovis AF2122/97
aucgcggcggccuccacca

SEQ ID NO: 3177672 - RNA, 17 nt, Mycobacterium bovis subsp bovis AF2122/97
aucgcggcgggcccgau

SEQ ID NO: 3177673 - RNA, 21 nt, Mycobacterium bovis subsp bovis AF2122/97
aucgcggcguugugaccgccg

SEQ ID NO: 3177674 - RNA, 23 nt, Mycobacterium bovis subsp bovis AF2122/97
aucgcggcguugugaccgccgau

SEQ ID NO: 3177675 - RNA, 17 nt, Mycobacterium bovis subsp bovis AF2122/97
aucgcgggcggcgcugg

SEQ ID NO: 3177676 - RNA, 18 nt, Mycobacterium bovis subsp bovis AF2122/97
aucgcgggcgugccgacc

SEQ ID NO: 3177677 - RNA, 21 nt, Mycobacterium bovis subsp bovis AF2122/97
aucgcgggcgugccgaccagc

SEQ ID NO: 3177678 - RNA, 23 nt, Mycobacterium bovis subsp bovis AF2122/97
aucgcgggcgugccgaccagcau

SEQ ID NO: 3177679 - RNA, 23 nt, Mycobacterium bovis subsp bovis AF2122/97
aucgcgggcgugcuacacccgua

SEQ ID NO: 3177680 - RNA, 14 nt, Mycobacterium bovis subsp bovis AF2122/97
aucgcgggugaucu

SEQ ID NO: 3177681 - RNA, 20 nt, Mycobacterium bovis subsp bovis AF2122/97
aucgcgggugaucuccaccg

SEQ ID NO: 3177682 - RNA, 24 nt, Mycobacterium bovis subsp bovis AF2122/97
aucgcgggugaucuccaccggcga

SEQ ID NO: 3177683 - RNA, 16 nt, Mycobacterium bovis subsp bovis AF2122/97
aucgcgguccgagcgg

SEQ ID NO: 3177684 - RNA, 17 nt, Mycobacterium bovis subsp bovis AF2122/97
aucgcggucgccaccgu

SEQ ID NO: 3177685 - RNA, 15 nt, Mycobacterium bovis subsp bovis AF2122/97
aucgcggugaccggc

SEQ ID NO: 3177686 - RNA, 22 nt, Mycobacterium bovis subsp bovis AF2122/97
aucgcgguggcggugucggcgc

SEQ ID NO: 3177687 - RNA, 22 nt, Mycobacterium bovis subsp bovis AF2122/97
aucgcgguggcuucuagcccgu

SEQ ID NO: 3177688 - RNA, 18 nt, Mycobacterium bovis subsp bovis AF2122/97
aucgcggugggccccgau

SEQ ID NO: 3177689 - RNA, 12 nt, Mycobacterium bovis subsp bovis AF2122/97
aucgcgucauca

SEQ ID NO: 3177690 - RNA, 16 nt, Mycobacterium bovis subsp bovis AF2122/97
aucgcguccgccucgg

SEQ ID NO: 3177691 - RNA, 14 nt, Mycobacterium bovis subsp bovis AF2122/97
aucgcgucgagcgc

SEQ ID NO: 3177692 - RNA, 12 nt, Mycobacterium bovis subsp bovis AF2122/97
aucgcgucggcg

SEQ ID NO: 3177693 - RNA, 14 nt, Mycobacterium bovis subsp bovis AF2122/97
aucgcgucggcgau

SEQ ID NO: 3177694 - RNA, 15 nt, Mycobacterium bovis subsp bovis AF2122/97
aucgcgucggcgaug

SEQ ID NO: 3177695 - RNA, 16 nt, Mycobacterium bovis subsp bovis AF2122/97
aucgcgugcggugccg

SEQ ID NO: 3177696 - RNA, 23 nt, Mycobacterium bovis subsp bovis AF2122/97
aucgcgugcggugccguggugga

SEQ ID NO: 3177697 - RNA, 17 nt, Mycobacterium bovis subsp bovis AF2122/97
aucgcguggaucgcgcu

SEQ ID NO: 3177698 - RNA, 13 nt, Mycobacterium bovis subsp bovis AF2122/97
aucgcguggcgca

SEQ ID NO: 3177699 - RNA, 20 nt, Mycobacterium bovis subsp bovis AF2122/97
aucgcguggcgcaccaccgc

SEQ ID NO: 3177700 - RNA, 17 nt, Mycobacterium bovis subsp bovis AF2122/97
aucgcguucugcaccag

SEQ ID NO: 3177701 - RNA, 19 nt, Mycobacterium bovis subsp bovis AF2122/97
aucgcguuguaggcuucca

SEQ ID NO: 3177702 - RNA, 23 nt, Mycobacterium bovis subsp bovis AF2122/97
aucgcguuguaggcuuccagcuc

SEQ ID NO: 3177703 - RNA, 13 nt, Mycobacterium bovis subsp bovis AF2122/97
aucgcuacgucga

SEQ ID NO: 3177704 - RNA, 17 nt, Mycobacterium bovis subsp bovis AF2122/97
aucgcuaggaccgcggu

SEQ ID NO: 3177705 - RNA, 22 nt, Mycobacterium bovis subsp bovis AF2122/97
aucgcucauucgugcccgggcg

SEQ ID NO: 3177706 - RNA, 23 nt, Mycobacterium bovis subsp bovis AF2122/97
aucgcuccgcggcgcagcacggc

SEQ ID NO: 3177707 - RNA, 19 nt, Mycobacterium bovis subsp bovis AF2122/97
aucgcuccggcccugccgc

SEQ ID NO: 3177708 - RNA, 14 nt, Mycobacterium bovis subsp bovis AF2122/97
aucgcucucgguca

SEQ ID NO: 3177709 - RNA, 12 nt, Mycobacterium bovis subsp bovis AF2122/97
aucgcuggccgc

SEQ ID NO: 3177710 - RNA, 22 nt, Mycobacterium bovis subsp bovis AF2122/97
aucgcugggcacucggcccggc

SEQ ID NO: 3177711 - RNA, 15 nt, Mycobacterium bovis subsp bovis AF2122/97
aucgcuucccggaag

SEQ ID NO: 3177712 - RNA, 14 nt, Mycobacterium bovis subsp bovis AF2122/97
aucgcuugaacgca

SEQ ID NO: 3177713 - RNA, 17 nt, Mycobacterium bovis subsp bovis AF2122/97
aucggaagagucgacgc

SEQ ID NO: 3177714 - RNA, 18 nt, Mycobacterium bovis subsp bovis AF2122/97
aucggaaucgcgagcuug

SEQ ID NO: 3177715 - RNA, 15 nt, Mycobacterium bovis subsp bovis AF2122/97
aucggacaacacggc

SEQ ID NO: 3177716 - RNA, 19 nt, Mycobacterium bovis subsp bovis AF2122/97
aucggacagguaacgcggu

SEQ ID NO: 3177717 - RNA, 15 nt, Mycobacterium bovis subsp bovis AF2122/97
aucggaccgaccggc

SEQ ID NO: 3177718 - RNA, 15 nt, Mycobacterium bovis subsp bovis AF2122/97
aucggaggaaccccg

SEQ ID NO: 3177719 - RNA, 12 nt, Mycobacterium bovis subsp bovis AF2122/97
aucggaggcccg

SEQ ID NO: 3177720 - RNA, 13 nt, Mycobacterium bovis subsp bovis AF2122/97
aucggagucuuca

SEQ ID NO: 3177721 - RNA, 22 nt, Mycobacterium bovis subsp bovis AF2122/97
aucggagucuucaacgucgaga

SEQ ID NO: 3177722 - RNA, 18 nt, Mycobacterium bovis subsp bovis AF2122/97
aucggauacccagccggc

SEQ ID NO: 3177723 - RNA, 19 nt, Mycobacterium bovis subsp bovis AF2122/97
aucggauacccagccggcc

SEQ ID NO: 3177724 - RNA, 20 nt, Mycobacterium bovis subsp bovis AF2122/97
aucggauacccagccggccu

SEQ ID NO: 3177725 - RNA, 15 nt, Mycobacterium bovis subsp bovis AF2122/97
aucggaucggcaccc

SEQ ID NO: 3177726 - RNA, 16 nt, Mycobacterium bovis subsp bovis AF2122/97
aucggaucggcacccc

SEQ ID NO: 3177727 - RNA, 14 nt, Mycobacterium bovis subsp bovis AF2122/97
aucggauggccccc

SEQ ID NO: 3177728 - RNA, 15 nt, Mycobacterium bovis subsp bovis AF2122/97
aucggauggcggcca

SEQ ID NO: 3177729 - RNA, 14 nt, Mycobacterium bovis subsp bovis AF2122/97
aucggcaacccgca

SEQ ID NO: 3177730 - RNA, 16 nt, Mycobacterium bovis subsp bovis AF2122/97
aucggcaaugagcuac

SEQ ID NO: 3177731 - RNA, 17 nt, Mycobacterium bovis subsp bovis AF2122/97
aucggcacaggcggcca

SEQ ID NO: 3177732 - RNA, 18 nt, Mycobacterium bovis subsp bovis AF2122/97
aucggcacaggcggccag

SEQ ID NO: 3177733 - RNA, 19 nt, Mycobacterium bovis subsp bovis AF2122/97
aucggcacaggcggccagc

SEQ ID NO: 3177734 - RNA, 12 nt, Mycobacterium bovis subsp bovis AF2122/97
aucggcacccca

SEQ ID NO: 3177735 - RNA, 21 nt, Mycobacterium bovis subsp bovis AF2122/97
aucggcaccccacgccugccg

SEQ ID NO: 3177736 - RNA, 12 nt, Mycobacterium bovis subsp bovis AF2122/97
aucggcaccccg

SEQ ID NO: 3177737 - RNA, 21 nt, Mycobacterium bovis subsp bovis AF2122/97
aucggcaccgucucgcaccgc

SEQ ID NO: 3177738 - RNA, 15 nt, Mycobacterium bovis subsp bovis AF2122/97
aucggcaccgugcgg

SEQ ID NO: 3177739 - RNA, 22 nt, Mycobacterium bovis subsp bovis AF2122/97
aucggcaccgugucgacgguca

SEQ ID NO: 3177740 - RNA, 22 nt, Mycobacterium bovis subsp bovis AF2122/97
aucggcacggucacacgccagc

SEQ ID NO: 3177741 - RNA, 18 nt, Mycobacterium bovis subsp bovis AF2122/97
aucggcacuuagcccgau

SEQ ID NO: 3177742 - RNA, 16 nt, Mycobacterium bovis subsp bovis AF2122/97
aucggcagaauccggu

SEQ ID NO: 3177743 - RNA, 14 nt, Mycobacterium bovis subsp bovis AF2122/97
aucggcagcagcgc

SEQ ID NO: 3177744 - RNA, 15 nt, Mycobacterium bovis subsp bovis AF2122/97
aucggcagcagcgca

SEQ ID NO: 3177745 - RNA, 15 nt, Mycobacterium bovis subsp bovis AF2122/97
aucggcagccccugc

SEQ ID NO: 3177746 - RNA, 22 nt, Mycobacterium bovis subsp bovis AF2122/97
aucggcagccccugccgauccc

SEQ ID NO: 3177747 - RNA, 19 nt, Mycobacterium bovis subsp bovis AF2122/97
aucggcaggguggccagca

SEQ ID NO: 3177748 - RNA, 21 nt, Mycobacterium bovis subsp bovis AF2122/97
aucggcaggguggccagcagg

SEQ ID NO: 3177749 - RNA, 22 nt, Mycobacterium bovis subsp bovis AF2122/97
aucggcagucccagcgccgcac

SEQ ID NO: 3177750 - RNA, 20 nt, Mycobacterium bovis subsp bovis AF2122/97
aucggcauacccaucaacau

SEQ ID NO: 3177751 - RNA, 16 nt, Mycobacterium bovis subsp bovis AF2122/97
aucggcaucggcgacg

SEQ ID NO: 3177752 - RNA, 22 nt, Mycobacterium bovis subsp bovis AF2122/97
aucgguugaucugucagcgcgg

SEQ ID NO: 3177753 - RNA, 15 nt, Mycobacterium bovis subsp bovis AF2122/97
aucgguugcacccgc

SEQ ID NO: 3177754 - RNA, 17 nt, Mycobacterium bovis subsp bovis AF2122/97
aucguagccguagcggu

SEQ ID NO: 3177755 - RNA, 16 nt, Mycobacterium bovis subsp bovis AF2122/97
aucguaggacucggcg

SEQ ID NO: 3177756 - RNA, 17 nt, Mycobacterium bovis subsp bovis AF2122/97
aucguagguacgcaggg

SEQ ID NO: 3177757 - RNA, 17 nt, Mycobacterium bovis subsp bovis AF2122/97
aucgucaacgacgacga

SEQ ID NO: 3177758 - RNA, 18 nt, Mycobacterium bovis subsp bovis AF2122/97
aucgucaagaacgccacg

SEQ ID NO: 3177759 - RNA, 14 nt, Mycobacterium bovis subsp bovis AF2122/97
aucgucacugccac

SEQ ID NO: 3177760 - RNA, 16 nt, Mycobacterium bovis subsp bovis AF2122/97
aucgucacugccaccu

SEQ ID NO: 3177761 - RNA, 17 nt, Mycobacterium bovis subsp bovis AF2122/97
aucgucagcgaccacgu

SEQ ID NO: 3177762 - RNA, 13 nt, Mycobacterium bovis subsp bovis AF2122/97
aucgucaggaacc

SEQ ID NO: 3177763 - RNA, 19 nt, Mycobacterium bovis subsp bovis AF2122/97
aucgucaggaaccacccac

SEQ ID NO: 3177764 - RNA, 15 nt, Mycobacterium bovis subsp bovis AF2122/97
aucgucaguaccgca

SEQ ID NO: 3177765 - RNA, 17 nt, Mycobacterium bovis subsp bovis AF2122/97
aucgucauccaggggcg

SEQ ID NO: 3177766 - RNA, 18 nt, Mycobacterium bovis subsp bovis AF2122/97
aucgucaucccgagcucu

SEQ ID NO: 3177767 - RNA, 14 nt, Mycobacterium bovis subsp bovis AF2122/97
aucguccacgcaga

SEQ ID NO: 3177768 - RNA, 19 nt, Mycobacterium bovis subsp bovis AF2122/97
aucgucgaacagcaccgcc

SEQ ID NO: 3177769 - RNA, 19 nt, Mycobacterium bovis subsp bovis AF2122/97
aucgucgaaccggaugcgg

SEQ ID NO: 3177770 - RNA, 20 nt, Mycobacterium bovis subsp bovis AF2122/97
aucgucgaaccggaugcggu

SEQ ID NO: 3177771 - RNA, 18 nt, Mycobacterium bovis subsp bovis AF2122/97
aucgucgacgccgaucgc

SEQ ID NO: 3177772 - RNA, 16 nt, Mycobacterium bovis subsp bovis AF2122/97
aucgucgacgcgucgu

SEQ ID NO: 3177773 - RNA, 17 nt, Mycobacterium bovis subsp bovis AF2122/97
aucgucgagccgaucgc

SEQ ID NO: 3177774 - RNA, 14 nt, Mycobacterium bovis subsp bovis AF2122/97
aucgucgagccgcc

SEQ ID NO: 3177775 - RNA, 15 nt, Mycobacterium bovis subsp bovis AF2122/97
aucgucgagcgcggu

SEQ ID NO: 3177776 - RNA, 22 nt, Mycobacterium bovis subsp bovis AF2122/97
aucgucgauggucuccggacgc

SEQ ID NO: 3177777 - RNA, 16 nt, Mycobacterium bovis subsp bovis AF2122/97
aucgucgccaagccca

SEQ ID NO: 3177778 - RNA, 12 nt, Mycobacterium bovis subsp bovis AF2122/97
aucgucgccaug

SEQ ID NO: 3177779 - RNA, 21 nt, Mycobacterium bovis subsp bovis AF2122/97
aucgucgccgaucaugaccau

SEQ ID NO: 3177780 - RNA, 14 nt, Mycobacterium bovis subsp bovis AF2122/97
aucgucggccagca

SEQ ID NO: 3177781 - RNA, 17 nt, Mycobacterium bovis subsp bovis AF2122/97
aucgucggccagcagau

SEQ ID NO: 3177782 - RNA, 18 nt, Mycobacterium bovis subsp bovis AF2122/97
aucgucgggcgucccggc

SEQ ID NO: 3177783 - RNA, 12 nt, Mycobacterium bovis subsp bovis AF2122/97
aucgucggguca

SEQ ID NO: 3177784 - RNA, 19 nt, Mycobacterium bovis subsp bovis AF2122/97
aucgucggguugucgcggu

SEQ ID NO: 3177785 - RNA, 18 nt, Mycobacterium bovis subsp bovis AF2122/97
aucgucgucgcugccgcc

SEQ ID NO: 3177786 - RNA, 19 nt, Mycobacterium bovis subsp bovis AF2122/97
aucgucgugcacggcggcc

SEQ ID NO: 3177787 - RNA, 14 nt, Mycobacterium bovis subsp bovis AF2122/97
aucgucgugucgcc

SEQ ID NO: 3177788 - RNA, 16 nt, Mycobacterium bovis subsp bovis AF2122/97
aucgucgugucgccgc

SEQ ID NO: 3177789 - RNA, 19 nt, Mycobacterium bovis subsp bovis AF2122/97
aucgucguugggugccgga

SEQ ID NO: 3177790 - RNA, 23 nt, Mycobacterium bovis subsp bovis AF2122/97
aucgucguugucagcgaacggcc

SEQ ID NO: 3177791 - RNA, 13 nt, Mycobacterium bovis subsp bovis AF2122/97
aucgucucggcca

SEQ ID NO: 3177792 - RNA, 14 nt, Mycobacterium bovis subsp bovis AF2122/97
aucgucugguggca

SEQ ID NO: 3177793 - RNA, 19 nt, Mycobacterium bovis subsp bovis AF2122/97
aucgugaacacgucgcggu

SEQ ID NO: 3177794 - RNA, 20 nt, Mycobacterium bovis subsp bovis AF2122/97
aucgugacguuguaggagaa

SEQ ID NO: 3177795 - RNA, 21 nt, Mycobacterium bovis subsp bovis AF2122/97
aucgugagacgccgucgacgu

SEQ ID NO: 3177796 - RNA, 14 nt, Mycobacterium bovis subsp bovis AF2122/97
aucgugcagguugc

SEQ ID NO: 3177797 - RNA, 16 nt, Mycobacterium bovis subsp bovis AF2122/97
aucgugccgaacacgg

SEQ ID NO: 3177798 - RNA, 12 nt, Mycobacterium bovis subsp bovis AF2122/97
aucgugccggcg

SEQ ID NO: 3177799 - RNA, 13 nt, Mycobacterium bovis subsp bovis AF2122/97
aucgugccggcga

SEQ ID NO: 3177800 - RNA, 14 nt, Mycobacterium bovis subsp bovis AF2122/97
aucgugccggcgaa

SEQ ID NO: 3177801 - RNA, 16 nt, Mycobacterium bovis subsp bovis AF2122/97
aucgugccggcgaacc

SEQ ID NO: 3177802 - RNA, 18 nt, Mycobacterium bovis subsp bovis AF2122/97
aucgugcggaaccugcuc

SEQ ID NO: 3177803 - RNA, 21 nt, Mycobacterium bovis subsp bovis AF2122/97
aucgugcggaaccugcucggc

SEQ ID NO: 3177804 - RNA, 18 nt, Mycobacterium bovis subsp bovis AF2122/97
aucguggcggcgucgaca

SEQ ID NO: 3177805 - RNA, 18 nt, Mycobacterium bovis subsp bovis AF2122/97
aucguggcgucgugcgcg

SEQ ID NO: 3177806 - RNA, 16 nt, Mycobacterium bovis subsp bovis AF2122/97
aucgugggugccggcu

SEQ ID NO: 3177807 - RNA, 18 nt, Mycobacterium bovis subsp bovis AF2122/97
aucgugggugccggcuca

SEQ ID NO: 3177808 - RNA, 18 nt, Mycobacterium bovis subsp bovis AF2122/97
aucgugguuuggaccgcu

SEQ ID NO: 3177809 - RNA, 16 nt, Mycobacterium bovis subsp bovis AF2122/97
aucguguugucaggac

SEQ ID NO: 3177810 - RNA, 20 nt, Mycobacterium bovis subsp bovis AF2122/97
aucguuaucgacaccaccau

SEQ ID NO: 3177811 - RNA, 22 nt, Mycobacterium bovis subsp bovis AF2122/97
aucguucaugaucggcagaauc

SEQ ID NO: 3177812 - RNA, 14 nt, Mycobacterium bovis subsp bovis AF2122/97
aucguuccgauccg

SEQ ID NO: 3177813 - RNA, 22 nt, Mycobacterium bovis subsp bovis AF2122/97
aucguucgcgugccagcgcccc

SEQ ID NO: 3177814 - RNA, 18 nt, Mycobacterium bovis subsp bovis AF2122/97
aucguucgggguggugga

SEQ ID NO: 3177815 - RNA, 20 nt, Mycobacterium bovis subsp bovis AF2122/97
aucguugccggugccgccgc

SEQ ID NO: 3177816 - RNA, 19 nt, Mycobacterium bovis subsp bovis AF2122/97
aucguugccucgucgccgc

SEQ ID NO: 3177817 - RNA, 17 nt, Mycobacterium bovis subsp bovis AF2122/97
aucguuggccaugccac

SEQ ID NO: 3177818 - RNA, 20 nt, Mycobacterium bovis subsp bovis AF2122/97
aucguuggccgggcacgcga

SEQ ID NO: 3177819 - RNA, 20 nt, Mycobacterium bovis subsp bovis AF2122/97
aucguuggcgaccaccgcgu

SEQ ID NO: 3177820 - RNA, 12 nt, Mycobacterium bovis subsp bovis AF2122/97
aucucaccacga

SEQ ID NO: 3177821 - RNA, 20 nt, Mycobacterium bovis subsp bovis AF2122/97
aucucaccgggcccgacgac

SEQ ID NO: 3177822 - RNA, 23 nt, Mycobacterium bovis subsp bovis AF2122/97
aucuccaaguagcacuucagcuu

SEQ ID NO: 3177823 - RNA, 14 nt, Mycobacterium bovis subsp bovis AF2122/97
aucuccaccggcga

SEQ ID NO: 3177824 - RNA, 22 nt, Mycobacterium bovis subsp bovis AF2122/97
aucuccaccggcgaucugcucg

SEQ ID NO: 3177825 - RNA, 16 nt, Mycobacterium bovis subsp bovis AF2122/97
aucuccaccgucgccg

SEQ ID NO: 3177826 - RNA, 20 nt, Mycobacterium bovis subsp bovis AF2122/97
aucuccaccgucgccgccgg

SEQ ID NO: 3177827 - RNA, 12 nt, Mycobacterium bovis subsp bovis AF2122/97
aucuccaccuuc

SEQ ID NO: 3177828 - RNA, 23 nt, Mycobacterium bovis subsp bovis AF2122/97
aucuccaccuucugguccagcac

SEQ ID NO: 3177829 - RNA, 15 nt, Mycobacterium bovis subsp bovis AF2122/97
aucuccagcgguucg

SEQ ID NO: 3177830 - RNA, 16 nt, Mycobacterium bovis subsp bovis AF2122/97
aucuccagcgguucgg

SEQ ID NO: 3177831 - RNA, 16 nt, Mycobacterium bovis subsp bovis AF2122/97
aucuccccgaccgcgc

SEQ ID NO: 3177832 - RNA, 16 nt, Mycobacterium bovis subsp bovis AF2122/97
aucucccgaaucgugc

SEQ ID NO: 3177833 - RNA, 23 nt, Mycobacterium bovis subsp bovis AF2122/97
aucucccgaaucgugcggcgacc

SEQ ID NO: 3177834 - RNA, 20 nt, Mycobacterium bovis subsp bovis AF2122/97
aucucccgaccgccgagcgg

SEQ ID NO: 3177835 - RNA, 20 nt, Mycobacterium bovis subsp bovis AF2122/97
aucuccgacuuaagcgaacc

SEQ ID NO: 3177836 - RNA, 17 nt, Mycobacterium bovis subsp bovis AF2122/97
aucuccgccaaccgggu

SEQ ID NO: 3177837 - RNA, 16 nt, Mycobacterium bovis subsp bovis AF2122/97
aucuccgccgucgcca

SEQ ID NO: 3177838 - RNA, 21 nt, Mycobacterium bovis subsp bovis AF2122/97
aucuccgcgucggucagcugu

SEQ ID NO: 3177839 - RNA, 23 nt, Mycobacterium bovis subsp bovis AF2122/97
aucuggggguagccgccggcgcc

SEQ ID NO: 3177840 - RNA, 21 nt, Mycobacterium bovis subsp bovis AF2122/97
aucuggguccgucgagucgcc

SEQ ID NO: 3177841 - RNA, 12 nt, Mycobacterium bovis subsp bovis AF2122/97
aucuggguuccc

SEQ ID NO: 3177842 - RNA, 17 nt, Mycobacterium bovis subsp bovis AF2122/97
aucugguaagucagcuc

SEQ ID NO: 3177843 - RNA, 23 nt, Mycobacterium bovis subsp bovis AF2122/97
aucugguaagucagcucgaucac

SEQ ID NO: 3177844 - RNA, 17 nt, Mycobacterium bovis subsp bovis AF2122/97
aucuggucaagacccgc

SEQ ID NO: 3177845 - RNA, 21 nt, Mycobacterium bovis subsp bovis AF2122/97
aucuggucacgguucgcccgu

SEQ ID NO: 3177846 - RNA, 14 nt, Mycobacterium bovis subsp bovis AF2122/97
aucugguccagugg

SEQ ID NO: 3177847 - RNA, 17 nt, Mycobacterium bovis subsp bovis AF2122/97
aucugguccagugggau

SEQ ID NO: 3177848 - RNA, 21 nt, Mycobacterium bovis subsp bovis AF2122/97
aucugguccagugggaugacc

SEQ ID NO: 3177849 - RNA, 17 nt, Mycobacterium bovis subsp bovis AF2122/97
aucugguggaccuccgg

SEQ ID NO: 3177850 - RNA, 17 nt, Mycobacterium bovis subsp bovis AF2122/97
aucuggugggugcggcc

SEQ ID NO: 3177851 - RNA, 15 nt, Mycobacterium bovis subsp bovis AF2122/97
aucuguaaccuccuc

SEQ ID NO: 3177852 - RNA, 16 nt, Mycobacterium bovis subsp bovis AF2122/97
aucuguaaccuccucg

SEQ ID NO: 3177853 - RNA, 17 nt, Mycobacterium bovis subsp bovis AF2122/97
aucugucagcgcggcgc

SEQ ID NO: 3177854 - RNA, 13 nt, Mycobacterium bovis subsp bovis AF2122/97
aucuguccgcgaa

SEQ ID NO: 3177855 - RNA, 19 nt, Mycobacterium bovis subsp bovis AF2122/97
aucuguuccuugugacccc

SEQ ID NO: 3177856 - RNA, 15 nt, Mycobacterium bovis subsp bovis AF2122/97
aucuucaccacgccg

SEQ ID NO: 3177857 - RNA, 15 nt, Mycobacterium bovis subsp bovis AF2122/97
aucuucaccggccgg

SEQ ID NO: 3177858 - RNA, 19 nt, Mycobacterium bovis subsp bovis AF2122/97
aucuucgacaggccaccgc

SEQ ID NO: 3177859 - RNA, 23 nt, Mycobacterium bovis subsp bovis AF2122/97
aucuucgcgcagccgccgcgccc

SEQ ID NO: 3177860 - RNA, 23 nt, Mycobacterium bovis subsp bovis AF2122/97
aucuucuccucgucgguuccggg

SEQ ID NO: 3177861 - RNA, 20 nt, Mycobacterium bovis subsp bovis AF2122/97
aucuucuucagguagcggcc

SEQ ID NO: 3177862 - RNA, 12 nt, Mycobacterium bovis subsp bovis AF2122/97
aucuugccacuc

SEQ ID NO: 3177863 - RNA, 18 nt, Mycobacterium bovis subsp bovis AF2122/97
aucuugccgucggccggc

SEQ ID NO: 3177864 - RNA, 19 nt, Mycobacterium bovis subsp bovis AF2122/97
aucuugccgucggccggca

SEQ ID NO: 3177865 - RNA, 15 nt, Mycobacterium bovis subsp bovis AF2122/97
aucuugcgcaaugcc

SEQ ID NO: 3177866 - RNA, 17 nt, Mycobacterium bovis subsp bovis AF2122/97
aucuugcggcagcgaaa

SEQ ID NO: 3177867 - RNA, 21 nt, Mycobacterium bovis subsp bovis AF2122/97
aucuuggagaagguuucccgc

SEQ ID NO: 3177868 - RNA, 12 nt, Mycobacterium bovis subsp bovis AF2122/97
aucuuggccacc

SEQ ID NO: 3177869 - RNA, 17 nt, Mycobacterium bovis subsp bovis AF2122/97
aucuuggccaccgccga

SEQ ID NO: 3177870 - RNA, 13 nt, Mycobacterium bovis subsp bovis AF2122/97
aucuuggccagca

SEQ ID NO: 3177871 - RNA, 15 nt, Mycobacterium bovis subsp bovis AF2122/97
aucuuggccagcagc

SEQ ID NO: 3177872 - RNA, 19 nt, Mycobacterium bovis subsp bovis AF2122/97
aucuuggugaagaucgaca

SEQ ID NO: 3177873 - RNA, 18 nt, Mycobacterium bovis subsp bovis AF2122/97
aucuugguggccucaucc

SEQ ID NO: 3177874 - RNA, 15 nt, Mycobacterium bovis subsp bovis AF2122/97
aucuuggugggaagc

SEQ ID NO: 3177875 - RNA, 13 nt, Mycobacterium bovis subsp bovis AF2122/97
aucuugucgagca

SEQ ID NO: 3177876 - RNA, 17 nt, Mycobacterium bovis subsp bovis AF2122/97
aucuugucgaucugccc

SEQ ID NO: 3177877 - RNA, 15 nt, Mycobacterium bovis subsp bovis AF2122/97
aucuuuggcggccgc

SEQ ID NO: 3177878 - RNA, 22 nt, Mycobacterium bovis subsp bovis AF2122/97
augaacagcgacgccaugguca

SEQ ID NO: 3177879 - RNA, 15 nt, Mycobacterium bovis subsp bovis AF2122/97
augaaccaggcggcc

SEQ ID NO: 3177880 - RNA, 17 nt, Mycobacterium bovis subsp bovis AF2122/97
augaaccgggcagcaaa

SEQ ID NO: 3177881 - RNA, 20 nt, Mycobacterium bovis subsp bovis AF2122/97
augaacgcaagcagcgcgau

SEQ ID NO: 3177882 - RNA, 21 nt, Mycobacterium bovis subsp bovis AF2122/97
augaacgcguagucgcgggug

SEQ ID NO: 3177883 - RNA, 15 nt, Mycobacterium bovis subsp bovis AF2122/97
augaacggaaucuug

SEQ ID NO: 3177884 - RNA, 13 nt, Mycobacterium bovis subsp bovis AF2122/97
augaagaacuggc

SEQ ID NO: 3177885 - RNA, 12 nt, Mycobacterium bovis subsp bovis AF2122/97
augaagccguug

SEQ ID NO: 3177886 - RNA, 16 nt, Mycobacterium bovis subsp bovis AF2122/97
augaagcucgaccgcc

SEQ ID NO: 3177887 - RNA, 22 nt, Mycobacterium bovis subsp bovis AF2122/97
augaagcuggugaucagcucag

SEQ ID NO: 3177888 - RNA, 23 nt, Mycobacterium bovis subsp bovis AF2122/97
augaaggagaucccccaggcgaa

SEQ ID NO: 3177889 - RNA, 18 nt, Mycobacterium bovis subsp bovis AF2122/97
augaauucauguggcgcg

SEQ ID NO: 3177890 - RNA, 21 nt, Mycobacterium bovis subsp bovis AF2122/97
augacaaaccugcaugcccag

SEQ ID NO: 3177891 - RNA, 15 nt, Mycobacterium bovis subsp bovis AF2122/97
augacaaagaagugg

SEQ ID NO: 3177892 - RNA, 17 nt, Mycobacterium bovis subsp bovis AF2122/97
augaccacauuggugau

SEQ ID NO: 3177893 - RNA, 19 nt, Mycobacterium bovis subsp bovis AF2122/97
augaccaccgaaauaccca

SEQ ID NO: 3177894 - RNA, 13 nt, Mycobacterium bovis subsp bovis AF2122/97
augaccaccgguu

SEQ ID NO: 3177895 - RNA, 17 nt, Mycobacterium bovis subsp bovis AF2122/97
augaccagggucugcuc

SEQ ID NO: 3177896 - RNA, 20 nt, Mycobacterium bovis subsp bovis AF2122/97
augaccagggucugcucauc

SEQ ID NO: 3177897 - RNA, 19 nt, Mycobacterium bovis subsp bovis AF2122/97
augaccaugaugaccggca

SEQ ID NO: 3177898 - RNA, 14 nt, Mycobacterium bovis subsp bovis AF2122/97
augacccacacacc

SEQ ID NO: 3177899 - RNA, 19 nt, Mycobacterium bovis subsp bovis AF2122/97
augaccgaaccuggucuug

SEQ ID NO: 3177900 - RNA, 16 nt, Mycobacterium bovis subsp bovis AF2122/97
augaccgacaggugcu

SEQ ID NO: 3177901 - RNA, 14 nt, Mycobacterium bovis subsp bovis AF2122/97
augaccgccagcag

SEQ ID NO: 3177902 - RNA, 17 nt, Mycobacterium bovis subsp bovis AF2122/97
augaccgcguagagcag

SEQ ID NO: 3177903 - RNA, 14 nt, Mycobacterium bovis subsp bovis AF2122/97
augaccgggcuggc

SEQ ID NO: 3177904 - RNA, 23 nt, Mycobacterium bovis subsp bovis AF2122/97
augaccgguauuaccgccguggc

SEQ ID NO: 3177905 - RNA, 15 nt, Mycobacterium bovis subsp bovis AF2122/97
augaccucggcgacg

SEQ ID NO: 3177906 - RNA, 14 nt, Mycobacterium bovis subsp bovis AF2122/97
augaccucggcgau

SEQ ID NO: 3177907 - RNA, 15 nt, Mycobacterium bovis subsp bovis AF2122/97
augaccugauccggc

SEQ ID NO: 3177908 - RNA, 22 nt, Mycobacterium bovis subsp bovis AF2122/97
augaccuguagaucagcagcgg

SEQ ID NO: 3177909 - RNA, 18 nt, Mycobacterium bovis subsp bovis AF2122/97
augacgaaugcgggugga

SEQ ID NO: 3177910 - RNA, 18 nt, Mycobacterium bovis subsp bovis AF2122/97
augacgaccgaucggcgc

SEQ ID NO: 3177911 - RNA, 22 nt, Mycobacterium bovis subsp bovis AF2122/97
augacgaucggcggcgcgccga

SEQ ID NO: 3177912 - RNA, 20 nt, Mycobacterium bovis subsp bovis AF2122/97
augacgauggccgccgcgag

SEQ ID NO: 3177913 - RNA, 14 nt, Mycobacterium bovis subsp bovis AF2122/97
augacgcccagggc

SEQ ID NO: 3177914 - RNA, 16 nt, Mycobacterium bovis subsp bovis AF2122/97
augacgccgucagcgg

SEQ ID NO: 3177915 - RNA, 17 nt, Mycobacterium bovis subsp bovis AF2122/97
augacgccgucggcgcg

SEQ ID NO: 3177916 - RNA, 20 nt, Mycobacterium bovis subsp bovis AF2122/97
augacgccgucggcgcgcac

SEQ ID NO: 3177917 - RNA, 15 nt, Mycobacterium bovis subsp bovis AF2122/97
augacgguggugacg

SEQ ID NO: 3177918 - RNA, 22 nt, Mycobacterium bovis subsp bovis AF2122/97
augacgguguggaaaccgcgga

SEQ ID NO: 3177919 - RNA, 16 nt, Mycobacterium bovis subsp bovis AF2122/97
augacgguuugcagcg

SEQ ID NO: 3177920 - RNA, 22 nt, Mycobacterium bovis subsp bovis AF2122/97
augacguacggggucgccggca

SEQ ID NO: 3177921 - RNA, 12 nt, Mycobacterium bovis subsp bovis AF2122/97
augacgucggac

SEQ ID NO: 3177922 - RNA, 20 nt, Mycobacterium bovis subsp bovis AF2122/97
augacgugaguuucaccacu

SEQ ID NO: 3177923 - RNA, 16 nt, Mycobacterium bovis subsp bovis AF2122/97
augacguuuggauggc

SEQ ID NO: 3177924 - RNA, 19 nt, Mycobacterium bovis subsp bovis AF2122/97
augacucggccgcaccagc

SEQ ID NO: 3177925 - RNA, 16 nt, Mycobacterium bovis subsp bovis AF2122/97
augacuugcgacccgu

SEQ ID NO: 3177926 - RNA, 13 nt, Mycobacterium bovis subsp bovis AF2122/97
augacuugcgcgc

SEQ ID NO: 3177927 - RNA, 17 nt, Mycobacterium bovis subsp bovis AF2122/97
augagccgcagaugcac

SEQ ID NO: 3177928 - RNA, 21 nt, Mycobacterium bovis subsp bovis AF2122/97
augagccggucuugcaucgcc

SEQ ID NO: 3177929 - RNA, 18 nt, Mycobacterium bovis subsp bovis AF2122/97
augagcgccacgccgagg

SEQ ID NO: 3177930 - RNA, 21 nt, Mycobacterium bovis subsp bovis AF2122/97
augagcgcucgggcaaccgga

SEQ ID NO: 3177931 - RNA, 23 nt, Mycobacterium bovis subsp bovis AF2122/97
augagcgugccgcagcggcggca

SEQ ID NO: 3177932 - RNA, 12 nt, Mycobacterium bovis subsp bovis AF2122/97
augagcucggcc

SEQ ID NO: 3177933 - RNA, 17 nt, Mycobacterium bovis subsp bovis AF2122/97
augagggcuugugguga

SEQ ID NO: 3177934 - RNA, 19 nt, Mycobacterium bovis subsp bovis AF2122/97
augagguucaucgccggcg

SEQ ID NO: 3177935 - RNA, 15 nt, Mycobacterium bovis subsp bovis AF2122/97
augauaccugcccac

SEQ ID NO: 3177936 - RNA, 17 nt, Mycobacterium bovis subsp bovis AF2122/97
augaucagcgccguggc

SEQ ID NO: 3177937 - RNA, 22 nt, Mycobacterium bovis subsp bovis AF2122/97
augaucagggucagcgccgcgc

SEQ ID NO: 3177938 - RNA, 15 nt, Mycobacterium bovis subsp bovis AF2122/97
augaucaugaacgca

SEQ ID NO: 3177939 - RNA, 19 nt, Mycobacterium bovis subsp bovis AF2122/97
augaucccgccaccgaaca

SEQ ID NO: 3177940 - RNA, 19 nt, Mycobacterium bovis subsp bovis AF2122/97
augaucccgcugaccuggg

SEQ ID NO: 3177941 - RNA, 13 nt, Mycobacterium bovis subsp bovis AF2122/97
augauccgccggc

SEQ ID NO: 3177942 - RNA, 20 nt, Mycobacterium bovis subsp bovis AF2122/97
augaucgcgaacaucgccag

SEQ ID NO: 3177943 - RNA, 23 nt, Mycobacterium bovis subsp bovis AF2122/97
augaucgcgaacaucgccagcgc

SEQ ID NO: 3177944 - RNA, 16 nt, Mycobacterium bovis subsp bovis AF2122/97
augaucgcggcggcga

SEQ ID NO: 3177945 - RNA, 19 nt, Mycobacterium bovis subsp bovis AF2122/97
augaucugccaccgcgggc

SEQ ID NO: 3177946 - RNA, 14 nt, Mycobacterium bovis subsp bovis AF2122/97
augaucuggucccg

SEQ ID NO: 3177947 - RNA, 17 nt, Mycobacterium bovis subsp bovis AF2122/97
augaugaccacauuggu

SEQ ID NO: 3177948 - RNA, 19 nt, Mycobacterium bovis subsp bovis AF2122/97
augaugaccggcaauuccg

SEQ ID NO: 3177949 - RNA, 17 nt, Mycobacterium bovis subsp bovis AF2122/97
augaugccuaccgggcc

SEQ ID NO: 3177950 - RNA, 15 nt, Mycobacterium bovis subsp bovis AF2122/97
augaugcgcucggcc

SEQ ID NO: 3177951 - RNA, 14 nt, Mycobacterium bovis subsp bovis AF2122/97
augaugcugccggc

SEQ ID NO: 3177952 - RNA, 21 nt, Mycobacterium bovis subsp bovis AF2122/97
augauggccgcggcuccgagg

SEQ ID NO: 3177953 - RNA, 21 nt, Mycobacterium bovis subsp bovis AF2122/97
augauggccgucagccaggug

SEQ ID NO: 3177954 - RNA, 21 nt, Mycobacterium bovis subsp bovis AF2122/97
augauguagcggcguuccggg

SEQ ID NO: 3177955 - RNA, 13 nt, Mycobacterium bovis subsp bovis AF2122/97
augaugucggccg

SEQ ID NO: 3177956 - RNA, 20 nt, Mycobacterium bovis subsp bovis AF2122/97
augauguggugugccugcgu

SEQ ID NO: 3177957 - RNA, 23 nt, Mycobacterium bovis subsp bovis AF2122/97
augauguggugugccugcgucuc

SEQ ID NO: 3177958 - RNA, 18 nt, Mycobacterium bovis subsp bovis AF2122/97
augauucacgcucggcgu

SEQ ID NO: 3177959 - RNA, 15 nt, Mycobacterium bovis subsp bovis AF2122/97
augauucagccggcu

SEQ ID NO: 3177960 - RNA, 19 nt, Mycobacterium bovis subsp bovis AF2122/97
augauucggcacgccgggc

SEQ ID NO: 3177961 - RNA, 14 nt, Mycobacterium bovis subsp bovis AF2122/97
augauugccaggac

SEQ ID NO: 3177962 - RNA, 20 nt, Mycobacterium bovis subsp bovis AF2122/97
augauugccaggaccgcgcc

SEQ ID NO: 3177963 - RNA, 16 nt, Mycobacterium bovis subsp bovis AF2122/97
augcaacacaccgcgg

SEQ ID NO: 3177964 - RNA, 20 nt, Mycobacterium bovis subsp bovis AF2122/97
augcaacgcggcgaagugca

SEQ ID NO: 3177965 - RNA, 16 nt, Mycobacterium bovis subsp bovis AF2122/97
augcaacuccucgacc

SEQ ID NO: 3177966 - RNA, 19 nt, Mycobacterium bovis subsp bovis AF2122/97
augcaacuccucgaccgug

SEQ ID NO: 3177967 - RNA, 17 nt, Mycobacterium bovis subsp bovis AF2122/97
augcaagccgacaucgg

SEQ ID NO: 3177968 - RNA, 22 nt, Mycobacterium bovis subsp bovis AF2122/97
augcaagucaaacgccgucacg

SEQ ID NO: 3177969 - RNA, 12 nt, Mycobacterium bovis subsp bovis AF2122/97
augcaaucggau

SEQ ID NO: 3177970 - RNA, 10 nt, Mycobacterium bovis subsp bovis AF2122/97
augcaaugcu

SEQ ID NO: 3177971 - RNA, 19 nt, Mycobacterium bovis subsp bovis AF2122/97
augcacaaccgcugcugcu

SEQ ID NO: 3177972 - RNA, 15 nt, Mycobacterium bovis subsp bovis AF2122/97
augcacccgcaccgg

SEQ ID NO: 3177973 - RNA, 21 nt, Mycobacterium bovis subsp bovis AF2122/97
augcacgcccaggcgaccgcu

SEQ ID NO: 3177974 - RNA, 23 nt, Mycobacterium bovis subsp bovis AF2122/97
augcacgcccaggcgaccgcuga

SEQ ID NO: 3177975 - RNA, 20 nt, Mycobacterium bovis subsp bovis AF2122/97
augcacgucgagcaggcugg

SEQ ID NO: 3177976 - RNA, 20 nt, Mycobacterium bovis subsp bovis AF2122/97
augcagcgggucgccgggcc

SEQ ID NO: 3177977 - RNA, 23 nt, Mycobacterium bovis subsp bovis AF2122/97
augcagcgguccagacaucagug

SEQ ID NO: 3177978 - RNA, 18 nt, Mycobacterium bovis subsp bovis AF2122/97
augcauccagcugcugcc

SEQ ID NO: 3177979 - RNA, 13 nt, Mycobacterium bovis subsp bovis AF2122/97
augcaugccggcu

SEQ ID NO: 3177980 - RNA, 17 nt, Mycobacterium bovis subsp bovis AF2122/97
augcauggcuugcucug

SEQ ID NO: 3177981 - RNA, 22 nt, Mycobacterium bovis subsp bovis AF2122/97
augcaugucaaguucgccagca

SEQ ID NO: 3177982 - RNA, 13 nt, Mycobacterium bovis subsp bovis AF2122/97
augccaacgguag

SEQ ID NO: 3177983 - RNA, 20 nt, Mycobacterium bovis subsp bovis AF2122/97
augccaagcuccaaccaugc

SEQ ID NO: 3177984 - RNA, 12 nt, Mycobacterium bovis subsp bovis AF2122/97
augccacacacu

SEQ ID NO: 3177985 - RNA, 14 nt, Mycobacterium bovis subsp bovis AF2122/97
augccacacacugc

SEQ ID NO: 3177986 - RNA, 16 nt, Mycobacterium bovis subsp bovis AF2122/97
augccacagcggcgau

SEQ ID NO: 3177987 - RNA, 16 nt, Mycobacterium bovis subsp bovis AF2122/97
augccacccagaugca

SEQ ID NO: 3177988 - RNA, 20 nt, Mycobacterium bovis subsp bovis AF2122/97
augccacccagaugcagcgg

SEQ ID NO: 3177989 - RNA, 22 nt, Mycobacterium bovis subsp bovis AF2122/97
augccaccgcuugaccccuggc

SEQ ID NO: 3177990 - RNA, 16 nt, Mycobacterium bovis subsp bovis AF2122/97
augccagccacgaacu

SEQ ID NO: 3177991 - RNA, 20 nt, Mycobacterium bovis subsp bovis AF2122/97
augccagcuguugcggggug

SEQ ID NO: 3177992 - RNA, 20 nt, Mycobacterium bovis subsp bovis AF2122/97
augccaggacuggcaccgcc

SEQ ID NO: 3177993 - RNA, 14 nt, Mycobacterium bovis subsp bovis AF2122/97
augccagucgccga

SEQ ID NO: 3177994 - RNA, 15 nt, Mycobacterium bovis subsp bovis AF2122/97
augccagugacaacc

SEQ ID NO: 3177995 - RNA, 17 nt, Mycobacterium bovis subsp bovis AF2122/97
augccagugcaucgguc

SEQ ID NO: 3177996 - RNA, 21 nt, Mycobacterium bovis subsp bovis AF2122/97
augccauagaugcccgcgauc

SEQ ID NO: 3177997 - RNA, 21 nt, Mycobacterium bovis subsp bovis AF2122/97
augccauaggacaggaacggc

SEQ ID NO: 3177998 - RNA, 21 nt, Mycobacterium bovis subsp bovis AF2122/97
augccauaugggggaaagcuu

SEQ ID NO: 3177999 - RNA, 20 nt, Mycobacterium bovis subsp bovis AF2122/97
augccauguugaaaaggcgc

SEQ ID NO: 3178000 - RNA, 14 nt, Mycobacterium bovis subsp bovis AF2122/97
augcccacgcacag

SEQ ID NO: 3178001 - RNA, 22 nt, Mycobacterium bovis subsp bovis AF2122/97
augcccacgcugccgcaguuca

SEQ ID NO: 3178002 - RNA, 22 nt, Mycobacterium bovis subsp bovis AF2122/97
augcccagcgcacggaccaucg

SEQ ID NO: 3178003 - RNA, 16 nt, Mycobacterium bovis subsp bovis AF2122/97
augcccagcgccgaau

SEQ ID NO: 3178004 - RNA, 16 nt, Mycobacterium bovis subsp bovis AF2122/97
augcccauccggccgu

SEQ ID NO: 3178005 - RNA, 21 nt, Mycobacterium bovis subsp bovis AF2122/97
augcccauccggccgucgggc

SEQ ID NO: 3178006 - RNA, 20 nt, Mycobacterium bovis subsp bovis AF2122/97
augccccacggugcggugau

SEQ ID NO: 3178007 - RNA, 16 nt, Mycobacterium bovis subsp bovis AF2122/97
augcccgccguagacc

SEQ ID NO: 3178008 - RNA, 16 nt, Mycobacterium bovis subsp bovis AF2122/97
augcccggcaucgcga

SEQ ID NO: 3178009 - RNA, 20 nt, Mycobacterium bovis subsp bovis AF2122/97
augcccuccucgaccgcggc

SEQ ID NO: 3178010 - RNA, 21 nt, Mycobacterium bovis subsp bovis AF2122/97
augcccugcccgaagguggga

SEQ ID NO: 3178011 - RNA, 15 nt, Mycobacterium bovis subsp bovis AF2122/97
augcccugcgcucgg

SEQ ID NO: 3178012 - RNA, 21 nt, Mycobacterium bovis subsp bovis AF2122/97
augcgccauuucgagggcaac

SEQ ID NO: 3178013 - RNA, 11 nt, Mycobacterium bovis subsp bovis AF2122/97
augcgccgaaa

SEQ ID NO: 3178014 - RNA, 13 nt, Mycobacterium bovis subsp bovis AF2122/97
augcgccgcaugc

SEQ ID NO: 3178015 - RNA, 12 nt, Mycobacterium bovis subsp bovis AF2122/97
augcgccgccca

SEQ ID NO: 3178016 - RNA, 19 nt, Mycobacterium bovis subsp bovis AF2122/97
augcgcgucucgagcgcgc

SEQ ID NO: 3178017 - RNA, 14 nt, Mycobacterium bovis subsp bovis AF2122/97
augcgcuaggugcg

SEQ ID NO: 3178018 - RNA, 16 nt, Mycobacterium bovis subsp bovis AF2122/97
augcgcuaggugcgaa

SEQ ID NO: 3178019 - RNA, 13 nt, Mycobacterium bovis subsp bovis AF2122/97
augcgcugccgcc

SEQ ID NO: 3178020 - RNA, 16 nt, Mycobacterium bovis subsp bovis AF2122/97
augcgcugcucacgca

SEQ ID NO: 3178021 - RNA, 16 nt, Mycobacterium bovis subsp bovis AF2122/97
augcgcugggccaggg

SEQ ID NO: 3178022 - RNA, 18 nt, Mycobacterium bovis subsp bovis AF2122/97
augcgcuugaugccggcc

SEQ ID NO: 3178023 - RNA, 12 nt, Mycobacterium bovis subsp bovis AF2122/97
augcggaacgcc

SEQ ID NO: 3178024 - RNA, 19 nt, Mycobacterium bovis subsp bovis AF2122/97
augcggaacgccgagcacg

SEQ ID NO: 3178025 - RNA, 18 nt, Mycobacterium bovis subsp bovis AF2122/97
augcggaccacaccguca

SEQ ID NO: 3178026 - RNA, 20 nt, Mycobacterium bovis subsp bovis AF2122/97
augcggaucacaucggccau

SEQ ID NO: 3178027 - RNA, 19 nt, Mycobacterium bovis subsp bovis AF2122/97
augcggaugucgucgacca

SEQ ID NO: 3178028 - RNA, 22 nt, Mycobacterium bovis subsp bovis AF2122/97
augcggaugucgucgaccaggc

SEQ ID NO: 3178029 - RNA, 13 nt, Mycobacterium bovis subsp bovis AF2122/97
augcggcaggugc

SEQ ID NO: 3178030 - RNA, 12 nt, Mycobacterium bovis subsp bovis AF2122/97
augcggccaugg

SEQ ID NO: 3178031 - RNA, 16 nt, Mycobacterium bovis subsp bovis AF2122/97
augcggcccggguggc

SEQ ID NO: 3178032 - RNA, 23 nt, Mycobacterium bovis subsp bovis AF2122/97
augcggcccggguggcccggaac

SEQ ID NO: 3178033 - RNA, 13 nt, Mycobacterium bovis subsp bovis AF2122/97
augcggcccucga

SEQ ID NO: 3178034 - RNA, 23 nt, Mycobacterium bovis subsp bovis AF2122/97
augcggcccucgaauucggccgg

SEQ ID NO: 3178035 - RNA, 18 nt, Mycobacterium bovis subsp bovis AF2122/97
augcggcgcagcgacgcg

SEQ ID NO: 3178036 - RNA, 17 nt, Mycobacterium bovis subsp bovis AF2122/97
augcggcggcgcucguc

SEQ ID NO: 3178037 - RNA, 14 nt, Mycobacterium bovis subsp bovis AF2122/97
augcggcgucgaac

SEQ ID NO: 3178038 - RNA, 17 nt, Mycobacterium bovis subsp bovis AF2122/97
augcgggaaacccaugc

SEQ ID NO: 3178039 - RNA, 13 nt, Mycobacterium bovis subsp bovis AF2122/97
augcgggccauca

SEQ ID NO: 3178040 - RNA, 19 nt, Mycobacterium bovis subsp bovis AF2122/97
augcgggccaucaagcgau

SEQ ID NO: 3178041 - RNA, 18 nt, Mycobacterium bovis subsp bovis AF2122/97
augcgggccuccugcugg

SEQ ID NO: 3178042 - RNA, 15 nt, Mycobacterium bovis subsp bovis AF2122/97
augcgggcgccccac

SEQ ID NO: 3178043 - RNA, 19 nt, Mycobacterium bovis subsp bovis AF2122/97
augcgggcuuugccaacaa

SEQ ID NO: 3178044 - RNA, 20 nt, Mycobacterium bovis subsp bovis AF2122/97
augcggggcaauccccugga

SEQ ID NO: 3178045 - RNA, 19 nt, Mycobacterium bovis subsp bovis AF2122/97
augcggguaaaccaggugg

SEQ ID NO: 3178046 - RNA, 16 nt, Mycobacterium bovis subsp bovis AF2122/97
augcgggucucgaccu

SEQ ID NO: 3178047 - RNA, 19 nt, Mycobacterium bovis subsp bovis AF2122/97
augcgggucugcggucauc

SEQ ID NO: 3178048 - RNA, 21 nt, Mycobacterium bovis subsp bovis AF2122/97
augcgggucugcggucaucgc

SEQ ID NO: 3178049 - RNA, 16 nt, Mycobacterium bovis subsp bovis AF2122/97
augcggucccugauca

SEQ ID NO: 3178050 - RNA, 15 nt, Mycobacterium bovis subsp bovis AF2122/97
augcgguccucgauc

SEQ ID NO: 3178051 - RNA, 15 nt, Mycobacterium bovis subsp bovis AF2122/97
augcggucggccaca

SEQ ID NO: 3178052 - RNA, 22 nt, Mycobacterium bovis subsp bovis AF2122/97
augcggucgucacggaccgcca

SEQ ID NO: 3178053 - RNA, 23 nt, Mycobacterium bovis subsp bovis AF2122/97
augcggucgucacggaccgccac

SEQ ID NO: 3178054 - RNA, 14 nt, Mycobacterium bovis subsp bovis AF2122/97
augcggugacaacc

SEQ ID NO: 3178055 - RNA, 14 nt, Mycobacterium bovis subsp bovis AF2122/97
augcggugcccgcc

SEQ ID NO: 3178056 - RNA, 15 nt, Mycobacterium bovis subsp bovis AF2122/97
augcggugcccgccc

SEQ ID NO: 3178057 - RNA, 22 nt, Mycobacterium bovis subsp bovis AF2122/97
augcggugucgggcuggguggc

SEQ ID NO: 3178058 - RNA, 16 nt, Mycobacterium bovis subsp bovis AF2122/97
augcgguuagcagccg

SEQ ID NO: 3178059 - RNA, 18 nt, Mycobacterium bovis subsp bovis AF2122/97
augcgguuccgauagccg

SEQ ID NO: 3178060 - RNA, 16 nt, Mycobacterium bovis subsp bovis AF2122/97
augcgguucucgagcu

SEQ ID NO: 3178061 - RNA, 18 nt, Mycobacterium bovis subsp bovis AF2122/97
augcgguucucgagcucg

SEQ ID NO: 3178062 - RNA, 20 nt, Mycobacterium bovis subsp bovis AF2122/97
augcgguucucgagcucggc

SEQ ID NO: 3178063 - RNA, 15 nt, Mycobacterium bovis subsp bovis AF2122/97
augcguccgcccagc

SEQ ID NO: 3178064 - RNA, 14 nt, Mycobacterium bovis subsp bovis AF2122/97
augcgucugcucgc

SEQ ID NO: 3178065 - RNA, 19 nt, Mycobacterium bovis subsp bovis AF2122/97
augcgucugcucgccgggc

SEQ ID NO: 3178066 - RNA, 21 nt, Mycobacterium bovis subsp bovis AF2122/97
augcgugaccagucgcggcgu

SEQ ID NO: 3178067 - RNA, 17 nt, Mycobacterium bovis subsp bovis AF2122/97
augcgugcggcagugcc

SEQ ID NO: 3178068 - RNA, 14 nt, Mycobacterium bovis subsp bovis AF2122/97
augcguucggccgg

SEQ ID NO: 3178069 - RNA, 17 nt, Mycobacterium bovis subsp bovis AF2122/97
augcguucggccgggcc

SEQ ID NO: 3178070 - RNA, 18 nt, Mycobacterium bovis subsp bovis AF2122/97
augcguugacgucgagca

SEQ ID NO: 3178071 - RNA, 19 nt, Mycobacterium bovis subsp bovis AF2122/97
augcguuggggcacgacgc

SEQ ID NO: 3178072 - RNA, 21 nt, Mycobacterium bovis subsp bovis AF2122/97
augcuaggcaugccacacacu

SEQ ID NO: 3178073 - RNA, 13 nt, Mycobacterium bovis subsp bovis AF2122/97
augcucaccggga

SEQ ID NO: 3178074 - RNA, 15 nt, Mycobacterium bovis subsp bovis AF2122/97
augcucacgaucacc

SEQ ID NO: 3178075 - RNA, 17 nt, Mycobacterium bovis subsp bovis AF2122/97
augcucagcaucgucga

SEQ ID NO: 3178076 - RNA, 21 nt, Mycobacterium bovis subsp bovis AF2122/97
augcucgagugggugaggcca

SEQ ID NO: 3178077 - RNA, 21 nt, Mycobacterium bovis subsp bovis AF2122/97
augcucgauccacugccgcgc

SEQ ID NO: 3178078 - RNA, 14 nt, Mycobacterium bovis subsp bovis AF2122/97
augcucgaucgcgu

SEQ ID NO: 3178079 - RNA, 19 nt, Mycobacterium bovis subsp bovis AF2122/97
augcucgaugcgacgaacc

SEQ ID NO: 3178080 - RNA, 15 nt, Mycobacterium bovis subsp bovis AF2122/97
augcucgcuggcgcu

SEQ ID NO: 3178081 - RNA, 22 nt, Mycobacterium bovis subsp bovis AF2122/97
augcucgucuugggccgggaug

SEQ ID NO: 3178082 - RNA, 24 nt, Mycobacterium bovis subsp bovis AF2122/97
augcucugggauuugggcugcgga

SEQ ID NO: 3178083 - RNA, 14 nt, Mycobacterium bovis subsp bovis AF2122/97
augcucuugaugcc

SEQ ID NO: 3178084 - RNA, 16 nt, Mycobacterium bovis subsp bovis AF2122/97
augcugaacacgcagc

SEQ ID NO: 3178085 - RNA, 22 nt, Mycobacterium bovis subsp bovis AF2122/97
augcugacgaacaugccauggc

SEQ ID NO: 3178086 - RNA, 20 nt, Mycobacterium bovis subsp bovis AF2122/97
augcugacgguggggauggc

SEQ ID NO: 3178087 - RNA, 15 nt, Mycobacterium bovis subsp bovis AF2122/97
augcugagccgguca

SEQ ID NO: 3178088 - RNA, 17 nt, Mycobacterium bovis subsp bovis AF2122/97
augcugagcgccaggcc

SEQ ID NO: 3178089 - RNA, 22 nt, Mycobacterium bovis subsp bovis AF2122/97
augcugccagaucggucggcca

SEQ ID NO: 3178090 - RNA, 13 nt, Mycobacterium bovis subsp bovis AF2122/97
augcugccagcca

SEQ ID NO: 3178091 - RNA, 18 nt, Mycobacterium bovis subsp bovis AF2122/97
augcugccagccauggcc

SEQ ID NO: 3178092 - RNA, 13 nt, Mycobacterium bovis subsp bovis AF2122/97
augcugccgccgc

SEQ ID NO: 3178093 - RNA, 16 nt, Mycobacterium bovis subsp bovis AF2122/97
augcugccgccgccgc

SEQ ID NO: 3178094 - RNA, 22 nt, Mycobacterium bovis subsp bovis AF2122/97
augcugccgccgccgccggcgc

SEQ ID NO: 3178095 - RNA, 24 nt, Mycobacterium bovis subsp bovis AF2122/97
augcugccggcaccaaccaccgac

SEQ ID NO: 3178096 - RNA, 23 nt, Mycobacterium bovis subsp bovis AF2122/97
augcuggagaaaccacuggaugg

SEQ ID NO: 3178097 - RNA, 19 nt, Mycobacterium bovis subsp bovis AF2122/97
augcuggcaaaguaucgca

SEQ ID NO: 3178098 - RNA, 20 nt, Mycobacterium bovis subsp bovis AF2122/97
augcuggcaaaguaucgcag

SEQ ID NO: 3178099 - RNA, 19 nt, Mycobacterium bovis subsp bovis AF2122/97
cacgauuucgagcgcugcu

SEQ ID NO: 3178100 - RNA, 20 nt, Mycobacterium bovis subsp bovis AF2122/97
cacgauuucgagcgcugcuc

SEQ ID NO: 3178101 - RNA, 18 nt, Mycobacterium bovis subsp bovis AF2122/97
cacgcaaaguucgucacc

SEQ ID NO: 3178102 - RNA, 14 nt, Mycobacterium bovis subsp bovis AF2122/97
cacgcaacaccgcc

SEQ ID NO: 3178103 - RNA, 15 nt, Mycobacterium bovis subsp bovis AF2122/97
cacgcaacaccgcca

SEQ ID NO: 3178104 - RNA, 18 nt, Mycobacterium bovis subsp bovis AF2122/97
cacgcaacaccgccaacu

SEQ ID NO: 3178105 - RNA, 20 nt, Mycobacterium bovis subsp bovis AF2122/97
cacgcaagcaaauucuggug

SEQ ID NO: 3178106 - RNA, 14 nt, Mycobacterium bovis subsp bovis AF2122/97
cacgcaauucaaau

SEQ ID NO: 3178107 - RNA, 22 nt, Mycobacterium bovis subsp bovis AF2122/97
cacgcaauucaaaugaaccgca

SEQ ID NO: 3178108 - RNA, 23 nt, Mycobacterium bovis subsp bovis AF2122/97
cacgcaauuggccguuggcggcg

SEQ ID NO: 3178109 - RNA, 14 nt, Mycobacterium bovis subsp bovis AF2122/97
cacgcaccacaaac

SEQ ID NO: 3178110 - RNA, 15 nt, Mycobacterium bovis subsp bovis AF2122/97
cacgcaccacaaaca

SEQ ID NO: 3178111 - RNA, 17 nt, Mycobacterium bovis subsp bovis AF2122/97
cacgcaccacaaacacc

SEQ ID NO: 3178112 - RNA, 15 nt, Mycobacterium bovis subsp bovis AF2122/97
cacgcaccacgagca

SEQ ID NO: 3178113 - RNA, 12 nt, Mycobacterium bovis subsp bovis AF2122/97
cacgcacccggc

SEQ ID NO: 3178114 - RNA, 13 nt, Mycobacterium bovis subsp bovis AF2122/97
cacgcacccggcg

SEQ ID NO: 3178115 - RNA, 15 nt, Mycobacterium bovis subsp bovis AF2122/97
cacgcacccggcgca

SEQ ID NO: 3178116 - RNA, 22 nt, Mycobacterium bovis subsp bovis AF2122/97
cacgcacccggcgcaacaaccg

SEQ ID NO: 3178117 - RNA, 14 nt, Mycobacterium bovis subsp bovis AF2122/97
cacgcaccgccccg

SEQ ID NO: 3178118 - RNA, 15 nt, Mycobacterium bovis subsp bovis AF2122/97
cacgcaccgccccgc

SEQ ID NO: 3178119 - RNA, 14 nt, Mycobacterium bovis subsp bovis AF2122/97
cacgcaccgcggug

SEQ ID NO: 3178120 - RNA, 14 nt, Mycobacterium bovis subsp bovis AF2122/97
cacgcacgcgguuc

SEQ ID NO: 3178121 - RNA, 20 nt, Mycobacterium bovis subsp bovis AF2122/97
cacgcacgcgguucaccacg

SEQ ID NO: 3178122 - RNA, 20 nt, Mycobacterium bovis subsp bovis AF2122/97
cacgcacguagacgguguca

SEQ ID NO: 3178123 - RNA, 20 nt, Mycobacterium bovis subsp bovis AF2122/97
cacgcacucccgagccacaa

SEQ ID NO: 3178124 - RNA, 13 nt, Mycobacterium bovis subsp bovis AF2122/97
cacgcacucgucg

SEQ ID NO: 3178125 - RNA, 14 nt, Mycobacterium bovis subsp bovis AF2122/97
cacgcacucgucgg

SEQ ID NO: 3178126 - RNA, 19 nt, Mycobacterium bovis subsp bovis AF2122/97
cacgcacucgucgggguug

SEQ ID NO: 3178127 - RNA, 22 nt, Mycobacterium bovis subsp bovis AF2122/97
cacgcacugaugucacccgccc

SEQ ID NO: 3178128 - RNA, 12 nt, Mycobacterium bovis subsp bovis AF2122/97
cacgcagagcca

SEQ ID NO: 3178129 - RNA, 19 nt, Mycobacterium bovis subsp bovis AF2122/97
cacgcagccccucgucguc

SEQ ID NO: 3178130 - RNA, 17 nt, Mycobacterium bovis subsp bovis AF2122/97
cacgcagcccgucggcg

SEQ ID NO: 3178131 - RNA, 21 nt, Mycobacterium bovis subsp bovis AF2122/97
cacgcagcccgucggcgccga

SEQ ID NO: 3178132 - RNA, 22 nt, Mycobacterium bovis subsp bovis AF2122/97
cacgcagccgauacaggccacg

SEQ ID NO: 3178133 - RNA, 13 nt, Mycobacterium bovis subsp bovis AF2122/97
cacgcagccgcgc

SEQ ID NO: 3178134 - RNA, 17 nt, Mycobacterium bovis subsp bovis AF2122/97
cacgcaggaaaaccccg

SEQ ID NO: 3178135 - RNA, 22 nt, Mycobacterium bovis subsp bovis AF2122/97
cacgcaggaaaaccccggccac

SEQ ID NO: 3178136 - RNA, 18 nt, Mycobacterium bovis subsp bovis AF2122/97
cacgcaguucggucagcg

SEQ ID NO: 3178137 - RNA, 22 nt, Mycobacterium bovis subsp bovis AF2122/97
cacgcaugcgcgcgccggugcu

SEQ ID NO: 3178138 - RNA, 21 nt, Mycobacterium bovis subsp bovis AF2122/97
cacgccaaguccgcucaccuu

SEQ ID NO: 3178139 - RNA, 21 nt, Mycobacterium bovis subsp bovis AF2122/97
cacgccacauguugucgacgg

SEQ ID NO: 3178140 - RNA, 13 nt, Mycobacterium bovis subsp bovis AF2122/97
cacgccaccgcaa

SEQ ID NO: 3178141 - RNA, 14 nt, Mycobacterium bovis subsp bovis AF2122/97
cacgccaccgcaac

SEQ ID NO: 3178142 - RNA, 19 nt, Mycobacterium bovis subsp bovis AF2122/97
cacgccaccgcaacucgcc

SEQ ID NO: 3178143 - RNA, 13 nt, Mycobacterium bovis subsp bovis AF2122/97
cacgccaccgcgg

SEQ ID NO: 3178144 - RNA, 21 nt, Mycobacterium bovis subsp bovis AF2122/97
cacgccacguccaacucggcc

SEQ ID NO: 3178145 - RNA, 22 nt, Mycobacterium bovis subsp bovis AF2122/97
cacgccacuggacucuucagcu

SEQ ID NO: 3178146 - RNA, 13 nt, Mycobacterium bovis subsp bovis AF2122/97
cacgccagccggu

SEQ ID NO: 3178147 - RNA, 16 nt, Mycobacterium bovis subsp bovis AF2122/97
cacgccagcgcgacca

SEQ ID NO: 3178148 - RNA, 15 nt, Mycobacterium bovis subsp bovis AF2122/97
cacgccagcucgccg

SEQ ID NO: 3178149 - RNA, 22 nt, Mycobacterium bovis subsp bovis AF2122/97
cacgccagucccacugggccgg

SEQ ID NO: 3178150 - RNA, 18 nt, Mycobacterium bovis subsp bovis AF2122/97
cacgccauaccggcuggc

SEQ ID NO: 3178151 - RNA, 21 nt, Mycobacterium bovis subsp bovis AF2122/97
cacgcccaauguccaggcgcg

SEQ ID NO: 3178152 - RNA, 18 nt, Mycobacterium bovis subsp bovis AF2122/97
cacgcccacagcugacga

SEQ ID NO: 3178153 - RNA, 22 nt, Mycobacterium bovis subsp bovis AF2122/97
cacgcccacagcugacgagccg

SEQ ID NO: 3178154 - RNA, 20 nt, Mycobacterium bovis subsp bovis AF2122/97
cacgcccacaggggcagcgc

SEQ ID NO: 3178155 - RNA, 11 nt, Mycobacterium bovis subsp bovis AF2122/97
cacgcccaggc

SEQ ID NO: 3178156 - RNA, 14 nt, Mycobacterium bovis subsp bovis AF2122/97
cacgcccaggcaag

SEQ ID NO: 3178157 - RNA, 17 nt, Mycobacterium bovis subsp bovis AF2122/97
cacgcccaugaccggcc

SEQ ID NO: 3178158 - RNA, 19 nt, Mycobacterium bovis subsp bovis AF2122/97
cacgcccaugaccggccgc

SEQ ID NO: 3178159 - RNA, 20 nt, Mycobacterium bovis subsp bovis AF2122/97
cacgcccaugaccggccgcc

SEQ ID NO: 3178160 - RNA, 22 nt, Mycobacterium bovis subsp bovis AF2122/97
cacgccccgaucggugacgcgc

SEQ ID NO: 3178161 - RNA, 21 nt, Mycobacterium bovis subsp bovis AF2122/97
cacgcccgaagaaugggaugg

SEQ ID NO: 3178162 - RNA, 13 nt, Mycobacterium bovis subsp bovis AF2122/97
cacgcccgacgag

SEQ ID NO: 3178163 - RNA, 13 nt, Mycobacterium bovis subsp bovis AF2122/97
cacgcccgcacuc

SEQ ID NO: 3178164 - RNA, 13 nt, Mycobacterium bovis subsp bovis AF2122/97
cacgcccgcgagc

SEQ ID NO: 3178165 - RNA, 14 nt, Mycobacterium bovis subsp bovis AF2122/97
cacgcccgcgagcu

SEQ ID NO: 3178166 - RNA, 11 nt, Mycobacterium bovis subsp bovis AF2122/97
cacgcccggcc

SEQ ID NO: 3178167 - RNA, 23 nt, Mycobacterium bovis subsp bovis AF2122/97
cacgcccggccccgcggccagca

SEQ ID NO: 3178168 - RNA, 14 nt, Mycobacterium bovis subsp bovis AF2122/97
cacgcccggcgugg

SEQ ID NO: 3178169 - RNA, 18 nt, Mycobacterium bovis subsp bovis AF2122/97
cacgcccuaacccugccc

SEQ ID NO: 3178170 - RNA, 19 nt, Mycobacterium bovis subsp bovis AF2122/97
cacgcccucgacgcgcucg

SEQ ID NO: 3178171 - RNA, 22 nt, Mycobacterium bovis subsp bovis AF2122/97
cacgcccucgucgaucgccgcg

SEQ ID NO: 3178172 - RNA, 22 nt, Mycobacterium bovis subsp bovis AF2122/97
cacgcccuguucuccgugaucg

SEQ ID NO: 3178173 - RNA, 19 nt, Mycobacterium bovis subsp bovis AF2122/97
cacgccgaacgugcggugg

SEQ ID NO: 3178174 - RNA, 19 nt, Mycobacterium bovis subsp bovis AF2122/97
cacgccgaccagcacccgc

SEQ ID NO: 3178175 - RNA, 20 nt, Mycobacterium bovis subsp bovis AF2122/97
cacgccgaccaucucaccgg

SEQ ID NO: 3178176 - RNA, 22 nt, Mycobacterium bovis subsp bovis AF2122/97
cacgccgaccaucucaccgggc

SEQ ID NO: 3178177 - RNA, 14 nt, Mycobacterium bovis subsp bovis AF2122/97
cacgccgaccggcc

SEQ ID NO: 3178178 - RNA, 15 nt, Mycobacterium bovis subsp bovis AF2122/97
cacgccgaucaacau

SEQ ID NO: 3178179 - RNA, 20 nt, Mycobacterium bovis subsp bovis AF2122/97
cacgccgaugauggacacca

SEQ ID NO: 3178180 - RNA, 22 nt, Mycobacterium bovis subsp bovis AF2122/97
cacgccgaugauggacaccagc

SEQ ID NO: 3178181 - RNA, 22 nt, Mycobacterium bovis subsp bovis AF2122/97
cacgccgaugcggugcggauca

SEQ ID NO: 3178182 - RNA, 15 nt, Mycobacterium bovis subsp bovis AF2122/97
cacgccgauucgccg

SEQ ID NO: 3178183 - RNA, 17 nt, Mycobacterium bovis subsp bovis AF2122/97
cacgccgauucgccguc

SEQ ID NO: 3178184 - RNA, 18 nt, Mycobacterium bovis subsp bovis AF2122/97
cacgccgauucgccgucg

SEQ ID NO: 3178185 - RNA, 19 nt, Mycobacterium bovis subsp bovis AF2122/97
cacgccgccccugcgcggc

SEQ ID NO: 3178186 - RNA, 21 nt, Mycobacterium bovis subsp bovis AF2122/97
cacgccgccccugcgcggcca

SEQ ID NO: 3178187 - RNA, 13 nt, Mycobacterium bovis subsp bovis AF2122/97
cacgccgccgacg

SEQ ID NO: 3178188 - RNA, 14 nt, Mycobacterium bovis subsp bovis AF2122/97
cacgccgccgacgu

SEQ ID NO: 3178189 - RNA, 15 nt, Mycobacterium bovis subsp bovis AF2122/97
cacgccgccgacgug

SEQ ID NO: 3178190 - RNA, 21 nt, Mycobacterium bovis subsp bovis AF2122/97
cacgccgccgacgugaggguc

SEQ ID NO: 3178191 - RNA, 17 nt, Mycobacterium bovis subsp bovis AF2122/97
cacgccgccggccgcca

SEQ ID NO: 3178192 - RNA, 20 nt, Mycobacterium bovis subsp bovis AF2122/97
cacgccgccggccgccagcg

SEQ ID NO: 3178193 - RNA, 13 nt, Mycobacterium bovis subsp bovis AF2122/97
cacgccgccggcg

SEQ ID NO: 3178194 - RNA, 21 nt, Mycobacterium bovis subsp bovis AF2122/97
cacgccgccggcgcugaucgc

SEQ ID NO: 3178195 - RNA, 22 nt, Mycobacterium bovis subsp bovis AF2122/97
cacgccgccggcgcugaucgcg

SEQ ID NO: 3178196 - RNA, 18 nt, Mycobacterium bovis subsp bovis AF2122/97
cacgccgccggugaacgu

SEQ ID NO: 3178197 - RNA, 20 nt, Mycobacterium bovis subsp bovis AF2122/97
cacgccgccggugucgggcu

SEQ ID NO: 3178198 - RNA, 20 nt, Mycobacterium bovis subsp bovis AF2122/97
cacgccggauggucggccac

SEQ ID NO: 3178199 - RNA, 13 nt, Mycobacterium bovis subsp bovis AF2122/97
cacgccggcaucg

SEQ ID NO: 3178200 - RNA, 14 nt, Mycobacterium bovis subsp bovis AF2122/97
cacgccggcaucgu

SEQ ID NO: 3178201 - RNA, 20 nt, Mycobacterium bovis subsp bovis AF2122/97
cacgccggcaucgucgacgc

SEQ ID NO: 3178202 - RNA, 15 nt, Mycobacterium bovis subsp bovis AF2122/97
cacgccggcaugcca

SEQ ID NO: 3178203 - RNA, 21 nt, Mycobacterium bovis subsp bovis AF2122/97
cacgccggcaugccagccacg

SEQ ID NO: 3178204 - RNA, 14 nt, Mycobacterium bovis subsp bovis AF2122/97
cacgccggccagcg

SEQ ID NO: 3178205 - RNA, 12 nt, Mycobacterium bovis subsp bovis AF2122/97
cacgccggcccg

SEQ ID NO: 3178206 - RNA, 17 nt, Mycobacterium bovis subsp bovis AF2122/97
cacgccggccucgccga

SEQ ID NO: 3178207 - RNA, 21 nt, Mycobacterium bovis subsp bovis AF2122/97
cacgccggccucgccgaagcg

SEQ ID NO: 3178208 - RNA, 19 nt, Mycobacterium bovis subsp bovis AF2122/97
cacgccggcgcuggagacg

SEQ ID NO: 3178209 - RNA, 14 nt, Mycobacterium bovis subsp bovis AF2122/97
cacgccggcggcgg

SEQ ID NO: 3178210 - RNA, 15 nt, Mycobacterium bovis subsp bovis AF2122/97
cacgccgggcaaggc

SEQ ID NO: 3178211 - RNA, 17 nt, Mycobacterium bovis subsp bovis AF2122/97
cacgccgggcaucggcg

SEQ ID NO: 3178212 - RNA, 22 nt, Mycobacterium bovis subsp bovis AF2122/97
cacgccgggcgaguacaggcgc

SEQ ID NO: 3178213 - RNA, 20 nt, Mycobacterium bovis subsp bovis AF2122/97
cacgccgggugccgccacgu

SEQ ID NO: 3178214 - RNA, 21 nt, Mycobacterium bovis subsp bovis AF2122/97
cacgccggguguggcuugacg

SEQ ID NO: 3178215 - RNA, 14 nt, Mycobacterium bovis subsp bovis AF2122/97
cacgccggugacgg

SEQ ID NO: 3178216 - RNA, 23 nt, Mycobacterium bovis subsp bovis AF2122/97
cacgccggugacgggguugaccg

SEQ ID NO: 3178217 - RNA, 16 nt, Mycobacterium bovis subsp bovis AF2122/97
cacgccguagcgcagc

SEQ ID NO: 3178218 - RNA, 22 nt, Mycobacterium bovis subsp bovis AF2122/97
cacgccguagcgcagcgccucc

SEQ ID NO: 3178219 - RNA, 23 nt, Mycobacterium bovis subsp bovis AF2122/97
cacgccguagcgcagcgccuccu

SEQ ID NO: 3178220 - RNA, 13 nt, Mycobacterium bovis subsp bovis AF2122/97
cacgccgugcgug

SEQ ID NO: 3178221 - RNA, 19 nt, Mycobacterium bovis subsp bovis AF2122/97
cacgccguggcccgcuccc

SEQ ID NO: 3178222 - RNA, 15 nt, Mycobacterium bovis subsp bovis AF2122/97
cacgccucgccgaag

SEQ ID NO: 3178223 - RNA, 19 nt, Mycobacterium bovis subsp bovis AF2122/97
cacgccugaacgacccgcu

SEQ ID NO: 3178224 - RNA, 21 nt, Mycobacterium bovis subsp bovis AF2122/97
cacgccugaacgacccgcugg

SEQ ID NO: 3178225 - RNA, 15 nt, Mycobacterium bovis subsp bovis AF2122/97
cacgccugagccacc

SEQ ID NO: 3178226 - RNA, 22 nt, Mycobacterium bovis subsp bovis AF2122/97
cacgccugagccaccaacaccg

SEQ ID NO: 3178227 - RNA, 17 nt, Mycobacterium bovis subsp bovis AF2122/97
cacgccugccaccggcg

SEQ ID NO: 3178228 - RNA, 21 nt, Mycobacterium bovis subsp bovis AF2122/97
cacgccugccaugggcaaugg

SEQ ID NO: 3178229 - RNA, 19 nt, Mycobacterium bovis subsp bovis AF2122/97
cacgccugcucggagagca

SEQ ID NO: 3178230 - RNA, 14 nt, Mycobacterium bovis subsp bovis AF2122/97
cacgccuggcuacg

SEQ ID NO: 3178231 - RNA, 21 nt, Mycobacterium bovis subsp bovis AF2122/97
cacgccuggcuacgcgcgccc

SEQ ID NO: 3178232 - RNA, 14 nt, Mycobacterium bovis subsp bovis AF2122/97
cacgccugggcgac

SEQ ID NO: 3178233 - RNA, 18 nt, Mycobacterium bovis subsp bovis AF2122/97
cacgccugggcgacgacg

SEQ ID NO: 3178234 - RNA, 17 nt, Mycobacterium bovis subsp bovis AF2122/97
cacgccuugagccgagg

SEQ ID NO: 3178235 - RNA, 23 nt, Mycobacterium bovis subsp bovis AF2122/97
cacgcgaaaugccugcgcgaugc

SEQ ID NO: 3178236 - RNA, 18 nt, Mycobacterium bovis subsp bovis AF2122/97
cacgcgacuugcaccccg

SEQ ID NO: 3178237 - RNA, 19 nt, Mycobacterium bovis subsp bovis AF2122/97
cacgcgacuugcaccccgu

SEQ ID NO: 3178238 - RNA, 21 nt, Mycobacterium bovis subsp bovis AF2122/97
cacgcgcaacucgccacgguc

SEQ ID NO: 3178239 - RNA, 16 nt, Mycobacterium bovis subsp bovis AF2122/97
cacgcgcacucgacgc

SEQ ID NO: 3178240 - RNA, 17 nt, Mycobacterium bovis subsp bovis AF2122/97
cacgcgcccgcaccacc

SEQ ID NO: 3178241 - RNA, 16 nt, Mycobacterium bovis subsp bovis AF2122/97
cacgcgcgcaggccgc

SEQ ID NO: 3178242 - RNA, 17 nt, Mycobacterium bovis subsp bovis AF2122/97
cacgcgcgcaggccgcc

SEQ ID NO: 3178243 - RNA, 19 nt, Mycobacterium bovis subsp bovis AF2122/97
cacgcgcgcaggccgccgc

SEQ ID NO: 3178244 - RNA, 14 nt, Mycobacterium bovis subsp bovis AF2122/97
cacgcgcgcgaccu

SEQ ID NO: 3178245 - RNA, 23 nt, Mycobacterium bovis subsp bovis AF2122/97
cacgcgcgcgaccucgcuggccg

SEQ ID NO: 3178246 - RNA, 13 nt, Mycobacterium bovis subsp bovis AF2122/97
cacgcgcggaucg

SEQ ID NO: 3178247 - RNA, 16 nt, Mycobacterium bovis subsp bovis AF2122/97
cacgcgcggaucggcg

SEQ ID NO: 3178248 - RNA, 17 nt, Mycobacterium bovis subsp bovis AF2122/97
cacgcgcggcgucgugg

SEQ ID NO: 3178249 - RNA, 12 nt, Mycobacterium bovis subsp bovis AF2122/97
cacgcgcgucgg

SEQ ID NO: 3178250 - RNA, 18 nt, Mycobacterium bovis subsp bovis AF2122/97
cacgcgcucaccgacgcu

SEQ ID NO: 3178251 - RNA, 19 nt, Mycobacterium bovis subsp bovis AF2122/97
cacgcgcucaccgacgcug

SEQ ID NO: 3178252 - RNA, 17 nt, Mycobacterium bovis subsp bovis AF2122/97
cacgcgcucgcgcaagc

SEQ ID NO: 3178253 - RNA, 18 nt, Mycobacterium bovis subsp bovis AF2122/97
cacgcgcucggugccgcc

SEQ ID NO: 3178254 - RNA, 22 nt, Mycobacterium bovis subsp bovis AF2122/97
cacgcggaaaccaucgccagcc

SEQ ID NO: 3178255 - RNA, 17 nt, Mycobacterium bovis subsp bovis AF2122/97
cacgcggaccucgaagc

SEQ ID NO: 3178256 - RNA, 12 nt, Mycobacterium bovis subsp bovis AF2122/97
cacgcggcgaug

SEQ ID NO: 3178257 - RNA, 13 nt, Mycobacterium bovis subsp bovis AF2122/97
cacgcggcggucg

SEQ ID NO: 3178258 - RNA, 16 nt, Mycobacterium bovis subsp bovis AF2122/97
cacgcggcggucguug

SEQ ID NO: 3178259 - RNA, 23 nt, Mycobacterium bovis subsp bovis AF2122/97
cacgcggcggucguugccgaccg

SEQ ID NO: 3178260 - RNA, 14 nt, Mycobacterium bovis subsp bovis AF2122/97
cacgcgggaagugc

SEQ ID NO: 3178261 - RNA, 20 nt, Mycobacterium bovis subsp bovis AF2122/97
cacgcgggagguacccccag

SEQ ID NO: 3178262 - RNA, 20 nt, Mycobacterium bovis subsp bovis AF2122/97
cacgcgggcacugguggcga

SEQ ID NO: 3178263 - RNA, 14 nt, Mycobacterium bovis subsp bovis AF2122/97
cacgcgggugccga

SEQ ID NO: 3178264 - RNA, 13 nt, Mycobacterium bovis subsp bovis AF2122/97
cacgcggucccac

SEQ ID NO: 3178265 - RNA, 14 nt, Mycobacterium bovis subsp bovis AF2122/97
cacgcguagcgguc

SEQ ID NO: 3178266 - RNA, 23 nt, Mycobacterium bovis subsp bovis AF2122/97
cacgcgucuggaacgugaugcgg

SEQ ID NO: 3178267 - RNA, 19 nt, Mycobacterium bovis subsp bovis AF2122/97
cacgcgucuucggucgcgg

SEQ ID NO: 3178268 - RNA, 23 nt, Mycobacterium bovis subsp bovis AF2122/97
cacgcgucuucggucgcggccuc

SEQ ID NO: 3178269 - RNA, 13 nt, Mycobacterium bovis subsp bovis AF2122/97
cacgcgugcacca

SEQ ID NO: 3178270 - RNA, 13 nt, Mycobacterium bovis subsp bovis AF2122/97
cacgcgugccgca

SEQ ID NO: 3178271 - RNA, 18 nt, Mycobacterium bovis subsp bovis AF2122/97
cacgcgugcuuagcgcga

SEQ ID NO: 3178272 - RNA, 17 nt, Mycobacterium bovis subsp bovis AF2122/97
cacgcguuccuccagca

SEQ ID NO: 3178273 - RNA, 15 nt, Mycobacterium bovis subsp bovis AF2122/97
cacgcguugacgauc

SEQ ID NO: 3178274 - RNA, 15 nt, Mycobacterium bovis subsp bovis AF2122/97
cacgcuagccgacag

SEQ ID NO: 3178275 - RNA, 15 nt, Mycobacterium bovis subsp bovis AF2122/97
cacgcucacccggcg

SEQ ID NO: 3178276 - RNA, 14 nt, Mycobacterium bovis subsp bovis AF2122/97
cacgcucacgggcu

SEQ ID NO: 3178277 - RNA, 23 nt, Mycobacterium bovis subsp bovis AF2122/97
cacgcuccagcucggccagugcc

SEQ ID NO: 3178278 - RNA, 13 nt, Mycobacterium bovis subsp bovis AF2122/97
cacgcucggcgcc

SEQ ID NO: 3178279 - RNA, 14 nt, Mycobacterium bovis subsp bovis AF2122/97
cacgcucggcgccg

SEQ ID NO: 3178280 - RNA, 15 nt, Mycobacterium bovis subsp bovis AF2122/97
cacgcucggcgccgu

SEQ ID NO: 3178281 - RNA, 22 nt, Mycobacterium bovis subsp bovis AF2122/97
cacgcucggcggggaccgcggu

SEQ ID NO: 3178282 - RNA, 18 nt, Mycobacterium bovis subsp bovis AF2122/97
cacgcucggcguccgccc

SEQ ID NO: 3178283 - RNA, 19 nt, Mycobacterium bovis subsp bovis AF2122/97
cacgcucgugacgaucagc

SEQ ID NO: 3178284 - RNA, 20 nt, Mycobacterium bovis subsp bovis AF2122/97
cacgcucgugacgaucagcg

SEQ ID NO: 3178285 - RNA, 20 nt, Mycobacterium bovis subsp bovis AF2122/97
cacgcucguuugcgagcagg

SEQ ID NO: 3178286 - RNA, 22 nt, Mycobacterium bovis subsp bovis AF2122/97
cacgcucguuugcgagcagggg

SEQ ID NO: 3178287 - RNA, 19 nt, Mycobacterium bovis subsp bovis AF2122/97
cacgcucugcgccacagca

SEQ ID NO: 3178288 - RNA, 20 nt, Mycobacterium bovis subsp bovis AF2122/97
cacgcugaauuccacugcgc

SEQ ID NO: 3178289 - RNA, 22 nt, Mycobacterium bovis subsp bovis AF2122/97
cacgcugaauuccacugcgcca

SEQ ID NO: 3178290 - RNA, 22 nt, Mycobacterium bovis subsp bovis AF2122/97
cacgcugaccggaucugacggc

SEQ ID NO: 3178291 - RNA, 18 nt, Mycobacterium bovis subsp bovis AF2122/97
cacgcugagcguccgaca

SEQ ID NO: 3178292 - RNA, 20 nt, Mycobacterium bovis subsp bovis AF2122/97
cacgcugaguccccaggugg

SEQ ID NO: 3178293 - RNA, 15 nt, Mycobacterium bovis subsp bovis AF2122/97
cacgcugcaggcggc

SEQ ID NO: 3178294 - RNA, 17 nt, Mycobacterium bovis subsp bovis AF2122/97
cacgcugcaggcggccg

SEQ ID NO: 3178295 - RNA, 13 nt, Mycobacterium bovis subsp bovis AF2122/97
cacgcugcccacg

SEQ ID NO: 3178296 - RNA, 23 nt, Mycobacterium bovis subsp bovis AF2122/97
cacgcugcccacgggccggccga

SEQ ID NO: 3178297 - RNA, 15 nt, Mycobacterium bovis subsp bovis AF2122/97
cacgcugccccgccg

SEQ ID NO: 3178298 - RNA, 19 nt, Mycobacterium bovis subsp bovis AF2122/97
cacgcuggaacuuggcguc

SEQ ID NO: 3178299 - RNA, 21 nt, Mycobacterium bovis subsp bovis AF2122/97
cacgcuggaacuuggcgucga

SEQ ID NO: 3178300 - RNA, 20 nt, Mycobacterium bovis subsp bovis AF2122/97
cacgcuggccuccagcuugg

SEQ ID NO: 3178301 - RNA, 14 nt, Mycobacterium bovis subsp bovis AF2122/97
cacgcuggccucgu

SEQ ID NO: 3178302 - RNA, 18 nt, Mycobacterium bovis subsp bovis AF2122/97
cacgcuggcgcccccgac

SEQ ID NO: 3178303 - RNA, 13 nt, Mycobacterium bovis subsp bovis AF2122/97
cacgcuggcguug

SEQ ID NO: 3178304 - RNA, 22 nt, Mycobacterium bovis subsp bovis AF2122/97
cacgcugucccgcgggccagca

SEQ ID NO: 3178305 - RNA, 15 nt, Mycobacterium bovis subsp bovis AF2122/97
cacgcugucgaucug

SEQ ID NO: 3178306 - RNA, 16 nt, Mycobacterium bovis subsp bovis AF2122/97
cacgcugucgaucuga

SEQ ID NO: 3178307 - RNA, 12 nt, Mycobacterium bovis subsp bovis AF2122/97
cacgcugugcgg

SEQ ID NO: 3178308 - RNA, 17 nt, Mycobacterium bovis subsp bovis AF2122/97
cacgcugugcgguaucg

SEQ ID NO: 3178309 - RNA, 22 nt, Mycobacterium bovis subsp bovis AF2122/97
cacgcugugcgguaucggucag

SEQ ID NO: 3178310 - RNA, 23 nt, Mycobacterium bovis subsp bovis AF2122/97
cacgcugugcgguaucggucagc

SEQ ID NO: 3178311 - RNA, 15 nt, Mycobacterium bovis subsp bovis AF2122/97
cacggaaggcccggc

SEQ ID NO: 3178312 - RNA, 16 nt, Mycobacterium bovis subsp bovis AF2122/97
cacggaaggcccggcg

SEQ ID NO: 3178313 - RNA, 17 nt, Mycobacterium bovis subsp bovis AF2122/97
cacggaaggcccggcgc

SEQ ID NO: 3178314 - RNA, 22 nt, Mycobacterium bovis subsp bovis AF2122/97
cacggaaggcccggcgcggccg

SEQ ID NO: 3178315 - RNA, 20 nt, Mycobacterium bovis subsp bovis AF2122/97
cacggaaguaucgccggccg

SEQ ID NO: 3178316 - RNA, 22 nt, Mycobacterium bovis subsp bovis AF2122/97
cacggaaguaucgccggccgcg

SEQ ID NO: 3178317 - RNA, 13 nt, Mycobacterium bovis subsp bovis AF2122/97
cacggaccgccac

SEQ ID NO: 3178318 - RNA, 14 nt, Mycobacterium bovis subsp bovis AF2122/97
cacggaccgccacc

SEQ ID NO: 3178319 - RNA, 15 nt, Mycobacterium bovis subsp bovis AF2122/97
cacggaccgcgucgc

SEQ ID NO: 3178320 - RNA, 17 nt, Mycobacterium bovis subsp bovis AF2122/97
cacggaccgcgucgcgg

SEQ ID NO: 3178321 - RNA, 13 nt, Mycobacterium bovis subsp bovis AF2122/97
cacggaccuggaa

SEQ ID NO: 3178322 - RNA, 16 nt, Mycobacterium bovis subsp bovis AF2122/97
cacggagaccggccgg

SEQ ID NO: 3178323 - RNA, 21 nt, Mycobacterium bovis subsp bovis AF2122/97
cacggagaccggccgggugaa

SEQ ID NO: 3178324 - RNA, 14 nt, Mycobacterium bovis subsp bovis AF2122/97
cacggagaccgugg

SEQ ID NO: 3178325 - RNA, 17 nt, Mycobacterium bovis subsp bovis AF2122/97
cacggagccgccggcgg

SEQ ID NO: 3178326 - RNA, 12 nt, Mycobacterium bovis subsp bovis AF2122/97
cacggagcucuu

SEQ ID NO: 3178327 - RNA, 18 nt, Mycobacterium bovis subsp bovis AF2122/97
cacggaggguugccgccg

SEQ ID NO: 3178328 - RNA, 21 nt, Mycobacterium bovis subsp bovis AF2122/97
cacggaggguugccgccgacu

SEQ ID NO: 3178329 - RNA, 20 nt, Mycobacterium bovis subsp bovis AF2122/97
cacggagguccgguggacga

SEQ ID NO: 3178330 - RNA, 20 nt, Mycobacterium bovis subsp bovis AF2122/97
cacggauacccuucgucaca

SEQ ID NO: 3178331 - RNA, 14 nt, Mycobacterium bovis subsp bovis AF2122/97
cacggaucgcggcg

SEQ ID NO: 3178332 - RNA, 14 nt, Mycobacterium bovis subsp bovis AF2122/97
cacggaugcgaugg

SEQ ID NO: 3178333 - RNA, 20 nt, Mycobacterium bovis subsp bovis AF2122/97
cacggaugugcucaggucgc

SEQ ID NO: 3178334 - RNA, 13 nt, Mycobacterium bovis subsp bovis AF2122/97
cacggauucgggc

SEQ ID NO: 3178335 - RNA, 19 nt, Mycobacterium bovis subsp bovis AF2122/97
cacggcaaaggcgcucugc

SEQ ID NO: 3178336 - RNA, 20 nt, Mycobacterium bovis subsp bovis AF2122/97
cacggcaaaggcgcucugcu

SEQ ID NO: 3178337 - RNA, 13 nt, Mycobacterium bovis subsp bovis AF2122/97
cacggcaaccagc

SEQ ID NO: 3178338 - RNA, 18 nt, Mycobacterium bovis subsp bovis AF2122/97
cacggcaaccagcgagcc

SEQ ID NO: 3178339 - RNA, 15 nt, Mycobacterium bovis subsp bovis AF2122/97
cacggcacaaucggc

SEQ ID NO: 3178340 - RNA, 12 nt, Mycobacterium bovis subsp bovis AF2122/97
cacggcaccacc

SEQ ID NO: 3178341 - RNA, 19 nt, Mycobacterium bovis subsp bovis AF2122/97
cacggcaccaccaagcucg

SEQ ID NO: 3178342 - RNA, 15 nt, Mycobacterium bovis subsp bovis AF2122/97
cacggcacccaaucc

SEQ ID NO: 3178343 - RNA, 23 nt, Mycobacterium bovis subsp bovis AF2122/97
cacggcagccuugaucucguccc

SEQ ID NO: 3178344 - RNA, 20 nt, Mycobacterium bovis subsp bovis AF2122/97
cacggcagcgcccagaucgc

SEQ ID NO: 3178345 - RNA, 13 nt, Mycobacterium bovis subsp bovis AF2122/97
cacggcagcgccg

SEQ ID NO: 3178346 - RNA, 18 nt, Mycobacterium bovis subsp bovis AF2122/97
cacggcagcgccggucgg

SEQ ID NO: 3178347 - RNA, 20 nt, Mycobacterium bovis subsp bovis AF2122/97
cacggcaggcagggcagccc

SEQ ID NO: 3178348 - RNA, 21 nt, Mycobacterium bovis subsp bovis AF2122/97
cacggccagaaacccggcgac

SEQ ID NO: 3178349 - RNA, 12 nt, Mycobacterium bovis subsp bovis AF2122/97
cacggccagcgg

SEQ ID NO: 3178350 - RNA, 13 nt, Mycobacterium bovis subsp bovis AF2122/97
cacggccagcggg

SEQ ID NO: 3178351 - RNA, 15 nt, Mycobacterium bovis subsp bovis AF2122/97
cacggccaggucgac

SEQ ID NO: 3178352 - RNA, 23 nt, Mycobacterium bovis subsp bovis AF2122/97
cacggccauauugggaguccggc

SEQ ID NO: 3178353 - RNA, 14 nt, Mycobacterium bovis subsp bovis AF2122/97
cacggccccugcca

SEQ ID NO: 3178354 - RNA, 18 nt, Mycobacterium bovis subsp bovis AF2122/97
cacggccccugccacgac

SEQ ID NO: 3178355 - RNA, 19 nt, Mycobacterium bovis subsp bovis AF2122/97
cacggccccugccacgacg

SEQ ID NO: 3178356 - RNA, 23 nt, Mycobacterium bovis subsp bovis AF2122/97
cacggccccugccacgacgaaca

SEQ ID NO: 3178357 - RNA, 15 nt, Mycobacterium bovis subsp bovis AF2122/97
cacggccgagcaggu

SEQ ID NO: 3178358 - RNA, 20 nt, Mycobacterium bovis subsp bovis AF2122/97
cacggccgcauaaaacucgc

SEQ ID NO: 3178359 - RNA, 12 nt, Mycobacterium bovis subsp bovis AF2122/97
cacggccgccga

SEQ ID NO: 3178360 - RNA, 16 nt, Mycobacterium bovis subsp bovis AF2122/97
cacggccggauacggc

SEQ ID NO: 3178361 - RNA, 22 nt, Mycobacterium bovis subsp bovis AF2122/97
cacggccggauacggcgacacc

SEQ ID NO: 3178362 - RNA, 12 nt, Mycobacterium bovis subsp bovis AF2122/97
cacggccggccg

SEQ ID NO: 3178363 - RNA, 14 nt, Mycobacterium bovis subsp bovis AF2122/97
cacggccggccgcu

SEQ ID NO: 3178364 - RNA, 12 nt, Mycobacterium bovis subsp bovis AF2122/97
cacggccgucga

SEQ ID NO: 3178365 - RNA, 14 nt, Mycobacterium bovis subsp bovis AF2122/97
cacggccgucgacg

SEQ ID NO: 3178366 - RNA, 17 nt, Mycobacterium bovis subsp bovis AF2122/97
cacggccgucgacgauc

SEQ ID NO: 3178367 - RNA, 20 nt, Mycobacterium bovis subsp bovis AF2122/97
cacggccgucgacgaucagc

SEQ ID NO: 3178368 - RNA, 14 nt, Mycobacterium bovis subsp bovis AF2122/97
cacggccuccggac

SEQ ID NO: 3178369 - RNA, 15 nt, Mycobacterium bovis subsp bovis AF2122/97
cacggccuugccgau

SEQ ID NO: 3178370 - RNA, 22 nt, Mycobacterium bovis subsp bovis AF2122/97
cacggccuugccgaucagcugg

SEQ ID NO: 3178371 - RNA, 14 nt, Mycobacterium bovis subsp bovis AF2122/97
cacggcgaaccggc

SEQ ID NO: 3178372 - RNA, 16 nt, Mycobacterium bovis subsp bovis AF2122/97
cacggcgaaccggccc

SEQ ID NO: 3178373 - RNA, 11 nt, Mycobacterium bovis subsp bovis AF2122/97
cacggcgaaug

SEQ ID NO: 3178374 - RNA, 18 nt, Mycobacterium bovis subsp bovis AF2122/97
cacggcgaccacgccgcc

SEQ ID NO: 3178375 - RNA, 19 nt, Mycobacterium bovis subsp bovis AF2122/97
cacggcgaccacgccgccg

SEQ ID NO: 3178376 - RNA, 18 nt, Mycobacterium bovis subsp bovis AF2122/97
cacggcgacgaucucggc

SEQ ID NO: 3178377 - RNA, 19 nt, Mycobacterium bovis subsp bovis AF2122/97
cacggcgacgaucucggcg

SEQ ID NO: 3178378 - RNA, 22 nt, Mycobacterium bovis subsp bovis AF2122/97
cacggcgacgaucucggcggcc

SEQ ID NO: 3178379 - RNA, 23 nt, Mycobacterium bovis subsp bovis AF2122/97
cacggcgacgaucucggcggccg

SEQ ID NO: 3178380 - RNA, 16 nt, Mycobacterium bovis subsp bovis AF2122/97
cacggcgaggugcucg

SEQ ID NO: 3178381 - RNA, 13 nt, Mycobacterium bovis subsp bovis AF2122/97
cacggcgauccgg

SEQ ID NO: 3178382 - RNA, 14 nt, Mycobacterium bovis subsp bovis AF2122/97
cacggcgauccggu

SEQ ID NO: 3178383 - RNA, 19 nt, Mycobacterium bovis subsp bovis AF2122/97
cacggcgauccggucggcc

SEQ ID NO: 3178384 - RNA, 21 nt, Mycobacterium bovis subsp bovis AF2122/97
cacggcgauccggucggccag

SEQ ID NO: 3178385 - RNA, 23 nt, Mycobacterium bovis subsp bovis AF2122/97
cacggcgauccggucggccaggc

SEQ ID NO: 3178386 - RNA, 19 nt, Mycobacterium bovis subsp bovis AF2122/97
cacggcgaugcagccacau

SEQ ID NO: 3178387 - RNA, 13 nt, Mycobacterium bovis subsp bovis AF2122/97
cacggcgccgacc

SEQ ID NO: 3178388 - RNA, 15 nt, Mycobacterium bovis subsp bovis AF2122/97
cacggcgccgacccg

SEQ ID NO: 3178389 - RNA, 13 nt, Mycobacterium bovis subsp bovis AF2122/97
cacggcgccgcca

SEQ ID NO: 3178390 - RNA, 14 nt, Mycobacterium bovis subsp bovis AF2122/97
cacggcgccgccac

SEQ ID NO: 3178391 - RNA, 22 nt, Mycobacterium bovis subsp bovis AF2122/97
cacggcgccgccacggaucgcg

SEQ ID NO: 3178392 - RNA, 23 nt, Mycobacterium bovis subsp bovis AF2122/97
cacggcgccuacaccggcgcuca

SEQ ID NO: 3178393 - RNA, 13 nt, Mycobacterium bovis subsp bovis AF2122/97
cacggcgcgagcc

SEQ ID NO: 3178394 - RNA, 16 nt, Mycobacterium bovis subsp bovis AF2122/97
cacggcgcgccagaac

SEQ ID NO: 3178395 - RNA, 20 nt, Mycobacterium bovis subsp bovis AF2122/97
cacggcgcgcgcgccggcug

SEQ ID NO: 3178396 - RNA, 22 nt, Mycobacterium bovis subsp bovis AF2122/97
cacggcgcgcgcgccggcugcc

SEQ ID NO: 3178397 - RNA, 18 nt, Mycobacterium bovis subsp bovis AF2122/97
cacggcgcguugggacca

SEQ ID NO: 3178398 - RNA, 22 nt, Mycobacterium bovis subsp bovis AF2122/97
cacggcgcguugggaccagugc

SEQ ID NO: 3178399 - RNA, 15 nt, Mycobacterium bovis subsp bovis AF2122/97
cacggcgcuaccagc

SEQ ID NO: 3178400 - RNA, 23 nt, Mycobacterium bovis subsp bovis AF2122/97
cacggcggaagaagugcacugcg

SEQ ID NO: 3178401 - RNA, 17 nt, Mycobacterium bovis subsp bovis AF2122/97
cacggcggcaucaccug

SEQ ID NO: 3178402 - RNA, 21 nt, Mycobacterium bovis subsp bovis AF2122/97
cacggcggcaucaccuggcgu

SEQ ID NO: 3178403 - RNA, 12 nt, Mycobacterium bovis subsp bovis AF2122/97
cacggcggccac

SEQ ID NO: 3178404 - RNA, 14 nt, Mycobacterium bovis subsp bovis AF2122/97
cacggcggccacgu

SEQ ID NO: 3178405 - RNA, 13 nt, Mycobacterium bovis subsp bovis AF2122/97
cacggcggccagg

SEQ ID NO: 3178406 - RNA, 14 nt, Mycobacterium bovis subsp bovis AF2122/97
cacggcggccaggg

SEQ ID NO: 3178407 - RNA, 11 nt, Mycobacterium bovis subsp bovis AF2122/97
cacggcggccc

SEQ ID NO: 3178408 - RNA, 15 nt, Mycobacterium bovis subsp bovis AF2122/97
cacggcggccccggc

SEQ ID NO: 3178409 - RNA, 14 nt, Mycobacterium bovis subsp bovis AF2122/97
cacggcggcccgcu

SEQ ID NO: 3178410 - RNA, 17 nt, Mycobacterium bovis subsp bovis AF2122/97
cacggcggcccgcucgg

SEQ ID NO: 3178411 - RNA, 18 nt, Mycobacterium bovis subsp bovis AF2122/97
cacggcggcccgcucggg

SEQ ID NO: 3178412 - RNA, 11 nt, Mycobacterium bovis subsp bovis AF2122/97
cacggcggcga

SEQ ID NO: 3178413 - RNA, 14 nt, Mycobacterium bovis subsp bovis AF2122/97
cacggcggcggcgu

SEQ ID NO: 3178414 - RNA, 22 nt, Mycobacterium bovis subsp bovis AF2122/97
cacggcggcggcguagcagaag

SEQ ID NO: 3178415 - RNA, 20 nt, Mycobacterium bovis subsp bovis AF2122/97
cacggcgggaugcagcugcc

SEQ ID NO: 3178416 - RNA, 14 nt, Mycobacterium bovis subsp bovis AF2122/97
cacggcgguguguu

SEQ ID NO: 3178417 - RNA, 20 nt, Mycobacterium bovis subsp bovis AF2122/97
cacggcgguugccccgaccg

SEQ ID NO: 3178418 - RNA, 23 nt, Mycobacterium bovis subsp bovis AF2122/97
cacggcgguugccccgaccgccg

SEQ ID NO: 3178419 - RNA, 11 nt, Mycobacterium bovis subsp bovis AF2122/97
cacggcgucgg

SEQ ID NO: 3178420 - RNA, 14 nt, Mycobacterium bovis subsp bovis AF2122/97
cacggcgucggcca

SEQ ID NO: 3178421 - RNA, 16 nt, Mycobacterium bovis subsp bovis AF2122/97
cacggcgucggccacc

SEQ ID NO: 3178422 - RNA, 17 nt, Mycobacterium bovis subsp bovis AF2122/97
cacggcgucggccaccc

SEQ ID NO: 3178423 - RNA, 23 nt, Mycobacterium bovis subsp bovis AF2122/97
cacggcgucggccacccggucca

SEQ ID NO: 3178424 - RNA, 23 nt, Mycobacterium bovis subsp bovis AF2122/97
cacggcgucuuccucggccaccc

SEQ ID NO: 3178425 - RNA, 14 nt, Mycobacterium bovis subsp bovis AF2122/97
cacggcgugucggg

SEQ ID NO: 3178426 - RNA, 15 nt, Mycobacterium bovis subsp bovis AF2122/97
cacggcgugucgggg

SEQ ID NO: 3178427 - RNA, 15 nt, Mycobacterium bovis subsp bovis AF2122/97
cacggcguugccgcc

SEQ ID NO: 3178428 - RNA, 21 nt, Mycobacterium bovis subsp bovis AF2122/97
auggccgaccagccgaucauc

SEQ ID NO: 3178429 - RNA, 16 nt, Mycobacterium bovis subsp bovis AF2122/97
auggccgauuccgcgc

SEQ ID NO: 3178430 - RNA, 21 nt, Mycobacterium bovis subsp bovis AF2122/97
auggccgcauuggcgaccgcu

SEQ ID NO: 3178431 - RNA, 14 nt, Mycobacterium bovis subsp bovis AF2122/97
auggccgccaccgc

SEQ ID NO: 3178432 - RNA, 14 nt, Mycobacterium bovis subsp bovis AF2122/97
auggccgccaggcg

SEQ ID NO: 3178433 - RNA, 11 nt, Mycobacterium bovis subsp bovis AF2122/97
auggccgccga

SEQ ID NO: 3178434 - RNA, 14 nt, Mycobacterium bovis subsp bovis AF2122/97
auggccgccgcagc

SEQ ID NO: 3178435 - RNA, 15 nt, Mycobacterium bovis subsp bovis AF2122/97
auggccgccgcagcu

SEQ ID NO: 3178436 - RNA, 12 nt, Mycobacterium bovis subsp bovis AF2122/97
auggccgccgcg

SEQ ID NO: 3178437 - RNA, 18 nt, Mycobacterium bovis subsp bovis AF2122/97
auggccgccuugaggccc

SEQ ID NO: 3178438 - RNA, 15 nt, Mycobacterium bovis subsp bovis AF2122/97
auggccgcgugcagc

SEQ ID NO: 3178439 - RNA, 17 nt, Mycobacterium bovis subsp bovis AF2122/97
auggccgggaacacgug

SEQ ID NO: 3178440 - RNA, 12 nt, Mycobacterium bovis subsp bovis AF2122/97
auggccgucagc

SEQ ID NO: 3178441 - RNA, 18 nt, Mycobacterium bovis subsp bovis AF2122/97
auggccguccgaccgaua

SEQ ID NO: 3178442 - RNA, 21 nt, Mycobacterium bovis subsp bovis AF2122/97
auggccguugccaacaacauc

SEQ ID NO: 3178443 - RNA, 22 nt, Mycobacterium bovis subsp bovis AF2122/97
auggccuugcugcgcgauggcc

SEQ ID NO: 3178444 - RNA, 22 nt, Mycobacterium bovis subsp bovis AF2122/97
auggcgaccacccccggcaggc

SEQ ID NO: 3178445 - RNA, 20 nt, Mycobacterium bovis subsp bovis AF2122/97
auggcgacgaacgccgucag

SEQ ID NO: 3178446 - RNA, 15 nt, Mycobacterium bovis subsp bovis AF2122/97
auggcgagcgcgcca

SEQ ID NO: 3178447 - RNA, 20 nt, Mycobacterium bovis subsp bovis AF2122/97
auggcgaguacggccugccg

SEQ ID NO: 3178448 - RNA, 14 nt, Mycobacterium bovis subsp bovis AF2122/97
auggcgaugcgcgc

SEQ ID NO: 3178449 - RNA, 16 nt, Mycobacterium bovis subsp bovis AF2122/97
auggcgcaccggcguc

SEQ ID NO: 3178450 - RNA, 16 nt, Mycobacterium bovis subsp bovis AF2122/97
auggcgccagccgacc

SEQ ID NO: 3178451 - RNA, 14 nt, Mycobacterium bovis subsp bovis AF2122/97
auggcgccgcggcu

SEQ ID NO: 3178452 - RNA, 14 nt, Mycobacterium bovis subsp bovis AF2122/97
auggcgccggccgg

SEQ ID NO: 3178453 - RNA, 20 nt, Mycobacterium bovis subsp bovis AF2122/97
auggcgcgcaacguagccag

SEQ ID NO: 3178454 - RNA, 22 nt, Mycobacterium bovis subsp bovis AF2122/97
auggcgcgcaacguagccagca

SEQ ID NO: 3178455 - RNA, 19 nt, Mycobacterium bovis subsp bovis AF2122/97
auggcgcggguccagccac

SEQ ID NO: 3178456 - RNA, 17 nt, Mycobacterium bovis subsp bovis AF2122/97
auggcggcauagccgaa

SEQ ID NO: 3178457 - RNA, 13 nt, Mycobacterium bovis subsp bovis AF2122/97
auggcggccacca

SEQ ID NO: 3178458 - RNA, 18 nt, Mycobacterium bovis subsp bovis AF2122/97
auggcggccaccgucagc

SEQ ID NO: 3178459 - RNA, 22 nt, Mycobacterium bovis subsp bovis AF2122/97
auggcggccaccgucagcgcga

SEQ ID NO: 3178460 - RNA, 21 nt, Mycobacterium bovis subsp bovis AF2122/97
auggugaugggggagccggug

SEQ ID NO: 3178461 - RNA, 15 nt, Mycobacterium bovis subsp bovis AF2122/97
auggugccgacccgc

SEQ ID NO: 3178462 - RNA, 20 nt, Mycobacterium bovis subsp bovis AF2122/97
auggugccgacccgccgcgc

SEQ ID NO: 3178463 - RNA, 15 nt, Mycobacterium bovis subsp bovis AF2122/97
auggugccguccggc

SEQ ID NO: 3178464 - RNA, 22 nt, Mycobacterium bovis subsp bovis AF2122/97
auggugcggcccaaccggucgu

SEQ ID NO: 3178465 - RNA, 14 nt, Mycobacterium bovis subsp bovis AF2122/97
auggugcggcggcg

SEQ ID NO: 3178466 - RNA, 17 nt, Mycobacterium bovis subsp bovis AF2122/97
augguggccgccaccuc

SEQ ID NO: 3178467 - RNA, 16 nt, Mycobacterium bovis subsp bovis AF2122/97
augguggccgcgcggu

SEQ ID NO: 3178468 - RNA, 13 nt, Mycobacterium bovis subsp bovis AF2122/97
augguggcgccga

SEQ ID NO: 3178469 - RNA, 21 nt, Mycobacterium bovis subsp bovis AF2122/97
augguggcgguuccggccggc

SEQ ID NO: 3178470 - RNA, 16 nt, Mycobacterium bovis subsp bovis AF2122/97
augguggugccaaccu

SEQ ID NO: 3178471 - RNA, 16 nt, Mycobacterium bovis subsp bovis AF2122/97
augguggugccgucag

SEQ ID NO: 3178472 - RNA, 15 nt, Mycobacterium bovis subsp bovis AF2122/97
auggugguggcccgg

SEQ ID NO: 3178473 - RNA, 15 nt, Mycobacterium bovis subsp bovis AF2122/97
augguggugggugau

SEQ ID NO: 3178474 - RNA, 16 nt, Mycobacterium bovis subsp bovis AF2122/97
augguguacugcugcu

SEQ ID NO: 3178475 - RNA, 15 nt, Mycobacterium bovis subsp bovis AF2122/97
auggugugcagcagc

SEQ ID NO: 3178476 - RNA, 22 nt, Mycobacterium bovis subsp bovis AF2122/97
augguuccguugaugccgccgg

SEQ ID NO: 3178477 - RNA, 20 nt, Mycobacterium bovis subsp bovis AF2122/97
augguucgcacaccuccucg

SEQ ID NO: 3178478 - RNA, 21 nt, Mycobacterium bovis subsp bovis AF2122/97
augguucgcacaccuccucga

SEQ ID NO: 3178479 - RNA, 23 nt, Mycobacterium bovis subsp bovis AF2122/97
auguaaccguagcccugcucagc

SEQ ID NO: 3178480 - RNA, 21 nt, Mycobacterium bovis subsp bovis AF2122/97
auguaaguuguagacgucgac

SEQ ID NO: 3178481 - RNA, 22 nt, Mycobacterium bovis subsp bovis AF2122/97
auguacaccggcuggaaucuga

SEQ ID NO: 3178482 - RNA, 18 nt, Mycobacterium bovis subsp bovis AF2122/97
auguacacuuugcccgcc

SEQ ID NO: 3178483 - RNA, 15 nt, Mycobacterium bovis subsp bovis AF2122/97
auguaccgaccgcgu

SEQ ID NO: 3178484 - RNA, 19 nt, Mycobacterium bovis subsp bovis AF2122/97
auguaccugguugcugacg

SEQ ID NO: 3178485 - RNA, 12 nt, Mycobacterium bovis subsp bovis AF2122/97
auguacugugcc

SEQ ID NO: 3178486 - RNA, 19 nt, Mycobacterium bovis subsp bovis AF2122/97
auguagagcucaccgucga

SEQ ID NO: 3178487 - RNA, 15 nt, Mycobacterium bovis subsp bovis AF2122/97
auguaggcuucgccg

SEQ ID NO: 3178488 - RNA, 17 nt, Mycobacterium bovis subsp bovis AF2122/97
auguauuuggugaugca

SEQ ID NO: 3178489 - RNA, 21 nt, Mycobacterium bovis subsp bovis AF2122/97
augucaaccaagugaccggcc

SEQ ID NO: 3178490 - RNA, 17 nt, Mycobacterium bovis subsp bovis AF2122/97
augucaaguucgccagc

SEQ ID NO: 3178491 - RNA, 17 nt, Mycobacterium bovis subsp bovis AF2122/97
augucaccccgcccagc

SEQ ID NO: 3178492 - RNA, 20 nt, Mycobacterium bovis subsp bovis AF2122/97
augucacggaugugcucagg

SEQ ID NO: 3178493 - RNA, 15 nt, Mycobacterium bovis subsp bovis AF2122/97
augucagcggccugc

SEQ ID NO: 3178494 - RNA, 18 nt, Mycobacterium bovis subsp bovis AF2122/97
augucagcggccugcucg

SEQ ID NO: 3178495 - RNA, 20 nt, Mycobacterium bovis subsp bovis AF2122/97
augucagugaucaccaaccc

SEQ ID NO: 3178496 - RNA, 16 nt, Mycobacterium bovis subsp bovis AF2122/97
augucagugccccgcc

SEQ ID NO: 3178497 - RNA, 17 nt, Mycobacterium bovis subsp bovis AF2122/97
augucagugccccgccc

SEQ ID NO: 3178498 - RNA, 17 nt, Mycobacterium bovis subsp bovis AF2122/97
augucauagcgcaccac

SEQ ID NO: 3178499 - RNA, 19 nt, Mycobacterium bovis subsp bovis AF2122/97
auguccaggcgcgcaccac

SEQ ID NO: 3178500 - RNA, 18 nt, Mycobacterium bovis subsp bovis AF2122/97
auguccauagccggcauu

SEQ ID NO: 3178501 - RNA, 23 nt, Mycobacterium bovis subsp bovis AF2122/97
auguccauguuuugcugcaugcc

SEQ ID NO: 3178502 - RNA, 17 nt, Mycobacterium bovis subsp bovis AF2122/97
augucccaugcacggcc

SEQ ID NO: 3178503 - RNA, 14 nt, Mycobacterium bovis subsp bovis AF2122/97
auguccgacgcacc

SEQ ID NO: 3178504 - RNA, 18 nt, Mycobacterium bovis subsp bovis AF2122/97
auguccgacgccaccgcc

SEQ ID NO: 3178505 - RNA, 14 nt, Mycobacterium bovis subsp bovis AF2122/97
auguccgcggccac

SEQ ID NO: 3178506 - RNA, 15 nt, Mycobacterium bovis subsp bovis AF2122/97
auguccgcggccacc

SEQ ID NO: 3178507 - RNA, 17 nt, Mycobacterium bovis subsp bovis AF2122/97
auguccgguccgccagc

SEQ ID NO: 3178508 - RNA, 21 nt, Mycobacterium bovis subsp bovis AF2122/97
auguccgguccgccagcgcga

SEQ ID NO: 3178509 - RNA, 17 nt, Mycobacterium bovis subsp bovis AF2122/97
auguccuauuugcagcc

SEQ ID NO: 3178510 - RNA, 22 nt, Mycobacterium bovis subsp bovis AF2122/97
auguccuauuugcagccuucga

SEQ ID NO: 3178511 - RNA, 17 nt, Mycobacterium bovis subsp bovis AF2122/97
auguccucgaugcgggc

SEQ ID NO: 3178512 - RNA, 17 nt, Mycobacterium bovis subsp bovis AF2122/97
auguccugggccgccgc

SEQ ID NO: 3178513 - RNA, 20 nt, Mycobacterium bovis subsp bovis AF2122/97
auguccugggccgccgcccu

SEQ ID NO: 3178514 - RNA, 20 nt, Mycobacterium bovis subsp bovis AF2122/97
augucgaaacccacguacgc

SEQ ID NO: 3178515 - RNA, 17 nt, Mycobacterium bovis subsp bovis AF2122/97
augucgaacaggaucag

SEQ ID NO: 3178516 - RNA, 18 nt, Mycobacterium bovis subsp bovis AF2122/97
augucgaacaggaucagc

SEQ ID NO: 3178517 - RNA, 18 nt, Mycobacterium bovis subsp bovis AF2122/97
augucgaagaaccggccg

SEQ ID NO: 3178518 - RNA, 21 nt, Mycobacterium bovis subsp bovis AF2122/97
augucgaagaaccggccgacg

SEQ ID NO: 3178519 - RNA, 20 nt, Mycobacterium bovis subsp bovis AF2122/97
augucgaagacguuggcgcg

SEQ ID NO: 3178520 - RNA, 11 nt, Mycobacterium bovis subsp bovis AF2122/97
augucgacgag

SEQ ID NO: 3178521 - RNA, 17 nt, Mycobacterium bovis subsp bovis AF2122/97
augucgacgagcaccgc

SEQ ID NO: 3178522 - RNA, 21 nt, Mycobacterium bovis subsp bovis AF2122/97
augucgagcacaccgucgucg

SEQ ID NO: 3178523 - RNA, 14 nt, Mycobacterium bovis subsp bovis AF2122/97
augucgagcacgcc

SEQ ID NO: 3178524 - RNA, 18 nt, Mycobacterium bovis subsp bovis AF2122/97
augucgagcccgucgagu

SEQ ID NO: 3178525 - RNA, 12 nt, Mycobacterium bovis subsp bovis AF2122/97
augucgaugccg

SEQ ID NO: 3178526 - RNA, 13 nt, Mycobacterium bovis subsp bovis AF2122/97
augucgaugccgu

SEQ ID NO: 3178527 - RNA, 20 nt, Mycobacterium bovis subsp bovis AF2122/97
augucgccgcuuggcccggc

SEQ ID NO: 3178528 - RNA, 23 nt, Mycobacterium bovis subsp bovis AF2122/97
augucgcgcgcuaggugcaacag

SEQ ID NO: 3178529 - RNA, 17 nt, Mycobacterium bovis subsp bovis AF2122/97
augucgcugccgccgcc

SEQ ID NO: 3178530 - RNA, 18 nt, Mycobacterium bovis subsp bovis AF2122/97
augucggcagggccccca

SEQ ID NO: 3178531 - RNA, 13 nt, Mycobacterium bovis subsp bovis AF2122/97
augucggcaggua

SEQ ID NO: 3178532 - RNA, 12 nt, Mycobacterium bovis subsp bovis AF2122/97
augucggccacc

SEQ ID NO: 3178533 - RNA, 17 nt, Mycobacterium bovis subsp bovis AF2122/97
augucggccacccggac

SEQ ID NO: 3178534 - RNA, 13 nt, Mycobacterium bovis subsp bovis AF2122/97
augucggccaccg

SEQ ID NO: 3178535 - RNA, 14 nt, Mycobacterium bovis subsp bovis AF2122/97
augucggccaccgg

SEQ ID NO: 3178536 - RNA, 20 nt, Mycobacterium bovis subsp bovis AF2122/97
augucggccaccggcgucug

SEQ ID NO: 3178537 - RNA, 13 nt, Mycobacterium bovis subsp bovis AF2122/97
augucggccaggu

SEQ ID NO: 3178538 - RNA, 16 nt, Mycobacterium bovis subsp bovis AF2122/97
augucggccaggucgg

SEQ ID NO: 3178539 - RNA, 22 nt, Mycobacterium bovis subsp bovis AF2122/97
augucggccgcgggucccggcc

SEQ ID NO: 3178540 - RNA, 15 nt, Mycobacterium bovis subsp bovis AF2122/97
augucggccggggcc

SEQ ID NO: 3178541 - RNA, 17 nt, Mycobacterium bovis subsp bovis AF2122/97
augucggcugguggggg

SEQ ID NO: 3178542 - RNA, 14 nt, Mycobacterium bovis subsp bovis AF2122/97
augucgggccaggc

SEQ ID NO: 3178543 - RNA, 18 nt, Mycobacterium bovis subsp bovis AF2122/97
augucggggccgucgucg

SEQ ID NO: 3178544 - RNA, 20 nt, Mycobacterium bovis subsp bovis AF2122/97
augucggggccgucgucggu

SEQ ID NO: 3178545 - RNA, 16 nt, Mycobacterium bovis subsp bovis AF2122/97
augucggucggaucgg

SEQ ID NO: 3178546 - RNA, 13 nt, Mycobacterium bovis subsp bovis AF2122/97
augucggugauca

SEQ ID NO: 3178547 - RNA, 14 nt, Mycobacterium bovis subsp bovis AF2122/97
augucguaggccgc

SEQ ID NO: 3178548 - RNA, 20 nt, Mycobacterium bovis subsp bovis AF2122/97
augucguaguagcggaucag

SEQ ID NO: 3178549 - RNA, 14 nt, Mycobacterium bovis subsp bovis AF2122/97
augucgucaccgug

SEQ ID NO: 3178550 - RNA, 13 nt, Mycobacterium bovis subsp bovis AF2122/97
augucgucgacca

SEQ ID NO: 3178551 - RNA, 13 nt, Mycobacterium bovis subsp bovis AF2122/97
augucgucgacga

SEQ ID NO: 3178552 - RNA, 13 nt, Mycobacterium bovis subsp bovis AF2122/97
augucgucgauga

SEQ ID NO: 3178553 - RNA, 22 nt, Mycobacterium bovis subsp bovis AF2122/97
augucgucuuuggucagccgau

SEQ ID NO: 3178554 - RNA, 22 nt, Mycobacterium bovis subsp bovis AF2122/97
augucgugcgggcgcaccaggg

SEQ ID NO: 3178555 - RNA, 16 nt, Mycobacterium bovis subsp bovis AF2122/97
augucguugcccgcga

SEQ ID NO: 3178556 - RNA, 16 nt, Mycobacterium bovis subsp bovis AF2122/97
augucguuggccaccu

SEQ ID NO: 3178557 - RNA, 18 nt, Mycobacterium bovis subsp bovis AF2122/97
augucuaccaacaccgcc

SEQ ID NO: 3178558 - RNA, 21 nt, Mycobacterium bovis subsp bovis AF2122/97
augucuaccaacaccgcccgc

SEQ ID NO: 3178559 - RNA, 19 nt, Mycobacterium bovis subsp bovis AF2122/97
augucuccaguagccggug

SEQ ID NO: 3178560 - RNA, 16 nt, Mycobacterium bovis subsp bovis AF2122/97
augucuccgacauugg

SEQ ID NO: 3178561 - RNA, 23 nt, Mycobacterium bovis subsp bovis AF2122/97
augucuccgacauuggccgucau

SEQ ID NO: 3178562 - RNA, 20 nt, Mycobacterium bovis subsp bovis AF2122/97
augucuugcgaugugcauuc

SEQ ID NO: 3178563 - RNA, 19 nt, Mycobacterium bovis subsp bovis AF2122/97
augugaaagacaacccgcu

SEQ ID NO: 3178564 - RNA, 19 nt, Mycobacterium bovis subsp bovis AF2122/97
augugacaucgggccgccg

SEQ ID NO: 3178565 - RNA, 18 nt, Mycobacterium bovis subsp bovis AF2122/97
augugaguccagccggcg

SEQ ID NO: 3178566 - RNA, 22 nt, Mycobacterium bovis subsp bovis AF2122/97
augugcacggugugcacggcga

SEQ ID NO: 3178567 - RNA, 20 nt, Mycobacterium bovis subsp bovis AF2122/97
augugcgaccacaucaugcc

SEQ ID NO: 3178568 - RNA, 14 nt, Mycobacterium bovis subsp bovis AF2122/97
augugcgccaccuc

SEQ ID NO: 3178569 - RNA, 15 nt, Mycobacterium bovis subsp bovis AF2122/97
augugcggcugcacc

SEQ ID NO: 3178570 - RNA, 13 nt, Mycobacterium bovis subsp bovis AF2122/97
auguggccgccgu

SEQ ID NO: 3178571 - RNA, 19 nt, Mycobacterium bovis subsp bovis AF2122/97
auguggccgccgucgacgu

SEQ ID NO: 3178572 - RNA, 16 nt, Mycobacterium bovis subsp bovis AF2122/97
auguggccggcgaugg

SEQ ID NO: 3178573 - RNA, 22 nt, Mycobacterium bovis subsp bovis AF2122/97
auguggcgucgcucgucgucac

SEQ ID NO: 3178574 - RNA, 14 nt, Mycobacterium bovis subsp bovis AF2122/97
auguggucggcugu

SEQ ID NO: 3178575 - RNA, 17 nt, Mycobacterium bovis subsp bovis AF2122/97
augugguggcgccggcc

SEQ ID NO: 3178576 - RNA, 18 nt, Mycobacterium bovis subsp bovis AF2122/97
augugguggcgccggccg

SEQ ID NO: 3178577 - RNA, 20 nt, Mycobacterium bovis subsp bovis AF2122/97
auguggugugccugcgucuc

SEQ ID NO: 3178578 - RNA, 16 nt, Mycobacterium bovis subsp bovis AF2122/97
auguguugccagauca

SEQ ID NO: 3178579 - RNA, 18 nt, Mycobacterium bovis subsp bovis AF2122/97
auguguugcgggugguuu

SEQ ID NO: 3178580 - RNA, 23 nt, Mycobacterium bovis subsp bovis AF2122/97
auguguuugaucaccgugguggc

SEQ ID NO: 3178581 - RNA, 15 nt, Mycobacterium bovis subsp bovis AF2122/97
auguucacgccgccg

SEQ ID NO: 3178582 - RNA, 16 nt, Mycobacterium bovis subsp bovis AF2122/97
auguucacgccgccgg

SEQ ID NO: 3178583 - RNA, 18 nt, Mycobacterium bovis subsp bovis AF2122/97
auguucagguugcugauc

SEQ ID NO: 3178584 - RNA, 14 nt, Mycobacterium bovis subsp bovis AF2122/97
auguucauccgcag

SEQ ID NO: 3178585 - RNA, 23 nt, Mycobacterium bovis subsp bovis AF2122/97
auguuccccgucgccagggccuu

SEQ ID NO: 3178586 - RNA, 23 nt, Mycobacterium bovis subsp bovis AF2122/97
auguucccgaaaccuguaccgcc

SEQ ID NO: 3178587 - RNA, 21 nt, Mycobacterium bovis subsp bovis AF2122/97
auguucgaaagcaccgaugcu

SEQ ID NO: 3178588 - RNA, 20 nt, Mycobacterium bovis subsp bovis AF2122/97
auguucgccgcgcggaacac

SEQ ID NO: 3178589 - RNA, 21 nt, Mycobacterium bovis subsp bovis AF2122/97
auguucggggcgcaccacgau

SEQ ID NO: 3178590 - RNA, 16 nt, Mycobacterium bovis subsp bovis AF2122/97
auguucucgaccgcgu

SEQ ID NO: 3178591 - RNA, 19 nt, Mycobacterium bovis subsp bovis AF2122/97
auguugccggaguugaagu

SEQ ID NO: 3178592 - RNA, 15 nt, Mycobacterium bovis subsp bovis AF2122/97
auguugcgacggccg

SEQ ID NO: 3178593 - RNA, 17 nt, Mycobacterium bovis subsp bovis AF2122/97
auguugcgacggccggc

SEQ ID NO: 3178594 - RNA, 21 nt, Mycobacterium bovis subsp bovis AF2122/97
auguuggcagggccagcggca

SEQ ID NO: 3178595 - RNA, 20 nt, Mycobacterium bovis subsp bovis AF2122/97
auguuggcgaaugcggcccc

SEQ ID NO: 3178596 - RNA, 15 nt, Mycobacterium bovis subsp bovis AF2122/97
auguuggugaucaaa

SEQ ID NO: 3178597 - RNA, 18 nt, Mycobacterium bovis subsp bovis AF2122/97
auguugguuugccggcgg

SEQ ID NO: 3178598 - RNA, 13 nt, Mycobacterium bovis subsp bovis AF2122/97
auguugucgacgg

SEQ ID NO: 3178599 - RNA, 19 nt, Mycobacterium bovis subsp bovis AF2122/97
auguugugccgaucggcca

SEQ ID NO: 3178600 - RNA, 14 nt, Mycobacterium bovis subsp bovis AF2122/97
auguuguucagcag

SEQ ID NO: 3178601 - RNA, 16 nt, Mycobacterium bovis subsp bovis AF2122/97
auguuguucagcaggc

SEQ ID NO: 3178602 - RNA, 22 nt, Mycobacterium bovis subsp bovis AF2122/97
auguuugaaacguaugacgccc

SEQ ID NO: 3178603 - RNA, 18 nt, Mycobacterium bovis subsp bovis AF2122/97
auguuuuccgguccggcg

SEQ ID NO: 3178604 - RNA, 16 nt, Mycobacterium bovis subsp bovis AF2122/97
auuaaaaagcccagcg

SEQ ID NO: 3178605 - RNA, 14 nt, Mycobacterium bovis subsp bovis AF2122/97
auuaacugcuucca

SEQ ID NO: 3178606 - RNA, 23 nt, Mycobacterium bovis subsp bovis AF2122/97
auuaagggucaucgccagcggca

SEQ ID NO: 3178607 - RNA, 16 nt, Mycobacterium bovis subsp bovis AF2122/97
auuaaggugaccacgg

SEQ ID NO: 3178608 - RNA, 21 nt, Mycobacterium bovis subsp bovis AF2122/97
auuaccagcggcaccgcgccg

SEQ ID NO: 3178609 - RNA, 21 nt, Mycobacterium bovis subsp bovis AF2122/97
auuacgcaccgaggccgccga

SEQ ID NO: 3178610 - RNA, 16 nt, Mycobacterium bovis subsp bovis AF2122/97
auuagccaggcccggc

SEQ ID NO: 3178611 - RNA, 17 nt, Mycobacterium bovis subsp bovis AF2122/97
auucacgacgccgagca

SEQ ID NO: 3178612 - RNA, 17 nt, Mycobacterium bovis subsp bovis AF2122/97
auucagcgccccaugca

SEQ ID NO: 3178613 - RNA, 22 nt, Mycobacterium bovis subsp bovis AF2122/97
auucagcggcaacgaucgacac

SEQ ID NO: 3178614 - RNA, 13 nt, Mycobacterium bovis subsp bovis AF2122/97
auucaucacggga

SEQ ID NO: 3178615 - RNA, 21 nt, Mycobacterium bovis subsp bovis AF2122/97
auucaugccgguguugccgaa

SEQ ID NO: 3178616 - RNA, 16 nt, Mycobacterium bovis subsp bovis AF2122/97
auuccacaaauccaaa

SEQ ID NO: 3178617 - RNA, 17 nt, Mycobacterium bovis subsp bovis AF2122/97
auuccacaaauccaaac

SEQ ID NO: 3178618 - RNA, 14 nt, Mycobacterium bovis subsp bovis AF2122/97
auuccacaggggcc

SEQ ID NO: 3178619 - RNA, 14 nt, Mycobacterium bovis subsp bovis AF2122/97
auuccaccgccgac

SEQ ID NO: 3178620 - RNA, 17 nt, Mycobacterium bovis subsp bovis AF2122/97
auuccaccuuggccaga

SEQ ID NO: 3178621 - RNA, 14 nt, Mycobacterium bovis subsp bovis AF2122/97
auuccagaucaacg

SEQ ID NO: 3178622 - RNA, 14 nt, Mycobacterium bovis subsp bovis AF2122/97
auuccagccccccg

SEQ ID NO: 3178623 - RNA, 20 nt, Mycobacterium bovis subsp bovis AF2122/97
auuccagccccccggcgacg

SEQ ID NO: 3178624 - RNA, 19 nt, Mycobacterium bovis subsp bovis AF2122/97
auuccagcggaagcgguug

SEQ ID NO: 3178625 - RNA, 23 nt, Mycobacterium bovis subsp bovis AF2122/97
auuccaugucgucgacaaacagc

SEQ ID NO: 3178626 - RNA, 14 nt, Mycobacterium bovis subsp bovis AF2122/97
auucccaggaacgg

SEQ ID NO: 3178627 - RNA, 14 nt, Mycobacterium bovis subsp bovis AF2122/97
auucccaucggccu

SEQ ID NO: 3178628 - RNA, 12 nt, Mycobacterium bovis subsp bovis AF2122/97
auucccgcccag

SEQ ID NO: 3178629 - RNA, 18 nt, Mycobacterium bovis subsp bovis AF2122/97
auucccgcccagcagcac

SEQ ID NO: 3178630 - RNA, 21 nt, Mycobacterium bovis subsp bovis AF2122/97
auucccgcggcaacgcggucu

SEQ ID NO: 3178631 - RNA, 15 nt, Mycobacterium bovis subsp bovis AF2122/97
auucccggacccacc

SEQ ID NO: 3178632 - RNA, 16 nt, Mycobacterium bovis subsp bovis AF2122/97
auucccggacccacca

SEQ ID NO: 3178633 - RNA, 17 nt, Mycobacterium bovis subsp bovis AF2122/97
auuccgaguuguucagc

SEQ ID NO: 3178634 - RNA, 18 nt, Mycobacterium bovis subsp bovis AF2122/97
auuccgcagagaccaagg

SEQ ID NO: 3178635 - RNA, 22 nt, Mycobacterium bovis subsp bovis AF2122/97
auuccgcccacaugcgcucgcg

SEQ ID NO: 3178636 - RNA, 12 nt, Mycobacterium bovis subsp bovis AF2122/97
auuccggcgcca

SEQ ID NO: 3178637 - RNA, 22 nt, Mycobacterium bovis subsp bovis AF2122/97
auuccggcggagcgggccagca

SEQ ID NO: 3178638 - RNA, 17 nt, Mycobacterium bovis subsp bovis AF2122/97
auuccggcggccacgcc

SEQ ID NO: 3178639 - RNA, 21 nt, Mycobacterium bovis subsp bovis AF2122/97
auuccggcggccacgccggcg

SEQ ID NO: 3178640 - RNA, 20 nt, Mycobacterium bovis subsp bovis AF2122/97
auuccggcucaccgaucccg

SEQ ID NO: 3178641 - RNA, 14 nt, Mycobacterium bovis subsp bovis AF2122/97
auuccgggccuggc

SEQ ID NO: 3178642 - RNA, 22 nt, Mycobacterium bovis subsp bovis AF2122/97
auuccgggccuggccugcccag

SEQ ID NO: 3178643 - RNA, 12 nt, Mycobacterium bovis subsp bovis AF2122/97
auuccgggucgg

SEQ ID NO: 3178644 - RNA, 21 nt, Mycobacterium bovis subsp bovis AF2122/97
auuccgggucggcgaacgccg

SEQ ID NO: 3178645 - RNA, 21 nt, Mycobacterium bovis subsp bovis AF2122/97
auuccggugugcuugcucggg

SEQ ID NO: 3178646 - RNA, 16 nt, Mycobacterium bovis subsp bovis AF2122/97
auuccuugauaacgac

SEQ ID NO: 3178647 - RNA, 14 nt, Mycobacterium bovis subsp bovis AF2122/97
auucgaagccgagc

SEQ ID NO: 3178648 - RNA, 20 nt, Mycobacterium bovis subsp bovis AF2122/97
auucgaaggucgguacccca

SEQ ID NO: 3178649 - RNA, 21 nt, Mycobacterium bovis subsp bovis AF2122/97
auucgacuucggggucaccgg

SEQ ID NO: 3178650 - RNA, 18 nt, Mycobacterium bovis subsp bovis AF2122/97
auucgccauagcgggcgg

SEQ ID NO: 3178651 - RNA, 12 nt, Mycobacterium bovis subsp bovis AF2122/97
auucgccgggcg

SEQ ID NO: 3178652 - RNA, 17 nt, Mycobacterium bovis subsp bovis AF2122/97
auucgcgacaacucgcg

SEQ ID NO: 3178653 - RNA, 22 nt, Mycobacterium bovis subsp bovis AF2122/97
auucgcgcagcauggugcggcg

SEQ ID NO: 3178654 - RNA, 15 nt, Mycobacterium bovis subsp bovis AF2122/97
auucgcgcuggccau

SEQ ID NO: 3178655 - RNA, 17 nt, Mycobacterium bovis subsp bovis AF2122/97
auucgcggcagccggcg

SEQ ID NO: 3178656 - RNA, 23 nt, Mycobacterium bovis subsp bovis AF2122/97
auucgcucaccaccgaccucgac

SEQ ID NO: 3178657 - RNA, 18 nt, Mycobacterium bovis subsp bovis AF2122/97
auucggccagcgcccgca

SEQ ID NO: 3178658 - RNA, 13 nt, Mycobacterium bovis subsp bovis AF2122/97
auucggccggcgc

SEQ ID NO: 3178659 - RNA, 16 nt, Mycobacterium bovis subsp bovis AF2122/97
auucggccguaucguc

SEQ ID NO: 3178660 - RNA, 13 nt, Mycobacterium bovis subsp bovis AF2122/97
auucggcgagccg

SEQ ID NO: 3178661 - RNA, 18 nt, Mycobacterium bovis subsp bovis AF2122/97
auucggcgagccgcgccc

SEQ ID NO: 3178662 - RNA, 22 nt, Mycobacterium bovis subsp bovis AF2122/97
auucggcggcauguucaucgca

SEQ ID NO: 3178663 - RNA, 13 nt, Mycobacterium bovis subsp bovis AF2122/97
auucggcugccac

SEQ ID NO: 3178664 - RNA, 16 nt, Mycobacterium bovis subsp bovis AF2122/97
auucggcugccaccgc

SEQ ID NO: 3178665 - RNA, 18 nt, Mycobacterium bovis subsp bovis AF2122/97
auucggcugccaccgcag

SEQ ID NO: 3178666 - RNA, 15 nt, Mycobacterium bovis subsp bovis AF2122/97
auucgggcgugcucg

SEQ ID NO: 3178667 - RNA, 18 nt, Mycobacterium bovis subsp bovis AF2122/97
auucggucucgaccgcgc

SEQ ID NO: 3178668 - RNA, 20 nt, Mycobacterium bovis subsp bovis AF2122/97
auucggugccagcaggccga

SEQ ID NO: 3178669 - RNA, 15 nt, Mycobacterium bovis subsp bovis AF2122/97
auucgguguggccgu

SEQ ID NO: 3178670 - RNA, 16 nt, Mycobacterium bovis subsp bovis AF2122/97
auucgugcccgggcgg

SEQ ID NO: 3178671 - RNA, 18 nt, Mycobacterium bovis subsp bovis AF2122/97
auucguggagccggccgu

SEQ ID NO: 3178672 - RNA, 21 nt, Mycobacterium bovis subsp bovis AF2122/97
auucgugggaaccaccagcac

SEQ ID NO: 3178673 - RNA, 18 nt, Mycobacterium bovis subsp bovis AF2122/97
auucguuggcgaacuggu

SEQ ID NO: 3178674 - RNA, 20 nt, Mycobacterium bovis subsp bovis AF2122/97
auucuagguucgaguccugg

SEQ ID NO: 3178675 - RNA, 19 nt, Mycobacterium bovis subsp bovis AF2122/97
auucucgagccaacgcauc

SEQ ID NO: 3178676 - RNA, 13 nt, Mycobacterium bovis subsp bovis AF2122/97
auucucggccggc

SEQ ID NO: 3178677 - RNA, 14 nt, Mycobacterium bovis subsp bovis AF2122/97
auucucggccggcg

SEQ ID NO: 3178678 - RNA, 18 nt, Mycobacterium bovis subsp bovis AF2122/97
auucucggccggcggcgc

SEQ ID NO: 3178679 - RNA, 20 nt, Mycobacterium bovis subsp bovis AF2122/97
auucucggccggcggcgccc

SEQ ID NO: 3178680 - RNA, 16 nt, Mycobacterium bovis subsp bovis AF2122/97
auucugacgaccggcu

SEQ ID NO: 3178681 - RNA, 12 nt, Mycobacterium bovis subsp bovis AF2122/97
auucugcgucug

SEQ ID NO: 3178682 - RNA, 13 nt, Mycobacterium bovis subsp bovis AF2122/97
auucuggugucau

SEQ ID NO: 3178683 - RNA, 19 nt, Mycobacterium bovis subsp bovis AF2122/97
auucuguugugccgcaagc

SEQ ID NO: 3178684 - RNA, 20 nt, Mycobacterium bovis subsp bovis AF2122/97
auugaacgaguagccggucg

SEQ ID NO: 3178685 - RNA, 19 nt, Mycobacterium bovis subsp bovis AF2122/97
auugaccaccgauauggcc

SEQ ID NO: 3178686 - RNA, 13 nt, Mycobacterium bovis subsp bovis AF2122/97
auugacccauccg

SEQ ID NO: 3178687 - RNA, 22 nt, Mycobacterium bovis subsp bovis AF2122/97
auugacccgacgaugccggccc

SEQ ID NO: 3178688 - RNA, 14 nt, Mycobacterium bovis subsp bovis AF2122/97
auugaccgcggccg

SEQ ID NO: 3178689 - RNA, 13 nt, Mycobacterium bovis subsp bovis AF2122/97
cacuccagcggcg

SEQ ID NO: 3178690 - RNA, 13 nt, Mycobacterium bovis subsp bovis AF2122/97
cacuccaugaucc

SEQ ID NO: 3178691 - RNA, 16 nt, Mycobacterium bovis subsp bovis AF2122/97
cacucccagccaaccc

SEQ ID NO: 3178692 - RNA, 14 nt, Mycobacterium bovis subsp bovis AF2122/97
cacuccccagcccc

SEQ ID NO: 3178693 - RNA, 16 nt, Mycobacterium bovis subsp bovis AF2122/97
cacuccccagccccac

SEQ ID NO: 3178694 - RNA, 23 nt, Mycobacterium bovis subsp bovis AF2122/97
cacucccccacacacccgacacg

SEQ ID NO: 3178695 - RNA, 14 nt, Mycobacterium bovis subsp bovis AF2122/97
cacucccgccccgc

SEQ ID NO: 3178696 - RNA, 16 nt, Mycobacterium bovis subsp bovis AF2122/97
cacucccggcucggcc

SEQ ID NO: 3178697 - RNA, 12 nt, Mycobacterium bovis subsp bovis AF2122/97
cacuccgccaac

SEQ ID NO: 3178698 - RNA, 12 nt, Mycobacterium bovis subsp bovis AF2122/97
cacuccgccgau

SEQ ID NO: 3178699 - RNA, 16 nt, Mycobacterium bovis subsp bovis AF2122/97
cacuccggcgacgauc

SEQ ID NO: 3178700 - RNA, 16 nt, Mycobacterium bovis subsp bovis AF2122/97
cacuccggcgaucucg

SEQ ID NO: 3178701 - RNA, 16 nt, Mycobacterium bovis subsp bovis AF2122/97
cacuccgggcucggcg

SEQ ID NO: 3178702 - RNA, 22 nt, Mycobacterium bovis subsp bovis AF2122/97
cacuccgggcucggcgucgccg

SEQ ID NO: 3178703 - RNA, 23 nt, Mycobacterium bovis subsp bovis AF2122/97
cacuccuagccaacgagcgcgcu

SEQ ID NO: 3178704 - RNA, 13 nt, Mycobacterium bovis subsp bovis AF2122/97
cacuccucggugu

SEQ ID NO: 3178705 - RNA, 17 nt, Mycobacterium bovis subsp bovis AF2122/97
cacuccugagaugcggc

SEQ ID NO: 3178706 - RNA, 15 nt, Mycobacterium bovis subsp bovis AF2122/97
cacuccugcacacag

SEQ ID NO: 3178707 - RNA, 21 nt, Mycobacterium bovis subsp bovis AF2122/97
cacuccugcacacaggacuug

SEQ ID NO: 3178708 - RNA, 18 nt, Mycobacterium bovis subsp bovis AF2122/97
cacuccugcaccaucggu

SEQ ID NO: 3178709 - RNA, 21 nt, Mycobacterium bovis subsp bovis AF2122/97
cacuccugcaccaucgguauc

SEQ ID NO: 3178710 - RNA, 19 nt, Mycobacterium bovis subsp bovis AF2122/97
cacucgaccaggaccggcu

SEQ ID NO: 3178711 - RNA, 13 nt, Mycobacterium bovis subsp bovis AF2122/97
cacucgacgucgu

SEQ ID NO: 3178712 - RNA, 18 nt, Mycobacterium bovis subsp bovis AF2122/97
cacucgauccggauucag

SEQ ID NO: 3178713 - RNA, 23 nt, Mycobacterium bovis subsp bovis AF2122/97
cacucgccagggccaucuggcug

SEQ ID NO: 3178714 - RNA, 15 nt, Mycobacterium bovis subsp bovis AF2122/97
cacucgcccgauccg

SEQ ID NO: 3178715 - RNA, 17 nt, Mycobacterium bovis subsp bovis AF2122/97
cacucgccgaaucgcug

SEQ ID NO: 3178716 - RNA, 19 nt, Mycobacterium bovis subsp bovis AF2122/97
cacucgccggcggacgccc

SEQ ID NO: 3178717 - RNA, 21 nt, Mycobacterium bovis subsp bovis AF2122/97
cacucgccggcggacgcccgg

SEQ ID NO: 3178718 - RNA, 23 nt, Mycobacterium bovis subsp bovis AF2122/97
cacucgccggcggacgcccggcg

SEQ ID NO: 3178719 - RNA, 17 nt, Mycobacterium bovis subsp bovis AF2122/97
cacucgcgccagugugg

SEQ ID NO: 3178720 - RNA, 21 nt, Mycobacterium bovis subsp bovis AF2122/97
cacucgcggauccgggcgugg

SEQ ID NO: 3178721 - RNA, 16 nt, Mycobacterium bovis subsp bovis AF2122/97
cacucgcucaggaaca

SEQ ID NO: 3178722 - RNA, 15 nt, Mycobacterium bovis subsp bovis AF2122/97
cacucggcccggcag

SEQ ID NO: 3178723 - RNA, 15 nt, Mycobacterium bovis subsp bovis AF2122/97
cacucggcccggccc

SEQ ID NO: 3178724 - RNA, 13 nt, Mycobacterium bovis subsp bovis AF2122/97
cacucggccgggc

SEQ ID NO: 3178725 - RNA, 13 nt, Mycobacterium bovis subsp bovis AF2122/97
cacucggcgcccu

SEQ ID NO: 3178726 - RNA, 17 nt, Mycobacterium bovis subsp bovis AF2122/97
cacucggcgguuccggc

SEQ ID NO: 3178727 - RNA, 15 nt, Mycobacterium bovis subsp bovis AF2122/97
cacucgggacuuccc

SEQ ID NO: 3178728 - RNA, 22 nt, Mycobacterium bovis subsp bovis AF2122/97
cacucggucguugccgcggucg

SEQ ID NO: 3178729 - RNA, 23 nt, Mycobacterium bovis subsp bovis AF2122/97
cacucggucguugccgcggucgg

SEQ ID NO: 3178730 - RNA, 16 nt, Mycobacterium bovis subsp bovis AF2122/97
cacucggugucggccg

SEQ ID NO: 3178731 - RNA, 14 nt, Mycobacterium bovis subsp bovis AF2122/97
cacucgucgucggu

SEQ ID NO: 3178732 - RNA, 17 nt, Mycobacterium bovis subsp bovis AF2122/97
cacucguugaccggccg

SEQ ID NO: 3178733 - RNA, 18 nt, Mycobacterium bovis subsp bovis AF2122/97
cacucguugaccggccgg

SEQ ID NO: 3178734 - RNA, 14 nt, Mycobacterium bovis subsp bovis AF2122/97
cacucucgccacgc

SEQ ID NO: 3178735 - RNA, 14 nt, Mycobacterium bovis subsp bovis AF2122/97
cacucucggcgcuc

SEQ ID NO: 3178736 - RNA, 23 nt, Mycobacterium bovis subsp bovis AF2122/97
cacucucggugaacgccgccccg

SEQ ID NO: 3178737 - RNA, 20 nt, Mycobacterium bovis subsp bovis AF2122/97
cacucuggcgagggcuaccg

SEQ ID NO: 3178738 - RNA, 22 nt, Mycobacterium bovis subsp bovis AF2122/97
cacucuggcgagggcuaccggc

SEQ ID NO: 3178739 - RNA, 17 nt, Mycobacterium bovis subsp bovis AF2122/97
cacucuucgggcggcgu

SEQ ID NO: 3178740 - RNA, 22 nt, Mycobacterium bovis subsp bovis AF2122/97
cacugaaccguucgacccagcg

SEQ ID NO: 3178741 - RNA, 21 nt, Mycobacterium bovis subsp bovis AF2122/97
cacugaccaggucugcggugc

SEQ ID NO: 3178742 - RNA, 15 nt, Mycobacterium bovis subsp bovis AF2122/97
cacugaccccgccgc

SEQ ID NO: 3178743 - RNA, 16 nt, Mycobacterium bovis subsp bovis AF2122/97
cacugaccccgccgcc

SEQ ID NO: 3178744 - RNA, 21 nt, Mycobacterium bovis subsp bovis AF2122/97
cacugaccgaacgcaacagcc

SEQ ID NO: 3178745 - RNA, 21 nt, Mycobacterium bovis subsp bovis AF2122/97
cacugaccgcgaucgccgacg

SEQ ID NO: 3178746 - RNA, 17 nt, Mycobacterium bovis subsp bovis AF2122/97
cacugacgcgcccgacg

SEQ ID NO: 3178747 - RNA, 21 nt, Mycobacterium bovis subsp bovis AF2122/97
cacugacgcgcccgacgaaca

SEQ ID NO: 3178748 - RNA, 20 nt, Mycobacterium bovis subsp bovis AF2122/97
cacugacgucucaucaaacc

SEQ ID NO: 3178749 - RNA, 13 nt, Mycobacterium bovis subsp bovis AF2122/97
cacugagauccag

SEQ ID NO: 3178750 - RNA, 14 nt, Mycobacterium bovis subsp bovis AF2122/97
cacugagccacagg

SEQ ID NO: 3178751 - RNA, 20 nt, Mycobacterium bovis subsp bovis AF2122/97
cacugaggagaugagcacca

SEQ ID NO: 3178752 - RNA, 18 nt, Mycobacterium bovis subsp bovis AF2122/97
cacugaugucacccgccc

SEQ ID NO: 3178753 - RNA, 22 nt, Mycobacterium bovis subsp bovis AF2122/97
cacugcagugaucgugaccggc

SEQ ID NO: 3178754 - RNA, 12 nt, Mycobacterium bovis subsp bovis AF2122/97
cacugccaccgc

SEQ ID NO: 3178755 - RNA, 13 nt, Mycobacterium bovis subsp bovis AF2122/97
cacugccaccgcg

SEQ ID NO: 3178756 - RNA, 12 nt, Mycobacterium bovis subsp bovis AF2122/97
cacugccagccg

SEQ ID NO: 3178757 - RNA, 14 nt, Mycobacterium bovis subsp bovis AF2122/97
cacugcccagcaga

SEQ ID NO: 3178758 - RNA, 16 nt, Mycobacterium bovis subsp bovis AF2122/97
cacugcccagcagacc

SEQ ID NO: 3178759 - RNA, 22 nt, Mycobacterium bovis subsp bovis AF2122/97
cacugcccgggguccaucgggg

SEQ ID NO: 3178760 - RNA, 15 nt, Mycobacterium bovis subsp bovis AF2122/97
cacugcccggggugc

SEQ ID NO: 3178761 - RNA, 15 nt, Mycobacterium bovis subsp bovis AF2122/97
cacugcccucaacga

SEQ ID NO: 3178762 - RNA, 20 nt, Mycobacterium bovis subsp bovis AF2122/97
cacugcccucaacgaucgcg

SEQ ID NO: 3178763 - RNA, 21 nt, Mycobacterium bovis subsp bovis AF2122/97
cacugcccucaacgaucgcgc

SEQ ID NO: 3178764 - RNA, 20 nt, Mycobacterium bovis subsp bovis AF2122/97
cacugccgagcacgacgacg

SEQ ID NO: 3178765 - RNA, 22 nt, Mycobacterium bovis subsp bovis AF2122/97
cacugccgccgguuccgccggc

SEQ ID NO: 3178766 - RNA, 15 nt, Mycobacterium bovis subsp bovis AF2122/97
cacugccgcgcgccc

SEQ ID NO: 3178767 - RNA, 13 nt, Mycobacterium bovis subsp bovis AF2122/97
cacugccggcacg

SEQ ID NO: 3178768 - RNA, 16 nt, Mycobacterium bovis subsp bovis AF2122/97
cacugccggcacgccg

SEQ ID NO: 3178769 - RNA, 17 nt, Mycobacterium bovis subsp bovis AF2122/97
cacugccggcacgccga

SEQ ID NO: 3178770 - RNA, 15 nt, Mycobacterium bovis subsp bovis AF2122/97
cacugccgugccggu

SEQ ID NO: 3178771 - RNA, 16 nt, Mycobacterium bovis subsp bovis AF2122/97
cacugccguugccgcc

SEQ ID NO: 3178772 - RNA, 17 nt, Mycobacterium bovis subsp bovis AF2122/97
cacugccguugccgccg

SEQ ID NO: 3178773 - RNA, 20 nt, Mycobacterium bovis subsp bovis AF2122/97
cacugccguugccgccggug

SEQ ID NO: 3178774 - RNA, 22 nt, Mycobacterium bovis subsp bovis AF2122/97
cacugcgaccgucccggccucg

SEQ ID NO: 3178775 - RNA, 10 nt, Mycobacterium bovis subsp bovis AF2122/97
cacugcgagc

SEQ ID NO: 3178776 - RNA, 12 nt, Mycobacterium bovis subsp bovis AF2122/97
cacugcgagcgc

SEQ ID NO: 3178777 - RNA, 16 nt, Mycobacterium bovis subsp bovis AF2122/97
cacugcgagcgccggc

SEQ ID NO: 3178778 - RNA, 17 nt, Mycobacterium bovis subsp bovis AF2122/97
cacugcgagcgccggcu

SEQ ID NO: 3178779 - RNA, 18 nt, Mycobacterium bovis subsp bovis AF2122/97
cacugcgagggcacgcgc

SEQ ID NO: 3178780 - RNA, 17 nt, Mycobacterium bovis subsp bovis AF2122/97
cacugcgaucgcgaccc

SEQ ID NO: 3178781 - RNA, 12 nt, Mycobacterium bovis subsp bovis AF2122/97
cacugcgcccgc

SEQ ID NO: 3178782 - RNA, 15 nt, Mycobacterium bovis subsp bovis AF2122/97
cacugcgccggccgg

SEQ ID NO: 3178783 - RNA, 16 nt, Mycobacterium bovis subsp bovis AF2122/97
cacugcgccgugaccc

SEQ ID NO: 3178784 - RNA, 17 nt, Mycobacterium bovis subsp bovis AF2122/97
cacugcgccgugaccca

SEQ ID NO: 3178785 - RNA, 23 nt, Mycobacterium bovis subsp bovis AF2122/97
cacugcggcgcugggacggucgc

SEQ ID NO: 3178786 - RNA, 20 nt, Mycobacterium bovis subsp bovis AF2122/97
cacugcguuccaucgccgac

SEQ ID NO: 3178787 - RNA, 21 nt, Mycobacterium bovis subsp bovis AF2122/97
cacugcguuccaucgccgacg

SEQ ID NO: 3178788 - RNA, 17 nt, Mycobacterium bovis subsp bovis AF2122/97
cacugcucgucgcgcau

SEQ ID NO: 3178789 - RNA, 16 nt, Mycobacterium bovis subsp bovis AF2122/97
cacugcugcggcagcg

SEQ ID NO: 3178790 - RNA, 22 nt, Mycobacterium bovis subsp bovis AF2122/97
cacugcuggucagguaucgggg

SEQ ID NO: 3178791 - RNA, 23 nt, Mycobacterium bovis subsp bovis AF2122/97
cacuggacccgcccaggcgucca

SEQ ID NO: 3178792 - RNA, 18 nt, Mycobacterium bovis subsp bovis AF2122/97
cacuggcacacggucacc

SEQ ID NO: 3178793 - RNA, 19 nt, Mycobacterium bovis subsp bovis AF2122/97
cacuggcacacggucaccg

SEQ ID NO: 3178794 - RNA, 22 nt, Mycobacterium bovis subsp bovis AF2122/97
cacuggcacacggucaccggca

SEQ ID NO: 3178795 - RNA, 14 nt, Mycobacterium bovis subsp bovis AF2122/97
cacuggccgucggc

SEQ ID NO: 3178796 - RNA, 13 nt, Mycobacterium bovis subsp bovis AF2122/97
cacuggcgccggu

SEQ ID NO: 3178797 - RNA, 18 nt, Mycobacterium bovis subsp bovis AF2122/97
cacuggcgccggugccgc

SEQ ID NO: 3178798 - RNA, 15 nt, Mycobacterium bovis subsp bovis AF2122/97
cacuggcgcugaucg

SEQ ID NO: 3178799 - RNA, 19 nt, Mycobacterium bovis subsp bovis AF2122/97
cacuggcgguguaacccgg

SEQ ID NO: 3178800 - RNA, 18 nt, Mycobacterium bovis subsp bovis AF2122/97
cacuggggaggccaaccc

SEQ ID NO: 3178801 - RNA, 14 nt, Mycobacterium bovis subsp bovis AF2122/97
cacuggggccccgg

SEQ ID NO: 3178802 - RNA, 22 nt, Mycobacterium bovis subsp bovis AF2122/97
cacuggggccccgggaagugaa

SEQ ID NO: 3178803 - RNA, 21 nt, Mycobacterium bovis subsp bovis AF2122/97
cacuggggugcugcgcgcggc

SEQ ID NO: 3178804 - RNA, 23 nt, Mycobacterium bovis subsp bovis AF2122/97
cacuggggugcugcgcgcggcgg

SEQ ID NO: 3178805 - RNA, 16 nt, Mycobacterium bovis subsp bovis AF2122/97
cacuggugacccugau

SEQ ID NO: 3178806 - RNA, 19 nt, Mycobacterium bovis subsp bovis AF2122/97
cacuggugcagcgccgaca

SEQ ID NO: 3178807 - RNA, 23 nt, Mycobacterium bovis subsp bovis AF2122/97
cacuggugcagcgccgacagccg

SEQ ID NO: 3178808 - RNA, 17 nt, Mycobacterium bovis subsp bovis AF2122/97
cacugguggcgauccgu

SEQ ID NO: 3178809 - RNA, 18 nt, Mycobacterium bovis subsp bovis AF2122/97
cacugucggguaacccca

SEQ ID NO: 3178810 - RNA, 14 nt, Mycobacterium bovis subsp bovis AF2122/97
cacugugaggucau

SEQ ID NO: 3178811 - RNA, 13 nt, Mycobacterium bovis subsp bovis AF2122/97
cacugugcucgcc

SEQ ID NO: 3178812 - RNA, 16 nt, Mycobacterium bovis subsp bovis AF2122/97
cacuguuacggccaca

SEQ ID NO: 3178813 - RNA, 18 nt, Mycobacterium bovis subsp bovis AF2122/97
cacuguuacggccacacc

SEQ ID NO: 3178814 - RNA, 19 nt, Mycobacterium bovis subsp bovis AF2122/97
cacuguugaagaagcccga

SEQ ID NO: 3178815 - RNA, 18 nt, Mycobacterium bovis subsp bovis AF2122/97
cacuguugcccaauucga

SEQ ID NO: 3178816 - RNA, 22 nt, Mycobacterium bovis subsp bovis AF2122/97
cacuguuggugccgccaccacc

SEQ ID NO: 3178817 - RNA, 22 nt, Mycobacterium bovis subsp bovis AF2122/97
cacuguuucugagcgcgcuggc

SEQ ID NO: 3178818 - RNA, 17 nt, Mycobacterium bovis subsp bovis AF2122/97
cacuuaccgagccguca

SEQ ID NO: 3178819 - RNA, 16 nt, Mycobacterium bovis subsp bovis AF2122/97
cacuucacgccgcccc

SEQ ID NO: 3178820 - RNA, 17 nt, Mycobacterium bovis subsp bovis AF2122/97
cacuucacgccgccccu

SEQ ID NO: 3178821 - RNA, 16 nt, Mycobacterium bovis subsp bovis AF2122/97
cacuuccagcccggca

SEQ ID NO: 3178822 - RNA, 17 nt, Mycobacterium bovis subsp bovis AF2122/97
cacuuccagcccggcaa

SEQ ID NO: 3178823 - RNA, 16 nt, Mycobacterium bovis subsp bovis AF2122/97
cacuucccaggauccg

SEQ ID NO: 3178824 - RNA, 16 nt, Mycobacterium bovis subsp bovis AF2122/97
cacuucccccgggucc

SEQ ID NO: 3178825 - RNA, 14 nt, Mycobacterium bovis subsp bovis AF2122/97
cacuuccggcgugg

SEQ ID NO: 3178826 - RNA, 12 nt, Mycobacterium bovis subsp bovis AF2122/97
cacuucggcgcc

SEQ ID NO: 3178827 - RNA, 15 nt, Mycobacterium bovis subsp bovis AF2122/97
cacuucggcgccgcg

SEQ ID NO: 3178828 - RNA, 17 nt, Mycobacterium bovis subsp bovis AF2122/97
cacuucggcgccgcgcc

SEQ ID NO: 3178829 - RNA, 22 nt, Mycobacterium bovis subsp bovis AF2122/97
cacuucggugccgugaucggcg

SEQ ID NO: 3178830 - RNA, 21 nt, Mycobacterium bovis subsp bovis AF2122/97
cacuugaaguucuucuccguc

SEQ ID NO: 3178831 - RNA, 12 nt, Mycobacterium bovis subsp bovis AF2122/97
cacuugaugcuc

SEQ ID NO: 3178832 - RNA, 14 nt, Mycobacterium bovis subsp bovis AF2122/97
cacuugcccgucgg

SEQ ID NO: 3178833 - RNA, 16 nt, Mycobacterium bovis subsp bovis AF2122/97
cacuugcccgucggcg

SEQ ID NO: 3178834 - RNA, 13 nt, Mycobacterium bovis subsp bovis AF2122/97
cacuugccgggca

SEQ ID NO: 3178835 - RNA, 20 nt, Mycobacterium bovis subsp bovis AF2122/97
cacuugcucggugagccucu

SEQ ID NO: 3178836 - RNA, 13 nt, Mycobacterium bovis subsp bovis AF2122/97
cacuuggacccgg

SEQ ID NO: 3178837 - RNA, 14 nt, Mycobacterium bovis subsp bovis AF2122/97
cacuuggacgaaca

SEQ ID NO: 3178838 - RNA, 16 nt, Mycobacterium bovis subsp bovis AF2122/97
cacuuggaugcgaccc

SEQ ID NO: 3178839 - RNA, 22 nt, Mycobacterium bovis subsp bovis AF2122/97
cacuuucagaucgaucugcggg

SEQ ID NO: 3178840 - RNA, 22 nt, Mycobacterium bovis subsp bovis AF2122/97
cacuuuccgaggagggccgcga

SEQ ID NO: 3178841 - RNA, 16 nt, Mycobacterium bovis subsp bovis AF2122/97
cacuuucgacccgcgg

SEQ ID NO: 3178842 - RNA, 12 nt, Mycobacterium bovis subsp bovis AF2122/97
cacuuucuuccu

SEQ ID NO: 3178843 - RNA, 21 nt, Mycobacterium bovis subsp bovis AF2122/97
cacuuuguagcccgcgaucuc

SEQ ID NO: 3178844 - RNA, 19 nt, Mycobacterium bovis subsp bovis AF2122/97
cacuuuuccgccggccagg

SEQ ID NO: 3178845 - RNA, 18 nt, Mycobacterium bovis subsp bovis AF2122/97
cacuuuucgguggcggca

SEQ ID NO: 3178846 - RNA, 21 nt, Mycobacterium bovis subsp bovis AF2122/97
cagaaaacccucgcugcggug

SEQ ID NO: 3178847 - RNA, 15 nt, Mycobacterium bovis subsp bovis AF2122/97
cagaaacaacgucgc

SEQ ID NO: 3178848 - RNA, 20 nt, Mycobacterium bovis subsp bovis AF2122/97
cagaaacaucgacagcauca

SEQ ID NO: 3178849 - RNA, 19 nt, Mycobacterium bovis subsp bovis AF2122/97
cagaaaccccaaacaaccc

SEQ ID NO: 3178850 - RNA, 14 nt, Mycobacterium bovis subsp bovis AF2122/97
cagaaaccggguag

SEQ ID NO: 3178851 - RNA, 17 nt, Mycobacterium bovis subsp bovis AF2122/97
cagaaacgcgauggugg

SEQ ID NO: 3178852 - RNA, 20 nt, Mycobacterium bovis subsp bovis AF2122/97
cagaaaugguucgcacaccu

SEQ ID NO: 3178853 - RNA, 19 nt, Mycobacterium bovis subsp bovis AF2122/97
cagaacaauuucgaccuug

SEQ ID NO: 3178854 - RNA, 12 nt, Mycobacterium bovis subsp bovis AF2122/97
cagaacaccacc

SEQ ID NO: 3178855 - RNA, 13 nt, Mycobacterium bovis subsp bovis AF2122/97
cagaacaccaccg

SEQ ID NO: 3178856 - RNA, 17 nt, Mycobacterium bovis subsp bovis AF2122/97
cagaacaccaccgccag

SEQ ID NO: 3178857 - RNA, 23 nt, Mycobacterium bovis subsp bovis AF2122/97
cagaacaccggccaggccggcgg

SEQ ID NO: 3178858 - RNA, 20 nt, Mycobacterium bovis subsp bovis AF2122/97
cagaacaguaucgccggagu

SEQ ID NO: 3178859 - RNA, 14 nt, Mycobacterium bovis subsp bovis AF2122/97
cagaacaugccgga

SEQ ID NO: 3178860 - RNA, 21 nt, Mycobacterium bovis subsp bovis AF2122/97
cagaaccacuuuccgaggagg

SEQ ID NO: 3178861 - RNA, 22 nt, Mycobacterium bovis subsp bovis AF2122/97
cagaaccgaagccucggcaugc

SEQ ID NO: 3178862 - RNA, 15 nt, Mycobacterium bovis subsp bovis AF2122/97
cagaaccgacggcca

SEQ ID NO: 3178863 - RNA, 16 nt, Mycobacterium bovis subsp bovis AF2122/97
cagaaccgacggccag

SEQ ID NO: 3178864 - RNA, 17 nt, Mycobacterium bovis subsp bovis AF2122/97
cagaaccggcucaagga

SEQ ID NO: 3178865 - RNA, 14 nt, Mycobacterium bovis subsp bovis AF2122/97
cagaaccggugcgg

SEQ ID NO: 3178866 - RNA, 18 nt, Mycobacterium bovis subsp bovis AF2122/97
cagaaccuggagccgugc

SEQ ID NO: 3178867 - RNA, 19 nt, Mycobacterium bovis subsp bovis AF2122/97
cagaaccuggagccgugcg

SEQ ID NO: 3178868 - RNA, 15 nt, Mycobacterium bovis subsp bovis AF2122/97
cagaacgacaccgcu

SEQ ID NO: 3178869 - RNA, 22 nt, Mycobacterium bovis subsp bovis AF2122/97
cagaacgcaucggucccacugc

SEQ ID NO: 3178870 - RNA, 22 nt, Mycobacterium bovis subsp bovis AF2122/97
cagaacgccguccacgccgacg

SEQ ID NO: 3178871 - RNA, 15 nt, Mycobacterium bovis subsp bovis AF2122/97
cagaacgcggccucg

SEQ ID NO: 3178872 - RNA, 22 nt, Mycobacterium bovis subsp bovis AF2122/97
cagaacggaauucagcgacgcu

SEQ ID NO: 3178873 - RNA, 14 nt, Mycobacterium bovis subsp bovis AF2122/97
cagaacggcggcag

SEQ ID NO: 3178874 - RNA, 14 nt, Mycobacterium bovis subsp bovis AF2122/97
cagaacggcgucga

SEQ ID NO: 3178875 - RNA, 23 nt, Mycobacterium bovis subsp bovis AF2122/97
cagaacgguggcgcggugccggc

SEQ ID NO: 3178876 - RNA, 20 nt, Mycobacterium bovis subsp bovis AF2122/97
cagaacguggccauccucga

SEQ ID NO: 3178877 - RNA, 16 nt, Mycobacterium bovis subsp bovis AF2122/97
cagaacucaccgacgg

SEQ ID NO: 3178878 - RNA, 21 nt, Mycobacterium bovis subsp bovis AF2122/97
cagaagcccccaaaccggcgg

SEQ ID NO: 3178879 - RNA, 14 nt, Mycobacterium bovis subsp bovis AF2122/97
cagaaggccagcga

SEQ ID NO: 3178880 - RNA, 15 nt, Mycobacterium bovis subsp bovis AF2122/97
cagaaggccagcgaa

SEQ ID NO: 3178881 - RNA, 16 nt, Mycobacterium bovis subsp bovis AF2122/97
cagaaggccgcaccgc

SEQ ID NO: 3178882 - RNA, 20 nt, Mycobacterium bovis subsp bovis AF2122/97
cagaaguugauggucaaugc

SEQ ID NO: 3178883 - RNA, 16 nt, Mycobacterium bovis subsp bovis AF2122/97
cagaaucaggcucgcc

SEQ ID NO: 3178884 - RNA, 22 nt, Mycobacterium bovis subsp bovis AF2122/97
cagaaucaggcucgccgaugcu

SEQ ID NO: 3178885 - RNA, 20 nt, Mycobacterium bovis subsp bovis AF2122/97
cagaaucccaacuccuccaa

SEQ ID NO: 3178886 - RNA, 23 nt, Mycobacterium bovis subsp bovis AF2122/97
cagaauccggcaaccaccggccg

SEQ ID NO: 3178887 - RNA, 17 nt, Mycobacterium bovis subsp bovis AF2122/97
cagaauccggucgauga

SEQ ID NO: 3178888 - RNA, 18 nt, Mycobacterium bovis subsp bovis AF2122/97
cagaauccugcgcugcac

SEQ ID NO: 3178889 - RNA, 17 nt, Mycobacterium bovis subsp bovis AF2122/97
cagaaucgaccgccgcu

SEQ ID NO: 3178890 - RNA, 13 nt, Mycobacterium bovis subsp bovis AF2122/97
cagaaucgcacgc

SEQ ID NO: 3178891 - RNA, 18 nt, Mycobacterium bovis subsp bovis AF2122/97
cagaaucgcacgcgaaau

SEQ ID NO: 3178892 - RNA, 18 nt, Mycobacterium bovis subsp bovis AF2122/97
cagaaucgcauugggcgg

SEQ ID NO: 3178893 - RNA, 16 nt, Mycobacterium bovis subsp bovis AF2122/97
cagaaucggugggcgg

SEQ ID NO: 3178894 - RNA, 18 nt, Mycobacterium bovis subsp bovis AF2122/97
cagaaucucgccgggcug

SEQ ID NO: 3178895 - RNA, 14 nt, Mycobacterium bovis subsp bovis AF2122/97
cagaaucugccucu

SEQ ID NO: 3178896 - RNA, 18 nt, Mycobacterium bovis subsp bovis AF2122/97
cagaaucugccucucagc

SEQ ID NO: 3178897 - RNA, 12 nt, Mycobacterium bovis subsp bovis AF2122/97
cagaaugccgaa

SEQ ID NO: 3178898 - RNA, 15 nt, Mycobacterium bovis subsp bovis AF2122/97
cagaauguucuccac

SEQ ID NO: 3178899 - RNA, 15 nt, Mycobacterium bovis subsp bovis AF2122/97
cagaauuccggcgga

SEQ ID NO: 3178900 - RNA, 17 nt, Mycobacterium bovis subsp bovis AF2122/97
cagaauucggcgcgaca

SEQ ID NO: 3178901 - RNA, 21 nt, Mycobacterium bovis subsp bovis AF2122/97
cagaauucggcgcgacagccg

SEQ ID NO: 3178902 - RNA, 13 nt, Mycobacterium bovis subsp bovis AF2122/97
cagaauugccggc

SEQ ID NO: 3178903 - RNA, 19 nt, Mycobacterium bovis subsp bovis AF2122/97
cagaauugugugcagcagc

SEQ ID NO: 3178904 - RNA, 16 nt, Mycobacterium bovis subsp bovis AF2122/97
cagacaacgccgucga

SEQ ID NO: 3178905 - RNA, 19 nt, Mycobacterium bovis subsp bovis AF2122/97
cagacaacgccgucgaugu

SEQ ID NO: 3178906 - RNA, 17 nt, Mycobacterium bovis subsp bovis AF2122/97
cagacaauccgccgccg

SEQ ID NO: 3178907 - RNA, 18 nt, Mycobacterium bovis subsp bovis AF2122/97
cagacaauccgccgccgg

SEQ ID NO: 3178908 - RNA, 18 nt, Mycobacterium bovis subsp bovis AF2122/97
cagacacuaaagcccucg

SEQ ID NO: 3178909 - RNA, 23 nt, Mycobacterium bovis subsp bovis AF2122/97
cagacacugcugcggcagcgcgg

SEQ ID NO: 3178910 - RNA, 14 nt, Mycobacterium bovis subsp bovis AF2122/97
cagacacuggccgu

SEQ ID NO: 3178911 - RNA, 18 nt, Mycobacterium bovis subsp bovis AF2122/97
cagacacuggccgucggc

SEQ ID NO: 3178912 - RNA, 20 nt, Mycobacterium bovis subsp bovis AF2122/97
cagacacuggccgucggcgu

SEQ ID NO: 3178913 - RNA, 19 nt, Mycobacterium bovis subsp bovis AF2122/97
cagacacuggucgcggcgc

SEQ ID NO: 3178914 - RNA, 14 nt, Mycobacterium bovis subsp bovis AF2122/97
cagacaggauugcc

SEQ ID NO: 3178915 - RNA, 19 nt, Mycobacterium bovis subsp bovis AF2122/97
cagacaggcggcggccugg

SEQ ID NO: 3178916 - RNA, 20 nt, Mycobacterium bovis subsp bovis AF2122/97
cagacaucagugcgccggcg

SEQ ID NO: 3178917 - RNA, 14 nt, Mycobacterium bovis subsp bovis AF2122/97
cagacaucgcgacg

SEQ ID NO: 3178918 - RNA, 17 nt, Mycobacterium bovis subsp bovis AF2122/97
cagacaucgcgacgauc

SEQ ID NO: 3178919 - RNA, 16 nt, Mycobacterium bovis subsp bovis AF2122/97
cagacaucggagauca

SEQ ID NO: 3178920 - RNA, 11 nt, Mycobacterium bovis subsp bovis AF2122/97
cagacauggca

SEQ ID NO: 3178921 - RNA, 21 nt, Mycobacterium bovis subsp bovis AF2122/97
cagacauggcaagucaacacc

SEQ ID NO: 3178922 - RNA, 23 nt, Mycobacterium bovis subsp bovis AF2122/97
cagacauggcaagucaacaccgc

SEQ ID NO: 3178923 - RNA, 13 nt, Mycobacterium bovis subsp bovis AF2122/97
cagaccaacauga

SEQ ID NO: 3178924 - RNA, 19 nt, Mycobacterium bovis subsp bovis AF2122/97
cagaccaacaugaacguca

SEQ ID NO: 3178925 - RNA, 10 nt, Mycobacterium bovis subsp bovis AF2122/97
cagaccaacg

SEQ ID NO: 3178926 - RNA, 12 nt, Mycobacterium bovis subsp bovis AF2122/97
cagaccaagccc

SEQ ID NO: 3178927 - RNA, 22 nt, Mycobacterium bovis subsp bovis AF2122/97
cagaccaagcccgucgucgugc

SEQ ID NO: 3178928 - RNA, 23 nt, Mycobacterium bovis subsp bovis AF2122/97
cagaccaaggcgaagguccgugc

SEQ ID NO: 3178929 - RNA, 22 nt, Mycobacterium bovis subsp bovis AF2122/97
cagaccaaugaccgccagcagc

SEQ ID NO: 3178930 - RNA, 23 nt, Mycobacterium bovis subsp bovis AF2122/97
cagaccaaugaccgccagcagca

SEQ ID NO: 3178931 - RNA, 14 nt, Mycobacterium bovis subsp bovis AF2122/97
cagaccaccgccug

SEQ ID NO: 3178932 - RNA, 16 nt, Mycobacterium bovis subsp bovis AF2122/97
cagaccauccagguug

SEQ ID NO: 3178933 - RNA, 14 nt, Mycobacterium bovis subsp bovis AF2122/97
cagacccaccaccg

SEQ ID NO: 3178934 - RNA, 15 nt, Mycobacterium bovis subsp bovis AF2122/97
cagacccaccaccgc

SEQ ID NO: 3178935 - RNA, 14 nt, Mycobacterium bovis subsp bovis AF2122/97
cagacccagcucgu

SEQ ID NO: 3178936 - RNA, 19 nt, Mycobacterium bovis subsp bovis AF2122/97
cagacccagcucgucgacg

SEQ ID NO: 3178937 - RNA, 22 nt, Mycobacterium bovis subsp bovis AF2122/97
cagacccaguccgguagcagcg

SEQ ID NO: 3178938 - RNA, 22 nt, Mycobacterium bovis subsp bovis AF2122/97
cagacccgaauccaccagcugg

SEQ ID NO: 3178939 - RNA, 16 nt, Mycobacterium bovis subsp bovis AF2122/97
cagacccgguaguccg

SEQ ID NO: 3178940 - RNA, 14 nt, Mycobacterium bovis subsp bovis AF2122/97
cagacccgugccgu

SEQ ID NO: 3178941 - RNA, 22 nt, Mycobacterium bovis subsp bovis AF2122/97
cagacccgugccgucaacgaug

SEQ ID NO: 3178942 - RNA, 18 nt, Mycobacterium bovis subsp bovis AF2122/97
cagacccguucgccgucg

SEQ ID NO: 3178943 - RNA, 21 nt, Mycobacterium bovis subsp bovis AF2122/97
cagacccguugcccaacccgg

SEQ ID NO: 3178944 - RNA, 17 nt, Mycobacterium bovis subsp bovis AF2122/97
cagaccgaacagcaccg

SEQ ID NO: 3178945 - RNA, 12 nt, Mycobacterium bovis subsp bovis AF2122/97
cagaccgacccg

SEQ ID NO: 3178946 - RNA, 13 nt, Mycobacterium bovis subsp bovis AF2122/97
cagaccgaucggc

SEQ ID NO: 3178947 - RNA, 14 nt, Mycobacterium bovis subsp bovis AF2122/97
cagaccgcaccauu

SEQ ID NO: 3178948 - RNA, 17 nt, Mycobacterium bovis subsp bovis AF2122/97
cagaccgccaccggcug

SEQ ID NO: 3178949 - RNA, 21 nt, Mycobacterium bovis subsp bovis AF2122/97
cagaccgccaccggcugauuc

SEQ ID NO: 3178950 - RNA, 12 nt, Mycobacterium bovis subsp bovis AF2122/97
cagaccgccgac

SEQ ID NO: 3178951 - RNA, 14 nt, Mycobacterium bovis subsp bovis AF2122/97
cagaccgccgacgc

SEQ ID NO: 3178952 - RNA, 18 nt, Mycobacterium bovis subsp bovis AF2122/97
cagaccggaaacagcaug

SEQ ID NO: 3178953 - RNA, 21 nt, Mycobacterium bovis subsp bovis AF2122/97
cagaccggaaacagcauggcg

SEQ ID NO: 3178954 - RNA, 12 nt, Mycobacterium bovis subsp bovis AF2122/97
cagaccggcauc

SEQ ID NO: 3178955 - RNA, 14 nt, Mycobacterium bovis subsp bovis AF2122/97
cagaccggcaucga

SEQ ID NO: 3178956 - RNA, 15 nt, Mycobacterium bovis subsp bovis AF2122/97
cagaccggccgacgu

SEQ ID NO: 3178957 - RNA, 16 nt, Mycobacterium bovis subsp bovis AF2122/97
cagaccggccgacgug

SEQ ID NO: 3178958 - RNA, 16 nt, Mycobacterium bovis subsp bovis AF2122/97
cagaccggcgccguag

SEQ ID NO: 3178959 - RNA, 20 nt, Mycobacterium bovis subsp bovis AF2122/97
cagaccggcgccguagccga

SEQ ID NO: 3178960 - RNA, 17 nt, Mycobacterium bovis subsp bovis AF2122/97
cagaccggcucgucggg

SEQ ID NO: 3178961 - RNA, 16 nt, Mycobacterium bovis subsp bovis AF2122/97
cagaccgggcaccaga

SEQ ID NO: 3178962 - RNA, 12 nt, Mycobacterium bovis subsp bovis AF2122/97
cagaccgggccc

SEQ ID NO: 3178963 - RNA, 22 nt, Mycobacterium bovis subsp bovis AF2122/97
cagaccgguuucuucggccagc

SEQ ID NO: 3178964 - RNA, 16 nt, Mycobacterium bovis subsp bovis AF2122/97
cagaccguccagcaac

SEQ ID NO: 3178965 - RNA, 21 nt, Mycobacterium bovis subsp bovis AF2122/97
cagaccguccagcaacagcga

SEQ ID NO: 3178966 - RNA, 13 nt, Mycobacterium bovis subsp bovis AF2122/97
cagaccgugacgu

SEQ ID NO: 3178967 - RNA, 16 nt, Mycobacterium bovis subsp bovis AF2122/97
cagaccuagcaccgcg

SEQ ID NO: 3178968 - RNA, 19 nt, Mycobacterium bovis subsp bovis AF2122/97
cagaccuagcaccgcgccg

SEQ ID NO: 3178969 - RNA, 21 nt, Mycobacterium bovis subsp bovis AF2122/97
cagaccuagcaccgcgccgaa

SEQ ID NO: 3178970 - RNA, 18 nt, Mycobacterium bovis subsp bovis AF2122/97
cagacgaaguagccgacc

SEQ ID NO: 3178971 - RNA, 19 nt, Mycobacterium bovis subsp bovis AF2122/97
cagacgaaguagccgacca

SEQ ID NO: 3178972 - RNA, 14 nt, Mycobacterium bovis subsp bovis AF2122/97
cagacgacgaucag

SEQ ID NO: 3178973 - RNA, 16 nt, Mycobacterium bovis subsp bovis AF2122/97
cagacgacgaucgcgu

SEQ ID NO: 3178974 - RNA, 14 nt, Mycobacterium bovis subsp bovis AF2122/97
cagacgauggccag

SEQ ID NO: 3178975 - RNA, 16 nt, Mycobacterium bovis subsp bovis AF2122/97
cagacgauggccaggu

SEQ ID NO: 3178976 - RNA, 20 nt, Mycobacterium bovis subsp bovis AF2122/97
cagacgcaaaagccaccgca

SEQ ID NO: 3178977 - RNA, 22 nt, Mycobacterium bovis subsp bovis AF2122/97
cagacgcaaaagccaccgcacg

SEQ ID NO: 3178978 - RNA, 19 nt, Mycobacterium bovis subsp bovis AF2122/97
cagacgcaaaagcccccua

SEQ ID NO: 3178979 - RNA, 21 nt, Mycobacterium bovis subsp bovis AF2122/97
cagacgcaaaauccccucgca

SEQ ID NO: 3178980 - RNA, 18 nt, Mycobacterium bovis subsp bovis AF2122/97
cagacgcaaaaucgccca

SEQ ID NO: 3178981 - RNA, 19 nt, Mycobacterium bovis subsp bovis AF2122/97
cagacgcaaaaucgcccaa

SEQ ID NO: 3178982 - RNA, 18 nt, Mycobacterium bovis subsp bovis AF2122/97
cagacgcaauagccauca

SEQ ID NO: 3178983 - RNA, 17 nt, Mycobacterium bovis subsp bovis AF2122/97
cagacgcagaagccccc

SEQ ID NO: 3178984 - RNA, 18 nt, Mycobacterium bovis subsp bovis AF2122/97
cagacgcagaagccccca

SEQ ID NO: 3178985 - RNA, 20 nt, Mycobacterium bovis subsp bovis AF2122/97
cagacgcagaagcccccaaa

SEQ ID NO: 3178986 - RNA, 19 nt, Mycobacterium bovis subsp bovis AF2122/97
cagacgcagaaucgcauga

SEQ ID NO: 3178987 - RNA, 20 nt, Mycobacterium bovis subsp bovis AF2122/97
cagacgcagaaucgcccaau

SEQ ID NO: 3178988 - RNA, 15 nt, Mycobacterium bovis subsp bovis AF2122/97
cagacgcagagucgc

SEQ ID NO: 3178989 - RNA, 19 nt, Mycobacterium bovis subsp bovis AF2122/97
cagacgcauaagcccccga

SEQ ID NO: 3178990 - RNA, 21 nt, Mycobacterium bovis subsp bovis AF2122/97
cagacgcauaagcccccgaca

SEQ ID NO: 3178991 - RNA, 19 nt, Mycobacterium bovis subsp bovis AF2122/97
cagacgcauaagcccccgc

SEQ ID NO: 3178992 - RNA, 20 nt, Mycobacterium bovis subsp bovis AF2122/97
cagacgcauaagcccccgca

SEQ ID NO: 3178993 - RNA, 22 nt, Mycobacterium bovis subsp bovis AF2122/97
cagacgcauaagcccccgcacg

SEQ ID NO: 3178994 - RNA, 20 nt, Mycobacterium bovis subsp bovis AF2122/97
cagacgccacugccagccgu

SEQ ID NO: 3178995 - RNA, 23 nt, Mycobacterium bovis subsp bovis AF2122/97
cagacgccacugccagccgugca

SEQ ID NO: 3178996 - RNA, 12 nt, Mycobacterium bovis subsp bovis AF2122/97
cagacgccgcgu

SEQ ID NO: 3178997 - RNA, 18 nt, Mycobacterium bovis subsp bovis AF2122/97
cagacgccgcguuucccg

SEQ ID NO: 3178998 - RNA, 20 nt, Mycobacterium bovis subsp bovis AF2122/97
cagacgccguagccggccgg

SEQ ID NO: 3178999 - RNA, 19 nt, Mycobacterium bovis subsp bovis AF2122/97
cagacgcgaaagcacccca

SEQ ID NO: 3179000 - RNA, 20 nt, Mycobacterium bovis subsp bovis AF2122/97
cagacgcggaaucgcaccgu

SEQ ID NO: 3179001 - RNA, 22 nt, Mycobacterium bovis subsp bovis AF2122/97
cagacgcuaaagcccccgcacg

SEQ ID NO: 3179002 - RNA, 19 nt, Mycobacterium bovis subsp bovis AF2122/97
cagacgcucgaccugccuu

SEQ ID NO: 3179003 - RNA, 20 nt, Mycobacterium bovis subsp bovis AF2122/97
cagacgcucuugaauaggaa

SEQ ID NO: 3179004 - RNA, 24 nt, Mycobacterium bovis subsp bovis AF2122/97
cagacgcugcccaaaagcgcggca

SEQ ID NO: 3179005 - RNA, 15 nt, Mycobacterium bovis subsp bovis AF2122/97
cagacggcugccacg

SEQ ID NO: 3179006 - RNA, 16 nt, Mycobacterium bovis subsp bovis AF2122/97
cagacggggucgcccg

SEQ ID NO: 3179007 - RNA, 18 nt, Mycobacterium bovis subsp bovis AF2122/97
cagacggggucgcccggg

SEQ ID NO: 3179008 - RNA, 16 nt, Mycobacterium bovis subsp bovis AF2122/97
cagacgguccgcuacg

SEQ ID NO: 3179009 - RNA, 17 nt, Mycobacterium bovis subsp bovis AF2122/97
cagacggucuugauguu

SEQ ID NO: 3179010 - RNA, 23 nt, Mycobacterium bovis subsp bovis AF2122/97
cagacggugaagccgagcgcccg

SEQ ID NO: 3179011 - RNA, 14 nt, Mycobacterium bovis subsp bovis AF2122/97
cagacggugcagcu

SEQ ID NO: 3179012 - RNA, 17 nt, Mycobacterium bovis subsp bovis AF2122/97
cagacggugcagcuccc

SEQ ID NO: 3179013 - RNA, 21 nt, Mycobacterium bovis subsp bovis AF2122/97
cagacggugcagcuccccgcc

SEQ ID NO: 3179014 - RNA, 23 nt, Mycobacterium bovis subsp bovis AF2122/97
cagacguaaaagcccccgcacgc

SEQ ID NO: 3179015 - RNA, 13 nt, Mycobacterium bovis subsp bovis AF2122/97
cagacgucaugcg

SEQ ID NO: 3179016 - RNA, 21 nt, Mycobacterium bovis subsp bovis AF2122/97
cagacguuccaucacggacca

SEQ ID NO: 3179017 - RNA, 23 nt, Mycobacterium bovis subsp bovis AF2122/97
cagacguuccaucacggaccagg

SEQ ID NO: 3179018 - RNA, 14 nt, Mycobacterium bovis subsp bovis AF2122/97
cagacuccguugcc

SEQ ID NO: 3179019 - RNA, 18 nt, Mycobacterium bovis subsp bovis AF2122/97
cagacuccguugccaccu

SEQ ID NO: 3179020 - RNA, 14 nt, Mycobacterium bovis subsp bovis AF2122/97
cagacucgauaugc

SEQ ID NO: 3179021 - RNA, 20 nt, Mycobacterium bovis subsp bovis AF2122/97
cagacucgauaugcagcucg

SEQ ID NO: 3179022 - RNA, 14 nt, Mycobacterium bovis subsp bovis AF2122/97
cagacugucgagcg

SEQ ID NO: 3179023 - RNA, 20 nt, Mycobacterium bovis subsp bovis AF2122/97
cagagaaaccgcgaacaacc

SEQ ID NO: 3179024 - RNA, 18 nt, Mycobacterium bovis subsp bovis AF2122/97
cagagaacuccgccacca

SEQ ID NO: 3179025 - RNA, 14 nt, Mycobacterium bovis subsp bovis AF2122/97
cagagacagcgcca

SEQ ID NO: 3179026 - RNA, 17 nt, Mycobacterium bovis subsp bovis AF2122/97
cagagacaugccggcga

SEQ ID NO: 3179027 - RNA, 20 nt, Mycobacterium bovis subsp bovis AF2122/97
cagagacgaucaucucgucg

SEQ ID NO: 3179028 - RNA, 21 nt, Mycobacterium bovis subsp bovis AF2122/97
cagagacgaucaucucgucgu

SEQ ID NO: 3179029 - RNA, 18 nt, Mycobacterium bovis subsp bovis AF2122/97
cagagacguacugggcga

SEQ ID NO: 3179030 - RNA, 12 nt, Mycobacterium bovis subsp bovis AF2122/97
cagagcaccgcg

SEQ ID NO: 3179031 - RNA, 17 nt, Mycobacterium bovis subsp bovis AF2122/97
cagagcaccgcgaacag

SEQ ID NO: 3179032 - RNA, 19 nt, Mycobacterium bovis subsp bovis AF2122/97
cagagcaccgcgaacagca

SEQ ID NO: 3179033 - RNA, 16 nt, Mycobacterium bovis subsp bovis AF2122/97
cagagcacgcgcggcg

SEQ ID NO: 3179034 - RNA, 14 nt, Mycobacterium bovis subsp bovis AF2122/97
cagagccccggcaa

SEQ ID NO: 3179035 - RNA, 18 nt, Mycobacterium bovis subsp bovis AF2122/97
cagagccccggcaagcgc

SEQ ID NO: 3179036 - RNA, 23 nt, Mycobacterium bovis subsp bovis AF2122/97
cagagccgccguugccgccggcg

SEQ ID NO: 3179037 - RNA, 15 nt, Mycobacterium bovis subsp bovis AF2122/97
cagagccgcgcgccg

SEQ ID NO: 3179038 - RNA, 16 nt, Mycobacterium bovis subsp bovis AF2122/97
cagagccgcgcgccgg

SEQ ID NO: 3179039 - RNA, 17 nt, Mycobacterium bovis subsp bovis AF2122/97
cagagccgcgcgccggu

SEQ ID NO: 3179040 - RNA, 13 nt, Mycobacterium bovis subsp bovis AF2122/97
cagagccgcugcg

SEQ ID NO: 3179041 - RNA, 18 nt, Mycobacterium bovis subsp bovis AF2122/97
cagagccgucaccgacug

SEQ ID NO: 3179042 - RNA, 20 nt, Mycobacterium bovis subsp bovis AF2122/97
cagagcgaacccccgccgcg

SEQ ID NO: 3179043 - RNA, 12 nt, Mycobacterium bovis subsp bovis AF2122/97
cagagcgcuggu

SEQ ID NO: 3179044 - RNA, 21 nt, Mycobacterium bovis subsp bovis AF2122/97
cagagcgcugguuggccugcc

SEQ ID NO: 3179045 - RNA, 16 nt, Mycobacterium bovis subsp bovis AF2122/97
cagagcggaaaaucac

SEQ ID NO: 3179046 - RNA, 14 nt, Mycobacterium bovis subsp bovis AF2122/97
cagagcggcaguca

SEQ ID NO: 3179047 - RNA, 21 nt, Mycobacterium bovis subsp bovis AF2122/97
cagagcguacaggucggccca

SEQ ID NO: 3179048 - RNA, 20 nt, Mycobacterium bovis subsp bovis AF2122/97
cagagcgucgaacacgucgg

SEQ ID NO: 3179049 - RNA, 21 nt, Mycobacterium bovis subsp bovis AF2122/97
cagaggcgcaagaaugccgcc

SEQ ID NO: 3179050 - RNA, 14 nt, Mycobacterium bovis subsp bovis AF2122/97
cagaggcggcuggc

SEQ ID NO: 3179051 - RNA, 17 nt, Mycobacterium bovis subsp bovis AF2122/97
cagaggcggcuggcggu

SEQ ID NO: 3179052 - RNA, 12 nt, Mycobacterium bovis subsp bovis AF2122/97
cagaggcuggcg

SEQ ID NO: 3179053 - RNA, 17 nt, Mycobacterium bovis subsp bovis AF2122/97
cagaggucgagcgccuu

SEQ ID NO: 3179054 - RNA, 12 nt, Mycobacterium bovis subsp bovis AF2122/97
cagagucgcccg

SEQ ID NO: 3179055 - RNA, 15 nt, Mycobacterium bovis subsp bovis AF2122/97
cagagucgcccgcac

SEQ ID NO: 3179056 - RNA, 14 nt, Mycobacterium bovis subsp bovis AF2122/97
cagagugguggcga

SEQ ID NO: 3179057 - RNA, 17 nt, Mycobacterium bovis subsp bovis AF2122/97
cagaguucccgaaaccc

SEQ ID NO: 3179058 - RNA, 18 nt, Mycobacterium bovis subsp bovis AF2122/97
cagaguucccgaaacccg

SEQ ID NO: 3179059 - RNA, 19 nt, Mycobacterium bovis subsp bovis AF2122/97
cagaguucccgaaacccga

SEQ ID NO: 3179060 - RNA, 20 nt, Mycobacterium bovis subsp bovis AF2122/97
cagaguucccgaaacccgau

SEQ ID NO: 3179061 - RNA, 19 nt, Mycobacterium bovis subsp bovis AF2122/97
cagaguuugcgaugcccac

SEQ ID NO: 3179062 - RNA, 20 nt, Mycobacterium bovis subsp bovis AF2122/97
cagaguuugcgaugcccacg

SEQ ID NO: 3179063 - RNA, 23 nt, Mycobacterium bovis subsp bovis AF2122/97
cagauacaucgggaucugggcuc

SEQ ID NO: 3179064 - RNA, 23 nt, Mycobacterium bovis subsp bovis AF2122/97
cagauaccaccgccgcugccggu

SEQ ID NO: 3179065 - RNA, 14 nt, Mycobacterium bovis subsp bovis AF2122/97
cagauacgagcugu

SEQ ID NO: 3179066 - RNA, 15 nt, Mycobacterium bovis subsp bovis AF2122/97
cagauacuccgcggu

SEQ ID NO: 3179067 - RNA, 19 nt, Mycobacterium bovis subsp bovis AF2122/97
cagauaggacccagccagc

SEQ ID NO: 3179068 - RNA, 21 nt, Mycobacterium bovis subsp bovis AF2122/97
cagauaguagucgugaucgcg

SEQ ID NO: 3179069 - RNA, 14 nt, Mycobacterium bovis subsp bovis AF2122/97
cagauaguccggcu

SEQ ID NO: 3179070 - RNA, 21 nt, Mycobacterium bovis subsp bovis AF2122/97
cagauaguccggcuuguccuc

SEQ ID NO: 3179071 - RNA, 21 nt, Mycobacterium bovis subsp bovis AF2122/97
cagauaugacggcagaccaug

SEQ ID NO: 3179072 - RNA, 20 nt, Mycobacterium bovis subsp bovis AF2122/97
cagaucaacaucaucacugu

SEQ ID NO: 3179073 - RNA, 16 nt, Mycobacterium bovis subsp bovis AF2122/97
cagaucaccgccagcu

SEQ ID NO: 3179074 - RNA, 18 nt, Mycobacterium bovis subsp bovis AF2122/97
cagaucaccgccagcugg

SEQ ID NO: 3179075 - RNA, 18 nt, Mycobacterium bovis subsp bovis AF2122/97
cagaucacgggugugccu

SEQ ID NO: 3179076 - RNA, 15 nt, Mycobacterium bovis subsp bovis AF2122/97
cagaucagccgccgc

SEQ ID NO: 3179077 - RNA, 17 nt, Mycobacterium bovis subsp bovis AF2122/97
cagaucagccgccgccu

SEQ ID NO: 3179078 - RNA, 15 nt, Mycobacterium bovis subsp bovis AF2122/97
cagaucaggacgcga

SEQ ID NO: 3179079 - RNA, 18 nt, Mycobacterium bovis subsp bovis AF2122/97
cagaucaggguggcgcgg

SEQ ID NO: 3179080 - RNA, 15 nt, Mycobacterium bovis subsp bovis AF2122/97
cagauccacgccgac

SEQ ID NO: 3179081 - RNA, 16 nt, Mycobacterium bovis subsp bovis AF2122/97
cagauccacgccgacc

SEQ ID NO: 3179082 - RNA, 17 nt, Mycobacterium bovis subsp bovis AF2122/97
cagauccacgccgacca

SEQ ID NO: 3179083 - RNA, 17 nt, Mycobacterium bovis subsp bovis AF2122/97
cagauccccgccaccga

SEQ ID NO: 3179084 - RNA, 14 nt, Mycobacterium bovis subsp bovis AF2122/97
cagaucccgccgcg

SEQ ID NO: 3179085 - RNA, 15 nt, Mycobacterium bovis subsp bovis AF2122/97
cagaucccgccgcgg

SEQ ID NO: 3179086 - RNA, 19 nt, Mycobacterium bovis subsp bovis AF2122/97
cagauccgacgaccgcauu

SEQ ID NO: 3179087 - RNA, 18 nt, Mycobacterium bovis subsp bovis AF2122/97
cagauccgccccguaauc

SEQ ID NO: 3179088 - RNA, 21 nt, Mycobacterium bovis subsp bovis AF2122/97
cagauccuucaacuuacgcga

SEQ ID NO: 3179089 - RNA, 17 nt, Mycobacterium bovis subsp bovis AF2122/97
cagaucgaacgcagcca

SEQ ID NO: 3179090 - RNA, 23 nt, Mycobacterium bovis subsp bovis AF2122/97
cagaucgaacgcagccagcgcca

SEQ ID NO: 3179091 - RNA, 20 nt, Mycobacterium bovis subsp bovis AF2122/97
cagaucgaagcgcagcaccu

SEQ ID NO: 3179092 - RNA, 14 nt, Mycobacterium bovis subsp bovis AF2122/97
cagaucgcgguccg

SEQ ID NO: 3179093 - RNA, 19 nt, Mycobacterium bovis subsp bovis AF2122/97
cagaucgcuaggaccgcgg

SEQ ID NO: 3179094 - RNA, 22 nt, Mycobacterium bovis subsp bovis AF2122/97
cagaucggccggauacgggcug

SEQ ID NO: 3179095 - RNA, 17 nt, Mycobacterium bovis subsp bovis AF2122/97
cagaucggcgacgccgu

SEQ ID NO: 3179096 - RNA, 21 nt, Mycobacterium bovis subsp bovis AF2122/97
cagaucgguugaucggccacg

SEQ ID NO: 3179097 - RNA, 19 nt, Mycobacterium bovis subsp bovis AF2122/97
cagaucguagugcgcgcca

SEQ ID NO: 3179098 - RNA, 14 nt, Mycobacterium bovis subsp bovis AF2122/97
cagaucguccaccg

SEQ ID NO: 3179099 - RNA, 15 nt, Mycobacterium bovis subsp bovis AF2122/97
cagaucguccaccgc

SEQ ID NO: 3179100 - RNA, 18 nt, Mycobacterium bovis subsp bovis AF2122/97
cagaucguccaccgccga

SEQ ID NO: 3179101 - RNA, 19 nt, Mycobacterium bovis subsp bovis AF2122/97
cagaucgugcacaaucggu

SEQ ID NO: 3179102 - RNA, 17 nt, Mycobacterium bovis subsp bovis AF2122/97
cagaucguuccaggccg

SEQ ID NO: 3179103 - RNA, 20 nt, Mycobacterium bovis subsp bovis AF2122/97
cagaucguuccaggccgcgu

SEQ ID NO: 3179104 - RNA, 20 nt, Mycobacterium bovis subsp bovis AF2122/97
cagaucuccaagcucgacaa

SEQ ID NO: 3179105 - RNA, 21 nt, Mycobacterium bovis subsp bovis AF2122/97
cagaucuggguucccgaugug

SEQ ID NO: 3179106 - RNA, 24 nt, Mycobacterium bovis subsp bovis AF2122/97
cagaucuguacggaucaggcccgg

SEQ ID NO: 3179107 - RNA, 19 nt, Mycobacterium bovis subsp bovis AF2122/97
cagaucuugugccaggcgu

SEQ ID NO: 3179108 - RNA, 17 nt, Mycobacterium bovis subsp bovis AF2122/97
cagaucuuucuugcugu

SEQ ID NO: 3179109 - RNA, 17 nt, Mycobacterium bovis subsp bovis AF2122/97
cagaugaaagugccagu

SEQ ID NO: 3179110 - RNA, 16 nt, Mycobacterium bovis subsp bovis AF2122/97
cagaugaaggugacga

SEQ ID NO: 3179111 - RNA, 23 nt, Mycobacterium bovis subsp bovis AF2122/97
cagaugaauugccgggcgcacgc

SEQ ID NO: 3179112 - RNA, 15 nt, Mycobacterium bovis subsp bovis AF2122/97
cagaugagcgcggcg

SEQ ID NO: 3179113 - RNA, 13 nt, Mycobacterium bovis subsp bovis AF2122/97
cagaugagucaaa

SEQ ID NO: 3179114 - RNA, 15 nt, Mycobacterium bovis subsp bovis AF2122/97
cagaugaugccaccc

SEQ ID NO: 3179115 - RNA, 22 nt, Mycobacterium bovis subsp bovis AF2122/97
cagaugaugccacccucggugu

SEQ ID NO: 3179116 - RNA, 21 nt, Mycobacterium bovis subsp bovis AF2122/97
cagaugaugccguucggaccc

SEQ ID NO: 3179117 - RNA, 14 nt, Mycobacterium bovis subsp bovis AF2122/97
cagaugcaccucgc

SEQ ID NO: 3179118 - RNA, 22 nt, Mycobacterium bovis subsp bovis AF2122/97
cagaugcaccucgcccugcaga

SEQ ID NO: 3179119 - RNA, 20 nt, Mycobacterium bovis subsp bovis AF2122/97
cagaugccacccagaugcag

SEQ ID NO: 3179120 - RNA, 18 nt, Mycobacterium bovis subsp bovis AF2122/97
cagaugccgggcugaggc

SEQ ID NO: 3179121 - RNA, 20 nt, Mycobacterium bovis subsp bovis AF2122/97
cagaugcgaaggcaucgcgg

SEQ ID NO: 3179122 - RNA, 17 nt, Mycobacterium bovis subsp bovis AF2122/97
cagaugcggcccgggcu

SEQ ID NO: 3179123 - RNA, 21 nt, Mycobacterium bovis subsp bovis AF2122/97
cagauggcauugcgcccaccg

SEQ ID NO: 3179124 - RNA, 22 nt, Mycobacterium bovis subsp bovis AF2122/97
cagauggcauugcgcccaccga

SEQ ID NO: 3179125 - RNA, 23 nt, Mycobacterium bovis subsp bovis AF2122/97
cagauggcucucggugguccagc

SEQ ID NO: 3179126 - RNA, 15 nt, Mycobacterium bovis subsp bovis AF2122/97
cagaugggccuccac

SEQ ID NO: 3179127 - RNA, 20 nt, Mycobacterium bovis subsp bovis AF2122/97
cagaugggccuccaccgcgu

SEQ ID NO: 3179128 - RNA, 14 nt, Mycobacterium bovis subsp bovis AF2122/97
cagaugggcgucgg

SEQ ID NO: 3179129 - RNA, 20 nt, Mycobacterium bovis subsp bovis AF2122/97
cagauggguacccgaucacu

SEQ ID NO: 3179130 - RNA, 22 nt, Mycobacterium bovis subsp bovis AF2122/97
cagauggucggucgcuucagcg

SEQ ID NO: 3179131 - RNA, 12 nt, Mycobacterium bovis subsp bovis AF2122/97
cagauggugaag

SEQ ID NO: 3179132 - RNA, 22 nt, Mycobacterium bovis subsp bovis AF2122/97
cagauggugaaguugccgguca

SEQ ID NO: 3179133 - RNA, 19 nt, Mycobacterium bovis subsp bovis AF2122/97
cagaugguuggaucgccac

SEQ ID NO: 3179134 - RNA, 21 nt, Mycobacterium bovis subsp bovis AF2122/97
cagaugguuggaucgccaccg

SEQ ID NO: 3179135 - RNA, 19 nt, Mycobacterium bovis subsp bovis AF2122/97
cagauguaccucaucgcag

SEQ ID NO: 3179136 - RNA, 21 nt, Mycobacterium bovis subsp bovis AF2122/97
cagauguccgacgcaccaacg

SEQ ID NO: 3179137 - RNA, 14 nt, Mycobacterium bovis subsp bovis AF2122/97
cagauuccugauga

SEQ ID NO: 3179138 - RNA, 12 nt, Mycobacterium bovis subsp bovis AF2122/97
cagauucgccgc

SEQ ID NO: 3179139 - RNA, 16 nt, Mycobacterium bovis subsp bovis AF2122/97
cagauucgcgcuggcc

SEQ ID NO: 3179140 - RNA, 22 nt, Mycobacterium bovis subsp bovis AF2122/97
cagauugccgagcccagguggu

SEQ ID NO: 3179141 - RNA, 20 nt, Mycobacterium bovis subsp bovis AF2122/97
cagauugccugggcggccgg

SEQ ID NO: 3179142 - RNA, 18 nt, Mycobacterium bovis subsp bovis AF2122/97
cagauugcucggugguga

SEQ ID NO: 3179143 - RNA, 16 nt, Mycobacterium bovis subsp bovis AF2122/97
cagauugucgcugaau

SEQ ID NO: 3179144 - RNA, 18 nt, Mycobacterium bovis subsp bovis AF2122/97
cagcaaaaaccagcgucc

SEQ ID NO: 3179145 - RNA, 20 nt, Mycobacterium bovis subsp bovis AF2122/97
cagcaaaacccgagccugga

SEQ ID NO: 3179146 - RNA, 21 nt, Mycobacterium bovis subsp bovis AF2122/97
cagcaaaacccgagccuggau

SEQ ID NO: 3179147 - RNA, 22 nt, Mycobacterium bovis subsp bovis AF2122/97
cagcaaaacccgcuccaccccu

SEQ ID NO: 3179148 - RNA, 17 nt, Mycobacterium bovis subsp bovis AF2122/97
cagcaaacaucgcaggc

SEQ ID NO: 3179149 - RNA, 18 nt, Mycobacterium bovis subsp bovis AF2122/97
cagcaaaggggugugugc

SEQ ID NO: 3179150 - RNA, 16 nt, Mycobacterium bovis subsp bovis AF2122/97
cagcaaaugcggcgcg

SEQ ID NO: 3179151 - RNA, 15 nt, Mycobacterium bovis subsp bovis AF2122/97
cagcaaccgcucggc

SEQ ID NO: 3179152 - RNA, 16 nt, Mycobacterium bovis subsp bovis AF2122/97
cagcaacgacauccag

SEQ ID NO: 3179153 - RNA, 21 nt, Mycobacterium bovis subsp bovis AF2122/97
cagcaacgacccgaagccgac

SEQ ID NO: 3179154 - RNA, 24 nt, Mycobacterium bovis subsp bovis AF2122/97
cagcaacgacccgaagccgaccgg

SEQ ID NO: 3179155 - RNA, 18 nt, Mycobacterium bovis subsp bovis AF2122/97
cagcaacgcggugccggg

SEQ ID NO: 3179156 - RNA, 15 nt, Mycobacterium bovis subsp bovis AF2122/97
cagcaacggcggcgu

SEQ ID NO: 3179157 - RNA, 16 nt, Mycobacterium bovis subsp bovis AF2122/97
cagcaacggcggcguc

SEQ ID NO: 3179158 - RNA, 20 nt, Mycobacterium bovis subsp bovis AF2122/97
cagcaacgucacgucgacgg

SEQ ID NO: 3179159 - RNA, 12 nt, Mycobacterium bovis subsp bovis AF2122/97
cagcaacucgac

SEQ ID NO: 3179160 - RNA, 22 nt, Mycobacterium bovis subsp bovis AF2122/97
cagcaacucggccacggcgucg

SEQ ID NO: 3179161 - RNA, 17 nt, Mycobacterium bovis subsp bovis AF2122/97
cagcaacugggcggccu

SEQ ID NO: 3179162 - RNA, 18 nt, Mycobacterium bovis subsp bovis AF2122/97
cagcaacugggcggccug

SEQ ID NO: 3179163 - RNA, 14 nt, Mycobacterium bovis subsp bovis AF2122/97
cagcaagagccgca

SEQ ID NO: 3179164 - RNA, 13 nt, Mycobacterium bovis subsp bovis AF2122/97
cagcaagccgccg

SEQ ID NO: 3179165 - RNA, 14 nt, Mycobacterium bovis subsp bovis AF2122/97
cagcaagccgccgg

SEQ ID NO: 3179166 - RNA, 20 nt, Mycobacterium bovis subsp bovis AF2122/97
cagcaagugugagcagaccc

SEQ ID NO: 3179167 - RNA, 21 nt, Mycobacterium bovis subsp bovis AF2122/97
cagcaagugugagcagaccca

SEQ ID NO: 3179168 - RNA, 17 nt, Mycobacterium bovis subsp bovis AF2122/97
cagcaaguucgucggga

SEQ ID NO: 3179169 - RNA, 17 nt, Mycobacterium bovis subsp bovis AF2122/97
cagcaauacggcggcgc

SEQ ID NO: 3179170 - RNA, 19 nt, Mycobacterium bovis subsp bovis AF2122/97
cagcaaucagccgccuucu

SEQ ID NO: 3179171 - RNA, 22 nt, Mycobacterium bovis subsp bovis AF2122/97
cagcaauccaaggcucagcagc

SEQ ID NO: 3179172 - RNA, 16 nt, Mycobacterium bovis subsp bovis AF2122/97
cagcacacccagaugc

SEQ ID NO: 3179173 - RNA, 17 nt, Mycobacterium bovis subsp bovis AF2122/97
cagcacacccgucaugc

SEQ ID NO: 3179174 - RNA, 13 nt, Mycobacterium bovis subsp bovis AF2122/97
cagcacaccgccc

SEQ ID NO: 3179175 - RNA, 14 nt, Mycobacterium bovis subsp bovis AF2122/97
cagcacaccgcccg

SEQ ID NO: 3179176 - RNA, 15 nt, Mycobacterium bovis subsp bovis AF2122/97
cagcacaccgguuga

SEQ ID NO: 3179177 - RNA, 17 nt, Mycobacterium bovis subsp bovis AF2122/97
cagcacaccgucgacga

SEQ ID NO: 3179178 - RNA, 20 nt, Mycobacterium bovis subsp bovis AF2122/97
cagcacacugucgauuugau

SEQ ID NO: 3179179 - RNA, 21 nt, Mycobacterium bovis subsp bovis AF2122/97
cagcacagcauuguccggcgu

SEQ ID NO: 3179180 - RNA, 14 nt, Mycobacterium bovis subsp bovis AF2122/97
cagcacagcgcagc

SEQ ID NO: 3179181 - RNA, 16 nt, Mycobacterium bovis subsp bovis AF2122/97
cagcacaggcuggcga

SEQ ID NO: 3179182 - RNA, 18 nt, Mycobacterium bovis subsp bovis AF2122/97
cagcacaggcuggcgaug

SEQ ID NO: 3179183 - RNA, 18 nt, Mycobacterium bovis subsp bovis AF2122/97
cagcacauccugcagcuc

SEQ ID NO: 3179184 - RNA, 14 nt, Mycobacterium bovis subsp bovis AF2122/97
cagcacaucggcga

SEQ ID NO: 3179185 - RNA, 20 nt, Mycobacterium bovis subsp bovis AF2122/97
cagcacauucugcagcgucu

SEQ ID NO: 3179186 - RNA, 23 nt, Mycobacterium bovis subsp bovis AF2122/97
cagcaccaaggucuucaggccgc

SEQ ID NO: 3179187 - RNA, 13 nt, Mycobacterium bovis subsp bovis AF2122/97
cagcaccacaacg

SEQ ID NO: 3179188 - RNA, 17 nt, Mycobacterium bovis subsp bovis AF2122/97
cagcaccacaacgucgg

SEQ ID NO: 3179189 - RNA, 12 nt, Mycobacterium bovis subsp bovis AF2122/97
cagcaccacauc

SEQ ID NO: 3179190 - RNA, 13 nt, Mycobacterium bovis subsp bovis AF2122/97
cagcaccacaucg

SEQ ID NO: 3179191 - RNA, 12 nt, Mycobacterium bovis subsp bovis AF2122/97
cagcaccaccac

SEQ ID NO: 3179192 - RNA, 15 nt, Mycobacterium bovis subsp bovis AF2122/97
cagcaccaccagcag

SEQ ID NO: 3179193 - RNA, 14 nt, Mycobacterium bovis subsp bovis AF2122/97
cagcaccaccggcu

SEQ ID NO: 3179194 - RNA, 14 nt, Mycobacterium bovis subsp bovis AF2122/97
cagcaccacggcca

SEQ ID NO: 3179195 - RNA, 16 nt, Mycobacterium bovis subsp bovis AF2122/97
cagcaccacggccagc

SEQ ID NO: 3179196 - RNA, 18 nt, Mycobacterium bovis subsp bovis AF2122/97
cagcaccacggcgcgcgc

SEQ ID NO: 3179197 - RNA, 22 nt, Mycobacterium bovis subsp bovis AF2122/97
cagcaccacggcgcgcgcgccg

SEQ ID NO: 3179198 - RNA, 23 nt, Mycobacterium bovis subsp bovis AF2122/97
cagcaccacggcgcgcgcgccgg

SEQ ID NO: 3179199 - RNA, 14 nt, Mycobacterium bovis subsp bovis AF2122/97
cagcaccagccacg

SEQ ID NO: 3179200 - RNA, 13 nt, Mycobacterium bovis subsp bovis AF2122/97
cagcaccagcgcc

SEQ ID NO: 3179201 - RNA, 20 nt, Mycobacterium bovis subsp bovis AF2122/97
cagcaccagcgccuugacca

SEQ ID NO: 3179202 - RNA, 14 nt, Mycobacterium bovis subsp bovis AF2122/97
cagcaccagggcgc

SEQ ID NO: 3179203 - RNA, 22 nt, Mycobacterium bovis subsp bovis AF2122/97
cagcaccaggguggcccgggga

SEQ ID NO: 3179204 - RNA, 15 nt, Mycobacterium bovis subsp bovis AF2122/97
cagcaccaugcucgg

SEQ ID NO: 3179205 - RNA, 18 nt, Mycobacterium bovis subsp bovis AF2122/97
cagcaccaugcucggaaa

SEQ ID NO: 3179206 - RNA, 17 nt, Mycobacterium bovis subsp bovis AF2122/97
cagcacccaacccggcg

SEQ ID NO: 3179207 - RNA, 16 nt, Mycobacterium bovis subsp bovis AF2122/97
cagcacccacaucagc

SEQ ID NO: 3179208 - RNA, 17 nt, Mycobacterium bovis subsp bovis AF2122/97
cagcacccagacgaugg

SEQ ID NO: 3179209 - RNA, 15 nt, Mycobacterium bovis subsp bovis AF2122/97
cagcaccccauggcc

SEQ ID NO: 3179210 - RNA, 20 nt, Mycobacterium bovis subsp bovis AF2122/97
cagcaccccauggccaccga

SEQ ID NO: 3179211 - RNA, 19 nt, Mycobacterium bovis subsp bovis AF2122/97
cagcacccccucggcuucg

SEQ ID NO: 3179212 - RNA, 14 nt, Mycobacterium bovis subsp bovis AF2122/97
cagcaccccgccgg

SEQ ID NO: 3179213 - RNA, 22 nt, Mycobacterium bovis subsp bovis AF2122/97
cagcacccgagcgaugcgaccg

SEQ ID NO: 3179214 - RNA, 13 nt, Mycobacterium bovis subsp bovis AF2122/97
cagcacccgcacg

SEQ ID NO: 3179215 - RNA, 16 nt, Mycobacterium bovis subsp bovis AF2122/97
cagcacccgcacggug

SEQ ID NO: 3179216 - RNA, 20 nt, Mycobacterium bovis subsp bovis AF2122/97
cagcacccgcacgguguauc

SEQ ID NO: 3179217 - RNA, 13 nt, Mycobacterium bovis subsp bovis AF2122/97
cagcacccgcagc

SEQ ID NO: 3179218 - RNA, 14 nt, Mycobacterium bovis subsp bovis AF2122/97
cagcacccgcagcc

SEQ ID NO: 3179219 - RNA, 14 nt, Mycobacterium bovis subsp bovis AF2122/97
cagcacccgcgcca

SEQ ID NO: 3179220 - RNA, 15 nt, Mycobacterium bovis subsp bovis AF2122/97
cagcacccgcgccag

SEQ ID NO: 3179221 - RNA, 13 nt, Mycobacterium bovis subsp bovis AF2122/97
cagcacccgcgcg

SEQ ID NO: 3179222 - RNA, 14 nt, Mycobacterium bovis subsp bovis AF2122/97
cagcacccgcucca

SEQ ID NO: 3179223 - RNA, 19 nt, Mycobacterium bovis subsp bovis AF2122/97
cagcacccgcuccagcucg

SEQ ID NO: 3179224 - RNA, 23 nt, Mycobacterium bovis subsp bovis AF2122/97
cagcacccgcuccagcucggcgg

SEQ ID NO: 3179225 - RNA, 17 nt, Mycobacterium bovis subsp bovis AF2122/97
cagcacccgcucggccg

SEQ ID NO: 3179226 - RNA, 16 nt, Mycobacterium bovis subsp bovis AF2122/97
cagcacccggccaccg

SEQ ID NO: 3179227 - RNA, 19 nt, Mycobacterium bovis subsp bovis AF2122/97
cagcacccggcuucgccgc

SEQ ID NO: 3179228 - RNA, 16 nt, Mycobacterium bovis subsp bovis AF2122/97
cagcacccgggccacg

SEQ ID NO: 3179229 - RNA, 18 nt, Mycobacterium bovis subsp bovis AF2122/97
cagcacccgggccuggga

SEQ ID NO: 3179230 - RNA, 15 nt, Mycobacterium bovis subsp bovis AF2122/97
cagcacccugcgggc

SEQ ID NO: 3179231 - RNA, 16 nt, Mycobacterium bovis subsp bovis AF2122/97
cagcaccgaacccgcc

SEQ ID NO: 3179232 - RNA, 18 nt, Mycobacterium bovis subsp bovis AF2122/97
cagcaccgaacccgccac

SEQ ID NO: 3179233 - RNA, 13 nt, Mycobacterium bovis subsp bovis AF2122/97
cagcaccgacagc

SEQ ID NO: 3179234 - RNA, 13 nt, Mycobacterium bovis subsp bovis AF2122/97
cagcaccgacggc

SEQ ID NO: 3179235 - RNA, 15 nt, Mycobacterium bovis subsp bovis AF2122/97
cagcaccgacggcgc

SEQ ID NO: 3179236 - RNA, 16 nt, Mycobacterium bovis subsp bovis AF2122/97
cagcaccgccgcgccg

SEQ ID NO: 3179237 - RNA, 22 nt, Mycobacterium bovis subsp bovis AF2122/97
cagcaccgccgcgccggcggcc

SEQ ID NO: 3179238 - RNA, 16 nt, Mycobacterium bovis subsp bovis AF2122/97
cagcaccgccgcugcc

SEQ ID NO: 3179239 - RNA, 12 nt, Mycobacterium bovis subsp bovis AF2122/97
cagcaccgccgg

SEQ ID NO: 3179240 - RNA, 17 nt, Mycobacterium bovis subsp bovis AF2122/97
cagcaccgccggcgacg

SEQ ID NO: 3179241 - RNA, 14 nt, Mycobacterium bovis subsp bovis AF2122/97
cagcaccgccggug

SEQ ID NO: 3179242 - RNA, 16 nt, Mycobacterium bovis subsp bovis AF2122/97
cagcaccgccggugcg

SEQ ID NO: 3179243 - RNA, 17 nt, Mycobacterium bovis subsp bovis AF2122/97
cagcaccgccggugcgg

SEQ ID NO: 3179244 - RNA, 13 nt, Mycobacterium bovis subsp bovis AF2122/97
cagcaccgcgacc

SEQ ID NO: 3179245 - RNA, 14 nt, Mycobacterium bovis subsp bovis AF2122/97
cagcaccgcgacga

SEQ ID NO: 3179246 - RNA, 16 nt, Mycobacterium bovis subsp bovis AF2122/97
cagcaccgcgacgacg

SEQ ID NO: 3179247 - RNA, 18 nt, Mycobacterium bovis subsp bovis AF2122/97
cagcaccgcuggcagcga

SEQ ID NO: 3179248 - RNA, 12 nt, Mycobacterium bovis subsp bovis AF2122/97
cagcaccggcgc

SEQ ID NO: 3179249 - RNA, 20 nt, Mycobacterium bovis subsp bovis AF2122/97
cagcaccgggaugugcggcu

SEQ ID NO: 3179250 - RNA, 20 nt, Mycobacterium bovis subsp bovis AF2122/97
cagcaccggggacagcccgg

SEQ ID NO: 3179251 - RNA, 14 nt, Mycobacterium bovis subsp bovis AF2122/97
cagcaccguacggc

SEQ ID NO: 3179252 - RNA, 14 nt, Mycobacterium bovis subsp bovis AF2122/97
cagcaccgucggca

SEQ ID NO: 3179253 - RNA, 22 nt, Mycobacterium bovis subsp bovis AF2122/97
cagcaccgucggcaccagcagc

SEQ ID NO: 3179254 - RNA, 13 nt, Mycobacterium bovis subsp bovis AF2122/97
cagcaccgucggg

SEQ ID NO: 3179255 - RNA, 22 nt, Mycobacterium bovis subsp bovis AF2122/97
cagcaccgucgggcccagccgg

SEQ ID NO: 3179256 - RNA, 22 nt, Mycobacterium bovis subsp bovis AF2122/97
cagcaccucagaaaguccccgc

SEQ ID NO: 3179257 - RNA, 14 nt, Mycobacterium bovis subsp bovis AF2122/97
cagcaccuccaccg

SEQ ID NO: 3179258 - RNA, 16 nt, Mycobacterium bovis subsp bovis AF2122/97
cagcaccuccaccgcg

SEQ ID NO: 3179259 - RNA, 19 nt, Mycobacterium bovis subsp bovis AF2122/97
cagcaccuccaccgcgccg

SEQ ID NO: 3179260 - RNA, 21 nt, Mycobacterium bovis subsp bovis AF2122/97
cagcaccuccaccgcgccggc

SEQ ID NO: 3179261 - RNA, 23 nt, Mycobacterium bovis subsp bovis AF2122/97
cagcaccuccaccgcgccggcgg

SEQ ID NO: 3179262 - RNA, 23 nt, Mycobacterium bovis subsp bovis AF2122/97
cagcaccuccguaacgccaagcu

SEQ ID NO: 3179263 - RNA, 14 nt, Mycobacterium bovis subsp bovis AF2122/97
cagcaccucgaccg

SEQ ID NO: 3179264 - RNA, 16 nt, Mycobacterium bovis subsp bovis AF2122/97
cagcaccucgaccgcc

SEQ ID NO: 3179265 - RNA, 21 nt, Mycobacterium bovis subsp bovis AF2122/97
cagcaccucgaccgccaaccu

SEQ ID NO: 3179266 - RNA, 15 nt, Mycobacterium bovis subsp bovis AF2122/97
cagcaccucggccag

SEQ ID NO: 3179267 - RNA, 14 nt, Mycobacterium bovis subsp bovis AF2122/97
cagcaccucgucga

SEQ ID NO: 3179268 - RNA, 16 nt, Mycobacterium bovis subsp bovis AF2122/97
cagcaccucgucgauc

SEQ ID NO: 3179269 - RNA, 20 nt, Mycobacterium bovis subsp bovis AF2122/97
cagcaccucgucgaucgccg

SEQ ID NO: 3179270 - RNA, 13 nt, Mycobacterium bovis subsp bovis AF2122/97
cagcaccugccgu

SEQ ID NO: 3179271 - RNA, 14 nt, Mycobacterium bovis subsp bovis AF2122/97
cagcacgaccuggu

SEQ ID NO: 3179272 - RNA, 16 nt, Mycobacterium bovis subsp bovis AF2122/97
cagcacgauccagcug

SEQ ID NO: 3179273 - RNA, 18 nt, Mycobacterium bovis subsp bovis AF2122/97
cagcacgauccagcugua

SEQ ID NO: 3179274 - RNA, 20 nt, Mycobacterium bovis subsp bovis AF2122/97
cagcacgauccagcuguaca

SEQ ID NO: 3179275 - RNA, 16 nt, Mycobacterium bovis subsp bovis AF2122/97
cagcacgccagcccca

SEQ ID NO: 3179276 - RNA, 19 nt, Mycobacterium bovis subsp bovis AF2122/97
cagcacgcccgcgcugaca

SEQ ID NO: 3179277 - RNA, 14 nt, Mycobacterium bovis subsp bovis AF2122/97
cagcacgcccucga

SEQ ID NO: 3179278 - RNA, 16 nt, Mycobacterium bovis subsp bovis AF2122/97
cagcacgcccucgacg

SEQ ID NO: 3179279 - RNA, 18 nt, Mycobacterium bovis subsp bovis AF2122/97
cagcacgccgccggccgc

SEQ ID NO: 3179280 - RNA, 20 nt, Mycobacterium bovis subsp bovis AF2122/97
cagcacgccgccggccgcca

SEQ ID NO: 3179281 - RNA, 14 nt, Mycobacterium bovis subsp bovis AF2122/97
cagcacgccgggug

SEQ ID NO: 3179282 - RNA, 19 nt, Mycobacterium bovis subsp bovis AF2122/97
cagcacgccgggugccgcc

SEQ ID NO: 3179283 - RNA, 22 nt, Mycobacterium bovis subsp bovis AF2122/97
cagcacgccgggugccgccacg

SEQ ID NO: 3179284 - RNA, 16 nt, Mycobacterium bovis subsp bovis AF2122/97
cagcacgccguccagg

SEQ ID NO: 3179285 - RNA, 19 nt, Mycobacterium bovis subsp bovis AF2122/97
cagcacgccguccagguuc

SEQ ID NO: 3179286 - RNA, 14 nt, Mycobacterium bovis subsp bovis AF2122/97
cagcacgcgcgcga

SEQ ID NO: 3179287 - RNA, 13 nt, Mycobacterium bovis subsp bovis AF2122/97
cagcacgcucgug

SEQ ID NO: 3179288 - RNA, 17 nt, Mycobacterium bovis subsp bovis AF2122/97
cagcacggcaaccagcg

SEQ ID NO: 3179289 - RNA, 17 nt, Mycobacterium bovis subsp bovis AF2122/97
cagcacggcacccaccc

SEQ ID NO: 3179290 - RNA, 13 nt, Mycobacterium bovis subsp bovis AF2122/97
cagcacggcgacg

SEQ ID NO: 3179291 - RNA, 13 nt, Mycobacterium bovis subsp bovis AF2122/97
cagcacggcgauc

SEQ ID NO: 3179292 - RNA, 16 nt, Mycobacterium bovis subsp bovis AF2122/97
cagcacggcgaucggu

SEQ ID NO: 3179293 - RNA, 17 nt, Mycobacterium bovis subsp bovis AF2122/97
cagcacggcgaucggug

SEQ ID NO: 3179294 - RNA, 18 nt, Mycobacterium bovis subsp bovis AF2122/97
cagcacggcgaucgguga

SEQ ID NO: 3179295 - RNA, 17 nt, Mycobacterium bovis subsp bovis AF2122/97
cagcacggcgccgccac

SEQ ID NO: 3179296 - RNA, 18 nt, Mycobacterium bovis subsp bovis AF2122/97
cagcacggcgccgccacg

SEQ ID NO: 3179297 - RNA, 14 nt, Mycobacterium bovis subsp bovis AF2122/97
cagcacggcggcca

SEQ ID NO: 3179298 - RNA, 17 nt, Mycobacterium bovis subsp bovis AF2122/97
cagcacggcuucgacca

SEQ ID NO: 3179299 - RNA, 23 nt, Mycobacterium bovis subsp bovis AF2122/97
cagcacggcuucgcgguuggcgg

SEQ ID NO: 3179300 - RNA, 12 nt, Mycobacterium bovis subsp bovis AF2122/97
cagcacggucaa

SEQ ID NO: 3179301 - RNA, 15 nt, Mycobacterium bovis subsp bovis AF2122/97
cagcacggucaacgu

SEQ ID NO: 3179302 - RNA, 17 nt, Mycobacterium bovis subsp bovis AF2122/97
cagcacggugaucagca

SEQ ID NO: 3179303 - RNA, 21 nt, Mycobacterium bovis subsp bovis AF2122/97
cagcacgguggcuucgacggc

SEQ ID NO: 3179304 - RNA, 23 nt, Mycobacterium bovis subsp bovis AF2122/97
cagcacgguguacgcccgcucgg

SEQ ID NO: 3179305 - RNA, 15 nt, Mycobacterium bovis subsp bovis AF2122/97
cagcacguaacccag

SEQ ID NO: 3179306 - RNA, 13 nt, Mycobacterium bovis subsp bovis AF2122/97
cagcagcgcgacg

SEQ ID NO: 3179307 - RNA, 14 nt, Mycobacterium bovis subsp bovis AF2122/97
cagcagcgcgacgg

SEQ ID NO: 3179308 - RNA, 11 nt, Mycobacterium bovis subsp bovis AF2122/97
cagcagcgcgc

SEQ ID NO: 3179309 - RNA, 15 nt, Mycobacterium bovis subsp bovis AF2122/97
cagcagcgcgcgggu

SEQ ID NO: 3179310 - RNA, 19 nt, Mycobacterium bovis subsp bovis AF2122/97
cagcagcgcgcggguuacc

SEQ ID NO: 3179311 - RNA, 21 nt, Mycobacterium bovis subsp bovis AF2122/97
cagcagcggcgaccgcggucg

SEQ ID NO: 3179312 - RNA, 16 nt, Mycobacterium bovis subsp bovis AF2122/97
cagcagcggcgagcca

SEQ ID NO: 3179313 - RNA, 13 nt, Mycobacterium bovis subsp bovis AF2122/97
cagcagcggcgga

SEQ ID NO: 3179314 - RNA, 20 nt, Mycobacterium bovis subsp bovis AF2122/97
cagcagcggcggaaggacgg

SEQ ID NO: 3179315 - RNA, 21 nt, Mycobacterium bovis subsp bovis AF2122/97
cagcagcggcggcgacgagcg

SEQ ID NO: 3179316 - RNA, 14 nt, Mycobacterium bovis subsp bovis AF2122/97
cagcagcgggcgcg

SEQ ID NO: 3179317 - RNA, 16 nt, Mycobacterium bovis subsp bovis AF2122/97
cagcagcgggcgcgcu

SEQ ID NO: 3179318 - RNA, 22 nt, Mycobacterium bovis subsp bovis AF2122/97
cagcagcggugcagcccgccgg

SEQ ID NO: 3179319 - RNA, 14 nt, Mycobacterium bovis subsp bovis AF2122/97
cagcagcgguugau

SEQ ID NO: 3179320 - RNA, 18 nt, Mycobacterium bovis subsp bovis AF2122/97
cagcagcgguugaugcgg

SEQ ID NO: 3179321 - RNA, 19 nt, Mycobacterium bovis subsp bovis AF2122/97
cagcagcgguugaugcggc

SEQ ID NO: 3179322 - RNA, 13 nt, Mycobacterium bovis subsp bovis AF2122/97
cagcagcgucggu

SEQ ID NO: 3179323 - RNA, 14 nt, Mycobacterium bovis subsp bovis AF2122/97
cagcagcgugacca

SEQ ID NO: 3179324 - RNA, 16 nt, Mycobacterium bovis subsp bovis AF2122/97
cagcagcgugaccacc

SEQ ID NO: 3179325 - RNA, 20 nt, Mycobacterium bovis subsp bovis AF2122/97
cagcagcgugaccaccgccg

SEQ ID NO: 3179326 - RNA, 24 nt, Mycobacterium bovis subsp bovis AF2122/97
cagcagcgugaccaccgccgacag

SEQ ID NO: 3179327 - RNA, 20 nt, Mycobacterium bovis subsp bovis AF2122/97
cagcagcguugacggcuucg

SEQ ID NO: 3179328 - RNA, 14 nt, Mycobacterium bovis subsp bovis AF2122/97
cagcagcuccacug

SEQ ID NO: 3179329 - RNA, 16 nt, Mycobacterium bovis subsp bovis AF2122/97
cagcagcuccacuggc

SEQ ID NO: 3179330 - RNA, 18 nt, Mycobacterium bovis subsp bovis AF2122/97
cagcagcucgccggcacg

SEQ ID NO: 3179331 - RNA, 16 nt, Mycobacterium bovis subsp bovis AF2122/97
cagcagcucggggcga

SEQ ID NO: 3179332 - RNA, 19 nt, Mycobacterium bovis subsp bovis AF2122/97
cagcagcucggggcgauga

SEQ ID NO: 3179333 - RNA, 17 nt, Mycobacterium bovis subsp bovis AF2122/97
cagcagcucguugaugc

SEQ ID NO: 3179334 - RNA, 13 nt, Mycobacterium bovis subsp bovis AF2122/97
cagcagcugcgau

SEQ ID NO: 3179335 - RNA, 20 nt, Mycobacterium bovis subsp bovis AF2122/97
cagcagcuugacaucgguca

SEQ ID NO: 3179336 - RNA, 21 nt, Mycobacterium bovis subsp bovis AF2122/97
cagcagcuugacccacauucc

SEQ ID NO: 3179337 - RNA, 23 nt, Mycobacterium bovis subsp bovis AF2122/97
cagcagcuuguuuuccaccagcg

SEQ ID NO: 3179338 - RNA, 21 nt, Mycobacterium bovis subsp bovis AF2122/97
cagcaggaaguaccccuugga

SEQ ID NO: 3179339 - RNA, 18 nt, Mycobacterium bovis subsp bovis AF2122/97
cagcaggaaguagccgag

SEQ ID NO: 3179340 - RNA, 13 nt, Mycobacterium bovis subsp bovis AF2122/97
cagcaggacaccu

SEQ ID NO: 3179341 - RNA, 19 nt, Mycobacterium bovis subsp bovis AF2122/97
cagcaggaucggcagcaga

SEQ ID NO: 3179342 - RNA, 14 nt, Mycobacterium bovis subsp bovis AF2122/97
cagcaggaugauga

SEQ ID NO: 3179343 - RNA, 22 nt, Mycobacterium bovis subsp bovis AF2122/97
cagcaggcauucccgcggcaac

SEQ ID NO: 3179344 - RNA, 23 nt, Mycobacterium bovis subsp bovis AF2122/97
cagcaggcauucccgcggcaacg

SEQ ID NO: 3179345 - RNA, 17 nt, Mycobacterium bovis subsp bovis AF2122/97
cagcaggccacugcguu

SEQ ID NO: 3179346 - RNA, 14 nt, Mycobacterium bovis subsp bovis AF2122/97
cagcaggcccaccc

SEQ ID NO: 3179347 - RNA, 15 nt, Mycobacterium bovis subsp bovis AF2122/97
cagcaggcccacccg

SEQ ID NO: 3179348 - RNA, 16 nt, Mycobacterium bovis subsp bovis AF2122/97
cagcaggcccagcgga

SEQ ID NO: 3179349 - RNA, 16 nt, Mycobacterium bovis subsp bovis AF2122/97
cagcaggcccuggcca

SEQ ID NO: 3179350 - RNA, 22 nt, Mycobacterium bovis subsp bovis AF2122/97
cagcaggcccuggccacccaga

SEQ ID NO: 3179351 - RNA, 18 nt, Mycobacterium bovis subsp bovis AF2122/97
cagcaggcccuucaguuc

SEQ ID NO: 3179352 - RNA, 16 nt, Mycobacterium bovis subsp bovis AF2122/97
cagcaggccgcgcucg

SEQ ID NO: 3179353 - RNA, 16 nt, Mycobacterium bovis subsp bovis AF2122/97
cagcaggccgggacag

SEQ ID NO: 3179354 - RNA, 20 nt, Mycobacterium bovis subsp bovis AF2122/97
cagcaggccgggacagcgcc

SEQ ID NO: 3179355 - RNA, 17 nt, Mycobacterium bovis subsp bovis AF2122/97
cagcaggccgggcgcaa

SEQ ID NO: 3179356 - RNA, 19 nt, Mycobacterium bovis subsp bovis AF2122/97
cagcaggccgggcgcaagc

SEQ ID NO: 3179357 - RNA, 16 nt, Mycobacterium bovis subsp bovis AF2122/97
cagcaggccgucgauc

SEQ ID NO: 3179358 - RNA, 14 nt, Mycobacterium bovis subsp bovis AF2122/97
cagcaggccuccaa

SEQ ID NO: 3179359 - RNA, 13 nt, Mycobacterium bovis subsp bovis AF2122/97
cagcaggcgaugc

SEQ ID NO: 3179360 - RNA, 12 nt, Mycobacterium bovis subsp bovis AF2122/97
cagcaggcggcu

SEQ ID NO: 3179361 - RNA, 14 nt, Mycobacterium bovis subsp bovis AF2122/97
cagcaggcggcuga

SEQ ID NO: 3179362 - RNA, 20 nt, Mycobacterium bovis subsp bovis AF2122/97
cagcaggcucgaaccgacgc

SEQ ID NO: 3179363 - RNA, 14 nt, Mycobacterium bovis subsp bovis AF2122/97
cagcagggccacca

SEQ ID NO: 3179364 - RNA, 16 nt, Mycobacterium bovis subsp bovis AF2122/97
cagcagggccaccacc

SEQ ID NO: 3179365 - RNA, 17 nt, Mycobacterium bovis subsp bovis AF2122/97
cagcagggccaccacca

SEQ ID NO: 3179366 - RNA, 18 nt, Mycobacterium bovis subsp bovis AF2122/97
cagcagggccaccaccac

SEQ ID NO: 3179367 - RNA, 19 nt, Mycobacterium bovis subsp bovis AF2122/97
cagcagggccaccaccacg

SEQ ID NO: 3179368 - RNA, 22 nt, Mycobacterium bovis subsp bovis AF2122/97
cagcagggccaccaccacggcc

SEQ ID NO: 3179369 - RNA, 18 nt, Mycobacterium bovis subsp bovis AF2122/97
cagcagggccagaccgaa

SEQ ID NO: 3179370 - RNA, 15 nt, Mycobacterium bovis subsp bovis AF2122/97
cagcagggcgcgcau

SEQ ID NO: 3179371 - RNA, 20 nt, Mycobacterium bovis subsp bovis AF2122/97
cagcagggcgcgcaucugcu

SEQ ID NO: 3179372 - RNA, 23 nt, Mycobacterium bovis subsp bovis AF2122/97
cagcagggcgcgcaucugcucgg

SEQ ID NO: 3179373 - RNA, 22 nt, Mycobacterium bovis subsp bovis AF2122/97
cagcagggcuucgugcaccaca

SEQ ID NO: 3179374 - RNA, 16 nt, Mycobacterium bovis subsp bovis AF2122/97
cagcaggggacgacca

SEQ ID NO: 3179375 - RNA, 22 nt, Mycobacterium bovis subsp bovis AF2122/97
cagcaggggacgaccaugccga

SEQ ID NO: 3179376 - RNA, 16 nt, Mycobacterium bovis subsp bovis AF2122/97
cagcaggggacgggcg

SEQ ID NO: 3179377 - RNA, 20 nt, Mycobacterium bovis subsp bovis AF2122/97
cagcaggggacgggcggcca

SEQ ID NO: 3179378 - RNA, 23 nt, Mycobacterium bovis subsp bovis AF2122/97
cagcaggggacgggcggccagga

SEQ ID NO: 3179379 - RNA, 23 nt, Mycobacterium bovis subsp bovis AF2122/97
cagcagggugugcgucugcggcg

SEQ ID NO: 3179380 - RNA, 17 nt, Mycobacterium bovis subsp bovis AF2122/97
cagcagguccgcggccg

SEQ ID NO: 3179381 - RNA, 21 nt, Mycobacterium bovis subsp bovis AF2122/97
cagcaggucgccugcccccgc

SEQ ID NO: 3179382 - RNA, 14 nt, Mycobacterium bovis subsp bovis AF2122/97
cagcaggucgucgg

SEQ ID NO: 3179383 - RNA, 20 nt, Mycobacterium bovis subsp bovis AF2122/97
cagcaggugagccaguuggc

SEQ ID NO: 3179384 - RNA, 20 nt, Mycobacterium bovis subsp bovis AF2122/97
cagcaggugccaaccgcggc

SEQ ID NO: 3179385 - RNA, 21 nt, Mycobacterium bovis subsp bovis AF2122/97
cagcaggugccaaccgcggcg

SEQ ID NO: 3179386 - RNA, 18 nt, Mycobacterium bovis subsp bovis AF2122/97
cagcagguuccacggcca

SEQ ID NO: 3179387 - RNA, 16 nt, Mycobacterium bovis subsp bovis AF2122/97
cagcagguugccgaag

SEQ ID NO: 3179388 - RNA, 14 nt, Mycobacterium bovis subsp bovis AF2122/97
cagcagguuggcga

SEQ ID NO: 3179389 - RNA, 15 nt, Mycobacterium bovis subsp bovis AF2122/97
cagcagguuguaguc

SEQ ID NO: 3179390 - RNA, 21 nt, Mycobacterium bovis subsp bovis AF2122/97
cagcagguuguaguccgcgcc

SEQ ID NO: 3179391 - RNA, 22 nt, Mycobacterium bovis subsp bovis AF2122/97
cagcagguuguaguccgcgccg

SEQ ID NO: 3179392 - RNA, 17 nt, Mycobacterium bovis subsp bovis AF2122/97
cagccaccgucaugccg

SEQ ID NO: 3179393 - RNA, 20 nt, Mycobacterium bovis subsp bovis AF2122/97
cagccaccgucaugccgacg

SEQ ID NO: 3179394 - RNA, 20 nt, Mycobacterium bovis subsp bovis AF2122/97
cagccaccucgacggugacg

SEQ ID NO: 3179395 - RNA, 22 nt, Mycobacterium bovis subsp bovis AF2122/97
cagccaccugccgacucaucgg

SEQ ID NO: 3179396 - RNA, 23 nt, Mycobacterium bovis subsp bovis AF2122/97
cagccaccugccgacucaucggc

SEQ ID NO: 3179397 - RNA, 18 nt, Mycobacterium bovis subsp bovis AF2122/97
cagccacgauccuuggcg

SEQ ID NO: 3179398 - RNA, 17 nt, Mycobacterium bovis subsp bovis AF2122/97
cagccacgcagcacggc

SEQ ID NO: 3179399 - RNA, 13 nt, Mycobacterium bovis subsp bovis AF2122/97
cagccacgccacg

SEQ ID NO: 3179400 - RNA, 20 nt, Mycobacterium bovis subsp bovis AF2122/97
cagccacguuacgcucgcgg

SEQ ID NO: 3179401 - RNA, 22 nt, Mycobacterium bovis subsp bovis AF2122/97
cagccacuccucggugugcucg

SEQ ID NO: 3179402 - RNA, 21 nt, Mycobacterium bovis subsp bovis AF2122/97
cagccacucgccacucagccc

SEQ ID NO: 3179403 - RNA, 14 nt, Mycobacterium bovis subsp bovis AF2122/97
cagccacugacggc

SEQ ID NO: 3179404 - RNA, 11 nt, Mycobacterium bovis subsp bovis AF2122/97
cagccagacca

SEQ ID NO: 3179405 - RNA, 14 nt, Mycobacterium bovis subsp bovis AF2122/97
cagccagaccaaca

SEQ ID NO: 3179406 - RNA, 13 nt, Mycobacterium bovis subsp bovis AF2122/97
cagccagaucucc

SEQ ID NO: 3179407 - RNA, 19 nt, Mycobacterium bovis subsp bovis AF2122/97
cagccagaucuccagguuc

SEQ ID NO: 3179408 - RNA, 18 nt, Mycobacterium bovis subsp bovis AF2122/97
cagccagaucuccccgac

SEQ ID NO: 3179409 - RNA, 21 nt, Mycobacterium bovis subsp bovis AF2122/97
cagccagaugccgguaacgaa

SEQ ID NO: 3179410 - RNA, 18 nt, Mycobacterium bovis subsp bovis AF2122/97
cagccagauucauuggcc

SEQ ID NO: 3179411 - RNA, 21 nt, Mycobacterium bovis subsp bovis AF2122/97
cagccagauucauuggccugg

SEQ ID NO: 3179412 - RNA, 18 nt, Mycobacterium bovis subsp bovis AF2122/97
cagccagauuugacgaca

SEQ ID NO: 3179413 - RNA, 15 nt, Mycobacterium bovis subsp bovis AF2122/97
cagccagcaacacca

SEQ ID NO: 3179414 - RNA, 19 nt, Mycobacterium bovis subsp bovis AF2122/97
cagccagcccagccgccag

SEQ ID NO: 3179415 - RNA, 14 nt, Mycobacterium bovis subsp bovis AF2122/97
cagccagccgcccu

SEQ ID NO: 3179416 - RNA, 14 nt, Mycobacterium bovis subsp bovis AF2122/97
cagccagccggagu

SEQ ID NO: 3179417 - RNA, 17 nt, Mycobacterium bovis subsp bovis AF2122/97
cagccagccugcuggcc

SEQ ID NO: 3179418 - RNA, 22 nt, Mycobacterium bovis subsp bovis AF2122/97
cagccagccugcuggccgcggc

SEQ ID NO: 3179419 - RNA, 14 nt, Mycobacterium bovis subsp bovis AF2122/97
cagccagcgggcga

SEQ ID NO: 3179420 - RNA, 17 nt, Mycobacterium bovis subsp bovis AF2122/97
cagccagcgguagcugc

SEQ ID NO: 3179421 - RNA, 18 nt, Mycobacterium bovis subsp bovis AF2122/97
cagccagcguccaugguc

SEQ ID NO: 3179422 - RNA, 19 nt, Mycobacterium bovis subsp bovis AF2122/97
cagccagcguccauggucg

SEQ ID NO: 3179423 - RNA, 14 nt, Mycobacterium bovis subsp bovis AF2122/97
cagccagcuggacu

SEQ ID NO: 3179424 - RNA, 18 nt, Mycobacterium bovis subsp bovis AF2122/97
cagccagcuggacuccgg

SEQ ID NO: 3179425 - RNA, 22 nt, Mycobacterium bovis subsp bovis AF2122/97
cagccagcuggacuccggucag

SEQ ID NO: 3179426 - RNA, 15 nt, Mycobacterium bovis subsp bovis AF2122/97
cagccaggaagcggu

SEQ ID NO: 3179427 - RNA, 12 nt, Mycobacterium bovis subsp bovis AF2122/97
cagccaggagcc

SEQ ID NO: 3179428 - RNA, 23 nt, Mycobacterium bovis subsp bovis AF2122/97
cagccaggagccgaucacgcugc

SEQ ID NO: 3179429 - RNA, 20 nt, Mycobacterium bovis subsp bovis AF2122/97
cagccaggccuuggugcggc

SEQ ID NO: 3179430 - RNA, 16 nt, Mycobacterium bovis subsp bovis AF2122/97
cagccaggcgaaguac

SEQ ID NO: 3179431 - RNA, 20 nt, Mycobacterium bovis subsp bovis AF2122/97
cagccaggcgugcacagguc

SEQ ID NO: 3179432 - RNA, 15 nt, Mycobacterium bovis subsp bovis AF2122/97
cagccagggcgccga

SEQ ID NO: 3179433 - RNA, 16 nt, Mycobacterium bovis subsp bovis AF2122/97
cagccagggcgccgaa

SEQ ID NO: 3179434 - RNA, 19 nt, Mycobacterium bovis subsp bovis AF2122/97
cagccagggucccgccgcc

SEQ ID NO: 3179435 - RNA, 24 nt, Mycobacterium bovis subsp bovis AF2122/97
cagccagggucccgccgccuggaa

SEQ ID NO: 3179436 - RNA, 22 nt, Mycobacterium bovis subsp bovis AF2122/97
cagccaggugauuaccugguuc

SEQ ID NO: 3179437 - RNA, 19 nt, Mycobacterium bovis subsp bovis AF2122/97
cagccaggugucgucgauc

SEQ ID NO: 3179438 - RNA, 23 nt, Mycobacterium bovis subsp bovis AF2122/97
cagccaggugucgucgaucgcgg

SEQ ID NO: 3179439 - RNA, 17 nt, Mycobacterium bovis subsp bovis AF2122/97
cagccaguccagcgcgc

SEQ ID NO: 3179440 - RNA, 19 nt, Mycobacterium bovis subsp bovis AF2122/97
cagccaguguugcaguggc

SEQ ID NO: 3179441 - RNA, 20 nt, Mycobacterium bovis subsp bovis AF2122/97
cagccaguguugcaguggcg

SEQ ID NO: 3179442 - RNA, 19 nt, Mycobacterium bovis subsp bovis AF2122/97
cagccaguugaucaggccg

SEQ ID NO: 3179443 - RNA, 22 nt, Mycobacterium bovis subsp bovis AF2122/97
cagccauacuccgagggaacgg

SEQ ID NO: 3179444 - RNA, 15 nt, Mycobacterium bovis subsp bovis AF2122/97
cagccauagugcggc

SEQ ID NO: 3179445 - RNA, 16 nt, Mycobacterium bovis subsp bovis AF2122/97
cagccaugcggcugcc

SEQ ID NO: 3179446 - RNA, 23 nt, Mycobacterium bovis subsp bovis AF2122/97
cagccaugcgguuugccggugcg

SEQ ID NO: 3179447 - RNA, 17 nt, Mycobacterium bovis subsp bovis AF2122/97
cagccaugcucgucuug

SEQ ID NO: 3179448 - RNA, 20 nt, Mycobacterium bovis subsp bovis AF2122/97
cagccaugcucgucuugggc

SEQ ID NO: 3179449 - RNA, 15 nt, Mycobacterium bovis subsp bovis AF2122/97
cagccaugcugcucg

SEQ ID NO: 3179450 - RNA, 19 nt, Mycobacterium bovis subsp bovis AF2122/97
cagccauggcagcgccgca

SEQ ID NO: 3179451 - RNA, 14 nt, Mycobacterium bovis subsp bovis AF2122/97
cagccauggccgcc

SEQ ID NO: 3179452 - RNA, 16 nt, Mycobacterium bovis subsp bovis AF2122/97
cagccauggugggccu

SEQ ID NO: 3179453 - RNA, 22 nt, Mycobacterium bovis subsp bovis AF2122/97
cagccauguccgcaguucgguc

SEQ ID NO: 3179454 - RNA, 21 nt, Mycobacterium bovis subsp bovis AF2122/97
cagccauucuucgaucagcgg

SEQ ID NO: 3179455 - RNA, 22 nt, Mycobacterium bovis subsp bovis AF2122/97
cagccauucuucgaucagcggc

SEQ ID NO: 3179456 - RNA, 16 nt, Mycobacterium bovis subsp bovis AF2122/97
cagcccaaagcgccag

SEQ ID NO: 3179457 - RNA, 15 nt, Mycobacterium bovis subsp bovis AF2122/97
cagcccaaaucccag

SEQ ID NO: 3179458 - RNA, 17 nt, Mycobacterium bovis subsp bovis AF2122/97
cagcccaacucggccag

SEQ ID NO: 3179459 - RNA, 19 nt, Mycobacterium bovis subsp bovis AF2122/97
cagcccaacucggccagcu

SEQ ID NO: 3179460 - RNA, 21 nt, Mycobacterium bovis subsp bovis AF2122/97
cagcccaacucggccagcuug

SEQ ID NO: 3179461 - RNA, 17 nt, Mycobacterium bovis subsp bovis AF2122/97
cagcccacaggcggcgc

SEQ ID NO: 3179462 - RNA, 15 nt, Mycobacterium bovis subsp bovis AF2122/97
cagcccaccggcgcc

SEQ ID NO: 3179463 - RNA, 20 nt, Mycobacterium bovis subsp bovis AF2122/97
cagcccaccggcgccgccgg

SEQ ID NO: 3179464 - RNA, 13 nt, Mycobacterium bovis subsp bovis AF2122/97
cagcccaccggug

SEQ ID NO: 3179465 - RNA, 14 nt, Mycobacterium bovis subsp bovis AF2122/97
cagcccaccggugc

SEQ ID NO: 3179466 - RNA, 10 nt, Mycobacterium bovis subsp bovis AF2122/97
cagcccacuc

SEQ ID NO: 3179467 - RNA, 14 nt, Mycobacterium bovis subsp bovis AF2122/97
cagcccagcacgcu

SEQ ID NO: 3179468 - RNA, 16 nt, Mycobacterium bovis subsp bovis AF2122/97
cagcccagcacgcugg

SEQ ID NO: 3179469 - RNA, 22 nt, Mycobacterium bovis subsp bovis AF2122/97
cagcccagcagguuccacggcc

SEQ ID NO: 3179470 - RNA, 22 nt, Mycobacterium bovis subsp bovis AF2122/97
cagcccagccaacucaggccgg

SEQ ID NO: 3179471 - RNA, 13 nt, Mycobacterium bovis subsp bovis AF2122/97
cagcccaggccuu

SEQ ID NO: 3179472 - RNA, 16 nt, Mycobacterium bovis subsp bovis AF2122/97
cagcccaggguguccg

SEQ ID NO: 3179473 - RNA, 20 nt, Mycobacterium bovis subsp bovis AF2122/97
cagcccaucccgauccugcc

SEQ ID NO: 3179474 - RNA, 18 nt, Mycobacterium bovis subsp bovis AF2122/97
cagcccaucuaccagcuc

SEQ ID NO: 3179475 - RNA, 15 nt, Mycobacterium bovis subsp bovis AF2122/97
cagcccaugcccggc

SEQ ID NO: 3179476 - RNA, 16 nt, Mycobacterium bovis subsp bovis AF2122/97
cagcccaugcgccacg

SEQ ID NO: 3179477 - RNA, 13 nt, Mycobacterium bovis subsp bovis AF2122/97
cagcccaugggcg

SEQ ID NO: 3179478 - RNA, 15 nt, Mycobacterium bovis subsp bovis AF2122/97
cagcccgucggcgcc

SEQ ID NO: 3179479 - RNA, 18 nt, Mycobacterium bovis subsp bovis AF2122/97
cagcccgucggcgccgaa

SEQ ID NO: 3179480 - RNA, 19 nt, Mycobacterium bovis subsp bovis AF2122/97
cagcccgucggcgccgaac

SEQ ID NO: 3179481 - RNA, 14 nt, Mycobacterium bovis subsp bovis AF2122/97
cagcccgucggugg

SEQ ID NO: 3179482 - RNA, 15 nt, Mycobacterium bovis subsp bovis AF2122/97
cagcccgugacuggu

SEQ ID NO: 3179483 - RNA, 19 nt, Mycobacterium bovis subsp bovis AF2122/97
cagcccgugacuggugaac

SEQ ID NO: 3179484 - RNA, 15 nt, Mycobacterium bovis subsp bovis AF2122/97
cagcccguugcagga

SEQ ID NO: 3179485 - RNA, 16 nt, Mycobacterium bovis subsp bovis AF2122/97
cagcccuaucagccga

SEQ ID NO: 3179486 - RNA, 22 nt, Mycobacterium bovis subsp bovis AF2122/97
cagcccucugguggcgcugaag

SEQ ID NO: 3179487 - RNA, 23 nt, Mycobacterium bovis subsp bovis AF2122/97
cagcccucugguggcgcugaagc

SEQ ID NO: 3179488 - RNA, 14 nt, Mycobacterium bovis subsp bovis AF2122/97
cagcccugcgcagc

SEQ ID NO: 3179489 - RNA, 19 nt, Mycobacterium bovis subsp bovis AF2122/97
cagcccugcgcagccgccu

SEQ ID NO: 3179490 - RNA, 14 nt, Mycobacterium bovis subsp bovis AF2122/97
cagcccuucagcga

SEQ ID NO: 3179491 - RNA, 21 nt, Mycobacterium bovis subsp bovis AF2122/97
cagcccuucagcgaagccggg

SEQ ID NO: 3179492 - RNA, 15 nt, Mycobacterium bovis subsp bovis AF2122/97
cagcccuucgcggga

SEQ ID NO: 3179493 - RNA, 18 nt, Mycobacterium bovis subsp bovis AF2122/97
cagcccuuggcgcgcagg

SEQ ID NO: 3179494 - RNA, 15 nt, Mycobacterium bovis subsp bovis AF2122/97
cagccgaaccggcac

SEQ ID NO: 3179495 - RNA, 16 nt, Mycobacterium bovis subsp bovis AF2122/97
cagccgaaccggcacc

SEQ ID NO: 3179496 - RNA, 17 nt, Mycobacterium bovis subsp bovis AF2122/97
cagccgaaccggcacca

SEQ ID NO: 3179497 - RNA, 16 nt, Mycobacterium bovis subsp bovis AF2122/97
cagccgaagaaccggu

SEQ ID NO: 3179498 - RNA, 14 nt, Mycobacterium bovis subsp bovis AF2122/97
cagccgaagccgaa

SEQ ID NO: 3179499 - RNA, 14 nt, Mycobacterium bovis subsp bovis AF2122/97
cagccgaagcgccc

SEQ ID NO: 3179500 - RNA, 15 nt, Mycobacterium bovis subsp bovis AF2122/97
cagccgaagcgcccg

SEQ ID NO: 3179501 - RNA, 17 nt, Mycobacterium bovis subsp bovis AF2122/97
cagccgaaguggcgccu

SEQ ID NO: 3179502 - RNA, 18 nt, Mycobacterium bovis subsp bovis AF2122/97
cagccgacaacuguccug

SEQ ID NO: 3179503 - RNA, 16 nt, Mycobacterium bovis subsp bovis AF2122/97
cagccgacagaugguc

SEQ ID NO: 3179504 - RNA, 20 nt, Mycobacterium bovis subsp bovis AF2122/97
cagccgaccgaaucagcacg

SEQ ID NO: 3179505 - RNA, 22 nt, Mycobacterium bovis subsp bovis AF2122/97
cagccgacgcacgugaugcccu

SEQ ID NO: 3179506 - RNA, 13 nt, Mycobacterium bovis subsp bovis AF2122/97
cagccgacgcggc

SEQ ID NO: 3179507 - RNA, 14 nt, Mycobacterium bovis subsp bovis AF2122/97
cagccgacgcggcg

SEQ ID NO: 3179508 - RNA, 22 nt, Mycobacterium bovis subsp bovis AF2122/97
cagccgagcgagaaucacgguc

SEQ ID NO: 3179509 - RNA, 19 nt, Mycobacterium bovis subsp bovis AF2122/97
cagccgagcggcggcacug

SEQ ID NO: 3179510 - RNA, 22 nt, Mycobacterium bovis subsp bovis AF2122/97
cagccgagcucacuucacgccg

SEQ ID NO: 3179511 - RNA, 17 nt, Mycobacterium bovis subsp bovis AF2122/97
cagccgauacaggccac

SEQ ID NO: 3179512 - RNA, 21 nt, Mycobacterium bovis subsp bovis AF2122/97
cagccgauacaggccacgcac

SEQ ID NO: 3179513 - RNA, 16 nt, Mycobacterium bovis subsp bovis AF2122/97
cagccgaucaucaccg

SEQ ID NO: 3179514 - RNA, 19 nt, Mycobacterium bovis subsp bovis AF2122/97
cagccgauccgaucgcaga

SEQ ID NO: 3179515 - RNA, 21 nt, Mycobacterium bovis subsp bovis AF2122/97
cagccgaucgucucggccacg

SEQ ID NO: 3179516 - RNA, 12 nt, Mycobacterium bovis subsp bovis AF2122/97
cagccgaugcug

SEQ ID NO: 3179517 - RNA, 19 nt, Mycobacterium bovis subsp bovis AF2122/97
cagccgaugcugcgggcgg

SEQ ID NO: 3179518 - RNA, 20 nt, Mycobacterium bovis subsp bovis AF2122/97
cagccgaugcugcgggcggu

SEQ ID NO: 3179519 - RNA, 18 nt, Mycobacterium bovis subsp bovis AF2122/97
cagccgaugucgcgcgcu

SEQ ID NO: 3179520 - RNA, 21 nt, Mycobacterium bovis subsp bovis AF2122/97
cagccgcaacaccccccgucc

SEQ ID NO: 3179521 - RNA, 24 nt, Mycobacterium bovis subsp bovis AF2122/97
cagccgcaacaccccccguccacc

SEQ ID NO: 3179522 - RNA, 22 nt, Mycobacterium bovis subsp bovis AF2122/97
cagccgcaccaguggcgcccau

SEQ ID NO: 3179523 - RNA, 13 nt, Mycobacterium bovis subsp bovis AF2122/97
cagccgcaccccg

SEQ ID NO: 3179524 - RNA, 15 nt, Mycobacterium bovis subsp bovis AF2122/97
cagccgcaccccgcc

SEQ ID NO: 3179525 - RNA, 14 nt, Mycobacterium bovis subsp bovis AF2122/97
cagccgcacgguuc

SEQ ID NO: 3179526 - RNA, 22 nt, Mycobacterium bovis subsp bovis AF2122/97
cagccgcacgguugccgucagg

SEQ ID NO: 3179527 - RNA, 16 nt, Mycobacterium bovis subsp bovis AF2122/97
cagccgcagcaccucg

SEQ ID NO: 3179528 - RNA, 14 nt, Mycobacterium bovis subsp bovis AF2122/97
cagccgcagccagg

SEQ ID NO: 3179529 - RNA, 13 nt, Mycobacterium bovis subsp bovis AF2122/97
cagccgcagcggc

SEQ ID NO: 3179530 - RNA, 16 nt, Mycobacterium bovis subsp bovis AF2122/97
cagccgcaggccaugg

SEQ ID NO: 3179531 - RNA, 16 nt, Mycobacterium bovis subsp bovis AF2122/97
cagccgccagcccguc

SEQ ID NO: 3179532 - RNA, 12 nt, Mycobacterium bovis subsp bovis AF2122/97
cagccgccccgg

SEQ ID NO: 3179533 - RNA, 13 nt, Mycobacterium bovis subsp bovis AF2122/97
cagccgcccgccc

SEQ ID NO: 3179534 - RNA, 21 nt, Mycobacterium bovis subsp bovis AF2122/97
cagccgcccugaauccucucg

SEQ ID NO: 3179535 - RNA, 22 nt, Mycobacterium bovis subsp bovis AF2122/97
cagccgcccugaauccucucga

SEQ ID NO: 3179536 - RNA, 12 nt, Mycobacterium bovis subsp bovis AF2122/97
cagccgccgacu

SEQ ID NO: 3179537 - RNA, 21 nt, Mycobacterium bovis subsp bovis AF2122/97
cagccgccgacuuccgcgucg

SEQ ID NO: 3179538 - RNA, 14 nt, Mycobacterium bovis subsp bovis AF2122/97
cagccgccgccugu

SEQ ID NO: 3179539 - RNA, 22 nt, Mycobacterium bovis subsp bovis AF2122/97
cagccgccgccugugcgcggug

SEQ ID NO: 3179540 - RNA, 15 nt, Mycobacterium bovis subsp bovis AF2122/97
cagccgccggccggc

SEQ ID NO: 3179541 - RNA, 23 nt, Mycobacterium bovis subsp bovis AF2122/97
cagccgccucaaugaccaccggg

SEQ ID NO: 3179542 - RNA, 18 nt, Mycobacterium bovis subsp bovis AF2122/97
cagccgcgacauccgcgg

SEQ ID NO: 3179543 - RNA, 13 nt, Mycobacterium bovis subsp bovis AF2122/97
cagccgcgacgcg

SEQ ID NO: 3179544 - RNA, 15 nt, Mycobacterium bovis subsp bovis AF2122/97
cagccgcgacgcggc

SEQ ID NO: 3179545 - RNA, 14 nt, Mycobacterium bovis subsp bovis AF2122/97
cagccgcgagccgg

SEQ ID NO: 3179546 - RNA, 19 nt, Mycobacterium bovis subsp bovis AF2122/97
cagccgcgagccggugauc

SEQ ID NO: 3179547 - RNA, 12 nt, Mycobacterium bovis subsp bovis AF2122/97
cagccgcgccga

SEQ ID NO: 3179548 - RNA, 13 nt, Mycobacterium bovis subsp bovis AF2122/97
cagccgcgccgcg

SEQ ID NO: 3179549 - RNA, 15 nt, Mycobacterium bovis subsp bovis AF2122/97
cagccgcgccgcggc

SEQ ID NO: 3179550 - RNA, 17 nt, Mycobacterium bovis subsp bovis AF2122/97
cagccgcgccgcggccc

SEQ ID NO: 3179551 - RNA, 22 nt, Mycobacterium bovis subsp bovis AF2122/97
cagccgcgccgcggcccgcucc

SEQ ID NO: 3179552 - RNA, 13 nt, Mycobacterium bovis subsp bovis AF2122/97
cagccgcgcgcca

SEQ ID NO: 3179553 - RNA, 16 nt, Mycobacterium bovis subsp bovis AF2122/97
cagccgcgcgccaucg

SEQ ID NO: 3179554 - RNA, 22 nt, Mycobacterium bovis subsp bovis AF2122/97
cagccgcgcgccaucgccucca

SEQ ID NO: 3179555 - RNA, 13 nt, Mycobacterium bovis subsp bovis AF2122/97
cagccgcgcgccg

SEQ ID NO: 3179556 - RNA, 21 nt, Mycobacterium bovis subsp bovis AF2122/97
cagccgcgcgggucacgaccu

SEQ ID NO: 3179557 - RNA, 22 nt, Mycobacterium bovis subsp bovis AF2122/97
cagccgcgcgguacugcgcagc

SEQ ID NO: 3179558 - RNA, 14 nt, Mycobacterium bovis subsp bovis AF2122/97
cagccgcgcgguga

SEQ ID NO: 3179559 - RNA, 17 nt, Mycobacterium bovis subsp bovis AF2122/97
cagccgcgcguccgggc

SEQ ID NO: 3179560 - RNA, 13 nt, Mycobacterium bovis subsp bovis AF2122/97
cagccgcgcugcg

SEQ ID NO: 3179561 - RNA, 13 nt, Mycobacterium bovis subsp bovis AF2122/97
cagccgcggcccu

SEQ ID NO: 3179562 - RNA, 13 nt, Mycobacterium bovis subsp bovis AF2122/97
cagccgcggcggc

SEQ ID NO: 3179563 - RNA, 16 nt, Mycobacterium bovis subsp bovis AF2122/97
cagccgcgggccgcgu

SEQ ID NO: 3179564 - RNA, 19 nt, Mycobacterium bovis subsp bovis AF2122/97
cagccgcgggccgcgucca

SEQ ID NO: 3179565 - RNA, 17 nt, Mycobacterium bovis subsp bovis AF2122/97
cagccugccgaugacga

SEQ ID NO: 3179566 - RNA, 13 nt, Mycobacterium bovis subsp bovis AF2122/97
cagccugcgccgc

SEQ ID NO: 3179567 - RNA, 14 nt, Mycobacterium bovis subsp bovis AF2122/97
cagccugcgccgcg

SEQ ID NO: 3179568 - RNA, 15 nt, Mycobacterium bovis subsp bovis AF2122/97
cagccugcgccgcgc

SEQ ID NO: 3179569 - RNA, 12 nt, Mycobacterium bovis subsp bovis AF2122/97
cagccugcugca

SEQ ID NO: 3179570 - RNA, 15 nt, Mycobacterium bovis subsp bovis AF2122/97
cagccugcuggccgc

SEQ ID NO: 3179571 - RNA, 17 nt, Mycobacterium bovis subsp bovis AF2122/97
cagccugcuggccgcgg

SEQ ID NO: 3179572 - RNA, 22 nt, Mycobacterium bovis subsp bovis AF2122/97
cagccugcuggccgcggccucg

SEQ ID NO: 3179573 - RNA, 20 nt, Mycobacterium bovis subsp bovis AF2122/97
cagccuggcaaccacguccg

SEQ ID NO: 3179574 - RNA, 14 nt, Mycobacterium bovis subsp bovis AF2122/97
cagccuggccaucg

SEQ ID NO: 3179575 - RNA, 14 nt, Mycobacterium bovis subsp bovis AF2122/97
cagccuggccucgc

SEQ ID NO: 3179576 - RNA, 19 nt, Mycobacterium bovis subsp bovis AF2122/97
cagccuggccucgccauug

SEQ ID NO: 3179577 - RNA, 18 nt, Mycobacterium bovis subsp bovis AF2122/97
cagccuuaugcagugaca

SEQ ID NO: 3179578 - RNA, 21 nt, Mycobacterium bovis subsp bovis AF2122/97
cagccuuggacgugcgcgcca

SEQ ID NO: 3179579 - RNA, 18 nt, Mycobacterium bovis subsp bovis AF2122/97
cagccuuguugccgccgg

SEQ ID NO: 3179580 - RNA, 16 nt, Mycobacterium bovis subsp bovis AF2122/97
cagccuuuccggccgc

SEQ ID NO: 3179581 - RNA, 17 nt, Mycobacterium bovis subsp bovis AF2122/97
cagccuuuccggccgcc

SEQ ID NO: 3179582 - RNA, 18 nt, Mycobacterium bovis subsp bovis AF2122/97
cagccuuuccggccgccu

SEQ ID NO: 3179583 - RNA, 15 nt, Mycobacterium bovis subsp bovis AF2122/97
cagcgaaaaccgucg

SEQ ID NO: 3179584 - RNA, 19 nt, Mycobacterium bovis subsp bovis AF2122/97
cagcgaaacaccggccagc

SEQ ID NO: 3179585 - RNA, 17 nt, Mycobacterium bovis subsp bovis AF2122/97
cagcgaaagcgucgagc

SEQ ID NO: 3179586 - RNA, 22 nt, Mycobacterium bovis subsp bovis AF2122/97
cagcgaaaugcccaucaccaga

SEQ ID NO: 3179587 - RNA, 19 nt, Mycobacterium bovis subsp bovis AF2122/97
cagcgaaaugccggugccg

SEQ ID NO: 3179588 - RNA, 22 nt, Mycobacterium bovis subsp bovis AF2122/97
cagcgaacagacaugcgcacca

SEQ ID NO: 3179589 - RNA, 15 nt, Mycobacterium bovis subsp bovis AF2122/97
cagcgaaccaccggc

SEQ ID NO: 3179590 - RNA, 17 nt, Mycobacterium bovis subsp bovis AF2122/97
cagcgaaccaccggcgc

SEQ ID NO: 3179591 - RNA, 21 nt, Mycobacterium bovis subsp bovis AF2122/97
cagcgaaccaccggcgccgcc

SEQ ID NO: 3179592 - RNA, 17 nt, Mycobacterium bovis subsp bovis AF2122/97
cagcgaaccgccggcac

SEQ ID NO: 3179593 - RNA, 19 nt, Mycobacterium bovis subsp bovis AF2122/97
cagcgaaccgccggcaccg

SEQ ID NO: 3179594 - RNA, 22 nt, Mycobacterium bovis subsp bovis AF2122/97
cagcgaaccgccggcaccgccg

SEQ ID NO: 3179595 - RNA, 15 nt, Mycobacterium bovis subsp bovis AF2122/97
cagcgaaccggcugg

SEQ ID NO: 3179596 - RNA, 21 nt, Mycobacterium bovis subsp bovis AF2122/97
cagcgaaccggcugggcgcca

SEQ ID NO: 3179597 - RNA, 15 nt, Mycobacterium bovis subsp bovis AF2122/97
cagcgaacggccagg

SEQ ID NO: 3179598 - RNA, 16 nt, Mycobacterium bovis subsp bovis AF2122/97
cagcgaacggccagga

SEQ ID NO: 3179599 - RNA, 17 nt, Mycobacterium bovis subsp bovis AF2122/97
cagcgaacggccaggac

SEQ ID NO: 3179600 - RNA, 17 nt, Mycobacterium bovis subsp bovis AF2122/97
cagcgaagaccagcggc

SEQ ID NO: 3179601 - RNA, 14 nt, Mycobacterium bovis subsp bovis AF2122/97
cagcgaagccgggu

SEQ ID NO: 3179602 - RNA, 16 nt, Mycobacterium bovis subsp bovis AF2122/97
cagcgaaucacccgcg

SEQ ID NO: 3179603 - RNA, 16 nt, Mycobacterium bovis subsp bovis AF2122/97
cagcgaauccaggccg

SEQ ID NO: 3179604 - RNA, 14 nt, Mycobacterium bovis subsp bovis AF2122/97
cagcgacaacacca

SEQ ID NO: 3179605 - RNA, 21 nt, Mycobacterium bovis subsp bovis AF2122/97
cagcgacaacaccacggugcc

SEQ ID NO: 3179606 - RNA, 22 nt, Mycobacterium bovis subsp bovis AF2122/97
cagcgacagcgugccgaacagg

SEQ ID NO: 3179607 - RNA, 12 nt, Mycobacterium bovis subsp bovis AF2122/97
cagcgaccaccg

SEQ ID NO: 3179608 - RNA, 21 nt, Mycobacterium bovis subsp bovis AF2122/97
cagcgaccaggucgccagcuc

SEQ ID NO: 3179609 - RNA, 22 nt, Mycobacterium bovis subsp bovis AF2122/97
cagcgaccaggucgccagcucg

SEQ ID NO: 3179610 - RNA, 16 nt, Mycobacterium bovis subsp bovis AF2122/97
cagcgaccaguggugg

SEQ ID NO: 3179611 - RNA, 19 nt, Mycobacterium bovis subsp bovis AF2122/97
cagcgacccggccagcggc

SEQ ID NO: 3179612 - RNA, 23 nt, Mycobacterium bovis subsp bovis AF2122/97
cagcgacccggccagcggcagga

SEQ ID NO: 3179613 - RNA, 12 nt, Mycobacterium bovis subsp bovis AF2122/97
cagcgacccguu

SEQ ID NO: 3179614 - RNA, 15 nt, Mycobacterium bovis subsp bovis AF2122/97
cagcgaccgguaauc

SEQ ID NO: 3179615 - RNA, 21 nt, Mycobacterium bovis subsp bovis AF2122/97
cagcgaccgguaauccguugc

SEQ ID NO: 3179616 - RNA, 14 nt, Mycobacterium bovis subsp bovis AF2122/97
cagcgaccucacga

SEQ ID NO: 3179617 - RNA, 15 nt, Mycobacterium bovis subsp bovis AF2122/97
cagcgaccucacugc

SEQ ID NO: 3179618 - RNA, 20 nt, Mycobacterium bovis subsp bovis AF2122/97
cagcgaccucacugcggcgc

SEQ ID NO: 3179619 - RNA, 22 nt, Mycobacterium bovis subsp bovis AF2122/97
cagcgacgaagucgcagcugcc

SEQ ID NO: 3179620 - RNA, 15 nt, Mycobacterium bovis subsp bovis AF2122/97
cagcgacgaccacac

SEQ ID NO: 3179621 - RNA, 19 nt, Mycobacterium bovis subsp bovis AF2122/97
cagcgacgaccacaccacg

SEQ ID NO: 3179622 - RNA, 18 nt, Mycobacterium bovis subsp bovis AF2122/97
cagcgacgagaucagccu

SEQ ID NO: 3179623 - RNA, 16 nt, Mycobacterium bovis subsp bovis AF2122/97
cagcgacgcauaaccg

SEQ ID NO: 3179624 - RNA, 23 nt, Mycobacterium bovis subsp bovis AF2122/97
cagcgacgcauaaccggcgcgcc

SEQ ID NO: 3179625 - RNA, 16 nt, Mycobacterium bovis subsp bovis AF2122/97
cagcgacgccaugguc

SEQ ID NO: 3179626 - RNA, 20 nt, Mycobacterium bovis subsp bovis AF2122/97
cagcgacgccaugucgaugu

SEQ ID NO: 3179627 - RNA, 15 nt, Mycobacterium bovis subsp bovis AF2122/97
cagcgacgccggccc

SEQ ID NO: 3179628 - RNA, 19 nt, Mycobacterium bovis subsp bovis AF2122/97
cagcgacgccggcccgacg

SEQ ID NO: 3179629 - RNA, 14 nt, Mycobacterium bovis subsp bovis AF2122/97
cagcgacgcggcca

SEQ ID NO: 3179630 - RNA, 17 nt, Mycobacterium bovis subsp bovis AF2122/97
cagcgacgcggccagcg

SEQ ID NO: 3179631 - RNA, 21 nt, Mycobacterium bovis subsp bovis AF2122/97
cagcgacgcggccagcggcaa

SEQ ID NO: 3179632 - RNA, 21 nt, Mycobacterium bovis subsp bovis AF2122/97
cagcgacgcggucaucgagcu

SEQ ID NO: 3179633 - RNA, 14 nt, Mycobacterium bovis subsp bovis AF2122/97
cagcgacgcuagga

SEQ ID NO: 3179634 - RNA, 16 nt, Mycobacterium bovis subsp bovis AF2122/97
cagcgacgcugccgcc

SEQ ID NO: 3179635 - RNA, 17 nt, Mycobacterium bovis subsp bovis AF2122/97
cagcgacgcugccgcca

SEQ ID NO: 3179636 - RNA, 18 nt, Mycobacterium bovis subsp bovis AF2122/97
cagcgacgcugccgccag

SEQ ID NO: 3179637 - RNA, 13 nt, Mycobacterium bovis subsp bovis AF2122/97
cagcgacggccgc

SEQ ID NO: 3179638 - RNA, 14 nt, Mycobacterium bovis subsp bovis AF2122/97
cagcgacggccgcc

SEQ ID NO: 3179639 - RNA, 15 nt, Mycobacterium bovis subsp bovis AF2122/97
cagcgacggccgcca

SEQ ID NO: 3179640 - RNA, 16 nt, Mycobacterium bovis subsp bovis AF2122/97
cagcgacggccgccag

SEQ ID NO: 3179641 - RNA, 19 nt, Mycobacterium bovis subsp bovis AF2122/97
cagcgacgggaaagccacc

SEQ ID NO: 3179642 - RNA, 19 nt, Mycobacterium bovis subsp bovis AF2122/97
cagcgacggucccggcacg

SEQ ID NO: 3179643 - RNA, 12 nt, Mycobacterium bovis subsp bovis AF2122/97
cagcgacgucgc

SEQ ID NO: 3179644 - RNA, 22 nt, Mycobacterium bovis subsp bovis AF2122/97
cagcgacgucgcaauaugccac

SEQ ID NO: 3179645 - RNA, 16 nt, Mycobacterium bovis subsp bovis AF2122/97
cagcgacucggccagg

SEQ ID NO: 3179646 - RNA, 19 nt, Mycobacterium bovis subsp bovis AF2122/97
cagcgacuuggcaucgcga

SEQ ID NO: 3179647 - RNA, 21 nt, Mycobacterium bovis subsp bovis AF2122/97
cagcgacuuggcaucgcgagc

SEQ ID NO: 3179648 - RNA, 23 nt, Mycobacterium bovis subsp bovis AF2122/97
cagcgacuuggcaucgcgagcca

SEQ ID NO: 3179649 - RNA, 16 nt, Mycobacterium bovis subsp bovis AF2122/97
cagcgagaccucucug

SEQ ID NO: 3179650 - RNA, 19 nt, Mycobacterium bovis subsp bovis AF2122/97
cagcgagacuucgacgcgg

SEQ ID NO: 3179651 - RNA, 19 nt, Mycobacterium bovis subsp bovis AF2122/97
cagcgccccgcgguccugg

SEQ ID NO: 3179652 - RNA, 16 nt, Mycobacterium bovis subsp bovis AF2122/97
cagcgcccgcaggugg

SEQ ID NO: 3179653 - RNA, 12 nt, Mycobacterium bovis subsp bovis AF2122/97
cagcgcccgccg

SEQ ID NO: 3179654 - RNA, 13 nt, Mycobacterium bovis subsp bovis AF2122/97
cagcgcccgccgg

SEQ ID NO: 3179655 - RNA, 18 nt, Mycobacterium bovis subsp bovis AF2122/97
cagcgcccgccggcauag

SEQ ID NO: 3179656 - RNA, 17 nt, Mycobacterium bovis subsp bovis AF2122/97
cagcgcccgcgcggcca

SEQ ID NO: 3179657 - RNA, 21 nt, Mycobacterium bovis subsp bovis AF2122/97
cagcgcccggauguccgccga

SEQ ID NO: 3179658 - RNA, 14 nt, Mycobacterium bovis subsp bovis AF2122/97
cagcgcccggccac

SEQ ID NO: 3179659 - RNA, 15 nt, Mycobacterium bovis subsp bovis AF2122/97
cagcgcccggccacu

SEQ ID NO: 3179660 - RNA, 14 nt, Mycobacterium bovis subsp bovis AF2122/97
cagcgcccggcccg

SEQ ID NO: 3179661 - RNA, 15 nt, Mycobacterium bovis subsp bovis AF2122/97
cagcgcccggcccgc

SEQ ID NO: 3179662 - RNA, 17 nt, Mycobacterium bovis subsp bovis AF2122/97
cagcgcccggcccgcca

SEQ ID NO: 3179663 - RNA, 20 nt, Mycobacterium bovis subsp bovis AF2122/97
cagcgcccggcccgccaccc

SEQ ID NO: 3179664 - RNA, 16 nt, Mycobacterium bovis subsp bovis AF2122/97
cagcgcccgucgcugg

SEQ ID NO: 3179665 - RNA, 21 nt, Mycobacterium bovis subsp bovis AF2122/97
cagcgccgaauucauccgggc

SEQ ID NO: 3179666 - RNA, 12 nt, Mycobacterium bovis subsp bovis AF2122/97
cagcgccgaccu

SEQ ID NO: 3179667 - RNA, 18 nt, Mycobacterium bovis subsp bovis AF2122/97
cagcgccgacuccaguuc

SEQ ID NO: 3179668 - RNA, 17 nt, Mycobacterium bovis subsp bovis AF2122/97
cagcgccgagagcaccg

SEQ ID NO: 3179669 - RNA, 18 nt, Mycobacterium bovis subsp bovis AF2122/97
cagcgccgagagcaccgc

SEQ ID NO: 3179670 - RNA, 20 nt, Mycobacterium bovis subsp bovis AF2122/97
cagcgccgagagcaccgcuc

SEQ ID NO: 3179671 - RNA, 21 nt, Mycobacterium bovis subsp bovis AF2122/97
cagcgccgagagcaccgcucg

SEQ ID NO: 3179672 - RNA, 14 nt, Mycobacterium bovis subsp bovis AF2122/97
cagcgccgcacccg

SEQ ID NO: 3179673 - RNA, 20 nt, Mycobacterium bovis subsp bovis AF2122/97
cagcgccgcacccgcucccg

SEQ ID NO: 3179674 - RNA, 18 nt, Mycobacterium bovis subsp bovis AF2122/97
cagcgccgcaguggaugc

SEQ ID NO: 3179675 - RNA, 19 nt, Mycobacterium bovis subsp bovis AF2122/97
cagcgccgcauucgcgaca

SEQ ID NO: 3179676 - RNA, 15 nt, Mycobacterium bovis subsp bovis AF2122/97
cagcgccgccgaggu

SEQ ID NO: 3179677 - RNA, 15 nt, Mycobacterium bovis subsp bovis AF2122/97
cagcgccgccgccga

SEQ ID NO: 3179678 - RNA, 17 nt, Mycobacterium bovis subsp bovis AF2122/97
cagcgccgccgccgacg

SEQ ID NO: 3179679 - RNA, 18 nt, Mycobacterium bovis subsp bovis AF2122/97
cagcgccgccgccgacga

SEQ ID NO: 3179680 - RNA, 13 nt, Mycobacterium bovis subsp bovis AF2122/97
cagcgccgccgcg

SEQ ID NO: 3179681 - RNA, 12 nt, Mycobacterium bovis subsp bovis AF2122/97
cagcgccgccgg

SEQ ID NO: 3179682 - RNA, 15 nt, Mycobacterium bovis subsp bovis AF2122/97
cagcgccgccggcgc

SEQ ID NO: 3179683 - RNA, 16 nt, Mycobacterium bovis subsp bovis AF2122/97
cagcgccgccggcgcc

SEQ ID NO: 3179684 - RNA, 19 nt, Mycobacterium bovis subsp bovis AF2122/97
cagcgccgccggcgccggc

SEQ ID NO: 3179685 - RNA, 13 nt, Mycobacterium bovis subsp bovis AF2122/97
cagcgccgcgcgc

SEQ ID NO: 3179686 - RNA, 17 nt, Mycobacterium bovis subsp bovis AF2122/97
cagcgccgcgcgggugc

SEQ ID NO: 3179687 - RNA, 13 nt, Mycobacterium bovis subsp bovis AF2122/97
cagcgccgcggcc

SEQ ID NO: 3179688 - RNA, 21 nt, Mycobacterium bovis subsp bovis AF2122/97
cagcgccgcggcuacaucggc

SEQ ID NO: 3179689 - RNA, 22 nt, Mycobacterium bovis subsp bovis AF2122/97
cagcgccgcggcuacaucggcg

SEQ ID NO: 3179690 - RNA, 16 nt, Mycobacterium bovis subsp bovis AF2122/97
cagcgccgcguggcug

SEQ ID NO: 3179691 - RNA, 21 nt, Mycobacterium bovis subsp bovis AF2122/97
cagcgccgcguggcuggcggc

SEQ ID NO: 3179692 - RNA, 20 nt, Mycobacterium bovis subsp bovis AF2122/97
cagcgccgcugacuccugcg

SEQ ID NO: 3179693 - RNA, 22 nt, Mycobacterium bovis subsp bovis AF2122/97
cagcgccgcugacuccugcggc

SEQ ID NO: 3179694 - RNA, 19 nt, Mycobacterium bovis subsp bovis AF2122/97
cagcgccggaagcuucggg

SEQ ID NO: 3179695 - RNA, 18 nt, Mycobacterium bovis subsp bovis AF2122/97
cagcgccggauccacacc

SEQ ID NO: 3179696 - RNA, 12 nt, Mycobacterium bovis subsp bovis AF2122/97
cagcgccggcca

SEQ ID NO: 3179697 - RNA, 13 nt, Mycobacterium bovis subsp bovis AF2122/97
cagcgccggccag

SEQ ID NO: 3179698 - RNA, 14 nt, Mycobacterium bovis subsp bovis AF2122/97
cagcgccgucaucg

SEQ ID NO: 3179699 - RNA, 20 nt, Mycobacterium bovis subsp bovis AF2122/97
cagcgccguggcgcggucgg

SEQ ID NO: 3179700 - RNA, 21 nt, Mycobacterium bovis subsp bovis AF2122/97
cagcgccucauccuccaguuc

SEQ ID NO: 3179701 - RNA, 21 nt, Mycobacterium bovis subsp bovis AF2122/97
cagcgccuccacucuucgggc

SEQ ID NO: 3179702 - RNA, 14 nt, Mycobacterium bovis subsp bovis AF2122/97
cagcgccuccagca

SEQ ID NO: 3179703 - RNA, 19 nt, Mycobacterium bovis subsp bovis AF2122/97
cagcgccuccagcaccacg

SEQ ID NO: 3179704 - RNA, 12 nt, Mycobacterium bovis subsp bovis AF2122/97
cagcgccuccuc

SEQ ID NO: 3179705 - RNA, 13 nt, Mycobacterium bovis subsp bovis AF2122/97
cagcgccucgacc

SEQ ID NO: 3179706 - RNA, 15 nt, Mycobacterium bovis subsp bovis AF2122/97
cagcgccucgauggu

SEQ ID NO: 3179707 - RNA, 16 nt, Mycobacterium bovis subsp bovis AF2122/97
cagcgccucggcaucg

SEQ ID NO: 3179708 - RNA, 20 nt, Mycobacterium bovis subsp bovis AF2122/97
cagcgccucggcaucgccgc

SEQ ID NO: 3179709 - RNA, 21 nt, Mycobacterium bovis subsp bovis AF2122/97
cagcgccucggcaucgccgcg

SEQ ID NO: 3179710 - RNA, 22 nt, Mycobacterium bovis subsp bovis AF2122/97
cagcgccucggcaucgccgcgg

SEQ ID NO: 3179711 - RNA, 15 nt, Mycobacterium bovis subsp bovis AF2122/97
cagcgccugcgccca

SEQ ID NO: 3179712 - RNA, 17 nt, Mycobacterium bovis subsp bovis AF2122/97
cagcgccugcgcccagc

SEQ ID NO: 3179713 - RNA, 13 nt, Mycobacterium bovis subsp bovis AF2122/97
cagcgccugcggc

SEQ ID NO: 3179714 - RNA, 16 nt, Mycobacterium bovis subsp bovis AF2122/97
cagcgccugcggcagc

SEQ ID NO: 3179715 - RNA, 13 nt, Mycobacterium bovis subsp bovis AF2122/97
cagcgccuggccg

SEQ ID NO: 3179716 - RNA, 17 nt, Mycobacterium bovis subsp bovis AF2122/97
cagcgccuugaccagca

SEQ ID NO: 3179717 - RNA, 20 nt, Mycobacterium bovis subsp bovis AF2122/97
cagcgccuugaccagcagcu

SEQ ID NO: 3179718 - RNA, 17 nt, Mycobacterium bovis subsp bovis AF2122/97
cagcgccuugcgggccu

SEQ ID NO: 3179719 - RNA, 21 nt, Mycobacterium bovis subsp bovis AF2122/97
cagcgccuuguggcacacccg

SEQ ID NO: 3179720 - RNA, 22 nt, Mycobacterium bovis subsp bovis AF2122/97
cagcgccuuguggcacacccgc

SEQ ID NO: 3179721 - RNA, 23 nt, Mycobacterium bovis subsp bovis AF2122/97
cagcgccuuguggcacacccgca

SEQ ID NO: 3179722 - RNA, 15 nt, Mycobacterium bovis subsp bovis AF2122/97
cagcgcgaacaccau

SEQ ID NO: 3179723 - RNA, 19 nt, Mycobacterium bovis subsp bovis AF2122/97
cagcgcgaacgccugcugg

SEQ ID NO: 3179724 - RNA, 16 nt, Mycobacterium bovis subsp bovis AF2122/97
cagcgcgaccaaugcg

SEQ ID NO: 3179725 - RNA, 23 nt, Mycobacterium bovis subsp bovis AF2122/97
cagcgcgacccguagcuuggcga

SEQ ID NO: 3179726 - RNA, 16 nt, Mycobacterium bovis subsp bovis AF2122/97
cagcgcgaccgucagg

SEQ ID NO: 3179727 - RNA, 16 nt, Mycobacterium bovis subsp bovis AF2122/97
cagcgcgacgguuugc

SEQ ID NO: 3179728 - RNA, 11 nt, Mycobacterium bovis subsp bovis AF2122/97
cagcgcgacgu

SEQ ID NO: 3179729 - RNA, 15 nt, Mycobacterium bovis subsp bovis AF2122/97
cagcgcgacguccac

SEQ ID NO: 3179730 - RNA, 18 nt, Mycobacterium bovis subsp bovis AF2122/97
cagcgcgacguccaccag

SEQ ID NO: 3179731 - RNA, 22 nt, Mycobacterium bovis subsp bovis AF2122/97
cagcgcgacguccaccagccgg

SEQ ID NO: 3179732 - RNA, 23 nt, Mycobacterium bovis subsp bovis AF2122/97
cagcgcgacguccaccagccggu

SEQ ID NO: 3179733 - RNA, 17 nt, Mycobacterium bovis subsp bovis AF2122/97
cagcgcgagaucagccg

SEQ ID NO: 3179734 - RNA, 22 nt, Mycobacterium bovis subsp bovis AF2122/97
cagcgcgagaucagccggcagc

SEQ ID NO: 3179735 - RNA, 21 nt, Mycobacterium bovis subsp bovis AF2122/97
cagcgcgagcccgaaccaccg

SEQ ID NO: 3179736 - RNA, 22 nt, Mycobacterium bovis subsp bovis AF2122/97
cagcgcgagcccgaaccaccgc

SEQ ID NO: 3179737 - RNA, 20 nt, Mycobacterium bovis subsp bovis AF2122/97
cagcgcgaggcucguggcga

SEQ ID NO: 3179738 - RNA, 18 nt, Mycobacterium bovis subsp bovis AF2122/97
cagcgcuucacgggccgu

SEQ ID NO: 3179739 - RNA, 19 nt, Mycobacterium bovis subsp bovis AF2122/97
cagcgcuucacgggccguc

SEQ ID NO: 3179740 - RNA, 22 nt, Mycobacterium bovis subsp bovis AF2122/97
cagcgcuucggcggucgccgcg

SEQ ID NO: 3179741 - RNA, 14 nt, Mycobacterium bovis subsp bovis AF2122/97
cagcgcuucgucgg

SEQ ID NO: 3179742 - RNA, 19 nt, Mycobacterium bovis subsp bovis AF2122/97
cagcgcuucgucggccggc

SEQ ID NO: 3179743 - RNA, 19 nt, Mycobacterium bovis subsp bovis AF2122/97
cagcgcuuugaugccgaug

SEQ ID NO: 3179744 - RNA, 20 nt, Mycobacterium bovis subsp bovis AF2122/97
cagcgcuuugaugccgaugu

SEQ ID NO: 3179745 - RNA, 16 nt, Mycobacterium bovis subsp bovis AF2122/97
cagcggaaucaccgaa

SEQ ID NO: 3179746 - RNA, 13 nt, Mycobacterium bovis subsp bovis AF2122/97
cagcggaccccac

SEQ ID NO: 3179747 - RNA, 23 nt, Mycobacterium bovis subsp bovis AF2122/97
cagcggaccgauugucggcaacg

SEQ ID NO: 3179748 - RNA, 14 nt, Mycobacterium bovis subsp bovis AF2122/97
cagcggaccgcugc

SEQ ID NO: 3179749 - RNA, 20 nt, Mycobacterium bovis subsp bovis AF2122/97
cagcggaccgcugccugccg

SEQ ID NO: 3179750 - RNA, 16 nt, Mycobacterium bovis subsp bovis AF2122/97
cagcggagacgaucgc

SEQ ID NO: 3179751 - RNA, 17 nt, Mycobacterium bovis subsp bovis AF2122/97
cagcggagccacucggc

SEQ ID NO: 3179752 - RNA, 18 nt, Mycobacterium bovis subsp bovis AF2122/97
cagcggagccacucggcc

SEQ ID NO: 3179753 - RNA, 20 nt, Mycobacterium bovis subsp bovis AF2122/97
cagcggagccacucggcccg

SEQ ID NO: 3179754 - RNA, 14 nt, Mycobacterium bovis subsp bovis AF2122/97
cagcggagcgcccu

SEQ ID NO: 3179755 - RNA, 13 nt, Mycobacterium bovis subsp bovis AF2122/97
cagcggauccagg

SEQ ID NO: 3179756 - RNA, 15 nt, Mycobacterium bovis subsp bovis AF2122/97
cagcggaucgcauuu

SEQ ID NO: 3179757 - RNA, 19 nt, Mycobacterium bovis subsp bovis AF2122/97
cagcggaucgucguuguca

SEQ ID NO: 3179758 - RNA, 23 nt, Mycobacterium bovis subsp bovis AF2122/97
cagcggaucgucguugucagcga

SEQ ID NO: 3179759 - RNA, 16 nt, Mycobacterium bovis subsp bovis AF2122/97
cagcggcaacgaucga

SEQ ID NO: 3179760 - RNA, 23 nt, Mycobacterium bovis subsp bovis AF2122/97
cagcggcaaggucaacgggaggu

SEQ ID NO: 3179761 - RNA, 19 nt, Mycobacterium bovis subsp bovis AF2122/97
cagcggcaauggccagcac

SEQ ID NO: 3179762 - RNA, 21 nt, Mycobacterium bovis subsp bovis AF2122/97
cagcggcaauggccagcacca

SEQ ID NO: 3179763 - RNA, 17 nt, Mycobacterium bovis subsp bovis AF2122/97
cagcggcacacccauca

SEQ ID NO: 3179764 - RNA, 19 nt, Mycobacterium bovis subsp bovis AF2122/97
cagcggcacaucaugggcg

SEQ ID NO: 3179765 - RNA, 13 nt, Mycobacterium bovis subsp bovis AF2122/97
cagcggcaccgcg

SEQ ID NO: 3179766 - RNA, 16 nt, Mycobacterium bovis subsp bovis AF2122/97
cagcggcaccgcgccg

SEQ ID NO: 3179767 - RNA, 15 nt, Mycobacterium bovis subsp bovis AF2122/97
cagcggcaccgcggc

SEQ ID NO: 3179768 - RNA, 16 nt, Mycobacterium bovis subsp bovis AF2122/97
cagcggcaccgcggcc

SEQ ID NO: 3179769 - RNA, 21 nt, Mycobacterium bovis subsp bovis AF2122/97
cagcggcaccgcggccagcgg

SEQ ID NO: 3179770 - RNA, 12 nt, Mycobacterium bovis subsp bovis AF2122/97
cagcggcaccgg

SEQ ID NO: 3179771 - RNA, 16 nt, Mycobacterium bovis subsp bovis AF2122/97
cagcggcacgaucggc

SEQ ID NO: 3179772 - RNA, 17 nt, Mycobacterium bovis subsp bovis AF2122/97
cagcggcacgaucggca

SEQ ID NO: 3179773 - RNA, 13 nt, Mycobacterium bovis subsp bovis AF2122/97
cagcggcagcacc

SEQ ID NO: 3179774 - RNA, 18 nt, Mycobacterium bovis subsp bovis AF2122/97
cagcggcagcaccgcacg

SEQ ID NO: 3179775 - RNA, 22 nt, Mycobacterium bovis subsp bovis AF2122/97
cagcggcaggaagaaaccgcag

SEQ ID NO: 3179776 - RNA, 21 nt, Mycobacterium bovis subsp bovis AF2122/97
cagcggcaguuccugacgcca

SEQ ID NO: 3179777 - RNA, 22 nt, Mycobacterium bovis subsp bovis AF2122/97
cagcggcaguuccugacgccau

SEQ ID NO: 3179778 - RNA, 17 nt, Mycobacterium bovis subsp bovis AF2122/97
cagcggcauccagcuuc

SEQ ID NO: 3179779 - RNA, 14 nt, Mycobacterium bovis subsp bovis AF2122/97
cagcggcaucgcgg

SEQ ID NO: 3179780 - RNA, 18 nt, Mycobacterium bovis subsp bovis AF2122/97
cagcggcaucgcgggcgg

SEQ ID NO: 3179781 - RNA, 20 nt, Mycobacterium bovis subsp bovis AF2122/97
cagcggcaucgcgggcggcg

SEQ ID NO: 3179782 - RNA, 22 nt, Mycobacterium bovis subsp bovis AF2122/97
cagcggcaucgcgggcggcgcu

SEQ ID NO: 3179783 - RNA, 15 nt, Mycobacterium bovis subsp bovis AF2122/97
cagcggcaucggcca

SEQ ID NO: 3179784 - RNA, 16 nt, Mycobacterium bovis subsp bovis AF2122/97
cagcggcaucggccag

SEQ ID NO: 3179785 - RNA, 17 nt, Mycobacterium bovis subsp bovis AF2122/97
cagcggcaucggccagc

SEQ ID NO: 3179786 - RNA, 18 nt, Mycobacterium bovis subsp bovis AF2122/97
cagcggcaucggccagcc

SEQ ID NO: 3179787 - RNA, 19 nt, Mycobacterium bovis subsp bovis AF2122/97
cagcggcaucggccagccg

SEQ ID NO: 3179788 - RNA, 13 nt, Mycobacterium bovis subsp bovis AF2122/97
cagcggcauugcc

SEQ ID NO: 3179789 - RNA, 15 nt, Mycobacterium bovis subsp bovis AF2122/97
cagcggcauugccag

SEQ ID NO: 3179790 - RNA, 18 nt, Mycobacterium bovis subsp bovis AF2122/97
cagcggcauugccagccg

SEQ ID NO: 3179791 - RNA, 13 nt, Mycobacterium bovis subsp bovis AF2122/97
cagcggccaaccc

SEQ ID NO: 3179792 - RNA, 14 nt, Mycobacterium bovis subsp bovis AF2122/97
cagcggccaaccca

SEQ ID NO: 3179793 - RNA, 15 nt, Mycobacterium bovis subsp bovis AF2122/97
cagcggccaacccau

SEQ ID NO: 3179794 - RNA, 12 nt, Mycobacterium bovis subsp bovis AF2122/97
cagcggccaccg

SEQ ID NO: 3179795 - RNA, 14 nt, Mycobacterium bovis subsp bovis AF2122/97
cagcggccaccgag

SEQ ID NO: 3179796 - RNA, 16 nt, Mycobacterium bovis subsp bovis AF2122/97
cagcggccagcagugc

SEQ ID NO: 3179797 - RNA, 19 nt, Mycobacterium bovis subsp bovis AF2122/97
cagcggccagcagugcggu

SEQ ID NO: 3179798 - RNA, 14 nt, Mycobacterium bovis subsp bovis AF2122/97
cagcggccagccca

SEQ ID NO: 3179799 - RNA, 19 nt, Mycobacterium bovis subsp bovis AF2122/97
cagcggccagcccagccgg

SEQ ID NO: 3179800 - RNA, 18 nt, Mycobacterium bovis subsp bovis AF2122/97
cagcggccagggcaccca

SEQ ID NO: 3179801 - RNA, 16 nt, Mycobacterium bovis subsp bovis AF2122/97
cagcggccauaucgcc

SEQ ID NO: 3179802 - RNA, 21 nt, Mycobacterium bovis subsp bovis AF2122/97
cagcggccauaucgcccacca

SEQ ID NO: 3179803 - RNA, 23 nt, Mycobacterium bovis subsp bovis AF2122/97
cagcggccauaucgcccaccacg

SEQ ID NO: 3179804 - RNA, 17 nt, Mycobacterium bovis subsp bovis AF2122/97
cagcggccgaccgcgac

SEQ ID NO: 3179805 - RNA, 20 nt, Mycobacterium bovis subsp bovis AF2122/97
cagcggccgaccgcgacccg

SEQ ID NO: 3179806 - RNA, 22 nt, Mycobacterium bovis subsp bovis AF2122/97
cagcggccgaccgcgacccggc

SEQ ID NO: 3179807 - RNA, 14 nt, Mycobacterium bovis subsp bovis AF2122/97
cagcggccgccgcg

SEQ ID NO: 3179808 - RNA, 13 nt, Mycobacterium bovis subsp bovis AF2122/97
cagcggccgcgac

SEQ ID NO: 3179809 - RNA, 14 nt, Mycobacterium bovis subsp bovis AF2122/97
cagcggccgcgacg

SEQ ID NO: 3179810 - RNA, 17 nt, Mycobacterium bovis subsp bovis AF2122/97
cagcggccgcgauggug

SEQ ID NO: 3179811 - RNA, 13 nt, Mycobacterium bovis subsp bovis AF2122/97
cagcggccgguac

SEQ ID NO: 3179812 - RNA, 22 nt, Mycobacterium bovis subsp bovis AF2122/97
cagcggccgguacacguccagu

SEQ ID NO: 3179813 - RNA, 13 nt, Mycobacterium bovis subsp bovis AF2122/97
cagcggccuccgg

SEQ ID NO: 3179814 - RNA, 17 nt, Mycobacterium bovis subsp bovis AF2122/97
cagcggccuccgggcca

SEQ ID NO: 3179815 - RNA, 16 nt, Mycobacterium bovis subsp bovis AF2122/97
cagcggccugaccggc

SEQ ID NO: 3179816 - RNA, 18 nt, Mycobacterium bovis subsp bovis AF2122/97
cagcggccugaccggcuc

SEQ ID NO: 3179817 - RNA, 19 nt, Mycobacterium bovis subsp bovis AF2122/97
cagcggccugaccggcucg

SEQ ID NO: 3179818 - RNA, 20 nt, Mycobacterium bovis subsp bovis AF2122/97
cagcggccugaccggcucgc

SEQ ID NO: 3179819 - RNA, 21 nt, Mycobacterium bovis subsp bovis AF2122/97
cagcggccugaccggcucgcc

SEQ ID NO: 3179820 - RNA, 17 nt, Mycobacterium bovis subsp bovis AF2122/97
caaucaccgccgcgacc

SEQ ID NO: 3179821 - RNA, 17 nt, Mycobacterium bovis subsp bovis AF2122/97
caaucagcccgacaccg

SEQ ID NO: 3179822 - RNA, 19 nt, Mycobacterium bovis subsp bovis AF2122/97
caaucagcccgacaccguc

SEQ ID NO: 3179823 - RNA, 13 nt, Mycobacterium bovis subsp bovis AF2122/97
caaucagccgccu

SEQ ID NO: 3179824 - RNA, 20 nt, Mycobacterium bovis subsp bovis AF2122/97
caaucaguagcagcggcucg

SEQ ID NO: 3179825 - RNA, 14 nt, Mycobacterium bovis subsp bovis AF2122/97
caaucagugcagcg

SEQ ID NO: 3179826 - RNA, 14 nt, Mycobacterium bovis subsp bovis AF2122/97
caaucaugucagcg

SEQ ID NO: 3179827 - RNA, 18 nt, Mycobacterium bovis subsp bovis AF2122/97
caaucaugucagcgcuga

SEQ ID NO: 3179828 - RNA, 15 nt, Mycobacterium bovis subsp bovis AF2122/97
caaucaugugccagu

SEQ ID NO: 3179829 - RNA, 15 nt, Mycobacterium bovis subsp bovis AF2122/97
caaucauguucaucu

SEQ ID NO: 3179830 - RNA, 17 nt, Mycobacterium bovis subsp bovis AF2122/97
caauccacagauugauu

SEQ ID NO: 3179831 - RNA, 19 nt, Mycobacterium bovis subsp bovis AF2122/97
caauccaccgaagccccuc

SEQ ID NO: 3179832 - RNA, 21 nt, Mycobacterium bovis subsp bovis AF2122/97
caauccaccgaagccccuccc

SEQ ID NO: 3179833 - RNA, 15 nt, Mycobacterium bovis subsp bovis AF2122/97
caauccaccgauucg

SEQ ID NO: 3179834 - RNA, 17 nt, Mycobacterium bovis subsp bovis AF2122/97
caauccacgcacucguc

SEQ ID NO: 3179835 - RNA, 19 nt, Mycobacterium bovis subsp bovis AF2122/97
caauccacgcacucgucgg

SEQ ID NO: 3179836 - RNA, 18 nt, Mycobacterium bovis subsp bovis AF2122/97
caauccacgguugccggc

SEQ ID NO: 3179837 - RNA, 20 nt, Mycobacterium bovis subsp bovis AF2122/97
caauccacgguugccggcgg

SEQ ID NO: 3179838 - RNA, 16 nt, Mycobacterium bovis subsp bovis AF2122/97
caauccacgucgcggc

SEQ ID NO: 3179839 - RNA, 15 nt, Mycobacterium bovis subsp bovis AF2122/97
caaucccacgcccgg

SEQ ID NO: 3179840 - RNA, 19 nt, Mycobacterium bovis subsp bovis AF2122/97
caaucccgccaucugccug

SEQ ID NO: 3179841 - RNA, 17 nt, Mycobacterium bovis subsp bovis AF2122/97
caaucccggccaggggc

SEQ ID NO: 3179842 - RNA, 13 nt, Mycobacterium bovis subsp bovis AF2122/97
caaucccuccgcc

SEQ ID NO: 3179843 - RNA, 14 nt, Mycobacterium bovis subsp bovis AF2122/97
caaucccuccgcca

SEQ ID NO: 3179844 - RNA, 19 nt, Mycobacterium bovis subsp bovis AF2122/97
caauccgcacagcgacgag

SEQ ID NO: 3179845 - RNA, 22 nt, Mycobacterium bovis subsp bovis AF2122/97
caauccgcacagcgacgagauc

SEQ ID NO: 3179846 - RNA, 18 nt, Mycobacterium bovis subsp bovis AF2122/97
caauccgcccuugccgcc

SEQ ID NO: 3179847 - RNA, 13 nt, Mycobacterium bovis subsp bovis AF2122/97
caauccgcucggu

SEQ ID NO: 3179848 - RNA, 14 nt, Mycobacterium bovis subsp bovis AF2122/97
caauccgcucgguc

SEQ ID NO: 3179849 - RNA, 15 nt, Mycobacterium bovis subsp bovis AF2122/97
caauccgcucggucg

SEQ ID NO: 3179850 - RNA, 17 nt, Mycobacterium bovis subsp bovis AF2122/97
caauccgcucggucgcc

SEQ ID NO: 3179851 - RNA, 16 nt, Mycobacterium bovis subsp bovis AF2122/97
caauccggcugcggua

SEQ ID NO: 3179852 - RNA, 19 nt, Mycobacterium bovis subsp bovis AF2122/97
caauccggucagcgcggcg

SEQ ID NO: 3179853 - RNA, 13 nt, Mycobacterium bovis subsp bovis AF2122/97
caaucgaccgccc

SEQ ID NO: 3179854 - RNA, 17 nt, Mycobacterium bovis subsp bovis AF2122/97
caaucgacugaucgaag

SEQ ID NO: 3179855 - RNA, 20 nt, Mycobacterium bovis subsp bovis AF2122/97
caaucgagaacgcccgcugc

SEQ ID NO: 3179856 - RNA, 13 nt, Mycobacterium bovis subsp bovis AF2122/97
caaucgaggaagg

SEQ ID NO: 3179857 - RNA, 21 nt, Mycobacterium bovis subsp bovis AF2122/97
caaucgcaaugaccugcagcg

SEQ ID NO: 3179858 - RNA, 13 nt, Mycobacterium bovis subsp bovis AF2122/97
caaucgccgggug

SEQ ID NO: 3179859 - RNA, 16 nt, Mycobacterium bovis subsp bovis AF2122/97
caaucgcgugcuggaa

SEQ ID NO: 3179860 - RNA, 19 nt, Mycobacterium bovis subsp bovis AF2122/97
caaucgcucugugucgccg

SEQ ID NO: 3179861 - RNA, 18 nt, Mycobacterium bovis subsp bovis AF2122/97
caaucggauagccgugcu

SEQ ID NO: 3179862 - RNA, 14 nt, Mycobacterium bovis subsp bovis AF2122/97
caaucggcggcacc

SEQ ID NO: 3179863 - RNA, 15 nt, Mycobacterium bovis subsp bovis AF2122/97
caaucgggaucgcug

SEQ ID NO: 3179864 - RNA, 21 nt, Mycobacterium bovis subsp bovis AF2122/97
caaucguccacccgagcucuu

SEQ ID NO: 3179865 - RNA, 14 nt, Mycobacterium bovis subsp bovis AF2122/97
caaucgucggccag

SEQ ID NO: 3179866 - RNA, 17 nt, Mycobacterium bovis subsp bovis AF2122/97
caaucgucggccagcag

SEQ ID NO: 3179867 - RNA, 14 nt, Mycobacterium bovis subsp bovis AF2122/97
caaucguuggccau

SEQ ID NO: 3179868 - RNA, 16 nt, Mycobacterium bovis subsp bovis AF2122/97
caaucguuuucguguc

SEQ ID NO: 3179869 - RNA, 13 nt, Mycobacterium bovis subsp bovis AF2122/97
caaucuccuccgc

SEQ ID NO: 3179870 - RNA, 12 nt, Mycobacterium bovis subsp bovis AF2122/97
caaucucggccg

SEQ ID NO: 3179871 - RNA, 14 nt, Mycobacterium bovis subsp bovis AF2122/97
caaucucggccgca

SEQ ID NO: 3179872 - RNA, 14 nt, Mycobacterium bovis subsp bovis AF2122/97
caaucucggcguug

SEQ ID NO: 3179873 - RNA, 19 nt, Mycobacterium bovis subsp bovis AF2122/97
caaucucggcguugccgcc

SEQ ID NO: 3179874 - RNA, 15 nt, Mycobacterium bovis subsp bovis AF2122/97
caaucugcgcgaggg

SEQ ID NO: 3179875 - RNA, 12 nt, Mycobacterium bovis subsp bovis AF2122/97
caaucuucccac

SEQ ID NO: 3179876 - RNA, 20 nt, Mycobacterium bovis subsp bovis AF2122/97
caaucuucucgagccgccgg

SEQ ID NO: 3179877 - RNA, 15 nt, Mycobacterium bovis subsp bovis AF2122/97
caaugacaccggggc

SEQ ID NO: 3179878 - RNA, 15 nt, Mycobacterium bovis subsp bovis AF2122/97
caaugaccaccgggc

SEQ ID NO: 3179879 - RNA, 17 nt, Mycobacterium bovis subsp bovis AF2122/97
caaugaccgccagcagc

SEQ ID NO: 3179880 - RNA, 15 nt, Mycobacterium bovis subsp bovis AF2122/97
caaugaccuggccgc

SEQ ID NO: 3179881 - RNA, 20 nt, Mycobacterium bovis subsp bovis AF2122/97
caaugacucggccgcaccag

SEQ ID NO: 3179882 - RNA, 22 nt, Mycobacterium bovis subsp bovis AF2122/97
caaugacuggaccgcggugacc

SEQ ID NO: 3179883 - RNA, 18 nt, Mycobacterium bovis subsp bovis AF2122/97
caaugacuugcgacccgu

SEQ ID NO: 3179884 - RNA, 12 nt, Mycobacterium bovis subsp bovis AF2122/97
caaugauucggc

SEQ ID NO: 3179885 - RNA, 16 nt, Mycobacterium bovis subsp bovis AF2122/97
caaugauucggcacgc

SEQ ID NO: 3179886 - RNA, 17 nt, Mycobacterium bovis subsp bovis AF2122/97
caaugcacaccgggcac

SEQ ID NO: 3179887 - RNA, 20 nt, Mycobacterium bovis subsp bovis AF2122/97
caaugcacaccgggcaccag

SEQ ID NO: 3179888 - RNA, 23 nt, Mycobacterium bovis subsp bovis AF2122/97
caaugccauguugaaaaggcgcu

SEQ ID NO: 3179889 - RNA, 21 nt, Mycobacterium bovis subsp bovis AF2122/97
caaugcccgaccggucuggcg

SEQ ID NO: 3179890 - RNA, 15 nt, Mycobacterium bovis subsp bovis AF2122/97
caaugcccgcaccgc

SEQ ID NO: 3179891 - RNA, 17 nt, Mycobacterium bovis subsp bovis AF2122/97
caaugcccuuggccagc

SEQ ID NO: 3179892 - RNA, 14 nt, Mycobacterium bovis subsp bovis AF2122/97
caaugccgacgcca

SEQ ID NO: 3179893 - RNA, 17 nt, Mycobacterium bovis subsp bovis AF2122/97
caaugccgacgccaacg

SEQ ID NO: 3179894 - RNA, 16 nt, Mycobacterium bovis subsp bovis AF2122/97
caaugccgcggccagu

SEQ ID NO: 3179895 - RNA, 23 nt, Mycobacterium bovis subsp bovis AF2122/97
caaugccggccgcggggcaucgg

SEQ ID NO: 3179896 - RNA, 14 nt, Mycobacterium bovis subsp bovis AF2122/97
caaugcgagcaccc

SEQ ID NO: 3179897 - RNA, 20 nt, Mycobacterium bovis subsp bovis AF2122/97
caaugcgagguucagccuga

SEQ ID NO: 3179898 - RNA, 19 nt, Mycobacterium bovis subsp bovis AF2122/97
caaugcgcgacggucaagg

SEQ ID NO: 3179899 - RNA, 13 nt, Mycobacterium bovis subsp bovis AF2122/97
caaugcggcccgg

SEQ ID NO: 3179900 - RNA, 13 nt, Mycobacterium bovis subsp bovis AF2122/97
caaugcgucgaug

SEQ ID NO: 3179901 - RNA, 17 nt, Mycobacterium bovis subsp bovis AF2122/97
caaugcguugacgucga

SEQ ID NO: 3179902 - RNA, 19 nt, Mycobacterium bovis subsp bovis AF2122/97
caaugcuccuaucugccgg

SEQ ID NO: 3179903 - RNA, 19 nt, Mycobacterium bovis subsp bovis AF2122/97
caaugcuucggcguccagg

SEQ ID NO: 3179904 - RNA, 15 nt, Mycobacterium bovis subsp bovis AF2122/97
caauggacaccaacc

SEQ ID NO: 3179905 - RNA, 16 nt, Mycobacterium bovis subsp bovis AF2122/97
caauggacaccaaccc

SEQ ID NO: 3179906 - RNA, 14 nt, Mycobacterium bovis subsp bovis AF2122/97
caauggccagcacc

SEQ ID NO: 3179907 - RNA, 15 nt, Mycobacterium bovis subsp bovis AF2122/97
caauggccugcagcg

SEQ ID NO: 3179908 - RNA, 18 nt, Mycobacterium bovis subsp bovis AF2122/97
caauggccugcagcgcga

SEQ ID NO: 3179909 - RNA, 22 nt, Mycobacterium bovis subsp bovis AF2122/97
caauggccugcagcgcgacccg

SEQ ID NO: 3179910 - RNA, 15 nt, Mycobacterium bovis subsp bovis AF2122/97
caauggcgccagccg

SEQ ID NO: 3179911 - RNA, 16 nt, Mycobacterium bovis subsp bovis AF2122/97
caauggcgccagccga

SEQ ID NO: 3179912 - RNA, 17 nt, Mycobacterium bovis subsp bovis AF2122/97
caauggcgccagccgac

SEQ ID NO: 3179913 - RNA, 17 nt, Mycobacterium bovis subsp bovis AF2122/97
caauggcgcgaccgaug

SEQ ID NO: 3179914 - RNA, 15 nt, Mycobacterium bovis subsp bovis AF2122/97
caauggcggcgccgu

SEQ ID NO: 3179915 - RNA, 18 nt, Mycobacterium bovis subsp bovis AF2122/97
caauggcggcgccgucga

SEQ ID NO: 3179916 - RNA, 20 nt, Mycobacterium bovis subsp bovis AF2122/97
caauggcggcgccgucgaag

SEQ ID NO: 3179917 - RNA, 19 nt, Mycobacterium bovis subsp bovis AF2122/97
caauggcucugaggucacc

SEQ ID NO: 3179918 - RNA, 21 nt, Mycobacterium bovis subsp bovis AF2122/97
caauggcuucgaagcgaucgc

SEQ ID NO: 3179919 - RNA, 20 nt, Mycobacterium bovis subsp bovis AF2122/97
caauggugggcgagcugcug

SEQ ID NO: 3179920 - RNA, 18 nt, Mycobacterium bovis subsp bovis AF2122/97
caauggugguugcguucc

SEQ ID NO: 3179921 - RNA, 20 nt, Mycobacterium bovis subsp bovis AF2122/97
caauguccaggcgcgcacca

SEQ ID NO: 3179922 - RNA, 22 nt, Mycobacterium bovis subsp bovis AF2122/97
caaugucggcgaugcguccgcc

SEQ ID NO: 3179923 - RNA, 23 nt, Mycobacterium bovis subsp bovis AF2122/97
caaugucggugacaccaacaccg

SEQ ID NO: 3179924 - RNA, 17 nt, Mycobacterium bovis subsp bovis AF2122/97
caaugucguugcccgcg

SEQ ID NO: 3179925 - RNA, 18 nt, Mycobacterium bovis subsp bovis AF2122/97
caaugugguucgucgucg

SEQ ID NO: 3179926 - RNA, 19 nt, Mycobacterium bovis subsp bovis AF2122/97
caaugugguucgucgucgu

SEQ ID NO: 3179927 - RNA, 19 nt, Mycobacterium bovis subsp bovis AF2122/97
caauucaacacacggcgcg

SEQ ID NO: 3179928 - RNA, 15 nt, Mycobacterium bovis subsp bovis AF2122/97
caauucacgcaccac

SEQ ID NO: 3179929 - RNA, 16 nt, Mycobacterium bovis subsp bovis AF2122/97
caauucagcggcaacg

SEQ ID NO: 3179930 - RNA, 14 nt, Mycobacterium bovis subsp bovis AF2122/97
caauuccagccccc

SEQ ID NO: 3179931 - RNA, 18 nt, Mycobacterium bovis subsp bovis AF2122/97
caauuccgcuugcucucg

SEQ ID NO: 3179932 - RNA, 14 nt, Mycobacterium bovis subsp bovis AF2122/97
caauucgaccgcgc

SEQ ID NO: 3179933 - RNA, 15 nt, Mycobacterium bovis subsp bovis AF2122/97
caauucgcaaucggc

SEQ ID NO: 3179934 - RNA, 23 nt, Mycobacterium bovis subsp bovis AF2122/97
caauucggugcgcuggcggcgca

SEQ ID NO: 3179935 - RNA, 18 nt, Mycobacterium bovis subsp bovis AF2122/97
caauugaacgcaccaacg

SEQ ID NO: 3179936 - RNA, 17 nt, Mycobacterium bovis subsp bovis AF2122/97
caauugcaccuucucca

SEQ ID NO: 3179937 - RNA, 13 nt, Mycobacterium bovis subsp bovis AF2122/97
caauugcccggca

SEQ ID NO: 3179938 - RNA, 17 nt, Mycobacterium bovis subsp bovis AF2122/97
caauugcccuuucccac

SEQ ID NO: 3179939 - RNA, 19 nt, Mycobacterium bovis subsp bovis AF2122/97
caauugcccuuucccaccu

SEQ ID NO: 3179940 - RNA, 19 nt, Mycobacterium bovis subsp bovis AF2122/97
caauugcgcugaagcccau

SEQ ID NO: 3179941 - RNA, 18 nt, Mycobacterium bovis subsp bovis AF2122/97
caauuggccguuggcggc

SEQ ID NO: 3179942 - RNA, 18 nt, Mycobacterium bovis subsp bovis AF2122/97
caauuggcguagcaaccc

SEQ ID NO: 3179943 - RNA, 14 nt, Mycobacterium bovis subsp bovis AF2122/97
caauuggcgucguc

SEQ ID NO: 3179944 - RNA, 14 nt, Mycobacterium bovis subsp bovis AF2122/97
caauuggcucggcg

SEQ ID NO: 3179945 - RNA, 14 nt, Mycobacterium bovis subsp bovis AF2122/97
caauugggcgaugc

SEQ ID NO: 3179946 - RNA, 15 nt, Mycobacterium bovis subsp bovis AF2122/97
caauugugcggcccc

SEQ ID NO: 3179947 - RNA, 18 nt, Mycobacterium bovis subsp bovis AF2122/97
caauugugcggccccguc

SEQ ID NO: 3179948 - RNA, 14 nt, Mycobacterium bovis subsp bovis AF2122/97
caauuucacugcga

SEQ ID NO: 3179949 - RNA, 14 nt, Mycobacterium bovis subsp bovis AF2122/97
cacaaacccagcau

SEQ ID NO: 3179950 - RNA, 15 nt, Mycobacterium bovis subsp bovis AF2122/97
cacaaacccaguuuc

SEQ ID NO: 3179951 - RNA, 21 nt, Mycobacterium bovis subsp bovis AF2122/97
cacaaacgggcgugggccgcu

SEQ ID NO: 3179952 - RNA, 17 nt, Mycobacterium bovis subsp bovis AF2122/97
cacaacagcccguagca

SEQ ID NO: 3179953 - RNA, 14 nt, Mycobacterium bovis subsp bovis AF2122/97
cacaaccaacgaca

SEQ ID NO: 3179954 - RNA, 15 nt, Mycobacterium bovis subsp bovis AF2122/97
cacaacccgucgagc

SEQ ID NO: 3179955 - RNA, 20 nt, Mycobacterium bovis subsp bovis AF2122/97
cacaacccgucgagccgugc

SEQ ID NO: 3179956 - RNA, 16 nt, Mycobacterium bovis subsp bovis AF2122/97
cacaaccgcugcugcu

SEQ ID NO: 3179957 - RNA, 19 nt, Mycobacterium bovis subsp bovis AF2122/97
cacaaccggauugagcacg

SEQ ID NO: 3179958 - RNA, 18 nt, Mycobacterium bovis subsp bovis AF2122/97
cacaaccgugagcaccag

SEQ ID NO: 3179959 - RNA, 22 nt, Mycobacterium bovis subsp bovis AF2122/97
cacaaccgugagcaccagcagc

SEQ ID NO: 3179960 - RNA, 14 nt, Mycobacterium bovis subsp bovis AF2122/97
cacaacgccaugug

SEQ ID NO: 3179961 - RNA, 23 nt, Mycobacterium bovis subsp bovis AF2122/97
cacaacgccucgauggcgguggc

SEQ ID NO: 3179962 - RNA, 20 nt, Mycobacterium bovis subsp bovis AF2122/97
cacaacgccucgccauccau

SEQ ID NO: 3179963 - RNA, 23 nt, Mycobacterium bovis subsp bovis AF2122/97
cacaacgcgugaccagggccuga

SEQ ID NO: 3179964 - RNA, 18 nt, Mycobacterium bovis subsp bovis AF2122/97
cacaacggauaucagcaa

SEQ ID NO: 3179965 - RNA, 15 nt, Mycobacterium bovis subsp bovis AF2122/97
cacaacggcggcgca

SEQ ID NO: 3179966 - RNA, 18 nt, Mycobacterium bovis subsp bovis AF2122/97
cacaacgggugucggcgu

SEQ ID NO: 3179967 - RNA, 21 nt, Mycobacterium bovis subsp bovis AF2122/97
cacaacucggcauucaccgcg

SEQ ID NO: 3179968 - RNA, 18 nt, Mycobacterium bovis subsp bovis AF2122/97
cacaagauccgccacgcu

SEQ ID NO: 3179969 - RNA, 22 nt, Mycobacterium bovis subsp bovis AF2122/97
cacaagccccgcgcguucggcg

SEQ ID NO: 3179970 - RNA, 13 nt, Mycobacterium bovis subsp bovis AF2122/97
cacaagccgugca

SEQ ID NO: 3179971 - RNA, 14 nt, Mycobacterium bovis subsp bovis AF2122/97
cacaagcugaacua

SEQ ID NO: 3179972 - RNA, 22 nt, Mycobacterium bovis subsp bovis AF2122/97
cacaaggcgugagcuaugcugg

SEQ ID NO: 3179973 - RNA, 16 nt, Mycobacterium bovis subsp bovis AF2122/97
cacaaguaccgcaucg

SEQ ID NO: 3179974 - RNA, 16 nt, Mycobacterium bovis subsp bovis AF2122/97
cacaaguggucgauga

SEQ ID NO: 3179975 - RNA, 17 nt, Mycobacterium bovis subsp bovis AF2122/97
cacaauacggucagcag

SEQ ID NO: 3179976 - RNA, 12 nt, Mycobacterium bovis subsp bovis AF2122/97
cacaaucaccgc

SEQ ID NO: 3179977 - RNA, 20 nt, Mycobacterium bovis subsp bovis AF2122/97
cacaauccacgucgcggcgu

SEQ ID NO: 3179978 - RNA, 21 nt, Mycobacterium bovis subsp bovis AF2122/97
cacaauccgcucggucgccuc

SEQ ID NO: 3179979 - RNA, 13 nt, Mycobacterium bovis subsp bovis AF2122/97
cacaaugcuucgg

SEQ ID NO: 3179980 - RNA, 16 nt, Mycobacterium bovis subsp bovis AF2122/97
cacaaugcuucggcgu

SEQ ID NO: 3179981 - RNA, 12 nt, Mycobacterium bovis subsp bovis AF2122/97
cacaauggcggc

SEQ ID NO: 3179982 - RNA, 19 nt, Mycobacterium bovis subsp bovis AF2122/97
cacaauggcggcgccgucg

SEQ ID NO: 3179983 - RNA, 12 nt, Mycobacterium bovis subsp bovis AF2122/97
cacaauuccaca

SEQ ID NO: 3179984 - RNA, 15 nt, Mycobacterium bovis subsp bovis AF2122/97
cacaauuccacaaau

SEQ ID NO: 3179985 - RNA, 19 nt, Mycobacterium bovis subsp bovis AF2122/97
cacacaaccgacgggucgc

SEQ ID NO: 3179986 - RNA, 20 nt, Mycobacterium bovis subsp bovis AF2122/97
cacacacagccgguggcauu

SEQ ID NO: 3179987 - RNA, 17 nt, Mycobacterium bovis subsp bovis AF2122/97
cacacaggcggcgaacu

SEQ ID NO: 3179988 - RNA, 23 nt, Mycobacterium bovis subsp bovis AF2122/97
cacacaggcguccaucgccaccg

SEQ ID NO: 3179989 - RNA, 23 nt, Mycobacterium bovis subsp bovis AF2122/97
cacacagguccugcgccgcacgc

SEQ ID NO: 3179990 - RNA, 14 nt, Mycobacterium bovis subsp bovis AF2122/97
cacacagucacgga

SEQ ID NO: 3179991 - RNA, 17 nt, Mycobacterium bovis subsp bovis AF2122/97
cacacagucacggaccg

SEQ ID NO: 3179992 - RNA, 18 nt, Mycobacterium bovis subsp bovis AF2122/97
cacaccaacgucgauguc

SEQ ID NO: 3179993 - RNA, 15 nt, Mycobacterium bovis subsp bovis AF2122/97
cacaccacgauggcg

SEQ ID NO: 3179994 - RNA, 19 nt, Mycobacterium bovis subsp bovis AF2122/97
cacaccacgauggcggcca

SEQ ID NO: 3179995 - RNA, 18 nt, Mycobacterium bovis subsp bovis AF2122/97
cacaccagcgggcaucgc

SEQ ID NO: 3179996 - RNA, 15 nt, Mycobacterium bovis subsp bovis AF2122/97
cacaccagcggucgg

SEQ ID NO: 3179997 - RNA, 21 nt, Mycobacterium bovis subsp bovis AF2122/97
cacaccagcuuguagcgcucg

SEQ ID NO: 3179998 - RNA, 13 nt, Mycobacterium bovis subsp bovis AF2122/97
cacaccaggccga

SEQ ID NO: 3179999 - RNA, 17 nt, Mycobacterium bovis subsp bovis AF2122/97
cacaccaggccgagccg

SEQ ID NO: 3180000 - RNA, 20 nt, Mycobacterium bovis subsp bovis AF2122/97
cacaccaggccgagccgccc

SEQ ID NO: 3180001 - RNA, 22 nt, Mycobacterium bovis subsp bovis AF2122/97
cacaccaugauugccaggaccg

SEQ ID NO: 3180002 - RNA, 14 nt, Mycobacterium bovis subsp bovis AF2122/97
cacacccacgucga

SEQ ID NO: 3180003 - RNA, 13 nt, Mycobacterium bovis subsp bovis AF2122/97
cacacccagaugc

SEQ ID NO: 3180004 - RNA, 15 nt, Mycobacterium bovis subsp bovis AF2122/97
cacacccagaugcag

SEQ ID NO: 3180005 - RNA, 14 nt, Mycobacterium bovis subsp bovis AF2122/97
cacacccagcgcgc

SEQ ID NO: 3180006 - RNA, 16 nt, Mycobacterium bovis subsp bovis AF2122/97
cacaccccaggcaccc

SEQ ID NO: 3180007 - RNA, 14 nt, Mycobacterium bovis subsp bovis AF2122/97
cacacccccgucug

SEQ ID NO: 3180008 - RNA, 15 nt, Mycobacterium bovis subsp bovis AF2122/97
cacacccccgucugc

SEQ ID NO: 3180009 - RNA, 14 nt, Mycobacterium bovis subsp bovis AF2122/97
cacacccgcaccgg

SEQ ID NO: 3180010 - RNA, 15 nt, Mycobacterium bovis subsp bovis AF2122/97
cacacccgcaccgga

SEQ ID NO: 3180011 - RNA, 19 nt, Mycobacterium bovis subsp bovis AF2122/97
cacacccgcgaacgcgaca

SEQ ID NO: 3180012 - RNA, 21 nt, Mycobacterium bovis subsp bovis AF2122/97
cacacccgcgaacgcgacagc

SEQ ID NO: 3180013 - RNA, 18 nt, Mycobacterium bovis subsp bovis AF2122/97
cacacccggcacacccuc

SEQ ID NO: 3180014 - RNA, 23 nt, Mycobacterium bovis subsp bovis AF2122/97
cacacccgggacgaaccggccga

SEQ ID NO: 3180015 - RNA, 16 nt, Mycobacterium bovis subsp bovis AF2122/97
cacaccgacagcaccc

SEQ ID NO: 3180016 - RNA, 21 nt, Mycobacterium bovis subsp bovis AF2122/97
cacaccgagcgcaaucgacca

SEQ ID NO: 3180017 - RNA, 13 nt, Mycobacterium bovis subsp bovis AF2122/97
cacaccgaggucg

SEQ ID NO: 3180018 - RNA, 23 nt, Mycobacterium bovis subsp bovis AF2122/97
cacaccgaguauuuuucgaccag

SEQ ID NO: 3180019 - RNA, 14 nt, Mycobacterium bovis subsp bovis AF2122/97
cacaccgcggcggc

SEQ ID NO: 3180020 - RNA, 14 nt, Mycobacterium bovis subsp bovis AF2122/97
cacaccggagccga

SEQ ID NO: 3180021 - RNA, 19 nt, Mycobacterium bovis subsp bovis AF2122/97
cacaccggauagguggucu

SEQ ID NO: 3180022 - RNA, 13 nt, Mycobacterium bovis subsp bovis AF2122/97
cacaccggcacug

SEQ ID NO: 3180023 - RNA, 19 nt, Mycobacterium bovis subsp bovis AF2122/97
cacaccggcacugcccagc

SEQ ID NO: 3180024 - RNA, 23 nt, Mycobacterium bovis subsp bovis AF2122/97
cacaccggcacugcccagcagac

SEQ ID NO: 3180025 - RNA, 18 nt, Mycobacterium bovis subsp bovis AF2122/97
cacaccgggaugggagcc

SEQ ID NO: 3180026 - RNA, 21 nt, Mycobacterium bovis subsp bovis AF2122/97
cacaccgggaugggagccacu

SEQ ID NO: 3180027 - RNA, 18 nt, Mycobacterium bovis subsp bovis AF2122/97
cacaccggggcggccgac

SEQ ID NO: 3180028 - RNA, 23 nt, Mycobacterium bovis subsp bovis AF2122/97
cacaccgguggacccggcggugc

SEQ ID NO: 3180029 - RNA, 13 nt, Mycobacterium bovis subsp bovis AF2122/97
cacaccguaccga

SEQ ID NO: 3180030 - RNA, 16 nt, Mycobacterium bovis subsp bovis AF2122/97
cacaccgucgcaccca

SEQ ID NO: 3180031 - RNA, 21 nt, Mycobacterium bovis subsp bovis AF2122/97
cacaccgucgcgcucgcacca

SEQ ID NO: 3180032 - RNA, 23 nt, Mycobacterium bovis subsp bovis AF2122/97
cacaccgucgucguacggcucau

SEQ ID NO: 3180033 - RNA, 16 nt, Mycobacterium bovis subsp bovis AF2122/97
cacaccgugaccagcc

SEQ ID NO: 3180034 - RNA, 16 nt, Mycobacterium bovis subsp bovis AF2122/97
cacaccgugggcgacg

SEQ ID NO: 3180035 - RNA, 15 nt, Mycobacterium bovis subsp bovis AF2122/97
cacaccuuggccgcc

SEQ ID NO: 3180036 - RNA, 21 nt, Mycobacterium bovis subsp bovis AF2122/97
cacaccuuggccgccggccgc

SEQ ID NO: 3180037 - RNA, 18 nt, Mycobacterium bovis subsp bovis AF2122/97
cacacgaucgcggugaug

SEQ ID NO: 3180038 - RNA, 12 nt, Mycobacterium bovis subsp bovis AF2122/97
cacacgaugacg

SEQ ID NO: 3180039 - RNA, 22 nt, Mycobacterium bovis subsp bovis AF2122/97
cacacgaugacguugacgucgg

SEQ ID NO: 3180040 - RNA, 18 nt, Mycobacterium bovis subsp bovis AF2122/97
cacacgcccucgacgccg

SEQ ID NO: 3180041 - RNA, 21 nt, Mycobacterium bovis subsp bovis AF2122/97
cacacgcccucgacgccgcgc

SEQ ID NO: 3180042 - RNA, 16 nt, Mycobacterium bovis subsp bovis AF2122/97
cacacgccgccggugu

SEQ ID NO: 3180043 - RNA, 20 nt, Mycobacterium bovis subsp bovis AF2122/97
cacacgccgccggugucggg

SEQ ID NO: 3180044 - RNA, 18 nt, Mycobacterium bovis subsp bovis AF2122/97
cacacgccuaccgcgacg

SEQ ID NO: 3180045 - RNA, 15 nt, Mycobacterium bovis subsp bovis AF2122/97
cacacggggccgcca

SEQ ID NO: 3180046 - RNA, 16 nt, Mycobacterium bovis subsp bovis AF2122/97
cacacggucaccggca

SEQ ID NO: 3180047 - RNA, 18 nt, Mycobacterium bovis subsp bovis AF2122/97
cacacggucaccggcacg

SEQ ID NO: 3180048 - RNA, 17 nt, Mycobacterium bovis subsp bovis AF2122/97
cacacgguccgccacgg

SEQ ID NO: 3180049 - RNA, 20 nt, Mycobacterium bovis subsp bovis AF2122/97
cacacgguccgccacggcgg

SEQ ID NO: 3180050 - RNA, 22 nt, Mycobacterium bovis subsp bovis AF2122/97
cacacgucaggcaacgaagagg

SEQ ID NO: 3180051 - RNA, 19 nt, Mycobacterium bovis subsp bovis AF2122/97
cacacguccgcgcaccgca

SEQ ID NO: 3180052 - RNA, 18 nt, Mycobacterium bovis subsp bovis AF2122/97
cacacguuggcagcccuc

SEQ ID NO: 3180053 - RNA, 22 nt, Mycobacterium bovis subsp bovis AF2122/97
cacacguuggcagcccucuggu

SEQ ID NO: 3180054 - RNA, 17 nt, Mycobacterium bovis subsp bovis AF2122/97
cacacuaccgccgcgac

SEQ ID NO: 3180055 - RNA, 14 nt, Mycobacterium bovis subsp bovis AF2122/97
cacacucagcaccc

SEQ ID NO: 3180056 - RNA, 14 nt, Mycobacterium bovis subsp bovis AF2122/97
cacacucccgcgcc

SEQ ID NO: 3180057 - RNA, 13 nt, Mycobacterium bovis subsp bovis AF2122/97
cacacucgccagg

SEQ ID NO: 3180058 - RNA, 23 nt, Mycobacterium bovis subsp bovis AF2122/97
cacacucggccgggcucuaucag

SEQ ID NO: 3180059 - RNA, 14 nt, Mycobacterium bovis subsp bovis AF2122/97
cacacucgggcggc

SEQ ID NO: 3180060 - RNA, 18 nt, Mycobacterium bovis subsp bovis AF2122/97
cacacugaagaucgcgcc

SEQ ID NO: 3180061 - RNA, 18 nt, Mycobacterium bovis subsp bovis AF2122/97
cacacugaccccgccgcc

SEQ ID NO: 3180062 - RNA, 22 nt, Mycobacterium bovis subsp bovis AF2122/97
cacacugccggacagccacgca

SEQ ID NO: 3180063 - RNA, 16 nt, Mycobacterium bovis subsp bovis AF2122/97
cacacuggccacaauc

SEQ ID NO: 3180064 - RNA, 20 nt, Mycobacterium bovis subsp bovis AF2122/97
cacacuguuacuccgacggc

SEQ ID NO: 3180065 - RNA, 22 nt, Mycobacterium bovis subsp bovis AF2122/97
cacacuguuacuccgacggccc

SEQ ID NO: 3180066 - RNA, 20 nt, Mycobacterium bovis subsp bovis AF2122/97
cacacuuugguugcccgcau

SEQ ID NO: 3180067 - RNA, 14 nt, Mycobacterium bovis subsp bovis AF2122/97
cacagaaccgggua

SEQ ID NO: 3180068 - RNA, 15 nt, Mycobacterium bovis subsp bovis AF2122/97
cacagaacucaccga

SEQ ID NO: 3180069 - RNA, 21 nt, Mycobacterium bovis subsp bovis AF2122/97
cacagaaucgcacgaaaucag

SEQ ID NO: 3180070 - RNA, 23 nt, Mycobacterium bovis subsp bovis AF2122/97
cacagaaucgcccauuucggcac

SEQ ID NO: 3180071 - RNA, 13 nt, Mycobacterium bovis subsp bovis AF2122/97
cacagacacggca

SEQ ID NO: 3180072 - RNA, 15 nt, Mycobacterium bovis subsp bovis AF2122/97
cacagaccgaacagc

SEQ ID NO: 3180073 - RNA, 20 nt, Mycobacterium bovis subsp bovis AF2122/97
cacagaccgaacagcaccga

SEQ ID NO: 3180074 - RNA, 15 nt, Mycobacterium bovis subsp bovis AF2122/97
cacagcaacgcccaa

SEQ ID NO: 3180075 - RNA, 16 nt, Mycobacterium bovis subsp bovis AF2122/97
cacagcaacgcccaac

SEQ ID NO: 3180076 - RNA, 16 nt, Mycobacterium bovis subsp bovis AF2122/97
cacagcacagcgcagc

SEQ ID NO: 3180077 - RNA, 12 nt, Mycobacterium bovis subsp bovis AF2122/97
cacagcaccacg

SEQ ID NO: 3180078 - RNA, 13 nt, Mycobacterium bovis subsp bovis AF2122/97
cacagcacccacg

SEQ ID NO: 3180079 - RNA, 15 nt, Mycobacterium bovis subsp bovis AF2122/97
cacagcacccacgcc

SEQ ID NO: 3180080 - RNA, 15 nt, Mycobacterium bovis subsp bovis AF2122/97
cacagcaccguccuc

SEQ ID NO: 3180081 - RNA, 20 nt, Mycobacterium bovis subsp bovis AF2122/97
cacagcaccguccucgguca

SEQ ID NO: 3180082 - RNA, 22 nt, Mycobacterium bovis subsp bovis AF2122/97
cacagcaccguccucggucacg

SEQ ID NO: 3180083 - RNA, 21 nt, Mycobacterium bovis subsp bovis AF2122/97
cacagcagcaccgcgaccauc

SEQ ID NO: 3180084 - RNA, 20 nt, Mycobacterium bovis subsp bovis AF2122/97
cacagcagcgucaucagguc

SEQ ID NO: 3180085 - RNA, 12 nt, Mycobacterium bovis subsp bovis AF2122/97
cacagcaggcuc

SEQ ID NO: 3180086 - RNA, 15 nt, Mycobacterium bovis subsp bovis AF2122/97
cacagcauaaagauc

SEQ ID NO: 3180087 - RNA, 15 nt, Mycobacterium bovis subsp bovis AF2122/97
cacagccaccagccg

SEQ ID NO: 3180088 - RNA, 15 nt, Mycobacterium bovis subsp bovis AF2122/97
cacagccaguaaaaa

SEQ ID NO: 3180089 - RNA, 19 nt, Mycobacterium bovis subsp bovis AF2122/97
cacagcccacaggcggcgc

SEQ ID NO: 3180090 - RNA, 15 nt, Mycobacterium bovis subsp bovis AF2122/97
cacagcccgaugccg

SEQ ID NO: 3180091 - RNA, 19 nt, Mycobacterium bovis subsp bovis AF2122/97
cacagcccgaugccgugcc

SEQ ID NO: 3180092 - RNA, 13 nt, Mycobacterium bovis subsp bovis AF2122/97
cacagcccggcga

SEQ ID NO: 3180093 - RNA, 14 nt, Mycobacterium bovis subsp bovis AF2122/97
cacagcccggcgac

SEQ ID NO: 3180094 - RNA, 16 nt, Mycobacterium bovis subsp bovis AF2122/97
cacagcccggcgacga

SEQ ID NO: 3180095 - RNA, 15 nt, Mycobacterium bovis subsp bovis AF2122/97
cacagccgcgccgac

SEQ ID NO: 3180096 - RNA, 16 nt, Mycobacterium bovis subsp bovis AF2122/97
cacagccgcgccgacc

SEQ ID NO: 3180097 - RNA, 15 nt, Mycobacterium bovis subsp bovis AF2122/97
cacagccgcuuggcg

SEQ ID NO: 3180098 - RNA, 14 nt, Mycobacterium bovis subsp bovis AF2122/97
cacagccgguggca

SEQ ID NO: 3180099 - RNA, 20 nt, Mycobacterium bovis subsp bovis AF2122/97
cacagccgucgcaccagauc

SEQ ID NO: 3180100 - RNA, 17 nt, Mycobacterium bovis subsp bovis AF2122/97
cacagcgcaaaaucacc

SEQ ID NO: 3180101 - RNA, 12 nt, Mycobacterium bovis subsp bovis AF2122/97
cacagcgcagcc

SEQ ID NO: 3180102 - RNA, 18 nt, Mycobacterium bovis subsp bovis AF2122/97
cacagcgcagccugcagc

SEQ ID NO: 3180103 - RNA, 18 nt, Mycobacterium bovis subsp bovis AF2122/97
cacagcgcguagcgggcg

SEQ ID NO: 3180104 - RNA, 14 nt, Mycobacterium bovis subsp bovis AF2122/97
cacagcggagacga

SEQ ID NO: 3180105 - RNA, 22 nt, Mycobacterium bovis subsp bovis AF2122/97
cacagcggccauaucgcccacc

SEQ ID NO: 3180106 - RNA, 12 nt, Mycobacterium bovis subsp bovis AF2122/97
cacagcggcgau

SEQ ID NO: 3180107 - RNA, 13 nt, Mycobacterium bovis subsp bovis AF2122/97
caccaacgacagc

SEQ ID NO: 3180108 - RNA, 15 nt, Mycobacterium bovis subsp bovis AF2122/97
caccaacgacagcga

SEQ ID NO: 3180109 - RNA, 15 nt, Mycobacterium bovis subsp bovis AF2122/97
caccaacgccaccgu

SEQ ID NO: 3180110 - RNA, 23 nt, Mycobacterium bovis subsp bovis AF2122/97
caccaacgcgaucaggcgcucga

SEQ ID NO: 3180111 - RNA, 15 nt, Mycobacterium bovis subsp bovis AF2122/97
caccaacucgacgug

SEQ ID NO: 3180112 - RNA, 18 nt, Mycobacterium bovis subsp bovis AF2122/97
caccaacucggcgaccug

SEQ ID NO: 3180113 - RNA, 21 nt, Mycobacterium bovis subsp bovis AF2122/97
caccaacugaauggcaccgag

SEQ ID NO: 3180114 - RNA, 15 nt, Mycobacterium bovis subsp bovis AF2122/97
caccaagacaccggc

SEQ ID NO: 3180115 - RNA, 16 nt, Mycobacterium bovis subsp bovis AF2122/97
caccaagcagcgacca

SEQ ID NO: 3180116 - RNA, 17 nt, Mycobacterium bovis subsp bovis AF2122/97
caccaagcucggccagc

SEQ ID NO: 3180117 - RNA, 14 nt, Mycobacterium bovis subsp bovis AF2122/97
caccaaggccgccu

SEQ ID NO: 3180118 - RNA, 17 nt, Mycobacterium bovis subsp bovis AF2122/97
caccaaggccgugaugc

SEQ ID NO: 3180119 - RNA, 23 nt, Mycobacterium bovis subsp bovis AF2122/97
caccaaggccgugaugccacggc

SEQ ID NO: 3180120 - RNA, 13 nt, Mycobacterium bovis subsp bovis AF2122/97
caccaaguucagc

SEQ ID NO: 3180121 - RNA, 17 nt, Mycobacterium bovis subsp bovis AF2122/97
caccaaguucagcacgu

SEQ ID NO: 3180122 - RNA, 19 nt, Mycobacterium bovis subsp bovis AF2122/97
caccaaucggguccacguc

SEQ ID NO: 3180123 - RNA, 20 nt, Mycobacterium bovis subsp bovis AF2122/97
caccaaucugcgggccggug

SEQ ID NO: 3180124 - RNA, 21 nt, Mycobacterium bovis subsp bovis AF2122/97
caccacaaacaccccacacag

SEQ ID NO: 3180125 - RNA, 14 nt, Mycobacterium bovis subsp bovis AF2122/97
caccacaacgccag

SEQ ID NO: 3180126 - RNA, 14 nt, Mycobacterium bovis subsp bovis AF2122/97
caccacacagccgc

SEQ ID NO: 3180127 - RNA, 15 nt, Mycobacterium bovis subsp bovis AF2122/97
caccacacagccgcg

SEQ ID NO: 3180128 - RNA, 15 nt, Mycobacterium bovis subsp bovis AF2122/97
caccacaccggagcc

SEQ ID NO: 3180129 - RNA, 19 nt, Mycobacterium bovis subsp bovis AF2122/97
caccacaccggagccgaac

SEQ ID NO: 3180130 - RNA, 14 nt, Mycobacterium bovis subsp bovis AF2122/97
caccacaccggcag

SEQ ID NO: 3180131 - RNA, 19 nt, Mycobacterium bovis subsp bovis AF2122/97
caccacaccugcggcugcu

SEQ ID NO: 3180132 - RNA, 12 nt, Mycobacterium bovis subsp bovis AF2122/97
caccacauccau

SEQ ID NO: 3180133 - RNA, 16 nt, Mycobacterium bovis subsp bovis AF2122/97
caccacauccaucucc

SEQ ID NO: 3180134 - RNA, 13 nt, Mycobacterium bovis subsp bovis AF2122/97
caccacaucgggc

SEQ ID NO: 3180135 - RNA, 20 nt, Mycobacterium bovis subsp bovis AF2122/97
caccacaucgggccggugga

SEQ ID NO: 3180136 - RNA, 19 nt, Mycobacterium bovis subsp bovis AF2122/97
caccacauuggcgaucagc

SEQ ID NO: 3180137 - RNA, 22 nt, Mycobacterium bovis subsp bovis AF2122/97
caccacauuggcgaucagcagc

SEQ ID NO: 3180138 - RNA, 24 nt, Mycobacterium bovis subsp bovis AF2122/97
caccacauuggcgaucagcagccg

SEQ ID NO: 3180139 - RNA, 18 nt, Mycobacterium bovis subsp bovis AF2122/97
caccaccaagcucggcca

SEQ ID NO: 3180140 - RNA, 13 nt, Mycobacterium bovis subsp bovis AF2122/97
caccaccacgccg

SEQ ID NO: 3180141 - RNA, 15 nt, Mycobacterium bovis subsp bovis AF2122/97
caccaccacggccag

SEQ ID NO: 3180142 - RNA, 22 nt, Mycobacterium bovis subsp bovis AF2122/97
caccaccagagacgaucaucuc

SEQ ID NO: 3180143 - RNA, 11 nt, Mycobacterium bovis subsp bovis AF2122/97
caccaccagca

SEQ ID NO: 3180144 - RNA, 12 nt, Mycobacterium bovis subsp bovis AF2122/97
caccaccagcac

SEQ ID NO: 3180145 - RNA, 17 nt, Mycobacterium bovis subsp bovis AF2122/97
caccaccagcacgcucg

SEQ ID NO: 3180146 - RNA, 19 nt, Mycobacterium bovis subsp bovis AF2122/97
caccaccaggcugucgugg

SEQ ID NO: 3180147 - RNA, 21 nt, Mycobacterium bovis subsp bovis AF2122/97
caccaccagguccaccccgcc

SEQ ID NO: 3180148 - RNA, 14 nt, Mycobacterium bovis subsp bovis AF2122/97
caccaccaggucgg

SEQ ID NO: 3180149 - RNA, 13 nt, Mycobacterium bovis subsp bovis AF2122/97
caccaccauuccc

SEQ ID NO: 3180150 - RNA, 20 nt, Mycobacterium bovis subsp bovis AF2122/97
caccaccauucccggaccca

SEQ ID NO: 3180151 - RNA, 21 nt, Mycobacterium bovis subsp bovis AF2122/97
caccaccauucccggacccac

SEQ ID NO: 3180152 - RNA, 23 nt, Mycobacterium bovis subsp bovis AF2122/97
caccaccauucccggacccacca

SEQ ID NO: 3180153 - RNA, 14 nt, Mycobacterium bovis subsp bovis AF2122/97
caccacccaacagc

SEQ ID NO: 3180154 - RNA, 13 nt, Mycobacterium bovis subsp bovis AF2122/97
caccaccccagcg

SEQ ID NO: 3180155 - RNA, 16 nt, Mycobacterium bovis subsp bovis AF2122/97
caccaccccagcggcc

SEQ ID NO: 3180156 - RNA, 17 nt, Mycobacterium bovis subsp bovis AF2122/97
caccaccccagcggcca

SEQ ID NO: 3180157 - RNA, 14 nt, Mycobacterium bovis subsp bovis AF2122/97
caccaccccgucga

SEQ ID NO: 3180158 - RNA, 15 nt, Mycobacterium bovis subsp bovis AF2122/97
caccacccgaccgcc

SEQ ID NO: 3180159 - RNA, 18 nt, Mycobacterium bovis subsp bovis AF2122/97
caccacccgaccgccauc

SEQ ID NO: 3180160 - RNA, 21 nt, Mycobacterium bovis subsp bovis AF2122/97
caccacccgaccgccauccuu

SEQ ID NO: 3180161 - RNA, 22 nt, Mycobacterium bovis subsp bovis AF2122/97
caccacccgaccgccauccuuc

SEQ ID NO: 3180162 - RNA, 15 nt, Mycobacterium bovis subsp bovis AF2122/97
caccacccugcacug

SEQ ID NO: 3180163 - RNA, 21 nt, Mycobacterium bovis subsp bovis AF2122/97
caccacccuguuguugccccg

SEQ ID NO: 3180164 - RNA, 14 nt, Mycobacterium bovis subsp bovis AF2122/97
caccaccgaccugg

SEQ ID NO: 3180165 - RNA, 22 nt, Mycobacterium bovis subsp bovis AF2122/97
caccaccgaccuggacgcggcc

SEQ ID NO: 3180166 - RNA, 15 nt, Mycobacterium bovis subsp bovis AF2122/97
caccaccgcaaccaa

SEQ ID NO: 3180167 - RNA, 15 nt, Mycobacterium bovis subsp bovis AF2122/97
caccaccgcacaucg

SEQ ID NO: 3180168 - RNA, 12 nt, Mycobacterium bovis subsp bovis AF2122/97
caccaccgccag

SEQ ID NO: 3180169 - RNA, 13 nt, Mycobacterium bovis subsp bovis AF2122/97
caccaccgccaga

SEQ ID NO: 3180170 - RNA, 19 nt, Mycobacterium bovis subsp bovis AF2122/97
caccaccgccccgcgccca

SEQ ID NO: 3180171 - RNA, 13 nt, Mycobacterium bovis subsp bovis AF2122/97
caccaccgcccgc

SEQ ID NO: 3180172 - RNA, 14 nt, Mycobacterium bovis subsp bovis AF2122/97
caccaccgcccgca

SEQ ID NO: 3180173 - RNA, 11 nt, Mycobacterium bovis subsp bovis AF2122/97
caccaccgccg

SEQ ID NO: 3180174 - RNA, 14 nt, Mycobacterium bovis subsp bovis AF2122/97
caccaccgccgacc

SEQ ID NO: 3180175 - RNA, 16 nt, Mycobacterium bovis subsp bovis AF2122/97
caccaccgccgacccu

SEQ ID NO: 3180176 - RNA, 14 nt, Mycobacterium bovis subsp bovis AF2122/97
caccaccgccgcca

SEQ ID NO: 3180177 - RNA, 15 nt, Mycobacterium bovis subsp bovis AF2122/97
caccaccgccgccac

SEQ ID NO: 3180178 - RNA, 16 nt, Mycobacterium bovis subsp bovis AF2122/97
caccaccgccgccacc

SEQ ID NO: 3180179 - RNA, 14 nt, Mycobacterium bovis subsp bovis AF2122/97
caccaccgccgccg

SEQ ID NO: 3180180 - RNA, 20 nt, Mycobacterium bovis subsp bovis AF2122/97
caccaccgccgccggcaccg

SEQ ID NO: 3180181 - RNA, 15 nt, Mycobacterium bovis subsp bovis AF2122/97
caccaccgccggugc

SEQ ID NO: 3180182 - RNA, 17 nt, Mycobacterium bovis subsp bovis AF2122/97
caccaccgcgccgucgu

SEQ ID NO: 3180183 - RNA, 13 nt, Mycobacterium bovis subsp bovis AF2122/97
caccaccgcggcg

SEQ ID NO: 3180184 - RNA, 20 nt, Mycobacterium bovis subsp bovis AF2122/97
caccaccgcggcggcggcca

SEQ ID NO: 3180185 - RNA, 14 nt, Mycobacterium bovis subsp bovis AF2122/97
caccaccgcucguc

SEQ ID NO: 3180186 - RNA, 16 nt, Mycobacterium bovis subsp bovis AF2122/97
caccaccgcugccggc

SEQ ID NO: 3180187 - RNA, 14 nt, Mycobacterium bovis subsp bovis AF2122/97
caccaccggaacca

SEQ ID NO: 3180188 - RNA, 15 nt, Mycobacterium bovis subsp bovis AF2122/97
caccaccggaaccac

SEQ ID NO: 3180189 - RNA, 19 nt, Mycobacterium bovis subsp bovis AF2122/97
caccaccggaucgcucccg

SEQ ID NO: 3180190 - RNA, 21 nt, Mycobacterium bovis subsp bovis AF2122/97
caccaccggaucgcucccguc

SEQ ID NO: 3180191 - RNA, 18 nt, Mycobacterium bovis subsp bovis AF2122/97
caccaccggcaacaucag

SEQ ID NO: 3180192 - RNA, 21 nt, Mycobacterium bovis subsp bovis AF2122/97
caccaccggcaacaucagcag

SEQ ID NO: 3180193 - RNA, 18 nt, Mycobacterium bovis subsp bovis AF2122/97
caccaccggcacccgcug

SEQ ID NO: 3180194 - RNA, 15 nt, Mycobacterium bovis subsp bovis AF2122/97
caccagcagccagcc

SEQ ID NO: 3180195 - RNA, 23 nt, Mycobacterium bovis subsp bovis AF2122/97
caccagcagccagcccagccgcc

SEQ ID NO: 3180196 - RNA, 21 nt, Mycobacterium bovis subsp bovis AF2122/97
caccagcaggaagaagccgaa

SEQ ID NO: 3180197 - RNA, 14 nt, Mycobacterium bovis subsp bovis AF2122/97
caccagcaggcggc

SEQ ID NO: 3180198 - RNA, 13 nt, Mycobacterium bovis subsp bovis AF2122/97
caccagcaugccu

SEQ ID NO: 3180199 - RNA, 17 nt, Mycobacterium bovis subsp bovis AF2122/97
caccagcauucucgccg

SEQ ID NO: 3180200 - RNA, 20 nt, Mycobacterium bovis subsp bovis AF2122/97
caccagcauucucgccgacg

SEQ ID NO: 3180201 - RNA, 17 nt, Mycobacterium bovis subsp bovis AF2122/97
caccagccaaaucagcc

SEQ ID NO: 3180202 - RNA, 13 nt, Mycobacterium bovis subsp bovis AF2122/97
caccagccacccc

SEQ ID NO: 3180203 - RNA, 15 nt, Mycobacterium bovis subsp bovis AF2122/97
caccagccaccccug

SEQ ID NO: 3180204 - RNA, 13 nt, Mycobacterium bovis subsp bovis AF2122/97
caccagccagaug

SEQ ID NO: 3180205 - RNA, 15 nt, Mycobacterium bovis subsp bovis AF2122/97
caccagccagccugc

SEQ ID NO: 3180206 - RNA, 14 nt, Mycobacterium bovis subsp bovis AF2122/97
caccagccccaacc

SEQ ID NO: 3180207 - RNA, 20 nt, Mycobacterium bovis subsp bovis AF2122/97
caccagcccgaugaucccgc

SEQ ID NO: 3180208 - RNA, 11 nt, Mycobacterium bovis subsp bovis AF2122/97
caccagcccgg

SEQ ID NO: 3180209 - RNA, 15 nt, Mycobacterium bovis subsp bovis AF2122/97
caccagcccggcggc

SEQ ID NO: 3180210 - RNA, 23 nt, Mycobacterium bovis subsp bovis AF2122/97
caccagcccggcggcggucacca

SEQ ID NO: 3180211 - RNA, 23 nt, Mycobacterium bovis subsp bovis AF2122/97
caccagccgggcaaggcccgguc

SEQ ID NO: 3180212 - RNA, 17 nt, Mycobacterium bovis subsp bovis AF2122/97
caccagccgguccagca

SEQ ID NO: 3180213 - RNA, 22 nt, Mycobacterium bovis subsp bovis AF2122/97
caccagccggucgucgcgcagu

SEQ ID NO: 3180214 - RNA, 12 nt, Mycobacterium bovis subsp bovis AF2122/97
caccagccggug

SEQ ID NO: 3180215 - RNA, 20 nt, Mycobacterium bovis subsp bovis AF2122/97
caccagccggugagcgagcg

SEQ ID NO: 3180216 - RNA, 19 nt, Mycobacterium bovis subsp bovis AF2122/97
caccagcgaauccagccgc

SEQ ID NO: 3180217 - RNA, 21 nt, Mycobacterium bovis subsp bovis AF2122/97
caccagcgaccaggucgccag

SEQ ID NO: 3180218 - RNA, 14 nt, Mycobacterium bovis subsp bovis AF2122/97
caccagcgacgcca

SEQ ID NO: 3180219 - RNA, 16 nt, Mycobacterium bovis subsp bovis AF2122/97
caccagcgaggccagc

SEQ ID NO: 3180220 - RNA, 19 nt, Mycobacterium bovis subsp bovis AF2122/97
caccagcgcacgcucggca

SEQ ID NO: 3180221 - RNA, 19 nt, Mycobacterium bovis subsp bovis AF2122/97
caccagcgcagcauugacc

SEQ ID NO: 3180222 - RNA, 21 nt, Mycobacterium bovis subsp bovis AF2122/97
caccagcgcagcauugaccaa

SEQ ID NO: 3180223 - RNA, 13 nt, Mycobacterium bovis subsp bovis AF2122/97
caccagcgcagcc

SEQ ID NO: 3180224 - RNA, 15 nt, Mycobacterium bovis subsp bovis AF2122/97
caccagcgcagccga

SEQ ID NO: 3180225 - RNA, 23 nt, Mycobacterium bovis subsp bovis AF2122/97
caccagcgcaucggccagcagcg

SEQ ID NO: 3180226 - RNA, 16 nt, Mycobacterium bovis subsp bovis AF2122/97
caccagcgcccggccc

SEQ ID NO: 3180227 - RNA, 18 nt, Mycobacterium bovis subsp bovis AF2122/97
caccagcgccuugacgcc

SEQ ID NO: 3180228 - RNA, 15 nt, Mycobacterium bovis subsp bovis AF2122/97
caccagcgcgagccc

SEQ ID NO: 3180229 - RNA, 17 nt, Mycobacterium bovis subsp bovis AF2122/97
caccagcgcgagcccga

SEQ ID NO: 3180230 - RNA, 21 nt, Mycobacterium bovis subsp bovis AF2122/97
caccagcgcgagcccgaacca

SEQ ID NO: 3180231 - RNA, 13 nt, Mycobacterium bovis subsp bovis AF2122/97
caccagcgcgccg

SEQ ID NO: 3180232 - RNA, 15 nt, Mycobacterium bovis subsp bovis AF2122/97
caccagcgcuccagc

SEQ ID NO: 3180233 - RNA, 16 nt, Mycobacterium bovis subsp bovis AF2122/97
caccagcgcuccagca

SEQ ID NO: 3180234 - RNA, 18 nt, Mycobacterium bovis subsp bovis AF2122/97
caccagcgcuccagcacc

SEQ ID NO: 3180235 - RNA, 21 nt, Mycobacterium bovis subsp bovis AF2122/97
caccagcgcuccagcacccgc

SEQ ID NO: 3180236 - RNA, 16 nt, Mycobacterium bovis subsp bovis AF2122/97
caccagcggcaccgcg

SEQ ID NO: 3180237 - RNA, 18 nt, Mycobacterium bovis subsp bovis AF2122/97
caccagcggcaccgcggc

SEQ ID NO: 3180238 - RNA, 19 nt, Mycobacterium bovis subsp bovis AF2122/97
caccagcggcaccgcggcc

SEQ ID NO: 3180239 - RNA, 22 nt, Mycobacterium bovis subsp bovis AF2122/97
caccagcggcaccgcggccagc

SEQ ID NO: 3180240 - RNA, 23 nt, Mycobacterium bovis subsp bovis AF2122/97
caccagcggcauauggauguugg

SEQ ID NO: 3180241 - RNA, 13 nt, Mycobacterium bovis subsp bovis AF2122/97
caccagcggcggc

SEQ ID NO: 3180242 - RNA, 14 nt, Mycobacterium bovis subsp bovis AF2122/97
caccagcggcggca

SEQ ID NO: 3180243 - RNA, 17 nt, Mycobacterium bovis subsp bovis AF2122/97
caccagcggcggcaacg

SEQ ID NO: 3180244 - RNA, 16 nt, Mycobacterium bovis subsp bovis AF2122/97
caccagcggcggcccu

SEQ ID NO: 3180245 - RNA, 20 nt, Mycobacterium bovis subsp bovis AF2122/97
caccagcggcugaccgggca

SEQ ID NO: 3180246 - RNA, 15 nt, Mycobacterium bovis subsp bovis AF2122/97
caccagcgggcaucg

SEQ ID NO: 3180247 - RNA, 13 nt, Mycobacterium bovis subsp bovis AF2122/97
caccagcgggucg

SEQ ID NO: 3180248 - RNA, 20 nt, Mycobacterium bovis subsp bovis AF2122/97
caccagcggucagccggcca

SEQ ID NO: 3180249 - RNA, 14 nt, Mycobacterium bovis subsp bovis AF2122/97
caccagcgucgcgg

SEQ ID NO: 3180250 - RNA, 18 nt, Mycobacterium bovis subsp bovis AF2122/97
caccagcgucgcggccac

SEQ ID NO: 3180251 - RNA, 22 nt, Mycobacterium bovis subsp bovis AF2122/97
caccagcgucgcggccacgguc

SEQ ID NO: 3180252 - RNA, 23 nt, Mycobacterium bovis subsp bovis AF2122/97
caccagcgucgcggccacgguca

SEQ ID NO: 3180253 - RNA, 15 nt, Mycobacterium bovis subsp bovis AF2122/97
caccagcguguagcg

SEQ ID NO: 3180254 - RNA, 16 nt, Mycobacterium bovis subsp bovis AF2122/97
caccagcucacccgga

SEQ ID NO: 3180255 - RNA, 21 nt, Mycobacterium bovis subsp bovis AF2122/97
caccagcucacccggagcacc

SEQ ID NO: 3180256 - RNA, 15 nt, Mycobacterium bovis subsp bovis AF2122/97
caccagcucgagguc

SEQ ID NO: 3180257 - RNA, 15 nt, Mycobacterium bovis subsp bovis AF2122/97
caccagcugcgcgau

SEQ ID NO: 3180258 - RNA, 17 nt, Mycobacterium bovis subsp bovis AF2122/97
caccagcugcgcgaugu

SEQ ID NO: 3180259 - RNA, 16 nt, Mycobacterium bovis subsp bovis AF2122/97
caccagcugcucgucg

SEQ ID NO: 3180260 - RNA, 13 nt, Mycobacterium bovis subsp bovis AF2122/97
caccagcuggaag

SEQ ID NO: 3180261 - RNA, 16 nt, Mycobacterium bovis subsp bovis AF2122/97
caccaggacguggucg

SEQ ID NO: 3180262 - RNA, 13 nt, Mycobacterium bovis subsp bovis AF2122/97
caccaggagcgga

SEQ ID NO: 3180263 - RNA, 20 nt, Mycobacterium bovis subsp bovis AF2122/97
caccaggaugccuaccgugc

SEQ ID NO: 3180264 - RNA, 15 nt, Mycobacterium bovis subsp bovis AF2122/97
caccaggcccgguuc

SEQ ID NO: 3180265 - RNA, 17 nt, Mycobacterium bovis subsp bovis AF2122/97
caccaggccgagccgcc

SEQ ID NO: 3180266 - RNA, 22 nt, Mycobacterium bovis subsp bovis AF2122/97
caccaggccgagccgcccgccc

SEQ ID NO: 3180267 - RNA, 21 nt, Mycobacterium bovis subsp bovis AF2122/97
caccaggcgagccggcgcgca

SEQ ID NO: 3180268 - RNA, 13 nt, Mycobacterium bovis subsp bovis AF2122/97
caccaggcggccg

SEQ ID NO: 3180269 - RNA, 23 nt, Mycobacterium bovis subsp bovis AF2122/97
caccaggcggccguaacggcgaa

SEQ ID NO: 3180270 - RNA, 13 nt, Mycobacterium bovis subsp bovis AF2122/97
caccaggcugcag

SEQ ID NO: 3180271 - RNA, 19 nt, Mycobacterium bovis subsp bovis AF2122/97
caccagggcacguucggcg

SEQ ID NO: 3180272 - RNA, 16 nt, Mycobacterium bovis subsp bovis AF2122/97
caccagggccaccgcg

SEQ ID NO: 3180273 - RNA, 19 nt, Mycobacterium bovis subsp bovis AF2122/97
caccagggccuccacccgc

SEQ ID NO: 3180274 - RNA, 22 nt, Mycobacterium bovis subsp bovis AF2122/97
caccagggccuccacccgccac

SEQ ID NO: 3180275 - RNA, 22 nt, Mycobacterium bovis subsp bovis AF2122/97
caccagggcgcggaucugcagc

SEQ ID NO: 3180276 - RNA, 22 nt, Mycobacterium bovis subsp bovis AF2122/97
caccaggggcgcgucauggcga

SEQ ID NO: 3180277 - RNA, 19 nt, Mycobacterium bovis subsp bovis AF2122/97
caccaggguggcccgggga

SEQ ID NO: 3180278 - RNA, 16 nt, Mycobacterium bovis subsp bovis AF2122/97
caccaggucauugccg

SEQ ID NO: 3180279 - RNA, 19 nt, Mycobacterium bovis subsp bovis AF2122/97
caccaggucauugccggcg

SEQ ID NO: 3180280 - RNA, 18 nt, Mycobacterium bovis subsp bovis AF2122/97
cacccacugcacggagcc

SEQ ID NO: 3180281 - RNA, 23 nt, Mycobacterium bovis subsp bovis AF2122/97
cacccacuuucgacccgcggcgg

SEQ ID NO: 3180282 - RNA, 21 nt, Mycobacterium bovis subsp bovis AF2122/97
cacccacuuuucgguggcggc

SEQ ID NO: 3180283 - RNA, 22 nt, Mycobacterium bovis subsp bovis AF2122/97
cacccagaaugacaucgucgcc

SEQ ID NO: 3180284 - RNA, 14 nt, Mycobacterium bovis subsp bovis AF2122/97
cacccagaccgccg

SEQ ID NO: 3180285 - RNA, 18 nt, Mycobacterium bovis subsp bovis AF2122/97
cacccagaccgccgaaga

SEQ ID NO: 3180286 - RNA, 14 nt, Mycobacterium bovis subsp bovis AF2122/97
cacccagaugcagg

SEQ ID NO: 3180287 - RNA, 15 nt, Mycobacterium bovis subsp bovis AF2122/97
cacccagaugcaggc

SEQ ID NO: 3180288 - RNA, 13 nt, Mycobacterium bovis subsp bovis AF2122/97
cacccagccgcag

SEQ ID NO: 3180289 - RNA, 14 nt, Mycobacterium bovis subsp bovis AF2122/97
cacccagccgcagc

SEQ ID NO: 3180290 - RNA, 17 nt, Mycobacterium bovis subsp bovis AF2122/97
cacccagcgacucggcc

SEQ ID NO: 3180291 - RNA, 16 nt, Mycobacterium bovis subsp bovis AF2122/97
cacccagcgccgaccc

SEQ ID NO: 3180292 - RNA, 13 nt, Mycobacterium bovis subsp bovis AF2122/97
cacccagcgcgcu

SEQ ID NO: 3180293 - RNA, 16 nt, Mycobacterium bovis subsp bovis AF2122/97
cacccagcggaaccga

SEQ ID NO: 3180294 - RNA, 17 nt, Mycobacterium bovis subsp bovis AF2122/97
cacccagcgugcccgcc

SEQ ID NO: 3180295 - RNA, 18 nt, Mycobacterium bovis subsp bovis AF2122/97
cacccagcgugcccgcca

SEQ ID NO: 3180296 - RNA, 21 nt, Mycobacterium bovis subsp bovis AF2122/97
cacccagcgugcccgccaccg

SEQ ID NO: 3180297 - RNA, 22 nt, Mycobacterium bovis subsp bovis AF2122/97
cacccagcgugcccgccaccgg

SEQ ID NO: 3180298 - RNA, 12 nt, Mycobacterium bovis subsp bovis AF2122/97
cacccagcucgc

SEQ ID NO: 3180299 - RNA, 22 nt, Mycobacterium bovis subsp bovis AF2122/97
cacccagcucgcgcacccagcc

SEQ ID NO: 3180300 - RNA, 19 nt, Mycobacterium bovis subsp bovis AF2122/97
cacccagcugggucccgcu

SEQ ID NO: 3180301 - RNA, 12 nt, Mycobacterium bovis subsp bovis AF2122/97
cacccaggccau

SEQ ID NO: 3180302 - RNA, 16 nt, Mycobacterium bovis subsp bovis AF2122/97
cacccaggcgccgaug

SEQ ID NO: 3180303 - RNA, 18 nt, Mycobacterium bovis subsp bovis AF2122/97
cacccagggcguuggcgg

SEQ ID NO: 3180304 - RNA, 22 nt, Mycobacterium bovis subsp bovis AF2122/97
cacccaggugucgcugcugaac

SEQ ID NO: 3180305 - RNA, 15 nt, Mycobacterium bovis subsp bovis AF2122/97
cacccagucggcgcc

SEQ ID NO: 3180306 - RNA, 16 nt, Mycobacterium bovis subsp bovis AF2122/97
cacccagucggcgccg

SEQ ID NO: 3180307 - RNA, 15 nt, Mycobacterium bovis subsp bovis AF2122/97
cacccagugccacgc

SEQ ID NO: 3180308 - RNA, 18 nt, Mycobacterium bovis subsp bovis AF2122/97
cacccaguuccacccggu

SEQ ID NO: 3180309 - RNA, 21 nt, Mycobacterium bovis subsp bovis AF2122/97
cacccauagacccggcugagc

SEQ ID NO: 3180310 - RNA, 15 nt, Mycobacterium bovis subsp bovis AF2122/97
cacccaucaacgccg

SEQ ID NO: 3180311 - RNA, 20 nt, Mycobacterium bovis subsp bovis AF2122/97
cacccaucaacgccggcgac

SEQ ID NO: 3180312 - RNA, 15 nt, Mycobacterium bovis subsp bovis AF2122/97
cacccaucaccgcca

SEQ ID NO: 3180313 - RNA, 17 nt, Mycobacterium bovis subsp bovis AF2122/97
cacccaucaccgccagc

SEQ ID NO: 3180314 - RNA, 18 nt, Mycobacterium bovis subsp bovis AF2122/97
cacccaucaccgccagcc

SEQ ID NO: 3180315 - RNA, 17 nt, Mycobacterium bovis subsp bovis AF2122/97
cacccauccucgcggug

SEQ ID NO: 3180316 - RNA, 15 nt, Mycobacterium bovis subsp bovis AF2122/97
cacccaucgaccgcc

SEQ ID NO: 3180317 - RNA, 18 nt, Mycobacterium bovis subsp bovis AF2122/97
cacccaucgaccgcccgc

SEQ ID NO: 3180318 - RNA, 20 nt, Mycobacterium bovis subsp bovis AF2122/97
cacccaucgaccgcccgcca

SEQ ID NO: 3180319 - RNA, 22 nt, Mycobacterium bovis subsp bovis AF2122/97
cacccaucgaccgcccgccagc

SEQ ID NO: 3180320 - RNA, 18 nt, Mycobacterium bovis subsp bovis AF2122/97
cacccaucgugcugaagc

SEQ ID NO: 3180321 - RNA, 22 nt, Mycobacterium bovis subsp bovis AF2122/97
cacccaucguuucgaagugccg

SEQ ID NO: 3180322 - RNA, 12 nt, Mycobacterium bovis subsp bovis AF2122/97
cacccaucucga

SEQ ID NO: 3180323 - RNA, 22 nt, Mycobacterium bovis subsp bovis AF2122/97
cacccauggccucccacucacc

SEQ ID NO: 3180324 - RNA, 17 nt, Mycobacterium bovis subsp bovis AF2122/97
caccccaacagggcggc

SEQ ID NO: 3180325 - RNA, 14 nt, Mycobacterium bovis subsp bovis AF2122/97
caccccacacaguc

SEQ ID NO: 3180326 - RNA, 19 nt, Mycobacterium bovis subsp bovis AF2122/97
caccccacagucgugagcc

SEQ ID NO: 3180327 - RNA, 15 nt, Mycobacterium bovis subsp bovis AF2122/97
caccccagcggccac

SEQ ID NO: 3180328 - RNA, 18 nt, Mycobacterium bovis subsp bovis AF2122/97
caccccagcggccaccga

SEQ ID NO: 3180329 - RNA, 13 nt, Mycobacterium bovis subsp bovis AF2122/97
caccccaggcacc

SEQ ID NO: 3180330 - RNA, 13 nt, Mycobacterium bovis subsp bovis AF2122/97
caccccauggcca

SEQ ID NO: 3180331 - RNA, 17 nt, Mycobacterium bovis subsp bovis AF2122/97
caccccauggccaccga

SEQ ID NO: 3180332 - RNA, 15 nt, Mycobacterium bovis subsp bovis AF2122/97
cacccccaaccgccg

SEQ ID NO: 3180333 - RNA, 17 nt, Mycobacterium bovis subsp bovis AF2122/97
caccccccagcgccgcc

SEQ ID NO: 3180334 - RNA, 20 nt, Mycobacterium bovis subsp bovis AF2122/97
caccccccagcgccgccgcg

SEQ ID NO: 3180335 - RNA, 16 nt, Mycobacterium bovis subsp bovis AF2122/97
cacccccccccccacc

SEQ ID NO: 3180336 - RNA, 16 nt, Mycobacterium bovis subsp bovis AF2122/97
caccccccguccaccg

SEQ ID NO: 3180337 - RNA, 13 nt, Mycobacterium bovis subsp bovis AF2122/97
cacccccggccag

SEQ ID NO: 3180338 - RNA, 13 nt, Mycobacterium bovis subsp bovis AF2122/97
cacccccuggacu

SEQ ID NO: 3180339 - RNA, 22 nt, Mycobacterium bovis subsp bovis AF2122/97
caccccgaagcucaucaccggc

SEQ ID NO: 3180340 - RNA, 17 nt, Mycobacterium bovis subsp bovis AF2122/97
caccccgagccgcagcu

SEQ ID NO: 3180341 - RNA, 16 nt, Mycobacterium bovis subsp bovis AF2122/97
caccccgauccgccac

SEQ ID NO: 3180342 - RNA, 18 nt, Mycobacterium bovis subsp bovis AF2122/97
caccccgaugccgugccg

SEQ ID NO: 3180343 - RNA, 21 nt, Mycobacterium bovis subsp bovis AF2122/97
caccccgauucgugucggugc

SEQ ID NO: 3180344 - RNA, 14 nt, Mycobacterium bovis subsp bovis AF2122/97
caccccgccaugcg

SEQ ID NO: 3180345 - RNA, 18 nt, Mycobacterium bovis subsp bovis AF2122/97
caccccgccaugcggcgc

SEQ ID NO: 3180346 - RNA, 14 nt, Mycobacterium bovis subsp bovis AF2122/97
caccccgcccgacg

SEQ ID NO: 3180347 - RNA, 16 nt, Mycobacterium bovis subsp bovis AF2122/97
caccccgcccgacgug

SEQ ID NO: 3180348 - RNA, 14 nt, Mycobacterium bovis subsp bovis AF2122/97
caccccgcgcgcca

SEQ ID NO: 3180349 - RNA, 18 nt, Mycobacterium bovis subsp bovis AF2122/97
caccccgcuugcgcggcu

SEQ ID NO: 3180350 - RNA, 20 nt, Mycobacterium bovis subsp bovis AF2122/97
caccccggaauccccaagcc

SEQ ID NO: 3180351 - RNA, 13 nt, Mycobacterium bovis subsp bovis AF2122/97
caccccggccacu

SEQ ID NO: 3180352 - RNA, 20 nt, Mycobacterium bovis subsp bovis AF2122/97
caccccggccuugccaccgg

SEQ ID NO: 3180353 - RNA, 22 nt, Mycobacterium bovis subsp bovis AF2122/97
caccccggcggccaucccgcgu

SEQ ID NO: 3180354 - RNA, 16 nt, Mycobacterium bovis subsp bovis AF2122/97
caccccggcggcgucc

SEQ ID NO: 3180355 - RNA, 18 nt, Mycobacterium bovis subsp bovis AF2122/97
caccccggcucggccacc

SEQ ID NO: 3180356 - RNA, 20 nt, Mycobacterium bovis subsp bovis AF2122/97
caccccggcucggccaccga

SEQ ID NO: 3180357 - RNA, 12 nt, Mycobacterium bovis subsp bovis AF2122/97
caccccgggcgc

SEQ ID NO: 3180358 - RNA, 16 nt, Mycobacterium bovis subsp bovis AF2122/97
caccccgggcgccgau

SEQ ID NO: 3180359 - RNA, 19 nt, Mycobacterium bovis subsp bovis AF2122/97
caccccggucccgccgacc

SEQ ID NO: 3180360 - RNA, 18 nt, Mycobacterium bovis subsp bovis AF2122/97
caccccggucggagcggu

SEQ ID NO: 3180361 - RNA, 21 nt, Mycobacterium bovis subsp bovis AF2122/97
caccccggucggagcggugcc

SEQ ID NO: 3180362 - RNA, 17 nt, Mycobacterium bovis subsp bovis AF2122/97
caccccggucggcccgc

SEQ ID NO: 3180363 - RNA, 17 nt, Mycobacterium bovis subsp bovis AF2122/97
caccccggugcccgcgg

SEQ ID NO: 3180364 - RNA, 22 nt, Mycobacterium bovis subsp bovis AF2122/97
caccccgucggggucguugagg

SEQ ID NO: 3180365 - RNA, 24 nt, Mycobacterium bovis subsp bovis AF2122/97
caccccuggguugaggaucccggc

SEQ ID NO: 3180366 - RNA, 15 nt, Mycobacterium bovis subsp bovis AF2122/97
caccccuucgccagc

SEQ ID NO: 3180367 - RNA, 14 nt, Mycobacterium bovis subsp bovis AF2122/97
cacccggccguugg

SEQ ID NO: 3180368 - RNA, 21 nt, Mycobacterium bovis subsp bovis AF2122/97
cacccggccucaacacccggc

SEQ ID NO: 3180369 - RNA, 20 nt, Mycobacterium bovis subsp bovis AF2122/97
cacccggcgauuggaccgcc

SEQ ID NO: 3180370 - RNA, 13 nt, Mycobacterium bovis subsp bovis AF2122/97
cacccggcgcgaa

SEQ ID NO: 3180371 - RNA, 15 nt, Mycobacterium bovis subsp bovis AF2122/97
cacccggcgggcggu

SEQ ID NO: 3180372 - RNA, 22 nt, Mycobacterium bovis subsp bovis AF2122/97
cacccggcgggcggugggcagc

SEQ ID NO: 3180373 - RNA, 19 nt, Mycobacterium bovis subsp bovis AF2122/97
cacccggcugaaacguccu

SEQ ID NO: 3180374 - RNA, 20 nt, Mycobacterium bovis subsp bovis AF2122/97
cacccgggacgaaccggccg

SEQ ID NO: 3180375 - RNA, 21 nt, Mycobacterium bovis subsp bovis AF2122/97
cacccgggacgaaccggccga

SEQ ID NO: 3180376 - RNA, 16 nt, Mycobacterium bovis subsp bovis AF2122/97
cacccgggcagccugc

SEQ ID NO: 3180377 - RNA, 20 nt, Mycobacterium bovis subsp bovis AF2122/97
cacccgggccaccccgagcu

SEQ ID NO: 3180378 - RNA, 17 nt, Mycobacterium bovis subsp bovis AF2122/97
cacccgggccacgucga

SEQ ID NO: 3180379 - RNA, 12 nt, Mycobacterium bovis subsp bovis AF2122/97
cacccgggccgc

SEQ ID NO: 3180380 - RNA, 17 nt, Mycobacterium bovis subsp bovis AF2122/97
cacccgggccgccucga

SEQ ID NO: 3180381 - RNA, 22 nt, Mycobacterium bovis subsp bovis AF2122/97
cacccgggccucggcgccgucg

SEQ ID NO: 3180382 - RNA, 13 nt, Mycobacterium bovis subsp bovis AF2122/97
cacccgggcgugg

SEQ ID NO: 3180383 - RNA, 22 nt, Mycobacterium bovis subsp bovis AF2122/97
cacccgggcugcuugcgcccgg

SEQ ID NO: 3180384 - RNA, 19 nt, Mycobacterium bovis subsp bovis AF2122/97
cacccggggugcccggccg

SEQ ID NO: 3180385 - RNA, 22 nt, Mycobacterium bovis subsp bovis AF2122/97
cacccggggugcccggccgcca

SEQ ID NO: 3180386 - RNA, 19 nt, Mycobacterium bovis subsp bovis AF2122/97
cacccggguggcacgcacg

SEQ ID NO: 3180387 - RNA, 17 nt, Mycobacterium bovis subsp bovis AF2122/97
cacccgguagacgucgu

SEQ ID NO: 3180388 - RNA, 17 nt, Mycobacterium bovis subsp bovis AF2122/97
cacccggucaacgugaa

SEQ ID NO: 3180389 - RNA, 14 nt, Mycobacterium bovis subsp bovis AF2122/97
cacccgguccugcu

SEQ ID NO: 3180390 - RNA, 17 nt, Mycobacterium bovis subsp bovis AF2122/97
cacccggugccgcagca

SEQ ID NO: 3180391 - RNA, 17 nt, Mycobacterium bovis subsp bovis AF2122/97
cacccgguuggccccca

SEQ ID NO: 3180392 - RNA, 15 nt, Mycobacterium bovis subsp bovis AF2122/97
cacccgguugugcgc

SEQ ID NO: 3180393 - RNA, 21 nt, Mycobacterium bovis subsp bovis AF2122/97
cacccgguugugcgcgcgccc

SEQ ID NO: 3180394 - RNA, 15 nt, Mycobacterium bovis subsp bovis AF2122/97
cacccguaagcggau

SEQ ID NO: 3180395 - RNA, 21 nt, Mycobacterium bovis subsp bovis AF2122/97
cacccgucaugcccaccgccu

SEQ ID NO: 3180396 - RNA, 14 nt, Mycobacterium bovis subsp bovis AF2122/97
cacccguccggccg

SEQ ID NO: 3180397 - RNA, 15 nt, Mycobacterium bovis subsp bovis AF2122/97
cacccguccggccgg

SEQ ID NO: 3180398 - RNA, 18 nt, Mycobacterium bovis subsp bovis AF2122/97
cacccgugaguucgcaau

SEQ ID NO: 3180399 - RNA, 18 nt, Mycobacterium bovis subsp bovis AF2122/97
cacccguguucgccacac

SEQ ID NO: 3180400 - RNA, 21 nt, Mycobacterium bovis subsp bovis AF2122/97
cacccguucgugagcggccag

SEQ ID NO: 3180401 - RNA, 23 nt, Mycobacterium bovis subsp bovis AF2122/97
cacccguugagcauaugacgucg

SEQ ID NO: 3180402 - RNA, 16 nt, Mycobacterium bovis subsp bovis AF2122/97
cacccguugcgacacc

SEQ ID NO: 3180403 - RNA, 20 nt, Mycobacterium bovis subsp bovis AF2122/97
cacccguugcgacaccuccg

SEQ ID NO: 3180404 - RNA, 16 nt, Mycobacterium bovis subsp bovis AF2122/97
cacccuaaucguuccg

SEQ ID NO: 3180405 - RNA, 13 nt, Mycobacterium bovis subsp bovis AF2122/97
cacccuccgccgg

SEQ ID NO: 3180406 - RNA, 22 nt, Mycobacterium bovis subsp bovis AF2122/97
cacccucgcguagggccagcgc

SEQ ID NO: 3180407 - RNA, 12 nt, Mycobacterium bovis subsp bovis AF2122/97
cacccucgggca

SEQ ID NO: 3180408 - RNA, 19 nt, Mycobacterium bovis subsp bovis AF2122/97
cacccucggguccaaccac

SEQ ID NO: 3180409 - RNA, 23 nt, Mycobacterium bovis subsp bovis AF2122/97
cacccucgguguccucgaccguc

SEQ ID NO: 3180410 - RNA, 22 nt, Mycobacterium bovis subsp bovis AF2122/97
cacccugaugugaguccagccg

SEQ ID NO: 3180411 - RNA, 14 nt, Mycobacterium bovis subsp bovis AF2122/97
cacccugcgggccg

SEQ ID NO: 3180412 - RNA, 15 nt, Mycobacterium bovis subsp bovis AF2122/97
cacccugcgggccga

SEQ ID NO: 3180413 - RNA, 21 nt, Mycobacterium bovis subsp bovis AF2122/97
cacccugcucgaacgcugagg

SEQ ID NO: 3180414 - RNA, 13 nt, Mycobacterium bovis subsp bovis AF2122/97
cacccuggucgaa

SEQ ID NO: 3180415 - RNA, 16 nt, Mycobacterium bovis subsp bovis AF2122/97
cacccuggucgaaacg

SEQ ID NO: 3180416 - RNA, 17 nt, Mycobacterium bovis subsp bovis AF2122/97
cacccuguuugcccaac

SEQ ID NO: 3180417 - RNA, 20 nt, Mycobacterium bovis subsp bovis AF2122/97
cacccuuggcccggugcagc

SEQ ID NO: 3180418 - RNA, 20 nt, Mycobacterium bovis subsp bovis AF2122/97
caccgaaaaguccgccgccu

SEQ ID NO: 3180419 - RNA, 16 nt, Mycobacterium bovis subsp bovis AF2122/97
caccgaaacgccgacc

SEQ ID NO: 3180420 - RNA, 21 nt, Mycobacterium bovis subsp bovis AF2122/97
caccgaaagccucucuuccca

SEQ ID NO: 3180421 - RNA, 14 nt, Mycobacterium bovis subsp bovis AF2122/97
caccgaaauaccca

SEQ ID NO: 3180422 - RNA, 21 nt, Mycobacterium bovis subsp bovis AF2122/97
caccgaaauacccagcgcagc

SEQ ID NO: 3180423 - RNA, 17 nt, Mycobacterium bovis subsp bovis AF2122/97
caccgaaauaggcuucg

SEQ ID NO: 3180424 - RNA, 22 nt, Mycobacterium bovis subsp bovis AF2122/97
caccgaaauugcccuagcagca

SEQ ID NO: 3180425 - RNA, 14 nt, Mycobacterium bovis subsp bovis AF2122/97
caccgaacacggcg

SEQ ID NO: 3180426 - RNA, 23 nt, Mycobacterium bovis subsp bovis AF2122/97
caccgaacagucgagugaagccg

SEQ ID NO: 3180427 - RNA, 16 nt, Mycobacterium bovis subsp bovis AF2122/97
caccgaacagucgcag

SEQ ID NO: 3180428 - RNA, 17 nt, Mycobacterium bovis subsp bovis AF2122/97
caccgaacccgccaccg

SEQ ID NO: 3180429 - RNA, 19 nt, Mycobacterium bovis subsp bovis AF2122/97
caccgaacccgccaccgcg

SEQ ID NO: 3180430 - RNA, 22 nt, Mycobacterium bovis subsp bovis AF2122/97
caccgaacccgccaccgcgaca

SEQ ID NO: 3180431 - RNA, 13 nt, Mycobacterium bovis subsp bovis AF2122/97
caccgaaccgccg

SEQ ID NO: 3180432 - RNA, 14 nt, Mycobacterium bovis subsp bovis AF2122/97
caccgaaccgccgc

SEQ ID NO: 3180433 - RNA, 15 nt, Mycobacterium bovis subsp bovis AF2122/97
caccgaaccgccgcu

SEQ ID NO: 3180434 - RNA, 20 nt, Mycobacterium bovis subsp bovis AF2122/97
caccgaaccgccgcugccgc

SEQ ID NO: 3180435 - RNA, 13 nt, Mycobacterium bovis subsp bovis AF2122/97
caccgaacgcacc

SEQ ID NO: 3180436 - RNA, 15 nt, Mycobacterium bovis subsp bovis AF2122/97
caccgaacgcaccga

SEQ ID NO: 3180437 - RNA, 13 nt, Mycobacterium bovis subsp bovis AF2122/97
caccgaacgcgau

SEQ ID NO: 3180438 - RNA, 14 nt, Mycobacterium bovis subsp bovis AF2122/97
caccgaacgcgaug

SEQ ID NO: 3180439 - RNA, 15 nt, Mycobacterium bovis subsp bovis AF2122/97
caccgaacgcgaugc

SEQ ID NO: 3180440 - RNA, 12 nt, Mycobacterium bovis subsp bovis AF2122/97
caccgaacgcgg

SEQ ID NO: 3180441 - RNA, 13 nt, Mycobacterium bovis subsp bovis AF2122/97
caccgaacgcggc

SEQ ID NO: 3180442 - RNA, 15 nt, Mycobacterium bovis subsp bovis AF2122/97
caccgaacgcggcca

SEQ ID NO: 3180443 - RNA, 16 nt, Mycobacterium bovis subsp bovis AF2122/97
caccgaacgcggccac

SEQ ID NO: 3180444 - RNA, 22 nt, Mycobacterium bovis subsp bovis AF2122/97
caccgaacgcggccaccgaccg

SEQ ID NO: 3180445 - RNA, 15 nt, Mycobacterium bovis subsp bovis AF2122/97
caccgaacggcgagg

SEQ ID NO: 3180446 - RNA, 17 nt, Mycobacterium bovis subsp bovis AF2122/97
caccgaagauggccagc

SEQ ID NO: 3180447 - RNA, 22 nt, Mycobacterium bovis subsp bovis AF2122/97
caccgaagauggccagcgcggc

SEQ ID NO: 3180448 - RNA, 14 nt, Mycobacterium bovis subsp bovis AF2122/97
caccgaagccgccg

SEQ ID NO: 3180449 - RNA, 15 nt, Mycobacterium bovis subsp bovis AF2122/97
caccgaagccgccgg

SEQ ID NO: 3180450 - RNA, 23 nt, Mycobacterium bovis subsp bovis AF2122/97
caccgaaggugcgcgugacgauc

SEQ ID NO: 3180451 - RNA, 15 nt, Mycobacterium bovis subsp bovis AF2122/97
caccgaauaccgccg

SEQ ID NO: 3180452 - RNA, 23 nt, Mycobacterium bovis subsp bovis AF2122/97
caccgaauaccgccgcgcagccg

SEQ ID NO: 3180453 - RNA, 21 nt, Mycobacterium bovis subsp bovis AF2122/97
caccgagucgaucacguggug

SEQ ID NO: 3180454 - RNA, 14 nt, Mycobacterium bovis subsp bovis AF2122/97
caccgagugcggug

SEQ ID NO: 3180455 - RNA, 17 nt, Mycobacterium bovis subsp bovis AF2122/97
caccgagugcggugugu

SEQ ID NO: 3180456 - RNA, 13 nt, Mycobacterium bovis subsp bovis AF2122/97
caccgaguuccuc

SEQ ID NO: 3180457 - RNA, 14 nt, Mycobacterium bovis subsp bovis AF2122/97
caccgaguuccucu

SEQ ID NO: 3180458 - RNA, 15 nt, Mycobacterium bovis subsp bovis AF2122/97
caccgauacccccgg

SEQ ID NO: 3180459 - RNA, 17 nt, Mycobacterium bovis subsp bovis AF2122/97
caccgauacccccggca

SEQ ID NO: 3180460 - RNA, 14 nt, Mycobacterium bovis subsp bovis AF2122/97
caccgauaccguca

SEQ ID NO: 3180461 - RNA, 20 nt, Mycobacterium bovis subsp bovis AF2122/97
caccgauaccgucagcgccg

SEQ ID NO: 3180462 - RNA, 22 nt, Mycobacterium bovis subsp bovis AF2122/97
caccgauaccgucagcgccgcu

SEQ ID NO: 3180463 - RNA, 18 nt, Mycobacterium bovis subsp bovis AF2122/97
caccgauauggccggguc

SEQ ID NO: 3180464 - RNA, 21 nt, Mycobacterium bovis subsp bovis AF2122/97
caccgauccacuguagggccg

SEQ ID NO: 3180465 - RNA, 15 nt, Mycobacterium bovis subsp bovis AF2122/97
caccgaucccgcggc

SEQ ID NO: 3180466 - RNA, 13 nt, Mycobacterium bovis subsp bovis AF2122/97
caccgauccugga

SEQ ID NO: 3180467 - RNA, 17 nt, Mycobacterium bovis subsp bovis AF2122/97
caccgaucgacugcagc

SEQ ID NO: 3180468 - RNA, 19 nt, Mycobacterium bovis subsp bovis AF2122/97
caccgaucgacugcagccc

SEQ ID NO: 3180469 - RNA, 12 nt, Mycobacterium bovis subsp bovis AF2122/97
caccgaucggca

SEQ ID NO: 3180470 - RNA, 17 nt, Mycobacterium bovis subsp bovis AF2122/97
caccgaucggugccggc

SEQ ID NO: 3180471 - RNA, 19 nt, Mycobacterium bovis subsp bovis AF2122/97
caccgaucucgaccagcgc

SEQ ID NO: 3180472 - RNA, 21 nt, Mycobacterium bovis subsp bovis AF2122/97
caccgaucucgaccagcgccg

SEQ ID NO: 3180473 - RNA, 15 nt, Mycobacterium bovis subsp bovis AF2122/97
caccgaugcacucca

SEQ ID NO: 3180474 - RNA, 15 nt, Mycobacterium bovis subsp bovis AF2122/97
caccgaugccacauc

SEQ ID NO: 3180475 - RNA, 20 nt, Mycobacterium bovis subsp bovis AF2122/97
caccgaugccgaagcccccg

SEQ ID NO: 3180476 - RNA, 15 nt, Mycobacterium bovis subsp bovis AF2122/97
caccgaugccuugac

SEQ ID NO: 3180477 - RNA, 23 nt, Mycobacterium bovis subsp bovis AF2122/97
caccgaugcgauaacccgcaucg

SEQ ID NO: 3180478 - RNA, 16 nt, Mycobacterium bovis subsp bovis AF2122/97
caccgauggcgcgcuc

SEQ ID NO: 3180479 - RNA, 22 nt, Mycobacterium bovis subsp bovis AF2122/97
caccgauggcgguggugccgcg

SEQ ID NO: 3180480 - RNA, 16 nt, Mycobacterium bovis subsp bovis AF2122/97
caccgauuccagcgga

SEQ ID NO: 3180481 - RNA, 13 nt, Mycobacterium bovis subsp bovis AF2122/97
caccgauucggcc

SEQ ID NO: 3180482 - RNA, 16 nt, Mycobacterium bovis subsp bovis AF2122/97
caccgauucggccagc

SEQ ID NO: 3180483 - RNA, 18 nt, Mycobacterium bovis subsp bovis AF2122/97
caccgauucggccagcgc

SEQ ID NO: 3180484 - RNA, 19 nt, Mycobacterium bovis subsp bovis AF2122/97
caccgcaaaguagacgugc

SEQ ID NO: 3180485 - RNA, 19 nt, Mycobacterium bovis subsp bovis AF2122/97
caccgcaaccaaagcgacg

SEQ ID NO: 3180486 - RNA, 23 nt, Mycobacterium bovis subsp bovis AF2122/97
caccgcaaccaaagcgacgagca

SEQ ID NO: 3180487 - RNA, 16 nt, Mycobacterium bovis subsp bovis AF2122/97
caccgcaacucgccga

SEQ ID NO: 3180488 - RNA, 15 nt, Mycobacterium bovis subsp bovis AF2122/97
caccgcaagaaucag

SEQ ID NO: 3180489 - RNA, 19 nt, Mycobacterium bovis subsp bovis AF2122/97
caccgcacaccugcgcggc

SEQ ID NO: 3180490 - RNA, 15 nt, Mycobacterium bovis subsp bovis AF2122/97
caccgcacgcuggcg

SEQ ID NO: 3180491 - RNA, 17 nt, Mycobacterium bovis subsp bovis AF2122/97
caccgcacgcuggcggg

SEQ ID NO: 3180492 - RNA, 22 nt, Mycobacterium bovis subsp bovis AF2122/97
caccgcacggaggcggaccagg

SEQ ID NO: 3180493 - RNA, 22 nt, Mycobacterium bovis subsp bovis AF2122/97
caccgcacggaugucgcccaac

SEQ ID NO: 3180494 - RNA, 16 nt, Mycobacterium bovis subsp bovis AF2122/97
caccgcacggugcuga

SEQ ID NO: 3180495 - RNA, 14 nt, Mycobacterium bovis subsp bovis AF2122/97
caccgcagacgccg

SEQ ID NO: 3180496 - RNA, 21 nt, Mycobacterium bovis subsp bovis AF2122/97
caccgcagauccccgccaccg

SEQ ID NO: 3180497 - RNA, 16 nt, Mycobacterium bovis subsp bovis AF2122/97
caccgcagccaacguc

SEQ ID NO: 3180498 - RNA, 14 nt, Mycobacterium bovis subsp bovis AF2122/97
caccgcagcgggcg

SEQ ID NO: 3180499 - RNA, 16 nt, Mycobacterium bovis subsp bovis AF2122/97
caccgcauaacgccag

SEQ ID NO: 3180500 - RNA, 19 nt, Mycobacterium bovis subsp bovis AF2122/97
caccgcauaacgccagucc

SEQ ID NO: 3180501 - RNA, 19 nt, Mycobacterium bovis subsp bovis AF2122/97
caccgcauaaggcccaugc

SEQ ID NO: 3180502 - RNA, 14 nt, Mycobacterium bovis subsp bovis AF2122/97
caccgcaucgccga

SEQ ID NO: 3180503 - RNA, 22 nt, Mycobacterium bovis subsp bovis AF2122/97
caccgcauucguggagccggcc

SEQ ID NO: 3180504 - RNA, 23 nt, Mycobacterium bovis subsp bovis AF2122/97
caccgcauucguggagccggccg

SEQ ID NO: 3180505 - RNA, 16 nt, Mycobacterium bovis subsp bovis AF2122/97
caccgccaccacccag

SEQ ID NO: 3180506 - RNA, 16 nt, Mycobacterium bovis subsp bovis AF2122/97
caccgccaccacgccg

SEQ ID NO: 3180507 - RNA, 19 nt, Mycobacterium bovis subsp bovis AF2122/97
caccgccaccacgccgucg

SEQ ID NO: 3180508 - RNA, 14 nt, Mycobacterium bovis subsp bovis AF2122/97
caccgccaccacgg

SEQ ID NO: 3180509 - RNA, 15 nt, Mycobacterium bovis subsp bovis AF2122/97
caccgccaccacggu

SEQ ID NO: 3180510 - RNA, 13 nt, Mycobacterium bovis subsp bovis AF2122/97
caccgccaccgcg

SEQ ID NO: 3180511 - RNA, 19 nt, Mycobacterium bovis subsp bovis AF2122/97
caccgccagcaugacaccg

SEQ ID NO: 3180512 - RNA, 22 nt, Mycobacterium bovis subsp bovis AF2122/97
caccgccagcaugacaccggcc

SEQ ID NO: 3180513 - RNA, 13 nt, Mycobacterium bovis subsp bovis AF2122/97
caccgccagccac

SEQ ID NO: 3180514 - RNA, 14 nt, Mycobacterium bovis subsp bovis AF2122/97
caccgccagccacc

SEQ ID NO: 3180515 - RNA, 18 nt, Mycobacterium bovis subsp bovis AF2122/97
caccgccagccaccacau

SEQ ID NO: 3180516 - RNA, 13 nt, Mycobacterium bovis subsp bovis AF2122/97
caccgccagcggc

SEQ ID NO: 3180517 - RNA, 21 nt, Mycobacterium bovis subsp bovis AF2122/97
caccgccagcgucgacacacc

SEQ ID NO: 3180518 - RNA, 19 nt, Mycobacterium bovis subsp bovis AF2122/97
caccgccagcucacggacg

SEQ ID NO: 3180519 - RNA, 19 nt, Mycobacterium bovis subsp bovis AF2122/97
caccgccagcugggcagcc

SEQ ID NO: 3180520 - RNA, 17 nt, Mycobacterium bovis subsp bovis AF2122/97
caccgccaugaacucga

SEQ ID NO: 3180521 - RNA, 15 nt, Mycobacterium bovis subsp bovis AF2122/97
caccgcccacagcaa

SEQ ID NO: 3180522 - RNA, 12 nt, Mycobacterium bovis subsp bovis AF2122/97
caccgccccgcc

SEQ ID NO: 3180523 - RNA, 15 nt, Mycobacterium bovis subsp bovis AF2122/97
caccgccccgccaac

SEQ ID NO: 3180524 - RNA, 19 nt, Mycobacterium bovis subsp bovis AF2122/97
caccgccccgccaaccacu

SEQ ID NO: 3180525 - RNA, 14 nt, Mycobacterium bovis subsp bovis AF2122/97
caccgccccgccgc

SEQ ID NO: 3180526 - RNA, 15 nt, Mycobacterium bovis subsp bovis AF2122/97
caccgccccgcgccc

SEQ ID NO: 3180527 - RNA, 18 nt, Mycobacterium bovis subsp bovis AF2122/97
caccgccccgcgcccaac

SEQ ID NO: 3180528 - RNA, 15 nt, Mycobacterium bovis subsp bovis AF2122/97
caccgccccggcggc

SEQ ID NO: 3180529 - RNA, 13 nt, Mycobacterium bovis subsp bovis AF2122/97
caccgcccgaccc

SEQ ID NO: 3180530 - RNA, 15 nt, Mycobacterium bovis subsp bovis AF2122/97
caccgcccgacccau

SEQ ID NO: 3180531 - RNA, 12 nt, Mycobacterium bovis subsp bovis AF2122/97
caccgcccgcaa

SEQ ID NO: 3180532 - RNA, 17 nt, Mycobacterium bovis subsp bovis AF2122/97
caccgcccgcaagucgg

SEQ ID NO: 3180533 - RNA, 21 nt, Mycobacterium bovis subsp bovis AF2122/97
caccgcccgcacuuggcugcg

SEQ ID NO: 3180534 - RNA, 14 nt, Mycobacterium bovis subsp bovis AF2122/97
caccgcccggcccg

SEQ ID NO: 3180535 - RNA, 16 nt, Mycobacterium bovis subsp bovis AF2122/97
caccgcccggcccggc

SEQ ID NO: 3180536 - RNA, 17 nt, Mycobacterium bovis subsp bovis AF2122/97
caccgcccuugccgccg

SEQ ID NO: 3180537 - RNA, 18 nt, Mycobacterium bovis subsp bovis AF2122/97
caccgcccuugccgccgg

SEQ ID NO: 3180538 - RNA, 19 nt, Mycobacterium bovis subsp bovis AF2122/97
caccgcccuugccgccggc

SEQ ID NO: 3180539 - RNA, 21 nt, Mycobacterium bovis subsp bovis AF2122/97
caccgcccuugccgccggccc

SEQ ID NO: 3180540 - RNA, 17 nt, Mycobacterium bovis subsp bovis AF2122/97
caccgccuuugccgccg

SEQ ID NO: 3180541 - RNA, 20 nt, Mycobacterium bovis subsp bovis AF2122/97
caccgccuuugccgccggca

SEQ ID NO: 3180542 - RNA, 23 nt, Mycobacterium bovis subsp bovis AF2122/97
caccgccuuugccgccggcaccg

SEQ ID NO: 3180543 - RNA, 13 nt, Mycobacterium bovis subsp bovis AF2122/97
caccgcgacaccc

SEQ ID NO: 3180544 - RNA, 19 nt, Mycobacterium bovis subsp bovis AF2122/97
caccgcgaccaucgcgacg

SEQ ID NO: 3180545 - RNA, 15 nt, Mycobacterium bovis subsp bovis AF2122/97
caccgcgaccgcgca

SEQ ID NO: 3180546 - RNA, 21 nt, Mycobacterium bovis subsp bovis AF2122/97
caccgcgaccgcgcacggcug

SEQ ID NO: 3180547 - RNA, 20 nt, Mycobacterium bovis subsp bovis AF2122/97
caccgcgaccucgcggcgcu

SEQ ID NO: 3180548 - RNA, 23 nt, Mycobacterium bovis subsp bovis AF2122/97
caccgcgaccucgcggcgcuggu

SEQ ID NO: 3180549 - RNA, 15 nt, Mycobacterium bovis subsp bovis AF2122/97
caccgcgacgacgag

SEQ ID NO: 3180550 - RNA, 23 nt, Mycobacterium bovis subsp bovis AF2122/97
caccgcgacgacgaggucgguca

SEQ ID NO: 3180551 - RNA, 19 nt, Mycobacterium bovis subsp bovis AF2122/97
caccgcgacgagcggccgu

SEQ ID NO: 3180552 - RNA, 15 nt, Mycobacterium bovis subsp bovis AF2122/97
caccgcgaucaccac

SEQ ID NO: 3180553 - RNA, 18 nt, Mycobacterium bovis subsp bovis AF2122/97
caccgcgaucaccaccgg

SEQ ID NO: 3180554 - RNA, 19 nt, Mycobacterium bovis subsp bovis AF2122/97
caccgcgauuagcaaaccg

SEQ ID NO: 3180555 - RNA, 14 nt, Mycobacterium bovis subsp bovis AF2122/97
caccgcgcagcgaa

SEQ ID NO: 3180556 - RNA, 13 nt, Mycobacterium bovis subsp bovis AF2122/97
caccgcgcaggug

SEQ ID NO: 3180557 - RNA, 16 nt, Mycobacterium bovis subsp bovis AF2122/97
caccgcgcaucaucgc

SEQ ID NO: 3180558 - RNA, 21 nt, Mycobacterium bovis subsp bovis AF2122/97
caccgcgcaucaucgcccacc

SEQ ID NO: 3180559 - RNA, 13 nt, Mycobacterium bovis subsp bovis AF2122/97
caccgcgccagcc

SEQ ID NO: 3180560 - RNA, 20 nt, Mycobacterium bovis subsp bovis AF2122/97
caccgcgccagccuccacca

SEQ ID NO: 3180561 - RNA, 18 nt, Mycobacterium bovis subsp bovis AF2122/97
caccgcgcccaccagcgg

SEQ ID NO: 3180562 - RNA, 14 nt, Mycobacterium bovis subsp bovis AF2122/97
caccgcgcccgccg

SEQ ID NO: 3180563 - RNA, 15 nt, Mycobacterium bovis subsp bovis AF2122/97
caccgcgcccgccga

SEQ ID NO: 3180564 - RNA, 18 nt, Mycobacterium bovis subsp bovis AF2122/97
caccgcgcccgccgaucc

SEQ ID NO: 3180565 - RNA, 11 nt, Mycobacterium bovis subsp bovis AF2122/97
caccgcgccga

SEQ ID NO: 3180566 - RNA, 13 nt, Mycobacterium bovis subsp bovis AF2122/97
caccgcgccgaac

SEQ ID NO: 3180567 - RNA, 13 nt, Mycobacterium bovis subsp bovis AF2122/97
caccgcgccgacg

SEQ ID NO: 3180568 - RNA, 15 nt, Mycobacterium bovis subsp bovis AF2122/97
caccgcgccgacgaa

SEQ ID NO: 3180569 - RNA, 12 nt, Mycobacterium bovis subsp bovis AF2122/97
caccgcgccgag

SEQ ID NO: 3180570 - RNA, 13 nt, Mycobacterium bovis subsp bovis AF2122/97
caccgcgccgagc

SEQ ID NO: 3180571 - RNA, 15 nt, Mycobacterium bovis subsp bovis AF2122/97
caccgcgccgcgccg

SEQ ID NO: 3180572 - RNA, 19 nt, Mycobacterium bovis subsp bovis AF2122/97
caccgcgccgcgccgcgcc

SEQ ID NO: 3180573 - RNA, 18 nt, Mycobacterium bovis subsp bovis AF2122/97
caccgcgccgucgucgag

SEQ ID NO: 3180574 - RNA, 18 nt, Mycobacterium bovis subsp bovis AF2122/97
caccgcgccgucgucgcg

SEQ ID NO: 3180575 - RNA, 20 nt, Mycobacterium bovis subsp bovis AF2122/97
caccgcgccgucgucgcgca

SEQ ID NO: 3180576 - RNA, 16 nt, Mycobacterium bovis subsp bovis AF2122/97
caccgcgcgcuccaga

SEQ ID NO: 3180577 - RNA, 17 nt, Mycobacterium bovis subsp bovis AF2122/97
caccgcgcgcuccagau

SEQ ID NO: 3180578 - RNA, 16 nt, Mycobacterium bovis subsp bovis AF2122/97
caccgcgcgcucgccc

SEQ ID NO: 3180579 - RNA, 14 nt, Mycobacterium bovis subsp bovis AF2122/97
caccgcgcggcgca

SEQ ID NO: 3180580 - RNA, 18 nt, Mycobacterium bovis subsp bovis AF2122/97
caccgcgcggcgcagcac

SEQ ID NO: 3180581 - RNA, 20 nt, Mycobacterium bovis subsp bovis AF2122/97
caccgcgcggcgcagcaccg

SEQ ID NO: 3180582 - RNA, 17 nt, Mycobacterium bovis subsp bovis AF2122/97
caccgcgcuggucagcc

SEQ ID NO: 3180583 - RNA, 23 nt, Mycobacterium bovis subsp bovis AF2122/97
caccgcgcuggucagccgugccg

SEQ ID NO: 3180584 - RNA, 22 nt, Mycobacterium bovis subsp bovis AF2122/97
caccgcggacccgcagcugcgg

SEQ ID NO: 3180585 - RNA, 20 nt, Mycobacterium bovis subsp bovis AF2122/97
caccgcggagauaccggacc

SEQ ID NO: 3180586 - RNA, 11 nt, Mycobacterium bovis subsp bovis AF2122/97
caccgcggcaa

SEQ ID NO: 3180587 - RNA, 13 nt, Mycobacterium bovis subsp bovis AF2122/97
caccgcggcaaga

SEQ ID NO: 3180588 - RNA, 12 nt, Mycobacterium bovis subsp bovis AF2122/97
caccgcggccag

SEQ ID NO: 3180589 - RNA, 14 nt, Mycobacterium bovis subsp bovis AF2122/97
caccgcggccagcg

SEQ ID NO: 3180590 - RNA, 15 nt, Mycobacterium bovis subsp bovis AF2122/97
caccgcggccagcgg

SEQ ID NO: 3180591 - RNA, 16 nt, Mycobacterium bovis subsp bovis AF2122/97
caccgcggccgaggga

SEQ ID NO: 3180592 - RNA, 12 nt, Mycobacterium bovis subsp bovis AF2122/97
caccgcggccgc

SEQ ID NO: 3180593 - RNA, 13 nt, Mycobacterium bovis subsp bovis AF2122/97
caccgcggccgcg

SEQ ID NO: 3180594 - RNA, 14 nt, Mycobacterium bovis subsp bovis AF2122/97
caccgcggccgcgg

SEQ ID NO: 3180595 - RNA, 22 nt, Mycobacterium bovis subsp bovis AF2122/97
caccgcggcgauuacggccagu

SEQ ID NO: 3180596 - RNA, 22 nt, Mycobacterium bovis subsp bovis AF2122/97
caccgcggcgcugaugccgucu

SEQ ID NO: 3180597 - RNA, 15 nt, Mycobacterium bovis subsp bovis AF2122/97
caccgcggcggcgcg

SEQ ID NO: 3180598 - RNA, 21 nt, Mycobacterium bovis subsp bovis AF2122/97
caccgcggcggcgcguggugc

SEQ ID NO: 3180599 - RNA, 21 nt, Mycobacterium bovis subsp bovis AF2122/97
caccgcggcugcuccgucgcc

SEQ ID NO: 3180600 - RNA, 15 nt, Mycobacterium bovis subsp bovis AF2122/97
caccgcgggaucggu

SEQ ID NO: 3180601 - RNA, 12 nt, Mycobacterium bovis subsp bovis AF2122/97
caccgcgggcag

SEQ ID NO: 3180602 - RNA, 13 nt, Mycobacterium bovis subsp bovis AF2122/97
caccgcgggcaua

SEQ ID NO: 3180603 - RNA, 13 nt, Mycobacterium bovis subsp bovis AF2122/97
caccgcgggcggc

SEQ ID NO: 3180604 - RNA, 17 nt, Mycobacterium bovis subsp bovis AF2122/97
caccgcgguacgccggu

SEQ ID NO: 3180605 - RNA, 17 nt, Mycobacterium bovis subsp bovis AF2122/97
caccgcggucaccgacg

SEQ ID NO: 3180606 - RNA, 19 nt, Mycobacterium bovis subsp bovis AF2122/97
caccgcggucagcucggca

SEQ ID NO: 3180607 - RNA, 17 nt, Mycobacterium bovis subsp bovis AF2122/97
caccgcgguggcggcga

SEQ ID NO: 3180608 - RNA, 19 nt, Mycobacterium bovis subsp bovis AF2122/97
caccgcgguggcggcgagc

SEQ ID NO: 3180609 - RNA, 20 nt, Mycobacterium bovis subsp bovis AF2122/97
caccgcgguggcggcgagca

SEQ ID NO: 3180610 - RNA, 12 nt, Mycobacterium bovis subsp bovis AF2122/97
caccgcggugug

SEQ ID NO: 3180611 - RNA, 19 nt, Mycobacterium bovis subsp bovis AF2122/97
caccgcgucaacgcuguug

SEQ ID NO: 3180612 - RNA, 15 nt, Mycobacterium bovis subsp bovis AF2122/97
caccgcgucaccgga

SEQ ID NO: 3180613 - RNA, 17 nt, Mycobacterium bovis subsp bovis AF2122/97
caccgcgucgggccgca

SEQ ID NO: 3180614 - RNA, 19 nt, Mycobacterium bovis subsp bovis AF2122/97
caccgcguguaccgcgacg

SEQ ID NO: 3180615 - RNA, 21 nt, Mycobacterium bovis subsp bovis AF2122/97
caccgcguugaugaccgccgc

SEQ ID NO: 3180616 - RNA, 23 nt, Mycobacterium bovis subsp bovis AF2122/97
caccgcguugaugaccgccgccg

SEQ ID NO: 3180617 - RNA, 14 nt, Mycobacterium bovis subsp bovis AF2122/97
caccgcguuucgcg

SEQ ID NO: 3180618 - RNA, 22 nt, Mycobacterium bovis subsp bovis AF2122/97
caccgcguuucgcgacgucugc

SEQ ID NO: 3180619 - RNA, 22 nt, Mycobacterium bovis subsp bovis AF2122/97
caccgcuacgaccaauagcacg

SEQ ID NO: 3180620 - RNA, 14 nt, Mycobacterium bovis subsp bovis AF2122/97
caccgcucggucca

SEQ ID NO: 3180621 - RNA, 18 nt, Mycobacterium bovis subsp bovis AF2122/97
caccgcucgguccagccg

SEQ ID NO: 3180622 - RNA, 18 nt, Mycobacterium bovis subsp bovis AF2122/97
caccgcucgucguccggc

SEQ ID NO: 3180623 - RNA, 21 nt, Mycobacterium bovis subsp bovis AF2122/97
caccgcucgucguccggccac

SEQ ID NO: 3180624 - RNA, 22 nt, Mycobacterium bovis subsp bovis AF2122/97
caccgcucgucguccggccacg

SEQ ID NO: 3180625 - RNA, 19 nt, Mycobacterium bovis subsp bovis AF2122/97
caccgcugaccccggcagc

SEQ ID NO: 3180626 - RNA, 23 nt, Mycobacterium bovis subsp bovis AF2122/97
caccgcugaccccggcagcgccc

SEQ ID NO: 3180627 - RNA, 14 nt, Mycobacterium bovis subsp bovis AF2122/97
caccggcgaucacc

SEQ ID NO: 3180628 - RNA, 15 nt, Mycobacterium bovis subsp bovis AF2122/97
caccggcgaucaccg

SEQ ID NO: 3180629 - RNA, 19 nt, Mycobacterium bovis subsp bovis AF2122/97
caccggcgaucguguccac

SEQ ID NO: 3180630 - RNA, 13 nt, Mycobacterium bovis subsp bovis AF2122/97
caccggcgcaccg

SEQ ID NO: 3180631 - RNA, 21 nt, Mycobacterium bovis subsp bovis AF2122/97
caccggcgcccucaugucggg

SEQ ID NO: 3180632 - RNA, 11 nt, Mycobacterium bovis subsp bovis AF2122/97
caccggcgccg

SEQ ID NO: 3180633 - RNA, 12 nt, Mycobacterium bovis subsp bovis AF2122/97
caccggcgccgc

SEQ ID NO: 3180634 - RNA, 14 nt, Mycobacterium bovis subsp bovis AF2122/97
caccggcgccgccc

SEQ ID NO: 3180635 - RNA, 15 nt, Mycobacterium bovis subsp bovis AF2122/97
caccggcgccgcccg

SEQ ID NO: 3180636 - RNA, 15 nt, Mycobacterium bovis subsp bovis AF2122/97
caccggcgccgccgu

SEQ ID NO: 3180637 - RNA, 17 nt, Mycobacterium bovis subsp bovis AF2122/97
caccggcgccgccgucg

SEQ ID NO: 3180638 - RNA, 20 nt, Mycobacterium bovis subsp bovis AF2122/97
caccggcgccgugucaccgg

SEQ ID NO: 3180639 - RNA, 11 nt, Mycobacterium bovis subsp bovis AF2122/97
caccggcgccu

SEQ ID NO: 3180640 - RNA, 20 nt, Mycobacterium bovis subsp bovis AF2122/97
caccggcgccuccggcaccu

SEQ ID NO: 3180641 - RNA, 13 nt, Mycobacterium bovis subsp bovis AF2122/97
caccggcgcgacc

SEQ ID NO: 3180642 - RNA, 18 nt, Mycobacterium bovis subsp bovis AF2122/97
caccggcgcgaccgcggc

SEQ ID NO: 3180643 - RNA, 19 nt, Mycobacterium bovis subsp bovis AF2122/97
caccggcgcgaccgcggcg

SEQ ID NO: 3180644 - RNA, 14 nt, Mycobacterium bovis subsp bovis AF2122/97
caccggcggcccca

SEQ ID NO: 3180645 - RNA, 14 nt, Mycobacterium bovis subsp bovis AF2122/97
caccggcggcgacg

SEQ ID NO: 3180646 - RNA, 22 nt, Mycobacterium bovis subsp bovis AF2122/97
caccggcggcgacggugccacc

SEQ ID NO: 3180647 - RNA, 17 nt, Mycobacterium bovis subsp bovis AF2122/97
caccggcggugccggug

SEQ ID NO: 3180648 - RNA, 12 nt, Mycobacterium bovis subsp bovis AF2122/97
caccggcgucga

SEQ ID NO: 3180649 - RNA, 13 nt, Mycobacterium bovis subsp bovis AF2122/97
caccggcgucgaa

SEQ ID NO: 3180650 - RNA, 14 nt, Mycobacterium bovis subsp bovis AF2122/97
caccggcgucgacg

SEQ ID NO: 3180651 - RNA, 17 nt, Mycobacterium bovis subsp bovis AF2122/97
caccggcgucgacgucg

SEQ ID NO: 3180652 - RNA, 12 nt, Mycobacterium bovis subsp bovis AF2122/97
caccggcgucgc

SEQ ID NO: 3180653 - RNA, 13 nt, Mycobacterium bovis subsp bovis AF2122/97
caccggcgucgcu

SEQ ID NO: 3180654 - RNA, 17 nt, Mycobacterium bovis subsp bovis AF2122/97
caccggcgucggcgcgg

SEQ ID NO: 3180655 - RNA, 19 nt, Mycobacterium bovis subsp bovis AF2122/97
caccggcgucggcgcggcc

SEQ ID NO: 3180656 - RNA, 20 nt, Mycobacterium bovis subsp bovis AF2122/97
caccggcgucggcgcggccg

SEQ ID NO: 3180657 - RNA, 21 nt, Mycobacterium bovis subsp bovis AF2122/97
caccggcgucguaggagccgu

SEQ ID NO: 3180658 - RNA, 14 nt, Mycobacterium bovis subsp bovis AF2122/97
caccggcgugcugu

SEQ ID NO: 3180659 - RNA, 21 nt, Mycobacterium bovis subsp bovis AF2122/97
caccggcguucaccugcgucg

SEQ ID NO: 3180660 - RNA, 18 nt, Mycobacterium bovis subsp bovis AF2122/97
caccggcuaugcuggcgc

SEQ ID NO: 3180661 - RNA, 16 nt, Mycobacterium bovis subsp bovis AF2122/97
caccggcucccggggg

SEQ ID NO: 3180662 - RNA, 13 nt, Mycobacterium bovis subsp bovis AF2122/97
caccggcucgacu

SEQ ID NO: 3180663 - RNA, 14 nt, Mycobacterium bovis subsp bovis AF2122/97
caccggcucgucga

SEQ ID NO: 3180664 - RNA, 16 nt, Mycobacterium bovis subsp bovis AF2122/97
caccggcucgucgaug

SEQ ID NO: 3180665 - RNA, 18 nt, Mycobacterium bovis subsp bovis AF2122/97
caccggcugaccgacccg

SEQ ID NO: 3180666 - RNA, 19 nt, Mycobacterium bovis subsp bovis AF2122/97
caccggcugaccgacccgg

SEQ ID NO: 3180667 - RNA, 12 nt, Mycobacterium bovis subsp bovis AF2122/97
caccggcugcaa

SEQ ID NO: 3180668 - RNA, 17 nt, Mycobacterium bovis subsp bovis AF2122/97
caccggcugcaaccagc

SEQ ID NO: 3180669 - RNA, 19 nt, Mycobacterium bovis subsp bovis AF2122/97
caccggcugcaaccagcgg

SEQ ID NO: 3180670 - RNA, 21 nt, Mycobacterium bovis subsp bovis AF2122/97
caccggcugcaaccagcggca

SEQ ID NO: 3180671 - RNA, 22 nt, Mycobacterium bovis subsp bovis AF2122/97
caccggcugcaaccagcggcac

SEQ ID NO: 3180672 - RNA, 17 nt, Mycobacterium bovis subsp bovis AF2122/97
caccggcuggugccaac

SEQ ID NO: 3180673 - RNA, 23 nt, Mycobacterium bovis subsp bovis AF2122/97
caccggcuggugccaacugcgcc

SEQ ID NO: 3180674 - RNA, 19 nt, Mycobacterium bovis subsp bovis AF2122/97
caccggcuucuccuccaga

SEQ ID NO: 3180675 - RNA, 20 nt, Mycobacterium bovis subsp bovis AF2122/97
caccggcuuggugaaccgcg

SEQ ID NO: 3180676 - RNA, 21 nt, Mycobacterium bovis subsp bovis AF2122/97
caccggcuuggugaaccgcgc

SEQ ID NO: 3180677 - RNA, 22 nt, Mycobacterium bovis subsp bovis AF2122/97
caccggcuuggugaaccgcgcg

SEQ ID NO: 3180678 - RNA, 20 nt, Mycobacterium bovis subsp bovis AF2122/97
caccgggauagccgcgacca

SEQ ID NO: 3180679 - RNA, 19 nt, Mycobacterium bovis subsp bovis AF2122/97
caccgggaugggagccacu

SEQ ID NO: 3180680 - RNA, 23 nt, Mycobacterium bovis subsp bovis AF2122/97
caccgggaugugcggcugcaccg

SEQ ID NO: 3180681 - RNA, 14 nt, Mycobacterium bovis subsp bovis AF2122/97
caccgggcaccagu

SEQ ID NO: 3180682 - RNA, 14 nt, Mycobacterium bovis subsp bovis AF2122/97
caccgggcccgacg

SEQ ID NO: 3180683 - RNA, 16 nt, Mycobacterium bovis subsp bovis AF2122/97
caccgggcccgacgac

SEQ ID NO: 3180684 - RNA, 18 nt, Mycobacterium bovis subsp bovis AF2122/97
caccgggcccgccggccc

SEQ ID NO: 3180685 - RNA, 19 nt, Mycobacterium bovis subsp bovis AF2122/97
caccgggcccgccggcccc

SEQ ID NO: 3180686 - RNA, 17 nt, Mycobacterium bovis subsp bovis AF2122/97
caccgggcgggcuggug

SEQ ID NO: 3180687 - RNA, 18 nt, Mycobacterium bovis subsp bovis AF2122/97
caccgggcgucgucggug

SEQ ID NO: 3180688 - RNA, 18 nt, Mycobacterium bovis subsp bovis AF2122/97
caccggggaagaucucgg

SEQ ID NO: 3180689 - RNA, 15 nt, Mycobacterium bovis subsp bovis AF2122/97
caccggggacgucga

SEQ ID NO: 3180690 - RNA, 19 nt, Mycobacterium bovis subsp bovis AF2122/97
caccggggccuucggcccg

SEQ ID NO: 3180691 - RNA, 14 nt, Mycobacterium bovis subsp bovis AF2122/97
caccggggcggccg

SEQ ID NO: 3180692 - RNA, 15 nt, Mycobacterium bovis subsp bovis AF2122/97
caccggggcggccga

SEQ ID NO: 3180693 - RNA, 16 nt, Mycobacterium bovis subsp bovis AF2122/97
caccggggcggccgac

SEQ ID NO: 3180694 - RNA, 17 nt, Mycobacterium bovis subsp bovis AF2122/97
caccggggcggccgacc

SEQ ID NO: 3180695 - RNA, 14 nt, Mycobacterium bovis subsp bovis AF2122/97
caccggggucaccu

SEQ ID NO: 3180696 - RNA, 18 nt, Mycobacterium bovis subsp bovis AF2122/97
caccggguccaccgcacg

SEQ ID NO: 3180697 - RNA, 19 nt, Mycobacterium bovis subsp bovis AF2122/97
caccggguccaccgcacgg

SEQ ID NO: 3180698 - RNA, 18 nt, Mycobacterium bovis subsp bovis AF2122/97
caccggguugagccgccg

SEQ ID NO: 3180699 - RNA, 19 nt, Mycobacterium bovis subsp bovis AF2122/97
caccggguuggaagccgca

SEQ ID NO: 3180700 - RNA, 22 nt, Mycobacterium bovis subsp bovis AF2122/97
caccggguuggaagccgcaccg

SEQ ID NO: 3180701 - RNA, 20 nt, Mycobacterium bovis subsp bovis AF2122/97
caccgguaacgccaacaccg

SEQ ID NO: 3180702 - RNA, 22 nt, Mycobacterium bovis subsp bovis AF2122/97
caccgguaacgccaacaccggc

SEQ ID NO: 3180703 - RNA, 21 nt, Mycobacterium bovis subsp bovis AF2122/97
caccgguaacgcgacaagguc

SEQ ID NO: 3180704 - RNA, 21 nt, Mycobacterium bovis subsp bovis AF2122/97
caccgguaccgacggggaugg

SEQ ID NO: 3180705 - RNA, 12 nt, Mycobacterium bovis subsp bovis AF2122/97
caccgguaccgc

SEQ ID NO: 3180706 - RNA, 14 nt, Mycobacterium bovis subsp bovis AF2122/97
caccgguaccgccg

SEQ ID NO: 3180707 - RNA, 21 nt, Mycobacterium bovis subsp bovis AF2122/97
caccgguacgcaaccaaccgu

SEQ ID NO: 3180708 - RNA, 16 nt, Mycobacterium bovis subsp bovis AF2122/97
caccgguacugcgaug

SEQ ID NO: 3180709 - RNA, 15 nt, Mycobacterium bovis subsp bovis AF2122/97
caccggucaccgcgc

SEQ ID NO: 3180710 - RNA, 18 nt, Mycobacterium bovis subsp bovis AF2122/97
caccggucaccgcgcagc

SEQ ID NO: 3180711 - RNA, 16 nt, Mycobacterium bovis subsp bovis AF2122/97
caccgguccagcgccg

SEQ ID NO: 3180712 - RNA, 12 nt, Mycobacterium bovis subsp bovis AF2122/97
caccgguccagg

SEQ ID NO: 3180713 - RNA, 19 nt, Mycobacterium bovis subsp bovis AF2122/97
caccggucccugcgccguc

SEQ ID NO: 3180714 - RNA, 20 nt, Mycobacterium bovis subsp bovis AF2122/97
caccgugggccugcccggcg

SEQ ID NO: 3180715 - RNA, 16 nt, Mycobacterium bovis subsp bovis AF2122/97
caccgugggcggaacg

SEQ ID NO: 3180716 - RNA, 22 nt, Mycobacterium bovis subsp bovis AF2122/97
caccgugggguaucgccagcca

SEQ ID NO: 3180717 - RNA, 12 nt, Mycobacterium bovis subsp bovis AF2122/97
caccgugucgac

SEQ ID NO: 3180718 - RNA, 16 nt, Mycobacterium bovis subsp bovis AF2122/97
caccgugucgccggcg

SEQ ID NO: 3180719 - RNA, 13 nt, Mycobacterium bovis subsp bovis AF2122/97
caccgugucgucg

SEQ ID NO: 3180720 - RNA, 19 nt, Mycobacterium bovis subsp bovis AF2122/97
caccgugugggccccgccg

SEQ ID NO: 3180721 - RNA, 14 nt, Mycobacterium bovis subsp bovis AF2122/97
caccguuaccgccg

SEQ ID NO: 3180722 - RNA, 15 nt, Mycobacterium bovis subsp bovis AF2122/97
caccguuaccgccgu

SEQ ID NO: 3180723 - RNA, 16 nt, Mycobacterium bovis subsp bovis AF2122/97
caccguuagccagguc

SEQ ID NO: 3180724 - RNA, 21 nt, Mycobacterium bovis subsp bovis AF2122/97
caccguugccgaaccacgcgc

SEQ ID NO: 3180725 - RNA, 22 nt, Mycobacterium bovis subsp bovis AF2122/97
caccguugcguuggcgccacca

SEQ ID NO: 3180726 - RNA, 17 nt, Mycobacterium bovis subsp bovis AF2122/97
caccguuggccgcgcuc

SEQ ID NO: 3180727 - RNA, 21 nt, Mycobacterium bovis subsp bovis AF2122/97
caccguuguaugcugcgcgcc

SEQ ID NO: 3180728 - RNA, 22 nt, Mycobacterium bovis subsp bovis AF2122/97
caccguuguaugcugcgcgccg

SEQ ID NO: 3180729 - RNA, 22 nt, Mycobacterium bovis subsp bovis AF2122/97
caccguuuccggcgcuccgcca

SEQ ID NO: 3180730 - RNA, 17 nt, Mycobacterium bovis subsp bovis AF2122/97
caccguuugagcggcca

SEQ ID NO: 3180731 - RNA, 16 nt, Mycobacterium bovis subsp bovis AF2122/97
caccguuugcgcaccg

SEQ ID NO: 3180732 - RNA, 19 nt, Mycobacterium bovis subsp bovis AF2122/97
caccuaccgagaucaccgc

SEQ ID NO: 3180733 - RNA, 19 nt, Mycobacterium bovis subsp bovis AF2122/97
caccuaccguacgcagcgu

SEQ ID NO: 3180734 - RNA, 13 nt, Mycobacterium bovis subsp bovis AF2122/97
caccuagucgcgg

SEQ ID NO: 3180735 - RNA, 14 nt, Mycobacterium bovis subsp bovis AF2122/97
caccuauggucaac

SEQ ID NO: 3180736 - RNA, 18 nt, Mycobacterium bovis subsp bovis AF2122/97
caccucaaacgccugguc

SEQ ID NO: 3180737 - RNA, 16 nt, Mycobacterium bovis subsp bovis AF2122/97
caccucaccgcggauc

SEQ ID NO: 3180738 - RNA, 21 nt, Mycobacterium bovis subsp bovis AF2122/97
caccucagaaaguccccgcaa

SEQ ID NO: 3180739 - RNA, 14 nt, Mycobacterium bovis subsp bovis AF2122/97
caccucaucgccau

SEQ ID NO: 3180740 - RNA, 17 nt, Mycobacterium bovis subsp bovis AF2122/97
caccucaugaucucacc

SEQ ID NO: 3180741 - RNA, 23 nt, Mycobacterium bovis subsp bovis AF2122/97
caccuccaauugcgaaccggccg

SEQ ID NO: 3180742 - RNA, 16 nt, Mycobacterium bovis subsp bovis AF2122/97
caccuccaccgcgccg

SEQ ID NO: 3180743 - RNA, 22 nt, Mycobacterium bovis subsp bovis AF2122/97
caccuccaccgcgccggcggca

SEQ ID NO: 3180744 - RNA, 15 nt, Mycobacterium bovis subsp bovis AF2122/97
caccuccagcaccac

SEQ ID NO: 3180745 - RNA, 16 nt, Mycobacterium bovis subsp bovis AF2122/97
caccucccacgccgcc

SEQ ID NO: 3180746 - RNA, 18 nt, Mycobacterium bovis subsp bovis AF2122/97
caccucccacgccgccgu

SEQ ID NO: 3180747 - RNA, 21 nt, Mycobacterium bovis subsp bovis AF2122/97
caccucccagggcucggcggc

SEQ ID NO: 3180748 - RNA, 22 nt, Mycobacterium bovis subsp bovis AF2122/97
caccucccagggcucggcggcc

SEQ ID NO: 3180749 - RNA, 17 nt, Mycobacterium bovis subsp bovis AF2122/97
caccucccgcggcaccu

SEQ ID NO: 3180750 - RNA, 14 nt, Mycobacterium bovis subsp bovis AF2122/97
caccucccgggcga

SEQ ID NO: 3180751 - RNA, 21 nt, Mycobacterium bovis subsp bovis AF2122/97
caccucccgggcgagccgugc

SEQ ID NO: 3180752 - RNA, 23 nt, Mycobacterium bovis subsp bovis AF2122/97
caccuccgacggccgcggcgucg

SEQ ID NO: 3180753 - RNA, 17 nt, Mycobacterium bovis subsp bovis AF2122/97
caccuccgaggccgcca

SEQ ID NO: 3180754 - RNA, 22 nt, Mycobacterium bovis subsp bovis AF2122/97
caccuccgcgacggcggcuccc

SEQ ID NO: 3180755 - RNA, 14 nt, Mycobacterium bovis subsp bovis AF2122/97
caccuccgcgucgg

SEQ ID NO: 3180756 - RNA, 16 nt, Mycobacterium bovis subsp bovis AF2122/97
caccuccgucagcgcc

SEQ ID NO: 3180757 - RNA, 15 nt, Mycobacterium bovis subsp bovis AF2122/97
caccuccugguugac

SEQ ID NO: 3180758 - RNA, 15 nt, Mycobacterium bovis subsp bovis AF2122/97
caccucgaaggcacu

SEQ ID NO: 3180759 - RNA, 16 nt, Mycobacterium bovis subsp bovis AF2122/97
caccucgaaggcacug

SEQ ID NO: 3180760 - RNA, 16 nt, Mycobacterium bovis subsp bovis AF2122/97
caccucgaaggcccgc

SEQ ID NO: 3180761 - RNA, 17 nt, Mycobacterium bovis subsp bovis AF2122/97
caccucgaaggcccgcu

SEQ ID NO: 3180762 - RNA, 21 nt, Mycobacterium bovis subsp bovis AF2122/97
caccucgagcccgcguucagg

SEQ ID NO: 3180763 - RNA, 14 nt, Mycobacterium bovis subsp bovis AF2122/97
caccucgagcgcgg

SEQ ID NO: 3180764 - RNA, 15 nt, Mycobacterium bovis subsp bovis AF2122/97
caccucgagcguggc

SEQ ID NO: 3180765 - RNA, 20 nt, Mycobacterium bovis subsp bovis AF2122/97
caccucgagcguggcaacga

SEQ ID NO: 3180766 - RNA, 15 nt, Mycobacterium bovis subsp bovis AF2122/97
caccucgaucgcgcc

SEQ ID NO: 3180767 - RNA, 18 nt, Mycobacterium bovis subsp bovis AF2122/97
caccucgaucgcgccguc

SEQ ID NO: 3180768 - RNA, 19 nt, Mycobacterium bovis subsp bovis AF2122/97
caccucgaucgcgccgucg

SEQ ID NO: 3180769 - RNA, 23 nt, Mycobacterium bovis subsp bovis AF2122/97
caccucgaugaugcgcucggccu

SEQ ID NO: 3180770 - RNA, 13 nt, Mycobacterium bovis subsp bovis AF2122/97
caccucgaugccg

SEQ ID NO: 3180771 - RNA, 21 nt, Mycobacterium bovis subsp bovis AF2122/97
caccucgauggcguccaucuc

SEQ ID NO: 3180772 - RNA, 16 nt, Mycobacterium bovis subsp bovis AF2122/97
caccucgcacgacacc

SEQ ID NO: 3180773 - RNA, 20 nt, Mycobacterium bovis subsp bovis AF2122/97
caccucgcacgacaccucga

SEQ ID NO: 3180774 - RNA, 14 nt, Mycobacterium bovis subsp bovis AF2122/97
caccucgccaucga

SEQ ID NO: 3180775 - RNA, 22 nt, Mycobacterium bovis subsp bovis AF2122/97
caccucgcccucccgggcccgc

SEQ ID NO: 3180776 - RNA, 14 nt, Mycobacterium bovis subsp bovis AF2122/97
caccucgccggcgg

SEQ ID NO: 3180777 - RNA, 13 nt, Mycobacterium bovis subsp bovis AF2122/97
caccucgcgggug

SEQ ID NO: 3180778 - RNA, 22 nt, Mycobacterium bovis subsp bovis AF2122/97
caccucggcgaagucacgcacc

SEQ ID NO: 3180779 - RNA, 13 nt, Mycobacterium bovis subsp bovis AF2122/97
caccucggcgcga

SEQ ID NO: 3180780 - RNA, 12 nt, Mycobacterium bovis subsp bovis AF2122/97
caccucggcguu

SEQ ID NO: 3180781 - RNA, 16 nt, Mycobacterium bovis subsp bovis AF2122/97
caccucgggcgcccgc

SEQ ID NO: 3180782 - RNA, 20 nt, Mycobacterium bovis subsp bovis AF2122/97
caccucggguguggucacca

SEQ ID NO: 3180783 - RNA, 21 nt, Mycobacterium bovis subsp bovis AF2122/97
caccucggucccguugccgcc

SEQ ID NO: 3180784 - RNA, 18 nt, Mycobacterium bovis subsp bovis AF2122/97
caccucggugaccaggcc

SEQ ID NO: 3180785 - RNA, 19 nt, Mycobacterium bovis subsp bovis AF2122/97
caccucggugaccaggccg

SEQ ID NO: 3180786 - RNA, 20 nt, Mycobacterium bovis subsp bovis AF2122/97
caccucggugaccaggccgg

SEQ ID NO: 3180787 - RNA, 20 nt, Mycobacterium bovis subsp bovis AF2122/97
caccucggugcggaacaccg

SEQ ID NO: 3180788 - RNA, 16 nt, Mycobacterium bovis subsp bovis AF2122/97
caccucgguggcugcc

SEQ ID NO: 3180789 - RNA, 21 nt, Mycobacterium bovis subsp bovis AF2122/97
caccucguauacccgggcggu

SEQ ID NO: 3180790 - RNA, 23 nt, Mycobacterium bovis subsp bovis AF2122/97
caccucguauacccgggcggucg

SEQ ID NO: 3180791 - RNA, 24 nt, Mycobacterium bovis subsp bovis AF2122/97
caccucguauacccgggcggucga

SEQ ID NO: 3180792 - RNA, 23 nt, Mycobacterium bovis subsp bovis AF2122/97
caccucgucgacaaaccacagac

SEQ ID NO: 3180793 - RNA, 14 nt, Mycobacterium bovis subsp bovis AF2122/97
caccucgucgaucg

SEQ ID NO: 3180794 - RNA, 21 nt, Mycobacterium bovis subsp bovis AF2122/97
caccucgucgaucgccgcgcc

SEQ ID NO: 3180795 - RNA, 13 nt, Mycobacterium bovis subsp bovis AF2122/97
caccucgucgccu

SEQ ID NO: 3180796 - RNA, 18 nt, Mycobacterium bovis subsp bovis AF2122/97
caccucgucgccuagccg

SEQ ID NO: 3180797 - RNA, 16 nt, Mycobacterium bovis subsp bovis AF2122/97
caccucuucgaucugu

SEQ ID NO: 3180798 - RNA, 19 nt, Mycobacterium bovis subsp bovis AF2122/97
caccucuuggugccguucc

SEQ ID NO: 3180799 - RNA, 18 nt, Mycobacterium bovis subsp bovis AF2122/97
caccugacgugcggcgcg

SEQ ID NO: 3180800 - RNA, 12 nt, Mycobacterium bovis subsp bovis AF2122/97
cacgaccucuug

SEQ ID NO: 3180801 - RNA, 19 nt, Mycobacterium bovis subsp bovis AF2122/97
cacgaccugcucauccacc

SEQ ID NO: 3180802 - RNA, 13 nt, Mycobacterium bovis subsp bovis AF2122/97
cacgaccugguua

SEQ ID NO: 3180803 - RNA, 18 nt, Mycobacterium bovis subsp bovis AF2122/97
cacgacgaagucguuggg

SEQ ID NO: 3180804 - RNA, 20 nt, Mycobacterium bovis subsp bovis AF2122/97
cacgacgaagucguugggaa

SEQ ID NO: 3180805 - RNA, 23 nt, Mycobacterium bovis subsp bovis AF2122/97
cacgacgacaaccggccagaugg

SEQ ID NO: 3180806 - RNA, 21 nt, Mycobacterium bovis subsp bovis AF2122/97
cacgacgacaucgagccaacg

SEQ ID NO: 3180807 - RNA, 13 nt, Mycobacterium bovis subsp bovis AF2122/97
cacgacgacgaca

SEQ ID NO: 3180808 - RNA, 13 nt, Mycobacterium bovis subsp bovis AF2122/97
cacgacgcccacc

SEQ ID NO: 3180809 - RNA, 13 nt, Mycobacterium bovis subsp bovis AF2122/97
cacgacgccgaau

SEQ ID NO: 3180810 - RNA, 12 nt, Mycobacterium bovis subsp bovis AF2122/97
cacgacgccggc

SEQ ID NO: 3180811 - RNA, 14 nt, Mycobacterium bovis subsp bovis AF2122/97
cacgacgccggccu

SEQ ID NO: 3180812 - RNA, 19 nt, Mycobacterium bovis subsp bovis AF2122/97
cacgacgccggccuggccg

SEQ ID NO: 3180813 - RNA, 22 nt, Mycobacterium bovis subsp bovis AF2122/97
cacgacgccggccuggccgcca

SEQ ID NO: 3180814 - RNA, 19 nt, Mycobacterium bovis subsp bovis AF2122/97
cacgacgccuugucggcgu

SEQ ID NO: 3180815 - RNA, 17 nt, Mycobacterium bovis subsp bovis AF2122/97
cacgacgcgacacgccg

SEQ ID NO: 3180816 - RNA, 20 nt, Mycobacterium bovis subsp bovis AF2122/97
cacgacgggggagcacuacc

SEQ ID NO: 3180817 - RNA, 20 nt, Mycobacterium bovis subsp bovis AF2122/97
cacgacgucaaucucggucg

SEQ ID NO: 3180818 - RNA, 22 nt, Mycobacterium bovis subsp bovis AF2122/97
cacgacgucggugaacgcgucg

SEQ ID NO: 3180819 - RNA, 17 nt, Mycobacterium bovis subsp bovis AF2122/97
cacgacgugcaggaaca

SEQ ID NO: 3180820 - RNA, 23 nt, Mycobacterium bovis subsp bovis AF2122/97
cacgacgugcgucggcccggugc

SEQ ID NO: 3180821 - RNA, 17 nt, Mycobacterium bovis subsp bovis AF2122/97
cacgacguucgacgaca

SEQ ID NO: 3180822 - RNA, 23 nt, Mycobacterium bovis subsp bovis AF2122/97
cacgacguucgacgacagcaccg

SEQ ID NO: 3180823 - RNA, 15 nt, Mycobacterium bovis subsp bovis AF2122/97
cacgacguugccucg

SEQ ID NO: 3180824 - RNA, 20 nt, Mycobacterium bovis subsp bovis AF2122/97
cacgacguugccucgcgacg

SEQ ID NO: 3180825 - RNA, 16 nt, Mycobacterium bovis subsp bovis AF2122/97
cacgacguugcgaggc

SEQ ID NO: 3180826 - RNA, 20 nt, Mycobacterium bovis subsp bovis AF2122/97
cacgacguugcgaggccgca

SEQ ID NO: 3180827 - RNA, 15 nt, Mycobacterium bovis subsp bovis AF2122/97
cacgacucccccggc

SEQ ID NO: 3180828 - RNA, 19 nt, Mycobacterium bovis subsp bovis AF2122/97
cacgacugcaucgucgacg

SEQ ID NO: 3180829 - RNA, 14 nt, Mycobacterium bovis subsp bovis AF2122/97
cacgacugugcgcc

SEQ ID NO: 3180830 - RNA, 17 nt, Mycobacterium bovis subsp bovis AF2122/97
cacgacugugcgccgca

SEQ ID NO: 3180831 - RNA, 23 nt, Mycobacterium bovis subsp bovis AF2122/97
cacgacugugcgccgcagccugc

SEQ ID NO: 3180832 - RNA, 21 nt, Mycobacterium bovis subsp bovis AF2122/97
cacgagcaaaccagauugccg

SEQ ID NO: 3180833 - RNA, 17 nt, Mycobacterium bovis subsp bovis AF2122/97
cacgagcagccgaugcu

SEQ ID NO: 3180834 - RNA, 18 nt, Mycobacterium bovis subsp bovis AF2122/97
cacgagccaacaagucga

SEQ ID NO: 3180835 - RNA, 22 nt, Mycobacterium bovis subsp bovis AF2122/97
cacgagccaaggcuuccuccga

SEQ ID NO: 3180836 - RNA, 13 nt, Mycobacterium bovis subsp bovis AF2122/97
cacgagcgcaugu

SEQ ID NO: 3180837 - RNA, 21 nt, Mycobacterium bovis subsp bovis AF2122/97
cacgaggcacaaucaccgccg

SEQ ID NO: 3180838 - RNA, 18 nt, Mycobacterium bovis subsp bovis AF2122/97
cacgaggcaucguccacg

SEQ ID NO: 3180839 - RNA, 19 nt, Mycobacterium bovis subsp bovis AF2122/97
cacgaggcuugcggcacaa

SEQ ID NO: 3180840 - RNA, 13 nt, Mycobacterium bovis subsp bovis AF2122/97
cacgagggccacg

SEQ ID NO: 3180841 - RNA, 16 nt, Mycobacterium bovis subsp bovis AF2122/97
cacgagguagccgacg

SEQ ID NO: 3180842 - RNA, 16 nt, Mycobacterium bovis subsp bovis AF2122/97
cacgagguugggccgg

SEQ ID NO: 3180843 - RNA, 17 nt, Mycobacterium bovis subsp bovis AF2122/97
cacgagguugggccggu

SEQ ID NO: 3180844 - RNA, 19 nt, Mycobacterium bovis subsp bovis AF2122/97
cacgaguccgcggaucacc

SEQ ID NO: 3180845 - RNA, 20 nt, Mycobacterium bovis subsp bovis AF2122/97
cacgaguccgcggaucacca

SEQ ID NO: 3180846 - RNA, 16 nt, Mycobacterium bovis subsp bovis AF2122/97
cacgagucgccagacc

SEQ ID NO: 3180847 - RNA, 17 nt, Mycobacterium bovis subsp bovis AF2122/97
cacgagucgccagaccg

SEQ ID NO: 3180848 - RNA, 19 nt, Mycobacterium bovis subsp bovis AF2122/97
cacgagucgucguccgacg

SEQ ID NO: 3180849 - RNA, 15 nt, Mycobacterium bovis subsp bovis AF2122/97
cacgagugcggcgac

SEQ ID NO: 3180850 - RNA, 15 nt, Mycobacterium bovis subsp bovis AF2122/97
cacgaguuggccaag

SEQ ID NO: 3180851 - RNA, 22 nt, Mycobacterium bovis subsp bovis AF2122/97
cacgauaaaugcuucgaccgcc

SEQ ID NO: 3180852 - RNA, 17 nt, Mycobacterium bovis subsp bovis AF2122/97
cacgauagccaccgacg

SEQ ID NO: 3180853 - RNA, 20 nt, Mycobacterium bovis subsp bovis AF2122/97
cacgauaucgaugcggcgac

SEQ ID NO: 3180854 - RNA, 23 nt, Mycobacterium bovis subsp bovis AF2122/97
cacgauaucgggcucagcggcga

SEQ ID NO: 3180855 - RNA, 17 nt, Mycobacterium bovis subsp bovis AF2122/97
cacgaucacaccacggu

SEQ ID NO: 3180856 - RNA, 16 nt, Mycobacterium bovis subsp bovis AF2122/97
cacgaucacccgcacg

SEQ ID NO: 3180857 - RNA, 17 nt, Mycobacterium bovis subsp bovis AF2122/97
cacgaucacccgcacgu

SEQ ID NO: 3180858 - RNA, 14 nt, Mycobacterium bovis subsp bovis AF2122/97
cacgaucacccgga

SEQ ID NO: 3180859 - RNA, 17 nt, Mycobacterium bovis subsp bovis AF2122/97
cacgaucaguugcccca

SEQ ID NO: 3180860 - RNA, 22 nt, Mycobacterium bovis subsp bovis AF2122/97
cacgaucaucgggguggccacc

SEQ ID NO: 3180861 - RNA, 22 nt, Mycobacterium bovis subsp bovis AF2122/97
cacgauccgcgguagcagcagc

SEQ ID NO: 3180862 - RNA, 14 nt, Mycobacterium bovis subsp bovis AF2122/97
cacgaucgccaacg

SEQ ID NO: 3180863 - RNA, 21 nt, Mycobacterium bovis subsp bovis AF2122/97
cacgaucgccaacgacucacc

SEQ ID NO: 3180864 - RNA, 15 nt, Mycobacterium bovis subsp bovis AF2122/97
cacgaucgcccguga

SEQ ID NO: 3180865 - RNA, 14 nt, Mycobacterium bovis subsp bovis AF2122/97
cacgaucgcgguga

SEQ ID NO: 3180866 - RNA, 15 nt, Mycobacterium bovis subsp bovis AF2122/97
cacgaucgcggugac

SEQ ID NO: 3180867 - RNA, 19 nt, Mycobacterium bovis subsp bovis AF2122/97
auugaccugcuggcgcacg

SEQ ID NO: 3180868 - RNA, 19 nt, Mycobacterium bovis subsp bovis AF2122/97
auugacgccguugccgccg

SEQ ID NO: 3180869 - RNA, 15 nt, Mycobacterium bovis subsp bovis AF2122/97
auugagcacgcgcaa

SEQ ID NO: 3180870 - RNA, 18 nt, Mycobacterium bovis subsp bovis AF2122/97
auugagcagcaagccgcc

SEQ ID NO: 3180871 - RNA, 13 nt, Mycobacterium bovis subsp bovis AF2122/97
auugagccggccc

SEQ ID NO: 3180872 - RNA, 22 nt, Mycobacterium bovis subsp bovis AF2122/97
auugagccggcccugcucgccg

SEQ ID NO: 3180873 - RNA, 22 nt, Mycobacterium bovis subsp bovis AF2122/97
auugaucgacggccagcccagc

SEQ ID NO: 3180874 - RNA, 14 nt, Mycobacterium bovis subsp bovis AF2122/97
auugaucggugccc

SEQ ID NO: 3180875 - RNA, 14 nt, Mycobacterium bovis subsp bovis AF2122/97
auugaugcugcccg

SEQ ID NO: 3180876 - RNA, 18 nt, Mycobacterium bovis subsp bovis AF2122/97
auugcaccuucuccaccg

SEQ ID NO: 3180877 - RNA, 22 nt, Mycobacterium bovis subsp bovis AF2122/97
auugcaugguuucguuccucga

SEQ ID NO: 3180878 - RNA, 23 nt, Mycobacterium bovis subsp bovis AF2122/97
auugccaccagaaacaccgacga

SEQ ID NO: 3180879 - RNA, 9 nt, Mycobacterium bovis subsp bovis AF2122/97
auugccaua

SEQ ID NO: 3180880 - RNA, 17 nt, Mycobacterium bovis subsp bovis AF2122/97
auugcccgacgaugcgg

SEQ ID NO: 3180881 - RNA, 22 nt, Mycobacterium bovis subsp bovis AF2122/97
auugcccgacgaugcgggcgau

SEQ ID NO: 3180882 - RNA, 13 nt, Mycobacterium bovis subsp bovis AF2122/97
auugcccgagccc

SEQ ID NO: 3180883 - RNA, 21 nt, Mycobacterium bovis subsp bovis AF2122/97
auugcccguguuaaagaagcc

SEQ ID NO: 3180884 - RNA, 17 nt, Mycobacterium bovis subsp bovis AF2122/97
auugcccuugaccaugu

SEQ ID NO: 3180885 - RNA, 14 nt, Mycobacterium bovis subsp bovis AF2122/97
auugccgaugguca

SEQ ID NO: 3180886 - RNA, 16 nt, Mycobacterium bovis subsp bovis AF2122/97
auugccgcaugcucag

SEQ ID NO: 3180887 - RNA, 18 nt, Mycobacterium bovis subsp bovis AF2122/97
auugccgccagcccagcc

SEQ ID NO: 3180888 - RNA, 11 nt, Mycobacterium bovis subsp bovis AF2122/97
auugccgccgc

SEQ ID NO: 3180889 - RNA, 13 nt, Mycobacterium bovis subsp bovis AF2122/97
auugccgccgccg

SEQ ID NO: 3180890 - RNA, 11 nt, Mycobacterium bovis subsp bovis AF2122/97
auugccgccgu

SEQ ID NO: 3180891 - RNA, 16 nt, Mycobacterium bovis subsp bovis AF2122/97
auugccgccgucgccg

SEQ ID NO: 3180892 - RNA, 14 nt, Mycobacterium bovis subsp bovis AF2122/97
auugccggccacca

SEQ ID NO: 3180893 - RNA, 20 nt, Mycobacterium bovis subsp bovis AF2122/97
auugccggcgauuaccggca

SEQ ID NO: 3180894 - RNA, 17 nt, Mycobacterium bovis subsp bovis AF2122/97
auugccgggccgccgag

SEQ ID NO: 3180895 - RNA, 17 nt, Mycobacterium bovis subsp bovis AF2122/97
auugccgggcgcacgcc

SEQ ID NO: 3180896 - RNA, 18 nt, Mycobacterium bovis subsp bovis AF2122/97
auugccgggcgcacgccc

SEQ ID NO: 3180897 - RNA, 21 nt, Mycobacterium bovis subsp bovis AF2122/97
auugccgggcgcacgcccgca

SEQ ID NO: 3180898 - RNA, 21 nt, Mycobacterium bovis subsp bovis AF2122/97
auugccguccgguggaccgcc

SEQ ID NO: 3180899 - RNA, 14 nt, Mycobacterium bovis subsp bovis AF2122/97
auugccgucgcggu

SEQ ID NO: 3180900 - RNA, 22 nt, Mycobacterium bovis subsp bovis AF2122/97
auugccgucgugaucggcgaac

SEQ ID NO: 3180901 - RNA, 18 nt, Mycobacterium bovis subsp bovis AF2122/97
auugccucccgcgccggc

SEQ ID NO: 3180902 - RNA, 14 nt, Mycobacterium bovis subsp bovis AF2122/97
auugccuccgcuag

SEQ ID NO: 3180903 - RNA, 17 nt, Mycobacterium bovis subsp bovis AF2122/97
auugccugccacccggc

SEQ ID NO: 3180904 - RNA, 21 nt, Mycobacterium bovis subsp bovis AF2122/97
auugccugccacccggccagg

SEQ ID NO: 3180905 - RNA, 18 nt, Mycobacterium bovis subsp bovis AF2122/97
auugccugggcgaccggc

SEQ ID NO: 3180906 - RNA, 19 nt, Mycobacterium bovis subsp bovis AF2122/97
auugccugggcggccgggc

SEQ ID NO: 3180907 - RNA, 20 nt, Mycobacterium bovis subsp bovis AF2122/97
auugcgaaccggccgucgac

SEQ ID NO: 3180908 - RNA, 17 nt, Mycobacterium bovis subsp bovis AF2122/97
auugcgaacucgcugcc

SEQ ID NO: 3180909 - RNA, 18 nt, Mycobacterium bovis subsp bovis AF2122/97
auugcgaagggcaccggc

SEQ ID NO: 3180910 - RNA, 21 nt, Mycobacterium bovis subsp bovis AF2122/97
auugcgcaaauaggacugcgc

SEQ ID NO: 3180911 - RNA, 16 nt, Mycobacterium bovis subsp bovis AF2122/97
auugcgcccggccaug

SEQ ID NO: 3180912 - RNA, 22 nt, Mycobacterium bovis subsp bovis AF2122/97
auugcgccgagcuggcaacgcc

SEQ ID NO: 3180913 - RNA, 19 nt, Mycobacterium bovis subsp bovis AF2122/97
auugcgcgcugagcucgau

SEQ ID NO: 3180914 - RNA, 12 nt, Mycobacterium bovis subsp bovis AF2122/97
auugcgcuucca

SEQ ID NO: 3180915 - RNA, 21 nt, Mycobacterium bovis subsp bovis AF2122/97
auugcggaacaccaccaggcu

SEQ ID NO: 3180916 - RNA, 18 nt, Mycobacterium bovis subsp bovis AF2122/97
auugcggcccgcgaucgg

SEQ ID NO: 3180917 - RNA, 12 nt, Mycobacterium bovis subsp bovis AF2122/97
auugcggccgcc

SEQ ID NO: 3180918 - RNA, 20 nt, Mycobacterium bovis subsp bovis AF2122/97
auugcggcgcgggugcggau

SEQ ID NO: 3180919 - RNA, 16 nt, Mycobacterium bovis subsp bovis AF2122/97
auugcgggagccucgc

SEQ ID NO: 3180920 - RNA, 14 nt, Mycobacterium bovis subsp bovis AF2122/97
auugcguucgccgc

SEQ ID NO: 3180921 - RNA, 16 nt, Mycobacterium bovis subsp bovis AF2122/97
auugcguucgccgccc

SEQ ID NO: 3180922 - RNA, 13 nt, Mycobacterium bovis subsp bovis AF2122/97
auugcucgaucug

SEQ ID NO: 3180923 - RNA, 14 nt, Mycobacterium bovis subsp bovis AF2122/97
auuggacgcugccg

SEQ ID NO: 3180924 - RNA, 11 nt, Mycobacterium bovis subsp bovis AF2122/97
auuggccaggu

SEQ ID NO: 3180925 - RNA, 21 nt, Mycobacterium bovis subsp bovis AF2122/97
auuggccaggucggccaccgu

SEQ ID NO: 3180926 - RNA, 23 nt, Mycobacterium bovis subsp bovis AF2122/97
auuggcccgaguuggcgaagccc

SEQ ID NO: 3180927 - RNA, 22 nt, Mycobacterium bovis subsp bovis AF2122/97
auuggcccgucacgcccgcgaa

SEQ ID NO: 3180928 - RNA, 14 nt, Mycobacterium bovis subsp bovis AF2122/97
auuggcgaucagca

SEQ ID NO: 3180929 - RNA, 18 nt, Mycobacterium bovis subsp bovis AF2122/97
auuggcgaucagcagccg

SEQ ID NO: 3180930 - RNA, 13 nt, Mycobacterium bovis subsp bovis AF2122/97
auuggcgccgccg

SEQ ID NO: 3180931 - RNA, 14 nt, Mycobacterium bovis subsp bovis AF2122/97
auuggcgccgccga

SEQ ID NO: 3180932 - RNA, 15 nt, Mycobacterium bovis subsp bovis AF2122/97
auuggcgccgccgau

SEQ ID NO: 3180933 - RNA, 16 nt, Mycobacterium bovis subsp bovis AF2122/97
auuggcgccgccgauc

SEQ ID NO: 3180934 - RNA, 16 nt, Mycobacterium bovis subsp bovis AF2122/97
auuggcgcugcccgcc

SEQ ID NO: 3180935 - RNA, 14 nt, Mycobacterium bovis subsp bovis AF2122/97
auuggcuccgaaca

SEQ ID NO: 3180936 - RNA, 22 nt, Mycobacterium bovis subsp bovis AF2122/97
auuggcuccgaacauggccagc

SEQ ID NO: 3180937 - RNA, 14 nt, Mycobacterium bovis subsp bovis AF2122/97
auuggcucgagcaa

SEQ ID NO: 3180938 - RNA, 15 nt, Mycobacterium bovis subsp bovis AF2122/97
auuggcucgccgaac

SEQ ID NO: 3180939 - RNA, 17 nt, Mycobacterium bovis subsp bovis AF2122/97
auuggcugcgccgauac

SEQ ID NO: 3180940 - RNA, 16 nt, Mycobacterium bovis subsp bovis AF2122/97
auuggcugggucguca

SEQ ID NO: 3180941 - RNA, 14 nt, Mycobacterium bovis subsp bovis AF2122/97
auugggcgaugcgg

SEQ ID NO: 3180942 - RNA, 22 nt, Mycobacterium bovis subsp bovis AF2122/97
auugggcgauuuugcgucugcu

SEQ ID NO: 3180943 - RNA, 14 nt, Mycobacterium bovis subsp bovis AF2122/97
auuggguccagcga

SEQ ID NO: 3180944 - RNA, 20 nt, Mycobacterium bovis subsp bovis AF2122/97
auugggugccguugcgucug

SEQ ID NO: 3180945 - RNA, 17 nt, Mycobacterium bovis subsp bovis AF2122/97
auuggucaccugcugca

SEQ ID NO: 3180946 - RNA, 23 nt, Mycobacterium bovis subsp bovis AF2122/97
auuggucgaacagcgaaccggcu

SEQ ID NO: 3180947 - RNA, 19 nt, Mycobacterium bovis subsp bovis AF2122/97
auuggugggccagcagcaa

SEQ ID NO: 3180948 - RNA, 20 nt, Mycobacterium bovis subsp bovis AF2122/97
auuggugggccagcagcaac

SEQ ID NO: 3180949 - RNA, 13 nt, Mycobacterium bovis subsp bovis AF2122/97
auugguugaggag

SEQ ID NO: 3180950 - RNA, 14 nt, Mycobacterium bovis subsp bovis AF2122/97
auugucgacgguca

SEQ ID NO: 3180951 - RNA, 14 nt, Mycobacterium bovis subsp bovis AF2122/97
auugucgaucuggu

SEQ ID NO: 3180952 - RNA, 15 nt, Mycobacterium bovis subsp bovis AF2122/97
auugugggacgcgau

SEQ ID NO: 3180953 - RNA, 14 nt, Mycobacterium bovis subsp bovis AF2122/97
auugugugcagcag

SEQ ID NO: 3180954 - RNA, 16 nt, Mycobacterium bovis subsp bovis AF2122/97
auugugugcagcagca

SEQ ID NO: 3180955 - RNA, 22 nt, Mycobacterium bovis subsp bovis AF2122/97
auuucagccuuguugccgccgg

SEQ ID NO: 3180956 - RNA, 16 nt, Mycobacterium bovis subsp bovis AF2122/97
auuuccacauccaacg

SEQ ID NO: 3180957 - RNA, 15 nt, Mycobacterium bovis subsp bovis AF2122/97
auuuccagcagugcg

SEQ ID NO: 3180958 - RNA, 20 nt, Mycobacterium bovis subsp bovis AF2122/97
auuuccuacggugcagucga

SEQ ID NO: 3180959 - RNA, 20 nt, Mycobacterium bovis subsp bovis AF2122/97
auuucgacgaccaccuucug

SEQ ID NO: 3180960 - RNA, 14 nt, Mycobacterium bovis subsp bovis AF2122/97
auuucgaucgcggc

SEQ ID NO: 3180961 - RNA, 14 nt, Mycobacterium bovis subsp bovis AF2122/97
auuucggaucucga

SEQ ID NO: 3180962 - RNA, 13 nt, Mycobacterium bovis subsp bovis AF2122/97
auuucggcccacu

SEQ ID NO: 3180963 - RNA, 12 nt, Mycobacterium bovis subsp bovis AF2122/97
auuucggcggcg

SEQ ID NO: 3180964 - RNA, 16 nt, Mycobacterium bovis subsp bovis AF2122/97
auuucggcggcgauga

SEQ ID NO: 3180965 - RNA, 13 nt, Mycobacterium bovis subsp bovis AF2122/97
auuucgucgaucg

SEQ ID NO: 3180966 - RNA, 15 nt, Mycobacterium bovis subsp bovis AF2122/97
auuucgucgaucggc

SEQ ID NO: 3180967 - RNA, 13 nt, Mycobacterium bovis subsp bovis AF2122/97
auuucgucggcca

SEQ ID NO: 3180968 - RNA, 15 nt, Mycobacterium bovis subsp bovis AF2122/97
auuucgucgucgcag

SEQ ID NO: 3180969 - RNA, 18 nt, Mycobacterium bovis subsp bovis AF2122/97
auuucguggcacgggucg

SEQ ID NO: 3180970 - RNA, 13 nt, Mycobacterium bovis subsp bovis AF2122/97
auuucucccagcc

SEQ ID NO: 3180971 - RNA, 15 nt, Mycobacterium bovis subsp bovis AF2122/97
auuucucccagccca

SEQ ID NO: 3180972 - RNA, 14 nt, Mycobacterium bovis subsp bovis AF2122/97
auuucugcagccca

SEQ ID NO: 3180973 - RNA, 24 nt, Mycobacterium bovis subsp bovis AF2122/97
auuugccccguugagcagcaccca

SEQ ID NO: 3180974 - RNA, 17 nt, Mycobacterium bovis subsp bovis AF2122/97
auuugccgugcucaccg

SEQ ID NO: 3180975 - RNA, 23 nt, Mycobacterium bovis subsp bovis AF2122/97
auuugccgugcucaccggcgccc

SEQ ID NO: 3180976 - RNA, 17 nt, Mycobacterium bovis subsp bovis AF2122/97
auuugccuugagccgcc

SEQ ID NO: 3180977 - RNA, 16 nt, Mycobacterium bovis subsp bovis AF2122/97
auuuggccgauguugu

SEQ ID NO: 3180978 - RNA, 20 nt, Mycobacterium bovis subsp bovis AF2122/97
auuuggccgauguuguugac

SEQ ID NO: 3180979 - RNA, 21 nt, Mycobacterium bovis subsp bovis AF2122/97
auuuggugaagccguagacgu

SEQ ID NO: 3180980 - RNA, 15 nt, Mycobacterium bovis subsp bovis AF2122/97
auuuggugguguuca

SEQ ID NO: 3180981 - RNA, 23 nt, Mycobacterium bovis subsp bovis AF2122/97
auuuguccggcggacccucgccg

SEQ ID NO: 3180982 - RNA, 21 nt, Mycobacterium bovis subsp bovis AF2122/97
auuuguugcugcugccguggc

SEQ ID NO: 3180983 - RNA, 15 nt, Mycobacterium bovis subsp bovis AF2122/97
auuuucggcacggau

SEQ ID NO: 3180984 - RNA, 12 nt, Mycobacterium bovis subsp bovis AF2122/97
auuuugcgucug

SEQ ID NO: 3180985 - RNA, 20 nt, Mycobacterium bovis subsp bovis AF2122/97
auuuugcgucugcucggcgg

SEQ ID NO: 3180986 - RNA, 17 nt, Mycobacterium bovis subsp bovis AF2122/97
auuuuggcugcagucag

SEQ ID NO: 3180987 - RNA, 22 nt, Mycobacterium bovis subsp bovis AF2122/97
caaaaaccagcguccaacccag

SEQ ID NO: 3180988 - RNA, 17 nt, Mycobacterium bovis subsp bovis AF2122/97
caaaaacccggugacca

SEQ ID NO: 3180989 - RNA, 21 nt, Mycobacterium bovis subsp bovis AF2122/97
caaaaacccggugaccagcaa

SEQ ID NO: 3180990 - RNA, 18 nt, Mycobacterium bovis subsp bovis AF2122/97
caaaaacgcugccgccgu

SEQ ID NO: 3180991 - RNA, 19 nt, Mycobacterium bovis subsp bovis AF2122/97
caaaaacgcugccgccguu

SEQ ID NO: 3180992 - RNA, 19 nt, Mycobacterium bovis subsp bovis AF2122/97
caaaaagcucggcccuguu

SEQ ID NO: 3180993 - RNA, 20 nt, Mycobacterium bovis subsp bovis AF2122/97
caaaacauaucggugccgga

SEQ ID NO: 3180994 - RNA, 19 nt, Mycobacterium bovis subsp bovis AF2122/97
caaaaccucgugcgcaucg

SEQ ID NO: 3180995 - RNA, 19 nt, Mycobacterium bovis subsp bovis AF2122/97
caaaacgagcuuccacgcc

SEQ ID NO: 3180996 - RNA, 13 nt, Mycobacterium bovis subsp bovis AF2122/97
caaaaucaucugc

SEQ ID NO: 3180997 - RNA, 18 nt, Mycobacterium bovis subsp bovis AF2122/97
caaaaucgcccaauucgg

SEQ ID NO: 3180998 - RNA, 16 nt, Mycobacterium bovis subsp bovis AF2122/97
caaaaucgcggccaca

SEQ ID NO: 3180999 - RNA, 22 nt, Mycobacterium bovis subsp bovis AF2122/97
caaaaucgucagcgccgccgga

SEQ ID NO: 3181000 - RNA, 21 nt, Mycobacterium bovis subsp bovis AF2122/97
caaaaugccuuggcagcccag

SEQ ID NO: 3181001 - RNA, 18 nt, Mycobacterium bovis subsp bovis AF2122/97
caaaauggccaccggcgg

SEQ ID NO: 3181002 - RNA, 15 nt, Mycobacterium bovis subsp bovis AF2122/97
caaaauuuugucggc

SEQ ID NO: 3181003 - RNA, 14 nt, Mycobacterium bovis subsp bovis AF2122/97
caaacaacgacucc

SEQ ID NO: 3181004 - RNA, 17 nt, Mycobacterium bovis subsp bovis AF2122/97
caaacaagaucagaccc

SEQ ID NO: 3181005 - RNA, 21 nt, Mycobacterium bovis subsp bovis AF2122/97
caaacaagaucagacccagcg

SEQ ID NO: 3181006 - RNA, 15 nt, Mycobacterium bovis subsp bovis AF2122/97
caaacaccccacaca

SEQ ID NO: 3181007 - RNA, 16 nt, Mycobacterium bovis subsp bovis AF2122/97
caaacaccccacacag

SEQ ID NO: 3181008 - RNA, 20 nt, Mycobacterium bovis subsp bovis AF2122/97
caaacaccccggccuugcca

SEQ ID NO: 3181009 - RNA, 15 nt, Mycobacterium bovis subsp bovis AF2122/97
caaacaccuccagga

SEQ ID NO: 3181010 - RNA, 22 nt, Mycobacterium bovis subsp bovis AF2122/97
caaacacgccucgccgaagugg

SEQ ID NO: 3181011 - RNA, 18 nt, Mycobacterium bovis subsp bovis AF2122/97
caaacauacgccaccccg

SEQ ID NO: 3181012 - RNA, 14 nt, Mycobacterium bovis subsp bovis AF2122/97
caaacaucgcaccc

SEQ ID NO: 3181013 - RNA, 15 nt, Mycobacterium bovis subsp bovis AF2122/97
caaacaucgcaccca

SEQ ID NO: 3181014 - RNA, 16 nt, Mycobacterium bovis subsp bovis AF2122/97
caaacaucgcacccac

SEQ ID NO: 3181015 - RNA, 20 nt, Mycobacterium bovis subsp bovis AF2122/97
caaacaucuugucgaucugc

SEQ ID NO: 3181016 - RNA, 16 nt, Mycobacterium bovis subsp bovis AF2122/97
caaaccaagcgcgcca

SEQ ID NO: 3181017 - RNA, 14 nt, Mycobacterium bovis subsp bovis AF2122/97
caaaccacagacug

SEQ ID NO: 3181018 - RNA, 18 nt, Mycobacterium bovis subsp bovis AF2122/97
caaaccacccgcaacaca

SEQ ID NO: 3181019 - RNA, 18 nt, Mycobacterium bovis subsp bovis AF2122/97
caaaccauugcgccugaa

SEQ ID NO: 3181020 - RNA, 15 nt, Mycobacterium bovis subsp bovis AF2122/97
caaacccagcgacgc

SEQ ID NO: 3181021 - RNA, 17 nt, Mycobacterium bovis subsp bovis AF2122/97
caaacccaugucggcgc

SEQ ID NO: 3181022 - RNA, 14 nt, Mycobacterium bovis subsp bovis AF2122/97
caaacccgccgaca

SEQ ID NO: 3181023 - RNA, 19 nt, Mycobacterium bovis subsp bovis AF2122/97
caaacccgccgacaaaagc

SEQ ID NO: 3181024 - RNA, 20 nt, Mycobacterium bovis subsp bovis AF2122/97
caaacccgccgacaaaagcc

SEQ ID NO: 3181025 - RNA, 21 nt, Mycobacterium bovis subsp bovis AF2122/97
caaacccgccgacaaaagcca

SEQ ID NO: 3181026 - RNA, 19 nt, Mycobacterium bovis subsp bovis AF2122/97
caaaccgaucaauccgccc

SEQ ID NO: 3181027 - RNA, 21 nt, Mycobacterium bovis subsp bovis AF2122/97
caaaccgaucaauccgcccuu

SEQ ID NO: 3181028 - RNA, 13 nt, Mycobacterium bovis subsp bovis AF2122/97
caaaccuuugauu

SEQ ID NO: 3181029 - RNA, 22 nt, Mycobacterium bovis subsp bovis AF2122/97
caaacgaacccccccgugcggu

SEQ ID NO: 3181030 - RNA, 17 nt, Mycobacterium bovis subsp bovis AF2122/97
caaacgaccgcugauga

SEQ ID NO: 3181031 - RNA, 16 nt, Mycobacterium bovis subsp bovis AF2122/97
caaacgacucgcggug

SEQ ID NO: 3181032 - RNA, 16 nt, Mycobacterium bovis subsp bovis AF2122/97
caaacgccgcccgccg

SEQ ID NO: 3181033 - RNA, 14 nt, Mycobacterium bovis subsp bovis AF2122/97
caaacgccgucacg

SEQ ID NO: 3181034 - RNA, 19 nt, Mycobacterium bovis subsp bovis AF2122/97
caaacgccgucacggcagu

SEQ ID NO: 3181035 - RNA, 17 nt, Mycobacterium bovis subsp bovis AF2122/97
caaacgcgcgcgccauu

SEQ ID NO: 3181036 - RNA, 12 nt, Mycobacterium bovis subsp bovis AF2122/97
caaacgcggcgu

SEQ ID NO: 3181037 - RNA, 15 nt, Mycobacterium bovis subsp bovis AF2122/97
caaacgcggcgucga

SEQ ID NO: 3181038 - RNA, 16 nt, Mycobacterium bovis subsp bovis AF2122/97
caaacgcugcgcccgg

SEQ ID NO: 3181039 - RNA, 21 nt, Mycobacterium bovis subsp bovis AF2122/97
caaacgcugcgcccggaccac

SEQ ID NO: 3181040 - RNA, 14 nt, Mycobacterium bovis subsp bovis AF2122/97
caaacggcgaccca

SEQ ID NO: 3181041 - RNA, 17 nt, Mycobacterium bovis subsp bovis AF2122/97
caaacggcgugucggug

SEQ ID NO: 3181042 - RNA, 22 nt, Mycobacterium bovis subsp bovis AF2122/97
caaacggcuuggcugccuccau

SEQ ID NO: 3181043 - RNA, 19 nt, Mycobacterium bovis subsp bovis AF2122/97
caaacguaccgucauggcg

SEQ ID NO: 3181044 - RNA, 21 nt, Mycobacterium bovis subsp bovis AF2122/97
caaacuaacggcagccaccgu

SEQ ID NO: 3181045 - RNA, 18 nt, Mycobacterium bovis subsp bovis AF2122/97
caaacuccugcaggauca

SEQ ID NO: 3181046 - RNA, 23 nt, Mycobacterium bovis subsp bovis AF2122/97
caaacugggaugugccgcgcacg

SEQ ID NO: 3181047 - RNA, 14 nt, Mycobacterium bovis subsp bovis AF2122/97
caaacugggcaccg

SEQ ID NO: 3181048 - RNA, 16 nt, Mycobacterium bovis subsp bovis AF2122/97
caaacugggcaccggc

SEQ ID NO: 3181049 - RNA, 16 nt, Mycobacterium bovis subsp bovis AF2122/97
caaacuucgcgcacgc

SEQ ID NO: 3181050 - RNA, 16 nt, Mycobacterium bovis subsp bovis AF2122/97
caaagacccgacgcca

SEQ ID NO: 3181051 - RNA, 14 nt, Mycobacterium bovis subsp bovis AF2122/97
caaagacgccgucg

SEQ ID NO: 3181052 - RNA, 16 nt, Mycobacterium bovis subsp bovis AF2122/97
caaagaucgccucucg

SEQ ID NO: 3181053 - RNA, 15 nt, Mycobacterium bovis subsp bovis AF2122/97
caaagcacgucccgg

SEQ ID NO: 3181054 - RNA, 11 nt, Mycobacterium bovis subsp bovis AF2122/97
caaagcagcgc

SEQ ID NO: 3181055 - RNA, 13 nt, Mycobacterium bovis subsp bovis AF2122/97
caaagcagcgcac

SEQ ID NO: 3181056 - RNA, 17 nt, Mycobacterium bovis subsp bovis AF2122/97
caaagccagcgcagcca

SEQ ID NO: 3181057 - RNA, 21 nt, Mycobacterium bovis subsp bovis AF2122/97
caaagccagcgcagccaggcu

SEQ ID NO: 3181058 - RNA, 14 nt, Mycobacterium bovis subsp bovis AF2122/97
caaagccgucagcu

SEQ ID NO: 3181059 - RNA, 16 nt, Mycobacterium bovis subsp bovis AF2122/97
caaagccgucgacgcg

SEQ ID NO: 3181060 - RNA, 16 nt, Mycobacterium bovis subsp bovis AF2122/97
caaagccgucgcgacg

SEQ ID NO: 3181061 - RNA, 13 nt, Mycobacterium bovis subsp bovis AF2122/97
caaagcggccucg

SEQ ID NO: 3181062 - RNA, 15 nt, Mycobacterium bovis subsp bovis AF2122/97
caaagcugcucgucg

SEQ ID NO: 3181063 - RNA, 23 nt, Mycobacterium bovis subsp bovis AF2122/97
caaagcugcucgucggcgccggc

SEQ ID NO: 3181064 - RNA, 18 nt, Mycobacterium bovis subsp bovis AF2122/97
caaaggacgacaccgcga

SEQ ID NO: 3181065 - RNA, 14 nt, Mycobacterium bovis subsp bovis AF2122/97
caaaggcgccguca

SEQ ID NO: 3181066 - RNA, 20 nt, Mycobacterium bovis subsp bovis AF2122/97
caaaggcuguaacacccggc

SEQ ID NO: 3181067 - RNA, 15 nt, Mycobacterium bovis subsp bovis AF2122/97
caaaggggugugugc

SEQ ID NO: 3181068 - RNA, 16 nt, Mycobacterium bovis subsp bovis AF2122/97
caaaggugcacugccg

SEQ ID NO: 3181069 - RNA, 14 nt, Mycobacterium bovis subsp bovis AF2122/97
caaaggugccgacc

SEQ ID NO: 3181070 - RNA, 18 nt, Mycobacterium bovis subsp bovis AF2122/97
caaagguuuccgcggucu

SEQ ID NO: 3181071 - RNA, 16 nt, Mycobacterium bovis subsp bovis AF2122/97
caaaguagacgugcca

SEQ ID NO: 3181072 - RNA, 22 nt, Mycobacterium bovis subsp bovis AF2122/97
caaagucggcgucacgguggac

SEQ ID NO: 3181073 - RNA, 16 nt, Mycobacterium bovis subsp bovis AF2122/97
caaaucaacggcgucg

SEQ ID NO: 3181074 - RNA, 13 nt, Mycobacterium bovis subsp bovis AF2122/97
caaaucaagcaca

SEQ ID NO: 3181075 - RNA, 15 nt, Mycobacterium bovis subsp bovis AF2122/97
caaaucaagcacagc

SEQ ID NO: 3181076 - RNA, 21 nt, Mycobacterium bovis subsp bovis AF2122/97
caaaucaagcacagcccggcu

SEQ ID NO: 3181077 - RNA, 14 nt, Mycobacterium bovis subsp bovis AF2122/97
caaaucccagagca

SEQ ID NO: 3181078 - RNA, 15 nt, Mycobacterium bovis subsp bovis AF2122/97
caaaucccagagcau

SEQ ID NO: 3181079 - RNA, 16 nt, Mycobacterium bovis subsp bovis AF2122/97
caaauccuucggcgug

SEQ ID NO: 3181080 - RNA, 14 nt, Mycobacterium bovis subsp bovis AF2122/97
caaaucggcaucgg

SEQ ID NO: 3181081 - RNA, 15 nt, Mycobacterium bovis subsp bovis AF2122/97
caaaucggucgacga

SEQ ID NO: 3181082 - RNA, 21 nt, Mycobacterium bovis subsp bovis AF2122/97
caaaucggucgacgaucucgc

SEQ ID NO: 3181083 - RNA, 22 nt, Mycobacterium bovis subsp bovis AF2122/97
caaaucguaggggucugcgucg

SEQ ID NO: 3181084 - RNA, 21 nt, Mycobacterium bovis subsp bovis AF2122/97
caaaugaaccgcacccugaca

SEQ ID NO: 3181085 - RNA, 20 nt, Mycobacterium bovis subsp bovis AF2122/97
caaaugccccgaaccgcgcu

SEQ ID NO: 3181086 - RNA, 23 nt, Mycobacterium bovis subsp bovis AF2122/97
caaaugcgggcuuugccaacaaa

SEQ ID NO: 3181087 - RNA, 15 nt, Mycobacterium bovis subsp bovis AF2122/97
caaauucugguguca

SEQ ID NO: 3181088 - RNA, 15 nt, Mycobacterium bovis subsp bovis AF2122/97
caacaacccaacaaa

SEQ ID NO: 3181089 - RNA, 16 nt, Mycobacterium bovis subsp bovis AF2122/97
caacaacgucugcagc

SEQ ID NO: 3181090 - RNA, 14 nt, Mycobacterium bovis subsp bovis AF2122/97
caacaacuccagca

SEQ ID NO: 3181091 - RNA, 20 nt, Mycobacterium bovis subsp bovis AF2122/97
caacaagaugccugacacga

SEQ ID NO: 3181092 - RNA, 22 nt, Mycobacterium bovis subsp bovis AF2122/97
caacaagaugccugacacgaug

SEQ ID NO: 3181093 - RNA, 22 nt, Mycobacterium bovis subsp bovis AF2122/97
caacacacugaagaucgcgccc

SEQ ID NO: 3181094 - RNA, 24 nt, Mycobacterium bovis subsp bovis AF2122/97
caacacagaacucaccgacggaug

SEQ ID NO: 3181095 - RNA, 15 nt, Mycobacterium bovis subsp bovis AF2122/97
caacacagccgucgc

SEQ ID NO: 3181096 - RNA, 17 nt, Mycobacterium bovis subsp bovis AF2122/97
caacacauugccggcca

SEQ ID NO: 3181097 - RNA, 17 nt, Mycobacterium bovis subsp bovis AF2122/97
caacaccaacgaacugg

SEQ ID NO: 3181098 - RNA, 17 nt, Mycobacterium bovis subsp bovis AF2122/97
caacaccaacgacagcg

SEQ ID NO: 3181099 - RNA, 18 nt, Mycobacterium bovis subsp bovis AF2122/97
caacaccaccagcacgcu

SEQ ID NO: 3181100 - RNA, 16 nt, Mycobacterium bovis subsp bovis AF2122/97
caacaccacggugccg

SEQ ID NO: 3181101 - RNA, 22 nt, Mycobacterium bovis subsp bovis AF2122/97
caacaccacggugccgacgaug

SEQ ID NO: 3181102 - RNA, 16 nt, Mycobacterium bovis subsp bovis AF2122/97
caacaccagccggucg

SEQ ID NO: 3181103 - RNA, 20 nt, Mycobacterium bovis subsp bovis AF2122/97
caacaccagccggucgucgc

SEQ ID NO: 3181104 - RNA, 23 nt, Mycobacterium bovis subsp bovis AF2122/97
caacaccaggucauugccggcga

SEQ ID NO: 3181105 - RNA, 11 nt, Mycobacterium bovis subsp bovis AF2122/97
caacaccauca

SEQ ID NO: 3181106 - RNA, 19 nt, Mycobacterium bovis subsp bovis AF2122/97
caacacccacgugcugccu

SEQ ID NO: 3181107 - RNA, 16 nt, Mycobacterium bovis subsp bovis AF2122/97
caacacccacugcacg

SEQ ID NO: 3181108 - RNA, 21 nt, Mycobacterium bovis subsp bovis AF2122/97
caacacccccccccccaccca

SEQ ID NO: 3181109 - RNA, 19 nt, Mycobacterium bovis subsp bovis AF2122/97
caacaccccccguccaccg

SEQ ID NO: 3181110 - RNA, 14 nt, Mycobacterium bovis subsp bovis AF2122/97
caacacccgcccgg

SEQ ID NO: 3181111 - RNA, 17 nt, Mycobacterium bovis subsp bovis AF2122/97
caacacccgcccgggcg

SEQ ID NO: 3181112 - RNA, 18 nt, Mycobacterium bovis subsp bovis AF2122/97
caacacccgcccgggcgu

SEQ ID NO: 3181113 - RNA, 13 nt, Mycobacterium bovis subsp bovis AF2122/97
caacacccgccgg

SEQ ID NO: 3181114 - RNA, 18 nt, Mycobacterium bovis subsp bovis AF2122/97
caacaccgaguuccucug

SEQ ID NO: 3181115 - RNA, 12 nt, Mycobacterium bovis subsp bovis AF2122/97
caacaccgcacc

SEQ ID NO: 3181116 - RNA, 13 nt, Mycobacterium bovis subsp bovis AF2122/97
caacaccgccagc

SEQ ID NO: 3181117 - RNA, 14 nt, Mycobacterium bovis subsp bovis AF2122/97
caacaccgccagca

SEQ ID NO: 3181118 - RNA, 16 nt, Mycobacterium bovis subsp bovis AF2122/97
caacaccgccagcaug

SEQ ID NO: 3181119 - RNA, 13 nt, Mycobacterium bovis subsp bovis AF2122/97
caacaccgcgccg

SEQ ID NO: 3181120 - RNA, 14 nt, Mycobacterium bovis subsp bovis AF2122/97
caacaccgcggccg

SEQ ID NO: 3181121 - RNA, 15 nt, Mycobacterium bovis subsp bovis AF2122/97
caacaccgcggccga

SEQ ID NO: 3181122 - RNA, 14 nt, Mycobacterium bovis subsp bovis AF2122/97
caacaccgcggcgc

SEQ ID NO: 3181123 - RNA, 17 nt, Mycobacterium bovis subsp bovis AF2122/97
caacaccgcgucaacgc

SEQ ID NO: 3181124 - RNA, 20 nt, Mycobacterium bovis subsp bovis AF2122/97
caacaccgcgucaacgcugu

SEQ ID NO: 3181125 - RNA, 14 nt, Mycobacterium bovis subsp bovis AF2122/97
caacaccggcaucg

SEQ ID NO: 3181126 - RNA, 15 nt, Mycobacterium bovis subsp bovis AF2122/97
caacaccggcaucgc

SEQ ID NO: 3181127 - RNA, 18 nt, Mycobacterium bovis subsp bovis AF2122/97
caacaccggcgaucaccg

SEQ ID NO: 3181128 - RNA, 12 nt, Mycobacterium bovis subsp bovis AF2122/97
caacaccggcgu

SEQ ID NO: 3181129 - RNA, 14 nt, Mycobacterium bovis subsp bovis AF2122/97
caacaccggcgugg

SEQ ID NO: 3181130 - RNA, 20 nt, Mycobacterium bovis subsp bovis AF2122/97
caacaccggcugguucaaca

SEQ ID NO: 3181131 - RNA, 22 nt, Mycobacterium bovis subsp bovis AF2122/97
caacaccgguaacgccaacacc

SEQ ID NO: 3181132 - RNA, 13 nt, Mycobacterium bovis subsp bovis AF2122/97
caacaccgguguc

SEQ ID NO: 3181133 - RNA, 20 nt, Mycobacterium bovis subsp bovis AF2122/97
caacaccggugucggccagc

SEQ ID NO: 3181134 - RNA, 19 nt, Mycobacterium bovis subsp bovis AF2122/97
caacaccgucggcagcagc

SEQ ID NO: 3181135 - RNA, 20 nt, Mycobacterium bovis subsp bovis AF2122/97
caacaccgucggcagcagcg

SEQ ID NO: 3181136 - RNA, 21 nt, Mycobacterium bovis subsp bovis AF2122/97
caacaccgucggcagcagcgg

SEQ ID NO: 3181137 - RNA, 16 nt, Mycobacterium bovis subsp bovis AF2122/97
caacaccgugcaccag

SEQ ID NO: 3181138 - RNA, 19 nt, Mycobacterium bovis subsp bovis AF2122/97
caacaccucaaacgccugg

SEQ ID NO: 3181139 - RNA, 14 nt, Mycobacterium bovis subsp bovis AF2122/97
caacaccucaccgc

SEQ ID NO: 3181140 - RNA, 19 nt, Mycobacterium bovis subsp bovis AF2122/97
caacaccucguaugccgug

SEQ ID NO: 3181141 - RNA, 19 nt, Mycobacterium bovis subsp bovis AF2122/97
caacaccucgucacccggu

SEQ ID NO: 3181142 - RNA, 12 nt, Mycobacterium bovis subsp bovis AF2122/97
caacacgccggc

SEQ ID NO: 3181143 - RNA, 13 nt, Mycobacterium bovis subsp bovis AF2122/97
caacacgccgucg

SEQ ID NO: 3181144 - RNA, 17 nt, Mycobacterium bovis subsp bovis AF2122/97
caacacgccgucgaccg

SEQ ID NO: 3181145 - RNA, 24 nt, Mycobacterium bovis subsp bovis AF2122/97
caacacggcgaaccggcccaccga

SEQ ID NO: 3181146 - RNA, 12 nt, Mycobacterium bovis subsp bovis AF2122/97
caacacgggcag

SEQ ID NO: 3181147 - RNA, 19 nt, Mycobacterium bovis subsp bovis AF2122/97
caacacgggcagcuucaau

SEQ ID NO: 3181148 - RNA, 12 nt, Mycobacterium bovis subsp bovis AF2122/97
caacacgucgag

SEQ ID NO: 3181149 - RNA, 13 nt, Mycobacterium bovis subsp bovis AF2122/97
caacacgucgagc

SEQ ID NO: 3181150 - RNA, 17 nt, Mycobacterium bovis subsp bovis AF2122/97
caacacgucgagcagcc

SEQ ID NO: 3181151 - RNA, 19 nt, Mycobacterium bovis subsp bovis AF2122/97
caacacgucgagcagccgc

SEQ ID NO: 3181152 - RNA, 20 nt, Mycobacterium bovis subsp bovis AF2122/97
caacacuggggccccgggaa

SEQ ID NO: 3181153 - RNA, 21 nt, Mycobacterium bovis subsp bovis AF2122/97
caacagaccuagcaccgcgcc

SEQ ID NO: 3181154 - RNA, 12 nt, Mycobacterium bovis subsp bovis AF2122/97
caacagcaccag

SEQ ID NO: 3181155 - RNA, 22 nt, Mycobacterium bovis subsp bovis AF2122/97
caacagcacccgggccacgucg

SEQ ID NO: 3181156 - RNA, 16 nt, Mycobacterium bovis subsp bovis AF2122/97
caacagcaccgcgacg

SEQ ID NO: 3181157 - RNA, 18 nt, Mycobacterium bovis subsp bovis AF2122/97
caacagcaccgcgacgac

SEQ ID NO: 3181158 - RNA, 16 nt, Mycobacterium bovis subsp bovis AF2122/97
caacagcacguacugc

SEQ ID NO: 3181159 - RNA, 12 nt, Mycobacterium bovis subsp bovis AF2122/97
caacagccagcu

SEQ ID NO: 3181160 - RNA, 20 nt, Mycobacterium bovis subsp bovis AF2122/97
caacagcccguagcacaccg

SEQ ID NO: 3181161 - RNA, 14 nt, Mycobacterium bovis subsp bovis AF2122/97
caacagcgccagua

SEQ ID NO: 3181162 - RNA, 23 nt, Mycobacterium bovis subsp bovis AF2122/97
caacagcgcuacaaacgauccga

SEQ ID NO: 3181163 - RNA, 14 nt, Mycobacterium bovis subsp bovis AF2122/97
caacagcgcuccag

SEQ ID NO: 3181164 - RNA, 18 nt, Mycobacterium bovis subsp bovis AF2122/97
caacagcgcuccagccgc

SEQ ID NO: 3181165 - RNA, 14 nt, Mycobacterium bovis subsp bovis AF2122/97
caacagcggcaaga

SEQ ID NO: 3181166 - RNA, 20 nt, Mycobacterium bovis subsp bovis AF2122/97
caacagcggggugugcgguu

SEQ ID NO: 3181167 - RNA, 19 nt, Mycobacterium bovis subsp bovis AF2122/97
caacagcuuggagaucgcc

SEQ ID NO: 3181168 - RNA, 14 nt, Mycobacterium bovis subsp bovis AF2122/97
caacaggaacaggc

SEQ ID NO: 3181169 - RNA, 19 nt, Mycobacterium bovis subsp bovis AF2122/97
caacaggaacaggcaaagu

SEQ ID NO: 3181170 - RNA, 22 nt, Mycobacterium bovis subsp bovis AF2122/97
caacaggaccgggaucgucagg

SEQ ID NO: 3181171 - RNA, 13 nt, Mycobacterium bovis subsp bovis AF2122/97
caacaggccaacu

SEQ ID NO: 3181172 - RNA, 22 nt, Mycobacterium bovis subsp bovis AF2122/97
caacaggccaacuuggcggcca

SEQ ID NO: 3181173 - RNA, 16 nt, Mycobacterium bovis subsp bovis AF2122/97
caacaggccggugugc

SEQ ID NO: 3181174 - RNA, 14 nt, Mycobacterium bovis subsp bovis AF2122/97
caacaggccgucga

SEQ ID NO: 3181175 - RNA, 22 nt, Mycobacterium bovis subsp bovis AF2122/97
caacaggccgucgaugaucugc

SEQ ID NO: 3181176 - RNA, 15 nt, Mycobacterium bovis subsp bovis AF2122/97
caacaggcgcgucgg

SEQ ID NO: 3181177 - RNA, 17 nt, Mycobacterium bovis subsp bovis AF2122/97
caacaggcgcgucggug

SEQ ID NO: 3181178 - RNA, 23 nt, Mycobacterium bovis subsp bovis AF2122/97
caacagggcggcaggguguuuau

SEQ ID NO: 3181179 - RNA, 12 nt, Mycobacterium bovis subsp bovis AF2122/97
caacaggguggg

SEQ ID NO: 3181180 - RNA, 15 nt, Mycobacterium bovis subsp bovis AF2122/97
caacagggugggcuu

SEQ ID NO: 3181181 - RNA, 22 nt, Mycobacterium bovis subsp bovis AF2122/97
caacagucgcagcacggcuucg

SEQ ID NO: 3181182 - RNA, 22 nt, Mycobacterium bovis subsp bovis AF2122/97
caacaguucucgcgcuugcgcc

SEQ ID NO: 3181183 - RNA, 13 nt, Mycobacterium bovis subsp bovis AF2122/97
caacaucacugcc

SEQ ID NO: 3181184 - RNA, 15 nt, Mycobacterium bovis subsp bovis AF2122/97
caacaucagcgacag

SEQ ID NO: 3181185 - RNA, 19 nt, Mycobacterium bovis subsp bovis AF2122/97
caacaucagcgacagcgga

SEQ ID NO: 3181186 - RNA, 15 nt, Mycobacterium bovis subsp bovis AF2122/97
caacaucccggaccg

SEQ ID NO: 3181187 - RNA, 19 nt, Mycobacterium bovis subsp bovis AF2122/97
caacaucccggaccgaugg

SEQ ID NO: 3181188 - RNA, 17 nt, Mycobacterium bovis subsp bovis AF2122/97
caacauccugggcaagu

SEQ ID NO: 3181189 - RNA, 19 nt, Mycobacterium bovis subsp bovis AF2122/97
caacaucgccauaccggcc

SEQ ID NO: 3181190 - RNA, 20 nt, Mycobacterium bovis subsp bovis AF2122/97
caacaucgccauaccggccg

SEQ ID NO: 3181191 - RNA, 13 nt, Mycobacterium bovis subsp bovis AF2122/97
caacaucggcccg

SEQ ID NO: 3181192 - RNA, 21 nt, Mycobacterium bovis subsp bovis AF2122/97
caacaucggguucuucaacuc

SEQ ID NO: 3181193 - RNA, 16 nt, Mycobacterium bovis subsp bovis AF2122/97
caacaucuccgcgucg

SEQ ID NO: 3181194 - RNA, 22 nt, Mycobacterium bovis subsp bovis AF2122/97
caacaucuccgcgucggucagc

SEQ ID NO: 3181195 - RNA, 17 nt, Mycobacterium bovis subsp bovis AF2122/97
caacaucuugccgucgg

SEQ ID NO: 3181196 - RNA, 23 nt, Mycobacterium bovis subsp bovis AF2122/97
caacaucuugccgucggccggca

SEQ ID NO: 3181197 - RNA, 17 nt, Mycobacterium bovis subsp bovis AF2122/97
caacaugcccgucagcg

SEQ ID NO: 3181198 - RNA, 20 nt, Mycobacterium bovis subsp bovis AF2122/97
caacaugcccgucagcggac

SEQ ID NO: 3181199 - RNA, 23 nt, Mycobacterium bovis subsp bovis AF2122/97
caacaugccggucauccgggcga

SEQ ID NO: 3181200 - RNA, 14 nt, Mycobacterium bovis subsp bovis AF2122/97
caacaugcuggaga

SEQ ID NO: 3181201 - RNA, 15 nt, Mycobacterium bovis subsp bovis AF2122/97
caacaugcuggagaa

SEQ ID NO: 3181202 - RNA, 15 nt, Mycobacterium bovis subsp bovis AF2122/97
caacaugggugaugc

SEQ ID NO: 3181203 - RNA, 19 nt, Mycobacterium bovis subsp bovis AF2122/97
caacaugucaccugcaucg

SEQ ID NO: 3181204 - RNA, 18 nt, Mycobacterium bovis subsp bovis AF2122/97
caacauguugucgucgcc

SEQ ID NO: 3181205 - RNA, 20 nt, Mycobacterium bovis subsp bovis AF2122/97
caacauguugucgucgccgc

SEQ ID NO: 3181206 - RNA, 18 nt, Mycobacterium bovis subsp bovis AF2122/97
caacauugugcucgccga

SEQ ID NO: 3181207 - RNA, 14 nt, Mycobacterium bovis subsp bovis AF2122/97
caaccaaagcgacg

SEQ ID NO: 3181208 - RNA, 21 nt, Mycobacterium bovis subsp bovis AF2122/97
caaccaaagcgacgagcagca

SEQ ID NO: 3181209 - RNA, 16 nt, Mycobacterium bovis subsp bovis AF2122/97
caaccaaccggucacg

SEQ ID NO: 3181210 - RNA, 23 nt, Mycobacterium bovis subsp bovis AF2122/97
caaccaaccggucacgucgauga

SEQ ID NO: 3181211 - RNA, 16 nt, Mycobacterium bovis subsp bovis AF2122/97
caaccaagcgugccug

SEQ ID NO: 3181212 - RNA, 20 nt, Mycobacterium bovis subsp bovis AF2122/97
caaccaauaggugucgacgc

SEQ ID NO: 3181213 - RNA, 14 nt, Mycobacterium bovis subsp bovis AF2122/97
caaccaccggccgc

SEQ ID NO: 3181214 - RNA, 20 nt, Mycobacterium bovis subsp bovis AF2122/97
caaccaccgguccagcgccg

SEQ ID NO: 3181215 - RNA, 20 nt, Mycobacterium bovis subsp bovis AF2122/97
caaccaccucgugggccacu

SEQ ID NO: 3181216 - RNA, 19 nt, Mycobacterium bovis subsp bovis AF2122/97
caaccacgcacgguggcuc

SEQ ID NO: 3181217 - RNA, 17 nt, Mycobacterium bovis subsp bovis AF2122/97
caaccacggccgccgcg

SEQ ID NO: 3181218 - RNA, 20 nt, Mycobacterium bovis subsp bovis AF2122/97
caaccacggccgccgcgucg

SEQ ID NO: 3181219 - RNA, 16 nt, Mycobacterium bovis subsp bovis AF2122/97
caaccacuuuccggcc

SEQ ID NO: 3181220 - RNA, 15 nt, Mycobacterium bovis subsp bovis AF2122/97
caaccagcaaugccg

SEQ ID NO: 3181221 - RNA, 11 nt, Mycobacterium bovis subsp bovis AF2122/97
caaccagcagc

SEQ ID NO: 3181222 - RNA, 13 nt, Mycobacterium bovis subsp bovis AF2122/97
caaccagcccggc

SEQ ID NO: 3181223 - RNA, 17 nt, Mycobacterium bovis subsp bovis AF2122/97
caaccagcccggccgcc

SEQ ID NO: 3181224 - RNA, 22 nt, Mycobacterium bovis subsp bovis AF2122/97
caaccagcccggccgccgagga

SEQ ID NO: 3181225 - RNA, 21 nt, Mycobacterium bovis subsp bovis AF2122/97
caaccagccuuuccggccgcc

SEQ ID NO: 3181226 - RNA, 19 nt, Mycobacterium bovis subsp bovis AF2122/97
caaccaggaugguugcgac

SEQ ID NO: 3181227 - RNA, 14 nt, Mycobacterium bovis subsp bovis AF2122/97
caaccaggccgcga

SEQ ID NO: 3181228 - RNA, 18 nt, Mycobacterium bovis subsp bovis AF2122/97
caaccaggccgcgacaau

SEQ ID NO: 3181229 - RNA, 19 nt, Mycobacterium bovis subsp bovis AF2122/97
caaccaggccgcgacaaug

SEQ ID NO: 3181230 - RNA, 22 nt, Mycobacterium bovis subsp bovis AF2122/97
caaccaucgguggccaucgcga

SEQ ID NO: 3181231 - RNA, 21 nt, Mycobacterium bovis subsp bovis AF2122/97
caaccaugcgguuagcagccg

SEQ ID NO: 3181232 - RNA, 22 nt, Mycobacterium bovis subsp bovis AF2122/97
caaccaugcgguuagcagccgc

SEQ ID NO: 3181233 - RNA, 17 nt, Mycobacterium bovis subsp bovis AF2122/97
caaccaugcugucggug

SEQ ID NO: 3181234 - RNA, 18 nt, Mycobacterium bovis subsp bovis AF2122/97
caacccaacaaaaggcca

SEQ ID NO: 3181235 - RNA, 20 nt, Mycobacterium bovis subsp bovis AF2122/97
caacccaauugggacgcgcg

SEQ ID NO: 3181236 - RNA, 11 nt, Mycobacterium bovis subsp bovis AF2122/97
caacccacccc

SEQ ID NO: 3181237 - RNA, 19 nt, Mycobacterium bovis subsp bovis AF2122/97
caacccauuucgucagcga

SEQ ID NO: 3181238 - RNA, 13 nt, Mycobacterium bovis subsp bovis AF2122/97
caaccccgagcgg

SEQ ID NO: 3181239 - RNA, 16 nt, Mycobacterium bovis subsp bovis AF2122/97
caaccccgccggccgg

SEQ ID NO: 3181240 - RNA, 16 nt, Mycobacterium bovis subsp bovis AF2122/97
caaccccggugcagau

SEQ ID NO: 3181241 - RNA, 21 nt, Mycobacterium bovis subsp bovis AF2122/97
caaccccuggggugcucgggc

SEQ ID NO: 3181242 - RNA, 21 nt, Mycobacterium bovis subsp bovis AF2122/97
caacccgaucucugcggcggu

SEQ ID NO: 3181243 - RNA, 14 nt, Mycobacterium bovis subsp bovis AF2122/97
caacccgcaccccg

SEQ ID NO: 3181244 - RNA, 17 nt, Mycobacterium bovis subsp bovis AF2122/97
caacccgcaccccggcc

SEQ ID NO: 3181245 - RNA, 22 nt, Mycobacterium bovis subsp bovis AF2122/97
caacccgccguugccaccggug

SEQ ID NO: 3181246 - RNA, 22 nt, Mycobacterium bovis subsp bovis AF2122/97
caacccgcgauucgcggcagcc

SEQ ID NO: 3181247 - RNA, 14 nt, Mycobacterium bovis subsp bovis AF2122/97
caacccgcuuggca

SEQ ID NO: 3181248 - RNA, 21 nt, Mycobacterium bovis subsp bovis AF2122/97
caacccggacgaacgccgucg

SEQ ID NO: 3181249 - RNA, 16 nt, Mycobacterium bovis subsp bovis AF2122/97
caacccggcgucgacg

SEQ ID NO: 3181250 - RNA, 18 nt, Mycobacterium bovis subsp bovis AF2122/97
caacccggcgucgacgau

SEQ ID NO: 3181251 - RNA, 12 nt, Mycobacterium bovis subsp bovis AF2122/97
caacccggcucg

SEQ ID NO: 3181252 - RNA, 13 nt, Mycobacterium bovis subsp bovis AF2122/97
caacccgggcagc

SEQ ID NO: 3181253 - RNA, 22 nt, Mycobacterium bovis subsp bovis AF2122/97
caacccgggcagcaucaacacc

SEQ ID NO: 3181254 - RNA, 14 nt, Mycobacterium bovis subsp bovis AF2122/97
caacccgggccgcc

SEQ ID NO: 3181255 - RNA, 17 nt, Mycobacterium bovis subsp bovis AF2122/97
caacccgggccgccagg

SEQ ID NO: 3181256 - RNA, 21 nt, Mycobacterium bovis subsp bovis AF2122/97
caacccgggccgccagggccc

SEQ ID NO: 3181257 - RNA, 19 nt, Mycobacterium bovis subsp bovis AF2122/97
caacccgguccagccggua

SEQ ID NO: 3181258 - RNA, 13 nt, Mycobacterium bovis subsp bovis AF2122/97
caacccggugaug

SEQ ID NO: 3181259 - RNA, 23 nt, Mycobacterium bovis subsp bovis AF2122/97
caacccggugauggugugcagca

SEQ ID NO: 3181260 - RNA, 17 nt, Mycobacterium bovis subsp bovis AF2122/97
caacccgucgagccgug

SEQ ID NO: 3181261 - RNA, 19 nt, Mycobacterium bovis subsp bovis AF2122/97
caacccgucgagccgugcc

SEQ ID NO: 3181262 - RNA, 17 nt, Mycobacterium bovis subsp bovis AF2122/97
caacccuaaaccagcca

SEQ ID NO: 3181263 - RNA, 17 nt, Mycobacterium bovis subsp bovis AF2122/97
caacccucgccggucag

SEQ ID NO: 3181264 - RNA, 17 nt, Mycobacterium bovis subsp bovis AF2122/97
caacccugcccggcccg

SEQ ID NO: 3181265 - RNA, 17 nt, Mycobacterium bovis subsp bovis AF2122/97
caacccugcggcgucgu

SEQ ID NO: 3181266 - RNA, 15 nt, Mycobacterium bovis subsp bovis AF2122/97
caacccugcggugca

SEQ ID NO: 3181267 - RNA, 18 nt, Mycobacterium bovis subsp bovis AF2122/97
caacccugcggugcagga

SEQ ID NO: 3181268 - RNA, 22 nt, Mycobacterium bovis subsp bovis AF2122/97
caacccuucggcauucgcacca

SEQ ID NO: 3181269 - RNA, 14 nt, Mycobacterium bovis subsp bovis AF2122/97
caaccgaaccgcgu

SEQ ID NO: 3181270 - RNA, 20 nt, Mycobacterium bovis subsp bovis AF2122/97
caaccgaauccaucgagacc

SEQ ID NO: 3181271 - RNA, 15 nt, Mycobacterium bovis subsp bovis AF2122/97
caaccgagcggucga

SEQ ID NO: 3181272 - RNA, 20 nt, Mycobacterium bovis subsp bovis AF2122/97
caaccgagcggucgaucuga

SEQ ID NO: 3181273 - RNA, 18 nt, Mycobacterium bovis subsp bovis AF2122/97
caaccgaucggucguccg

SEQ ID NO: 3181274 - RNA, 19 nt, Mycobacterium bovis subsp bovis AF2122/97
caaccgaugacgcguucaa

SEQ ID NO: 3181275 - RNA, 14 nt, Mycobacterium bovis subsp bovis AF2122/97
caaccgcaggccga

SEQ ID NO: 3181276 - RNA, 11 nt, Mycobacterium bovis subsp bovis AF2122/97
caaccgcccgu

SEQ ID NO: 3181277 - RNA, 12 nt, Mycobacterium bovis subsp bovis AF2122/97
caaccgccgcca

SEQ ID NO: 3181278 - RNA, 15 nt, Mycobacterium bovis subsp bovis AF2122/97
caaccgccgccacca

SEQ ID NO: 3181279 - RNA, 21 nt, Mycobacterium bovis subsp bovis AF2122/97
caaccgccgccaccagggcgg

SEQ ID NO: 3181280 - RNA, 14 nt, Mycobacterium bovis subsp bovis AF2122/97
caaccgccgcucca

SEQ ID NO: 3181281 - RNA, 15 nt, Mycobacterium bovis subsp bovis AF2122/97
caaccgcgcccuagc

SEQ ID NO: 3181282 - RNA, 22 nt, Mycobacterium bovis subsp bovis AF2122/97
caaccgcgcuuucgagugcagc

SEQ ID NO: 3181283 - RNA, 19 nt, Mycobacterium bovis subsp bovis AF2122/97
caaccgcggccccgacugc

SEQ ID NO: 3181284 - RNA, 20 nt, Mycobacterium bovis subsp bovis AF2122/97
caaccgcgugcgucagcgcc

SEQ ID NO: 3181285 - RNA, 14 nt, Mycobacterium bovis subsp bovis AF2122/97
caaccgcucggcga

SEQ ID NO: 3181286 - RNA, 14 nt, Mycobacterium bovis subsp bovis AF2122/97
caaccgcugcugcu

SEQ ID NO: 3181287 - RNA, 21 nt, Mycobacterium bovis subsp bovis AF2122/97
caaccgcuuugaauugcgcgc

SEQ ID NO: 3181288 - RNA, 18 nt, Mycobacterium bovis subsp bovis AF2122/97
caaccggacgcccucacg

SEQ ID NO: 3181289 - RNA, 20 nt, Mycobacterium bovis subsp bovis AF2122/97
caaccggauugagcacgcgc

SEQ ID NO: 3181290 - RNA, 17 nt, Mycobacterium bovis subsp bovis AF2122/97
caaccggcgcaguagcc

SEQ ID NO: 3181291 - RNA, 21 nt, Mycobacterium bovis subsp bovis AF2122/97
caaccggcgcaguagccgacc

SEQ ID NO: 3181292 - RNA, 22 nt, Mycobacterium bovis subsp bovis AF2122/97
caaccggcgcaguagccgacca

SEQ ID NO: 3181293 - RNA, 15 nt, Mycobacterium bovis subsp bovis AF2122/97
caaccggcgugucga

SEQ ID NO: 3181294 - RNA, 19 nt, Mycobacterium bovis subsp bovis AF2122/97
caaccgggucagcccagcc

SEQ ID NO: 3181295 - RNA, 17 nt, Mycobacterium bovis subsp bovis AF2122/97
caaccgggugugcgucg

SEQ ID NO: 3181296 - RNA, 20 nt, Mycobacterium bovis subsp bovis AF2122/97
caaccgggugugcgucgagg

SEQ ID NO: 3181297 - RNA, 19 nt, Mycobacterium bovis subsp bovis AF2122/97
caaccgguagccaggcgcg

SEQ ID NO: 3181298 - RNA, 18 nt, Mycobacterium bovis subsp bovis AF2122/97
caaccggucacgucgaug

SEQ ID NO: 3181299 - RNA, 18 nt, Mycobacterium bovis subsp bovis AF2122/97
caaccggucagccugcca

SEQ ID NO: 3181300 - RNA, 12 nt, Mycobacterium bovis subsp bovis AF2122/97
caaccgguccag

SEQ ID NO: 3181301 - RNA, 13 nt, Mycobacterium bovis subsp bovis AF2122/97
caaccgguccagg

SEQ ID NO: 3181302 - RNA, 15 nt, Mycobacterium bovis subsp bovis AF2122/97
caaccggucgugguc

SEQ ID NO: 3181303 - RNA, 22 nt, Mycobacterium bovis subsp bovis AF2122/97
caaccgguguaauugccgacgc

SEQ ID NO: 3181304 - RNA, 20 nt, Mycobacterium bovis subsp bovis AF2122/97
caaccgucccaaugcaacaa

SEQ ID NO: 3181305 - RNA, 13 nt, Mycobacterium bovis subsp bovis AF2122/97
caaccguccccgg

SEQ ID NO: 3181306 - RNA, 15 nt, Mycobacterium bovis subsp bovis AF2122/97
caaccgucgaaaaau

SEQ ID NO: 3181307 - RNA, 23 nt, Mycobacterium bovis subsp bovis AF2122/97
caaccgucggugaaauucgcggc

SEQ ID NO: 3181308 - RNA, 22 nt, Mycobacterium bovis subsp bovis AF2122/97
caaccgugaacucgcgcgucgu

SEQ ID NO: 3181309 - RNA, 17 nt, Mycobacterium bovis subsp bovis AF2122/97
caaccgugagcaccagc

SEQ ID NO: 3181310 - RNA, 18 nt, Mycobacterium bovis subsp bovis AF2122/97
caaccgugagcaccagca

SEQ ID NO: 3181311 - RNA, 19 nt, Mycobacterium bovis subsp bovis AF2122/97
caaccgugccgcaucaccc

SEQ ID NO: 3181312 - RNA, 17 nt, Mycobacterium bovis subsp bovis AF2122/97
caaccucaucgcggucg

SEQ ID NO: 3181313 - RNA, 16 nt, Mycobacterium bovis subsp bovis AF2122/97
caaccucaugcacgcc

SEQ ID NO: 3181314 - RNA, 19 nt, Mycobacterium bovis subsp bovis AF2122/97
caaccucgucgucaucgag

SEQ ID NO: 3181315 - RNA, 12 nt, Mycobacterium bovis subsp bovis AF2122/97
caaccucuggcg

SEQ ID NO: 3181316 - RNA, 14 nt, Mycobacterium bovis subsp bovis AF2122/97
caaccucuggcggc

SEQ ID NO: 3181317 - RNA, 17 nt, Mycobacterium bovis subsp bovis AF2122/97
caaccugaaccggccgc

SEQ ID NO: 3181318 - RNA, 18 nt, Mycobacterium bovis subsp bovis AF2122/97
caaccugaaccggccgcg

SEQ ID NO: 3181319 - RNA, 21 nt, Mycobacterium bovis subsp bovis AF2122/97
caaccugagcaucuccucgcc

SEQ ID NO: 3181320 - RNA, 15 nt, Mycobacterium bovis subsp bovis AF2122/97
caaccugccgggcca

SEQ ID NO: 3181321 - RNA, 18 nt, Mycobacterium bovis subsp bovis AF2122/97
caaccugccgggccacgg

SEQ ID NO: 3181322 - RNA, 23 nt, Mycobacterium bovis subsp bovis AF2122/97
caaccugcgaccaggcgcggcga

SEQ ID NO: 3181323 - RNA, 16 nt, Mycobacterium bovis subsp bovis AF2122/97
caaccugcgcggcgau

SEQ ID NO: 3181324 - RNA, 22 nt, Mycobacterium bovis subsp bovis AF2122/97
caaccuggacugcagcgccucg

SEQ ID NO: 3181325 - RNA, 23 nt, Mycobacterium bovis subsp bovis AF2122/97
caaccuggacugggucgccuccu

SEQ ID NO: 3181326 - RNA, 22 nt, Mycobacterium bovis subsp bovis AF2122/97
caaccugggccaucacggucag

SEQ ID NO: 3181327 - RNA, 16 nt, Mycobacterium bovis subsp bovis AF2122/97
caaccuggggccacca

SEQ ID NO: 3181328 - RNA, 19 nt, Mycobacterium bovis subsp bovis AF2122/97
caaccuguuccagcgugcc

SEQ ID NO: 3181329 - RNA, 23 nt, Mycobacterium bovis subsp bovis AF2122/97
caaccuguuccagcgugccuggu

SEQ ID NO: 3181330 - RNA, 16 nt, Mycobacterium bovis subsp bovis AF2122/97
caaccuucgugucuau

SEQ ID NO: 3181331 - RNA, 19 nt, Mycobacterium bovis subsp bovis AF2122/97
caacgaaaauuugacgacg

SEQ ID NO: 3181332 - RNA, 14 nt, Mycobacterium bovis subsp bovis AF2122/97
caacgaaaccgacc

SEQ ID NO: 3181333 - RNA, 23 nt, Mycobacterium bovis subsp bovis AF2122/97
caacgaaaccgaccuacugcggu

SEQ ID NO: 3181334 - RNA, 20 nt, Mycobacterium bovis subsp bovis AF2122/97
caacgaaccgcucagcgcag

SEQ ID NO: 3181335 - RNA, 15 nt, Mycobacterium bovis subsp bovis AF2122/97
caacgaacgaugggg

SEQ ID NO: 3181336 - RNA, 17 nt, Mycobacterium bovis subsp bovis AF2122/97
caacgaagagggcgccg

SEQ ID NO: 3181337 - RNA, 19 nt, Mycobacterium bovis subsp bovis AF2122/97
caacgaagagggcgccgcg

SEQ ID NO: 3181338 - RNA, 21 nt, Mycobacterium bovis subsp bovis AF2122/97
caacgaagagggcgccgcgcg

SEQ ID NO: 3181339 - RNA, 13 nt, Mycobacterium bovis subsp bovis AF2122/97
caacgaagccggc

SEQ ID NO: 3181340 - RNA, 18 nt, Mycobacterium bovis subsp bovis AF2122/97
caacgaagccggcgccgg

SEQ ID NO: 3181341 - RNA, 22 nt, Mycobacterium bovis subsp bovis AF2122/97
caacgacaaaccgggcgugcca

SEQ ID NO: 3181342 - RNA, 17 nt, Mycobacterium bovis subsp bovis AF2122/97
caacgacaacacccacg

SEQ ID NO: 3181343 - RNA, 23 nt, Mycobacterium bovis subsp bovis AF2122/97
caacgacaccagaucguuccagg

SEQ ID NO: 3181344 - RNA, 20 nt, Mycobacterium bovis subsp bovis AF2122/97
caacgacaccauaggccgac

SEQ ID NO: 3181345 - RNA, 21 nt, Mycobacterium bovis subsp bovis AF2122/97
caacgacaggcgcccacaaau

SEQ ID NO: 3181346 - RNA, 22 nt, Mycobacterium bovis subsp bovis AF2122/97
caacgacaggcgcccacaaaua

SEQ ID NO: 3181347 - RNA, 18 nt, Mycobacterium bovis subsp bovis AF2122/97
caacgacauugccacggc

SEQ ID NO: 3181348 - RNA, 16 nt, Mycobacterium bovis subsp bovis AF2122/97
caacgaccaccaccaa

SEQ ID NO: 3181349 - RNA, 15 nt, Mycobacterium bovis subsp bovis AF2122/97
caacgacccgccgcc

SEQ ID NO: 3181350 - RNA, 16 nt, Mycobacterium bovis subsp bovis AF2122/97
caacgacccgccgccc

SEQ ID NO: 3181351 - RNA, 16 nt, Mycobacterium bovis subsp bovis AF2122/97
caacgacggcaacagc

SEQ ID NO: 3181352 - RNA, 14 nt, Mycobacterium bovis subsp bovis AF2122/97
caacgacggcaagc

SEQ ID NO: 3181353 - RNA, 17 nt, Mycobacterium bovis subsp bovis AF2122/97
caacgacgucgccgacc

SEQ ID NO: 3181354 - RNA, 14 nt, Mycobacterium bovis subsp bovis AF2122/97
caacgacguugauc

SEQ ID NO: 3181355 - RNA, 20 nt, Mycobacterium bovis subsp bovis AF2122/97
caacgacucacccacccgca

SEQ ID NO: 3181356 - RNA, 23 nt, Mycobacterium bovis subsp bovis AF2122/97
caacgacucucaucaacucgacc

SEQ ID NO: 3181357 - RNA, 18 nt, Mycobacterium bovis subsp bovis AF2122/97
caacgacugaucaagugc

SEQ ID NO: 3181358 - RNA, 14 nt, Mycobacterium bovis subsp bovis AF2122/97
caacgacugcauga

SEQ ID NO: 3181359 - RNA, 17 nt, Mycobacterium bovis subsp bovis AF2122/97
caacgacuguggcgccg

SEQ ID NO: 3181360 - RNA, 19 nt, Mycobacterium bovis subsp bovis AF2122/97
caacgacuguggcgccgcc

SEQ ID NO: 3181361 - RNA, 20 nt, Mycobacterium bovis subsp bovis AF2122/97
caacgacuguggcgccgccg

SEQ ID NO: 3181362 - RNA, 18 nt, Mycobacterium bovis subsp bovis AF2122/97
caacgacuucgggaacgc

SEQ ID NO: 3181363 - RNA, 21 nt, Mycobacterium bovis subsp bovis AF2122/97
caacgacuucgggaacgcucg

SEQ ID NO: 3181364 - RNA, 21 nt, Mycobacterium bovis subsp bovis AF2122/97
caacgagcaggauaaacccgg

SEQ ID NO: 3181365 - RNA, 15 nt, Mycobacterium bovis subsp bovis AF2122/97
caacgagcgcgcugc

SEQ ID NO: 3181366 - RNA, 17 nt, Mycobacterium bovis subsp bovis AF2122/97
caacgaggccgacgaca

SEQ ID NO: 3181367 - RNA, 17 nt, Mycobacterium bovis subsp bovis AF2122/97
caacgaggucugcggcc

SEQ ID NO: 3181368 - RNA, 21 nt, Mycobacterium bovis subsp bovis AF2122/97
caacgaggucugcggccgaua

SEQ ID NO: 3181369 - RNA, 21 nt, Mycobacterium bovis subsp bovis AF2122/97
caacgagucagugccaucuac

SEQ ID NO: 3181370 - RNA, 19 nt, Mycobacterium bovis subsp bovis AF2122/97
caacgaucagguuggcggc

SEQ ID NO: 3181371 - RNA, 14 nt, Mycobacterium bovis subsp bovis AF2122/97
caacgaucgcgccg

SEQ ID NO: 3181372 - RNA, 15 nt, Mycobacterium bovis subsp bovis AF2122/97
caacgaucgcgccgu

SEQ ID NO: 3181373 - RNA, 17 nt, Mycobacterium bovis subsp bovis AF2122/97
caacgaucgcgccgucg

SEQ ID NO: 3181374 - RNA, 21 nt, Mycobacterium bovis subsp bovis AF2122/97
caacgaucgcgccgucgucga

SEQ ID NO: 3181375 - RNA, 14 nt, Mycobacterium bovis subsp bovis AF2122/97
caacgaucgcgcga

SEQ ID NO: 3181376 - RNA, 20 nt, Mycobacterium bovis subsp bovis AF2122/97
caacgaucgcgcgagcgaug

SEQ ID NO: 3181377 - RNA, 15 nt, Mycobacterium bovis subsp bovis AF2122/97
caacgaugaugauga

SEQ ID NO: 3181378 - RNA, 18 nt, Mycobacterium bovis subsp bovis AF2122/97
caacgauggaacgggcgg

SEQ ID NO: 3181379 - RNA, 14 nt, Mycobacterium bovis subsp bovis AF2122/97
caacgaugguggcg

SEQ ID NO: 3181380 - RNA, 21 nt, Mycobacterium bovis subsp bovis AF2122/97
caacgauugcgaagggcaccg

SEQ ID NO: 3181381 - RNA, 16 nt, Mycobacterium bovis subsp bovis AF2122/97
caacgcaacacgggcg

SEQ ID NO: 3181382 - RNA, 17 nt, Mycobacterium bovis subsp bovis AF2122/97
caacgcaacacgggcgc

SEQ ID NO: 3181383 - RNA, 18 nt, Mycobacterium bovis subsp bovis AF2122/97
caacgcaacacgggcgcc

SEQ ID NO: 3181384 - RNA, 23 nt, Mycobacterium bovis subsp bovis AF2122/97
caacgcaacacgggcgccggaac

SEQ ID NO: 3181385 - RNA, 16 nt, Mycobacterium bovis subsp bovis AF2122/97
caacgcaacggugauc

SEQ ID NO: 3181386 - RNA, 20 nt, Mycobacterium bovis subsp bovis AF2122/97
caacgcaauauccuccagca

SEQ ID NO: 3181387 - RNA, 23 nt, Mycobacterium bovis subsp bovis AF2122/97
caacgcaaugccaaucgcacugg

SEQ ID NO: 3181388 - RNA, 13 nt, Mycobacterium bovis subsp bovis AF2122/97
caacgcacacacc

SEQ ID NO: 3181389 - RNA, 19 nt, Mycobacterium bovis subsp bovis AF2122/97
caacgcaucgguggcacgc

SEQ ID NO: 3181390 - RNA, 16 nt, Mycobacterium bovis subsp bovis AF2122/97
caacgccaacgccacg

SEQ ID NO: 3181391 - RNA, 16 nt, Mycobacterium bovis subsp bovis AF2122/97
caacgccacgccgaug

SEQ ID NO: 3181392 - RNA, 23 nt, Mycobacterium bovis subsp bovis AF2122/97
caacgccacugcgccgugaccca

SEQ ID NO: 3181393 - RNA, 16 nt, Mycobacterium bovis subsp bovis AF2122/97
caacgccagcaccagc

SEQ ID NO: 3181394 - RNA, 21 nt, Mycobacterium bovis subsp bovis AF2122/97
caacgccagcaccagcgucgc

SEQ ID NO: 3181395 - RNA, 23 nt, Mycobacterium bovis subsp bovis AF2122/97
caacgccagcaccagcgucgcgg

SEQ ID NO: 3181396 - RNA, 15 nt, Mycobacterium bovis subsp bovis AF2122/97
caacgcccaccacgc

SEQ ID NO: 3181397 - RNA, 19 nt, Mycobacterium bovis subsp bovis AF2122/97
caacgcccccauccggucg

SEQ ID NO: 3181398 - RNA, 20 nt, Mycobacterium bovis subsp bovis AF2122/97
caacgcccccauccggucga

SEQ ID NO: 3181399 - RNA, 22 nt, Mycobacterium bovis subsp bovis AF2122/97
caacgcccccauccggucgaug

SEQ ID NO: 3181400 - RNA, 23 nt, Mycobacterium bovis subsp bovis AF2122/97
caacgcccccauccggucgaugu

SEQ ID NO: 3181401 - RNA, 15 nt, Mycobacterium bovis subsp bovis AF2122/97
caacgcccgcaucgc

SEQ ID NO: 3181402 - RNA, 20 nt, Mycobacterium bovis subsp bovis AF2122/97
caacgcccgcaucgccucga

SEQ ID NO: 3181403 - RNA, 23 nt, Mycobacterium bovis subsp bovis AF2122/97
caacgcccgggcgaauccggcgg

SEQ ID NO: 3181404 - RNA, 20 nt, Mycobacterium bovis subsp bovis AF2122/97
caacgccgauggcuuggugc

SEQ ID NO: 3181405 - RNA, 13 nt, Mycobacterium bovis subsp bovis AF2122/97
caacgccgcgccg

SEQ ID NO: 3181406 - RNA, 14 nt, Mycobacterium bovis subsp bovis AF2122/97
caacgccgcgccgu

SEQ ID NO: 3181407 - RNA, 23 nt, Mycobacterium bovis subsp bovis AF2122/97
caacgccgggcuguucggccaug

SEQ ID NO: 3181408 - RNA, 20 nt, Mycobacterium bovis subsp bovis AF2122/97
caacgccucgccauccauga

SEQ ID NO: 3181409 - RNA, 14 nt, Mycobacterium bovis subsp bovis AF2122/97
caacgcgaaccggc

SEQ ID NO: 3181410 - RNA, 15 nt, Mycobacterium bovis subsp bovis AF2122/97
caacgcgaaccggcc

SEQ ID NO: 3181411 - RNA, 19 nt, Mycobacterium bovis subsp bovis AF2122/97
caacgcgaaccggccaucg

SEQ ID NO: 3181412 - RNA, 17 nt, Mycobacterium bovis subsp bovis AF2122/97
caacgcgaaccgucucg

SEQ ID NO: 3181413 - RNA, 14 nt, Mycobacterium bovis subsp bovis AF2122/97
caacgcgacgccgc

SEQ ID NO: 3181414 - RNA, 15 nt, Mycobacterium bovis subsp bovis AF2122/97
caacgcgacgccgcu

SEQ ID NO: 3181415 - RNA, 21 nt, Mycobacterium bovis subsp bovis AF2122/97
caacgcgacgccgcucccgca

SEQ ID NO: 3181416 - RNA, 13 nt, Mycobacterium bovis subsp bovis AF2122/97
caacgcgaugccg

SEQ ID NO: 3181417 - RNA, 17 nt, Mycobacterium bovis subsp bovis AF2122/97
caacgcgaugccgucca

SEQ ID NO: 3181418 - RNA, 16 nt, Mycobacterium bovis subsp bovis AF2122/97
caacgcgauguccagg

SEQ ID NO: 3181419 - RNA, 15 nt, Mycobacterium bovis subsp bovis AF2122/97
caacgcgcaaccagc

SEQ ID NO: 3181420 - RNA, 17 nt, Mycobacterium bovis subsp bovis AF2122/97
caacgcgcaccuggcgc

SEQ ID NO: 3181421 - RNA, 18 nt, Mycobacterium bovis subsp bovis AF2122/97
caacgcgcaccuggcgcg

SEQ ID NO: 3181422 - RNA, 14 nt, Mycobacterium bovis subsp bovis AF2122/97
caacgcgcggcucg

SEQ ID NO: 3181423 - RNA, 15 nt, Mycobacterium bovis subsp bovis AF2122/97
caacgcgcggcucga

SEQ ID NO: 3181424 - RNA, 22 nt, Mycobacterium bovis subsp bovis AF2122/97
caacgcggcaccuucggcccau

SEQ ID NO: 3181425 - RNA, 11 nt, Mycobacterium bovis subsp bovis AF2122/97
caacgcggcga

SEQ ID NO: 3181426 - RNA, 22 nt, Mycobacterium bovis subsp bovis AF2122/97
caacgcggcgcgagccugcucu

SEQ ID NO: 3181427 - RNA, 21 nt, Mycobacterium bovis subsp bovis AF2122/97
caacgcgggaacgaugccgcc

SEQ ID NO: 3181428 - RNA, 22 nt, Mycobacterium bovis subsp bovis AF2122/97
caacgcgggaacgaugccgccg

SEQ ID NO: 3181429 - RNA, 14 nt, Mycobacterium bovis subsp bovis AF2122/97
caacgcggucugcu

SEQ ID NO: 3181430 - RNA, 18 nt, Mycobacterium bovis subsp bovis AF2122/97
caacgcggugacgauugc

SEQ ID NO: 3181431 - RNA, 12 nt, Mycobacterium bovis subsp bovis AF2122/97
caacgcggugcc

SEQ ID NO: 3181432 - RNA, 14 nt, Mycobacterium bovis subsp bovis AF2122/97
caacgcggugccgg

SEQ ID NO: 3181433 - RNA, 22 nt, Mycobacterium bovis subsp bovis AF2122/97
caacgcggugggcacagccagu

SEQ ID NO: 3181434 - RNA, 19 nt, Mycobacterium bovis subsp bovis AF2122/97
caacgcguauucggcaucg

SEQ ID NO: 3181435 - RNA, 14 nt, Mycobacterium bovis subsp bovis AF2122/97
caacgcgucccgcc

SEQ ID NO: 3181436 - RNA, 17 nt, Mycobacterium bovis subsp bovis AF2122/97
caacgcguugcacagca

SEQ ID NO: 3181437 - RNA, 17 nt, Mycobacterium bovis subsp bovis AF2122/97
caacgcugcggcagguc

SEQ ID NO: 3181438 - RNA, 15 nt, Mycobacterium bovis subsp bovis AF2122/97
caacgcuucggcacg

SEQ ID NO: 3181439 - RNA, 23 nt, Mycobacterium bovis subsp bovis AF2122/97
caacgcuucggcacgcuugaugu

SEQ ID NO: 3181440 - RNA, 18 nt, Mycobacterium bovis subsp bovis AF2122/97
caacgcuucggcagcucc

SEQ ID NO: 3181441 - RNA, 15 nt, Mycobacterium bovis subsp bovis AF2122/97
caacgcuucggcgug

SEQ ID NO: 3181442 - RNA, 19 nt, Mycobacterium bovis subsp bovis AF2122/97
caacgcuucggcgugcgug

SEQ ID NO: 3181443 - RNA, 14 nt, Mycobacterium bovis subsp bovis AF2122/97
caacgcuucugccu

SEQ ID NO: 3181444 - RNA, 18 nt, Mycobacterium bovis subsp bovis AF2122/97
caacgcuucugccugcgc

SEQ ID NO: 3181445 - RNA, 21 nt, Mycobacterium bovis subsp bovis AF2122/97
caacggaagaagcaguagcug

SEQ ID NO: 3181446 - RNA, 16 nt, Mycobacterium bovis subsp bovis AF2122/97
caacggaagaccgcgg

SEQ ID NO: 3181447 - RNA, 11 nt, Mycobacterium bovis subsp bovis AF2122/97
caacggaaucu

SEQ ID NO: 3181448 - RNA, 20 nt, Mycobacterium bovis subsp bovis AF2122/97
caacggaaucucuucggcgg

SEQ ID NO: 3181449 - RNA, 22 nt, Mycobacterium bovis subsp bovis AF2122/97
caacggacgaagcaccucccga

SEQ ID NO: 3181450 - RNA, 22 nt, Mycobacterium bovis subsp bovis AF2122/97
caacggacgggaucgcccaggc

SEQ ID NO: 3181451 - RNA, 18 nt, Mycobacterium bovis subsp bovis AF2122/97
caacggaggugccggcgc

SEQ ID NO: 3181452 - RNA, 16 nt, Mycobacterium bovis subsp bovis AF2122/97
caacggagugucgaug

SEQ ID NO: 3181453 - RNA, 23 nt, Mycobacterium bovis subsp bovis AF2122/97
caacggagugucgaugcgcgccg

SEQ ID NO: 3181454 - RNA, 13 nt, Mycobacterium bovis subsp bovis AF2122/97
caacggcacccga

SEQ ID NO: 3181455 - RNA, 17 nt, Mycobacterium bovis subsp bovis AF2122/97
caacggcacccgaaaac

SEQ ID NO: 3181456 - RNA, 12 nt, Mycobacterium bovis subsp bovis AF2122/97
caacggcacccu

SEQ ID NO: 3181457 - RNA, 19 nt, Mycobacterium bovis subsp bovis AF2122/97
caacggcacuagcccgacc

SEQ ID NO: 3181458 - RNA, 20 nt, Mycobacterium bovis subsp bovis AF2122/97
caacggcacuagcccgaccg

SEQ ID NO: 3181459 - RNA, 23 nt, Mycobacterium bovis subsp bovis AF2122/97
caacggcagaucccacgccagga

SEQ ID NO: 3181460 - RNA, 17 nt, Mycobacterium bovis subsp bovis AF2122/97
caacggccacaugccac

SEQ ID NO: 3181461 - RNA, 14 nt, Mycobacterium bovis subsp bovis AF2122/97
caacggcgcgccga

SEQ ID NO: 3181462 - RNA, 15 nt, Mycobacterium bovis subsp bovis AF2122/97
caacggcgcgccgac

SEQ ID NO: 3181463 - RNA, 16 nt, Mycobacterium bovis subsp bovis AF2122/97
caacggcgcgccgacc

SEQ ID NO: 3181464 - RNA, 13 nt, Mycobacterium bovis subsp bovis AF2122/97
caacggcgcggca

SEQ ID NO: 3181465 - RNA, 18 nt, Mycobacterium bovis subsp bovis AF2122/97
caacggcggaucggcggc

SEQ ID NO: 3181466 - RNA, 16 nt, Mycobacterium bovis subsp bovis AF2122/97
caacggcggcaacggc

SEQ ID NO: 3181467 - RNA, 16 nt, Mycobacterium bovis subsp bovis AF2122/97
caacggcggcaggccg

SEQ ID NO: 3181468 - RNA, 18 nt, Mycobacterium bovis subsp bovis AF2122/97
caacggcggcaggccggc

SEQ ID NO: 3181469 - RNA, 19 nt, Mycobacterium bovis subsp bovis AF2122/97
caacggcggcaggccggcc

SEQ ID NO: 3181470 - RNA, 22 nt, Mycobacterium bovis subsp bovis AF2122/97
caacggcggcaggccggccacc

SEQ ID NO: 3181471 - RNA, 14 nt, Mycobacterium bovis subsp bovis AF2122/97
caacggcggcaucg

SEQ ID NO: 3181472 - RNA, 17 nt, Mycobacterium bovis subsp bovis AF2122/97
caacggcggcaucggcg

SEQ ID NO: 3181473 - RNA, 20 nt, Mycobacterium bovis subsp bovis AF2122/97
caacggcggcaucggcggca

SEQ ID NO: 3181474 - RNA, 19 nt, Mycobacterium bovis subsp bovis AF2122/97
caacggcggcgacggcgga

SEQ ID NO: 3181475 - RNA, 15 nt, Mycobacterium bovis subsp bovis AF2122/97
caacggcggcgucgc

SEQ ID NO: 3181476 - RNA, 15 nt, Mycobacterium bovis subsp bovis AF2122/97
caacggcggcguggg

SEQ ID NO: 3181477 - RNA, 22 nt, Mycobacterium bovis subsp bovis AF2122/97
caacggcggggccggcggcucg

SEQ ID NO: 3181478 - RNA, 18 nt, Mycobacterium bovis subsp bovis AF2122/97
caacggcgguaacggcgg

SEQ ID NO: 3181479 - RNA, 20 nt, Mycobacterium bovis subsp bovis AF2122/97
caacggcguaaucgggaagu

SEQ ID NO: 3181480 - RNA, 17 nt, Mycobacterium bovis subsp bovis AF2122/97
caacggcguuggcgccg

SEQ ID NO: 3181481 - RNA, 17 nt, Mycobacterium bovis subsp bovis AF2122/97
caacgggauccgcgcgc

SEQ ID NO: 3181482 - RNA, 24 nt, Mycobacterium bovis subsp bovis AF2122/97
caacgggccauggguagccgccca

SEQ ID NO: 3181483 - RNA, 15 nt, Mycobacterium bovis subsp bovis AF2122/97
caacgggccgcaucg

SEQ ID NO: 3181484 - RNA, 20 nt, Mycobacterium bovis subsp bovis AF2122/97
caacgggccuucagcucacc

SEQ ID NO: 3181485 - RNA, 22 nt, Mycobacterium bovis subsp bovis AF2122/97
caacgggccuucagcucaccac

SEQ ID NO: 3181486 - RNA, 16 nt, Mycobacterium bovis subsp bovis AF2122/97
caacgggggcgccgga

SEQ ID NO: 3181487 - RNA, 14 nt, Mycobacterium bovis subsp bovis AF2122/97
caacggguacaccc

SEQ ID NO: 3181488 - RNA, 15 nt, Mycobacterium bovis subsp bovis AF2122/97
caacgggugucggcg

SEQ ID NO: 3181489 - RNA, 16 nt, Mycobacterium bovis subsp bovis AF2122/97
caacggguugucguug

SEQ ID NO: 3181490 - RNA, 21 nt, Mycobacterium bovis subsp bovis AF2122/97
caacggucaaucccggccagg

SEQ ID NO: 3181491 - RNA, 19 nt, Mycobacterium bovis subsp bovis AF2122/97
caacggucucaacgcaucg

SEQ ID NO: 3181492 - RNA, 16 nt, Mycobacterium bovis subsp bovis AF2122/97
caacggugcucuucga

SEQ ID NO: 3181493 - RNA, 23 nt, Mycobacterium bovis subsp bovis AF2122/97
caacgguggcaacggaggugccg

SEQ ID NO: 3181494 - RNA, 23 nt, Mycobacterium bovis subsp bovis AF2122/97
caacggugggugggcgccgcaac

SEQ ID NO: 3181495 - RNA, 17 nt, Mycobacterium bovis subsp bovis AF2122/97
caacguacgcacgcagc

SEQ ID NO: 3181496 - RNA, 16 nt, Mycobacterium bovis subsp bovis AF2122/97
caacguagccagcagc

SEQ ID NO: 3181497 - RNA, 20 nt, Mycobacterium bovis subsp bovis AF2122/97
caacguagccagcagcggcu

SEQ ID NO: 3181498 - RNA, 14 nt, Mycobacterium bovis subsp bovis AF2122/97
caacgucacgucga

SEQ ID NO: 3181499 - RNA, 20 nt, Mycobacterium bovis subsp bovis AF2122/97
caacgucgacuucagcggcc

SEQ ID NO: 3181500 - RNA, 21 nt, Mycobacterium bovis subsp bovis AF2122/97
caacgucgagauccucgucga

SEQ ID NO: 3181501 - RNA, 19 nt, Mycobacterium bovis subsp bovis AF2122/97
caacgucgauguccccggc

SEQ ID NO: 3181502 - RNA, 18 nt, Mycobacterium bovis subsp bovis AF2122/97
caacgucgccgcggcggc

SEQ ID NO: 3181503 - RNA, 22 nt, Mycobacterium bovis subsp bovis AF2122/97
caacgucgccgcggcggcagcg

SEQ ID NO: 3181504 - RNA, 23 nt, Mycobacterium bovis subsp bovis AF2122/97
caacgucgcguucuccggcaccg

SEQ ID NO: 3181505 - RNA, 13 nt, Mycobacterium bovis subsp bovis AF2122/97
caacgucgcuccg

SEQ ID NO: 3181506 - RNA, 22 nt, Mycobacterium bovis subsp bovis AF2122/97
caacgucgcuccgaugugccga

SEQ ID NO: 3181507 - RNA, 12 nt, Mycobacterium bovis subsp bovis AF2122/97
caacgucgcuga

SEQ ID NO: 3181508 - RNA, 14 nt, Mycobacterium bovis subsp bovis AF2122/97
caacgucgcugaaa

SEQ ID NO: 3181509 - RNA, 19 nt, Mycobacterium bovis subsp bovis AF2122/97
caacgucgcugaaaucggu

SEQ ID NO: 3181510 - RNA, 20 nt, Mycobacterium bovis subsp bovis AF2122/97
caacgucuucacucacgacg

SEQ ID NO: 3181511 - RNA, 23 nt, Mycobacterium bovis subsp bovis AF2122/97
caacgucuucacucacgacgccg

SEQ ID NO: 3181512 - RNA, 21 nt, Mycobacterium bovis subsp bovis AF2122/97
caacgucuugcuggucgaugg

SEQ ID NO: 3181513 - RNA, 19 nt, Mycobacterium bovis subsp bovis AF2122/97
caacgugaugcguucggcc

SEQ ID NO: 3181514 - RNA, 18 nt, Mycobacterium bovis subsp bovis AF2122/97
caacgugccgaacgccag

SEQ ID NO: 3181515 - RNA, 20 nt, Mycobacterium bovis subsp bovis AF2122/97
caacgugcgcaacgcgucgu

SEQ ID NO: 3181516 - RNA, 20 nt, Mycobacterium bovis subsp bovis AF2122/97
caacguggucaguugugcgu

SEQ ID NO: 3181517 - RNA, 17 nt, Mycobacterium bovis subsp bovis AF2122/97
caacgugugcaccauca

SEQ ID NO: 3181518 - RNA, 15 nt, Mycobacterium bovis subsp bovis AF2122/97
caacguucggcacaa

SEQ ID NO: 3181519 - RNA, 18 nt, Mycobacterium bovis subsp bovis AF2122/97
caacguucggcacaacca

SEQ ID NO: 3181520 - RNA, 21 nt, Mycobacterium bovis subsp bovis AF2122/97
caacguucggcacaaccaacg

SEQ ID NO: 3181521 - RNA, 13 nt, Mycobacterium bovis subsp bovis AF2122/97
caacguugcaccg

SEQ ID NO: 3181522 - RNA, 16 nt, Mycobacterium bovis subsp bovis AF2122/97
caacguugcgccagcg

SEQ ID NO: 3181523 - RNA, 21 nt, Mycobacterium bovis subsp bovis AF2122/97
caacguugcgccagcggugga

SEQ ID NO: 3181524 - RNA, 21 nt, Mycobacterium bovis subsp bovis AF2122/97
caacguugguccgcugcagca

SEQ ID NO: 3181525 - RNA, 16 nt, Mycobacterium bovis subsp bovis AF2122/97
caacguuguagcccaa

SEQ ID NO: 3181526 - RNA, 23 nt, Mycobacterium bovis subsp bovis AF2122/97
caacuacggcguccccgacaacg

SEQ ID NO: 3181527 - RNA, 23 nt, Mycobacterium bovis subsp bovis AF2122/97
caacuacucauccagaagccggc

SEQ ID NO: 3181528 - RNA, 19 nt, Mycobacterium bovis subsp bovis AF2122/97
caacuaucgucgugucgcc

SEQ ID NO: 3181529 - RNA, 14 nt, Mycobacterium bovis subsp bovis AF2122/97
caacucaggccggu

SEQ ID NO: 3181530 - RNA, 16 nt, Mycobacterium bovis subsp bovis AF2122/97
caacucauagaccagu

SEQ ID NO: 3181531 - RNA, 19 nt, Mycobacterium bovis subsp bovis AF2122/97
caacuccacgcggaccucg

SEQ ID NO: 3181532 - RNA, 17 nt, Mycobacterium bovis subsp bovis AF2122/97
caacuccagcacccgcu

SEQ ID NO: 3181533 - RNA, 14 nt, Mycobacterium bovis subsp bovis AF2122/97
caacucccagcacg

SEQ ID NO: 3181534 - RNA, 15 nt, Mycobacterium bovis subsp bovis AF2122/97
caacucccagcacgg

SEQ ID NO: 3181535 - RNA, 16 nt, Mycobacterium bovis subsp bovis AF2122/97
caacucccgcgguacg

SEQ ID NO: 3181536 - RNA, 18 nt, Mycobacterium bovis subsp bovis AF2122/97
caacuccgggaccggaaa

SEQ ID NO: 3181537 - RNA, 12 nt, Mycobacterium bovis subsp bovis AF2122/97
caacuccucagc

SEQ ID NO: 3181538 - RNA, 20 nt, Mycobacterium bovis subsp bovis AF2122/97
caacuccucagccgccuguc

SEQ ID NO: 3181539 - RNA, 11 nt, Mycobacterium bovis subsp bovis AF2122/97
caacuccugca

SEQ ID NO: 3181540 - RNA, 21 nt, Mycobacterium bovis subsp bovis AF2122/97
caacucgaauccggcccacuu

SEQ ID NO: 3181541 - RNA, 19 nt, Mycobacterium bovis subsp bovis AF2122/97
caacucgagaguggccucg

SEQ ID NO: 3181542 - RNA, 20 nt, Mycobacterium bovis subsp bovis AF2122/97
caacucgagaguggccucgu

SEQ ID NO: 3181543 - RNA, 21 nt, Mycobacterium bovis subsp bovis AF2122/97
caacucgagaguggccucguc

SEQ ID NO: 3181544 - RNA, 22 nt, Mycobacterium bovis subsp bovis AF2122/97
caacucgccacggucgccgacc

SEQ ID NO: 3181545 - RNA, 18 nt, Mycobacterium bovis subsp bovis AF2122/97
caacucgcgaagcaucgc

SEQ ID NO: 3181546 - RNA, 18 nt, Mycobacterium bovis subsp bovis AF2122/97
caacucgcguggcaccga

SEQ ID NO: 3181547 - RNA, 11 nt, Mycobacterium bovis subsp bovis AF2122/97
caacucggcag

SEQ ID NO: 3181548 - RNA, 17 nt, Mycobacterium bovis subsp bovis AF2122/97
caacucggcauucaccg

SEQ ID NO: 3181549 - RNA, 21 nt, Mycobacterium bovis subsp bovis AF2122/97
caacucggccaacgacggccg

SEQ ID NO: 3181550 - RNA, 12 nt, Mycobacterium bovis subsp bovis AF2122/97
caacucggccac

SEQ ID NO: 3181551 - RNA, 13 nt, Mycobacterium bovis subsp bovis AF2122/97
caacucggccacg

SEQ ID NO: 3181552 - RNA, 15 nt, Mycobacterium bovis subsp bovis AF2122/97
caacucggccacggc

SEQ ID NO: 3181553 - RNA, 12 nt, Mycobacterium bovis subsp bovis AF2122/97
caacucggcccg

SEQ ID NO: 3181554 - RNA, 13 nt, Mycobacterium bovis subsp bovis AF2122/97
caacucggcccgg

SEQ ID NO: 3181555 - RNA, 19 nt, Mycobacterium bovis subsp bovis AF2122/97
caacucggcgaccugccgg

SEQ ID NO: 3181556 - RNA, 19 nt, Mycobacterium bovis subsp bovis AF2122/97
caacucgggcagcgcggcc

SEQ ID NO: 3181557 - RNA, 16 nt, Mycobacterium bovis subsp bovis AF2122/97
caacucgggcagcuuc

SEQ ID NO: 3181558 - RNA, 23 nt, Mycobacterium bovis subsp bovis AF2122/97
caacucggugacguuggcaggca

SEQ ID NO: 3181559 - RNA, 17 nt, Mycobacterium bovis subsp bovis AF2122/97
caacucguccaacugaa

SEQ ID NO: 3181560 - RNA, 20 nt, Mycobacterium bovis subsp bovis AF2122/97
caacucguccagcagugcga

SEQ ID NO: 3181561 - RNA, 19 nt, Mycobacterium bovis subsp bovis AF2122/97
caacucuucagcaagccaa

SEQ ID NO: 3181562 - RNA, 20 nt, Mycobacterium bovis subsp bovis AF2122/97
caacucuucccauuucggca

SEQ ID NO: 3181563 - RNA, 20 nt, Mycobacterium bovis subsp bovis AF2122/97
caacugcagcauggcccugg

SEQ ID NO: 3181564 - RNA, 14 nt, Mycobacterium bovis subsp bovis AF2122/97
caacugcaucacca

SEQ ID NO: 3181565 - RNA, 18 nt, Mycobacterium bovis subsp bovis AF2122/97
caacugccgcacccgguc

SEQ ID NO: 3181566 - RNA, 19 nt, Mycobacterium bovis subsp bovis AF2122/97
caacugccgcacccggucg

SEQ ID NO: 3181567 - RNA, 14 nt, Mycobacterium bovis subsp bovis AF2122/97
caacugcgccggug

SEQ ID NO: 3181568 - RNA, 20 nt, Mycobacterium bovis subsp bovis AF2122/97
caacugcgccggugccggcc

SEQ ID NO: 3181569 - RNA, 22 nt, Mycobacterium bovis subsp bovis AF2122/97
caacugcgccguucgcuccccc

SEQ ID NO: 3181570 - RNA, 23 nt, Mycobacterium bovis subsp bovis AF2122/97
caacugcgccguucgcucccccg

SEQ ID NO: 3181571 - RNA, 15 nt, Mycobacterium bovis subsp bovis AF2122/97
caacugcggcagguc

SEQ ID NO: 3181572 - RNA, 15 nt, Mycobacterium bovis subsp bovis AF2122/97
caacugcucgacgag

SEQ ID NO: 3181573 - RNA, 15 nt, Mycobacterium bovis subsp bovis AF2122/97
caacuggccgcgucg

SEQ ID NO: 3181574 - RNA, 21 nt, Mycobacterium bovis subsp bovis AF2122/97
caacugggccgagcgcgccgu

SEQ ID NO: 3181575 - RNA, 15 nt, Mycobacterium bovis subsp bovis AF2122/97
caacuggugggccau

SEQ ID NO: 3181576 - RNA, 22 nt, Mycobacterium bovis subsp bovis AF2122/97
caacugucuugggggccaaccg

SEQ ID NO: 3181577 - RNA, 14 nt, Mycobacterium bovis subsp bovis AF2122/97
caacuuacgcgacg

SEQ ID NO: 3181578 - RNA, 17 nt, Mycobacterium bovis subsp bovis AF2122/97
caacuucaacuggauca

SEQ ID NO: 3181579 - RNA, 16 nt, Mycobacterium bovis subsp bovis AF2122/97
caacuucaccacccug

SEQ ID NO: 3181580 - RNA, 20 nt, Mycobacterium bovis subsp bovis AF2122/97
caacuuccgcagcgccaccc

SEQ ID NO: 3181581 - RNA, 16 nt, Mycobacterium bovis subsp bovis AF2122/97
caacuucuucagcagc

SEQ ID NO: 3181582 - RNA, 16 nt, Mycobacterium bovis subsp bovis AF2122/97
caacuugggcccgcug

SEQ ID NO: 3181583 - RNA, 21 nt, Mycobacterium bovis subsp bovis AF2122/97
caagaaagacgcuguccaggu

SEQ ID NO: 3181584 - RNA, 14 nt, Mycobacterium bovis subsp bovis AF2122/97
caagaaccacgacg

SEQ ID NO: 3181585 - RNA, 17 nt, Mycobacterium bovis subsp bovis AF2122/97
caagaaggccagcgcgc

SEQ ID NO: 3181586 - RNA, 13 nt, Mycobacterium bovis subsp bovis AF2122/97
caagaaucaccgg

SEQ ID NO: 3181587 - RNA, 16 nt, Mycobacterium bovis subsp bovis AF2122/97
caagaaucaccggcaa

SEQ ID NO: 3181588 - RNA, 16 nt, Mycobacterium bovis subsp bovis AF2122/97
caagaaucagcagcag

SEQ ID NO: 3181589 - RNA, 17 nt, Mycobacterium bovis subsp bovis AF2122/97
caagaaugccgccgacg

SEQ ID NO: 3181590 - RNA, 18 nt, Mycobacterium bovis subsp bovis AF2122/97
caagaauggccgccuuga

SEQ ID NO: 3181591 - RNA, 17 nt, Mycobacterium bovis subsp bovis AF2122/97
caagaauucaccacucc

SEQ ID NO: 3181592 - RNA, 19 nt, Mycobacterium bovis subsp bovis AF2122/97
caagacaaagccgucgacg

SEQ ID NO: 3181593 - RNA, 17 nt, Mycobacterium bovis subsp bovis AF2122/97
caagaccaagugucgcc

SEQ ID NO: 3181594 - RNA, 15 nt, Mycobacterium bovis subsp bovis AF2122/97
caagaccgcgccaac

SEQ ID NO: 3181595 - RNA, 16 nt, Mycobacterium bovis subsp bovis AF2122/97
caagaccgcgccaacu

SEQ ID NO: 3181596 - RNA, 13 nt, Mycobacterium bovis subsp bovis AF2122/97
caagaccggcggg

SEQ ID NO: 3181597 - RNA, 22 nt, Mycobacterium bovis subsp bovis AF2122/97
caagacgaugcuggcggccucg

SEQ ID NO: 3181598 - RNA, 17 nt, Mycobacterium bovis subsp bovis AF2122/97
caagacgucggcguggu

SEQ ID NO: 3181599 - RNA, 15 nt, Mycobacterium bovis subsp bovis AF2122/97
caagagccgcagcca

SEQ ID NO: 3181600 - RNA, 21 nt, Mycobacterium bovis subsp bovis AF2122/97
caagagccguccgaccaggga

SEQ ID NO: 3181601 - RNA, 15 nt, Mycobacterium bovis subsp bovis AF2122/97
caagagugcucagcg

SEQ ID NO: 3181602 - RNA, 23 nt, Mycobacterium bovis subsp bovis AF2122/97
caagaucagacccagcgcggcaa

SEQ ID NO: 3181603 - RNA, 17 nt, Mycobacterium bovis subsp bovis AF2122/97
caagauccgccacgcuc

SEQ ID NO: 3181604 - RNA, 18 nt, Mycobacterium bovis subsp bovis AF2122/97
caagaucucgcgggcccg

SEQ ID NO: 3181605 - RNA, 14 nt, Mycobacterium bovis subsp bovis AF2122/97
caagcaaccggugc

SEQ ID NO: 3181606 - RNA, 20 nt, Mycobacterium bovis subsp bovis AF2122/97
caagcaaguccaccggaucg

SEQ ID NO: 3181607 - RNA, 12 nt, Mycobacterium bovis subsp bovis AF2122/97
caagcacaaucc

SEQ ID NO: 3181608 - RNA, 18 nt, Mycobacterium bovis subsp bovis AF2122/97
caagcacaccgccagcgg

SEQ ID NO: 3181609 - RNA, 16 nt, Mycobacterium bovis subsp bovis AF2122/97
caagcacagcccggcg

SEQ ID NO: 3181610 - RNA, 21 nt, Mycobacterium bovis subsp bovis AF2122/97
caagcacagcccggcgacgac

SEQ ID NO: 3181611 - RNA, 22 nt, Mycobacterium bovis subsp bovis AF2122/97
caagcacagcccggcgacgacc

SEQ ID NO: 3181612 - RNA, 14 nt, Mycobacterium bovis subsp bovis AF2122/97
caagcacagcgaac

SEQ ID NO: 3181613 - RNA, 18 nt, Mycobacterium bovis subsp bovis AF2122/97
caagcacagcgaacagac

SEQ ID NO: 3181614 - RNA, 21 nt, Mycobacterium bovis subsp bovis AF2122/97
caagcacauuauucuucgcgg

SEQ ID NO: 3181615 - RNA, 14 nt, Mycobacterium bovis subsp bovis AF2122/97
caagcacggcgucg

SEQ ID NO: 3181616 - RNA, 14 nt, Mycobacterium bovis subsp bovis AF2122/97
caagcacgguggcc

SEQ ID NO: 3181617 - RNA, 21 nt, Mycobacterium bovis subsp bovis AF2122/97
caagcacgguggccgagccgc

SEQ ID NO: 3181618 - RNA, 20 nt, Mycobacterium bovis subsp bovis AF2122/97
caagcacuaaucggccacuu

SEQ ID NO: 3181619 - RNA, 13 nt, Mycobacterium bovis subsp bovis AF2122/97
caagcagcgacca

SEQ ID NO: 3181620 - RNA, 16 nt, Mycobacterium bovis subsp bovis AF2122/97
caagcagcgaccagca

SEQ ID NO: 3181621 - RNA, 19 nt, Mycobacterium bovis subsp bovis AF2122/97
caagcaguccacgagcacg

SEQ ID NO: 3181622 - RNA, 17 nt, Mycobacterium bovis subsp bovis AF2122/97
caagcagucgguauagc

SEQ ID NO: 3181623 - RNA, 16 nt, Mycobacterium bovis subsp bovis AF2122/97
caagcauuggcgucga

SEQ ID NO: 3181624 - RNA, 17 nt, Mycobacterium bovis subsp bovis AF2122/97
caagcauuuccgcgaag

SEQ ID NO: 3181625 - RNA, 18 nt, Mycobacterium bovis subsp bovis AF2122/97
caagccaaccagcccggc

SEQ ID NO: 3181626 - RNA, 21 nt, Mycobacterium bovis subsp bovis AF2122/97
caagccaaccagcccggccgc

SEQ ID NO: 3181627 - RNA, 22 nt, Mycobacterium bovis subsp bovis AF2122/97
caagccaaccagcccggccgcc

SEQ ID NO: 3181628 - RNA, 11 nt, Mycobacterium bovis subsp bovis AF2122/97
caagccaagcg

SEQ ID NO: 3181629 - RNA, 16 nt, Mycobacterium bovis subsp bovis AF2122/97
caagccacgucgucgc

SEQ ID NO: 3181630 - RNA, 13 nt, Mycobacterium bovis subsp bovis AF2122/97
caagccagcacug

SEQ ID NO: 3181631 - RNA, 14 nt, Mycobacterium bovis subsp bovis AF2122/97
caagccagcacugc

SEQ ID NO: 3181632 - RNA, 16 nt, Mycobacterium bovis subsp bovis AF2122/97
caagccagcacugcca

SEQ ID NO: 3181633 - RNA, 18 nt, Mycobacterium bovis subsp bovis AF2122/97
caagccauguggcgucgc

SEQ ID NO: 3181634 - RNA, 21 nt, Mycobacterium bovis subsp bovis AF2122/97
caagccauguggcgucgcucg

SEQ ID NO: 3181635 - RNA, 21 nt, Mycobacterium bovis subsp bovis AF2122/97
caagcccaaaaagaccgccgc

SEQ ID NO: 3181636 - RNA, 21 nt, Mycobacterium bovis subsp bovis AF2122/97
caagcccgauucagcgcccca

SEQ ID NO: 3181637 - RNA, 16 nt, Mycobacterium bovis subsp bovis AF2122/97
caagccgacaucggcg

SEQ ID NO: 3181638 - RNA, 19 nt, Mycobacterium bovis subsp bovis AF2122/97
caagccgacaucggcggcc

SEQ ID NO: 3181639 - RNA, 13 nt, Mycobacterium bovis subsp bovis AF2122/97
caagccgaccugc

SEQ ID NO: 3181640 - RNA, 14 nt, Mycobacterium bovis subsp bovis AF2122/97
caagccgccggcgc

SEQ ID NO: 3181641 - RNA, 16 nt, Mycobacterium bovis subsp bovis AF2122/97
caagccgccggcgcca

SEQ ID NO: 3181642 - RNA, 17 nt, Mycobacterium bovis subsp bovis AF2122/97
caagccgccggugcgca

SEQ ID NO: 3181643 - RNA, 16 nt, Mycobacterium bovis subsp bovis AF2122/97
caagccgcgagucgcc

SEQ ID NO: 3181644 - RNA, 20 nt, Mycobacterium bovis subsp bovis AF2122/97
caagccgcggcuaggccagc

SEQ ID NO: 3181645 - RNA, 13 nt, Mycobacterium bovis subsp bovis AF2122/97
caagccggacaga

SEQ ID NO: 3181646 - RNA, 15 nt, Mycobacterium bovis subsp bovis AF2122/97
caagccggccacgca

SEQ ID NO: 3181647 - RNA, 15 nt, Mycobacterium bovis subsp bovis AF2122/97
caagccggcgcccgc

SEQ ID NO: 3181648 - RNA, 19 nt, Mycobacterium bovis subsp bovis AF2122/97
caagccggcgcccgccgcg

SEQ ID NO: 3181649 - RNA, 14 nt, Mycobacterium bovis subsp bovis AF2122/97
caagccggggaacu

SEQ ID NO: 3181650 - RNA, 19 nt, Mycobacterium bovis subsp bovis AF2122/97
caagccggggaacuuaccg

SEQ ID NO: 3181651 - RNA, 19 nt, Mycobacterium bovis subsp bovis AF2122/97
caagccgggugggagcagc

SEQ ID NO: 3181652 - RNA, 18 nt, Mycobacterium bovis subsp bovis AF2122/97
caagccguagaccaggcc

SEQ ID NO: 3181653 - RNA, 19 nt, Mycobacterium bovis subsp bovis AF2122/97
caagccguagaccaggccc

SEQ ID NO: 3181654 - RNA, 21 nt, Mycobacterium bovis subsp bovis AF2122/97
caagccguaguaguggccgcc

SEQ ID NO: 3181655 - RNA, 22 nt, Mycobacterium bovis subsp bovis AF2122/97
caagccguaguaguggccgcca

SEQ ID NO: 3181656 - RNA, 14 nt, Mycobacterium bovis subsp bovis AF2122/97
caagccgugcagcu

SEQ ID NO: 3181657 - RNA, 19 nt, Mycobacterium bovis subsp bovis AF2122/97
caagccguguucgaccgca

SEQ ID NO: 3181658 - RNA, 17 nt, Mycobacterium bovis subsp bovis AF2122/97
caagccguucugucccg

SEQ ID NO: 3181659 - RNA, 18 nt, Mycobacterium bovis subsp bovis AF2122/97
caagccguugcacggccg

SEQ ID NO: 3181660 - RNA, 21 nt, Mycobacterium bovis subsp bovis AF2122/97
caagccucuauacgccugcuc

SEQ ID NO: 3181661 - RNA, 12 nt, Mycobacterium bovis subsp bovis AF2122/97
caagccugccga

SEQ ID NO: 3181662 - RNA, 15 nt, Mycobacterium bovis subsp bovis AF2122/97
caagccugcgcuguu

SEQ ID NO: 3181663 - RNA, 12 nt, Mycobacterium bovis subsp bovis AF2122/97
caagcgauggca

SEQ ID NO: 3181664 - RNA, 21 nt, Mycobacterium bovis subsp bovis AF2122/97
caagcgaugucccaucgcguc

SEQ ID NO: 3181665 - RNA, 22 nt, Mycobacterium bovis subsp bovis AF2122/97
caagcgauuuggcgucgccgag

SEQ ID NO: 3181666 - RNA, 23 nt, Mycobacterium bovis subsp bovis AF2122/97
caagcgauuuggcgucgccgagg

SEQ ID NO: 3181667 - RNA, 15 nt, Mycobacterium bovis subsp bovis AF2122/97
caagcgcagacacga

SEQ ID NO: 3181668 - RNA, 23 nt, Mycobacterium bovis subsp bovis AF2122/97
caagcgcagccuggucgcgcagc

SEQ ID NO: 3181669 - RNA, 18 nt, Mycobacterium bovis subsp bovis AF2122/97
caagcgccaacaacccaa

SEQ ID NO: 3181670 - RNA, 22 nt, Mycobacterium bovis subsp bovis AF2122/97
caagcgccaacaacccaacaaa

SEQ ID NO: 3181671 - RNA, 21 nt, Mycobacterium bovis subsp bovis AF2122/97
caagcgccgcgcuugcgaucg

SEQ ID NO: 3181672 - RNA, 16 nt, Mycobacterium bovis subsp bovis AF2122/97
caagcgccugagcggc

SEQ ID NO: 3181673 - RNA, 13 nt, Mycobacterium bovis subsp bovis AF2122/97
caagcgcggcgaa

SEQ ID NO: 3181674 - RNA, 23 nt, Mycobacterium bovis subsp bovis AF2122/97
caagcggacccgaccgucgucgu

SEQ ID NO: 3181675 - RNA, 13 nt, Mycobacterium bovis subsp bovis AF2122/97
caagcggccgcgg

SEQ ID NO: 3181676 - RNA, 22 nt, Mycobacterium bovis subsp bovis AF2122/97
caagcggguuguggcacccggc

SEQ ID NO: 3181677 - RNA, 23 nt, Mycobacterium bovis subsp bovis AF2122/97
caagcggguuguggcacccggcu

SEQ ID NO: 3181678 - RNA, 18 nt, Mycobacterium bovis subsp bovis AF2122/97
caagcguccgcugcaggu

SEQ ID NO: 3181679 - RNA, 15 nt, Mycobacterium bovis subsp bovis AF2122/97
caagcgucgcaaaca

SEQ ID NO: 3181680 - RNA, 13 nt, Mycobacterium bovis subsp bovis AF2122/97
caagcgugacccg

SEQ ID NO: 3181681 - RNA, 14 nt, Mycobacterium bovis subsp bovis AF2122/97
caagcgugcugccg

SEQ ID NO: 3181682 - RNA, 17 nt, Mycobacterium bovis subsp bovis AF2122/97
caagcuaagcgccugau

SEQ ID NO: 3181683 - RNA, 15 nt, Mycobacterium bovis subsp bovis AF2122/97
caagcuaccggcccg

SEQ ID NO: 3181684 - RNA, 16 nt, Mycobacterium bovis subsp bovis AF2122/97
caagcuccaguagucg

SEQ ID NO: 3181685 - RNA, 13 nt, Mycobacterium bovis subsp bovis AF2122/97
caagcucgacaac

SEQ ID NO: 3181686 - RNA, 16 nt, Mycobacterium bovis subsp bovis AF2122/97
caagcucgacaacugc

SEQ ID NO: 3181687 - RNA, 12 nt, Mycobacterium bovis subsp bovis AF2122/97
caagcucggcca

SEQ ID NO: 3181688 - RNA, 14 nt, Mycobacterium bovis subsp bovis AF2122/97
caagcucggccacc

SEQ ID NO: 3181689 - RNA, 15 nt, Mycobacterium bovis subsp bovis AF2122/97
caagcucggccagca

SEQ ID NO: 3181690 - RNA, 15 nt, Mycobacterium bovis subsp bovis AF2122/97
caagcucggcccagc

SEQ ID NO: 3181691 - RNA, 16 nt, Mycobacterium bovis subsp bovis AF2122/97
caagcucggcccagcg

SEQ ID NO: 3181692 - RNA, 13 nt, Mycobacterium bovis subsp bovis AF2122/97
caagcucggucaa

SEQ ID NO: 3181693 - RNA, 14 nt, Mycobacterium bovis subsp bovis AF2122/97
caagcucugcgucg

SEQ ID NO: 3181694 - RNA, 22 nt, Mycobacterium bovis subsp bovis AF2122/97
caagcugacacgacgaacuagg

SEQ ID NO: 3181695 - RNA, 15 nt, Mycobacterium bovis subsp bovis AF2122/97
caagcugaccgccag

SEQ ID NO: 3181696 - RNA, 17 nt, Mycobacterium bovis subsp bovis AF2122/97
caagcuggggaacagca

SEQ ID NO: 3181697 - RNA, 13 nt, Mycobacterium bovis subsp bovis AF2122/97
caagcugucggcg

SEQ ID NO: 3181698 - RNA, 19 nt, Mycobacterium bovis subsp bovis AF2122/97
caagcugucgucgccccgg

SEQ ID NO: 3181699 - RNA, 16 nt, Mycobacterium bovis subsp bovis AF2122/97
caaggaacggcgucgu

SEQ ID NO: 3181700 - RNA, 13 nt, Mycobacterium bovis subsp bovis AF2122/97
caaggacgcaccg

SEQ ID NO: 3181701 - RNA, 16 nt, Mycobacterium bovis subsp bovis AF2122/97
caaggacgcaccgcca

SEQ ID NO: 3181702 - RNA, 18 nt, Mycobacterium bovis subsp bovis AF2122/97
caaggacguuucagccgg

SEQ ID NO: 3181703 - RNA, 22 nt, Mycobacterium bovis subsp bovis AF2122/97
caaggacucggacgcgccggcg

SEQ ID NO: 3181704 - RNA, 17 nt, Mycobacterium bovis subsp bovis AF2122/97
caaggagcccguccagg

SEQ ID NO: 3181705 - RNA, 14 nt, Mycobacterium bovis subsp bovis AF2122/97
caaggaugucgggg

SEQ ID NO: 3181706 - RNA, 17 nt, Mycobacterium bovis subsp bovis AF2122/97
caaggcauccaacgcgg

SEQ ID NO: 3181707 - RNA, 20 nt, Mycobacterium bovis subsp bovis AF2122/97
caaggcauccaacgcggcgc

SEQ ID NO: 3181708 - RNA, 12 nt, Mycobacterium bovis subsp bovis AF2122/97
caaggccaagcg

SEQ ID NO: 3181709 - RNA, 15 nt, Mycobacterium bovis subsp bovis AF2122/97
caaggccaagcgcca

SEQ ID NO: 3181710 - RNA, 12 nt, Mycobacterium bovis subsp bovis AF2122/97
caaggccaccgg

SEQ ID NO: 3181711 - RNA, 13 nt, Mycobacterium bovis subsp bovis AF2122/97
caaggccaccggc

SEQ ID NO: 3181712 - RNA, 15 nt, Mycobacterium bovis subsp bovis AF2122/97
caaggcccgcaccgc

SEQ ID NO: 3181713 - RNA, 17 nt, Mycobacterium bovis subsp bovis AF2122/97
caaggcccgcaccgcug

SEQ ID NO: 3181714 - RNA, 14 nt, Mycobacterium bovis subsp bovis AF2122/97
caaggccgaccugu

SEQ ID NO: 3181715 - RNA, 20 nt, Mycobacterium bovis subsp bovis AF2122/97
caaggccgccgccgucggcg

SEQ ID NO: 3181716 - RNA, 13 nt, Mycobacterium bovis subsp bovis AF2122/97
caaggccgccugc

SEQ ID NO: 3181717 - RNA, 20 nt, Mycobacterium bovis subsp bovis AF2122/97
caaggccgcguugccggucg

SEQ ID NO: 3181718 - RNA, 21 nt, Mycobacterium bovis subsp bovis AF2122/97
caaggccgcguugccggucgc

SEQ ID NO: 3181719 - RNA, 14 nt, Mycobacterium bovis subsp bovis AF2122/97
caaggccuucagcg

SEQ ID NO: 3181720 - RNA, 19 nt, Mycobacterium bovis subsp bovis AF2122/97
caaggcgaagguccgugcc

SEQ ID NO: 3181721 - RNA, 19 nt, Mycobacterium bovis subsp bovis AF2122/97
caaggcgacgaaucggcaa

SEQ ID NO: 3181722 - RNA, 21 nt, Mycobacterium bovis subsp bovis AF2122/97
caaggcgccgauaccggcggc

SEQ ID NO: 3181723 - RNA, 14 nt, Mycobacterium bovis subsp bovis AF2122/97
caaggcggcggcca

SEQ ID NO: 3181724 - RNA, 17 nt, Mycobacterium bovis subsp bovis AF2122/97
caaggcggcggccagcc

SEQ ID NO: 3181725 - RNA, 16 nt, Mycobacterium bovis subsp bovis AF2122/97
caaggcggucaccacc

SEQ ID NO: 3181726 - RNA, 17 nt, Mycobacterium bovis subsp bovis AF2122/97
caaggcggucaccaccg

SEQ ID NO: 3181727 - RNA, 14 nt, Mycobacterium bovis subsp bovis AF2122/97
caaggcguguagcc

SEQ ID NO: 3181728 - RNA, 15 nt, Mycobacterium bovis subsp bovis AF2122/97
caaggcucagcagcg

SEQ ID NO: 3181729 - RNA, 20 nt, Mycobacterium bovis subsp bovis AF2122/97
caaggcuuccuccgacgcga

SEQ ID NO: 3181730 - RNA, 19 nt, Mycobacterium bovis subsp bovis AF2122/97
caagggaauccgaacucgc

SEQ ID NO: 3181731 - RNA, 17 nt, Mycobacterium bovis subsp bovis AF2122/97
caagggcauacagcaug

SEQ ID NO: 3181732 - RNA, 21 nt, Mycobacterium bovis subsp bovis AF2122/97
caagggccggaugggcgucga

SEQ ID NO: 3181733 - RNA, 14 nt, Mycobacterium bovis subsp bovis AF2122/97
caagggcggcaacg

SEQ ID NO: 3181734 - RNA, 16 nt, Mycobacterium bovis subsp bovis AF2122/97
caagggcggcaacggg

SEQ ID NO: 3181735 - RNA, 22 nt, Mycobacterium bovis subsp bovis AF2122/97
caagggggaguuggugaacggu

SEQ ID NO: 3181736 - RNA, 15 nt, Mycobacterium bovis subsp bovis AF2122/97
caaggguggugacgc

SEQ ID NO: 3181737 - RNA, 18 nt, Mycobacterium bovis subsp bovis AF2122/97
caaggguucaggucgggg

SEQ ID NO: 3181738 - RNA, 18 nt, Mycobacterium bovis subsp bovis AF2122/97
caaggguuggccgauaaa

SEQ ID NO: 3181739 - RNA, 15 nt, Mycobacterium bovis subsp bovis AF2122/97
caagguauggccgga

SEQ ID NO: 3181740 - RNA, 20 nt, Mycobacterium bovis subsp bovis AF2122/97
caagguauggccggagcgca

SEQ ID NO: 3181741 - RNA, 17 nt, Mycobacterium bovis subsp bovis AF2122/97
caaggucgacggaaucg

SEQ ID NO: 3181742 - RNA, 15 nt, Mycobacterium bovis subsp bovis AF2122/97
caaggucggcgaucg

SEQ ID NO: 3181743 - RNA, 18 nt, Mycobacterium bovis subsp bovis AF2122/97
caaggucuuuagccgccg

SEQ ID NO: 3181744 - RNA, 20 nt, Mycobacterium bovis subsp bovis AF2122/97
caaggugagcagcaagaccg

SEQ ID NO: 3181745 - RNA, 23 nt, Mycobacterium bovis subsp bovis AF2122/97
caaggugagcagcaagaccgcgc

SEQ ID NO: 3181746 - RNA, 24 nt, Mycobacterium bovis subsp bovis AF2122/97
caagguggcaugcgacagaugccg

SEQ ID NO: 3181747 - RNA, 18 nt, Mycobacterium bovis subsp bovis AF2122/97
caagguggccaccaaacg

SEQ ID NO: 3181748 - RNA, 15 nt, Mycobacterium bovis subsp bovis AF2122/97
caagguggcggccag

SEQ ID NO: 3181749 - RNA, 20 nt, Mycobacterium bovis subsp bovis AF2122/97
caaggugucaacgcgcggcu

SEQ ID NO: 3181750 - RNA, 14 nt, Mycobacterium bovis subsp bovis AF2122/97
caagguguccagca

SEQ ID NO: 3181751 - RNA, 18 nt, Mycobacterium bovis subsp bovis AF2122/97
caagguguccagcaccug

SEQ ID NO: 3181752 - RNA, 14 nt, Mycobacterium bovis subsp bovis AF2122/97
caaggugucgacgg

SEQ ID NO: 3181753 - RNA, 15 nt, Mycobacterium bovis subsp bovis AF2122/97
caagguguggugaca

SEQ ID NO: 3181754 - RNA, 17 nt, Mycobacterium bovis subsp bovis AF2122/97
caagguguugcgguggg

SEQ ID NO: 3181755 - RNA, 21 nt, Mycobacterium bovis subsp bovis AF2122/97
caagguguugcggugggugaa

SEQ ID NO: 3181756 - RNA, 23 nt, Mycobacterium bovis subsp bovis AF2122/97
caagguuggucggugcugacccc

SEQ ID NO: 3181757 - RNA, 18 nt, Mycobacterium bovis subsp bovis AF2122/97
caaguacgcgucggugac

SEQ ID NO: 3181758 - RNA, 19 nt, Mycobacterium bovis subsp bovis AF2122/97
caaguacgcgucggugacc

SEQ ID NO: 3181759 - RNA, 22 nt, Mycobacterium bovis subsp bovis AF2122/97
caaguagccgucgucgucgaga

SEQ ID NO: 3181760 - RNA, 16 nt, Mycobacterium bovis subsp bovis AF2122/97
caagucaaacgccguc

SEQ ID NO: 3181761 - RNA, 20 nt, Mycobacterium bovis subsp bovis AF2122/97
caagucaacaccgcggccga

SEQ ID NO: 3181762 - RNA, 17 nt, Mycobacterium bovis subsp bovis AF2122/97
caagucaacccugccac

SEQ ID NO: 3181763 - RNA, 22 nt, Mycobacterium bovis subsp bovis AF2122/97
caagucauccaggucgccuucc

SEQ ID NO: 3181764 - RNA, 16 nt, Mycobacterium bovis subsp bovis AF2122/97
caaguccaacgacugu

SEQ ID NO: 3181765 - RNA, 13 nt, Mycobacterium bovis subsp bovis AF2122/97
caaguccagcagc

SEQ ID NO: 3181766 - RNA, 16 nt, Mycobacterium bovis subsp bovis AF2122/97
caaguccuccacggcg

SEQ ID NO: 3181767 - RNA, 15 nt, Mycobacterium bovis subsp bovis AF2122/97
caaguccuucacugc

SEQ ID NO: 3181768 - RNA, 14 nt, Mycobacterium bovis subsp bovis AF2122/97
caagucgacacgcc

SEQ ID NO: 3181769 - RNA, 18 nt, Mycobacterium bovis subsp bovis AF2122/97
caagucgacacgccgaac

SEQ ID NO: 3181770 - RNA, 21 nt, Mycobacterium bovis subsp bovis AF2122/97
caagucgaccaugagccggcg

SEQ ID NO: 3181771 - RNA, 11 nt, Mycobacterium bovis subsp bovis AF2122/97
caagucgacgc

SEQ ID NO: 3181772 - RNA, 14 nt, Mycobacterium bovis subsp bovis AF2122/97
caagucgacgccgc

SEQ ID NO: 3181773 - RNA, 20 nt, Mycobacterium bovis subsp bovis AF2122/97
caagucgacgccgcagcguc

SEQ ID NO: 3181774 - RNA, 22 nt, Mycobacterium bovis subsp bovis AF2122/97
caagucgacgguggcgccgucg

SEQ ID NO: 3181775 - RNA, 16 nt, Mycobacterium bovis subsp bovis AF2122/97
caagucggagcgggga

SEQ ID NO: 3181776 - RNA, 17 nt, Mycobacterium bovis subsp bovis AF2122/97
caagucggcgcuggccg

SEQ ID NO: 3181777 - RNA, 22 nt, Mycobacterium bovis subsp bovis AF2122/97
caagucucccggccgcacccgu

SEQ ID NO: 3181778 - RNA, 15 nt, Mycobacterium bovis subsp bovis AF2122/97
caagucugcccgacu

SEQ ID NO: 3181779 - RNA, 18 nt, Mycobacterium bovis subsp bovis AF2122/97
caagucugcccgacugcc

SEQ ID NO: 3181780 - RNA, 12 nt, Mycobacterium bovis subsp bovis AF2122/97
caagucugugcu

SEQ ID NO: 3181781 - RNA, 13 nt, Mycobacterium bovis subsp bovis AF2122/97
caagugcccggcc

SEQ ID NO: 3181782 - RNA, 14 nt, Mycobacterium bovis subsp bovis AF2122/97
caagugccggcgcg

SEQ ID NO: 3181783 - RNA, 15 nt, Mycobacterium bovis subsp bovis AF2122/97
caagugccggcgcgg

SEQ ID NO: 3181784 - RNA, 15 nt, Mycobacterium bovis subsp bovis AF2122/97
caagugcgguccggc

SEQ ID NO: 3181785 - RNA, 23 nt, Mycobacterium bovis subsp bovis AF2122/97
caagugcgguccggcuucggcga

SEQ ID NO: 3181786 - RNA, 18 nt, Mycobacterium bovis subsp bovis AF2122/97
caagugcuggccgaagaa

SEQ ID NO: 3181787 - RNA, 15 nt, Mycobacterium bovis subsp bovis AF2122/97
caagugcuuccggcc

SEQ ID NO: 3181788 - RNA, 15 nt, Mycobacterium bovis subsp bovis AF2122/97
caaguggccagcgcc

SEQ ID NO: 3181789 - RNA, 20 nt, Mycobacterium bovis subsp bovis AF2122/97
caaguggcgcucgcaaacaa

SEQ ID NO: 3181790 - RNA, 15 nt, Mycobacterium bovis subsp bovis AF2122/97
caagugggugagaaa

SEQ ID NO: 3181791 - RNA, 17 nt, Mycobacterium bovis subsp bovis AF2122/97
caagugggugccggcac

SEQ ID NO: 3181792 - RNA, 13 nt, Mycobacterium bovis subsp bovis AF2122/97
caagugucgccgc

SEQ ID NO: 3181793 - RNA, 19 nt, Mycobacterium bovis subsp bovis AF2122/97
caagugucuccggcaacag

SEQ ID NO: 3181794 - RNA, 16 nt, Mycobacterium bovis subsp bovis AF2122/97
caagugugagcagacc

SEQ ID NO: 3181795 - RNA, 22 nt, Mycobacterium bovis subsp bovis AF2122/97
caaguucacccaucaucgccac

SEQ ID NO: 3181796 - RNA, 20 nt, Mycobacterium bovis subsp bovis AF2122/97
caaguucagcacgugggcca

SEQ ID NO: 3181797 - RNA, 16 nt, Mycobacterium bovis subsp bovis AF2122/97
caaguucgccagcaac

SEQ ID NO: 3181798 - RNA, 21 nt, Mycobacterium bovis subsp bovis AF2122/97
caaguucgccagcaacgucgg

SEQ ID NO: 3181799 - RNA, 15 nt, Mycobacterium bovis subsp bovis AF2122/97
caaguucugcgcucc

SEQ ID NO: 3181800 - RNA, 20 nt, Mycobacterium bovis subsp bovis AF2122/97
caaguugaccuucaccugga

SEQ ID NO: 3181801 - RNA, 23 nt, Mycobacterium bovis subsp bovis AF2122/97
caaguugagcagcuugguggcgu

SEQ ID NO: 3181802 - RNA, 20 nt, Mycobacterium bovis subsp bovis AF2122/97
caaguugggcguucaggugu

SEQ ID NO: 3181803 - RNA, 19 nt, Mycobacterium bovis subsp bovis AF2122/97
caauaagggagaccgcggc

SEQ ID NO: 3181804 - RNA, 21 nt, Mycobacterium bovis subsp bovis AF2122/97
caauaagggagaccgcggccg

SEQ ID NO: 3181805 - RNA, 17 nt, Mycobacterium bovis subsp bovis AF2122/97
caauaccgccagcgcca

SEQ ID NO: 3181806 - RNA, 23 nt, Mycobacterium bovis subsp bovis AF2122/97
caauaccgccagcgccaccguua

SEQ ID NO: 3181807 - RNA, 18 nt, Mycobacterium bovis subsp bovis AF2122/97
caauaccugagcgcgcgc

SEQ ID NO: 3181808 - RNA, 15 nt, Mycobacterium bovis subsp bovis AF2122/97
caauacggcggcgcc

SEQ ID NO: 3181809 - RNA, 17 nt, Mycobacterium bovis subsp bovis AF2122/97
caauacggcggcgccgc

SEQ ID NO: 3181810 - RNA, 15 nt, Mycobacterium bovis subsp bovis AF2122/97
caauacguagucgcc

SEQ ID NO: 3181811 - RNA, 22 nt, Mycobacterium bovis subsp bovis AF2122/97
caauacgugauguagcugcagg

SEQ ID NO: 3181812 - RNA, 19 nt, Mycobacterium bovis subsp bovis AF2122/97
caauacgugcgaaucgaga

SEQ ID NO: 3181813 - RNA, 15 nt, Mycobacterium bovis subsp bovis AF2122/97
caauagaagcacguc

SEQ ID NO: 3181814 - RNA, 19 nt, Mycobacterium bovis subsp bovis AF2122/97
caauagaagcacgucgucg

SEQ ID NO: 3181815 - RNA, 20 nt, Mycobacterium bovis subsp bovis AF2122/97
caauagaagcacgucgucgc

SEQ ID NO: 3181816 - RNA, 12 nt, Mycobacterium bovis subsp bovis AF2122/97
caauagaccgca

SEQ ID NO: 3181817 - RNA, 16 nt, Mycobacterium bovis subsp bovis AF2122/97
caauagcugcgcgaag

SEQ ID NO: 3181818 - RNA, 13 nt, Mycobacterium bovis subsp bovis AF2122/97
caauaggucccca

SEQ ID NO: 3181819 - RNA, 16 nt, Mycobacterium bovis subsp bovis AF2122/97
caauaucuuuagcgcg

SEQ ID NO: 3181820 - RNA, 12 nt, Mycobacterium bovis subsp bovis AF2122/97
caaucaccaccg

SEQ ID NO: 3181821 - RNA, 12 nt, Mycobacterium bovis subsp bovis AF2122/97
caaucaccgccg

SEQ ID NO: 3181822 - RNA, 20 nt, Mycobacterium bovis subsp bovis AF2122/97
cgccggauacgucagcccga

SEQ ID NO: 3181823 - RNA, 17 nt, Mycobacterium bovis subsp bovis AF2122/97
cgccggauagcaccggc

SEQ ID NO: 3181824 - RNA, 15 nt, Mycobacterium bovis subsp bovis AF2122/97
cgccggauagcgcag

SEQ ID NO: 3181825 - RNA, 16 nt, Mycobacterium bovis subsp bovis AF2122/97
cgccggauagcgcagc

SEQ ID NO: 3181826 - RNA, 17 nt, Mycobacterium bovis subsp bovis AF2122/97
cgccggauagcgcagcu

SEQ ID NO: 3181827 - RNA, 15 nt, Mycobacterium bovis subsp bovis AF2122/97
cgccggauauggcag

SEQ ID NO: 3181828 - RNA, 13 nt, Mycobacterium bovis subsp bovis AF2122/97
cgccggaucagga

SEQ ID NO: 3181829 - RNA, 17 nt, Mycobacterium bovis subsp bovis AF2122/97
cgccggaucaggaucga

SEQ ID NO: 3181830 - RNA, 14 nt, Mycobacterium bovis subsp bovis AF2122/97
cgccggaucgccac

SEQ ID NO: 3181831 - RNA, 15 nt, Mycobacterium bovis subsp bovis AF2122/97
cgccggaucgccacg

SEQ ID NO: 3181832 - RNA, 19 nt, Mycobacterium bovis subsp bovis AF2122/97
cgccggaucgccacggugg

SEQ ID NO: 3181833 - RNA, 13 nt, Mycobacterium bovis subsp bovis AF2122/97
cgccggaucgccg

SEQ ID NO: 3181834 - RNA, 21 nt, Mycobacterium bovis subsp bovis AF2122/97
cgccggaucguucgcgugcca

SEQ ID NO: 3181835 - RNA, 17 nt, Mycobacterium bovis subsp bovis AF2122/97
cgccggaugacaccgac

SEQ ID NO: 3181836 - RNA, 18 nt, Mycobacterium bovis subsp bovis AF2122/97
cgccggaugacaccgacc

SEQ ID NO: 3181837 - RNA, 23 nt, Mycobacterium bovis subsp bovis AF2122/97
cgccggaugacaccgaccggguc

SEQ ID NO: 3181838 - RNA, 21 nt, Mycobacterium bovis subsp bovis AF2122/97
cgccggaugcugucagcagcc

SEQ ID NO: 3181839 - RNA, 23 nt, Mycobacterium bovis subsp bovis AF2122/97
cgccggaugcugucagcagccca

SEQ ID NO: 3181840 - RNA, 20 nt, Mycobacterium bovis subsp bovis AF2122/97
cgccggauggguggccagca

SEQ ID NO: 3181841 - RNA, 21 nt, Mycobacterium bovis subsp bovis AF2122/97
cgccggauggguggccagcaa

SEQ ID NO: 3181842 - RNA, 15 nt, Mycobacterium bovis subsp bovis AF2122/97
cgccggauggucggc

SEQ ID NO: 3181843 - RNA, 21 nt, Mycobacterium bovis subsp bovis AF2122/97
cgccggauggucggccacgcg

SEQ ID NO: 3181844 - RNA, 21 nt, Mycobacterium bovis subsp bovis AF2122/97
cgccggauuauucgcgguagc

SEQ ID NO: 3181845 - RNA, 17 nt, Mycobacterium bovis subsp bovis AF2122/97
cgccggauucgaugaca

SEQ ID NO: 3181846 - RNA, 19 nt, Mycobacterium bovis subsp bovis AF2122/97
cgccggauucgcccgggcg

SEQ ID NO: 3181847 - RNA, 19 nt, Mycobacterium bovis subsp bovis AF2122/97
cgccggcaaaggacgucga

SEQ ID NO: 3181848 - RNA, 14 nt, Mycobacterium bovis subsp bovis AF2122/97
cgccggcaaccggg

SEQ ID NO: 3181849 - RNA, 17 nt, Mycobacterium bovis subsp bovis AF2122/97
cgccggcaacgcggcuc

SEQ ID NO: 3181850 - RNA, 18 nt, Mycobacterium bovis subsp bovis AF2122/97
cgccggcaauaccgccag

SEQ ID NO: 3181851 - RNA, 20 nt, Mycobacterium bovis subsp bovis AF2122/97
cgccggcaauaccgccagcg

SEQ ID NO: 3181852 - RNA, 22 nt, Mycobacterium bovis subsp bovis AF2122/97
cgccggcaauaccgccagcgcc

SEQ ID NO: 3181853 - RNA, 20 nt, Mycobacterium bovis subsp bovis AF2122/97
cgccggcacauugaucgacg

SEQ ID NO: 3181854 - RNA, 22 nt, Mycobacterium bovis subsp bovis AF2122/97
cgccggcacauugaucgacggc

SEQ ID NO: 3181855 - RNA, 21 nt, Mycobacterium bovis subsp bovis AF2122/97
cgccggcacccgccgugcccc

SEQ ID NO: 3181856 - RNA, 13 nt, Mycobacterium bovis subsp bovis AF2122/97
cgccggcaccgcc

SEQ ID NO: 3181857 - RNA, 14 nt, Mycobacterium bovis subsp bovis AF2122/97
cgccggcaccgcca

SEQ ID NO: 3181858 - RNA, 22 nt, Mycobacterium bovis subsp bovis AF2122/97
cgccggcaccgccagugcccgc

SEQ ID NO: 3181859 - RNA, 14 nt, Mycobacterium bovis subsp bovis AF2122/97
cgccggcaccgccg

SEQ ID NO: 3181860 - RNA, 15 nt, Mycobacterium bovis subsp bovis AF2122/97
cgccggcaccgccgc

SEQ ID NO: 3181861 - RNA, 20 nt, Mycobacterium bovis subsp bovis AF2122/97
cgccggcaccgccgcccccg

SEQ ID NO: 3181862 - RNA, 16 nt, Mycobacterium bovis subsp bovis AF2122/97
cgccggcaccgccggc

SEQ ID NO: 3181863 - RNA, 17 nt, Mycobacterium bovis subsp bovis AF2122/97
cgccggcaccgccggca

SEQ ID NO: 3181864 - RNA, 17 nt, Mycobacterium bovis subsp bovis AF2122/97
cgccggcaccgccggcg

SEQ ID NO: 3181865 - RNA, 20 nt, Mycobacterium bovis subsp bovis AF2122/97
cgccggcaccgccggcgcca

SEQ ID NO: 3181866 - RNA, 19 nt, Mycobacterium bovis subsp bovis AF2122/97
cgccggcaccgccgguggc

SEQ ID NO: 3181867 - RNA, 14 nt, Mycobacterium bovis subsp bovis AF2122/97
cgccggcaccggcc

SEQ ID NO: 3181868 - RNA, 13 nt, Mycobacterium bovis subsp bovis AF2122/97
cgccggcaccggg

SEQ ID NO: 3181869 - RNA, 22 nt, Mycobacterium bovis subsp bovis AF2122/97
cgccggcaccggggcugcccgc

SEQ ID NO: 3181870 - RNA, 23 nt, Mycobacterium bovis subsp bovis AF2122/97
cgccggcaccggggcugcccgcg

SEQ ID NO: 3181871 - RNA, 20 nt, Mycobacterium bovis subsp bovis AF2122/97
cgccggcacgaaucccccgg

SEQ ID NO: 3181872 - RNA, 16 nt, Mycobacterium bovis subsp bovis AF2122/97
cgccggcacgcagcca

SEQ ID NO: 3181873 - RNA, 15 nt, Mycobacterium bovis subsp bovis AF2122/97
cgccggcaggguucc

SEQ ID NO: 3181874 - RNA, 17 nt, Mycobacterium bovis subsp bovis AF2122/97
cgccggcauagaugccg

SEQ ID NO: 3181875 - RNA, 15 nt, Mycobacterium bovis subsp bovis AF2122/97
cgccggcaucgacgu

SEQ ID NO: 3181876 - RNA, 17 nt, Mycobacterium bovis subsp bovis AF2122/97
cgccggcaucgcgcaac

SEQ ID NO: 3181877 - RNA, 15 nt, Mycobacterium bovis subsp bovis AF2122/97
cgccggcaucgcgcg

SEQ ID NO: 3181878 - RNA, 22 nt, Mycobacterium bovis subsp bovis AF2122/97
cgccggcaucggucagcgcggc

SEQ ID NO: 3181879 - RNA, 15 nt, Mycobacterium bovis subsp bovis AF2122/97
cgccggcaucgucga

SEQ ID NO: 3181880 - RNA, 16 nt, Mycobacterium bovis subsp bovis AF2122/97
cgccggcaucuccacc

SEQ ID NO: 3181881 - RNA, 19 nt, Mycobacterium bovis subsp bovis AF2122/97
cgccggcaucuccaccguc

SEQ ID NO: 3181882 - RNA, 20 nt, Mycobacterium bovis subsp bovis AF2122/97
cgccggcaucuccaccgucg

SEQ ID NO: 3181883 - RNA, 21 nt, Mycobacterium bovis subsp bovis AF2122/97
cgccggcaucuccaccgucgc

SEQ ID NO: 3181884 - RNA, 22 nt, Mycobacterium bovis subsp bovis AF2122/97
cgccggcaucuccaccgucgcc

SEQ ID NO: 3181885 - RNA, 16 nt, Mycobacterium bovis subsp bovis AF2122/97
cgccggcaugccagcc

SEQ ID NO: 3181886 - RNA, 17 nt, Mycobacterium bovis subsp bovis AF2122/97
cgccggcaugccagcca

SEQ ID NO: 3181887 - RNA, 12 nt, Mycobacterium bovis subsp bovis AF2122/97
cgccggccacca

SEQ ID NO: 3181888 - RNA, 14 nt, Mycobacterium bovis subsp bovis AF2122/97
cgccggccacccgc

SEQ ID NO: 3181889 - RNA, 17 nt, Mycobacterium bovis subsp bovis AF2122/97
cgccggccacccgcgcg

SEQ ID NO: 3181890 - RNA, 11 nt, Mycobacterium bovis subsp bovis AF2122/97
cgccggccacg

SEQ ID NO: 3181891 - RNA, 13 nt, Mycobacterium bovis subsp bovis AF2122/97
cgccggccacgac

SEQ ID NO: 3181892 - RNA, 14 nt, Mycobacterium bovis subsp bovis AF2122/97
cgccggccacgacc

SEQ ID NO: 3181893 - RNA, 20 nt, Mycobacterium bovis subsp bovis AF2122/97
cgccggccagcacuccgcgg

SEQ ID NO: 3181894 - RNA, 12 nt, Mycobacterium bovis subsp bovis AF2122/97
cgccggccagcc

SEQ ID NO: 3181895 - RNA, 13 nt, Mycobacterium bovis subsp bovis AF2122/97
cgccggccagcca

SEQ ID NO: 3181896 - RNA, 21 nt, Mycobacterium bovis subsp bovis AF2122/97
cgccggccagccagcgaucca

SEQ ID NO: 3181897 - RNA, 14 nt, Mycobacterium bovis subsp bovis AF2122/97
cgccggccagcggc

SEQ ID NO: 3181898 - RNA, 22 nt, Mycobacterium bovis subsp bovis AF2122/97
cgccggccagcggccauccggc

SEQ ID NO: 3181899 - RNA, 14 nt, Mycobacterium bovis subsp bovis AF2122/97
cgccggccagcguc

SEQ ID NO: 3181900 - RNA, 16 nt, Mycobacterium bovis subsp bovis AF2122/97
cgccggccagcgucgc

SEQ ID NO: 3181901 - RNA, 11 nt, Mycobacterium bovis subsp bovis AF2122/97
cgccggccagg

SEQ ID NO: 3181902 - RNA, 15 nt, Mycobacterium bovis subsp bovis AF2122/97
cgccggccaguccgc

SEQ ID NO: 3181903 - RNA, 20 nt, Mycobacterium bovis subsp bovis AF2122/97
cgccggccaguccgcgcgca

SEQ ID NO: 3181904 - RNA, 13 nt, Mycobacterium bovis subsp bovis AF2122/97
cgccggccagucg

SEQ ID NO: 3181905 - RNA, 13 nt, Mycobacterium bovis subsp bovis AF2122/97
cgccggccaguuc

SEQ ID NO: 3181906 - RNA, 15 nt, Mycobacterium bovis subsp bovis AF2122/97
cgccggccaugugca

SEQ ID NO: 3181907 - RNA, 20 nt, Mycobacterium bovis subsp bovis AF2122/97
cgccggccaugugcacggcg

SEQ ID NO: 3181908 - RNA, 16 nt, Mycobacterium bovis subsp bovis AF2122/97
cgccggccccaccggu

SEQ ID NO: 3181909 - RNA, 21 nt, Mycobacterium bovis subsp bovis AF2122/97
cgccggccccaccggugccgc

SEQ ID NO: 3181910 - RNA, 23 nt, Mycobacterium bovis subsp bovis AF2122/97
cgccggccccaccggugccgccg

SEQ ID NO: 3181911 - RNA, 14 nt, Mycobacterium bovis subsp bovis AF2122/97
cgccggccccgcca

SEQ ID NO: 3181912 - RNA, 16 nt, Mycobacterium bovis subsp bovis AF2122/97
cgccggccccgccagc

SEQ ID NO: 3181913 - RNA, 20 nt, Mycobacterium bovis subsp bovis AF2122/97
cgccggccccgccagcgccg

SEQ ID NO: 3181914 - RNA, 14 nt, Mycobacterium bovis subsp bovis AF2122/97
cgccggccccgccg

SEQ ID NO: 3181915 - RNA, 20 nt, Mycobacterium bovis subsp bovis AF2122/97
cgccggccccgccgaugccg

SEQ ID NO: 3181916 - RNA, 15 nt, Mycobacterium bovis subsp bovis AF2122/97
cgccggccccgccgc

SEQ ID NO: 3181917 - RNA, 16 nt, Mycobacterium bovis subsp bovis AF2122/97
cgccggccccgccggc

SEQ ID NO: 3181918 - RNA, 23 nt, Mycobacterium bovis subsp bovis AF2122/97
cgccggccccgccggccccgccg

SEQ ID NO: 3181919 - RNA, 17 nt, Mycobacterium bovis subsp bovis AF2122/97
cgccggccccgccggcg

SEQ ID NO: 3181920 - RNA, 21 nt, Mycobacterium bovis subsp bovis AF2122/97
cgccggccccgccggcgccgc

SEQ ID NO: 3181921 - RNA, 23 nt, Mycobacterium bovis subsp bovis AF2122/97
cgccggccccgccggcgccgccc

SEQ ID NO: 3181922 - RNA, 17 nt, Mycobacterium bovis subsp bovis AF2122/97
cgccggccccgccguca

SEQ ID NO: 3181923 - RNA, 23 nt, Mycobacterium bovis subsp bovis AF2122/97
cgccggccccgccgucacccccg

SEQ ID NO: 3181924 - RNA, 21 nt, Mycobacterium bovis subsp bovis AF2122/97
cgccggccccgccgucaccgc

SEQ ID NO: 3181925 - RNA, 22 nt, Mycobacterium bovis subsp bovis AF2122/97
cgccggccccgccgucaccgcc

SEQ ID NO: 3181926 - RNA, 23 nt, Mycobacterium bovis subsp bovis AF2122/97
cgccggccccgccgucaccgccg

SEQ ID NO: 3181927 - RNA, 19 nt, Mycobacterium bovis subsp bovis AF2122/97
cgccggccccgccgucgcc

SEQ ID NO: 3181928 - RNA, 20 nt, Mycobacterium bovis subsp bovis AF2122/97
cgccggccccgccgucgccg

SEQ ID NO: 3181929 - RNA, 21 nt, Mycobacterium bovis subsp bovis AF2122/97
cgccggccccgccgucgccgc

SEQ ID NO: 3181930 - RNA, 15 nt, Mycobacterium bovis subsp bovis AF2122/97
cgccggcccgacggg

SEQ ID NO: 3181931 - RNA, 12 nt, Mycobacterium bovis subsp bovis AF2122/97
cgccggcccgcg

SEQ ID NO: 3181932 - RNA, 17 nt, Mycobacterium bovis subsp bovis AF2122/97
cgccggcccggugauga

SEQ ID NO: 3181933 - RNA, 18 nt, Mycobacterium bovis subsp bovis AF2122/97
cgccggcccggugaugaa

SEQ ID NO: 3181934 - RNA, 15 nt, Mycobacterium bovis subsp bovis AF2122/97
cgccggccgaucggc

SEQ ID NO: 3181935 - RNA, 13 nt, Mycobacterium bovis subsp bovis AF2122/97
cgccggccgcacg

SEQ ID NO: 3181936 - RNA, 14 nt, Mycobacterium bovis subsp bovis AF2122/97
cgccggccgcacgc

SEQ ID NO: 3181937 - RNA, 16 nt, Mycobacterium bovis subsp bovis AF2122/97
cgccggccgcacgccg

SEQ ID NO: 3181938 - RNA, 23 nt, Mycobacterium bovis subsp bovis AF2122/97
cgccggccgcacgccggccagcg

SEQ ID NO: 3181939 - RNA, 12 nt, Mycobacterium bovis subsp bovis AF2122/97
cgccggccgcca

SEQ ID NO: 3181940 - RNA, 14 nt, Mycobacterium bovis subsp bovis AF2122/97
cgccggccgccagc

SEQ ID NO: 3181941 - RNA, 16 nt, Mycobacterium bovis subsp bovis AF2122/97
cgccggccgccagcgc

SEQ ID NO: 3181942 - RNA, 13 nt, Mycobacterium bovis subsp bovis AF2122/97
cgccggccgcgca

SEQ ID NO: 3181943 - RNA, 14 nt, Mycobacterium bovis subsp bovis AF2122/97
cgccggccgcgcag

SEQ ID NO: 3181944 - RNA, 21 nt, Mycobacterium bovis subsp bovis AF2122/97
cgccggccgcggcggccccgc

SEQ ID NO: 3181945 - RNA, 21 nt, Mycobacterium bovis subsp bovis AF2122/97
cgccggccgcugccuuggcgc

SEQ ID NO: 3181946 - RNA, 20 nt, Mycobacterium bovis subsp bovis AF2122/97
cgccggccggaacgcccggc

SEQ ID NO: 3181947 - RNA, 13 nt, Mycobacterium bovis subsp bovis AF2122/97
cgccggccggcag

SEQ ID NO: 3181948 - RNA, 14 nt, Mycobacterium bovis subsp bovis AF2122/97
cgccggccggcagg

SEQ ID NO: 3181949 - RNA, 13 nt, Mycobacterium bovis subsp bovis AF2122/97
cgccggccggcau

SEQ ID NO: 3181950 - RNA, 12 nt, Mycobacterium bovis subsp bovis AF2122/97
cgccggccggcc

SEQ ID NO: 3181951 - RNA, 15 nt, Mycobacterium bovis subsp bovis AF2122/97
cgccggccggcccgg

SEQ ID NO: 3181952 - RNA, 14 nt, Mycobacterium bovis subsp bovis AF2122/97
cgccggccggcgcg

SEQ ID NO: 3181953 - RNA, 15 nt, Mycobacterium bovis subsp bovis AF2122/97
cgccggccgucagca

SEQ ID NO: 3181954 - RNA, 17 nt, Mycobacterium bovis subsp bovis AF2122/97
cgccggccgucggccgg

SEQ ID NO: 3181955 - RNA, 15 nt, Mycobacterium bovis subsp bovis AF2122/97
cgccggccucgccga

SEQ ID NO: 3181956 - RNA, 17 nt, Mycobacterium bovis subsp bovis AF2122/97
cgccggccucgccgaag

SEQ ID NO: 3181957 - RNA, 17 nt, Mycobacterium bovis subsp bovis AF2122/97
cgccggccucgccgggg

SEQ ID NO: 3181958 - RNA, 22 nt, Mycobacterium bovis subsp bovis AF2122/97
cgccggccucuggaucacgucg

SEQ ID NO: 3181959 - RNA, 16 nt, Mycobacterium bovis subsp bovis AF2122/97
cgccggccugcucggc

SEQ ID NO: 3181960 - RNA, 12 nt, Mycobacterium bovis subsp bovis AF2122/97
cgccggccuggc

SEQ ID NO: 3181961 - RNA, 15 nt, Mycobacterium bovis subsp bovis AF2122/97
cgccggccuggccgc

SEQ ID NO: 3181962 - RNA, 17 nt, Mycobacterium bovis subsp bovis AF2122/97
cgccggccuggccgcca

SEQ ID NO: 3181963 - RNA, 22 nt, Mycobacterium bovis subsp bovis AF2122/97
cgccggccuugagcacccgaua

SEQ ID NO: 3181964 - RNA, 19 nt, Mycobacterium bovis subsp bovis AF2122/97
cgccggccuugugcucgau

SEQ ID NO: 3181965 - RNA, 20 nt, Mycobacterium bovis subsp bovis AF2122/97
cgccggcgaacugaucguug

SEQ ID NO: 3181966 - RNA, 18 nt, Mycobacterium bovis subsp bovis AF2122/97
cgccggcgaagaccgccg

SEQ ID NO: 3181967 - RNA, 23 nt, Mycobacterium bovis subsp bovis AF2122/97
cgccggcgaagcgugcgccgacu

SEQ ID NO: 3181968 - RNA, 12 nt, Mycobacterium bovis subsp bovis AF2122/97
cgccggcgacgg

SEQ ID NO: 3181969 - RNA, 15 nt, Mycobacterium bovis subsp bovis AF2122/97
cgccggcgacggguc

SEQ ID NO: 3181970 - RNA, 13 nt, Mycobacterium bovis subsp bovis AF2122/97
cgccggcgccacc

SEQ ID NO: 3181971 - RNA, 14 nt, Mycobacterium bovis subsp bovis AF2122/97
cgccggcgccaccc

SEQ ID NO: 3181972 - RNA, 21 nt, Mycobacterium bovis subsp bovis AF2122/97
cgccggcgccacccgcgccgc

SEQ ID NO: 3181973 - RNA, 16 nt, Mycobacterium bovis subsp bovis AF2122/97
cgccggcgccaccguc

SEQ ID NO: 3181974 - RNA, 23 nt, Mycobacterium bovis subsp bovis AF2122/97
cgccggcgccaccgucaccgccg

SEQ ID NO: 3181975 - RNA, 23 nt, Mycobacterium bovis subsp bovis AF2122/97
cgccggcgccaccgucgccguac

SEQ ID NO: 3181976 - RNA, 23 nt, Mycobacterium bovis subsp bovis AF2122/97
cgccggcgccaccguugccgaac

SEQ ID NO: 3181977 - RNA, 14 nt, Mycobacterium bovis subsp bovis AF2122/97
cgccggcgccagca

SEQ ID NO: 3181978 - RNA, 22 nt, Mycobacterium bovis subsp bovis AF2122/97
cgccggcgccagcagaucuccg

SEQ ID NO: 3181979 - RNA, 15 nt, Mycobacterium bovis subsp bovis AF2122/97
cgccggcgccagcgc

SEQ ID NO: 3181980 - RNA, 18 nt, Mycobacterium bovis subsp bovis AF2122/97
cgccggcgccagcgccgc

SEQ ID NO: 3181981 - RNA, 20 nt, Mycobacterium bovis subsp bovis AF2122/97
cgccggcgccagcgccgcca

SEQ ID NO: 3181982 - RNA, 22 nt, Mycobacterium bovis subsp bovis AF2122/97
cgccggcgccaucgggucaccc

SEQ ID NO: 3181983 - RNA, 13 nt, Mycobacterium bovis subsp bovis AF2122/97
cgccggcgcccag

SEQ ID NO: 3181984 - RNA, 14 nt, Mycobacterium bovis subsp bovis AF2122/97
cgccggcgcccagg

SEQ ID NO: 3181985 - RNA, 17 nt, Mycobacterium bovis subsp bovis AF2122/97
cgccggcgcccaggccg

SEQ ID NO: 3181986 - RNA, 14 nt, Mycobacterium bovis subsp bovis AF2122/97
cgccggcgccgaac

SEQ ID NO: 3181987 - RNA, 13 nt, Mycobacterium bovis subsp bovis AF2122/97
cgccggcgccgcc

SEQ ID NO: 3181988 - RNA, 18 nt, Mycobacterium bovis subsp bovis AF2122/97
cgccggcgccgccauugc

SEQ ID NO: 3181989 - RNA, 14 nt, Mycobacterium bovis subsp bovis AF2122/97
cgccggcgccgccc

SEQ ID NO: 3181990 - RNA, 16 nt, Mycobacterium bovis subsp bovis AF2122/97
cgccggcgccgcccgc

SEQ ID NO: 3181991 - RNA, 17 nt, Mycobacterium bovis subsp bovis AF2122/97
cgccggcgccgcccgcg

SEQ ID NO: 3181992 - RNA, 18 nt, Mycobacterium bovis subsp bovis AF2122/97
cgccggcgccgcccgcgc

SEQ ID NO: 3181993 - RNA, 17 nt, Mycobacterium bovis subsp bovis AF2122/97
cgccggcgccgccgaug

SEQ ID NO: 3181994 - RNA, 20 nt, Mycobacterium bovis subsp bovis AF2122/97
cgccggcgccgccgaugccg

SEQ ID NO: 3181995 - RNA, 17 nt, Mycobacterium bovis subsp bovis AF2122/97
cgccggcgccgccggcg

SEQ ID NO: 3181996 - RNA, 22 nt, Mycobacterium bovis subsp bovis AF2122/97
cgccggcgccgccggugccacc

SEQ ID NO: 3181997 - RNA, 17 nt, Mycobacterium bovis subsp bovis AF2122/97
cgccggcgccgccguuc

SEQ ID NO: 3181998 - RNA, 23 nt, Mycobacterium bovis subsp bovis AF2122/97
cgccggcgccgccguucccgccg

SEQ ID NO: 3181999 - RNA, 19 nt, Mycobacterium bovis subsp bovis AF2122/97
cgccggcgccggagccgcc

SEQ ID NO: 3182000 - RNA, 13 nt, Mycobacterium bovis subsp bovis AF2122/97
cgccggcgccggc

SEQ ID NO: 3182001 - RNA, 14 nt, Mycobacterium bovis subsp bovis AF2122/97
cgccggcgccggca

SEQ ID NO: 3182002 - RNA, 13 nt, Mycobacterium bovis subsp bovis AF2122/97
cgccggcgccggu

SEQ ID NO: 3182003 - RNA, 17 nt, Mycobacterium bovis subsp bovis AF2122/97
cgccggcgccggugccg

SEQ ID NO: 3182004 - RNA, 15 nt, Mycobacterium bovis subsp bovis AF2122/97
cgccggcgccucgug

SEQ ID NO: 3182005 - RNA, 20 nt, Mycobacterium bovis subsp bovis AF2122/97
cgccggcgccucgugcgugg

SEQ ID NO: 3182006 - RNA, 14 nt, Mycobacterium bovis subsp bovis AF2122/97
cgccggcgcgcacc

SEQ ID NO: 3182007 - RNA, 18 nt, Mycobacterium bovis subsp bovis AF2122/97
cgccggcgcgcaccccgg

SEQ ID NO: 3182008 - RNA, 16 nt, Mycobacterium bovis subsp bovis AF2122/97
cgccggcgcgcagccg

SEQ ID NO: 3182009 - RNA, 13 nt, Mycobacterium bovis subsp bovis AF2122/97
cgccggcgcgccg

SEQ ID NO: 3182010 - RNA, 15 nt, Mycobacterium bovis subsp bovis AF2122/97
cgccggcgcgccgau

SEQ ID NO: 3182011 - RNA, 16 nt, Mycobacterium bovis subsp bovis AF2122/97
cgccggcgcgccgaug

SEQ ID NO: 3182012 - RNA, 20 nt, Mycobacterium bovis subsp bovis AF2122/97
cgccggcgcugaucgcgaag

SEQ ID NO: 3182013 - RNA, 13 nt, Mycobacterium bovis subsp bovis AF2122/97
cgccggcgcugcu

SEQ ID NO: 3182014 - RNA, 22 nt, Mycobacterium bovis subsp bovis AF2122/97
cgccggcgcuggcgggcgaucg

SEQ ID NO: 3182015 - RNA, 14 nt, Mycobacterium bovis subsp bovis AF2122/97
cgccggcggaagcg

SEQ ID NO: 3182016 - RNA, 21 nt, Mycobacterium bovis subsp bovis AF2122/97
cgccggcggaccccucgaccg

SEQ ID NO: 3182017 - RNA, 16 nt, Mycobacterium bovis subsp bovis AF2122/97
cgccggcggccaccuc

SEQ ID NO: 3182018 - RNA, 14 nt, Mycobacterium bovis subsp bovis AF2122/97
cgccggcggcccgc

SEQ ID NO: 3182019 - RNA, 19 nt, Mycobacterium bovis subsp bovis AF2122/97
cgccggcggccgcggugcc

SEQ ID NO: 3182020 - RNA, 13 nt, Mycobacterium bovis subsp bovis AF2122/97
cgccggcggcggc

SEQ ID NO: 3182021 - RNA, 17 nt, Mycobacterium bovis subsp bovis AF2122/97
cgccggcggcggccgca

SEQ ID NO: 3182022 - RNA, 13 nt, Mycobacterium bovis subsp bovis AF2122/97
cgccggcggcggu

SEQ ID NO: 3182023 - RNA, 22 nt, Mycobacterium bovis subsp bovis AF2122/97
cgccggcggcggugcgccccgc

SEQ ID NO: 3182024 - RNA, 15 nt, Mycobacterium bovis subsp bovis AF2122/97
cgccggcgggcgagu

SEQ ID NO: 3182025 - RNA, 20 nt, Mycobacterium bovis subsp bovis AF2122/97
cgccggcgggcgcgggcgcc

SEQ ID NO: 3182026 - RNA, 21 nt, Mycobacterium bovis subsp bovis AF2122/97
cgccggcgggcgcgggcgccg

SEQ ID NO: 3182027 - RNA, 14 nt, Mycobacterium bovis subsp bovis AF2122/97
cgccggcgggcugu

SEQ ID NO: 3182028 - RNA, 19 nt, Mycobacterium bovis subsp bovis AF2122/97
cgccggcggguggcccccg

SEQ ID NO: 3182029 - RNA, 21 nt, Mycobacterium bovis subsp bovis AF2122/97
cgccggcgguagucggccagc

SEQ ID NO: 3182030 - RNA, 13 nt, Mycobacterium bovis subsp bovis AF2122/97
cgccggcggucgc

SEQ ID NO: 3182031 - RNA, 14 nt, Mycobacterium bovis subsp bovis AF2122/97
cgccggcggugaug

SEQ ID NO: 3182032 - RNA, 18 nt, Mycobacterium bovis subsp bovis AF2122/97
cgccggcguccggagccc

SEQ ID NO: 3182033 - RNA, 23 nt, Mycobacterium bovis subsp bovis AF2122/97
cgccggcguccggagccccuguc

SEQ ID NO: 3182034 - RNA, 15 nt, Mycobacterium bovis subsp bovis AF2122/97
cgccggcgucgagcc

SEQ ID NO: 3182035 - RNA, 16 nt, Mycobacterium bovis subsp bovis AF2122/97
cgccggcgucggcgcc

SEQ ID NO: 3182036 - RNA, 22 nt, Mycobacterium bovis subsp bovis AF2122/97
cgccggcgucggcgcccagcuc

SEQ ID NO: 3182037 - RNA, 22 nt, Mycobacterium bovis subsp bovis AF2122/97
cgccggcuaccgccuugucggc

SEQ ID NO: 3182038 - RNA, 22 nt, Mycobacterium bovis subsp bovis AF2122/97
cgccggcuagggcccuggcggc

SEQ ID NO: 3182039 - RNA, 10 nt, Mycobacterium bovis subsp bovis AF2122/97
cgccggcucc

SEQ ID NO: 3182040 - RNA, 13 nt, Mycobacterium bovis subsp bovis AF2122/97
cgccggcuccacc

SEQ ID NO: 3182041 - RNA, 14 nt, Mycobacterium bovis subsp bovis AF2122/97
cgccggcuccaccc

SEQ ID NO: 3182042 - RNA, 20 nt, Mycobacterium bovis subsp bovis AF2122/97
cgccggcuccacccuugccg

SEQ ID NO: 3182043 - RNA, 12 nt, Mycobacterium bovis subsp bovis AF2122/97
cgccggcuccgc

SEQ ID NO: 3182044 - RNA, 14 nt, Mycobacterium bovis subsp bovis AF2122/97
cgccggcuccgcag

SEQ ID NO: 3182045 - RNA, 16 nt, Mycobacterium bovis subsp bovis AF2122/97
cgccggcuccgcagcg

SEQ ID NO: 3182046 - RNA, 19 nt, Mycobacterium bovis subsp bovis AF2122/97
cgccggcuccgccacuggc

SEQ ID NO: 3182047 - RNA, 20 nt, Mycobacterium bovis subsp bovis AF2122/97
cgccggcuccgccacuggcg

SEQ ID NO: 3182048 - RNA, 20 nt, Mycobacterium bovis subsp bovis AF2122/97
cgccggcuccgccguugccg

SEQ ID NO: 3182049 - RNA, 23 nt, Mycobacterium bovis subsp bovis AF2122/97
cgccggcuccgccguugccgccg

SEQ ID NO: 3182050 - RNA, 14 nt, Mycobacterium bovis subsp bovis AF2122/97
cgccggcuccggcg

SEQ ID NO: 3182051 - RNA, 15 nt, Mycobacterium bovis subsp bovis AF2122/97
cgccggcuccggcgg

SEQ ID NO: 3182052 - RNA, 18 nt, Mycobacterium bovis subsp bovis AF2122/97
cgccggcuccggcggugc

SEQ ID NO: 3182053 - RNA, 14 nt, Mycobacterium bovis subsp bovis AF2122/97
cgccggcucgucga

SEQ ID NO: 3182054 - RNA, 23 nt, Mycobacterium bovis subsp bovis AF2122/97
cgccggcucuccggugaucaccg

SEQ ID NO: 3182055 - RNA, 16 nt, Mycobacterium bovis subsp bovis AF2122/97
cgccggcugcggaggc

SEQ ID NO: 3182056 - RNA, 16 nt, Mycobacterium bovis subsp bovis AF2122/97
cgccggcuucgcccag

SEQ ID NO: 3182057 - RNA, 22 nt, Mycobacterium bovis subsp bovis AF2122/97
cgccggcuucgcccagagccgc

SEQ ID NO: 3182058 - RNA, 23 nt, Mycobacterium bovis subsp bovis AF2122/97
cgccggcuucgcccagagccgcu

SEQ ID NO: 3182059 - RNA, 16 nt, Mycobacterium bovis subsp bovis AF2122/97
cgccggcuuggauacc

SEQ ID NO: 3182060 - RNA, 12 nt, Mycobacterium bovis subsp bovis AF2122/97
cgccgggaaaca

SEQ ID NO: 3182061 - RNA, 15 nt, Mycobacterium bovis subsp bovis AF2122/97
cgccgggaaacaccg

SEQ ID NO: 3182062 - RNA, 17 nt, Mycobacterium bovis subsp bovis AF2122/97
cgccgggaaacaccggc

SEQ ID NO: 3182063 - RNA, 19 nt, Mycobacterium bovis subsp bovis AF2122/97
cgccgggaaacaccggcuu

SEQ ID NO: 3182064 - RNA, 20 nt, Mycobacterium bovis subsp bovis AF2122/97
cgccgggaaauaucucggug

SEQ ID NO: 3182065 - RNA, 19 nt, Mycobacterium bovis subsp bovis AF2122/97
cgccgggaacaucccagcg

SEQ ID NO: 3182066 - RNA, 19 nt, Mycobacterium bovis subsp bovis AF2122/97
cgccgggauaacccagcac

SEQ ID NO: 3182067 - RNA, 15 nt, Mycobacterium bovis subsp bovis AF2122/97
cgccgggcaacgcga

SEQ ID NO: 3182068 - RNA, 19 nt, Mycobacterium bovis subsp bovis AF2122/97
cgccgggcaaggccaccgu

SEQ ID NO: 3182069 - RNA, 16 nt, Mycobacterium bovis subsp bovis AF2122/97
cgccgggcaguuuggc

SEQ ID NO: 3182070 - RNA, 21 nt, Mycobacterium bovis subsp bovis AF2122/97
cgccgggcaguuuggcggcag

SEQ ID NO: 3182071 - RNA, 22 nt, Mycobacterium bovis subsp bovis AF2122/97
cgccgggcaguuuggcggcagg

SEQ ID NO: 3182072 - RNA, 14 nt, Mycobacterium bovis subsp bovis AF2122/97
cgccgggcaucggu

SEQ ID NO: 3182073 - RNA, 22 nt, Mycobacterium bovis subsp bovis AF2122/97
cgccgggcaucggugccacggc

SEQ ID NO: 3182074 - RNA, 21 nt, Mycobacterium bovis subsp bovis AF2122/97
cgccgggccacguccugcccg

SEQ ID NO: 3182075 - RNA, 13 nt, Mycobacterium bovis subsp bovis AF2122/97
cgccgggcccguc

SEQ ID NO: 3182076 - RNA, 12 nt, Mycobacterium bovis subsp bovis AF2122/97
cgccgggcccuc

SEQ ID NO: 3182077 - RNA, 17 nt, Mycobacterium bovis subsp bovis AF2122/97
cgccgggcccucgccau

SEQ ID NO: 3182078 - RNA, 22 nt, Mycobacterium bovis subsp bovis AF2122/97
cgccgggcgaguacaggcgcag

SEQ ID NO: 3182079 - RNA, 12 nt, Mycobacterium bovis subsp bovis AF2122/97
cgccgggcggca

SEQ ID NO: 3182080 - RNA, 22 nt, Mycobacterium bovis subsp bovis AF2122/97
cgccgggcggcauccugcacga

SEQ ID NO: 3182081 - RNA, 15 nt, Mycobacterium bovis subsp bovis AF2122/97
cgccgggcggcgcga

SEQ ID NO: 3182082 - RNA, 19 nt, Mycobacterium bovis subsp bovis AF2122/97
cgccgggcguccgccggcg

SEQ ID NO: 3182083 - RNA, 21 nt, Mycobacterium bovis subsp bovis AF2122/97
cgccgggcguccgccggcgag

SEQ ID NO: 3182084 - RNA, 23 nt, Mycobacterium bovis subsp bovis AF2122/97
cgccgggcuguucggccauggcg

SEQ ID NO: 3182085 - RNA, 18 nt, Mycobacterium bovis subsp bovis AF2122/97
cgccgggcuuaggccgcg

SEQ ID NO: 3182086 - RNA, 21 nt, Mycobacterium bovis subsp bovis AF2122/97
cgccgggcuuaggccgcggca

SEQ ID NO: 3182087 - RNA, 18 nt, Mycobacterium bovis subsp bovis AF2122/97
cgccgggcuucagcacgc

SEQ ID NO: 3182088 - RNA, 20 nt, Mycobacterium bovis subsp bovis AF2122/97
cgccgggcuuggccgcgccg

SEQ ID NO: 3182089 - RNA, 13 nt, Mycobacterium bovis subsp bovis AF2122/97
cgccggggaccac

SEQ ID NO: 3182090 - RNA, 15 nt, Mycobacterium bovis subsp bovis AF2122/97
cgccggggacgccgc

SEQ ID NO: 3182091 - RNA, 18 nt, Mycobacterium bovis subsp bovis AF2122/97
cgccggggacgccgcggc

SEQ ID NO: 3182092 - RNA, 22 nt, Mycobacterium bovis subsp bovis AF2122/97
cgccggggacgccgcggcgccg

SEQ ID NO: 3182093 - RNA, 18 nt, Mycobacterium bovis subsp bovis AF2122/97
cgccggggauaccgguca

SEQ ID NO: 3182094 - RNA, 13 nt, Mycobacterium bovis subsp bovis AF2122/97
cgccggggccgcc

SEQ ID NO: 3182095 - RNA, 14 nt, Mycobacterium bovis subsp bovis AF2122/97
cgccggggccgccg

SEQ ID NO: 3182096 - RNA, 13 nt, Mycobacterium bovis subsp bovis AF2122/97
cgccggggccgcu

SEQ ID NO: 3182097 - RNA, 20 nt, Mycobacterium bovis subsp bovis AF2122/97
cgccggggcgaugucggcug

SEQ ID NO: 3182098 - RNA, 19 nt, Mycobacterium bovis subsp bovis AF2122/97
cgccggggcgcagguuggc

SEQ ID NO: 3182099 - RNA, 21 nt, Mycobacterium bovis subsp bovis AF2122/97
cgccgggggacgauuccgccc

SEQ ID NO: 3182100 - RNA, 16 nt, Mycobacterium bovis subsp bovis AF2122/97
cgccgggggcgccgcc

SEQ ID NO: 3182101 - RNA, 18 nt, Mycobacterium bovis subsp bovis AF2122/97
cgccggggggcugcugcu

SEQ ID NO: 3182102 - RNA, 17 nt, Mycobacterium bovis subsp bovis AF2122/97
cgccggguagcuguaca

SEQ ID NO: 3182103 - RNA, 13 nt, Mycobacterium bovis subsp bovis AF2122/97
cgccgggucacgu

SEQ ID NO: 3182104 - RNA, 17 nt, Mycobacterium bovis subsp bovis AF2122/97
cgccgggucagcccggc

SEQ ID NO: 3182105 - RNA, 18 nt, Mycobacterium bovis subsp bovis AF2122/97
cgccgggucagcccggcg

SEQ ID NO: 3182106 - RNA, 20 nt, Mycobacterium bovis subsp bovis AF2122/97
cgccgggucagcccggcgcg

SEQ ID NO: 3182107 - RNA, 21 nt, Mycobacterium bovis subsp bovis AF2122/97
cgccgggucagcccggcgcga

SEQ ID NO: 3182108 - RNA, 20 nt, Mycobacterium bovis subsp bovis AF2122/97
cgccggguccggaaccggua

SEQ ID NO: 3182109 - RNA, 16 nt, Mycobacterium bovis subsp bovis AF2122/97
cgccgggucgaugggu

SEQ ID NO: 3182110 - RNA, 19 nt, Mycobacterium bovis subsp bovis AF2122/97
cgccgggucguacaacacg

SEQ ID NO: 3182111 - RNA, 16 nt, Mycobacterium bovis subsp bovis AF2122/97
cgccgggugaggcggu

SEQ ID NO: 3182112 - RNA, 17 nt, Mycobacterium bovis subsp bovis AF2122/97
cgccgggugcaacggcg

SEQ ID NO: 3182113 - RNA, 19 nt, Mycobacterium bovis subsp bovis AF2122/97
cgccgggugcaacggcguu

SEQ ID NO: 3182114 - RNA, 14 nt, Mycobacterium bovis subsp bovis AF2122/97
cgccgggugcgccg

SEQ ID NO: 3182115 - RNA, 17 nt, Mycobacterium bovis subsp bovis AF2122/97
cgccgggugucgguggu

SEQ ID NO: 3182116 - RNA, 22 nt, Mycobacterium bovis subsp bovis AF2122/97
cgccggguguggcuugacgccc

SEQ ID NO: 3182117 - RNA, 15 nt, Mycobacterium bovis subsp bovis AF2122/97
cgccggguucgccgg

SEQ ID NO: 3182118 - RNA, 22 nt, Mycobacterium bovis subsp bovis AF2122/97
cgccgguaacuguccgcccgga

SEQ ID NO: 3182119 - RNA, 14 nt, Mycobacterium bovis subsp bovis AF2122/97
cgccgguaggcggc

SEQ ID NO: 3182120 - RNA, 19 nt, Mycobacterium bovis subsp bovis AF2122/97
cgccgguaggcggccagcg

SEQ ID NO: 3182121 - RNA, 13 nt, Mycobacterium bovis subsp bovis AF2122/97
cgccggucacgac

SEQ ID NO: 3182122 - RNA, 23 nt, Mycobacterium bovis subsp bovis AF2122/97
cgccggucagcaauacggcggcg

SEQ ID NO: 3182123 - RNA, 16 nt, Mycobacterium bovis subsp bovis AF2122/97
cgccggucaggccgcc

SEQ ID NO: 3182124 - RNA, 17 nt, Mycobacterium bovis subsp bovis AF2122/97
cgccggucaggccgccg

SEQ ID NO: 3182125 - RNA, 22 nt, Mycobacterium bovis subsp bovis AF2122/97
cgccggucaggccgccgcggcg

SEQ ID NO: 3182126 - RNA, 18 nt, Mycobacterium bovis subsp bovis AF2122/97
cgccggucaucccaagcg

SEQ ID NO: 3182127 - RNA, 24 nt, Mycobacterium bovis subsp bovis AF2122/97
cgccggucaucccaagcguccgcu

SEQ ID NO: 3182128 - RNA, 15 nt, Mycobacterium bovis subsp bovis AF2122/97
cgccggucccccgcc

SEQ ID NO: 3182129 - RNA, 22 nt, Mycobacterium bovis subsp bovis AF2122/97
cgccgguccccucggugccacu

SEQ ID NO: 3182130 - RNA, 19 nt, Mycobacterium bovis subsp bovis AF2122/97
cgccgguccucgucggcga

SEQ ID NO: 3182131 - RNA, 13 nt, Mycobacterium bovis subsp bovis AF2122/97
cgccggucgccga

SEQ ID NO: 3182132 - RNA, 14 nt, Mycobacterium bovis subsp bovis AF2122/97
cgccggucgccgac

SEQ ID NO: 3182133 - RNA, 13 nt, Mycobacterium bovis subsp bovis AF2122/97
cgccggucgccgg

SEQ ID NO: 3182134 - RNA, 15 nt, Mycobacterium bovis subsp bovis AF2122/97
cgccggucgccggcu

SEQ ID NO: 3182135 - RNA, 17 nt, Mycobacterium bovis subsp bovis AF2122/97
cgccggugacgacgucg

SEQ ID NO: 3182136 - RNA, 18 nt, Mycobacterium bovis subsp bovis AF2122/97
cgccggugacgacgucgc

SEQ ID NO: 3182137 - RNA, 23 nt, Mycobacterium bovis subsp bovis AF2122/97
cgccggugacgacgucgccgccg

SEQ ID NO: 3182138 - RNA, 17 nt, Mycobacterium bovis subsp bovis AF2122/97
cgccggugacgaugacc

SEQ ID NO: 3182139 - RNA, 21 nt, Mycobacterium bovis subsp bovis AF2122/97
cgccggugacgaugaccgcgc

SEQ ID NO: 3182140 - RNA, 22 nt, Mycobacterium bovis subsp bovis AF2122/97
cgccggugacgaugaccgcgcg

SEQ ID NO: 3182141 - RNA, 13 nt, Mycobacterium bovis subsp bovis AF2122/97
cgccggugagccg

SEQ ID NO: 3182142 - RNA, 14 nt, Mycobacterium bovis subsp bovis AF2122/97
cgccggugagccgg

SEQ ID NO: 3182143 - RNA, 17 nt, Mycobacterium bovis subsp bovis AF2122/97
cgccggugagccggaug

SEQ ID NO: 3182144 - RNA, 18 nt, Mycobacterium bovis subsp bovis AF2122/97
cgccggugaggaucagcg

SEQ ID NO: 3182145 - RNA, 17 nt, Mycobacterium bovis subsp bovis AF2122/97
cgccggugaggcgaccg

SEQ ID NO: 3182146 - RNA, 22 nt, Mycobacterium bovis subsp bovis AF2122/97
cgccggugaggcgaccggacga

SEQ ID NO: 3182147 - RNA, 17 nt, Mycobacterium bovis subsp bovis AF2122/97
cgccggugaucggcggc

SEQ ID NO: 3182148 - RNA, 13 nt, Mycobacterium bovis subsp bovis AF2122/97
cgccggugccacc

SEQ ID NO: 3182149 - RNA, 14 nt, Mycobacterium bovis subsp bovis AF2122/97
cgccggugccaccc

SEQ ID NO: 3182150 - RNA, 20 nt, Mycobacterium bovis subsp bovis AF2122/97
cgccggugccacccuugccg

SEQ ID NO: 3182151 - RNA, 14 nt, Mycobacterium bovis subsp bovis AF2122/97
cgccggugccaccg

SEQ ID NO: 3182152 - RNA, 15 nt, Mycobacterium bovis subsp bovis AF2122/97
cgccggugccaccga

SEQ ID NO: 3182153 - RNA, 16 nt, Mycobacterium bovis subsp bovis AF2122/97
cgccggugccaccggc

SEQ ID NO: 3182154 - RNA, 17 nt, Mycobacterium bovis subsp bovis AF2122/97
cgccggugccaccggcu

SEQ ID NO: 3182155 - RNA, 21 nt, Mycobacterium bovis subsp bovis AF2122/97
cgccggugccgaucagcagug

SEQ ID NO: 3182156 - RNA, 13 nt, Mycobacterium bovis subsp bovis AF2122/97
cgccggugccgcc

SEQ ID NO: 3182157 - RNA, 14 nt, Mycobacterium bovis subsp bovis AF2122/97
cgccggugccgcca

SEQ ID NO: 3182158 - RNA, 19 nt, Mycobacterium bovis subsp bovis AF2122/97
cgccggugccgccaucgcc

SEQ ID NO: 3182159 - RNA, 14 nt, Mycobacterium bovis subsp bovis AF2122/97
cgccggugccgccc

SEQ ID NO: 3182160 - RNA, 15 nt, Mycobacterium bovis subsp bovis AF2122/97
cgccggugccgcccg

SEQ ID NO: 3182161 - RNA, 16 nt, Mycobacterium bovis subsp bovis AF2122/97
cgccggugccgcccga

SEQ ID NO: 3182162 - RNA, 17 nt, Mycobacterium bovis subsp bovis AF2122/97
cgccggugccgccgccu

SEQ ID NO: 3182163 - RNA, 16 nt, Mycobacterium bovis subsp bovis AF2122/97
cgccggugccgccggg

SEQ ID NO: 3182164 - RNA, 20 nt, Mycobacterium bovis subsp bovis AF2122/97
cgccggugccgccgucgccg

SEQ ID NO: 3182165 - RNA, 23 nt, Mycobacterium bovis subsp bovis AF2122/97
cgccggugccgccgucgccgcca

SEQ ID NO: 3182166 - RNA, 15 nt, Mycobacterium bovis subsp bovis AF2122/97
cgccggugccggcca

SEQ ID NO: 3182167 - RNA, 13 nt, Mycobacterium bovis subsp bovis AF2122/97
cgccggugcgcug

SEQ ID NO: 3182168 - RNA, 22 nt, Mycobacterium bovis subsp bovis AF2122/97
cgccggugcgcuggaucuucga

SEQ ID NO: 3182169 - RNA, 14 nt, Mycobacterium bovis subsp bovis AF2122/97
cgccggugcggcca

SEQ ID NO: 3182170 - RNA, 15 nt, Mycobacterium bovis subsp bovis AF2122/97
cgccggugcggcggg

SEQ ID NO: 3182171 - RNA, 12 nt, Mycobacterium bovis subsp bovis AF2122/97
cgccggugcuga

SEQ ID NO: 3182172 - RNA, 14 nt, Mycobacterium bovis subsp bovis AF2122/97
cgccggugcugacg

SEQ ID NO: 3182173 - RNA, 11 nt, Mycobacterium bovis subsp bovis AF2122/97
cgccgguggca

SEQ ID NO: 3182174 - RNA, 17 nt, Mycobacterium bovis subsp bovis AF2122/97
cgccgguggcacccgcg

SEQ ID NO: 3182175 - RNA, 20 nt, Mycobacterium bovis subsp bovis AF2122/97
cgccgguggcacccgcgucg

SEQ ID NO: 3182176 - RNA, 15 nt, Mycobacterium bovis subsp bovis AF2122/97
cgccgguggcacggc

SEQ ID NO: 3182177 - RNA, 19 nt, Mycobacterium bovis subsp bovis AF2122/97
cgccgguggcagagccgcc

SEQ ID NO: 3182178 - RNA, 20 nt, Mycobacterium bovis subsp bovis AF2122/97
cgccgguggcagagccgccg

SEQ ID NO: 3182179 - RNA, 21 nt, Mycobacterium bovis subsp bovis AF2122/97
cgccgguggcagagccgccgu

SEQ ID NO: 3182180 - RNA, 21 nt, Mycobacterium bovis subsp bovis AF2122/97
cgccgguggccgcgcugguca

SEQ ID NO: 3182181 - RNA, 18 nt, Mycobacterium bovis subsp bovis AF2122/97
cgccgguggggucggucu

SEQ ID NO: 3182182 - RNA, 13 nt, Mycobacterium bovis subsp bovis AF2122/97
cgccggugguaac

SEQ ID NO: 3182183 - RNA, 18 nt, Mycobacterium bovis subsp bovis AF2122/97
cgccggugguaacggcgg

SEQ ID NO: 3182184 - RNA, 19 nt, Mycobacterium bovis subsp bovis AF2122/97
cgccggugguaacggcggc

SEQ ID NO: 3182185 - RNA, 21 nt, Mycobacterium bovis subsp bovis AF2122/97
cgccggugguaacggcggcca

SEQ ID NO: 3182186 - RNA, 14 nt, Mycobacterium bovis subsp bovis AF2122/97
cgccggugguaccg

SEQ ID NO: 3182187 - RNA, 17 nt, Mycobacterium bovis subsp bovis AF2122/97
cgccggugguaccggcg

SEQ ID NO: 3182188 - RNA, 18 nt, Mycobacterium bovis subsp bovis AF2122/97
cgccggugguaccggcgg

SEQ ID NO: 3182189 - RNA, 20 nt, Mycobacterium bovis subsp bovis AF2122/97
cgccggugguaccggcggcg

SEQ ID NO: 3182190 - RNA, 14 nt, Mycobacterium bovis subsp bovis AF2122/97
cgccgguggucagg

SEQ ID NO: 3182191 - RNA, 22 nt, Mycobacterium bovis subsp bovis AF2122/97
cgccgguggucagguuggcacg

SEQ ID NO: 3182192 - RNA, 23 nt, Mycobacterium bovis subsp bovis AF2122/97
cgccgguggucagguuggcacgc

SEQ ID NO: 3182193 - RNA, 16 nt, Mycobacterium bovis subsp bovis AF2122/97
cgccgguggugccggc

SEQ ID NO: 3182194 - RNA, 18 nt, Mycobacterium bovis subsp bovis AF2122/97
cgccgguggugccggcgc

SEQ ID NO: 3182195 - RNA, 21 nt, Mycobacterium bovis subsp bovis AF2122/97
cgccgguggugccggcgccgc

SEQ ID NO: 3182196 - RNA, 22 nt, Mycobacterium bovis subsp bovis AF2122/97
cgccgguggugccggcgccgcc

SEQ ID NO: 3182197 - RNA, 18 nt, Mycobacterium bovis subsp bovis AF2122/97
cgccgguguaacccucga

SEQ ID NO: 3182198 - RNA, 20 nt, Mycobacterium bovis subsp bovis AF2122/97
cgccgguguaacccucgaac

SEQ ID NO: 3182199 - RNA, 19 nt, Mycobacterium bovis subsp bovis AF2122/97
cgccgguguccuuggccgc

SEQ ID NO: 3182200 - RNA, 20 nt, Mycobacterium bovis subsp bovis AF2122/97
cgccgguguccuuggccgcc

SEQ ID NO: 3182201 - RNA, 21 nt, Mycobacterium bovis subsp bovis AF2122/97
cgccgguguccuuggccgcca

SEQ ID NO: 3182202 - RNA, 15 nt, Mycobacterium bovis subsp bovis AF2122/97
cgccggugucggcug

SEQ ID NO: 3182203 - RNA, 13 nt, Mycobacterium bovis subsp bovis AF2122/97
cgccggugucggg

SEQ ID NO: 3182204 - RNA, 17 nt, Mycobacterium bovis subsp bovis AF2122/97
cgccggugucgggcugu

SEQ ID NO: 3182205 - RNA, 21 nt, Mycobacterium bovis subsp bovis AF2122/97
cgccgguguuagugaggcccg

SEQ ID NO: 3182206 - RNA, 14 nt, Mycobacterium bovis subsp bovis AF2122/97
cgccgguucagacg

SEQ ID NO: 3182207 - RNA, 17 nt, Mycobacterium bovis subsp bovis AF2122/97
cgccgguuccgccggcc

SEQ ID NO: 3182208 - RNA, 18 nt, Mycobacterium bovis subsp bovis AF2122/97
cgccgguuccgccggccc

SEQ ID NO: 3182209 - RNA, 19 nt, Mycobacterium bovis subsp bovis AF2122/97
cgccgguuccgccggcccc

SEQ ID NO: 3182210 - RNA, 17 nt, Mycobacterium bovis subsp bovis AF2122/97
cgccgguuucgaggcga

SEQ ID NO: 3182211 - RNA, 15 nt, Mycobacterium bovis subsp bovis AF2122/97
cgccguaacagccgg

SEQ ID NO: 3182212 - RNA, 20 nt, Mycobacterium bovis subsp bovis AF2122/97
cgccguaacagccggccgga

SEQ ID NO: 3182213 - RNA, 21 nt, Mycobacterium bovis subsp bovis AF2122/97
cgccguaacggucgcugucgg

SEQ ID NO: 3182214 - RNA, 16 nt, Mycobacterium bovis subsp bovis AF2122/97
cgccguaagcaccagc

SEQ ID NO: 3182215 - RNA, 20 nt, Mycobacterium bovis subsp bovis AF2122/97
cgccguaagcaccagccagc

SEQ ID NO: 3182216 - RNA, 14 nt, Mycobacterium bovis subsp bovis AF2122/97
cgccguacaaccac

SEQ ID NO: 3182217 - RNA, 15 nt, Mycobacterium bovis subsp bovis AF2122/97
cgccguacagcgcaa

SEQ ID NO: 3182218 - RNA, 15 nt, Mycobacterium bovis subsp bovis AF2122/97
cgccguacagcggcg

SEQ ID NO: 3182219 - RNA, 13 nt, Mycobacterium bovis subsp bovis AF2122/97
cgccguacaucag

SEQ ID NO: 3182220 - RNA, 18 nt, Mycobacterium bovis subsp bovis AF2122/97
cgccguacaucagcgcga

SEQ ID NO: 3182221 - RNA, 20 nt, Mycobacterium bovis subsp bovis AF2122/97
cgccguacaucagcgcgaac

SEQ ID NO: 3182222 - RNA, 19 nt, Mycobacterium bovis subsp bovis AF2122/97
cgccguagaccagcaggcc

SEQ ID NO: 3182223 - RNA, 22 nt, Mycobacterium bovis subsp bovis AF2122/97
cgccguagaccagcaggcccug

SEQ ID NO: 3182224 - RNA, 18 nt, Mycobacterium bovis subsp bovis AF2122/97
cgccguagagcuggugcg

SEQ ID NO: 3182225 - RNA, 18 nt, Mycobacterium bovis subsp bovis AF2122/97
cgccguagcaucgggcga

SEQ ID NO: 3182226 - RNA, 14 nt, Mycobacterium bovis subsp bovis AF2122/97
cgccguagccgagg

SEQ ID NO: 3182227 - RNA, 20 nt, Mycobacterium bovis subsp bovis AF2122/97
cgccguagccggccggccca

SEQ ID NO: 3182228 - RNA, 17 nt, Mycobacterium bovis subsp bovis AF2122/97
cgccguagcgcagcgcc

SEQ ID NO: 3182229 - RNA, 19 nt, Mycobacterium bovis subsp bovis AF2122/97
cgccguagcgcagcgccuc

SEQ ID NO: 3182230 - RNA, 21 nt, Mycobacterium bovis subsp bovis AF2122/97
cgccguaguucuccgccaaca

SEQ ID NO: 3182231 - RNA, 23 nt, Mycobacterium bovis subsp bovis AF2122/97
cgccguaguucuccgccaacaac

SEQ ID NO: 3182232 - RNA, 13 nt, Mycobacterium bovis subsp bovis AF2122/97
cgccguaucggcg

SEQ ID NO: 3182233 - RNA, 14 nt, Mycobacterium bovis subsp bovis AF2122/97
cgccguaucggcgu

SEQ ID NO: 3182234 - RNA, 15 nt, Mycobacterium bovis subsp bovis AF2122/97
cgccguaucggcgug

SEQ ID NO: 3182235 - RNA, 23 nt, Mycobacterium bovis subsp bovis AF2122/97
cgccguaucggggcaccacgcca

SEQ ID NO: 3182236 - RNA, 13 nt, Mycobacterium bovis subsp bovis AF2122/97
cgccguaugccgc

SEQ ID NO: 3182237 - RNA, 15 nt, Mycobacterium bovis subsp bovis AF2122/97
cgccguaugccgcca

SEQ ID NO: 3182238 - RNA, 17 nt, Mycobacterium bovis subsp bovis AF2122/97
cgccguaugccgccaac

SEQ ID NO: 3182239 - RNA, 19 nt, Mycobacterium bovis subsp bovis AF2122/97
cgccguaugccgccaaccg

SEQ ID NO: 3182240 - RNA, 14 nt, Mycobacterium bovis subsp bovis AF2122/97
cgccgucacccccg

SEQ ID NO: 3182241 - RNA, 15 nt, Mycobacterium bovis subsp bovis AF2122/97
cgccgucacccccga

SEQ ID NO: 3182242 - RNA, 19 nt, Mycobacterium bovis subsp bovis AF2122/97
cgccgucaccgaucgaaca

SEQ ID NO: 3182243 - RNA, 14 nt, Mycobacterium bovis subsp bovis AF2122/97
cgccgucaccgccc

SEQ ID NO: 3182244 - RNA, 22 nt, Mycobacterium bovis subsp bovis AF2122/97
cgccgucaccgucauugccacc

SEQ ID NO: 3182245 - RNA, 15 nt, Mycobacterium bovis subsp bovis AF2122/97
cgccgucacgcacgc

SEQ ID NO: 3182246 - RNA, 18 nt, Mycobacterium bovis subsp bovis AF2122/97
cgccgucacgcacgccgc

SEQ ID NO: 3182247 - RNA, 16 nt, Mycobacterium bovis subsp bovis AF2122/97
cgccgucacggcagua

SEQ ID NO: 3182248 - RNA, 16 nt, Mycobacterium bovis subsp bovis AF2122/97
cgccgucagaacaccg

SEQ ID NO: 3182249 - RNA, 18 nt, Mycobacterium bovis subsp bovis AF2122/97
cgccgucagaacaccggc

SEQ ID NO: 3182250 - RNA, 21 nt, Mycobacterium bovis subsp bovis AF2122/97
cgccgucagaacaccggccag

SEQ ID NO: 3182251 - RNA, 22 nt, Mycobacterium bovis subsp bovis AF2122/97
cgccgucagaacaccggccagg

SEQ ID NO: 3182252 - RNA, 16 nt, Mycobacterium bovis subsp bovis AF2122/97
cgccgucagcaccgcu

SEQ ID NO: 3182253 - RNA, 12 nt, Mycobacterium bovis subsp bovis AF2122/97
cgccgucagccc

SEQ ID NO: 3182254 - RNA, 16 nt, Mycobacterium bovis subsp bovis AF2122/97
cgccgucaucgcagca

SEQ ID NO: 3182255 - RNA, 14 nt, Mycobacterium bovis subsp bovis AF2122/97
cgccgucaugccca

SEQ ID NO: 3182256 - RNA, 14 nt, Mycobacterium bovis subsp bovis AF2122/97
cgccguccacgccg

SEQ ID NO: 3182257 - RNA, 23 nt, Mycobacterium bovis subsp bovis AF2122/97
cgccguccagcaauaccugagcg

SEQ ID NO: 3182258 - RNA, 21 nt, Mycobacterium bovis subsp bovis AF2122/97
cgccguccagcgccgcggccc

SEQ ID NO: 3182259 - RNA, 19 nt, Mycobacterium bovis subsp bovis AF2122/97
cgccguccagucggucggu

SEQ ID NO: 3182260 - RNA, 15 nt, Mycobacterium bovis subsp bovis AF2122/97
cgccguccccgccga

SEQ ID NO: 3182261 - RNA, 18 nt, Mycobacterium bovis subsp bovis AF2122/97
cgccguccccgccgacgc

SEQ ID NO: 3182262 - RNA, 21 nt, Mycobacterium bovis subsp bovis AF2122/97
cgccguccccgccgacgccga

SEQ ID NO: 3182263 - RNA, 18 nt, Mycobacterium bovis subsp bovis AF2122/97
cgccguccccgccgucgc

SEQ ID NO: 3182264 - RNA, 23 nt, Mycobacterium bovis subsp bovis AF2122/97
cgccgucccgauacggccggccg

SEQ ID NO: 3182265 - RNA, 18 nt, Mycobacterium bovis subsp bovis AF2122/97
cgccgucgaagacguugg

SEQ ID NO: 3182266 - RNA, 21 nt, Mycobacterium bovis subsp bovis AF2122/97
cgccgucgaagcggaccagcg

SEQ ID NO: 3182267 - RNA, 22 nt, Mycobacterium bovis subsp bovis AF2122/97
cgccgucgacaacaaacccggc

SEQ ID NO: 3182268 - RNA, 13 nt, Mycobacterium bovis subsp bovis AF2122/97
cgccgucgaccac

SEQ ID NO: 3182269 - RNA, 15 nt, Mycobacterium bovis subsp bovis AF2122/97
cgccgucgaccggcg

SEQ ID NO: 3182270 - RNA, 17 nt, Mycobacterium bovis subsp bovis AF2122/97
cgccgucgaccggcggg

SEQ ID NO: 3182271 - RNA, 18 nt, Mycobacterium bovis subsp bovis AF2122/97
cgccgucgaccggcggga

SEQ ID NO: 3182272 - RNA, 20 nt, Mycobacterium bovis subsp bovis AF2122/97
cgccgucgacgcggccggcc

SEQ ID NO: 3182273 - RNA, 15 nt, Mycobacterium bovis subsp bovis AF2122/97
cgccgucgacgucga

SEQ ID NO: 3182274 - RNA, 17 nt, Mycobacterium bovis subsp bovis AF2122/97
cgccgucgaugaccagc

SEQ ID NO: 3182275 - RNA, 22 nt, Mycobacterium bovis subsp bovis AF2122/97
cgccgucgaugaccagcacacc

SEQ ID NO: 3182276 - RNA, 18 nt, Mycobacterium bovis subsp bovis AF2122/97
cgccgucgauguggcgcu

SEQ ID NO: 3182277 - RNA, 14 nt, Mycobacterium bovis subsp bovis AF2122/97
cgccgucgcagcca

SEQ ID NO: 3182278 - RNA, 16 nt, Mycobacterium bovis subsp bovis AF2122/97
cgccgucgcagccagc

SEQ ID NO: 3182279 - RNA, 17 nt, Mycobacterium bovis subsp bovis AF2122/97
cgccgucgcagccagcu

SEQ ID NO: 3182280 - RNA, 18 nt, Mycobacterium bovis subsp bovis AF2122/97
cgccgucgcagccagcug

SEQ ID NO: 3182281 - RNA, 14 nt, Mycobacterium bovis subsp bovis AF2122/97
cgccgucgccacca

SEQ ID NO: 3182282 - RNA, 14 nt, Mycobacterium bovis subsp bovis AF2122/97
cgccgucgccacgc

SEQ ID NO: 3182283 - RNA, 19 nt, Mycobacterium bovis subsp bovis AF2122/97
cgccgucgccacgcccagc

SEQ ID NO: 3182284 - RNA, 12 nt, Mycobacterium bovis subsp bovis AF2122/97
cgccgucgccgc

SEQ ID NO: 3182285 - RNA, 14 nt, Mycobacterium bovis subsp bovis AF2122/97
cgccgucgccgcca

SEQ ID NO: 3182286 - RNA, 20 nt, Mycobacterium bovis subsp bovis AF2122/97
cgccgucgccgccaaagccg

SEQ ID NO: 3182287 - RNA, 14 nt, Mycobacterium bovis subsp bovis AF2122/97
cgccgucgccgccg

SEQ ID NO: 3182288 - RNA, 15 nt, Mycobacterium bovis subsp bovis AF2122/97
cgccgucgccgccgc

SEQ ID NO: 3182289 - RNA, 17 nt, Mycobacterium bovis subsp bovis AF2122/97
cgccgucgccgccgcua

SEQ ID NO: 3182290 - RNA, 22 nt, Mycobacterium bovis subsp bovis AF2122/97
cgccgucgccgccggcgccgcc

SEQ ID NO: 3182291 - RNA, 16 nt, Mycobacterium bovis subsp bovis AF2122/97
cgccgucgccggugcc

SEQ ID NO: 3182292 - RNA, 13 nt, Mycobacterium bovis subsp bovis AF2122/97
cgccgucgccguu

SEQ ID NO: 3182293 - RNA, 15 nt, Mycobacterium bovis subsp bovis AF2122/97
cgccgucgccguugg

SEQ ID NO: 3182294 - RNA, 19 nt, Mycobacterium bovis subsp bovis AF2122/97
cgccgucgcgaccgaugau

SEQ ID NO: 3182295 - RNA, 15 nt, Mycobacterium bovis subsp bovis AF2122/97
cgccgucgcggcacg

SEQ ID NO: 3182296 - RNA, 17 nt, Mycobacterium bovis subsp bovis AF2122/97
cgccgucgcggcacgcc

SEQ ID NO: 3182297 - RNA, 16 nt, Mycobacterium bovis subsp bovis AF2122/97
cgccgucggacaccgc

SEQ ID NO: 3182298 - RNA, 18 nt, Mycobacterium bovis subsp bovis AF2122/97
cgccgucggagccggcca

SEQ ID NO: 3182299 - RNA, 19 nt, Mycobacterium bovis subsp bovis AF2122/97
cgccgucggagccggccac

SEQ ID NO: 3182300 - RNA, 21 nt, Mycobacterium bovis subsp bovis AF2122/97
cgccgucggagccggccaccu

SEQ ID NO: 3182301 - RNA, 12 nt, Mycobacterium bovis subsp bovis AF2122/97
cgccgucggccg

SEQ ID NO: 3182302 - RNA, 18 nt, Mycobacterium bovis subsp bovis AF2122/97
cgccgucggccgagucga

SEQ ID NO: 3182303 - RNA, 12 nt, Mycobacterium bovis subsp bovis AF2122/97
cgccgucggcga

SEQ ID NO: 3182304 - RNA, 17 nt, Mycobacterium bovis subsp bovis AF2122/97
cgccgucggcgacuccu

SEQ ID NO: 3182305 - RNA, 16 nt, Mycobacterium bovis subsp bovis AF2122/97
cgccgucggcgagcag

SEQ ID NO: 3182306 - RNA, 16 nt, Mycobacterium bovis subsp bovis AF2122/97
cgccgucggcgccggc

SEQ ID NO: 3182307 - RNA, 17 nt, Mycobacterium bovis subsp bovis AF2122/97
cgccgucggcgccggca

SEQ ID NO: 3182308 - RNA, 13 nt, Mycobacterium bovis subsp bovis AF2122/97
cgccgucggcgcg

SEQ ID NO: 3182309 - RNA, 15 nt, Mycobacterium bovis subsp bovis AF2122/97
cgccgucggcgcgca

SEQ ID NO: 3182310 - RNA, 12 nt, Mycobacterium bovis subsp bovis AF2122/97
cgccgucggcgg

SEQ ID NO: 3182311 - RNA, 19 nt, Mycobacterium bovis subsp bovis AF2122/97
cgccgucggguuccuccuc

SEQ ID NO: 3182312 - RNA, 20 nt, Mycobacterium bovis subsp bovis AF2122/97
cgccgucggguugcgacgaa

SEQ ID NO: 3182313 - RNA, 21 nt, Mycobacterium bovis subsp bovis AF2122/97
cgccgucgguaaagggcucga

SEQ ID NO: 3182314 - RNA, 17 nt, Mycobacterium bovis subsp bovis AF2122/97
cgccgucggugccgccg

SEQ ID NO: 3182315 - RNA, 18 nt, Mycobacterium bovis subsp bovis AF2122/97
cgccgucggugccgccgc

SEQ ID NO: 3182316 - RNA, 19 nt, Mycobacterium bovis subsp bovis AF2122/97
cgccgucggugccgccgcc

SEQ ID NO: 3182317 - RNA, 20 nt, Mycobacterium bovis subsp bovis AF2122/97
cgccgucggugccgccgccg

SEQ ID NO: 3182318 - RNA, 23 nt, Mycobacterium bovis subsp bovis AF2122/97
cgccgucguacucgaccgcgagc

SEQ ID NO: 3182319 - RNA, 16 nt, Mycobacterium bovis subsp bovis AF2122/97
cgccgucgucagcggg

SEQ ID NO: 3182320 - RNA, 15 nt, Mycobacterium bovis subsp bovis AF2122/97
cgccgucgucgacca

SEQ ID NO: 3182321 - RNA, 15 nt, Mycobacterium bovis subsp bovis AF2122/97
cgccgucgucgcgca

SEQ ID NO: 3182322 - RNA, 16 nt, Mycobacterium bovis subsp bovis AF2122/97
cgccgucgugccaccg

SEQ ID NO: 3182323 - RNA, 17 nt, Mycobacterium bovis subsp bovis AF2122/97
cgccgucguugcccgac

SEQ ID NO: 3182324 - RNA, 17 nt, Mycobacterium bovis subsp bovis AF2122/97
cgccgucucgaucgcgg

SEQ ID NO: 3182325 - RNA, 22 nt, Mycobacterium bovis subsp bovis AF2122/97
cgccgucucgcggugcggcaac

SEQ ID NO: 3182326 - RNA, 15 nt, Mycobacterium bovis subsp bovis AF2122/97
cgccgucucugccac

SEQ ID NO: 3182327 - RNA, 17 nt, Mycobacterium bovis subsp bovis AF2122/97
cgccgucucugccacgc

SEQ ID NO: 3182328 - RNA, 20 nt, Mycobacterium bovis subsp bovis AF2122/97
cgccgucuuggcccgguccg

SEQ ID NO: 3182329 - RNA, 23 nt, Mycobacterium bovis subsp bovis AF2122/97
cgccgugaccaggugccaggaug

SEQ ID NO: 3182330 - RNA, 20 nt, Mycobacterium bovis subsp bovis AF2122/97
cgccgugacccauucucggc

SEQ ID NO: 3182331 - RNA, 23 nt, Mycobacterium bovis subsp bovis AF2122/97
cgccgugacccauucucggccgg

SEQ ID NO: 3182332 - RNA, 19 nt, Mycobacterium bovis subsp bovis AF2122/97
cgccgugaguagguccacg

SEQ ID NO: 3182333 - RNA, 22 nt, Mycobacterium bovis subsp bovis AF2122/97
cgccgugaguagguccacguuc

SEQ ID NO: 3182334 - RNA, 20 nt, Mycobacterium bovis subsp bovis AF2122/97
cgccgugaguucacguucgg

SEQ ID NO: 3182335 - RNA, 14 nt, Mycobacterium bovis subsp bovis AF2122/97
cgccgugcccccgg

SEQ ID NO: 3182336 - RNA, 17 nt, Mycobacterium bovis subsp bovis AF2122/97
cgccgugcccccggcuu

SEQ ID NO: 3182337 - RNA, 12 nt, Mycobacterium bovis subsp bovis AF2122/97
cgccgugcgccg

SEQ ID NO: 3182338 - RNA, 13 nt, Mycobacterium bovis subsp bovis AF2122/97
cgccgugcgccgu

SEQ ID NO: 3182339 - RNA, 18 nt, Mycobacterium bovis subsp bovis AF2122/97
cgccgugcgugcgggggc

SEQ ID NO: 3182340 - RNA, 22 nt, Mycobacterium bovis subsp bovis AF2122/97
cgccgugcugggugacaccggu

SEQ ID NO: 3182341 - RNA, 14 nt, Mycobacterium bovis subsp bovis AF2122/97
cgccgugcuugcga

SEQ ID NO: 3182342 - RNA, 20 nt, Mycobacterium bovis subsp bovis AF2122/97
cgccguggaacacgaagucg

SEQ ID NO: 3182343 - RNA, 21 nt, Mycobacterium bovis subsp bovis AF2122/97
cgccguggacgaucaacccgg

SEQ ID NO: 3182344 - RNA, 23 nt, Mycobacterium bovis subsp bovis AF2122/97
cgccguggacgaucaacccgguc

SEQ ID NO: 3182345 - RNA, 20 nt, Mycobacterium bovis subsp bovis AF2122/97
cgccguggauacgcacggcg

SEQ ID NO: 3182346 - RNA, 19 nt, Mycobacterium bovis subsp bovis AF2122/97
cgccguggaucaucccgac

SEQ ID NO: 3182347 - RNA, 19 nt, Mycobacterium bovis subsp bovis AF2122/97
cgccguggcaucgccucca

SEQ ID NO: 3182348 - RNA, 13 nt, Mycobacterium bovis subsp bovis AF2122/97
cgccguggccgca

SEQ ID NO: 3182349 - RNA, 23 nt, Mycobacterium bovis subsp bovis AF2122/97
cgccguggccugaaacggcugca

SEQ ID NO: 3182350 - RNA, 15 nt, Mycobacterium bovis subsp bovis AF2122/97
cgccguggcgcgguc

SEQ ID NO: 3182351 - RNA, 16 nt, Mycobacterium bovis subsp bovis AF2122/97
cgccguggcgcggucg

SEQ ID NO: 3182352 - RNA, 23 nt, Mycobacterium bovis subsp bovis AF2122/97
cgccguggcgcggucggagucga

SEQ ID NO: 3182353 - RNA, 16 nt, Mycobacterium bovis subsp bovis AF2122/97
cgccguggcgucggcg

SEQ ID NO: 3182354 - RNA, 15 nt, Mycobacterium bovis subsp bovis AF2122/97
cgccgugggccuguu

SEQ ID NO: 3182355 - RNA, 12 nt, Mycobacterium bovis subsp bovis AF2122/97
cgccguggugcg

SEQ ID NO: 3182356 - RNA, 18 nt, Mycobacterium bovis subsp bovis AF2122/97
cgccguggugcgcauggc

SEQ ID NO: 3182357 - RNA, 20 nt, Mycobacterium bovis subsp bovis AF2122/97
cgccgugguggaugagccgg

SEQ ID NO: 3182358 - RNA, 19 nt, Mycobacterium bovis subsp bovis AF2122/97
cgccgugguugcacguucg

SEQ ID NO: 3182359 - RNA, 21 nt, Mycobacterium bovis subsp bovis AF2122/97
cgccgugguugcacguucggc

SEQ ID NO: 3182360 - RNA, 18 nt, Mycobacterium bovis subsp bovis AF2122/97
cgccgugugccacggggc

SEQ ID NO: 3182361 - RNA, 22 nt, Mycobacterium bovis subsp bovis AF2122/97
cgccgugugcucuugcgccacg

SEQ ID NO: 3182362 - RNA, 15 nt, Mycobacterium bovis subsp bovis AF2122/97
cgccguguuccaggu

SEQ ID NO: 3182363 - RNA, 17 nt, Mycobacterium bovis subsp bovis AF2122/97
cgccguuaccgacgccg

SEQ ID NO: 3182364 - RNA, 18 nt, Mycobacterium bovis subsp bovis AF2122/97
cgccguuaccgacgccgg

SEQ ID NO: 3182365 - RNA, 19 nt, Mycobacterium bovis subsp bovis AF2122/97
cgccguuaccgagcccgaa

SEQ ID NO: 3182366 - RNA, 14 nt, Mycobacterium bovis subsp bovis AF2122/97
cgccguuaccgccg

SEQ ID NO: 3182367 - RNA, 15 nt, Mycobacterium bovis subsp bovis AF2122/97
cgccguuaccgccgc

SEQ ID NO: 3182368 - RNA, 16 nt, Mycobacterium bovis subsp bovis AF2122/97
cgccguuaccgccguu

SEQ ID NO: 3182369 - RNA, 15 nt, Mycobacterium bovis subsp bovis AF2122/97
cgccguuagcgucgc

SEQ ID NO: 3182370 - RNA, 17 nt, Mycobacterium bovis subsp bovis AF2122/97
cgccguucccaccacca

SEQ ID NO: 3182371 - RNA, 23 nt, Mycobacterium bovis subsp bovis AF2122/97
cgccguucccaccaccaccgccg

SEQ ID NO: 3182372 - RNA, 16 nt, Mycobacterium bovis subsp bovis AF2122/97
cgccguucccacccac

SEQ ID NO: 3182373 - RNA, 20 nt, Mycobacterium bovis subsp bovis AF2122/97
cgccguucccacccacgccg

SEQ ID NO: 3182374 - RNA, 16 nt, Mycobacterium bovis subsp bovis AF2122/97
cgccguucgcuccccc

SEQ ID NO: 3182375 - RNA, 17 nt, Mycobacterium bovis subsp bovis AF2122/97
cgccguucgcucccccg

SEQ ID NO: 3182376 - RNA, 19 nt, Mycobacterium bovis subsp bovis AF2122/97
cgccguucgcucccccgcu

SEQ ID NO: 3182377 - RNA, 21 nt, Mycobacterium bovis subsp bovis AF2122/97
cgccguucgcucccccgcuac

SEQ ID NO: 3182378 - RNA, 19 nt, Mycobacterium bovis subsp bovis AF2122/97
cgccguucgggaugcaagg

SEQ ID NO: 3182379 - RNA, 15 nt, Mycobacterium bovis subsp bovis AF2122/97
cgccguucugaucug

SEQ ID NO: 3182380 - RNA, 21 nt, Mycobacterium bovis subsp bovis AF2122/97
cgccguucugaucugcgcaac

SEQ ID NO: 3182381 - RNA, 14 nt, Mycobacterium bovis subsp bovis AF2122/97
cgccguugacgccg

SEQ ID NO: 3182382 - RNA, 16 nt, Mycobacterium bovis subsp bovis AF2122/97
cgccguugaugucggc

SEQ ID NO: 3182383 - RNA, 18 nt, Mycobacterium bovis subsp bovis AF2122/97
cgccguugaugucggcag

SEQ ID NO: 3182384 - RNA, 22 nt, Mycobacterium bovis subsp bovis AF2122/97
cgccguugaugucggcagguac

SEQ ID NO: 3182385 - RNA, 16 nt, Mycobacterium bovis subsp bovis AF2122/97
cgccguugccaagcag

SEQ ID NO: 3182386 - RNA, 16 nt, Mycobacterium bovis subsp bovis AF2122/97
cgccguugccaccggu

SEQ ID NO: 3182387 - RNA, 17 nt, Mycobacterium bovis subsp bovis AF2122/97
cgccguugccaccggug

SEQ ID NO: 3182388 - RNA, 20 nt, Mycobacterium bovis subsp bovis AF2122/97
cgccguugccaccggugccg

SEQ ID NO: 3182389 - RNA, 15 nt, Mycobacterium bovis subsp bovis AF2122/97
cgccguugccaccgu

SEQ ID NO: 3182390 - RNA, 23 nt, Mycobacterium bovis subsp bovis AF2122/97
cgccguugccaccguugccgccg

SEQ ID NO: 3182391 - RNA, 15 nt, Mycobacterium bovis subsp bovis AF2122/97
cgccguugcccccgu

SEQ ID NO: 3182392 - RNA, 19 nt, Mycobacterium bovis subsp bovis AF2122/97
cgccguugccgaucaccac

SEQ ID NO: 3182393 - RNA, 21 nt, Mycobacterium bovis subsp bovis AF2122/97
cgccguugccgaucaccacgg

SEQ ID NO: 3182394 - RNA, 19 nt, Mycobacterium bovis subsp bovis AF2122/97
cgccguugccgaucagccc

SEQ ID NO: 3182395 - RNA, 20 nt, Mycobacterium bovis subsp bovis AF2122/97
cgccguugccgaucagcccg

SEQ ID NO: 3182396 - RNA, 21 nt, Mycobacterium bovis subsp bovis AF2122/97
cgccguugccgaucagcccgg

SEQ ID NO: 3182397 - RNA, 15 nt, Mycobacterium bovis subsp bovis AF2122/97
cgccguugccgaucc

SEQ ID NO: 3182398 - RNA, 21 nt, Mycobacterium bovis subsp bovis AF2122/97
cgccguugccgauccccaggc

SEQ ID NO: 3182399 - RNA, 17 nt, Mycobacterium bovis subsp bovis AF2122/97
cgccguugccgaucgcu

SEQ ID NO: 3182400 - RNA, 20 nt, Mycobacterium bovis subsp bovis AF2122/97
cgccguugccgccaucaccg

SEQ ID NO: 3182401 - RNA, 14 nt, Mycobacterium bovis subsp bovis AF2122/97
cgccguugccgccc

SEQ ID NO: 3182402 - RNA, 17 nt, Mycobacterium bovis subsp bovis AF2122/97
cgccguugccgccgacg

SEQ ID NO: 3182403 - RNA, 18 nt, Mycobacterium bovis subsp bovis AF2122/97
cgccguugccgccgacgc

SEQ ID NO: 3182404 - RNA, 21 nt, Mycobacterium bovis subsp bovis AF2122/97
cgccguugccgccgacgccgc

SEQ ID NO: 3182405 - RNA, 17 nt, Mycobacterium bovis subsp bovis AF2122/97
cgccguugccgccgccu

SEQ ID NO: 3182406 - RNA, 18 nt, Mycobacterium bovis subsp bovis AF2122/97
cgccguugccgccggcgc

SEQ ID NO: 3182407 - RNA, 19 nt, Mycobacterium bovis subsp bovis AF2122/97
cgccguugccgccggcgcc

SEQ ID NO: 3182408 - RNA, 20 nt, Mycobacterium bovis subsp bovis AF2122/97
cgccguugccgccggcgccg

SEQ ID NO: 3182409 - RNA, 15 nt, Mycobacterium bovis subsp bovis AF2122/97
cgccguugccgccgu

SEQ ID NO: 3182410 - RNA, 17 nt, Mycobacterium bovis subsp bovis AF2122/97
cgccguugccgccguca

SEQ ID NO: 3182411 - RNA, 21 nt, Mycobacterium bovis subsp bovis AF2122/97
cgccguugccgccgucgccgc

SEQ ID NO: 3182412 - RNA, 15 nt, Mycobacterium bovis subsp bovis AF2122/97
cgccguugccggcca

SEQ ID NO: 3182413 - RNA, 17 nt, Mycobacterium bovis subsp bovis AF2122/97
cgccguugccggccacc

SEQ ID NO: 3182414 - RNA, 15 nt, Mycobacterium bovis subsp bovis AF2122/97
cgccguugccggcga

SEQ ID NO: 3182415 - RNA, 15 nt, Mycobacterium bovis subsp bovis AF2122/97
cgccguugccggcuu

SEQ ID NO: 3182416 - RNA, 15 nt, Mycobacterium bovis subsp bovis AF2122/97
cgccguugccguaca

SEQ ID NO: 3182417 - RNA, 21 nt, Mycobacterium bovis subsp bovis AF2122/97
cgccguugccguacagcccgg

SEQ ID NO: 3182418 - RNA, 14 nt, Mycobacterium bovis subsp bovis AF2122/97
cgccguugccgucg

SEQ ID NO: 3182419 - RNA, 15 nt, Mycobacterium bovis subsp bovis AF2122/97
cgccguugccguugg

SEQ ID NO: 3182420 - RNA, 22 nt, Mycobacterium bovis subsp bovis AF2122/97
cgccguugccguuggugccgcc

SEQ ID NO: 3182421 - RNA, 14 nt, Mycobacterium bovis subsp bovis AF2122/97
cgccguuggcucga

SEQ ID NO: 3182422 - RNA, 20 nt, Mycobacterium bovis subsp bovis AF2122/97
cgccguuggcucgagccgcc

SEQ ID NO: 3182423 - RNA, 21 nt, Mycobacterium bovis subsp bovis AF2122/97
cgccguuggcucgagccgccc

SEQ ID NO: 3182424 - RNA, 22 nt, Mycobacterium bovis subsp bovis AF2122/97
cgccguuggcucgagccgcccg

SEQ ID NO: 3182425 - RNA, 23 nt, Mycobacterium bovis subsp bovis AF2122/97
cgccguuggcucgagccgcccgu

SEQ ID NO: 3182426 - RNA, 15 nt, Mycobacterium bovis subsp bovis AF2122/97
cgccguugggccgcg

SEQ ID NO: 3182427 - RNA, 16 nt, Mycobacterium bovis subsp bovis AF2122/97
cgccguugggccgcgc

SEQ ID NO: 3182428 - RNA, 19 nt, Mycobacterium bovis subsp bovis AF2122/97
cgccguugggccgcgcccu

SEQ ID NO: 3182429 - RNA, 14 nt, Mycobacterium bovis subsp bovis AF2122/97
cgccguuggggccg

SEQ ID NO: 3182430 - RNA, 17 nt, Mycobacterium bovis subsp bovis AF2122/97
cgccguugucgaccucc

SEQ ID NO: 3182431 - RNA, 22 nt, Mycobacterium bovis subsp bovis AF2122/97
cgccguugucgaccuccucgac

SEQ ID NO: 3182432 - RNA, 15 nt, Mycobacterium bovis subsp bovis AF2122/97
cgccguugucggcgg

SEQ ID NO: 3182433 - RNA, 16 nt, Mycobacterium bovis subsp bovis AF2122/97
cgccguugucggcggu

SEQ ID NO: 3182434 - RNA, 15 nt, Mycobacterium bovis subsp bovis AF2122/97
cgccguuguuguaga

SEQ ID NO: 3182435 - RNA, 15 nt, Mycobacterium bovis subsp bovis AF2122/97
cgccguuuccgccgc

SEQ ID NO: 3182436 - RNA, 14 nt, Mycobacterium bovis subsp bovis AF2122/97
cgccuaaacccgug

SEQ ID NO: 3182437 - RNA, 20 nt, Mycobacterium bovis subsp bovis AF2122/97
cgccuaagcauucagcgcgc

SEQ ID NO: 3182438 - RNA, 18 nt, Mycobacterium bovis subsp bovis AF2122/97
cgccuaaucggccugccg

SEQ ID NO: 3182439 - RNA, 17 nt, Mycobacterium bovis subsp bovis AF2122/97
cgccuaccagcaccggg

SEQ ID NO: 3182440 - RNA, 19 nt, Mycobacterium bovis subsp bovis AF2122/97
cgccuagccgcuccgccca

SEQ ID NO: 3182441 - RNA, 20 nt, Mycobacterium bovis subsp bovis AF2122/97
cgccuaggacuucggugagc

SEQ ID NO: 3182442 - RNA, 18 nt, Mycobacterium bovis subsp bovis AF2122/97
cgccuaggaguuccucga

SEQ ID NO: 3182443 - RNA, 21 nt, Mycobacterium bovis subsp bovis AF2122/97
cgccuaggaguuccucgaucg

SEQ ID NO: 3182444 - RNA, 18 nt, Mycobacterium bovis subsp bovis AF2122/97
cgccuauccaaagacccc

SEQ ID NO: 3182445 - RNA, 18 nt, Mycobacterium bovis subsp bovis AF2122/97
cgccucaagcucgccgga

SEQ ID NO: 3182446 - RNA, 17 nt, Mycobacterium bovis subsp bovis AF2122/97
cgccucaaugaccaccg

SEQ ID NO: 3182447 - RNA, 21 nt, Mycobacterium bovis subsp bovis AF2122/97
cgccucaaugaccaccgggcg

SEQ ID NO: 3182448 - RNA, 23 nt, Mycobacterium bovis subsp bovis AF2122/97
cgccucaaugaccaccgggcgcu

SEQ ID NO: 3182449 - RNA, 18 nt, Mycobacterium bovis subsp bovis AF2122/97
cgccucaggggcgccuua

SEQ ID NO: 3182450 - RNA, 15 nt, Mycobacterium bovis subsp bovis AF2122/97
cgccuccaccgccgc

SEQ ID NO: 3182451 - RNA, 16 nt, Mycobacterium bovis subsp bovis AF2122/97
cgccuccaccgccgcg

SEQ ID NO: 3182452 - RNA, 17 nt, Mycobacterium bovis subsp bovis AF2122/97
cgccuccaccgccgcgc

SEQ ID NO: 3182453 - RNA, 18 nt, Mycobacterium bovis subsp bovis AF2122/97
cgccuccacucuucgggc

SEQ ID NO: 3182454 - RNA, 22 nt, Mycobacterium bovis subsp bovis AF2122/97
cgccuccagcaccacggcgcgc

SEQ ID NO: 3182455 - RNA, 14 nt, Mycobacterium bovis subsp bovis AF2122/97
cgccuccagccggc

SEQ ID NO: 3182456 - RNA, 15 nt, Mycobacterium bovis subsp bovis AF2122/97
cgccuccagccggcg

SEQ ID NO: 3182457 - RNA, 20 nt, Mycobacterium bovis subsp bovis AF2122/97
cgccuccaggcgccacccga

SEQ ID NO: 3182458 - RNA, 13 nt, Mycobacterium bovis subsp bovis AF2122/97
cgccuccgccgag

SEQ ID NO: 3182459 - RNA, 15 nt, Mycobacterium bovis subsp bovis AF2122/97
cgccuccgccgaggc

SEQ ID NO: 3182460 - RNA, 13 nt, Mycobacterium bovis subsp bovis AF2122/97
cgccuccgcggca

SEQ ID NO: 3182461 - RNA, 14 nt, Mycobacterium bovis subsp bovis AF2122/97
cgccuccgcggcau

SEQ ID NO: 3182462 - RNA, 14 nt, Mycobacterium bovis subsp bovis AF2122/97
cgccuccgcucacg

SEQ ID NO: 3182463 - RNA, 14 nt, Mycobacterium bovis subsp bovis AF2122/97
cgccuccggcaccu

SEQ ID NO: 3182464 - RNA, 16 nt, Mycobacterium bovis subsp bovis AF2122/97
cgccuccguugccccc

SEQ ID NO: 3182465 - RNA, 17 nt, Mycobacterium bovis subsp bovis AF2122/97
cgccuccucgacgucgg

SEQ ID NO: 3182466 - RNA, 18 nt, Mycobacterium bovis subsp bovis AF2122/97
cgccuccucgacgucggc

SEQ ID NO: 3182467 - RNA, 22 nt, Mycobacterium bovis subsp bovis AF2122/97
cgccuccucgacgucggcgagc

SEQ ID NO: 3182468 - RNA, 13 nt, Mycobacterium bovis subsp bovis AF2122/97
cgccuccucgauc

SEQ ID NO: 3182469 - RNA, 15 nt, Mycobacterium bovis subsp bovis AF2122/97
cgccuccucgugcag

SEQ ID NO: 3182470 - RNA, 14 nt, Mycobacterium bovis subsp bovis AF2122/97
cgccuccugccgcc

SEQ ID NO: 3182471 - RNA, 18 nt, Mycobacterium bovis subsp bovis AF2122/97
cgccucgacacccagccg

SEQ ID NO: 3182472 - RNA, 23 nt, Mycobacterium bovis subsp bovis AF2122/97
cgccucgacacccagccgcagcc

SEQ ID NO: 3182473 - RNA, 14 nt, Mycobacterium bovis subsp bovis AF2122/97
cgccucgaccgcca

SEQ ID NO: 3182474 - RNA, 15 nt, Mycobacterium bovis subsp bovis AF2122/97
cgccucgaccgccag

SEQ ID NO: 3182475 - RNA, 17 nt, Mycobacterium bovis subsp bovis AF2122/97
cgccucgaccgccagcc

SEQ ID NO: 3182476 - RNA, 18 nt, Mycobacterium bovis subsp bovis AF2122/97
cgccucgaccgccagccc

SEQ ID NO: 3182477 - RNA, 18 nt, Mycobacterium bovis subsp bovis AF2122/97
cgccucgaggaccaccac

SEQ ID NO: 3182478 - RNA, 20 nt, Mycobacterium bovis subsp bovis AF2122/97
cgccucgagguauucgcgca

SEQ ID NO: 3182479 - RNA, 22 nt, Mycobacterium bovis subsp bovis AF2122/97
cgccucgagguauucgcgcagc

SEQ ID NO: 3182480 - RNA, 16 nt, Mycobacterium bovis subsp bovis AF2122/97
cgccucgauggcggug

SEQ ID NO: 3182481 - RNA, 14 nt, Mycobacterium bovis subsp bovis AF2122/97
cgccucgccaucca

SEQ ID NO: 3182482 - RNA, 14 nt, Mycobacterium bovis subsp bovis AF2122/97
cgccucgccggcca

SEQ ID NO: 3182483 - RNA, 17 nt, Mycobacterium bovis subsp bovis AF2122/97
cgccucgccggccacca

SEQ ID NO: 3182484 - RNA, 17 nt, Mycobacterium bovis subsp bovis AF2122/97
cgccucgccggccaccc

SEQ ID NO: 3182485 - RNA, 18 nt, Mycobacterium bovis subsp bovis AF2122/97
cgccucggaccagaccca

SEQ ID NO: 3182486 - RNA, 17 nt, Mycobacterium bovis subsp bovis AF2122/97
cgccucggcaucgccgc

SEQ ID NO: 3182487 - RNA, 12 nt, Mycobacterium bovis subsp bovis AF2122/97
cgccucggcgcu

SEQ ID NO: 3182488 - RNA, 16 nt, Mycobacterium bovis subsp bovis AF2122/97
cgccucggcggccagc

SEQ ID NO: 3182489 - RNA, 13 nt, Mycobacterium bovis subsp bovis AF2122/97
cgccucggcggcg

SEQ ID NO: 3182490 - RNA, 23 nt, Mycobacterium bovis subsp bovis AF2122/97
cgccucgggcaccuggucggccg

SEQ ID NO: 3182491 - RNA, 22 nt, Mycobacterium bovis subsp bovis AF2122/97
cgccucgggccggcguagcggc

SEQ ID NO: 3182492 - RNA, 22 nt, Mycobacterium bovis subsp bovis AF2122/97
cgccucgguggucuuggcccgg

SEQ ID NO: 3182493 - RNA, 16 nt, Mycobacterium bovis subsp bovis AF2122/97
cgccucguacggaccg

SEQ ID NO: 3182494 - RNA, 13 nt, Mycobacterium bovis subsp bovis AF2122/97
cgccucgucgaug

SEQ ID NO: 3182495 - RNA, 13 nt, Mycobacterium bovis subsp bovis AF2122/97
cgccucgucgucg

SEQ ID NO: 3182496 - RNA, 16 nt, Mycobacterium bovis subsp bovis AF2122/97
cgccucgugaguugac

SEQ ID NO: 3182497 - RNA, 21 nt, Mycobacterium bovis subsp bovis AF2122/97
cgccucgugaguugacggugg

SEQ ID NO: 3182498 - RNA, 14 nt, Mycobacterium bovis subsp bovis AF2122/97
cgccucugcucagc

SEQ ID NO: 3182499 - RNA, 14 nt, Mycobacterium bovis subsp bovis AF2122/97
cgccucugucuuca

SEQ ID NO: 3182500 - RNA, 19 nt, Mycobacterium bovis subsp bovis AF2122/97
cgccugaauaggucggucc

SEQ ID NO: 3182501 - RNA, 15 nt, Mycobacterium bovis subsp bovis AF2122/97
cgccugaccgccacc

SEQ ID NO: 3182502 - RNA, 16 nt, Mycobacterium bovis subsp bovis AF2122/97
cgccugaccgccaccg

SEQ ID NO: 3182503 - RNA, 17 nt, Mycobacterium bovis subsp bovis AF2122/97
cgccugaccgccaccgu

SEQ ID NO: 3182504 - RNA, 23 nt, Mycobacterium bovis subsp bovis AF2122/97
cgccugacgaaguccaccacgac

SEQ ID NO: 3182505 - RNA, 19 nt, Mycobacterium bovis subsp bovis AF2122/97
cgccugacucaucaccgau

SEQ ID NO: 3182506 - RNA, 20 nt, Mycobacterium bovis subsp bovis AF2122/97
cgccugacucaucaccgaug

SEQ ID NO: 3182507 - RNA, 13 nt, Mycobacterium bovis subsp bovis AF2122/97
cgccugagcgccg

SEQ ID NO: 3182508 - RNA, 16 nt, Mycobacterium bovis subsp bovis AF2122/97
cgccugagcgccgcgg

SEQ ID NO: 3182509 - RNA, 19 nt, Mycobacterium bovis subsp bovis AF2122/97
cgccugagcgccgcggcgg

SEQ ID NO: 3182510 - RNA, 14 nt, Mycobacterium bovis subsp bovis AF2122/97
cgccugagcggccu

SEQ ID NO: 3182511 - RNA, 19 nt, Mycobacterium bovis subsp bovis AF2122/97
cgccugaugcggccggcgc

SEQ ID NO: 3182512 - RNA, 20 nt, Mycobacterium bovis subsp bovis AF2122/97
cgccugaugcggccggcgcc

SEQ ID NO: 3182513 - RNA, 14 nt, Mycobacterium bovis subsp bovis AF2122/97
cgccugaugcugcc

SEQ ID NO: 3182514 - RNA, 24 nt, Mycobacterium bovis subsp bovis AF2122/97
cgccugaugcugccagaucggucg

SEQ ID NO: 3182515 - RNA, 16 nt, Mycobacterium bovis subsp bovis AF2122/97
cgccugcacccggcga

SEQ ID NO: 3182516 - RNA, 16 nt, Mycobacterium bovis subsp bovis AF2122/97
cgccugcacgcccggc

SEQ ID NO: 3182517 - RNA, 14 nt, Mycobacterium bovis subsp bovis AF2122/97
cgccugccaccggc

SEQ ID NO: 3182518 - RNA, 16 nt, Mycobacterium bovis subsp bovis AF2122/97
cgccugccccacccgc

SEQ ID NO: 3182519 - RNA, 17 nt, Mycobacterium bovis subsp bovis AF2122/97
cgccugccccacccgcg

SEQ ID NO: 3182520 - RNA, 18 nt, Mycobacterium bovis subsp bovis AF2122/97
cgccugccccacccgcgg

SEQ ID NO: 3182521 - RNA, 19 nt, Mycobacterium bovis subsp bovis AF2122/97
cgccugccccacccgcggc

SEQ ID NO: 3182522 - RNA, 23 nt, Mycobacterium bovis subsp bovis AF2122/97
cgccugccccacccgcggcgccg

SEQ ID NO: 3182523 - RNA, 16 nt, Mycobacterium bovis subsp bovis AF2122/97
cgccugcccccgcgcg

SEQ ID NO: 3182524 - RNA, 12 nt, Mycobacterium bovis subsp bovis AF2122/97
cgccugcccgaa

SEQ ID NO: 3182525 - RNA, 15 nt, Mycobacterium bovis subsp bovis AF2122/97
cgccugcccgaacca

SEQ ID NO: 3182526 - RNA, 20 nt, Mycobacterium bovis subsp bovis AF2122/97
cgccugcccgaaccaccacc

SEQ ID NO: 3182527 - RNA, 23 nt, Mycobacterium bovis subsp bovis AF2122/97
cgccugcccgaaccaccaccggc

SEQ ID NO: 3182528 - RNA, 16 nt, Mycobacterium bovis subsp bovis AF2122/97
cgccugcccggcccgc

SEQ ID NO: 3182529 - RNA, 23 nt, Mycobacterium bovis subsp bovis AF2122/97
cgccugcccggcccgcucagccg

SEQ ID NO: 3182530 - RNA, 15 nt, Mycobacterium bovis subsp bovis AF2122/97
cgccugccgacgagg

SEQ ID NO: 3182531 - RNA, 18 nt, Mycobacterium bovis subsp bovis AF2122/97
cgccugccgacggcauca

SEQ ID NO: 3182532 - RNA, 16 nt, Mycobacterium bovis subsp bovis AF2122/97
cgccugccgcuggucg

SEQ ID NO: 3182533 - RNA, 18 nt, Mycobacterium bovis subsp bovis AF2122/97
cgccugccucaccgccgc

SEQ ID NO: 3182534 - RNA, 20 nt, Mycobacterium bovis subsp bovis AF2122/97
cgccugcgacagcacgugcc

SEQ ID NO: 3182535 - RNA, 15 nt, Mycobacterium bovis subsp bovis AF2122/97
cgccugcgccacccg

SEQ ID NO: 3182536 - RNA, 15 nt, Mycobacterium bovis subsp bovis AF2122/97
cgccugcgccgccag

SEQ ID NO: 3182537 - RNA, 16 nt, Mycobacterium bovis subsp bovis AF2122/97
cgccugcgccgccagc

SEQ ID NO: 3182538 - RNA, 18 nt, Mycobacterium bovis subsp bovis AF2122/97
cgccugcgccgccagcgc

SEQ ID NO: 3182539 - RNA, 15 nt, Mycobacterium bovis subsp bovis AF2122/97
cgccugcgccgcccg

SEQ ID NO: 3182540 - RNA, 16 nt, Mycobacterium bovis subsp bovis AF2122/97
cgccugcgccgcccgc

SEQ ID NO: 3182541 - RNA, 14 nt, Mycobacterium bovis subsp bovis AF2122/97
cgccugcgggaacg

SEQ ID NO: 3182542 - RNA, 20 nt, Mycobacterium bovis subsp bovis AF2122/97
cgccugcgggaacgcggcgg

SEQ ID NO: 3182543 - RNA, 16 nt, Mycobacterium bovis subsp bovis AF2122/97
cgccugcuccaccguc

SEQ ID NO: 3182544 - RNA, 19 nt, Mycobacterium bovis subsp bovis AF2122/97
cgccugcuccucggccagc

SEQ ID NO: 3182545 - RNA, 20 nt, Mycobacterium bovis subsp bovis AF2122/97
cgccugcuccucggccagcg

SEQ ID NO: 3182546 - RNA, 14 nt, Mycobacterium bovis subsp bovis AF2122/97
cgccugcucggcga

SEQ ID NO: 3182547 - RNA, 20 nt, Mycobacterium bovis subsp bovis AF2122/97
cgccugcucgucggccaccg

SEQ ID NO: 3182548 - RNA, 21 nt, Mycobacterium bovis subsp bovis AF2122/97
cgccugcucgucggccaccgc

SEQ ID NO: 3182549 - RNA, 16 nt, Mycobacterium bovis subsp bovis AF2122/97
cgccugcuggccgcgg

SEQ ID NO: 3182550 - RNA, 22 nt, Mycobacterium bovis subsp bovis AF2122/97
cgccugcugguaccgggcucca

SEQ ID NO: 3182551 - RNA, 18 nt, Mycobacterium bovis subsp bovis AF2122/97
cgccuggacgccgccgga

SEQ ID NO: 3182552 - RNA, 19 nt, Mycobacterium bovis subsp bovis AF2122/97
cgccuggacgccgccggag

SEQ ID NO: 3182553 - RNA, 15 nt, Mycobacterium bovis subsp bovis AF2122/97
cgccuggagcgaucu

SEQ ID NO: 3182554 - RNA, 20 nt, Mycobacterium bovis subsp bovis AF2122/97
cgccuggaucagcgcguuga

SEQ ID NO: 3182555 - RNA, 17 nt, Mycobacterium bovis subsp bovis AF2122/97
cgccuggccggaauacc

SEQ ID NO: 3182556 - RNA, 15 nt, Mycobacterium bovis subsp bovis AF2122/97
cgccuggcggcgccg

SEQ ID NO: 3182557 - RNA, 21 nt, Mycobacterium bovis subsp bovis AF2122/97
cgccuggcuacgcgcgcccga

SEQ ID NO: 3182558 - RNA, 22 nt, Mycobacterium bovis subsp bovis AF2122/97
cgccuggcuugucauccccgac

SEQ ID NO: 3182559 - RNA, 23 nt, Mycobacterium bovis subsp bovis AF2122/97
cgccuggcuugucauccccgacu

SEQ ID NO: 3182560 - RNA, 14 nt, Mycobacterium bovis subsp bovis AF2122/97
cgccugggcgacga

SEQ ID NO: 3182561 - RNA, 15 nt, Mycobacterium bovis subsp bovis AF2122/97
cgccugggcgacgac

SEQ ID NO: 3182562 - RNA, 14 nt, Mycobacterium bovis subsp bovis AF2122/97
cgccugggcggcca

SEQ ID NO: 3182563 - RNA, 23 nt, Mycobacterium bovis subsp bovis AF2122/97
cgccugggugagguuggagcgcc

SEQ ID NO: 3182564 - RNA, 17 nt, Mycobacterium bovis subsp bovis AF2122/97
cgccuggguugaccgcc

SEQ ID NO: 3182565 - RNA, 19 nt, Mycobacterium bovis subsp bovis AF2122/97
cgccuggguugaccgccac

SEQ ID NO: 3182566 - RNA, 20 nt, Mycobacterium bovis subsp bovis AF2122/97
cgccuggguugaccgccacc

SEQ ID NO: 3182567 - RNA, 16 nt, Mycobacterium bovis subsp bovis AF2122/97
cgccugguaccgcggu

SEQ ID NO: 3182568 - RNA, 17 nt, Mycobacterium bovis subsp bovis AF2122/97
cgccugguaccgcggug

SEQ ID NO: 3182569 - RNA, 14 nt, Mycobacterium bovis subsp bovis AF2122/97
cgccuguaccggcg

SEQ ID NO: 3182570 - RNA, 13 nt, Mycobacterium bovis subsp bovis AF2122/97
cgccugucccgcc

SEQ ID NO: 3182571 - RNA, 15 nt, Mycobacterium bovis subsp bovis AF2122/97
cgccugucccgccgg

SEQ ID NO: 3182572 - RNA, 16 nt, Mycobacterium bovis subsp bovis AF2122/97
cgccugucccgccggc

SEQ ID NO: 3182573 - RNA, 19 nt, Mycobacterium bovis subsp bovis AF2122/97
cgccugucccgccggcccc

SEQ ID NO: 3182574 - RNA, 12 nt, Mycobacterium bovis subsp bovis AF2122/97
cgccugucgggc

SEQ ID NO: 3182575 - RNA, 14 nt, Mycobacterium bovis subsp bovis AF2122/97
cgccugugccaccg

SEQ ID NO: 3182576 - RNA, 15 nt, Mycobacterium bovis subsp bovis AF2122/97
cgccugugccaccgc

SEQ ID NO: 3182577 - RNA, 17 nt, Mycobacterium bovis subsp bovis AF2122/97
cgccugugccaccgcug

SEQ ID NO: 3182578 - RNA, 22 nt, Mycobacterium bovis subsp bovis AF2122/97
cgccugugccaccgcuggaucg

SEQ ID NO: 3182579 - RNA, 14 nt, Mycobacterium bovis subsp bovis AF2122/97
cgccugugccgccg

SEQ ID NO: 3182580 - RNA, 18 nt, Mycobacterium bovis subsp bovis AF2122/97
cgccugugccgccggcgc

SEQ ID NO: 3182581 - RNA, 20 nt, Mycobacterium bovis subsp bovis AF2122/97
cgccugugccgccggcgcca

SEQ ID NO: 3182582 - RNA, 17 nt, Mycobacterium bovis subsp bovis AF2122/97
cgccugugcgcggugac

SEQ ID NO: 3182583 - RNA, 19 nt, Mycobacterium bovis subsp bovis AF2122/97
cgccuguucgggagcugau

SEQ ID NO: 3182584 - RNA, 22 nt, Mycobacterium bovis subsp bovis AF2122/97
cgccuguucgggagcugaucac

SEQ ID NO: 3182585 - RNA, 21 nt, Mycobacterium bovis subsp bovis AF2122/97
cgccuucaccuggugugcggg

SEQ ID NO: 3182586 - RNA, 15 nt, Mycobacterium bovis subsp bovis AF2122/97
cgccuucacgcuggc

SEQ ID NO: 3182587 - RNA, 17 nt, Mycobacterium bovis subsp bovis AF2122/97
cgccuucacgcuggccu

SEQ ID NO: 3182588 - RNA, 22 nt, Mycobacterium bovis subsp bovis AF2122/97
cgccuucacgcuggccuccagc

SEQ ID NO: 3182589 - RNA, 18 nt, Mycobacterium bovis subsp bovis AF2122/97
cgccuuccagcccgagca

SEQ ID NO: 3182590 - RNA, 13 nt, Mycobacterium bovis subsp bovis AF2122/97
cgccuuccaggcg

SEQ ID NO: 3182591 - RNA, 23 nt, Mycobacterium bovis subsp bovis AF2122/97
cgccuuccaggcgggcggcaccg

SEQ ID NO: 3182592 - RNA, 13 nt, Mycobacterium bovis subsp bovis AF2122/97
cgccuucgccacg

SEQ ID NO: 3182593 - RNA, 13 nt, Mycobacterium bovis subsp bovis AF2122/97
cgccuucgccagc

SEQ ID NO: 3182594 - RNA, 14 nt, Mycobacterium bovis subsp bovis AF2122/97
cgccuucgccagcg

SEQ ID NO: 3182595 - RNA, 16 nt, Mycobacterium bovis subsp bovis AF2122/97
cgccuucgccagcggc

SEQ ID NO: 3182596 - RNA, 17 nt, Mycobacterium bovis subsp bovis AF2122/97
cgccuucggggugcacg

SEQ ID NO: 3182597 - RNA, 19 nt, Mycobacterium bovis subsp bovis AF2122/97
cgccuucggggugcacgcg

SEQ ID NO: 3182598 - RNA, 18 nt, Mycobacterium bovis subsp bovis AF2122/97
cgccuucguaaccacgac

SEQ ID NO: 3182599 - RNA, 18 nt, Mycobacterium bovis subsp bovis AF2122/97
cgccuucucccgcacggc

SEQ ID NO: 3182600 - RNA, 21 nt, Mycobacterium bovis subsp bovis AF2122/97
cgccuucuccggcgucacggc

SEQ ID NO: 3182601 - RNA, 18 nt, Mycobacterium bovis subsp bovis AF2122/97
cgccuucuucgcggcggu

SEQ ID NO: 3182602 - RNA, 19 nt, Mycobacterium bovis subsp bovis AF2122/97
cgccuucuucucggcgagc

SEQ ID NO: 3182603 - RNA, 18 nt, Mycobacterium bovis subsp bovis AF2122/97
cgccuucuuggcaggugc

SEQ ID NO: 3182604 - RNA, 20 nt, Mycobacterium bovis subsp bovis AF2122/97
cgccuucuuggcaggugccu

SEQ ID NO: 3182605 - RNA, 17 nt, Mycobacterium bovis subsp bovis AF2122/97
cgccuugaagcggugga

SEQ ID NO: 3182606 - RNA, 20 nt, Mycobacterium bovis subsp bovis AF2122/97
cgccuugaagcgguggacga

SEQ ID NO: 3182607 - RNA, 23 nt, Mycobacterium bovis subsp bovis AF2122/97
cgccuugacgaucgagcugacga

SEQ ID NO: 3182608 - RNA, 13 nt, Mycobacterium bovis subsp bovis AF2122/97
cgccuugagccga

SEQ ID NO: 3182609 - RNA, 21 nt, Mycobacterium bovis subsp bovis AF2122/97
cgccuugaggcccugcggcca

SEQ ID NO: 3182610 - RNA, 15 nt, Mycobacterium bovis subsp bovis AF2122/97
cgccuugaucggcga

SEQ ID NO: 3182611 - RNA, 22 nt, Mycobacterium bovis subsp bovis AF2122/97
cgccuugauggucuccaccagg

SEQ ID NO: 3182612 - RNA, 22 nt, Mycobacterium bovis subsp bovis AF2122/97
cgccuugcuuccgggacuacca

SEQ ID NO: 3182613 - RNA, 14 nt, Mycobacterium bovis subsp bovis AF2122/97
cgccuuggcacccu

SEQ ID NO: 3182614 - RNA, 17 nt, Mycobacterium bovis subsp bovis AF2122/97
cgccuuggcacccuccg

SEQ ID NO: 3182615 - RNA, 14 nt, Mycobacterium bovis subsp bovis AF2122/97
cgccuuggccacca

SEQ ID NO: 3182616 - RNA, 16 nt, Mycobacterium bovis subsp bovis AF2122/97
cgccuuggccaccauc

SEQ ID NO: 3182617 - RNA, 12 nt, Mycobacterium bovis subsp bovis AF2122/97
cgccuuggcccc

SEQ ID NO: 3182618 - RNA, 15 nt, Mycobacterium bovis subsp bovis AF2122/97
cgccuuggcgcccgc

SEQ ID NO: 3182619 - RNA, 14 nt, Mycobacterium bovis subsp bovis AF2122/97
cgccuuggucaccu

SEQ ID NO: 3182620 - RNA, 13 nt, Mycobacterium bovis subsp bovis AF2122/97
cgccuuggucgcc

SEQ ID NO: 3182621 - RNA, 17 nt, Mycobacterium bovis subsp bovis AF2122/97
cgccuuggucgcgucgg

SEQ ID NO: 3182622 - RNA, 21 nt, Mycobacterium bovis subsp bovis AF2122/97
cgccuuguggcacacccgcac

SEQ ID NO: 3182623 - RNA, 16 nt, Mycobacterium bovis subsp bovis AF2122/97
cgccuuugccgccggc

SEQ ID NO: 3182624 - RNA, 20 nt, Mycobacterium bovis subsp bovis AF2122/97
cgccuuugccgccggcaccg

SEQ ID NO: 3182625 - RNA, 21 nt, Mycobacterium bovis subsp bovis AF2122/97
cgccuuugccgccggcaccgc

SEQ ID NO: 3182626 - RNA, 17 nt, Mycobacterium bovis subsp bovis AF2122/97
cgccuuuuuucgccgcc

SEQ ID NO: 3182627 - RNA, 18 nt, Mycobacterium bovis subsp bovis AF2122/97
cgcgaaaauucgucgcgu

SEQ ID NO: 3182628 - RNA, 14 nt, Mycobacterium bovis subsp bovis AF2122/97
cgcgaaacaccaga

SEQ ID NO: 3182629 - RNA, 15 nt, Mycobacterium bovis subsp bovis AF2122/97
cgcgaaacaccagac

SEQ ID NO: 3182630 - RNA, 18 nt, Mycobacterium bovis subsp bovis AF2122/97
cgcgaaacccugaaaagg

SEQ ID NO: 3182631 - RNA, 19 nt, Mycobacterium bovis subsp bovis AF2122/97
cgcgaaaccgccgucccgg

SEQ ID NO: 3182632 - RNA, 16 nt, Mycobacterium bovis subsp bovis AF2122/97
cgcgaaagaacaucuc

SEQ ID NO: 3182633 - RNA, 15 nt, Mycobacterium bovis subsp bovis AF2122/97
cgcgaaagcaccgag

SEQ ID NO: 3182634 - RNA, 23 nt, Mycobacterium bovis subsp bovis AF2122/97
cgcgaaauauuggcccgucacgc

SEQ ID NO: 3182635 - RNA, 15 nt, Mycobacterium bovis subsp bovis AF2122/97
cgcgaacaucgccag

SEQ ID NO: 3182636 - RNA, 17 nt, Mycobacterium bovis subsp bovis AF2122/97
cgcgaacaucgccagcg

SEQ ID NO: 3182637 - RNA, 18 nt, Mycobacterium bovis subsp bovis AF2122/97
cgcgaacaucgccagcgc

SEQ ID NO: 3182638 - RNA, 12 nt, Mycobacterium bovis subsp bovis AF2122/97
cgcgaacccgau

SEQ ID NO: 3182639 - RNA, 13 nt, Mycobacterium bovis subsp bovis AF2122/97
cgcgaacccgcga

SEQ ID NO: 3182640 - RNA, 15 nt, Mycobacterium bovis subsp bovis AF2122/97
cgcgaacccggcccu

SEQ ID NO: 3182641 - RNA, 19 nt, Mycobacterium bovis subsp bovis AF2122/97
cgcgaacccggcccugaac

SEQ ID NO: 3182642 - RNA, 20 nt, Mycobacterium bovis subsp bovis AF2122/97
cgcgaaccgcggaucgaccg

SEQ ID NO: 3182643 - RNA, 18 nt, Mycobacterium bovis subsp bovis AF2122/97
cgcgaaccggccaucgac

SEQ ID NO: 3182644 - RNA, 15 nt, Mycobacterium bovis subsp bovis AF2122/97
cgcgaaccgucucgg

SEQ ID NO: 3182645 - RNA, 21 nt, Mycobacterium bovis subsp bovis AF2122/97
cgcgaaccgucucggcgaccg

SEQ ID NO: 3182646 - RNA, 17 nt, Mycobacterium bovis subsp bovis AF2122/97
cgcgaacgaagucgacg

SEQ ID NO: 3182647 - RNA, 23 nt, Mycobacterium bovis subsp bovis AF2122/97
cgcgaacgaagucgacgaacucg

SEQ ID NO: 3182648 - RNA, 20 nt, Mycobacterium bovis subsp bovis AF2122/97
cgcgaacgcgacagccaccu

SEQ ID NO: 3182649 - RNA, 14 nt, Mycobacterium bovis subsp bovis AF2122/97
cgcgaacgcggcca

SEQ ID NO: 3182650 - RNA, 19 nt, Mycobacterium bovis subsp bovis AF2122/97
cgcgaacgucaaccgggcg

SEQ ID NO: 3182651 - RNA, 19 nt, Mycobacterium bovis subsp bovis AF2122/97
cgcgaacgucagugccccg

SEQ ID NO: 3182652 - RNA, 20 nt, Mycobacterium bovis subsp bovis AF2122/97
cgcgaacucaugcccgacga

SEQ ID NO: 3182653 - RNA, 14 nt, Mycobacterium bovis subsp bovis AF2122/97
cgcgaacuccagca

SEQ ID NO: 3182654 - RNA, 16 nt, Mycobacterium bovis subsp bovis AF2122/97
cgcgaacuccagcagc

SEQ ID NO: 3182655 - RNA, 17 nt, Mycobacterium bovis subsp bovis AF2122/97
cgcgaacuccagcagcc

SEQ ID NO: 3182656 - RNA, 23 nt, Mycobacterium bovis subsp bovis AF2122/97
cgcgaacuccagcagcccggugg

SEQ ID NO: 3182657 - RNA, 20 nt, Mycobacterium bovis subsp bovis AF2122/97
cgcgaagaacgacgccaccg

SEQ ID NO: 3182658 - RNA, 21 nt, Mycobacterium bovis subsp bovis AF2122/97
cgcgaagaacgacgccaccgc

SEQ ID NO: 3182659 - RNA, 23 nt, Mycobacterium bovis subsp bovis AF2122/97
cgcgaagaacgacgccaccgcga

SEQ ID NO: 3182660 - RNA, 14 nt, Mycobacterium bovis subsp bovis AF2122/97
cgcgaagccaccag

SEQ ID NO: 3182661 - RNA, 17 nt, Mycobacterium bovis subsp bovis AF2122/97
cgcgaagcgcucggcag

SEQ ID NO: 3182662 - RNA, 19 nt, Mycobacterium bovis subsp bovis AF2122/97
cgcgaagcgcucggcagcc

SEQ ID NO: 3182663 - RNA, 20 nt, Mycobacterium bovis subsp bovis AF2122/97
cgcgaagcgcucggcagccg

SEQ ID NO: 3182664 - RNA, 18 nt, Mycobacterium bovis subsp bovis AF2122/97
cgcgaagcggaccgagcc

SEQ ID NO: 3182665 - RNA, 14 nt, Mycobacterium bovis subsp bovis AF2122/97
cgcgaagcugcggg

SEQ ID NO: 3182666 - RNA, 13 nt, Mycobacterium bovis subsp bovis AF2122/97
cgcgaagcugugc

SEQ ID NO: 3182667 - RNA, 19 nt, Mycobacterium bovis subsp bovis AF2122/97
cgcgaagcugugcccggcg

SEQ ID NO: 3182668 - RNA, 22 nt, Mycobacterium bovis subsp bovis AF2122/97
cgcgaagcugugcccggcgccc

SEQ ID NO: 3182669 - RNA, 23 nt, Mycobacterium bovis subsp bovis AF2122/97
cgcgaagcugugcccggcgcccg

SEQ ID NO: 3182670 - RNA, 23 nt, Mycobacterium bovis subsp bovis AF2122/97
cgcgaaggggugcccggcggcca

SEQ ID NO: 3182671 - RNA, 14 nt, Mycobacterium bovis subsp bovis AF2122/97
cgcgaaggucucga

SEQ ID NO: 3182672 - RNA, 17 nt, Mycobacterium bovis subsp bovis AF2122/97
cgcgaagucuugaccgc

SEQ ID NO: 3182673 - RNA, 14 nt, Mycobacterium bovis subsp bovis AF2122/97
cgcgaagugcuugg

SEQ ID NO: 3182674 - RNA, 23 nt, Mycobacterium bovis subsp bovis AF2122/97
cgcgaagugcuugggccgcugau

SEQ ID NO: 3182675 - RNA, 17 nt, Mycobacterium bovis subsp bovis AF2122/97
cgcgaaguuugcgacga

SEQ ID NO: 3182676 - RNA, 21 nt, Mycobacterium bovis subsp bovis AF2122/97
cgcgaauaccagaccggccga

SEQ ID NO: 3182677 - RNA, 16 nt, Mycobacterium bovis subsp bovis AF2122/97
cgcgaauccuggcggg

SEQ ID NO: 3182678 - RNA, 17 nt, Mycobacterium bovis subsp bovis AF2122/97
cgcgaaucgcgucgagc

SEQ ID NO: 3182679 - RNA, 19 nt, Mycobacterium bovis subsp bovis AF2122/97
cgcgaaugcugugccgaga

SEQ ID NO: 3182680 - RNA, 14 nt, Mycobacterium bovis subsp bovis AF2122/97
cgcgaauguccggc

SEQ ID NO: 3182681 - RNA, 16 nt, Mycobacterium bovis subsp bovis AF2122/97
cgcgaaugucgccgcc

SEQ ID NO: 3182682 - RNA, 14 nt, Mycobacterium bovis subsp bovis AF2122/97
cgcgaaugucgcgc

SEQ ID NO: 3182683 - RNA, 22 nt, Mycobacterium bovis subsp bovis AF2122/97
cgcgacaaaguucgacgagaag

SEQ ID NO: 3182684 - RNA, 17 nt, Mycobacterium bovis subsp bovis AF2122/97
cgcgacaaaucggucga

SEQ ID NO: 3182685 - RNA, 22 nt, Mycobacterium bovis subsp bovis AF2122/97
cgcgacaacaacucuucggcgg

SEQ ID NO: 3182686 - RNA, 18 nt, Mycobacterium bovis subsp bovis AF2122/97
cgcgacaauggugcccag

SEQ ID NO: 3182687 - RNA, 16 nt, Mycobacterium bovis subsp bovis AF2122/97
cgcgacacacgccgcc

SEQ ID NO: 3182688 - RNA, 18 nt, Mycobacterium bovis subsp bovis AF2122/97
cgcgacacacgccgccgg

SEQ ID NO: 3182689 - RNA, 20 nt, Mycobacterium bovis subsp bovis AF2122/97
cgcgacacacgccgccggug

SEQ ID NO: 3182690 - RNA, 15 nt, Mycobacterium bovis subsp bovis AF2122/97
cgcgacaccccggaa

SEQ ID NO: 3182691 - RNA, 15 nt, Mycobacterium bovis subsp bovis AF2122/97
cgcgacacgccggcg

SEQ ID NO: 3182692 - RNA, 23 nt, Mycobacterium bovis subsp bovis AF2122/97
cgcgacacgccggcgggcugucg

SEQ ID NO: 3182693 - RNA, 15 nt, Mycobacterium bovis subsp bovis AF2122/97
cgcgacacgcggccc

SEQ ID NO: 3182694 - RNA, 17 nt, Mycobacterium bovis subsp bovis AF2122/97
cgcgacacgcggcccga

SEQ ID NO: 3182695 - RNA, 22 nt, Mycobacterium bovis subsp bovis AF2122/97
cgcgacacgcggcccgaggcuc

SEQ ID NO: 3182696 - RNA, 14 nt, Mycobacterium bovis subsp bovis AF2122/97
cgcgacacggccau

SEQ ID NO: 3182697 - RNA, 15 nt, Mycobacterium bovis subsp bovis AF2122/97
cgcgacagacagcac

SEQ ID NO: 3182698 - RNA, 17 nt, Mycobacterium bovis subsp bovis AF2122/97
cgcgacagacagcaccg

SEQ ID NO: 3182699 - RNA, 19 nt, Mycobacterium bovis subsp bovis AF2122/97
cgcgacagacagcaccgcc

SEQ ID NO: 3182700 - RNA, 14 nt, Mycobacterium bovis subsp bovis AF2122/97
cgcgacagccaccu

SEQ ID NO: 3182701 - RNA, 17 nt, Mycobacterium bovis subsp bovis AF2122/97
cgcgacagccaccucga

SEQ ID NO: 3182702 - RNA, 16 nt, Mycobacterium bovis subsp bovis AF2122/97
cgcgacagccguggcg

SEQ ID NO: 3182703 - RNA, 13 nt, Mycobacterium bovis subsp bovis AF2122/97
cgcgacaucaccg

SEQ ID NO: 3182704 - RNA, 14 nt, Mycobacterium bovis subsp bovis AF2122/97
cgcgacauccgcgg

SEQ ID NO: 3182705 - RNA, 16 nt, Mycobacterium bovis subsp bovis AF2122/97
cgcgacaucgguggcg

SEQ ID NO: 3182706 - RNA, 22 nt, Mycobacterium bovis subsp bovis AF2122/97
cgcgaccaaaccgcuguaaccg

SEQ ID NO: 3182707 - RNA, 19 nt, Mycobacterium bovis subsp bovis AF2122/97
cgcgaccaaugcguugacg

SEQ ID NO: 3182708 - RNA, 17 nt, Mycobacterium bovis subsp bovis AF2122/97
cgcgaccacccgccgca

SEQ ID NO: 3182709 - RNA, 12 nt, Mycobacterium bovis subsp bovis AF2122/97
cgcgaccaccgc

SEQ ID NO: 3182710 - RNA, 14 nt, Mycobacterium bovis subsp bovis AF2122/97
cgcgaccaccgccg

SEQ ID NO: 3182711 - RNA, 17 nt, Mycobacterium bovis subsp bovis AF2122/97
cgcgaccaccgccgagc

SEQ ID NO: 3182712 - RNA, 16 nt, Mycobacterium bovis subsp bovis AF2122/97
cgcgaccacgcaccgc

SEQ ID NO: 3182713 - RNA, 17 nt, Mycobacterium bovis subsp bovis AF2122/97
cgcgaccacgcaccgcc

SEQ ID NO: 3182714 - RNA, 19 nt, Mycobacterium bovis subsp bovis AF2122/97
cgcgaccacgcaccgcccc

SEQ ID NO: 3182715 - RNA, 20 nt, Mycobacterium bovis subsp bovis AF2122/97
cgcgaccagaaucgggccga

SEQ ID NO: 3182716 - RNA, 14 nt, Mycobacterium bovis subsp bovis AF2122/97
cgcgaccagcgccg

SEQ ID NO: 3182717 - RNA, 21 nt, Mycobacterium bovis subsp bovis AF2122/97
cgcgaccagcgccgcacccgc

SEQ ID NO: 3182718 - RNA, 13 nt, Mycobacterium bovis subsp bovis AF2122/97
cgcgaccagcugg

SEQ ID NO: 3182719 - RNA, 19 nt, Mycobacterium bovis subsp bovis AF2122/97
cgcgaccauacccgcgcgc

SEQ ID NO: 3182720 - RNA, 24 nt, Mycobacterium bovis subsp bovis AF2122/97
cgcgaccauacccgcgcgcaccag

SEQ ID NO: 3182721 - RNA, 14 nt, Mycobacterium bovis subsp bovis AF2122/97
cgcgaccaucgcga

SEQ ID NO: 3182722 - RNA, 16 nt, Mycobacterium bovis subsp bovis AF2122/97
cgcgaccaucucgacg

SEQ ID NO: 3182723 - RNA, 17 nt, Mycobacterium bovis subsp bovis AF2122/97
cgcgaccaucucgacgu

SEQ ID NO: 3182724 - RNA, 23 nt, Mycobacterium bovis subsp bovis AF2122/97
cgcgaccccugguagcacccacg

SEQ ID NO: 3182725 - RNA, 14 nt, Mycobacterium bovis subsp bovis AF2122/97
cgcgacccgaucgc

SEQ ID NO: 3182726 - RNA, 19 nt, Mycobacterium bovis subsp bovis AF2122/97
cgcgacccgaucgcgccag

SEQ ID NO: 3182727 - RNA, 14 nt, Mycobacterium bovis subsp bovis AF2122/97
cgcgacccgcgcaa

SEQ ID NO: 3182728 - RNA, 15 nt, Mycobacterium bovis subsp bovis AF2122/97
cgcgacccggcccag

SEQ ID NO: 3182729 - RNA, 14 nt, Mycobacterium bovis subsp bovis AF2122/97
cgcgaccgaccagc

SEQ ID NO: 3182730 - RNA, 22 nt, Mycobacterium bovis subsp bovis AF2122/97
cgcgaccgaccagccguggugg

SEQ ID NO: 3182731 - RNA, 19 nt, Mycobacterium bovis subsp bovis AF2122/97
cgcgaccgaccgcauggug

SEQ ID NO: 3182732 - RNA, 21 nt, Mycobacterium bovis subsp bovis AF2122/97
cgcgaccgaugaucgguaccg

SEQ ID NO: 3182733 - RNA, 15 nt, Mycobacterium bovis subsp bovis AF2122/97
cgcgaccgcgcacgg

SEQ ID NO: 3182734 - RNA, 12 nt, Mycobacterium bovis subsp bovis AF2122/97
cgcgaccgcggg

SEQ ID NO: 3182735 - RNA, 13 nt, Mycobacterium bovis subsp bovis AF2122/97
cgcgaccgcgggc

SEQ ID NO: 3182736 - RNA, 20 nt, Mycobacterium bovis subsp bovis AF2122/97
cgcgaccggcguaaccggca

SEQ ID NO: 3182737 - RNA, 17 nt, Mycobacterium bovis subsp bovis AF2122/97
cgcgaccggucugaucg

SEQ ID NO: 3182738 - RNA, 13 nt, Mycobacterium bovis subsp bovis AF2122/97
cgcgaccgucagg

SEQ ID NO: 3182739 - RNA, 16 nt, Mycobacterium bovis subsp bovis AF2122/97
cgcgaccgucaggguc

SEQ ID NO: 3182740 - RNA, 17 nt, Mycobacterium bovis subsp bovis AF2122/97
cgcgaccgucaggguca

SEQ ID NO: 3182741 - RNA, 20 nt, Mycobacterium bovis subsp bovis AF2122/97
cgcgaccgucagggucaccu

SEQ ID NO: 3182742 - RNA, 16 nt, Mycobacterium bovis subsp bovis AF2122/97
cgcgaccucgcuggcc

SEQ ID NO: 3182743 - RNA, 18 nt, Mycobacterium bovis subsp bovis AF2122/97
cgcgaccucgcuggccgc

SEQ ID NO: 3182744 - RNA, 19 nt, Mycobacterium bovis subsp bovis AF2122/97
cgcgaccuggucgaacugu

SEQ ID NO: 3182745 - RNA, 14 nt, Mycobacterium bovis subsp bovis AF2122/97
cgcgaccuugcccg

SEQ ID NO: 3182746 - RNA, 20 nt, Mycobacterium bovis subsp bovis AF2122/97
cgcgacgacacgccugggcg

SEQ ID NO: 3182747 - RNA, 14 nt, Mycobacterium bovis subsp bovis AF2122/97
cgcgacgacgaggu

SEQ ID NO: 3182748 - RNA, 16 nt, Mycobacterium bovis subsp bovis AF2122/97
cgcgacgccgucaugc

SEQ ID NO: 3182749 - RNA, 13 nt, Mycobacterium bovis subsp bovis AF2122/97
cgcgacgcggggc

SEQ ID NO: 3182750 - RNA, 12 nt, Mycobacterium bovis subsp bovis AF2122/97
cgcgacgcucgc

SEQ ID NO: 3182751 - RNA, 13 nt, Mycobacterium bovis subsp bovis AF2122/97
cgcgacgcucgcu

SEQ ID NO: 3182752 - RNA, 16 nt, Mycobacterium bovis subsp bovis AF2122/97
cgcgacggaaccaguu

SEQ ID NO: 3182753 - RNA, 16 nt, Mycobacterium bovis subsp bovis AF2122/97
cgcgacggaccaucuc

SEQ ID NO: 3182754 - RNA, 14 nt, Mycobacterium bovis subsp bovis AF2122/97
cgcgacggcaacgu

SEQ ID NO: 3182755 - RNA, 13 nt, Mycobacterium bovis subsp bovis AF2122/97
cgcgacggcaagc

SEQ ID NO: 3182756 - RNA, 20 nt, Mycobacterium bovis subsp bovis AF2122/97
cgcgacggcaagcacggugg

SEQ ID NO: 3182757 - RNA, 23 nt, Mycobacterium bovis subsp bovis AF2122/97
cgcgacggcaagcacgguggccg

SEQ ID NO: 3182758 - RNA, 12 nt, Mycobacterium bovis subsp bovis AF2122/97
cgcgacggcacg

SEQ ID NO: 3182759 - RNA, 21 nt, Mycobacterium bovis subsp bovis AF2122/97
cgcgacggcauguaccgaccg

SEQ ID NO: 3182760 - RNA, 17 nt, Mycobacterium bovis subsp bovis AF2122/97
cgcgacggcccgauccc

SEQ ID NO: 3182761 - RNA, 14 nt, Mycobacterium bovis subsp bovis AF2122/97
cgcgacggccggga

SEQ ID NO: 3182762 - RNA, 13 nt, Mycobacterium bovis subsp bovis AF2122/97
cgcgacggcgccc

SEQ ID NO: 3182763 - RNA, 14 nt, Mycobacterium bovis subsp bovis AF2122/97
cgcgacggcgccgg

SEQ ID NO: 3182764 - RNA, 12 nt, Mycobacterium bovis subsp bovis AF2122/97
cgcgacggcgcg

SEQ ID NO: 3182765 - RNA, 23 nt, Mycobacterium bovis subsp bovis AF2122/97
cgcgacggucaaggugcgccgcc

SEQ ID NO: 3182766 - RNA, 22 nt, Mycobacterium bovis subsp bovis AF2122/97
cgcgacggucccuucgucaccg

SEQ ID NO: 3182767 - RNA, 23 nt, Mycobacterium bovis subsp bovis AF2122/97
cgcgacggucccuucgucaccgu

SEQ ID NO: 3182768 - RNA, 18 nt, Mycobacterium bovis subsp bovis AF2122/97
cgcgacguacgaguagug

SEQ ID NO: 3182769 - RNA, 19 nt, Mycobacterium bovis subsp bovis AF2122/97
cgcgacguagacgacgucg

SEQ ID NO: 3182770 - RNA, 13 nt, Mycobacterium bovis subsp bovis AF2122/97
cgcgacguagugg

SEQ ID NO: 3182771 - RNA, 20 nt, Mycobacterium bovis subsp bovis AF2122/97
cgcgacguaguggaagccga

SEQ ID NO: 3182772 - RNA, 21 nt, Mycobacterium bovis subsp bovis AF2122/97
cgcgacguaguggaagccgac

SEQ ID NO: 3182773 - RNA, 22 nt, Mycobacterium bovis subsp bovis AF2122/97
cgcgacguaguggaagccgacc

SEQ ID NO: 3182774 - RNA, 19 nt, Mycobacterium bovis subsp bovis AF2122/97
cgcgacguaguugccggcu

SEQ ID NO: 3182775 - RNA, 16 nt, Mycobacterium bovis subsp bovis AF2122/97
cgcgacguccaccagc

SEQ ID NO: 3182776 - RNA, 17 nt, Mycobacterium bovis subsp bovis AF2122/97
cgcgacguccaccagcc

SEQ ID NO: 3182777 - RNA, 14 nt, Mycobacterium bovis subsp bovis AF2122/97
cgcgacgucggccg

SEQ ID NO: 3182778 - RNA, 16 nt, Mycobacterium bovis subsp bovis AF2122/97
cgcgacuagacgccgc

SEQ ID NO: 3182779 - RNA, 17 nt, Mycobacterium bovis subsp bovis AF2122/97
cgcgacuagacgccgcc

SEQ ID NO: 3182780 - RNA, 19 nt, Mycobacterium bovis subsp bovis AF2122/97
cgcgacuagacgccgccgc

SEQ ID NO: 3182781 - RNA, 21 nt, Mycobacterium bovis subsp bovis AF2122/97
cgcgacugcaccuggccgccc

SEQ ID NO: 3182782 - RNA, 17 nt, Mycobacterium bovis subsp bovis AF2122/97
cgcgagaaggugcugcg

SEQ ID NO: 3182783 - RNA, 17 nt, Mycobacterium bovis subsp bovis AF2122/97
cgcgagaauucgcggga

SEQ ID NO: 3182784 - RNA, 21 nt, Mycobacterium bovis subsp bovis AF2122/97
cgcgagaccaacauacagcaa

SEQ ID NO: 3182785 - RNA, 23 nt, Mycobacterium bovis subsp bovis AF2122/97
cgcgagaccuucgggguaguuga

SEQ ID NO: 3182786 - RNA, 14 nt, Mycobacterium bovis subsp bovis AF2122/97
cgcgagagccggcg

SEQ ID NO: 3182787 - RNA, 14 nt, Mycobacterium bovis subsp bovis AF2122/97
cgcgagaucagccg

SEQ ID NO: 3182788 - RNA, 17 nt, Mycobacterium bovis subsp bovis AF2122/97
cgcgagauccuucgcgu

SEQ ID NO: 3182789 - RNA, 12 nt, Mycobacterium bovis subsp bovis AF2122/97
cgcgagaucggg

SEQ ID NO: 3182790 - RNA, 16 nt, Mycobacterium bovis subsp bovis AF2122/97
cgcgagaucgggccgg

SEQ ID NO: 3182791 - RNA, 17 nt, Mycobacterium bovis subsp bovis AF2122/97
cgcgagaucgggccggc

SEQ ID NO: 3182792 - RNA, 18 nt, Mycobacterium bovis subsp bovis AF2122/97
cgcgagaucgggccggcc

SEQ ID NO: 3182793 - RNA, 19 nt, Mycobacterium bovis subsp bovis AF2122/97
cgcgagaucgggccggccg

SEQ ID NO: 3182794 - RNA, 23 nt, Mycobacterium bovis subsp bovis AF2122/97
cgcgagaucgggccggccgccgc

SEQ ID NO: 3182795 - RNA, 15 nt, Mycobacterium bovis subsp bovis AF2122/97
cgcgagcaacaccag

SEQ ID NO: 3182796 - RNA, 16 nt, Mycobacterium bovis subsp bovis AF2122/97
cgcgagcaacaccagg

SEQ ID NO: 3182797 - RNA, 18 nt, Mycobacterium bovis subsp bovis AF2122/97
cgcgagcaacaccagggc

SEQ ID NO: 3182798 - RNA, 14 nt, Mycobacterium bovis subsp bovis AF2122/97
cgcgagcacgucgg

SEQ ID NO: 3182799 - RNA, 21 nt, Mycobacterium bovis subsp bovis AF2122/97
cgcgagcagacacagaaucgc

SEQ ID NO: 3182800 - RNA, 15 nt, Mycobacterium bovis subsp bovis AF2122/97
cgcgagcagacgcag

SEQ ID NO: 3182801 - RNA, 22 nt, Mycobacterium bovis subsp bovis AF2122/97
cgcgagcagacguaaaagcccc

SEQ ID NO: 3182802 - RNA, 20 nt, Mycobacterium bovis subsp bovis AF2122/97
cgcgagcagacgugggcgcu

SEQ ID NO: 3182803 - RNA, 24 nt, Mycobacterium bovis subsp bovis AF2122/97
cgcgagcagacgugggcgcuggug

SEQ ID NO: 3182804 - RNA, 16 nt, Mycobacterium bovis subsp bovis AF2122/97
cgcgagcagcccggcg

SEQ ID NO: 3182805 - RNA, 21 nt, Mycobacterium bovis subsp bovis AF2122/97
cgcgagcagcuacagcuugcg

SEQ ID NO: 3182806 - RNA, 22 nt, Mycobacterium bovis subsp bovis AF2122/97
cgcgagcaucugggguccggug

SEQ ID NO: 3182807 - RNA, 14 nt, Mycobacterium bovis subsp bovis AF2122/97
cgcgagccagcugc

SEQ ID NO: 3182808 - RNA, 15 nt, Mycobacterium bovis subsp bovis AF2122/97
cgcgagccagcugcu

SEQ ID NO: 3182809 - RNA, 19 nt, Mycobacterium bovis subsp bovis AF2122/97
cgcgagcccggccucggcg

SEQ ID NO: 3182810 - RNA, 18 nt, Mycobacterium bovis subsp bovis AF2122/97
cgcgagccgcacgaugcc

SEQ ID NO: 3182811 - RNA, 13 nt, Mycobacterium bovis subsp bovis AF2122/97
cgcgagccggcuc

SEQ ID NO: 3182812 - RNA, 13 nt, Mycobacterium bovis subsp bovis AF2122/97
cgcgagccgguga

SEQ ID NO: 3182813 - RNA, 14 nt, Mycobacterium bovis subsp bovis AF2122/97
cgcgagccggugau

SEQ ID NO: 3182814 - RNA, 19 nt, Mycobacterium bovis subsp bovis AF2122/97
cgcgagccggugauccggu

SEQ ID NO: 3182815 - RNA, 14 nt, Mycobacterium bovis subsp bovis AF2122/97
cgcgagccucgcgc

SEQ ID NO: 3182816 - RNA, 22 nt, Mycobacterium bovis subsp bovis AF2122/97
cgcgagccugauaaagcccggc

SEQ ID NO: 3182817 - RNA, 14 nt, Mycobacterium bovis subsp bovis AF2122/97
cgcgagcgagccaa

SEQ ID NO: 3182818 - RNA, 13 nt, Mycobacterium bovis subsp bovis AF2122/97
cgcgagcgccggc

SEQ ID NO: 3182819 - RNA, 17 nt, Mycobacterium bovis subsp bovis AF2122/97
cgcgagcgccggccgcg

SEQ ID NO: 3182820 - RNA, 15 nt, Mycobacterium bovis subsp bovis AF2122/97
cgcgagcgcggcgga

SEQ ID NO: 3182821 - RNA, 19 nt, Mycobacterium bovis subsp bovis AF2122/97
cgcgagcgcuaucaccgcc

SEQ ID NO: 3182822 - RNA, 23 nt, Mycobacterium bovis subsp bovis AF2122/97
cgcgagcggaauggaggccgccg

SEQ ID NO: 3182823 - RNA, 21 nt, Mycobacterium bovis subsp bovis AF2122/97
cgcgagcugcgacgaugccgc

SEQ ID NO: 3182824 - RNA, 20 nt, Mycobacterium bovis subsp bovis AF2122/97
cgcgagcuuggccagcagca

SEQ ID NO: 3182825 - RNA, 23 nt, Mycobacterium bovis subsp bovis AF2122/97
cgcgagcuuggccagcagcagcg

SEQ ID NO: 3182826 - RNA, 17 nt, Mycobacterium bovis subsp bovis AF2122/97
cgcgagcuuggccggca

SEQ ID NO: 3182827 - RNA, 19 nt, Mycobacterium bovis subsp bovis AF2122/97
cgcgagcuuggccggcagg

SEQ ID NO: 3182828 - RNA, 13 nt, Mycobacterium bovis subsp bovis AF2122/97
cgcgaggaacgcc

SEQ ID NO: 3182829 - RNA, 17 nt, Mycobacterium bovis subsp bovis AF2122/97
cgcgaggaacgccgggg

SEQ ID NO: 3182830 - RNA, 22 nt, Mycobacterium bovis subsp bovis AF2122/97
cgcgaggaggcuuacaugcccu

SEQ ID NO: 3182831 - RNA, 18 nt, Mycobacterium bovis subsp bovis AF2122/97
cgcgaggcucgcguggcc

SEQ ID NO: 3182832 - RNA, 21 nt, Mycobacterium bovis subsp bovis AF2122/97
cgcgaggcucgcguggccgcc

SEQ ID NO: 3182833 - RNA, 22 nt, Mycobacterium bovis subsp bovis AF2122/97
cgcgaggcucgcguggccgccg

SEQ ID NO: 3182834 - RNA, 21 nt, Mycobacterium bovis subsp bovis AF2122/97
cgcgaggcucguggcgacggc

SEQ ID NO: 3182835 - RNA, 16 nt, Mycobacterium bovis subsp bovis AF2122/97
cgcgagggcgcguguc

SEQ ID NO: 3182836 - RNA, 22 nt, Mycobacterium bovis subsp bovis AF2122/97
cgcgagggggguguugaggccg

SEQ ID NO: 3182837 - RNA, 14 nt, Mycobacterium bovis subsp bovis AF2122/97
cgcgaggucggcgg

SEQ ID NO: 3182838 - RNA, 16 nt, Mycobacterium bovis subsp bovis AF2122/97
cgcgaggucggcggcg

SEQ ID NO: 3182839 - RNA, 17 nt, Mycobacterium bovis subsp bovis AF2122/97
cgcgaggugaagccgag

SEQ ID NO: 3182840 - RNA, 23 nt, Mycobacterium bovis subsp bovis AF2122/97
cgcgagguugaccaccagcgugc

SEQ ID NO: 3182841 - RNA, 22 nt, Mycobacterium bovis subsp bovis AF2122/97
cgcgaguaagcgaacagcggca

SEQ ID NO: 3182842 - RNA, 21 nt, Mycobacterium bovis subsp bovis AF2122/97
cgcgaguagaucaucgagccc

SEQ ID NO: 3182843 - RNA, 15 nt, Mycobacterium bovis subsp bovis AF2122/97
cgcgaguagcugacc

SEQ ID NO: 3182844 - RNA, 15 nt, Mycobacterium bovis subsp bovis AF2122/97
cgcgaguccaggcug

SEQ ID NO: 3182845 - RNA, 19 nt, Mycobacterium bovis subsp bovis AF2122/97
cgcgaguccaggcugaucc

SEQ ID NO: 3182846 - RNA, 16 nt, Mycobacterium bovis subsp bovis AF2122/97
cgcgagucgcccguga

SEQ ID NO: 3182847 - RNA, 13 nt, Mycobacterium bovis subsp bovis AF2122/97
cgcgagucggcgg

SEQ ID NO: 3182848 - RNA, 17 nt, Mycobacterium bovis subsp bovis AF2122/97
cgcgagucggcggggcg

SEQ ID NO: 3182849 - RNA, 19 nt, Mycobacterium bovis subsp bovis AF2122/97
cgcgagucggcggggcgga

SEQ ID NO: 3182850 - RNA, 16 nt, Mycobacterium bovis subsp bovis AF2122/97
cgcgauagauacccgc

SEQ ID NO: 3182851 - RNA, 19 nt, Mycobacterium bovis subsp bovis AF2122/97
cgcgauagauacccgcggc

SEQ ID NO: 3182852 - RNA, 14 nt, Mycobacterium bovis subsp bovis AF2122/97
cgcgauagccgccg

SEQ ID NO: 3182853 - RNA, 17 nt, Mycobacterium bovis subsp bovis AF2122/97
cgcgaucaacgcguugc

SEQ ID NO: 3182854 - RNA, 14 nt, Mycobacterium bovis subsp bovis AF2122/97
cgcgaucaccaccg

SEQ ID NO: 3182855 - RNA, 15 nt, Mycobacterium bovis subsp bovis AF2122/97
cgcgaucaccaccgg

SEQ ID NO: 3182856 - RNA, 16 nt, Mycobacterium bovis subsp bovis AF2122/97
cgcgaucaccaccgga

SEQ ID NO: 3182857 - RNA, 16 nt, Mycobacterium bovis subsp bovis AF2122/97
cgcgaucaccgagucg

SEQ ID NO: 3182858 - RNA, 20 nt, Mycobacterium bovis subsp bovis AF2122/97
cgcgaucaccgagucgacgg

SEQ ID NO: 3182859 - RNA, 20 nt, Mycobacterium bovis subsp bovis AF2122/97
cgcgaucaccucgccacacu

SEQ ID NO: 3182860 - RNA, 21 nt, Mycobacterium bovis subsp bovis AF2122/97
cgcgaucacuuccggauucgg

SEQ ID NO: 3182861 - RNA, 15 nt, Mycobacterium bovis subsp bovis AF2122/97
cgcgaucagcgcgca

SEQ ID NO: 3182862 - RNA, 19 nt, Mycobacterium bovis subsp bovis AF2122/97
cgcgaucagguaccggcgg

SEQ ID NO: 3182863 - RNA, 21 nt, Mycobacterium bovis subsp bovis AF2122/97
cgcgaucaugguggggaccgc

SEQ ID NO: 3182864 - RNA, 14 nt, Mycobacterium bovis subsp bovis AF2122/97
cgcgauccacccgg

SEQ ID NO: 3182865 - RNA, 18 nt, Mycobacterium bovis subsp bovis AF2122/97
cgcgauccacccggcauu

SEQ ID NO: 3182866 - RNA, 15 nt, Mycobacterium bovis subsp bovis AF2122/97
cgcgauccacuccgg

SEQ ID NO: 3182867 - RNA, 16 nt, Mycobacterium bovis subsp bovis AF2122/97
cgcgauccagcgcuga

SEQ ID NO: 3182868 - RNA, 19 nt, Mycobacterium bovis subsp bovis AF2122/97
cgcgauccagcgcugaccg

SEQ ID NO: 3182869 - RNA, 21 nt, Mycobacterium bovis subsp bovis AF2122/97
cgcgauccccgcgcugagcac

SEQ ID NO: 3182870 - RNA, 18 nt, Mycobacterium bovis subsp bovis AF2122/97
cgcgaucccggccgucgc

SEQ ID NO: 3182871 - RNA, 12 nt, Mycobacterium bovis subsp bovis AF2122/97
cgcgauccgcgc

SEQ ID NO: 3182872 - RNA, 15 nt, Mycobacterium bovis subsp bovis AF2122/97
cgcgauccgcgcgca

SEQ ID NO: 3182873 - RNA, 16 nt, Mycobacterium bovis subsp bovis AF2122/97
cgcgaucgacgcucgg

SEQ ID NO: 3182874 - RNA, 18 nt, Mycobacterium bovis subsp bovis AF2122/97
cgcgaucgacgcucggcu

SEQ ID NO: 3182875 - RNA, 22 nt, Mycobacterium bovis subsp bovis AF2122/97
cgcgaucgacgcucggcuaugg

SEQ ID NO: 3182876 - RNA, 12 nt, Mycobacterium bovis subsp bovis AF2122/97
cgcgaucgacgg

SEQ ID NO: 3182877 - RNA, 14 nt, Mycobacterium bovis subsp bovis AF2122/97
cgcgaucgacggug

SEQ ID NO: 3182878 - RNA, 16 nt, Mycobacterium bovis subsp bovis AF2122/97
cgcgaucgacgguguc

SEQ ID NO: 3182879 - RNA, 13 nt, Mycobacterium bovis subsp bovis AF2122/97
cgcgaucgcagug

SEQ ID NO: 3182880 - RNA, 20 nt, Mycobacterium bovis subsp bovis AF2122/97
cgcgaucgcagugagcagcc

SEQ ID NO: 3182881 - RNA, 13 nt, Mycobacterium bovis subsp bovis AF2122/97
cgcgaucgccgac

SEQ ID NO: 3182882 - RNA, 15 nt, Mycobacterium bovis subsp bovis AF2122/97
cgcgaucgccgacgc

SEQ ID NO: 3182883 - RNA, 13 nt, Mycobacterium bovis subsp bovis AF2122/97
cgcgaucgcgccc

SEQ ID NO: 3182884 - RNA, 17 nt, Mycobacterium bovis subsp bovis AF2122/97
cgcgaucgggcccagca

SEQ ID NO: 3182885 - RNA, 14 nt, Mycobacterium bovis subsp bovis AF2122/97
cgcgaucgggccga

SEQ ID NO: 3182886 - RNA, 17 nt, Mycobacterium bovis subsp bovis AF2122/97
cgcgaucgggccgaucu

SEQ ID NO: 3182887 - RNA, 18 nt, Mycobacterium bovis subsp bovis AF2122/97
cgcgaucgggccgaucuc

SEQ ID NO: 3182888 - RNA, 14 nt, Mycobacterium bovis subsp bovis AF2122/97
cgcgaucgggccgg

SEQ ID NO: 3182889 - RNA, 17 nt, Mycobacterium bovis subsp bovis AF2122/97
cgcgaucgggccggcgc

SEQ ID NO: 3182890 - RNA, 22 nt, Mycobacterium bovis subsp bovis AF2122/97
cgcgaucggggcgacgauccgc

SEQ ID NO: 3182891 - RNA, 12 nt, Mycobacterium bovis subsp bovis AF2122/97
cgcgaucggugc

SEQ ID NO: 3182892 - RNA, 14 nt, Mycobacterium bovis subsp bovis AF2122/97
cgcgaucggugccg

SEQ ID NO: 3182893 - RNA, 19 nt, Mycobacterium bovis subsp bovis AF2122/97
cgcgaucggugcgggcgcc

SEQ ID NO: 3182894 - RNA, 18 nt, Mycobacterium bovis subsp bovis AF2122/97
cgcgaucuccuccaccag

SEQ ID NO: 3182895 - RNA, 15 nt, Mycobacterium bovis subsp bovis AF2122/97
cgcgaucucggagcg

SEQ ID NO: 3182896 - RNA, 16 nt, Mycobacterium bovis subsp bovis AF2122/97
cgcgaucugcucgccc

SEQ ID NO: 3182897 - RNA, 23 nt, Mycobacterium bovis subsp bovis AF2122/97
cgcgaucugcucguagcggcggc

SEQ ID NO: 3182898 - RNA, 13 nt, Mycobacterium bovis subsp bovis AF2122/97
cgcgaugaccgca

SEQ ID NO: 3182899 - RNA, 20 nt, Mycobacterium bovis subsp bovis AF2122/97
cgcgaugaccgcaccgaccu

SEQ ID NO: 3182900 - RNA, 24 nt, Mycobacterium bovis subsp bovis AF2122/97
cgcgaugaccgcaccgaccugagu

SEQ ID NO: 3182901 - RNA, 14 nt, Mycobacterium bovis subsp bovis AF2122/97
cgcgaugaccucgg

SEQ ID NO: 3182902 - RNA, 16 nt, Mycobacterium bovis subsp bovis AF2122/97
cgcgaugaccucggcg

SEQ ID NO: 3182903 - RNA, 17 nt, Mycobacterium bovis subsp bovis AF2122/97
cgcgaugaccucggcga

SEQ ID NO: 3182904 - RNA, 20 nt, Mycobacterium bovis subsp bovis AF2122/97
cgcgaugaccucggcgaugu

SEQ ID NO: 3182905 - RNA, 17 nt, Mycobacterium bovis subsp bovis AF2122/97
cgcgaugacggugccga

SEQ ID NO: 3182906 - RNA, 21 nt, Mycobacterium bovis subsp bovis AF2122/97
cgcgaugacggugccgaccgc

SEQ ID NO: 3182907 - RNA, 19 nt, Mycobacterium bovis subsp bovis AF2122/97
cgcgaugagcggcgcggca

SEQ ID NO: 3182908 - RNA, 21 nt, Mycobacterium bovis subsp bovis AF2122/97
cgcgaugagcggcgcggcaaa

SEQ ID NO: 3182909 - RNA, 18 nt, Mycobacterium bovis subsp bovis AF2122/97
cgcgaugauaccugccca

SEQ ID NO: 3182910 - RNA, 14 nt, Mycobacterium bovis subsp bovis AF2122/97
cgcgaugaucgcau

SEQ ID NO: 3182911 - RNA, 19 nt, Mycobacterium bovis subsp bovis AF2122/97
cgcgaugauggcgguaccg

SEQ ID NO: 3182912 - RNA, 23 nt, Mycobacterium bovis subsp bovis AF2122/97
cgcgaugauggcgguaccgggau

SEQ ID NO: 3182913 - RNA, 15 nt, Mycobacterium bovis subsp bovis AF2122/97
cgcgaugcaacucga

SEQ ID NO: 3182914 - RNA, 15 nt, Mycobacterium bovis subsp bovis AF2122/97
cgcgaugcagugcga

SEQ ID NO: 3182915 - RNA, 20 nt, Mycobacterium bovis subsp bovis AF2122/97
cgcgaugcccacgcacagca

SEQ ID NO: 3182916 - RNA, 21 nt, Mycobacterium bovis subsp bovis AF2122/97
cgcgaugcccacgcacagcaa

SEQ ID NO: 3182917 - RNA, 13 nt, Mycobacterium bovis subsp bovis AF2122/97
cgcgaugccguuc

SEQ ID NO: 3182918 - RNA, 14 nt, Mycobacterium bovis subsp bovis AF2122/97
cgcgaugcgcacca

SEQ ID NO: 3182919 - RNA, 15 nt, Mycobacterium bovis subsp bovis AF2122/97
cgcgaugcgcaccag

SEQ ID NO: 3182920 - RNA, 17 nt, Mycobacterium bovis subsp bovis AF2122/97
cgcgaugcgcaccagcg

SEQ ID NO: 3182921 - RNA, 21 nt, Mycobacterium bovis subsp bovis AF2122/97
cgcgaugcgccuugacgaucg

SEQ ID NO: 3182922 - RNA, 14 nt, Mycobacterium bovis subsp bovis AF2122/97
cgcgaugcuucccg

SEQ ID NO: 3182923 - RNA, 15 nt, Mycobacterium bovis subsp bovis AF2122/97
cgcgauggcagcgcc

SEQ ID NO: 3182924 - RNA, 17 nt, Mycobacterium bovis subsp bovis AF2122/97
cgcgauggcagcgccga

SEQ ID NO: 3182925 - RNA, 20 nt, Mycobacterium bovis subsp bovis AF2122/97
cgcgauggcagcgccgaugg

SEQ ID NO: 3182926 - RNA, 14 nt, Mycobacterium bovis subsp bovis AF2122/97
cgcgauggccauca

SEQ ID NO: 3182927 - RNA, 13 nt, Mycobacterium bovis subsp bovis AF2122/97
cgcgauggcgcgu

SEQ ID NO: 3182928 - RNA, 17 nt, Mycobacterium bovis subsp bovis AF2122/97
cgcgauggcgguccacc

SEQ ID NO: 3182929 - RNA, 18 nt, Mycobacterium bovis subsp bovis AF2122/97
cgcgauggcgguccaccg

SEQ ID NO: 3182930 - RNA, 17 nt, Mycobacterium bovis subsp bovis AF2122/97
cgcgauggcguagccca

SEQ ID NO: 3182931 - RNA, 16 nt, Mycobacterium bovis subsp bovis AF2122/97
cgcgaugggagcccgg

SEQ ID NO: 3182932 - RNA, 21 nt, Mycobacterium bovis subsp bovis AF2122/97
cgcgaugggagcccggcggcc

SEQ ID NO: 3182933 - RNA, 20 nt, Mycobacterium bovis subsp bovis AF2122/97
cgcgaugggcccagcggccg

SEQ ID NO: 3182934 - RNA, 14 nt, Mycobacterium bovis subsp bovis AF2122/97
cgcgauggugcgcc

SEQ ID NO: 3182935 - RNA, 19 nt, Mycobacterium bovis subsp bovis AF2122/97
cgcgauggugcgccgggcg

SEQ ID NO: 3182936 - RNA, 16 nt, Mycobacterium bovis subsp bovis AF2122/97
cgcgaugguggccgcc

SEQ ID NO: 3182937 - RNA, 17 nt, Mycobacterium bovis subsp bovis AF2122/97
cgcgaugguggccgcca

SEQ ID NO: 3182938 - RNA, 19 nt, Mycobacterium bovis subsp bovis AF2122/97
cgcgaugguggccgccacc

SEQ ID NO: 3182939 - RNA, 18 nt, Mycobacterium bovis subsp bovis AF2122/97
cgcgauggugguuccgcc

SEQ ID NO: 3182940 - RNA, 20 nt, Mycobacterium bovis subsp bovis AF2122/97
cgcgauggugguuccgcccg

SEQ ID NO: 3182941 - RNA, 22 nt, Mycobacterium bovis subsp bovis AF2122/97
cgcgauggugguuccgcccggu

SEQ ID NO: 3182942 - RNA, 17 nt, Mycobacterium bovis subsp bovis AF2122/97
cgcgauguccagguggc

SEQ ID NO: 3182943 - RNA, 22 nt, Mycobacterium bovis subsp bovis AF2122/97
cgcgauguccucgagcaccgcg

SEQ ID NO: 3182944 - RNA, 14 nt, Mycobacterium bovis subsp bovis AF2122/97
cgcgaugucguucg

SEQ ID NO: 3182945 - RNA, 18 nt, Mycobacterium bovis subsp bovis AF2122/97
cgcgaugucguucgcguc

SEQ ID NO: 3182946 - RNA, 13 nt, Mycobacterium bovis subsp bovis AF2122/97
cgcgaugugcgcc

SEQ ID NO: 3182947 - RNA, 16 nt, Mycobacterium bovis subsp bovis AF2122/97
cgcgaugugcgccacc

SEQ ID NO: 3182948 - RNA, 16 nt, Mycobacterium bovis subsp bovis AF2122/97
cgcgauuagcaaaccg

SEQ ID NO: 3182949 - RNA, 20 nt, Mycobacterium bovis subsp bovis AF2122/97
cgcgauuagcaaaccgaccg

SEQ ID NO: 3182950 - RNA, 22 nt, Mycobacterium bovis subsp bovis AF2122/97
cgcgauuagcaaaccgaccgug

SEQ ID NO: 3182951 - RNA, 15 nt, Mycobacterium bovis subsp bovis AF2122/97
cgcgauuccggcggc

SEQ ID NO: 3182952 - RNA, 19 nt, Mycobacterium bovis subsp bovis AF2122/97
cgcgauuccggcggccacg

SEQ ID NO: 3182953 - RNA, 18 nt, Mycobacterium bovis subsp bovis AF2122/97
cgcgauucgaccggugau

SEQ ID NO: 3182954 - RNA, 18 nt, Mycobacterium bovis subsp bovis AF2122/97
cgcgauucgcggcagccg

SEQ ID NO: 3182955 - RNA, 16 nt, Mycobacterium bovis subsp bovis AF2122/97
cgcgauuucgucgucg

SEQ ID NO: 3182956 - RNA, 17 nt, Mycobacterium bovis subsp bovis AF2122/97
cgcgauuucgucgucgu

SEQ ID NO: 3182957 - RNA, 20 nt, Mycobacterium bovis subsp bovis AF2122/97
cgcgcaaaugccugcugguc

SEQ ID NO: 3182958 - RNA, 22 nt, Mycobacterium bovis subsp bovis AF2122/97
cgcgcaaaugccugcuggucgg

SEQ ID NO: 3182959 - RNA, 16 nt, Mycobacterium bovis subsp bovis AF2122/97
cgcgcaacacauccag

SEQ ID NO: 3182960 - RNA, 23 nt, Mycobacterium bovis subsp bovis AF2122/97
cgcgcaacaccucgucggcuuug

SEQ ID NO: 3182961 - RNA, 13 nt, Mycobacterium bovis subsp bovis AF2122/97
cgcgcaaccagcc

SEQ ID NO: 3182962 - RNA, 15 nt, Mycobacterium bovis subsp bovis AF2122/97
cgcgcaaccagccca

SEQ ID NO: 3182963 - RNA, 14 nt, Mycobacterium bovis subsp bovis AF2122/97
cgcgcaacccggac

SEQ ID NO: 3182964 - RNA, 17 nt, Mycobacterium bovis subsp bovis AF2122/97
cgcgcaacccggacgaa

SEQ ID NO: 3182965 - RNA, 18 nt, Mycobacterium bovis subsp bovis AF2122/97
cgcgcaacccugccgcga

SEQ ID NO: 3182966 - RNA, 15 nt, Mycobacterium bovis subsp bovis AF2122/97
cgcgcaaccgcucau

SEQ ID NO: 3182967 - RNA, 13 nt, Mycobacterium bovis subsp bovis AF2122/97
cgcgcaaccgcug

SEQ ID NO: 3182968 - RNA, 17 nt, Mycobacterium bovis subsp bovis AF2122/97
cgcgcaacgccgccagc

SEQ ID NO: 3182969 - RNA, 18 nt, Mycobacterium bovis subsp bovis AF2122/97
cgcgcaacgccgccagcc

SEQ ID NO: 3182970 - RNA, 19 nt, Mycobacterium bovis subsp bovis AF2122/97
cgcgcaacgccgccagccu

SEQ ID NO: 3182971 - RNA, 21 nt, Mycobacterium bovis subsp bovis AF2122/97
cgcgcaacguacgcacgcagc

SEQ ID NO: 3182972 - RNA, 19 nt, Mycobacterium bovis subsp bovis AF2122/97
cgcgcaacguagccagcag

SEQ ID NO: 3182973 - RNA, 22 nt, Mycobacterium bovis subsp bovis AF2122/97
cgcgcaacuuccauuuucgcca

SEQ ID NO: 3182974 - RNA, 23 nt, Mycobacterium bovis subsp bovis AF2122/97
cgcgcaacuuccauuuucgccaa

SEQ ID NO: 3182975 - RNA, 16 nt, Mycobacterium bovis subsp bovis AF2122/97
cgcgcaaggcgccgca

SEQ ID NO: 3182976 - RNA, 19 nt, Mycobacterium bovis subsp bovis AF2122/97
cgcgcaaggcgccgcaggg

SEQ ID NO: 3182977 - RNA, 12 nt, Mycobacterium bovis subsp bovis AF2122/97
cgcgcaagucga

SEQ ID NO: 3182978 - RNA, 15 nt, Mycobacterium bovis subsp bovis AF2122/97
cgcgcaagucgaugu

SEQ ID NO: 3182979 - RNA, 23 nt, Mycobacterium bovis subsp bovis AF2122/97
cgcgcaaucaggaaccgcucguc

SEQ ID NO: 3182980 - RNA, 18 nt, Mycobacterium bovis subsp bovis AF2122/97
cgcgcaauccugcgggac

SEQ ID NO: 3182981 - RNA, 16 nt, Mycobacterium bovis subsp bovis AF2122/97
cgcgcaccaacaccag

SEQ ID NO: 3182982 - RNA, 17 nt, Mycobacterium bovis subsp bovis AF2122/97
cgcgcaccaacaccagc

SEQ ID NO: 3182983 - RNA, 18 nt, Mycobacterium bovis subsp bovis AF2122/97
cgcgcaccaacaccagcg

SEQ ID NO: 3182984 - RNA, 21 nt, Mycobacterium bovis subsp bovis AF2122/97
cgcgcaccaacaccagcgcgu

SEQ ID NO: 3182985 - RNA, 12 nt, Mycobacterium bovis subsp bovis AF2122/97
cgcgcaccaccg

SEQ ID NO: 3182986 - RNA, 14 nt, Mycobacterium bovis subsp bovis AF2122/97
cgcgcaccaccgcg

SEQ ID NO: 3182987 - RNA, 15 nt, Mycobacterium bovis subsp bovis AF2122/97
cgcgcaccaccgcgg

SEQ ID NO: 3182988 - RNA, 16 nt, Mycobacterium bovis subsp bovis AF2122/97
cgcgcaccaccgcggc

SEQ ID NO: 3182989 - RNA, 19 nt, Mycobacterium bovis subsp bovis AF2122/97
cgcgcaccaccgcggcggc

SEQ ID NO: 3182990 - RNA, 14 nt, Mycobacterium bovis subsp bovis AF2122/97
cgcgcacccagccc

SEQ ID NO: 3182991 - RNA, 17 nt, Mycobacterium bovis subsp bovis AF2122/97
cgcgcaccccggcauac

SEQ ID NO: 3182992 - RNA, 18 nt, Mycobacterium bovis subsp bovis AF2122/97
cgcgcacccguccgccgc

SEQ ID NO: 3182993 - RNA, 19 nt, Mycobacterium bovis subsp bovis AF2122/97
cgcgcacccguccgccgca

SEQ ID NO: 3182994 - RNA, 16 nt, Mycobacterium bovis subsp bovis AF2122/97
cgcgcaccgcaggguc

SEQ ID NO: 3182995 - RNA, 17 nt, Mycobacterium bovis subsp bovis AF2122/97
cgcgcaccggaucgccg

SEQ ID NO: 3182996 - RNA, 23 nt, Mycobacterium bovis subsp bovis AF2122/97
cgcgcaccggguugagccgccgc

SEQ ID NO: 3182997 - RNA, 14 nt, Mycobacterium bovis subsp bovis AF2122/97
cgcgcaccuggcgc

SEQ ID NO: 3182998 - RNA, 16 nt, Mycobacterium bovis subsp bovis AF2122/97
cgcgcacgccaccggg

SEQ ID NO: 3182999 - RNA, 12 nt, Mycobacterium bovis subsp bovis AF2122/97
cgcgcacgcgug

SEQ ID NO: 3183000 - RNA, 17 nt, Mycobacterium bovis subsp bovis AF2122/97
cgcgcacggcccgagcc

SEQ ID NO: 3183001 - RNA, 19 nt, Mycobacterium bovis subsp bovis AF2122/97
cgcgcacggcccgagccgc

SEQ ID NO: 3183002 - RNA, 14 nt, Mycobacterium bovis subsp bovis AF2122/97
cgcgcacggcgucg

SEQ ID NO: 3183003 - RNA, 22 nt, Mycobacterium bovis subsp bovis AF2122/97
cgcgcacggcgucggccaccgc

SEQ ID NO: 3183004 - RNA, 12 nt, Mycobacterium bovis subsp bovis AF2122/97
cgcgcacgucga

SEQ ID NO: 3183005 - RNA, 12 nt, Mycobacterium bovis subsp bovis AF2122/97
cgcgcacgucgg

SEQ ID NO: 3183006 - RNA, 17 nt, Mycobacterium bovis subsp bovis AF2122/97
cgcgcacucgaccagga

SEQ ID NO: 3183007 - RNA, 20 nt, Mycobacterium bovis subsp bovis AF2122/97
cgcgcacucgacggucaucg

SEQ ID NO: 3183008 - RNA, 18 nt, Mycobacterium bovis subsp bovis AF2122/97
cgcgcacuugcguggcgu

SEQ ID NO: 3183009 - RNA, 20 nt, Mycobacterium bovis subsp bovis AF2122/97
cgcgcagauauuccucgucg

SEQ ID NO: 3183010 - RNA, 20 nt, Mycobacterium bovis subsp bovis AF2122/97
cgcgcagaucgaaaucagcc

SEQ ID NO: 3183011 - RNA, 19 nt, Mycobacterium bovis subsp bovis AF2122/97
cgcgcagaucguccaccgc

SEQ ID NO: 3183012 - RNA, 16 nt, Mycobacterium bovis subsp bovis AF2122/97
cgcgcagauggcauug

SEQ ID NO: 3183013 - RNA, 16 nt, Mycobacterium bovis subsp bovis AF2122/97
cgcgcagauucccggc

SEQ ID NO: 3183014 - RNA, 14 nt, Mycobacterium bovis subsp bovis AF2122/97
cgcgcagcaccggc

SEQ ID NO: 3183015 - RNA, 20 nt, Mycobacterium bovis subsp bovis AF2122/97
cgcgcagcaccggcucgacu

SEQ ID NO: 3183016 - RNA, 22 nt, Mycobacterium bovis subsp bovis AF2122/97
cgcgcagcaccggcucgacugc

SEQ ID NO: 3183017 - RNA, 13 nt, Mycobacterium bovis subsp bovis AF2122/97
cgcgcagcacugc

SEQ ID NO: 3183018 - RNA, 16 nt, Mycobacterium bovis subsp bovis AF2122/97
cgcgcagcacugcggc

SEQ ID NO: 3183019 - RNA, 20 nt, Mycobacterium bovis subsp bovis AF2122/97
cgcgcagcacugcggcagcg

SEQ ID NO: 3183020 - RNA, 12 nt, Mycobacterium bovis subsp bovis AF2122/97
cgcgcagcaguu

SEQ ID NO: 3183021 - RNA, 22 nt, Mycobacterium bovis subsp bovis AF2122/97
cgcgcagcaucuccgccggucc

SEQ ID NO: 3183022 - RNA, 18 nt, Mycobacterium bovis subsp bovis AF2122/97
cgcgcagcauggugcggc

SEQ ID NO: 3183023 - RNA, 21 nt, Mycobacterium bovis subsp bovis AF2122/97
cgcgcagcauggugcggcggc

SEQ ID NO: 3183024 - RNA, 14 nt, Mycobacterium bovis subsp bovis AF2122/97
cgcgcagccgccgc

SEQ ID NO: 3183025 - RNA, 18 nt, Mycobacterium bovis subsp bovis AF2122/97
cgcgcagccgccgcgccc

SEQ ID NO: 3183026 - RNA, 17 nt, Mycobacterium bovis subsp bovis AF2122/97
cgcgcagccgcucgacg

SEQ ID NO: 3183027 - RNA, 14 nt, Mycobacterium bovis subsp bovis AF2122/97
cgcgcagccgggcc

SEQ ID NO: 3183028 - RNA, 20 nt, Mycobacterium bovis subsp bovis AF2122/97
cgcgcagccgggccaaccgg

SEQ ID NO: 3183029 - RNA, 18 nt, Mycobacterium bovis subsp bovis AF2122/97
cgcgcagcgccgccaccc

SEQ ID NO: 3183030 - RNA, 12 nt, Mycobacterium bovis subsp bovis AF2122/97
cgcgcagcgcga

SEQ ID NO: 3183031 - RNA, 16 nt, Mycobacterium bovis subsp bovis AF2122/97
cgcgcagcgcgaucgc

SEQ ID NO: 3183032 - RNA, 20 nt, Mycobacterium bovis subsp bovis AF2122/97
cgcgcagcgcgaucgcgguc

SEQ ID NO: 3183033 - RNA, 17 nt, Mycobacterium bovis subsp bovis AF2122/97
cgcgcagcgcgaugucg

SEQ ID NO: 3183034 - RNA, 15 nt, Mycobacterium bovis subsp bovis AF2122/97
cgcgcagcgcggcgg

SEQ ID NO: 3183035 - RNA, 18 nt, Mycobacterium bovis subsp bovis AF2122/97
cgcgcagcgguccgccgc

SEQ ID NO: 3183036 - RNA, 15 nt, Mycobacterium bovis subsp bovis AF2122/97
cgcgcagcuccaccg

SEQ ID NO: 3183037 - RNA, 13 nt, Mycobacterium bovis subsp bovis AF2122/97
cgcgcagcugacg

SEQ ID NO: 3183038 - RNA, 15 nt, Mycobacterium bovis subsp bovis AF2122/97
cgcgcagcugacguc

SEQ ID NO: 3183039 - RNA, 15 nt, Mycobacterium bovis subsp bovis AF2122/97
cgcgcagcugccgca

SEQ ID NO: 3183040 - RNA, 12 nt, Mycobacterium bovis subsp bovis AF2122/97
cgcgcagcuugg

SEQ ID NO: 3183041 - RNA, 14 nt, Mycobacterium bovis subsp bovis AF2122/97
cgcgcaggaccugc

SEQ ID NO: 3183042 - RNA, 13 nt, Mycobacterium bovis subsp bovis AF2122/97
cgcgcaggccgcc

SEQ ID NO: 3183043 - RNA, 14 nt, Mycobacterium bovis subsp bovis AF2122/97
cgcgcaggccgccg

SEQ ID NO: 3183044 - RNA, 15 nt, Mycobacterium bovis subsp bovis AF2122/97
cgcgcaggccgccgc

SEQ ID NO: 3183045 - RNA, 18 nt, Mycobacterium bovis subsp bovis AF2122/97
cgcgcaggccgccgccag

SEQ ID NO: 3183046 - RNA, 19 nt, Mycobacterium bovis subsp bovis AF2122/97
cgcgcaggcuuccagccac

SEQ ID NO: 3183047 - RNA, 18 nt, Mycobacterium bovis subsp bovis AF2122/97
cgcgcagggaucgcaggg

SEQ ID NO: 3183048 - RNA, 20 nt, Mycobacterium bovis subsp bovis AF2122/97
cgcgcagggcgucggcgaau

SEQ ID NO: 3183049 - RNA, 17 nt, Mycobacterium bovis subsp bovis AF2122/97
cgcgcaggggcggcgug

SEQ ID NO: 3183050 - RNA, 21 nt, Mycobacterium bovis subsp bovis AF2122/97
cgcgcaggggcggcgugaagu

SEQ ID NO: 3183051 - RNA, 14 nt, Mycobacterium bovis subsp bovis AF2122/97
cgcgcagguagcgc

SEQ ID NO: 3183052 - RNA, 17 nt, Mycobacterium bovis subsp bovis AF2122/97
cgcgcagguagcgcucg

SEQ ID NO: 3183053 - RNA, 21 nt, Mycobacterium bovis subsp bovis AF2122/97
cgcgcagguagcgcucgauca

SEQ ID NO: 3183054 - RNA, 18 nt, Mycobacterium bovis subsp bovis AF2122/97
cgcgcagguagucgacga

SEQ ID NO: 3183055 - RNA, 19 nt, Mycobacterium bovis subsp bovis AF2122/97
cgcgcagguagucgacgac

SEQ ID NO: 3183056 - RNA, 17 nt, Mycobacterium bovis subsp bovis AF2122/97
cgcgcaggugcugggcg

SEQ ID NO: 3183057 - RNA, 22 nt, Mycobacterium bovis subsp bovis AF2122/97
cgcgcaggugcugggcgaggug

SEQ ID NO: 3183058 - RNA, 21 nt, Mycobacterium bovis subsp bovis AF2122/97
cgcgcaguacuugaccgucca

SEQ ID NO: 3183059 - RNA, 16 nt, Mycobacterium bovis subsp bovis AF2122/97
cgcgcaguuuggcggc

SEQ ID NO: 3183060 - RNA, 17 nt, Mycobacterium bovis subsp bovis AF2122/97
cgcgcaguuuggcggcg

SEQ ID NO: 3183061 - RNA, 18 nt, Mycobacterium bovis subsp bovis AF2122/97
cgcgcaguuuggcggcgc

SEQ ID NO: 3183062 - RNA, 22 nt, Mycobacterium bovis subsp bovis AF2122/97
cgcgcaguuuggcggcgcgcag

SEQ ID NO: 3183063 - RNA, 14 nt, Mycobacterium bovis subsp bovis AF2122/97
cgcgcauauccgca

SEQ ID NO: 3183064 - RNA, 17 nt, Mycobacterium bovis subsp bovis AF2122/97
cgcgcauauccgcaggc

SEQ ID NO: 3183065 - RNA, 13 nt, Mycobacterium bovis subsp bovis AF2122/97
cgcgcaucgcggc

SEQ ID NO: 3183066 - RNA, 16 nt, Mycobacterium bovis subsp bovis AF2122/97
cgcgcaucgcggccga

SEQ ID NO: 3183067 - RNA, 19 nt, Mycobacterium bovis subsp bovis AF2122/97
cgcgcaucugucgcgcggc

SEQ ID NO: 3183068 - RNA, 15 nt, Mycobacterium bovis subsp bovis AF2122/97
cgcgcaugccccgac

SEQ ID NO: 3183069 - RNA, 14 nt, Mycobacterium bovis subsp bovis AF2122/97
cgcgcauucgccgg

SEQ ID NO: 3183070 - RNA, 15 nt, Mycobacterium bovis subsp bovis AF2122/97
cgcgcauucgccggg

SEQ ID NO: 3183071 - RNA, 16 nt, Mycobacterium bovis subsp bovis AF2122/97
cgcgcauucgccgggc

SEQ ID NO: 3183072 - RNA, 20 nt, Mycobacterium bovis subsp bovis AF2122/97
cgcgcauugccgacgcgcgg

SEQ ID NO: 3183073 - RNA, 21 nt, Mycobacterium bovis subsp bovis AF2122/97
cgcgcauugccgacgcgcggc

SEQ ID NO: 3183074 - RNA, 16 nt, Mycobacterium bovis subsp bovis AF2122/97
cgcgcauugcgcuucc

SEQ ID NO: 3183075 - RNA, 22 nt, Mycobacterium bovis subsp bovis AF2122/97
cgcgcauugcgcuuccaacacc

SEQ ID NO: 3183076 - RNA, 21 nt, Mycobacterium bovis subsp bovis AF2122/97
cgcgcauuucguggcgcgccg

SEQ ID NO: 3183077 - RNA, 18 nt, Mycobacterium bovis subsp bovis AF2122/97
cgcgcauuuuucgccagc

SEQ ID NO: 3183078 - RNA, 20 nt, Mycobacterium bovis subsp bovis AF2122/97
cgcgcauuuuucgccagcug

SEQ ID NO: 3183079 - RNA, 17 nt, Mycobacterium bovis subsp bovis AF2122/97
cgcgccaaacaccccgg

SEQ ID NO: 3183080 - RNA, 19 nt, Mycobacterium bovis subsp bovis AF2122/97
cgcgccaaacaccccggcc

SEQ ID NO: 3183081 - RNA, 22 nt, Mycobacterium bovis subsp bovis AF2122/97
cgcgccaacagaugccacccag

SEQ ID NO: 3183082 - RNA, 20 nt, Mycobacterium bovis subsp bovis AF2122/97
cgcgccaaguggcgcucgca

SEQ ID NO: 3183083 - RNA, 15 nt, Mycobacterium bovis subsp bovis AF2122/97
cgcgccaaucgccca

SEQ ID NO: 3183084 - RNA, 14 nt, Mycobacterium bovis subsp bovis AF2122/97
cgcgccaccagcac

SEQ ID NO: 3183085 - RNA, 19 nt, Mycobacterium bovis subsp bovis AF2122/97
cgcgccaccagcaccgccg

SEQ ID NO: 3183086 - RNA, 12 nt, Mycobacterium bovis subsp bovis AF2122/97
cgcgccacccag

SEQ ID NO: 3183087 - RNA, 11 nt, Mycobacterium bovis subsp bovis AF2122/97
cgcgccaccga

SEQ ID NO: 3183088 - RNA, 15 nt, Mycobacterium bovis subsp bovis AF2122/97
cgcgccaccgagccc

SEQ ID NO: 3183089 - RNA, 15 nt, Mycobacterium bovis subsp bovis AF2122/97
cgcgccaccggcacc

SEQ ID NO: 3183090 - RNA, 16 nt, Mycobacterium bovis subsp bovis AF2122/97
cgcgccaccggcaccg

SEQ ID NO: 3183091 - RNA, 18 nt, Mycobacterium bovis subsp bovis AF2122/97
cgcgccaccggcaccgcc

SEQ ID NO: 3183092 - RNA, 20 nt, Mycobacterium bovis subsp bovis AF2122/97
cgcgccaccggcaccgccug

SEQ ID NO: 3183093 - RNA, 19 nt, Mycobacterium bovis subsp bovis AF2122/97
cgcgccaccucccacgccg

SEQ ID NO: 3183094 - RNA, 15 nt, Mycobacterium bovis subsp bovis AF2122/97
cgcgccaccuccgac

SEQ ID NO: 3183095 - RNA, 21 nt, Mycobacterium bovis subsp bovis AF2122/97
cgcgccaccuccgacgggcga

SEQ ID NO: 3183096 - RNA, 22 nt, Mycobacterium bovis subsp bovis AF2122/97
cgcgccagaacgacaccgcuug

SEQ ID NO: 3183097 - RNA, 13 nt, Mycobacterium bovis subsp bovis AF2122/97
cgcgccagcuccg

SEQ ID NO: 3183098 - RNA, 17 nt, Mycobacterium bovis subsp bovis AF2122/97
cgcgccagcucggcggc

SEQ ID NO: 3183099 - RNA, 23 nt, Mycobacterium bovis subsp bovis AF2122/97
cgcgccagcucggcggcagcggc

SEQ ID NO: 3183100 - RNA, 15 nt, Mycobacterium bovis subsp bovis AF2122/97
cgcgccaggccacgu

SEQ ID NO: 3183101 - RNA, 14 nt, Mycobacterium bovis subsp bovis AF2122/97
cgcgccaggcgcga

SEQ ID NO: 3183102 - RNA, 14 nt, Mycobacterium bovis subsp bovis AF2122/97
cgcgccaggcucga

SEQ ID NO: 3183103 - RNA, 19 nt, Mycobacterium bovis subsp bovis AF2122/97
cgcgccaggcuugcggcac

SEQ ID NO: 3183104 - RNA, 20 nt, Mycobacterium bovis subsp bovis AF2122/97
cgcgccaggcuugcggcacc

SEQ ID NO: 3183105 - RNA, 15 nt, Mycobacterium bovis subsp bovis AF2122/97
cgcgccaguguggug

SEQ ID NO: 3183106 - RNA, 17 nt, Mycobacterium bovis subsp bovis AF2122/97
cgcgccauacuggcggu

SEQ ID NO: 3183107 - RNA, 14 nt, Mycobacterium bovis subsp bovis AF2122/97
cgcgccaucgucgc

SEQ ID NO: 3183108 - RNA, 18 nt, Mycobacterium bovis subsp bovis AF2122/97
cgcgccaucgucgcgccg

SEQ ID NO: 3183109 - RNA, 21 nt, Mycobacterium bovis subsp bovis AF2122/97
cgcgccaucgucgcgccgcgu

SEQ ID NO: 3183110 - RNA, 16 nt, Mycobacterium bovis subsp bovis AF2122/97
cgcgccauuggcgccg

SEQ ID NO: 3183111 - RNA, 18 nt, Mycobacterium bovis subsp bovis AF2122/97
cgcgccauuggcgccgcc

SEQ ID NO: 3183112 - RNA, 19 nt, Mycobacterium bovis subsp bovis AF2122/97
cgcgccauuggcgccgccg

SEQ ID NO: 3183113 - RNA, 17 nt, Mycobacterium bovis subsp bovis AF2122/97
cgcgccauuggcggugg

SEQ ID NO: 3183114 - RNA, 19 nt, Mycobacterium bovis subsp bovis AF2122/97
cgcgcccacagcccgggcg

SEQ ID NO: 3183115 - RNA, 13 nt, Mycobacterium bovis subsp bovis AF2122/97
cgcgcccaccagc

SEQ ID NO: 3183116 - RNA, 16 nt, Mycobacterium bovis subsp bovis AF2122/97
cgcgcccaccagcggc

SEQ ID NO: 3183117 - RNA, 23 nt, Mycobacterium bovis subsp bovis AF2122/97
cgcgcccaccagcggcggcaacg

SEQ ID NO: 3183118 - RNA, 15 nt, Mycobacterium bovis subsp bovis AF2122/97
cgcgcccaccccggc

SEQ ID NO: 3183119 - RNA, 16 nt, Mycobacterium bovis subsp bovis AF2122/97
cgcgcccaccccggcc

SEQ ID NO: 3183120 - RNA, 14 nt, Mycobacterium bovis subsp bovis AF2122/97
cgcgcccaccgggc

SEQ ID NO: 3183121 - RNA, 17 nt, Mycobacterium bovis subsp bovis AF2122/97
cgcgcccaccgggcggc

SEQ ID NO: 3183122 - RNA, 16 nt, Mycobacterium bovis subsp bovis AF2122/97
cgcgcccagaccgacc

SEQ ID NO: 3183123 - RNA, 19 nt, Mycobacterium bovis subsp bovis AF2122/97
cgcgcccagaccgacccgc

SEQ ID NO: 3183124 - RNA, 13 nt, Mycobacterium bovis subsp bovis AF2122/97
cgcgccccaccgc

SEQ ID NO: 3183125 - RNA, 22 nt, Mycobacterium bovis subsp bovis AF2122/97
cgcgcccccggugccguuggag

SEQ ID NO: 3183126 - RNA, 14 nt, Mycobacterium bovis subsp bovis AF2122/97
cgcgccccgccgca

SEQ ID NO: 3183127 - RNA, 15 nt, Mycobacterium bovis subsp bovis AF2122/97
cgcgccccgccgcac

SEQ ID NO: 3183128 - RNA, 20 nt, Mycobacterium bovis subsp bovis AF2122/97
cgcgcccgaaugcgacgucg

SEQ ID NO: 3183129 - RNA, 21 nt, Mycobacterium bovis subsp bovis AF2122/97
cgcgcccgaaugcgacgucgu

SEQ ID NO: 3183130 - RNA, 13 nt, Mycobacterium bovis subsp bovis AF2122/97
cgcgcccgacacc

SEQ ID NO: 3183131 - RNA, 12 nt, Mycobacterium bovis subsp bovis AF2122/97
cgcgcccgacga

SEQ ID NO: 3183132 - RNA, 15 nt, Mycobacterium bovis subsp bovis AF2122/97
cgcgcccgagccggu

SEQ ID NO: 3183133 - RNA, 21 nt, Mycobacterium bovis subsp bovis AF2122/97
cgcgcccgccaucagcccggc

SEQ ID NO: 3183134 - RNA, 12 nt, Mycobacterium bovis subsp bovis AF2122/97
cgcgcccgccgc

SEQ ID NO: 3183135 - RNA, 14 nt, Mycobacterium bovis subsp bovis AF2122/97
cgcgcccgccucau

SEQ ID NO: 3183136 - RNA, 17 nt, Mycobacterium bovis subsp bovis AF2122/97
cgcgcccgccucaucgg

SEQ ID NO: 3183137 - RNA, 19 nt, Mycobacterium bovis subsp bovis AF2122/97
cgcgcccgccucaucggca

SEQ ID NO: 3183138 - RNA, 18 nt, Mycobacterium bovis subsp bovis AF2122/97
cgcgcccgccucgaccgc

SEQ ID NO: 3183139 - RNA, 22 nt, Mycobacterium bovis subsp bovis AF2122/97
cgcgcccgccucgaccgccagc

SEQ ID NO: 3183140 - RNA, 15 nt, Mycobacterium bovis subsp bovis AF2122/97
cgcgcccgcggccgc

SEQ ID NO: 3183141 - RNA, 19 nt, Mycobacterium bovis subsp bovis AF2122/97
cgcgcccgcggccgccagc

SEQ ID NO: 3183142 - RNA, 20 nt, Mycobacterium bovis subsp bovis AF2122/97
cgcgcccgcggccgccagcg

SEQ ID NO: 3183143 - RNA, 13 nt, Mycobacterium bovis subsp bovis AF2122/97
cgcgcccgcgggc

SEQ ID NO: 3183144 - RNA, 14 nt, Mycobacterium bovis subsp bovis AF2122/97
cgcgcccggccggu

SEQ ID NO: 3183145 - RNA, 13 nt, Mycobacterium bovis subsp bovis AF2122/97
cgcgcccggcgca

SEQ ID NO: 3183146 - RNA, 13 nt, Mycobacterium bovis subsp bovis AF2122/97
cgcgcccggcgcu

SEQ ID NO: 3183147 - RNA, 19 nt, Mycobacterium bovis subsp bovis AF2122/97
cgcgcccgggcauccuuca

SEQ ID NO: 3183148 - RNA, 19 nt, Mycobacterium bovis subsp bovis AF2122/97
cgcgcccgggcggaacgcc

SEQ ID NO: 3183149 - RNA, 12 nt, Mycobacterium bovis subsp bovis AF2122/97
cgcgcccguccc

SEQ ID NO: 3183150 - RNA, 16 nt, Mycobacterium bovis subsp bovis AF2122/97
cgcgcccugcggaucg

SEQ ID NO: 3183151 - RNA, 16 nt, Mycobacterium bovis subsp bovis AF2122/97
cgcgcccuucagcacg

SEQ ID NO: 3183152 - RNA, 23 nt, Mycobacterium bovis subsp bovis AF2122/97
cgcgcccuucagcacggugauca

SEQ ID NO: 3183153 - RNA, 21 nt, Mycobacterium bovis subsp bovis AF2122/97
cgcgccgaacacgcacacgau

SEQ ID NO: 3183154 - RNA, 14 nt, Mycobacterium bovis subsp bovis AF2122/97
cgcgccgaccaccg

SEQ ID NO: 3183155 - RNA, 15 nt, Mycobacterium bovis subsp bovis AF2122/97
cgcgccgaccaccgc

SEQ ID NO: 3183156 - RNA, 19 nt, Mycobacterium bovis subsp bovis AF2122/97
cgcgccgaccaccgcugcg

SEQ ID NO: 3183157 - RNA, 20 nt, Mycobacterium bovis subsp bovis AF2122/97
cgcgccgaccaccgcugcga

SEQ ID NO: 3183158 - RNA, 17 nt, Mycobacterium bovis subsp bovis AF2122/97
cgcgccgaccucaucgg

SEQ ID NO: 3183159 - RNA, 19 nt, Mycobacterium bovis subsp bovis AF2122/97
cgcgccgaccucaucggca

SEQ ID NO: 3183160 - RNA, 20 nt, Mycobacterium bovis subsp bovis AF2122/97
cgcgccgaccucaucggcac

SEQ ID NO: 3183161 - RNA, 19 nt, Mycobacterium bovis subsp bovis AF2122/97
cgcgccgacggccagcagg

SEQ ID NO: 3183162 - RNA, 23 nt, Mycobacterium bovis subsp bovis AF2122/97
cgcgccgagccagcacccgcagc

SEQ ID NO: 3183163 - RNA, 12 nt, Mycobacterium bovis subsp bovis AF2122/97
cgcgccgagccc

SEQ ID NO: 3183164 - RNA, 16 nt, Mycobacterium bovis subsp bovis AF2122/97
cgcgccgagcccgggc

SEQ ID NO: 3183165 - RNA, 18 nt, Mycobacterium bovis subsp bovis AF2122/97
cgcgccgagcccgggccu

SEQ ID NO: 3183166 - RNA, 21 nt, Mycobacterium bovis subsp bovis AF2122/97
cgcgccgagcgugaagucacg

SEQ ID NO: 3183167 - RNA, 23 nt, Mycobacterium bovis subsp bovis AF2122/97
cgcgccgaguugcccgggucggc

SEQ ID NO: 3183168 - RNA, 13 nt, Mycobacterium bovis subsp bovis AF2122/97
cgcgccgaucacc

SEQ ID NO: 3183169 - RNA, 14 nt, Mycobacterium bovis subsp bovis AF2122/97
cgcgccgaucacca

SEQ ID NO: 3183170 - RNA, 19 nt, Mycobacterium bovis subsp bovis AF2122/97
cgcgccgaucaccaccggc

SEQ ID NO: 3183171 - RNA, 19 nt, Mycobacterium bovis subsp bovis AF2122/97
cgcgccgaugaacguggcg

SEQ ID NO: 3183172 - RNA, 19 nt, Mycobacterium bovis subsp bovis AF2122/97
cgcgccgauuccaccgccg

SEQ ID NO: 3183173 - RNA, 23 nt, Mycobacterium bovis subsp bovis AF2122/97
cgcgccgauuccaccgccgacgc

SEQ ID NO: 3183174 - RNA, 19 nt, Mycobacterium bovis subsp bovis AF2122/97
cgcgccgcaccaucggcga

SEQ ID NO: 3183175 - RNA, 13 nt, Mycobacterium bovis subsp bovis AF2122/97
cgcgccgcagcgc

SEQ ID NO: 3183176 - RNA, 15 nt, Mycobacterium bovis subsp bovis AF2122/97
cgcgccgcaucggcg

SEQ ID NO: 3183177 - RNA, 16 nt, Mycobacterium bovis subsp bovis AF2122/97
cgcgccgccccgcucg

SEQ ID NO: 3183178 - RNA, 12 nt, Mycobacterium bovis subsp bovis AF2122/97
cgcgccgcccgc

SEQ ID NO: 3183179 - RNA, 21 nt, Mycobacterium bovis subsp bovis AF2122/97
cgcgccgcccgcuccuccggc

SEQ ID NO: 3183180 - RNA, 13 nt, Mycobacterium bovis subsp bovis AF2122/97
cgcgccgccgcua

SEQ ID NO: 3183181 - RNA, 23 nt, Mycobacterium bovis subsp bovis AF2122/97
cgcgccgccgcuacccccgaugg

SEQ ID NO: 3183182 - RNA, 17 nt, Mycobacterium bovis subsp bovis AF2122/97
cgcgccgcgaggcaccg

SEQ ID NO: 3183183 - RNA, 13 nt, Mycobacterium bovis subsp bovis AF2122/97
cgcgccgcgcauc

SEQ ID NO: 3183184 - RNA, 18 nt, Mycobacterium bovis subsp bovis AF2122/97
cgcgccgcgcaucgcggc

SEQ ID NO: 3183185 - RNA, 20 nt, Mycobacterium bovis subsp bovis AF2122/97
cgcgccgcgcaucgcggccg

SEQ ID NO: 3183186 - RNA, 13 nt, Mycobacterium bovis subsp bovis AF2122/97
cgcgccgcggccc

SEQ ID NO: 3183187 - RNA, 16 nt, Mycobacterium bovis subsp bovis AF2122/97
cgcgccggccccgggg

SEQ ID NO: 3183188 - RNA, 12 nt, Mycobacterium bovis subsp bovis AF2122/97
cgcgccggccgc

SEQ ID NO: 3183189 - RNA, 22 nt, Mycobacterium bovis subsp bovis AF2122/97
cgcgccggccgcacgccggcca

SEQ ID NO: 3183190 - RNA, 14 nt, Mycobacterium bovis subsp bovis AF2122/97
cgcgccggcgaccc

SEQ ID NO: 3183191 - RNA, 18 nt, Mycobacterium bovis subsp bovis AF2122/97
cgcgccggcgacccgggu

SEQ ID NO: 3183192 - RNA, 13 nt, Mycobacterium bovis subsp bovis AF2122/97
cgcgccggcggcc

SEQ ID NO: 3183193 - RNA, 16 nt, Mycobacterium bovis subsp bovis AF2122/97
cgcgccggcggccacc

SEQ ID NO: 3183194 - RNA, 17 nt, Mycobacterium bovis subsp bovis AF2122/97
cgcgccggcggccaccu

SEQ ID NO: 3183195 - RNA, 15 nt, Mycobacterium bovis subsp bovis AF2122/97
cgcgccggcgguagu

SEQ ID NO: 3183196 - RNA, 21 nt, Mycobacterium bovis subsp bovis AF2122/97
cgcgccggcgguagucggcca

SEQ ID NO: 3183197 - RNA, 11 nt, Mycobacterium bovis subsp bovis AF2122/97
cgcgccggcgu

SEQ ID NO: 3183198 - RNA, 21 nt, Mycobacterium bovis subsp bovis AF2122/97
cgcgccggcgugcaugagccg

SEQ ID NO: 3183199 - RNA, 19 nt, Mycobacterium bovis subsp bovis AF2122/97
cgcgccggcugccacacag

SEQ ID NO: 3183200 - RNA, 16 nt, Mycobacterium bovis subsp bovis AF2122/97
cgcgccggguccgcgg

SEQ ID NO: 3183201 - RNA, 14 nt, Mycobacterium bovis subsp bovis AF2122/97
cgcgccggucgccg

SEQ ID NO: 3183202 - RNA, 20 nt, Mycobacterium bovis subsp bovis AF2122/97
cgcgccggucgccgacggcg

SEQ ID NO: 3183203 - RNA, 14 nt, Mycobacterium bovis subsp bovis AF2122/97
cgcgccgguucaga

SEQ ID NO: 3183204 - RNA, 17 nt, Mycobacterium bovis subsp bovis AF2122/97
cgcgccgguucagacgg

SEQ ID NO: 3183205 - RNA, 17 nt, Mycobacterium bovis subsp bovis AF2122/97
cgcgccguaacagccgg

SEQ ID NO: 3183206 - RNA, 21 nt, Mycobacterium bovis subsp bovis AF2122/97
cgcgccguacguucaccaccg

SEQ ID NO: 3183207 - RNA, 17 nt, Mycobacterium bovis subsp bovis AF2122/97
cgcgccguagaccagca

SEQ ID NO: 3183208 - RNA, 19 nt, Mycobacterium bovis subsp bovis AF2122/97
cgcgccguagaccagcagg

SEQ ID NO: 3183209 - RNA, 22 nt, Mycobacterium bovis subsp bovis AF2122/97
cgcgccguagaccagcaggccc

SEQ ID NO: 3183210 - RNA, 17 nt, Mycobacterium bovis subsp bovis AF2122/97
cgcgccguaguucuccg

SEQ ID NO: 3183211 - RNA, 16 nt, Mycobacterium bovis subsp bovis AF2122/97
cgcgccgucggguucc

SEQ ID NO: 3183212 - RNA, 24 nt, Mycobacterium bovis subsp bovis AF2122/97
cgcgccgucggguuccuccucggc

SEQ ID NO: 3183213 - RNA, 14 nt, Mycobacterium bovis subsp bovis AF2122/97
cgcgccgucgucga

SEQ ID NO: 3183214 - RNA, 19 nt, Mycobacterium bovis subsp bovis AF2122/97
cgcgccgucgucgaccacg

SEQ ID NO: 3183215 - RNA, 21 nt, Mycobacterium bovis subsp bovis AF2122/97
cgcgccgucgucgaccacgac

SEQ ID NO: 3183216 - RNA, 16 nt, Mycobacterium bovis subsp bovis AF2122/97
cgcgccgucucgaagc

SEQ ID NO: 3183217 - RNA, 13 nt, Mycobacterium bovis subsp bovis AF2122/97
cgcgccguggcgu

SEQ ID NO: 3183218 - RNA, 19 nt, Mycobacterium bovis subsp bovis AF2122/97
cgcgccguggcgucggugg

SEQ ID NO: 3183219 - RNA, 21 nt, Mycobacterium bovis subsp bovis AF2122/97
cgcgccguucgccuggucacc

SEQ ID NO: 3183220 - RNA, 22 nt, Mycobacterium bovis subsp bovis AF2122/97
cgcgccguucgccuggucaccg

SEQ ID NO: 3183221 - RNA, 21 nt, Mycobacterium bovis subsp bovis AF2122/97
cgcgccguucugaucugcgca

SEQ ID NO: 3183222 - RNA, 16 nt, Mycobacterium bovis subsp bovis AF2122/97
cgcgccguugccgccc

SEQ ID NO: 3183223 - RNA, 22 nt, Mycobacterium bovis subsp bovis AF2122/97
cgcgccuauccaaagaccccua

SEQ ID NO: 3183224 - RNA, 17 nt, Mycobacterium bovis subsp bovis AF2122/97
cgcgccuaugggccugc

SEQ ID NO: 3183225 - RNA, 19 nt, Mycobacterium bovis subsp bovis AF2122/97
cgcgccuccguugccccca

SEQ ID NO: 3183226 - RNA, 21 nt, Mycobacterium bovis subsp bovis AF2122/97
cgcgccuccguugcccccauu

SEQ ID NO: 3183227 - RNA, 18 nt, Mycobacterium bovis subsp bovis AF2122/97
cgcgccugccucaccgcc

SEQ ID NO: 3183228 - RNA, 19 nt, Mycobacterium bovis subsp bovis AF2122/97
cgcgccugccucaccgccg

SEQ ID NO: 3183229 - RNA, 22 nt, Mycobacterium bovis subsp bovis AF2122/97
cgcgccugcgccacccgcggug

SEQ ID NO: 3183230 - RNA, 18 nt, Mycobacterium bovis subsp bovis AF2122/97
cgcgccuggagcgaucuc

SEQ ID NO: 3183231 - RNA, 15 nt, Mycobacterium bovis subsp bovis AF2122/97
cgcgccugugccacc

SEQ ID NO: 3183232 - RNA, 17 nt, Mycobacterium bovis subsp bovis AF2122/97
cgcgccugugccaccgc

SEQ ID NO: 3183233 - RNA, 19 nt, Mycobacterium bovis subsp bovis AF2122/97
cgcgccugugccaccgcug

SEQ ID NO: 3183234 - RNA, 19 nt, Mycobacterium bovis subsp bovis AF2122/97
cgcgccugugcgcaaggcc

SEQ ID NO: 3183235 - RNA, 20 nt, Mycobacterium bovis subsp bovis AF2122/97
cgcgccugugcgcaaggccg

SEQ ID NO: 3183236 - RNA, 14 nt, Mycobacterium bovis subsp bovis AF2122/97
cgcgccuucacgcu

SEQ ID NO: 3183237 - RNA, 18 nt, Mycobacterium bovis subsp bovis AF2122/97
cgcgccuucacgcuggcc

SEQ ID NO: 3183238 - RNA, 21 nt, Mycobacterium bovis subsp bovis AF2122/97
cgcgccuugauggucuccacc

SEQ ID NO: 3183239 - RNA, 21 nt, Mycobacterium bovis subsp bovis AF2122/97
cgcgccuuggcacccuccgcc

SEQ ID NO: 3183240 - RNA, 18 nt, Mycobacterium bovis subsp bovis AF2122/97
cgcgccuuucgucgaagg

SEQ ID NO: 3183241 - RNA, 15 nt, Mycobacterium bovis subsp bovis AF2122/97
cgcgccuuugagccc

SEQ ID NO: 3183242 - RNA, 18 nt, Mycobacterium bovis subsp bovis AF2122/97
cgcgcgaaccccagccga

SEQ ID NO: 3183243 - RNA, 23 nt, Mycobacterium bovis subsp bovis AF2122/97
cgcgcgaacgucaaccgggcggc

SEQ ID NO: 3183244 - RNA, 18 nt, Mycobacterium bovis subsp bovis AF2122/97
cgcgcgaagaucggcgcu

SEQ ID NO: 3183245 - RNA, 14 nt, Mycobacterium bovis subsp bovis AF2122/97
cgcgcgaaugguca

SEQ ID NO: 3183246 - RNA, 22 nt, Mycobacterium bovis subsp bovis AF2122/97
cgcgcgaauggucagcgucgcu

SEQ ID NO: 3183247 - RNA, 14 nt, Mycobacterium bovis subsp bovis AF2122/97
cgcgcgacaacccg

SEQ ID NO: 3183248 - RNA, 18 nt, Mycobacterium bovis subsp bovis AF2122/97
cgcgcgacaacccggcgu

SEQ ID NO: 3183249 - RNA, 14 nt, Mycobacterium bovis subsp bovis AF2122/97
cgcgcgaccauacc

SEQ ID NO: 3183250 - RNA, 13 nt, Mycobacterium bovis subsp bovis AF2122/97
cgcgcgaccuggu

SEQ ID NO: 3183251 - RNA, 16 nt, Mycobacterium bovis subsp bovis AF2122/97
cgcgcgaccuggucga

SEQ ID NO: 3183252 - RNA, 13 nt, Mycobacterium bovis subsp bovis AF2122/97
cgcgcgacgccgu

SEQ ID NO: 3183253 - RNA, 12 nt, Mycobacterium bovis subsp bovis AF2122/97
cgcgcgacggac

SEQ ID NO: 3183254 - RNA, 13 nt, Mycobacterium bovis subsp bovis AF2122/97
cgcgcgacggccg

SEQ ID NO: 3183255 - RNA, 15 nt, Mycobacterium bovis subsp bovis AF2122/97
cgcgcgacggccggg

SEQ ID NO: 3183256 - RNA, 21 nt, Mycobacterium bovis subsp bovis AF2122/97
cgcgcgacuuucugcgcgugg

SEQ ID NO: 3183257 - RNA, 14 nt, Mycobacterium bovis subsp bovis AF2122/97
cgcgcgagaacacc

SEQ ID NO: 3183258 - RNA, 21 nt, Mycobacterium bovis subsp bovis AF2122/97
cgcgcgagaacacccgugccu

SEQ ID NO: 3183259 - RNA, 22 nt, Mycobacterium bovis subsp bovis AF2122/97
cgcgcgagauccuucgcguugg

SEQ ID NO: 3183260 - RNA, 16 nt, Mycobacterium bovis subsp bovis AF2122/97
cgcgcgaugcuggcga

SEQ ID NO: 3183261 - RNA, 18 nt, Mycobacterium bovis subsp bovis AF2122/97
cgcgcgaugcuggcgaac

SEQ ID NO: 3183262 - RNA, 18 nt, Mycobacterium bovis subsp bovis AF2122/97
cgcgcgcaacccugccgc

SEQ ID NO: 3183263 - RNA, 20 nt, Mycobacterium bovis subsp bovis AF2122/97
cgcgcgcaacccugccgcga

SEQ ID NO: 3183264 - RNA, 23 nt, Mycobacterium bovis subsp bovis AF2122/97
cgcgcgcaacccugccgcgauga

SEQ ID NO: 3183265 - RNA, 22 nt, Mycobacterium bovis subsp bovis AF2122/97
cgcgcgcaagucgauguacacc

SEQ ID NO: 3183266 - RNA, 13 nt, Mycobacterium bovis subsp bovis AF2122/97
cgcgcgcaccaga

SEQ ID NO: 3183267 - RNA, 13 nt, Mycobacterium bovis subsp bovis AF2122/97
cgcgcgcaccggg

SEQ ID NO: 3183268 - RNA, 22 nt, Mycobacterium bovis subsp bovis AF2122/97
cgcgcgcacggcgucggccacc

SEQ ID NO: 3183269 - RNA, 22 nt, Mycobacterium bovis subsp bovis AF2122/97
cgcgcgcagaugagcgcggcga

SEQ ID NO: 3183270 - RNA, 16 nt, Mycobacterium bovis subsp bovis AF2122/97
cgcgcgcagccgggca

SEQ ID NO: 3183271 - RNA, 13 nt, Mycobacterium bovis subsp bovis AF2122/97
cgcgcgcagcuga

SEQ ID NO: 3183272 - RNA, 17 nt, Mycobacterium bovis subsp bovis AF2122/97
cgcgcgcaggccgccgc

SEQ ID NO: 3183273 - RNA, 16 nt, Mycobacterium bovis subsp bovis AF2122/97
cgcgcgcaucgcgccu

SEQ ID NO: 3183274 - RNA, 12 nt, Mycobacterium bovis subsp bovis AF2122/97
cgcgcgccagcu

SEQ ID NO: 3183275 - RNA, 18 nt, Mycobacterium bovis subsp bovis AF2122/97
cgcgcgccagcucggcgg

SEQ ID NO: 3183276 - RNA, 20 nt, Mycobacterium bovis subsp bovis AF2122/97
cgcgcgccagcucggcggca

SEQ ID NO: 3183277 - RNA, 14 nt, Mycobacterium bovis subsp bovis AF2122/97
cgcgcgccaucgcc

SEQ ID NO: 3183278 - RNA, 20 nt, Mycobacterium bovis subsp bovis AF2122/97
cgcgcgccaucgccuccagc

SEQ ID NO: 3183279 - RNA, 17 nt, Mycobacterium bovis subsp bovis AF2122/97
cgcgcgccauuggcggu

SEQ ID NO: 3183280 - RNA, 13 nt, Mycobacterium bovis subsp bovis AF2122/97
cgcgcgcccgccu

SEQ ID NO: 3183281 - RNA, 16 nt, Mycobacterium bovis subsp bovis AF2122/97
cgcgcgccgagcccgg

SEQ ID NO: 3183282 - RNA, 13 nt, Mycobacterium bovis subsp bovis AF2122/97
cgcgcgccgcagc

SEQ ID NO: 3183283 - RNA, 13 nt, Mycobacterium bovis subsp bovis AF2122/97
cgcgcgccgcgac

SEQ ID NO: 3183284 - RNA, 14 nt, Mycobacterium bovis subsp bovis AF2122/97
cgcgcgccgcgacg

SEQ ID NO: 3183285 - RNA, 14 nt, Mycobacterium bovis subsp bovis AF2122/97
cgcgcgccgcuggg

SEQ ID NO: 3183286 - RNA, 12 nt, Mycobacterium bovis subsp bovis AF2122/97
cgcgcgccggcu

SEQ ID NO: 3183287 - RNA, 17 nt, Mycobacterium bovis subsp bovis AF2122/97
cgcgcgccggcugccac

SEQ ID NO: 3183288 - RNA, 12 nt, Mycobacterium bovis subsp bovis AF2122/97
cgcgcgcucgag

SEQ ID NO: 3183289 - RNA, 24 nt, Mycobacterium bovis subsp bovis AF2122/97
cgcgcgcucgcucaccggcgcggu

SEQ ID NO: 3183290 - RNA, 23 nt, Mycobacterium bovis subsp bovis AF2122/97
cgcgcgcucgcucaccggcuggu

SEQ ID NO: 3183291 - RNA, 14 nt, Mycobacterium bovis subsp bovis AF2122/97
cgcgcgcugagccg

SEQ ID NO: 3183292 - RNA, 16 nt, Mycobacterium bovis subsp bovis AF2122/97
cgcgcgcugagccgua

SEQ ID NO: 3183293 - RNA, 18 nt, Mycobacterium bovis subsp bovis AF2122/97
cgcgcgcugggcgcgcuc

SEQ ID NO: 3183294 - RNA, 22 nt, Mycobacterium bovis subsp bovis AF2122/97
cgcgcgcugggcgcgcucaucg

SEQ ID NO: 3183295 - RNA, 13 nt, Mycobacterium bovis subsp bovis AF2122/97
cgcgcggaacacc

SEQ ID NO: 3183296 - RNA, 14 nt, Mycobacterium bovis subsp bovis AF2122/97
cgcgcggaccagag

SEQ ID NO: 3183297 - RNA, 18 nt, Mycobacterium bovis subsp bovis AF2122/97
cgcgcggacccagcaccc

SEQ ID NO: 3183298 - RNA, 16 nt, Mycobacterium bovis subsp bovis AF2122/97
cgcgcggaucggcggc

SEQ ID NO: 3183299 - RNA, 19 nt, Mycobacterium bovis subsp bovis AF2122/97
cgcgcggauggguacgaca

SEQ ID NO: 3183300 - RNA, 13 nt, Mycobacterium bovis subsp bovis AF2122/97
cgcgcggauuucg

SEQ ID NO: 3183301 - RNA, 12 nt, Mycobacterium bovis subsp bovis AF2122/97
cgcgcggcaccg

SEQ ID NO: 3183302 - RNA, 14 nt, Mycobacterium bovis subsp bovis AF2122/97
cgcgcggcaccgau

SEQ ID NO: 3183303 - RNA, 22 nt, Mycobacterium bovis subsp bovis AF2122/97
cgcgcggcaccgauggcgcacc

SEQ ID NO: 3183304 - RNA, 14 nt, Mycobacterium bovis subsp bovis AF2122/97
cgcgcggccgcgcu

SEQ ID NO: 3183305 - RNA, 11 nt, Mycobacterium bovis subsp bovis AF2122/97
cgcgcggcgac

SEQ ID NO: 3183306 - RNA, 14 nt, Mycobacterium bovis subsp bovis AF2122/97
cgcgcggcgcagca

SEQ ID NO: 3183307 - RNA, 21 nt, Mycobacterium bovis subsp bovis AF2122/97
cgcgcggcgcagcaccgucgg

SEQ ID NO: 3183308 - RNA, 15 nt, Mycobacterium bovis subsp bovis AF2122/97
cgcgcggcgccgcaa

SEQ ID NO: 3183309 - RNA, 15 nt, Mycobacterium bovis subsp bovis AF2122/97
cgcgcggcgcgaucg

SEQ ID NO: 3183310 - RNA, 16 nt, Mycobacterium bovis subsp bovis AF2122/97
cgcgcggcgcgaucgu

SEQ ID NO: 3183311 - RNA, 13 nt, Mycobacterium bovis subsp bovis AF2122/97
cgcgcggcggccg

SEQ ID NO: 3183312 - RNA, 15 nt, Mycobacterium bovis subsp bovis AF2122/97
cgcgcgggccgccgc

SEQ ID NO: 3183313 - RNA, 15 nt, Mycobacterium bovis subsp bovis AF2122/97
cgcgcgggcggaucg

SEQ ID NO: 3183314 - RNA, 21 nt, Mycobacterium bovis subsp bovis AF2122/97
cgcgcggggugcgcgcgacca

SEQ ID NO: 3183315 - RNA, 19 nt, Mycobacterium bovis subsp bovis AF2122/97
cgcgcgggguggcggcgcu

SEQ ID NO: 3183316 - RNA, 19 nt, Mycobacterium bovis subsp bovis AF2122/97
cgcgcgggucacgaccugc

SEQ ID NO: 3183317 - RNA, 17 nt, Mycobacterium bovis subsp bovis AF2122/97
cgcgcgggugcaaccgg

SEQ ID NO: 3183318 - RNA, 18 nt, Mycobacterium bovis subsp bovis AF2122/97
cgcgcgggugcucggugg

SEQ ID NO: 3183319 - RNA, 15 nt, Mycobacterium bovis subsp bovis AF2122/97
cgcgcgguacugcgc

SEQ ID NO: 3183320 - RNA, 16 nt, Mycobacterium bovis subsp bovis AF2122/97
cgcgcgguacugcgca

SEQ ID NO: 3183321 - RNA, 19 nt, Mycobacterium bovis subsp bovis AF2122/97
cgcgcgguacugcgcagcg

SEQ ID NO: 3183322 - RNA, 13 nt, Mycobacterium bovis subsp bovis AF2122/97
cgcgcggugcggc

SEQ ID NO: 3183323 - RNA, 23 nt, Mycobacterium bovis subsp bovis AF2122/97
cgcgcggugcggccacucgcccg

SEQ ID NO: 3183324 - RNA, 18 nt, Mycobacterium bovis subsp bovis AF2122/97
cgcgcgguggcggucgcc

SEQ ID NO: 3183325 - RNA, 20 nt, Mycobacterium bovis subsp bovis AF2122/97
cgcgcgguggcggucgccac

SEQ ID NO: 3183326 - RNA, 22 nt, Mycobacterium bovis subsp bovis AF2122/97
cgcgcgguuuucggcugccgcu

SEQ ID NO: 3183327 - RNA, 20 nt, Mycobacterium bovis subsp bovis AF2122/97
cgcgcgguuuuucgcagugg

SEQ ID NO: 3183328 - RNA, 16 nt, Mycobacterium bovis subsp bovis AF2122/97
cgcgcguaauccgagc

SEQ ID NO: 3183329 - RNA, 18 nt, Mycobacterium bovis subsp bovis AF2122/97
cgcgcguaauccgagcgc

SEQ ID NO: 3183330 - RNA, 22 nt, Mycobacterium bovis subsp bovis AF2122/97
cgcgcguccgggcagccgcgcc

SEQ ID NO: 3183331 - RNA, 17 nt, Mycobacterium bovis subsp bovis AF2122/97
cgcgcguccgucggcga

SEQ ID NO: 3183332 - RNA, 14 nt, Mycobacterium bovis subsp bovis AF2122/97
cgcgcgucgcccag

SEQ ID NO: 3183333 - RNA, 15 nt, Mycobacterium bovis subsp bovis AF2122/97
cgcgcgucgcccagu

SEQ ID NO: 3183334 - RNA, 13 nt, Mycobacterium bovis subsp bovis AF2122/97
cgcgcgugcagcc

SEQ ID NO: 3183335 - RNA, 17 nt, Mycobacterium bovis subsp bovis AF2122/97
cgcgcguucggcgagca

SEQ ID NO: 3183336 - RNA, 19 nt, Mycobacterium bovis subsp bovis AF2122/97
cgcgcguucggcgagcagc

SEQ ID NO: 3183337 - RNA, 21 nt, Mycobacterium bovis subsp bovis AF2122/97
cgcgcguucggcgagcagcgc

SEQ ID NO: 3183338 - RNA, 16 nt, Mycobacterium bovis subsp bovis AF2122/97
cgcgcguucggcgcug

SEQ ID NO: 3183339 - RNA, 20 nt, Mycobacterium bovis subsp bovis AF2122/97
cgcgcguucggcgcugaucg

SEQ ID NO: 3183340 - RNA, 16 nt, Mycobacterium bovis subsp bovis AF2122/97
cgcgcguugaagucgc

SEQ ID NO: 3183341 - RNA, 18 nt, Mycobacterium bovis subsp bovis AF2122/97
cgcgcguugaagucgccg

SEQ ID NO: 3183342 - RNA, 19 nt, Mycobacterium bovis subsp bovis AF2122/97
cgcgcguugaagucgccgg

SEQ ID NO: 3183343 - RNA, 22 nt, Mycobacterium bovis subsp bovis AF2122/97
cgcgcguugaagucgccgguga

SEQ ID NO: 3183344 - RNA, 15 nt, Mycobacterium bovis subsp bovis AF2122/97
cgcgcguugcgguca

SEQ ID NO: 3183345 - RNA, 16 nt, Mycobacterium bovis subsp bovis AF2122/97
cgcgcguugcggucaa

SEQ ID NO: 3183346 - RNA, 16 nt, Mycobacterium bovis subsp bovis AF2122/97
cgcgcguugcuggucg

SEQ ID NO: 3183347 - RNA, 21 nt, Mycobacterium bovis subsp bovis AF2122/97
cgcgcguugcuggucgccguc

SEQ ID NO: 3183348 - RNA, 15 nt, Mycobacterium bovis subsp bovis AF2122/97
cgcgcguuguggcga

SEQ ID NO: 3183349 - RNA, 19 nt, Mycobacterium bovis subsp bovis AF2122/97
cgcgcguuuagucuccggc

SEQ ID NO: 3183350 - RNA, 20 nt, Mycobacterium bovis subsp bovis AF2122/97
cgcgcguuuagucuccggcg

SEQ ID NO: 3183351 - RNA, 17 nt, Mycobacterium bovis subsp bovis AF2122/97
cgcgcuaaccuuggcga

SEQ ID NO: 3183352 - RNA, 19 nt, Mycobacterium bovis subsp bovis AF2122/97
cgcgcuaaugucgauuucg

SEQ ID NO: 3183353 - RNA, 19 nt, Mycobacterium bovis subsp bovis AF2122/97
cgcgcuaccagcucacggc

SEQ ID NO: 3183354 - RNA, 13 nt, Mycobacterium bovis subsp bovis AF2122/97
cgcgcuacgcggc

SEQ ID NO: 3183355 - RNA, 14 nt, Mycobacterium bovis subsp bovis AF2122/97
cgcgcuacgcggcc

SEQ ID NO: 3183356 - RNA, 19 nt, Mycobacterium bovis subsp bovis AF2122/97
cgcgcuacgucaagccgug

SEQ ID NO: 3183357 - RNA, 15 nt, Mycobacterium bovis subsp bovis AF2122/97
cgcgcuagcucggcc

SEQ ID NO: 3183358 - RNA, 23 nt, Mycobacterium bovis subsp bovis AF2122/97
cgcgcuaggugcaacaggcgcgu

SEQ ID NO: 3183359 - RNA, 16 nt, Mycobacterium bovis subsp bovis AF2122/97
cgcgcuaucaugacca

SEQ ID NO: 3183360 - RNA, 13 nt, Mycobacterium bovis subsp bovis AF2122/97
cgcgcucaacggc

SEQ ID NO: 3183361 - RNA, 13 nt, Mycobacterium bovis subsp bovis AF2122/97
cgcgcucaccgac

SEQ ID NO: 3183362 - RNA, 14 nt, Mycobacterium bovis subsp bovis AF2122/97
cgcgcucaccgacg

SEQ ID NO: 3183363 - RNA, 19 nt, Mycobacterium bovis subsp bovis AF2122/97
cgcgcucaccgacgcugac

SEQ ID NO: 3183364 - RNA, 19 nt, Mycobacterium bovis subsp bovis AF2122/97
cgcgcucaccggggccguc

SEQ ID NO: 3183365 - RNA, 13 nt, Mycobacterium bovis subsp bovis AF2122/97
cgcgcucagccgg

SEQ ID NO: 3183366 - RNA, 18 nt, Mycobacterium bovis subsp bovis AF2122/97
cgcgcucaucgaccgcgg

SEQ ID NO: 3183367 - RNA, 23 nt, Mycobacterium bovis subsp bovis AF2122/97
cgcgcucaucgaccgcggccggg

SEQ ID NO: 3183368 - RNA, 19 nt, Mycobacterium bovis subsp bovis AF2122/97
cgcgcucaucgaccggggc

SEQ ID NO: 3183369 - RNA, 21 nt, Mycobacterium bovis subsp bovis AF2122/97
cgcgcuccaacaaugccagcu

SEQ ID NO: 3183370 - RNA, 22 nt, Mycobacterium bovis subsp bovis AF2122/97
cgcgcuccaacaaugccagcug

SEQ ID NO: 3183371 - RNA, 16 nt, Mycobacterium bovis subsp bovis AF2122/97
cgcgcucccggcgucu

SEQ ID NO: 3183372 - RNA, 14 nt, Mycobacterium bovis subsp bovis AF2122/97
cgcgcucgauggcg

SEQ ID NO: 3183373 - RNA, 16 nt, Mycobacterium bovis subsp bovis AF2122/97
cgcgcucgauggcggc

SEQ ID NO: 3183374 - RNA, 17 nt, Mycobacterium bovis subsp bovis AF2122/97
cgcgcucgauggcggcc

SEQ ID NO: 3183375 - RNA, 18 nt, Mycobacterium bovis subsp bovis AF2122/97
cgcgcucgcacccgcucg

SEQ ID NO: 3183376 - RNA, 14 nt, Mycobacterium bovis subsp bovis AF2122/97
cgcgcucgcccagg

SEQ ID NO: 3183377 - RNA, 15 nt, Mycobacterium bovis subsp bovis AF2122/97
cgcgcucgcgcaagc

SEQ ID NO: 3183378 - RNA, 14 nt, Mycobacterium bovis subsp bovis AF2122/97
cgcgcucgcgcggu

SEQ ID NO: 3183379 - RNA, 19 nt, Mycobacterium bovis subsp bovis AF2122/97
cgcgcucgcucaccggcug

SEQ ID NO: 3183380 - RNA, 20 nt, Mycobacterium bovis subsp bovis AF2122/97
cgcgcucgcucaccggcugg

SEQ ID NO: 3183381 - RNA, 14 nt, Mycobacterium bovis subsp bovis AF2122/97
cgcgcucggccagc

SEQ ID NO: 3183382 - RNA, 17 nt, Mycobacterium bovis subsp bovis AF2122/97
cgcgcucgggcgagauc

SEQ ID NO: 3183383 - RNA, 16 nt, Mycobacterium bovis subsp bovis AF2122/97
cgcgcucggugccgcc

SEQ ID NO: 3183384 - RNA, 18 nt, Mycobacterium bovis subsp bovis AF2122/97
cgcgcucguuagcggcgg

SEQ ID NO: 3183385 - RNA, 16 nt, Mycobacterium bovis subsp bovis AF2122/97
cgcgcugaaggccggu

SEQ ID NO: 3183386 - RNA, 15 nt, Mycobacterium bovis subsp bovis AF2122/97
cgcgcugaaucaccc

SEQ ID NO: 3183387 - RNA, 19 nt, Mycobacterium bovis subsp bovis AF2122/97
cgcgcugaaucaccccggc

SEQ ID NO: 3183388 - RNA, 15 nt, Mycobacterium bovis subsp bovis AF2122/97
cgcgcugagcacgcg

SEQ ID NO: 3183389 - RNA, 19 nt, Mycobacterium bovis subsp bovis AF2122/97
cgcgcugagcacgcggauc

SEQ ID NO: 3183390 - RNA, 14 nt, Mycobacterium bovis subsp bovis AF2122/97
cgcgcugagcgacu

SEQ ID NO: 3183391 - RNA, 16 nt, Mycobacterium bovis subsp bovis AF2122/97
cgcgcugagcgacugc

SEQ ID NO: 3183392 - RNA, 22 nt, Mycobacterium bovis subsp bovis AF2122/97
cgcgcugagcgacugcagcggc

SEQ ID NO: 3183393 - RNA, 14 nt, Mycobacterium bovis subsp bovis AF2122/97
cgcgcugagguggc

SEQ ID NO: 3183394 - RNA, 15 nt, Mycobacterium bovis subsp bovis AF2122/97
cgcgcugaucagccc

SEQ ID NO: 3183395 - RNA, 10 nt, Mycobacterium bovis subsp bovis AF2122/97
cgcgcugcca

SEQ ID NO: 3183396 - RNA, 14 nt, Mycobacterium bovis subsp bovis AF2122/97
cgcgcugccggccg

SEQ ID NO: 3183397 - RNA, 15 nt, Mycobacterium bovis subsp bovis AF2122/97
cgcgcugccggccgc

SEQ ID NO: 3183398 - RNA, 16 nt, Mycobacterium bovis subsp bovis AF2122/97
cgcgcugccggccgcg

SEQ ID NO: 3183399 - RNA, 20 nt, Mycobacterium bovis subsp bovis AF2122/97
cgcgcugcgcgacugauccu

SEQ ID NO: 3183400 - RNA, 13 nt, Mycobacterium bovis subsp bovis AF2122/97
cgcgcugcggccc

SEQ ID NO: 3183401 - RNA, 18 nt, Mycobacterium bovis subsp bovis AF2122/97
cgcgcugcggcccacacc

SEQ ID NO: 3183402 - RNA, 22 nt, Mycobacterium bovis subsp bovis AF2122/97
cgcgcugcggcccacaccagcg

SEQ ID NO: 3183403 - RNA, 12 nt, Mycobacterium bovis subsp bovis AF2122/97
cgcgcugcuguc

SEQ ID NO: 3183404 - RNA, 14 nt, Mycobacterium bovis subsp bovis AF2122/97
cgcgcugcugucga

SEQ ID NO: 3183405 - RNA, 19 nt, Mycobacterium bovis subsp bovis AF2122/97
cgcgcugcugucgauuucg

SEQ ID NO: 3183406 - RNA, 16 nt, Mycobacterium bovis subsp bovis AF2122/97
cgcgcugcuucuucgg

SEQ ID NO: 3183407 - RNA, 22 nt, Mycobacterium bovis subsp bovis AF2122/97
cgcgcugcuucuucggacagca

SEQ ID NO: 3183408 - RNA, 19 nt, Mycobacterium bovis subsp bovis AF2122/97
cgcgcuggacaacggcggu

SEQ ID NO: 3183409 - RNA, 20 nt, Mycobacterium bovis subsp bovis AF2122/97
cgcgcuggaccugaugagcu

SEQ ID NO: 3183410 - RNA, 19 nt, Mycobacterium bovis subsp bovis AF2122/97
cgcgcuggaucgugcuggu

SEQ ID NO: 3183411 - RNA, 20 nt, Mycobacterium bovis subsp bovis AF2122/97
cgcgcuggaucgugcuggug

SEQ ID NO: 3183412 - RNA, 15 nt, Mycobacterium bovis subsp bovis AF2122/97
cgcgcuggcgcccuu

SEQ ID NO: 3183413 - RNA, 16 nt, Mycobacterium bovis subsp bovis AF2122/97
cgcgcuggcgccggcc

SEQ ID NO: 3183414 - RNA, 17 nt, Mycobacterium bovis subsp bovis AF2122/97
cgcgcuggcgccggcca

SEQ ID NO: 3183415 - RNA, 18 nt, Mycobacterium bovis subsp bovis AF2122/97
cgcgcuggcgccggccag

SEQ ID NO: 3183416 - RNA, 20 nt, Mycobacterium bovis subsp bovis AF2122/97
cgcgcuggcgccggccagcc

SEQ ID NO: 3183417 - RNA, 14 nt, Mycobacterium bovis subsp bovis AF2122/97
cgcgcuggcgggcg

SEQ ID NO: 3183418 - RNA, 15 nt, Mycobacterium bovis subsp bovis AF2122/97
cgcgcuggcgggcgg

SEQ ID NO: 3183419 - RNA, 12 nt, Mycobacterium bovis subsp bovis AF2122/97
cgcgcugggcgc

SEQ ID NO: 3183420 - RNA, 16 nt, Mycobacterium bovis subsp bovis AF2122/97
cgcgcugggcgccgua

SEQ ID NO: 3183421 - RNA, 13 nt, Mycobacterium bovis subsp bovis AF2122/97
cgcgcugggcgcg

SEQ ID NO: 3183422 - RNA, 15 nt, Mycobacterium bovis subsp bovis AF2122/97
cgcgcugggcgcgcu

SEQ ID NO: 3183423 - RNA, 18 nt, Mycobacterium bovis subsp bovis AF2122/97
cgcgcugggcgcgcucau

SEQ ID NO: 3183424 - RNA, 14 nt, Mycobacterium bovis subsp bovis AF2122/97
cgcgcugggcugcc

SEQ ID NO: 3183425 - RNA, 20 nt, Mycobacterium bovis subsp bovis AF2122/97
cgcgcuggucaacuccacgc

SEQ ID NO: 3183426 - RNA, 20 nt, Mycobacterium bovis subsp bovis AF2122/97
cgcgcuguacugccccagca

SEQ ID NO: 3183427 - RNA, 17 nt, Mycobacterium bovis subsp bovis AF2122/97
cgcgcuguagggcacug

SEQ ID NO: 3183428 - RNA, 20 nt, Mycobacterium bovis subsp bovis AF2122/97
cgcgcuguccacgaugacgu

SEQ ID NO: 3183429 - RNA, 23 nt, Mycobacterium bovis subsp bovis AF2122/97
cgcgcuguccacgaugacgucga

SEQ ID NO: 3183430 - RNA, 22 nt, Mycobacterium bovis subsp bovis AF2122/97
cgcgcugugccgugcgaucacc

SEQ ID NO: 3183431 - RNA, 23 nt, Mycobacterium bovis subsp bovis AF2122/97
cgcgcuguugccaucgacgccgc

SEQ ID NO: 3183432 - RNA, 22 nt, Mycobacterium bovis subsp bovis AF2122/97
cgcgcuucacagccaccagccg

SEQ ID NO: 3183433 - RNA, 20 nt, Mycobacterium bovis subsp bovis AF2122/97
cgcgcuucaggcaucaccgg

SEQ ID NO: 3183434 - RNA, 21 nt, Mycobacterium bovis subsp bovis AF2122/97
cgcgcuugaagguucgaucgc

SEQ ID NO: 3183435 - RNA, 17 nt, Mycobacterium bovis subsp bovis AF2122/97
cgcgcuugcgaucgccg

SEQ ID NO: 3183436 - RNA, 18 nt, Mycobacterium bovis subsp bovis AF2122/97
cgcgcuugcgaucgccgc

SEQ ID NO: 3183437 - RNA, 20 nt, Mycobacterium bovis subsp bovis AF2122/97
cgcgcuugcgaucgccgcua

SEQ ID NO: 3183438 - RNA, 16 nt, Mycobacterium bovis subsp bovis AF2122/97
cgcgcuugcgaucggc

SEQ ID NO: 3183439 - RNA, 17 nt, Mycobacterium bovis subsp bovis AF2122/97
cgcgcuugcgaucggca

SEQ ID NO: 3183440 - RNA, 20 nt, Mycobacterium bovis subsp bovis AF2122/97
cgcgcuugcgaucggcacuu

SEQ ID NO: 3183441 - RNA, 14 nt, Mycobacterium bovis subsp bovis AF2122/97
cgcgcuugcgccgc

SEQ ID NO: 3183442 - RNA, 15 nt, Mycobacterium bovis subsp bovis AF2122/97
cgcgcuugcgccgcc

SEQ ID NO: 3183443 - RNA, 18 nt, Mycobacterium bovis subsp bovis AF2122/97
cgcgcuugcgccgcccau

SEQ ID NO: 3183444 - RNA, 22 nt, Mycobacterium bovis subsp bovis AF2122/97
cgcgcuuggcuccacaauccug

SEQ ID NO: 3183445 - RNA, 22 nt, Mycobacterium bovis subsp bovis AF2122/97
cgcgcuugggguccggauggcc

SEQ ID NO: 3183446 - RNA, 21 nt, Mycobacterium bovis subsp bovis AF2122/97
cgcgcuugguccugcggucgc

SEQ ID NO: 3183447 - RNA, 16 nt, Mycobacterium bovis subsp bovis AF2122/97
cgcgcuugguguggcc

SEQ ID NO: 3183448 - RNA, 16 nt, Mycobacterium bovis subsp bovis AF2122/97
cgcggaaaccaucgcc

SEQ ID NO: 3183449 - RNA, 21 nt, Mycobacterium bovis subsp bovis AF2122/97
cgcggaaaccaucgccagccg

SEQ ID NO: 3183450 - RNA, 20 nt, Mycobacterium bovis subsp bovis AF2122/97
cgcggaaaggcuuccgcgug

SEQ ID NO: 3183451 - RNA, 13 nt, Mycobacterium bovis subsp bovis AF2122/97
cgcggaacccagc

SEQ ID NO: 3183452 - RNA, 15 nt, Mycobacterium bovis subsp bovis AF2122/97
cgcggaacgcgucgc

SEQ ID NO: 3183453 - RNA, 19 nt, Mycobacterium bovis subsp bovis AF2122/97
cgcggaacgcgucgccgac

SEQ ID NO: 3183454 - RNA, 20 nt, Mycobacterium bovis subsp bovis AF2122/97
cgcggaacgcgucgccgacg

SEQ ID NO: 3183455 - RNA, 20 nt, Mycobacterium bovis subsp bovis AF2122/97
cgcggaagccgccuaggacu

SEQ ID NO: 3183456 - RNA, 18 nt, Mycobacterium bovis subsp bovis AF2122/97
cgcggaaucgcaucggcg

SEQ ID NO: 3183457 - RNA, 19 nt, Mycobacterium bovis subsp bovis AF2122/97
cgcggaaucgcaucggcgg

SEQ ID NO: 3183458 - RNA, 22 nt, Mycobacterium bovis subsp bovis AF2122/97
cgcggaaucgcaucggcggggc

SEQ ID NO: 3183459 - RNA, 14 nt, Mycobacterium bovis subsp bovis AF2122/97
cgcggaaucgcgac

SEQ ID NO: 3183460 - RNA, 16 nt, Mycobacterium bovis subsp bovis AF2122/97
cgcggacaccaggaug

SEQ ID NO: 3183461 - RNA, 13 nt, Mycobacterium bovis subsp bovis AF2122/97
cgcggacaccgcg

SEQ ID NO: 3183462 - RNA, 15 nt, Mycobacterium bovis subsp bovis AF2122/97
cgcggacaccgcggc

SEQ ID NO: 3183463 - RNA, 16 nt, Mycobacterium bovis subsp bovis AF2122/97
cgcggacaccgcggcg

SEQ ID NO: 3183464 - RNA, 21 nt, Mycobacterium bovis subsp bovis AF2122/97
cgcggacaccuuucuccacac

SEQ ID NO: 3183465 - RNA, 16 nt, Mycobacterium bovis subsp bovis AF2122/97
cgcggacacgaucgcg

SEQ ID NO: 3183466 - RNA, 14 nt, Mycobacterium bovis subsp bovis AF2122/97
cgcggacagcccgg

SEQ ID NO: 3183467 - RNA, 21 nt, Mycobacterium bovis subsp bovis AF2122/97
cgcggacagcccggacgcgcg

SEQ ID NO: 3183468 - RNA, 21 nt, Mycobacterium bovis subsp bovis AF2122/97
cgcggacccgcagcugcggau

SEQ ID NO: 3183469 - RNA, 22 nt, Mycobacterium bovis subsp bovis AF2122/97
cgcggacccgcagcugcggauc

SEQ ID NO: 3183470 - RNA, 22 nt, Mycobacterium bovis subsp bovis AF2122/97
cgcggacccgccgugaguaggu

SEQ ID NO: 3183471 - RNA, 15 nt, Mycobacterium bovis subsp bovis AF2122/97
cgcggacccgcgcgu

SEQ ID NO: 3183472 - RNA, 16 nt, Mycobacterium bovis subsp bovis AF2122/97
cgcggacccgcgcguc

SEQ ID NO: 3183473 - RNA, 22 nt, Mycobacterium bovis subsp bovis AF2122/97
cgcggacccgcgcgucgcccag

SEQ ID NO: 3183474 - RNA, 14 nt, Mycobacterium bovis subsp bovis AF2122/97
cgcggacccgucgg

SEQ ID NO: 3183475 - RNA, 18 nt, Mycobacterium bovis subsp bovis AF2122/97
cgcggacccgucggcgug

SEQ ID NO: 3183476 - RNA, 14 nt, Mycobacterium bovis subsp bovis AF2122/97
cgcggaccgcaacg

SEQ ID NO: 3183477 - RNA, 17 nt, Mycobacterium bovis subsp bovis AF2122/97
cgcggaccucgaagccc

SEQ ID NO: 3183478 - RNA, 19 nt, Mycobacterium bovis subsp bovis AF2122/97
cgcggaccucgaagcccag

SEQ ID NO: 3183479 - RNA, 15 nt, Mycobacterium bovis subsp bovis AF2122/97
cgcggaccucggcga

SEQ ID NO: 3183480 - RNA, 15 nt, Mycobacterium bovis subsp bovis AF2122/97
cgcggacgugccggu

SEQ ID NO: 3183481 - RNA, 15 nt, Mycobacterium bovis subsp bovis AF2122/97
cgcggacguggucgg

SEQ ID NO: 3183482 - RNA, 23 nt, Mycobacterium bovis subsp bovis AF2122/97
cgcggacucgggcaggccccacu

SEQ ID NO: 3183483 - RNA, 20 nt, Mycobacterium bovis subsp bovis AF2122/97
cgcggacucguagcaccggu

SEQ ID NO: 3183484 - RNA, 21 nt, Mycobacterium bovis subsp bovis AF2122/97
cgcggacuucguuccgugccg

SEQ ID NO: 3183485 - RNA, 15 nt, Mycobacterium bovis subsp bovis AF2122/97
cgcggacuuggcggu

SEQ ID NO: 3183486 - RNA, 17 nt, Mycobacterium bovis subsp bovis AF2122/97
cgcggacuuggcggucg

SEQ ID NO: 3183487 - RNA, 19 nt, Mycobacterium bovis subsp bovis AF2122/97
cgcggacuuggcggucggu

SEQ ID NO: 3183488 - RNA, 20 nt, Mycobacterium bovis subsp bovis AF2122/97
cgcggagaacaucccccggc

SEQ ID NO: 3183489 - RNA, 15 nt, Mycobacterium bovis subsp bovis AF2122/97
cgcggagauaccgga

SEQ ID NO: 3183490 - RNA, 13 nt, Mycobacterium bovis subsp bovis AF2122/97
cgcggagccagga

SEQ ID NO: 3183491 - RNA, 15 nt, Mycobacterium bovis subsp bovis AF2122/97
cgcggagccaggacg

SEQ ID NO: 3183492 - RNA, 12 nt, Mycobacterium bovis subsp bovis AF2122/97
cgcggagccguc

SEQ ID NO: 3183493 - RNA, 16 nt, Mycobacterium bovis subsp bovis AF2122/97
cgcggagcucaaccac

SEQ ID NO: 3183494 - RNA, 18 nt, Mycobacterium bovis subsp bovis AF2122/97
cgcggaggcggccagccu

SEQ ID NO: 3183495 - RNA, 19 nt, Mycobacterium bovis subsp bovis AF2122/97
cgcggaguacuccagccgc

SEQ ID NO: 3183496 - RNA, 20 nt, Mycobacterium bovis subsp bovis AF2122/97
cgcggaguccgucgacaccg

SEQ ID NO: 3183497 - RNA, 22 nt, Mycobacterium bovis subsp bovis AF2122/97
cgcggagucugcugaucgagcg

SEQ ID NO: 3183498 - RNA, 22 nt, Mycobacterium bovis subsp bovis AF2122/97
cgcggaguucgcugacggccau

SEQ ID NO: 3183499 - RNA, 23 nt, Mycobacterium bovis subsp bovis AF2122/97
cgcggauacgccccugguccacc

SEQ ID NO: 3183500 - RNA, 21 nt, Mycobacterium bovis subsp bovis AF2122/97
cgcggauacgggcagugaaca

SEQ ID NO: 3183501 - RNA, 18 nt, Mycobacterium bovis subsp bovis AF2122/97
cgcggauagaugacgggc

SEQ ID NO: 3183502 - RNA, 15 nt, Mycobacterium bovis subsp bovis AF2122/97
cgcggauaggccgcg

SEQ ID NO: 3183503 - RNA, 20 nt, Mycobacterium bovis subsp bovis AF2122/97
cgcggauaggccgcgcggcg

SEQ ID NO: 3183504 - RNA, 22 nt, Mycobacterium bovis subsp bovis AF2122/97
cgcggauaggccgcgcggcggc

SEQ ID NO: 3183505 - RNA, 23 nt, Mycobacterium bovis subsp bovis AF2122/97
cgcggauaggccgcgcggcggcg

SEQ ID NO: 3183506 - RNA, 24 nt, Mycobacterium bovis subsp bovis AF2122/97
cgcggaucaaaaaccacgcgucgc

SEQ ID NO: 3183507 - RNA, 20 nt, Mycobacterium bovis subsp bovis AF2122/97
cgcggaucaacaggccggcu

SEQ ID NO: 3183508 - RNA, 21 nt, Mycobacterium bovis subsp bovis AF2122/97
cgcggaucaacaggccggcuc

SEQ ID NO: 3183509 - RNA, 15 nt, Mycobacterium bovis subsp bovis AF2122/97
cgcggaucaccaucg

SEQ ID NO: 3183510 - RNA, 16 nt, Mycobacterium bovis subsp bovis AF2122/97
cgcggaucaccaucgc

SEQ ID NO: 3183511 - RNA, 17 nt, Mycobacterium bovis subsp bovis AF2122/97
cgcggaucaccaucgcc

SEQ ID NO: 3183512 - RNA, 19 nt, Mycobacterium bovis subsp bovis AF2122/97
cgcggaucaccaucgccgc

SEQ ID NO: 3183513 - RNA, 16 nt, Mycobacterium bovis subsp bovis AF2122/97
cgcggaucagcccgcg

SEQ ID NO: 3183514 - RNA, 22 nt, Mycobacterium bovis subsp bovis AF2122/97
cgcggaucauccuucgccggcg

SEQ ID NO: 3183515 - RNA, 15 nt, Mycobacterium bovis subsp bovis AF2122/97
cgcggauccgggcgu

SEQ ID NO: 3183516 - RNA, 18 nt, Mycobacterium bovis subsp bovis AF2122/97
cgcggauccgggcguggu

SEQ ID NO: 3183517 - RNA, 17 nt, Mycobacterium bovis subsp bovis AF2122/97
cgcggaucgaccgccag

SEQ ID NO: 3183518 - RNA, 22 nt, Mycobacterium bovis subsp bovis AF2122/97
cgcggaucgaccgccagcgccg

SEQ ID NO: 3183519 - RNA, 21 nt, Mycobacterium bovis subsp bovis AF2122/97
cgcggaucgacuucgacgaca

SEQ ID NO: 3183520 - RNA, 15 nt, Mycobacterium bovis subsp bovis AF2122/97
cgcggaucgggcacc

SEQ ID NO: 3183521 - RNA, 21 nt, Mycobacterium bovis subsp bovis AF2122/97
cgcggaucucaccacccgucg

SEQ ID NO: 3183522 - RNA, 15 nt, Mycobacterium bovis subsp bovis AF2122/97
cgcggaucucaucgg

SEQ ID NO: 3183523 - RNA, 21 nt, Mycobacterium bovis subsp bovis AF2122/97
cgcggaucucaucgggccaca

SEQ ID NO: 3183524 - RNA, 14 nt, Mycobacterium bovis subsp bovis AF2122/97
cgcggaucugggcg

SEQ ID NO: 3183525 - RNA, 16 nt, Mycobacterium bovis subsp bovis AF2122/97
cgcggaucugggcggc

SEQ ID NO: 3183526 - RNA, 15 nt, Mycobacterium bovis subsp bovis AF2122/97
cgcggaugagcucgg

SEQ ID NO: 3183527 - RNA, 17 nt, Mycobacterium bovis subsp bovis AF2122/97
cgcggaugagcucggcc

SEQ ID NO: 3183528 - RNA, 21 nt, Mycobacterium bovis subsp bovis AF2122/97
cgcggaugagcucggccauca

SEQ ID NO: 3183529 - RNA, 17 nt, Mycobacterium bovis subsp bovis AF2122/97
cgcggaugcucagguca

SEQ ID NO: 3183530 - RNA, 19 nt, Mycobacterium bovis subsp bovis AF2122/97
cgcggaugcucaggucacc

SEQ ID NO: 3183531 - RNA, 23 nt, Mycobacterium bovis subsp bovis AF2122/97
cgcggaugcucaggucaccggcc

SEQ ID NO: 3183532 - RNA, 23 nt, Mycobacterium bovis subsp bovis AF2122/97
cgcggauggguacgacaccgcag

SEQ ID NO: 3183533 - RNA, 23 nt, Mycobacterium bovis subsp bovis AF2122/97
cgcggauucgguuagcgcggcca

SEQ ID NO: 3183534 - RNA, 16 nt, Mycobacterium bovis subsp bovis AF2122/97
cgcggauugccgcgcg

SEQ ID NO: 3183535 - RNA, 19 nt, Mycobacterium bovis subsp bovis AF2122/97
cgcggauuggcacugucga

SEQ ID NO: 3183536 - RNA, 16 nt, Mycobacterium bovis subsp bovis AF2122/97
cgcggauuucucgccc

SEQ ID NO: 3183537 - RNA, 19 nt, Mycobacterium bovis subsp bovis AF2122/97
cgcggauuucucgcccuga

SEQ ID NO: 3183538 - RNA, 21 nt, Mycobacterium bovis subsp bovis AF2122/97
cgcggcaaaguuggccgcccg

SEQ ID NO: 3183539 - RNA, 22 nt, Mycobacterium bovis subsp bovis AF2122/97
cgcggcaaaguuggccgcccga

SEQ ID NO: 3183540 - RNA, 17 nt, Mycobacterium bovis subsp bovis AF2122/97
cgcggcaacaaagucgc

SEQ ID NO: 3183541 - RNA, 23 nt, Mycobacterium bovis subsp bovis AF2122/97
cgcggcaaccgucgaaaaaucga

SEQ ID NO: 3183542 - RNA, 18 nt, Mycobacterium bovis subsp bovis AF2122/97
cgcggcaacgcggucugc

SEQ ID NO: 3183543 - RNA, 21 nt, Mycobacterium bovis subsp bovis AF2122/97
cgcggcaacgcggucugcucc

SEQ ID NO: 3183544 - RNA, 16 nt, Mycobacterium bovis subsp bovis AF2122/97
cgcggcaagcucgucc

SEQ ID NO: 3183545 - RNA, 19 nt, Mycobacterium bovis subsp bovis AF2122/97
cgcggcaaucucaugcccg

SEQ ID NO: 3183546 - RNA, 17 nt, Mycobacterium bovis subsp bovis AF2122/97
cgcggcaaugaggccgu

SEQ ID NO: 3183547 - RNA, 14 nt, Mycobacterium bovis subsp bovis AF2122/97
cgcggcaccacguc

SEQ ID NO: 3183548 - RNA, 15 nt, Mycobacterium bovis subsp bovis AF2122/97
cgcggcaccacgucg

SEQ ID NO: 3183549 - RNA, 19 nt, Mycobacterium bovis subsp bovis AF2122/97
cgcggcaccacgucgacca

SEQ ID NO: 3183550 - RNA, 15 nt, Mycobacterium bovis subsp bovis AF2122/97
cgcggcaccagcacc

SEQ ID NO: 3183551 - RNA, 19 nt, Mycobacterium bovis subsp bovis AF2122/97
cgcggcaccagcaccgucg

SEQ ID NO: 3183552 - RNA, 20 nt, Mycobacterium bovis subsp bovis AF2122/97
cgcggcaccagcaccgucgg

SEQ ID NO: 3183553 - RNA, 16 nt, Mycobacterium bovis subsp bovis AF2122/97
cgcggcacccaaccag

SEQ ID NO: 3183554 - RNA, 19 nt, Mycobacterium bovis subsp bovis AF2122/97
cgcggcacccggucggcca

SEQ ID NO: 3183555 - RNA, 20 nt, Mycobacterium bovis subsp bovis AF2122/97
cgcggcacccggucggccau

SEQ ID NO: 3183556 - RNA, 12 nt, Mycobacterium bovis subsp bovis AF2122/97
cgcggcaccgcc

SEQ ID NO: 3183557 - RNA, 13 nt, Mycobacterium bovis subsp bovis AF2122/97
cgcggcaccgccg

SEQ ID NO: 3183558 - RNA, 16 nt, Mycobacterium bovis subsp bovis AF2122/97
cgcggcaccgccgagc

SEQ ID NO: 3183559 - RNA, 14 nt, Mycobacterium bovis subsp bovis AF2122/97
cgcggcacgcccac

SEQ ID NO: 3183560 - RNA, 21 nt, Mycobacterium bovis subsp bovis AF2122/97
cgcggcacgcccacagcugac

SEQ ID NO: 3183561 - RNA, 16 nt, Mycobacterium bovis subsp bovis AF2122/97
cgcggcacgcuccagc

SEQ ID NO: 3183562 - RNA, 19 nt, Mycobacterium bovis subsp bovis AF2122/97
cgcggcacgcuccagcucg

SEQ ID NO: 3183563 - RNA, 22 nt, Mycobacterium bovis subsp bovis AF2122/97
cgcggcacgcuccagcucggcc

SEQ ID NO: 3183564 - RNA, 19 nt, Mycobacterium bovis subsp bovis AF2122/97
cgcggcacggugugcggca

SEQ ID NO: 3183565 - RNA, 21 nt, Mycobacterium bovis subsp bovis AF2122/97
cgcggcacggugugcggcauu

SEQ ID NO: 3183566 - RNA, 21 nt, Mycobacterium bovis subsp bovis AF2122/97
cgcggcacuuuguagcccgcg

SEQ ID NO: 3183567 - RNA, 23 nt, Mycobacterium bovis subsp bovis AF2122/97
cgcggcacuuuguagcccgcgau

SEQ ID NO: 3183568 - RNA, 13 nt, Mycobacterium bovis subsp bovis AF2122/97
cgcggcagcacga

SEQ ID NO: 3183569 - RNA, 17 nt, Mycobacterium bovis subsp bovis AF2122/97
cgcggcagcauccucga

SEQ ID NO: 3183570 - RNA, 12 nt, Mycobacterium bovis subsp bovis AF2122/97
cgcggcagcgga

SEQ ID NO: 3183571 - RNA, 13 nt, Mycobacterium bovis subsp bovis AF2122/97
cgcggcagcguug

SEQ ID NO: 3183572 - RNA, 13 nt, Mycobacterium bovis subsp bovis AF2122/97
cgcggcaggccug

SEQ ID NO: 3183573 - RNA, 16 nt, Mycobacterium bovis subsp bovis AF2122/97
cgcggcaggccuggcg

SEQ ID NO: 3183574 - RNA, 22 nt, Mycobacterium bovis subsp bovis AF2122/97
cgcggcaggccuggcgagccag

SEQ ID NO: 3183575 - RNA, 16 nt, Mycobacterium bovis subsp bovis AF2122/97
cgcggcaguggccaga

SEQ ID NO: 3183576 - RNA, 14 nt, Mycobacterium bovis subsp bovis AF2122/97
cgcggcaucccgcc

SEQ ID NO: 3183577 - RNA, 18 nt, Mycobacterium bovis subsp bovis AF2122/97
cgcggcaucgacgcggcc

SEQ ID NO: 3183578 - RNA, 24 nt, Mycobacterium bovis subsp bovis AF2122/97
cgcggcaugauuuuucgcagugac

SEQ ID NO: 3183579 - RNA, 22 nt, Mycobacterium bovis subsp bovis AF2122/97
cgcggcauucucgagcacccgc

SEQ ID NO: 3183580 - RNA, 22 nt, Mycobacterium bovis subsp bovis AF2122/97
cgcggccaacgaacgugccccg

SEQ ID NO: 3183581 - RNA, 16 nt, Mycobacterium bovis subsp bovis AF2122/97
cgcggccaaucagccc

SEQ ID NO: 3183582 - RNA, 19 nt, Mycobacterium bovis subsp bovis AF2122/97
cgcggccaaucagcccgcc

SEQ ID NO: 3183583 - RNA, 20 nt, Mycobacterium bovis subsp bovis AF2122/97
cgcggccaaucagcccgccg

SEQ ID NO: 3183584 - RNA, 22 nt, Mycobacterium bovis subsp bovis AF2122/97
cgcggccaaucagcccgccgga

SEQ ID NO: 3183585 - RNA, 17 nt, Mycobacterium bovis subsp bovis AF2122/97
cgcggccaauugcgccg

SEQ ID NO: 3183586 - RNA, 18 nt, Mycobacterium bovis subsp bovis AF2122/97
cgcggccaauugcgccgc

SEQ ID NO: 3183587 - RNA, 19 nt, Mycobacterium bovis subsp bovis AF2122/97
cgcggccaauugcgccgcc

SEQ ID NO: 3183588 - RNA, 19 nt, Mycobacterium bovis subsp bovis AF2122/97
cgcggccacaaccucgucg

SEQ ID NO: 3183589 - RNA, 23 nt, Mycobacterium bovis subsp bovis AF2122/97
cgcggccacaaugcggccguucg

SEQ ID NO: 3183590 - RNA, 20 nt, Mycobacterium bovis subsp bovis AF2122/97
cgcggccacaccuuggccgc

SEQ ID NO: 3183591 - RNA, 23 nt, Mycobacterium bovis subsp bovis AF2122/97
cgcggccacaccuuggccgccgg

SEQ ID NO: 3183592 - RNA, 18 nt, Mycobacterium bovis subsp bovis AF2122/97
cgcggccacauaccacca

SEQ ID NO: 3183593 - RNA, 17 nt, Mycobacterium bovis subsp bovis AF2122/97
cgcggccacaucgccag

SEQ ID NO: 3183594 - RNA, 23 nt, Mycobacterium bovis subsp bovis AF2122/97
cgcggccacaucgccagcagcaa

SEQ ID NO: 3183595 - RNA, 11 nt, Mycobacterium bovis subsp bovis AF2122/97
cgcggccacca

SEQ ID NO: 3183596 - RNA, 22 nt, Mycobacterium bovis subsp bovis AF2122/97
cgcggccaccacaacgccagga

SEQ ID NO: 3183597 - RNA, 17 nt, Mycobacterium bovis subsp bovis AF2122/97
cgcggccaccaccaggc

SEQ ID NO: 3183598 - RNA, 14 nt, Mycobacterium bovis subsp bovis AF2122/97
cgcggccaccaccg

SEQ ID NO: 3183599 - RNA, 15 nt, Mycobacterium bovis subsp bovis AF2122/97
cgcggccaccaccgc

SEQ ID NO: 3183600 - RNA, 20 nt, Mycobacterium bovis subsp bovis AF2122/97
cgcggccaccaccgccgccg

SEQ ID NO: 3183601 - RNA, 22 nt, Mycobacterium bovis subsp bovis AF2122/97
cgcggccaccaccgccgccggc

SEQ ID NO: 3183602 - RNA, 15 nt, Mycobacterium bovis subsp bovis AF2122/97
cgcggccaccagauc

SEQ ID NO: 3183603 - RNA, 12 nt, Mycobacterium bovis subsp bovis AF2122/97
cgcggccacccg

SEQ ID NO: 3183604 - RNA, 13 nt, Mycobacterium bovis subsp bovis AF2122/97
cgcggccacccgc

SEQ ID NO: 3183605 - RNA, 14 nt, Mycobacterium bovis subsp bovis AF2122/97
cgcggccacccgcg

SEQ ID NO: 3183606 - RNA, 16 nt, Mycobacterium bovis subsp bovis AF2122/97
cgcggccacccgcgac

SEQ ID NO: 3183607 - RNA, 18 nt, Mycobacterium bovis subsp bovis AF2122/97
cgcggccacccgcgacga

SEQ ID NO: 3183608 - RNA, 19 nt, Mycobacterium bovis subsp bovis AF2122/97
cgcggccacccgcgacgau

SEQ ID NO: 3183609 - RNA, 16 nt, Mycobacterium bovis subsp bovis AF2122/97
cgcggccaccgaccgc

SEQ ID NO: 3183610 - RNA, 12 nt, Mycobacterium bovis subsp bovis AF2122/97
cgcggccaccgc

SEQ ID NO: 3183611 - RNA, 13 nt, Mycobacterium bovis subsp bovis AF2122/97
cgcggccaccgcc

SEQ ID NO: 3183612 - RNA, 14 nt, Mycobacterium bovis subsp bovis AF2122/97
cgcggccaccgccg

SEQ ID NO: 3183613 - RNA, 15 nt, Mycobacterium bovis subsp bovis AF2122/97
cgcggccaccgccgc

SEQ ID NO: 3183614 - RNA, 16 nt, Mycobacterium bovis subsp bovis AF2122/97
cgcggccaccgccgcc

SEQ ID NO: 3183615 - RNA, 17 nt, Mycobacterium bovis subsp bovis AF2122/97
cgcggccaccgccgccg

SEQ ID NO: 3183616 - RNA, 22 nt, Mycobacterium bovis subsp bovis AF2122/97
cgcggccaccucaucgccaucg

SEQ ID NO: 3183617 - RNA, 17 nt, Mycobacterium bovis subsp bovis AF2122/97
cgcggccacggucagcc

SEQ ID NO: 3183618 - RNA, 19 nt, Mycobacterium bovis subsp bovis AF2122/97
cgcggccacggucagccag

SEQ ID NO: 3183619 - RNA, 15 nt, Mycobacterium bovis subsp bovis AF2122/97
cgcggccagagccgc

SEQ ID NO: 3183620 - RNA, 16 nt, Mycobacterium bovis subsp bovis AF2122/97
cgcggccagagccgcg

SEQ ID NO: 3183621 - RNA, 21 nt, Mycobacterium bovis subsp bovis AF2122/97
cgcggccagagccgcgcgccg

SEQ ID NO: 3183622 - RNA, 15 nt, Mycobacterium bovis subsp bovis AF2122/97
cgcggccagcagcag

SEQ ID NO: 3183623 - RNA, 13 nt, Mycobacterium bovis subsp bovis AF2122/97
cgcggccagcagg

SEQ ID NO: 3183624 - RNA, 12 nt, Mycobacterium bovis subsp bovis AF2122/97
cgcggccagccc

SEQ ID NO: 3183625 - RNA, 13 nt, Mycobacterium bovis subsp bovis AF2122/97
cgcggccagccca

SEQ ID NO: 3183626 - RNA, 17 nt, Mycobacterium bovis subsp bovis AF2122/97
cgcggccagcccacucg

SEQ ID NO: 3183627 - RNA, 12 nt, Mycobacterium bovis subsp bovis AF2122/97
cgcggccagcgg

SEQ ID NO: 3183628 - RNA, 13 nt, Mycobacterium bovis subsp bovis AF2122/97
cgcggccagcggg

SEQ ID NO: 3183629 - RNA, 16 nt, Mycobacterium bovis subsp bovis AF2122/97
cgcggccaguacgucg

SEQ ID NO: 3183630 - RNA, 17 nt, Mycobacterium bovis subsp bovis AF2122/97
cgcggccaguacgucga

SEQ ID NO: 3183631 - RNA, 14 nt, Mycobacterium bovis subsp bovis AF2122/97
cgcggccaucgccg

SEQ ID NO: 3183632 - RNA, 16 nt, Mycobacterium bovis subsp bovis AF2122/97
cgcggccaucgccgac

SEQ ID NO: 3183633 - RNA, 17 nt, Mycobacterium bovis subsp bovis AF2122/97
cgcggccaucgccgaca

SEQ ID NO: 3183634 - RNA, 19 nt, Mycobacterium bovis subsp bovis AF2122/97
cgcggccaucgccgacacc

SEQ ID NO: 3183635 - RNA, 14 nt, Mycobacterium bovis subsp bovis AF2122/97
cgcggccauggcag

SEQ ID NO: 3183636 - RNA, 16 nt, Mycobacterium bovis subsp bovis AF2122/97
cgcggccauggcagcg

SEQ ID NO: 3183637 - RNA, 20 nt, Mycobacterium bovis subsp bovis AF2122/97
cgcggccauggcagcgcgcu

SEQ ID NO: 3183638 - RNA, 19 nt, Mycobacterium bovis subsp bovis AF2122/97
cgcggccauuagcagcacc

SEQ ID NO: 3183639 - RNA, 16 nt, Mycobacterium bovis subsp bovis AF2122/97
cgcggcccaccucacc

SEQ ID NO: 3183640 - RNA, 18 nt, Mycobacterium bovis subsp bovis AF2122/97
cgcggcccacucucgcca

SEQ ID NO: 3183641 - RNA, 22 nt, Mycobacterium bovis subsp bovis AF2122/97
cgcggcccagguccgcgugcug

SEQ ID NO: 3183642 - RNA, 19 nt, Mycobacterium bovis subsp bovis AF2122/97
cgcggccccgacugccgcg

SEQ ID NO: 3183643 - RNA, 19 nt, Mycobacterium bovis subsp bovis AF2122/97
cgcggccccgccguugccg

SEQ ID NO: 3183644 - RNA, 20 nt, Mycobacterium bovis subsp bovis AF2122/97
cgcggccccgccguugccgc

SEQ ID NO: 3183645 - RNA, 22 nt, Mycobacterium bovis subsp bovis AF2122/97
cgcggccccgccguugccgccg

SEQ ID NO: 3183646 - RNA, 12 nt, Mycobacterium bovis subsp bovis AF2122/97
cgcggcccgaga

SEQ ID NO: 3183647 - RNA, 12 nt, Mycobacterium bovis subsp bovis AF2122/97
cgcggcccgccg

SEQ ID NO: 3183648 - RNA, 13 nt, Mycobacterium bovis subsp bovis AF2122/97
cgcggcccgccga

SEQ ID NO: 3183649 - RNA, 18 nt, Mycobacterium bovis subsp bovis AF2122/97
cgcggcccgccucggcgg

SEQ ID NO: 3183650 - RNA, 22 nt, Mycobacterium bovis subsp bovis AF2122/97
cgcggcccgccucggcggcggc

SEQ ID NO: 3183651 - RNA, 23 nt, Mycobacterium bovis subsp bovis AF2122/97
cgcggcccgcucgaucggcagcc

SEQ ID NO: 3183652 - RNA, 17 nt, Mycobacterium bovis subsp bovis AF2122/97
cgcggcccggacgucgg

SEQ ID NO: 3183653 - RNA, 22 nt, Mycobacterium bovis subsp bovis AF2122/97
cgcggcccggacgucggcggcc

SEQ ID NO: 3183654 - RNA, 18 nt, Mycobacterium bovis subsp bovis AF2122/97
cgcggcccucgaugccgc

SEQ ID NO: 3183655 - RNA, 19 nt, Mycobacterium bovis subsp bovis AF2122/97
cgcggcccucgaugccgcg

SEQ ID NO: 3183656 - RNA, 20 nt, Mycobacterium bovis subsp bovis AF2122/97
cgcggccgaaagagccagcg

SEQ ID NO: 3183657 - RNA, 22 nt, Mycobacterium bovis subsp bovis AF2122/97
cgcggccgaaagagccagcggc

SEQ ID NO: 3183658 - RNA, 19 nt, Mycobacterium bovis subsp bovis AF2122/97
cgcggccgagacggcguug

SEQ ID NO: 3183659 - RNA, 16 nt, Mycobacterium bovis subsp bovis AF2122/97
cgcggccgaggucacc

SEQ ID NO: 3183660 - RNA, 17 nt, Mycobacterium bovis subsp bovis AF2122/97
cgcggccgaggucaccc

SEQ ID NO: 3183661 - RNA, 20 nt, Mycobacterium bovis subsp bovis AF2122/97
cgcggccgaggucacccggu

SEQ ID NO: 3183662 - RNA, 17 nt, Mycobacterium bovis subsp bovis AF2122/97
cgcggccgaggucgcgg

SEQ ID NO: 3183663 - RNA, 24 nt, Mycobacterium bovis subsp bovis AF2122/97
cgcggccgcaagccgcgagucgcc

SEQ ID NO: 3183664 - RNA, 13 nt, Mycobacterium bovis subsp bovis AF2122/97
cgcggccgcagcc

SEQ ID NO: 3183665 - RNA, 14 nt, Mycobacterium bovis subsp bovis AF2122/97
cgcggccgcagcca

SEQ ID NO: 3183666 - RNA, 16 nt, Mycobacterium bovis subsp bovis AF2122/97
cgcggccgcagccagc

SEQ ID NO: 3183667 - RNA, 17 nt, Mycobacterium bovis subsp bovis AF2122/97
cgcggccgcagccagca

SEQ ID NO: 3183668 - RNA, 14 nt, Mycobacterium bovis subsp bovis AF2122/97
cgcggccgccagcg

SEQ ID NO: 3183669 - RNA, 12 nt, Mycobacterium bovis subsp bovis AF2122/97
cgcggccgcccc

SEQ ID NO: 3183670 - RNA, 13 nt, Mycobacterium bovis subsp bovis AF2122/97
cgcggccgcccca

SEQ ID NO: 3183671 - RNA, 15 nt, Mycobacterium bovis subsp bovis AF2122/97
cgcggccgcggugac

SEQ ID NO: 3183672 - RNA, 16 nt, Mycobacterium bovis subsp bovis AF2122/97
cgcggccgcggugacg

SEQ ID NO: 3183673 - RNA, 17 nt, Mycobacterium bovis subsp bovis AF2122/97
cgcggccgcggugacgg

SEQ ID NO: 3183674 - RNA, 12 nt, Mycobacterium bovis subsp bovis AF2122/97
cgcggccgcugg

SEQ ID NO: 3183675 - RNA, 16 nt, Mycobacterium bovis subsp bovis AF2122/97
cgcggccggcacgacc

SEQ ID NO: 3183676 - RNA, 15 nt, Mycobacterium bovis subsp bovis AF2122/97
cgcggccggccgccc

SEQ ID NO: 3183677 - RNA, 14 nt, Mycobacterium bovis subsp bovis AF2122/97
cgcggccggccgcu

SEQ ID NO: 3183678 - RNA, 18 nt, Mycobacterium bovis subsp bovis AF2122/97
cgcggccggcggccgccc

SEQ ID NO: 3183679 - RNA, 14 nt, Mycobacterium bovis subsp bovis AF2122/97
cgcggccggcgucg

SEQ ID NO: 3183680 - RNA, 13 nt, Mycobacterium bovis subsp bovis AF2122/97
cgcggccggcgug

SEQ ID NO: 3183681 - RNA, 17 nt, Mycobacterium bovis subsp bovis AF2122/97
cgcggccggcgugccag

SEQ ID NO: 3183682 - RNA, 11 nt, Mycobacterium bovis subsp bovis AF2122/97
cgcggccgggc

SEQ ID NO: 3183683 - RNA, 12 nt, Mycobacterium bovis subsp bovis AF2122/97
cgcggccgggcc

SEQ ID NO: 3183684 - RNA, 13 nt, Mycobacterium bovis subsp bovis AF2122/97
cgcggccgggcgc

SEQ ID NO: 3183685 - RNA, 15 nt, Mycobacterium bovis subsp bovis AF2122/97
cgcggccgggcgccc

SEQ ID NO: 3183686 - RNA, 13 nt, Mycobacterium bovis subsp bovis AF2122/97
cgcggccgggugg

SEQ ID NO: 3183687 - RNA, 14 nt, Mycobacterium bovis subsp bovis AF2122/97
cgcggccggguggc

SEQ ID NO: 3183688 - RNA, 16 nt, Mycobacterium bovis subsp bovis AF2122/97
cgcggccggguggccc

SEQ ID NO: 3183689 - RNA, 15 nt, Mycobacterium bovis subsp bovis AF2122/97
cgcggccguagugca

SEQ ID NO: 3183690 - RNA, 17 nt, Mycobacterium bovis subsp bovis AF2122/97
cgcggccguagugcacg

SEQ ID NO: 3183691 - RNA, 16 nt, Mycobacterium bovis subsp bovis AF2122/97
cgcggccgucgcggga

SEQ ID NO: 3183692 - RNA, 17 nt, Mycobacterium bovis subsp bovis AF2122/97
cgcggccgucgcgggac

SEQ ID NO: 3183693 - RNA, 18 nt, Mycobacterium bovis subsp bovis AF2122/97
cgcggccgugaacggcgc

SEQ ID NO: 3183694 - RNA, 22 nt, Mycobacterium bovis subsp bovis AF2122/97
cgcggccgugaacggcgcgggc

SEQ ID NO: 3183695 - RNA, 20 nt, Mycobacterium bovis subsp bovis AF2122/97
cgcggccguggaugucgcgg

SEQ ID NO: 3183696 - RNA, 12 nt, Mycobacterium bovis subsp bovis AF2122/97
cgcggccucgua

SEQ ID NO: 3183697 - RNA, 16 nt, Mycobacterium bovis subsp bovis AF2122/97
cgcggccugacgcugc

SEQ ID NO: 3183698 - RNA, 19 nt, Mycobacterium bovis subsp bovis AF2122/97
cgcggccugacgcugcagc

SEQ ID NO: 3183699 - RNA, 20 nt, Mycobacterium bovis subsp bovis AF2122/97
cgcggccuugcgcacaggcg

SEQ ID NO: 3183700 - RNA, 21 nt, Mycobacterium bovis subsp bovis AF2122/97
cgcggccuugcgcacaggcgc

SEQ ID NO: 3183701 - RNA, 20 nt, Mycobacterium bovis subsp bovis AF2122/97
cgcggcgaacaucaccgucg

SEQ ID NO: 3183702 - RNA, 20 nt, Mycobacterium bovis subsp bovis AF2122/97
cgcggcgaaccgucucgccc

SEQ ID NO: 3183703 - RNA, 21 nt, Mycobacterium bovis subsp bovis AF2122/97
cgcggcgacaagccgagcccg

SEQ ID NO: 3183704 - RNA, 19 nt, Mycobacterium bovis subsp bovis AF2122/97
cgcggcgacauccacaccg

SEQ ID NO: 3183705 - RNA, 21 nt, Mycobacterium bovis subsp bovis AF2122/97
cgcggcgacauccacaccgcg

SEQ ID NO: 3183706 - RNA, 18 nt, Mycobacterium bovis subsp bovis AF2122/97
cgcggcgaccuguccggu

SEQ ID NO: 3183707 - RNA, 15 nt, Mycobacterium bovis subsp bovis AF2122/97
cgcggcgacgacggc

SEQ ID NO: 3183708 - RNA, 18 nt, Mycobacterium bovis subsp bovis AF2122/97
cgcggcgacgacggccug

SEQ ID NO: 3183709 - RNA, 14 nt, Mycobacterium bovis subsp bovis AF2122/97
cgcggcgagagccu

SEQ ID NO: 3183710 - RNA, 15 nt, Mycobacterium bovis subsp bovis AF2122/97
cgcggcgagcaccac

SEQ ID NO: 3183711 - RNA, 17 nt, Mycobacterium bovis subsp bovis AF2122/97
cgcggcgagcaccaccc

SEQ ID NO: 3183712 - RNA, 21 nt, Mycobacterium bovis subsp bovis AF2122/97
cgcggcgagcaccaccccagc

SEQ ID NO: 3183713 - RNA, 13 nt, Mycobacterium bovis subsp bovis AF2122/97
cgcggcgagcacg

SEQ ID NO: 3183714 - RNA, 19 nt, Mycobacterium bovis subsp bovis AF2122/97
cgcggcgaguggcuccauc

SEQ ID NO: 3183715 - RNA, 17 nt, Mycobacterium bovis subsp bovis AF2122/97
cgcggcgaucgcuccgc

SEQ ID NO: 3183716 - RNA, 21 nt, Mycobacterium bovis subsp bovis AF2122/97
cgcggcgaucgcuccgcggcg

SEQ ID NO: 3183717 - RNA, 22 nt, Mycobacterium bovis subsp bovis AF2122/97
cgcggcgaucgcuccgcggcgc

SEQ ID NO: 3183718 - RNA, 14 nt, Mycobacterium bovis subsp bovis AF2122/97
cgcggcgaucugcg

SEQ ID NO: 3183719 - RNA, 17 nt, Mycobacterium bovis subsp bovis AF2122/97
cgcggcgaucugcgaca

SEQ ID NO: 3183720 - RNA, 17 nt, Mycobacterium bovis subsp bovis AF2122/97
cgcggcgauuacggcca

SEQ ID NO: 3183721 - RNA, 17 nt, Mycobacterium bovis subsp bovis AF2122/97
cgcggcgcaagcccacc

SEQ ID NO: 3183722 - RNA, 16 nt, Mycobacterium bovis subsp bovis AF2122/97
cgcggcgcacaacccg

SEQ ID NO: 3183723 - RNA, 17 nt, Mycobacterium bovis subsp bovis AF2122/97
cgcggcgcacaacccgu

SEQ ID NO: 3183724 - RNA, 18 nt, Mycobacterium bovis subsp bovis AF2122/97
cgcggcgcagcaccgucg

SEQ ID NO: 3183725 - RNA, 20 nt, Mycobacterium bovis subsp bovis AF2122/97
cgcggcgcagcacggcggcc

SEQ ID NO: 3183726 - RNA, 18 nt, Mycobacterium bovis subsp bovis AF2122/97
cgcggcgcaggucgcgca

SEQ ID NO: 3183727 - RNA, 22 nt, Mycobacterium bovis subsp bovis AF2122/97
cgcggcgcaggucgcgcaguug

SEQ ID NO: 3183728 - RNA, 20 nt, Mycobacterium bovis subsp bovis AF2122/97
cgcggcgcauuccggcgcca

SEQ ID NO: 3183729 - RNA, 13 nt, Mycobacterium bovis subsp bovis AF2122/97
cgcggcgccagau

SEQ ID NO: 3183730 - RNA, 21 nt, Mycobacterium bovis subsp bovis AF2122/97
cgcggcgccauagccgcgacc

SEQ ID NO: 3183731 - RNA, 14 nt, Mycobacterium bovis subsp bovis AF2122/97
cgcggcgcccggcg

SEQ ID NO: 3183732 - RNA, 16 nt, Mycobacterium bovis subsp bovis AF2122/97
cgcggcgcccggcgga

SEQ ID NO: 3183733 - RNA, 18 nt, Mycobacterium bovis subsp bovis AF2122/97
cgcggcgcccggcggauc

SEQ ID NO: 3183734 - RNA, 19 nt, Mycobacterium bovis subsp bovis AF2122/97
cgcggcgcccggcggaucc

SEQ ID NO: 3183735 - RNA, 18 nt, Mycobacterium bovis subsp bovis AF2122/97
cgcggcgcccuggccgcc

SEQ ID NO: 3183736 - RNA, 19 nt, Mycobacterium bovis subsp bovis AF2122/97
cgcggcgcccuggccgccc

SEQ ID NO: 3183737 - RNA, 17 nt, Mycobacterium bovis subsp bovis AF2122/97
cgcggcgccgcaaugac

SEQ ID NO: 3183738 - RNA, 14 nt, Mycobacterium bovis subsp bovis AF2122/97
cgcggcgccgccac

SEQ ID NO: 3183739 - RNA, 14 nt, Mycobacterium bovis subsp bovis AF2122/97
cgcggcgccgccau

SEQ ID NO: 3183740 - RNA, 20 nt, Mycobacterium bovis subsp bovis AF2122/97
cgcggcgccgucgucagcgg

SEQ ID NO: 3183741 - RNA, 18 nt, Mycobacterium bovis subsp bovis AF2122/97
cgcggcgccguugccacc

SEQ ID NO: 3183742 - RNA, 14 nt, Mycobacterium bovis subsp bovis AF2122/97
cgcggcgccuccgc

SEQ ID NO: 3183743 - RNA, 16 nt, Mycobacterium bovis subsp bovis AF2122/97
cgcggcgcgcaggacc

SEQ ID NO: 3183744 - RNA, 15 nt, Mycobacterium bovis subsp bovis AF2122/97
cgcggcgcgcggggc

SEQ ID NO: 3183745 - RNA, 13 nt, Mycobacterium bovis subsp bovis AF2122/97
cgcggcgcgcuga

SEQ ID NO: 3183746 - RNA, 16 nt, Mycobacterium bovis subsp bovis AF2122/97
cgcggcgcgcugaaau

SEQ ID NO: 3183747 - RNA, 13 nt, Mycobacterium bovis subsp bovis AF2122/97
cgcggcgcggccg

SEQ ID NO: 3183748 - RNA, 14 nt, Mycobacterium bovis subsp bovis AF2122/97
cgcggcgcggccgc

SEQ ID NO: 3183749 - RNA, 22 nt, Mycobacterium bovis subsp bovis AF2122/97
cgcggcgcguccgggcucgcgc

SEQ ID NO: 3183750 - RNA, 21 nt, Mycobacterium bovis subsp bovis AF2122/97
cgcggcggaacaccgacgaca

SEQ ID NO: 3183751 - RNA, 22 nt, Mycobacterium bovis subsp bovis AF2122/97
cgcggcggaacaccgacgacac

SEQ ID NO: 3183752 - RNA, 21 nt, Mycobacterium bovis subsp bovis AF2122/97
cgcggcggaccguccgacggc

SEQ ID NO: 3183753 - RNA, 14 nt, Mycobacterium bovis subsp bovis AF2122/97
cgcggcggagugca

SEQ ID NO: 3183754 - RNA, 13 nt, Mycobacterium bovis subsp bovis AF2122/97
cgcggcggcagca

SEQ ID NO: 3183755 - RNA, 16 nt, Mycobacterium bovis subsp bovis AF2122/97
cgcggcggcagcggcg

SEQ ID NO: 3183756 - RNA, 22 nt, Mycobacterium bovis subsp bovis AF2122/97
cgcggcggcaucucgcaccgcg

SEQ ID NO: 3183757 - RNA, 14 nt, Mycobacterium bovis subsp bovis AF2122/97
cgcggcggccagcg

SEQ ID NO: 3183758 - RNA, 14 nt, Mycobacterium bovis subsp bovis AF2122/97
cgcggcggcgaucc

SEQ ID NO: 3183759 - RNA, 12 nt, Mycobacterium bovis subsp bovis AF2122/97
cgcggcggcgcg

SEQ ID NO: 3183760 - RNA, 14 nt, Mycobacterium bovis subsp bovis AF2122/97
cgcggcggcggcca

SEQ ID NO: 3183761 - RNA, 14 nt, Mycobacterium bovis subsp bovis AF2122/97
cgcggcgggcccga

SEQ ID NO: 3183762 - RNA, 15 nt, Mycobacterium bovis subsp bovis AF2122/97
cgcggcgggcccgau

SEQ ID NO: 3183763 - RNA, 17 nt, Mycobacterium bovis subsp bovis AF2122/97
cgcggcgggcccgauga

SEQ ID NO: 3183764 - RNA, 22 nt, Mycobacterium bovis subsp bovis AF2122/97
cgcggcggggguucgcucuggu

SEQ ID NO: 3183765 - RNA, 21 nt, Mycobacterium bovis subsp bovis AF2122/97
cgcggcggguccucgcggagc

SEQ ID NO: 3183766 - RNA, 20 nt, Mycobacterium bovis subsp bovis AF2122/97
cgcggcggucagucccguga

SEQ ID NO: 3183767 - RNA, 21 nt, Mycobacterium bovis subsp bovis AF2122/97
cgcggcggucccugaagccag

SEQ ID NO: 3183768 - RNA, 22 nt, Mycobacterium bovis subsp bovis AF2122/97
cgcggcggucguugccgaccga

SEQ ID NO: 3183769 - RNA, 13 nt, Mycobacterium bovis subsp bovis AF2122/97
cgcggcggugaac

SEQ ID NO: 3183770 - RNA, 22 nt, Mycobacterium bovis subsp bovis AF2122/97
cgcggcggugaacugcuggccg

SEQ ID NO: 3183771 - RNA, 22 nt, Mycobacterium bovis subsp bovis AF2122/97
cgcggcgguuaucgucggguca

SEQ ID NO: 3183772 - RNA, 12 nt, Mycobacterium bovis subsp bovis AF2122/97
cgcggcgucgcc

SEQ ID NO: 3183773 - RNA, 19 nt, Mycobacterium bovis subsp bovis AF2122/97
cgcggcgucggucgggugg

SEQ ID NO: 3183774 - RNA, 22 nt, Mycobacterium bovis subsp bovis AF2122/97
cgcggcgucgucgaugaugccg

SEQ ID NO: 3183775 - RNA, 15 nt, Mycobacterium bovis subsp bovis AF2122/97
cgcggcgugcgcggu

SEQ ID NO: 3183776 - RNA, 20 nt, Mycobacterium bovis subsp bovis AF2122/97
cgcggcgugcgcggugaugg

SEQ ID NO: 3183777 - RNA, 23 nt, Mycobacterium bovis subsp bovis AF2122/97
cgcggcguguacgucgaucaggu

SEQ ID NO: 3183778 - RNA, 20 nt, Mycobacterium bovis subsp bovis AF2122/97
cgcggcguucggcuucacug

SEQ ID NO: 3183779 - RNA, 19 nt, Mycobacterium bovis subsp bovis AF2122/97
cgcggcguugugaccgccg

SEQ ID NO: 3183780 - RNA, 19 nt, Mycobacterium bovis subsp bovis AF2122/97
cgcggcguuguugcggauc

SEQ ID NO: 3183781 - RNA, 24 nt, Mycobacterium bovis subsp bovis AF2122/97
cgcggcguuguugcggaucgagca

SEQ ID NO: 3183782 - RNA, 16 nt, Mycobacterium bovis subsp bovis AF2122/97
cgcggcuacaucggcg

SEQ ID NO: 3183783 - RNA, 19 nt, Mycobacterium bovis subsp bovis AF2122/97
cgcggcuacaucggcggcg

SEQ ID NO: 3183784 - RNA, 16 nt, Mycobacterium bovis subsp bovis AF2122/97
cgcggcuaggccaagc

SEQ ID NO: 3183785 - RNA, 21 nt, Mycobacterium bovis subsp bovis AF2122/97
cgcggcuaggccaagccgcgg

SEQ ID NO: 3183786 - RNA, 16 nt, Mycobacterium bovis subsp bovis AF2122/97
cgcggcuaggccagca

SEQ ID NO: 3183787 - RNA, 20 nt, Mycobacterium bovis subsp bovis AF2122/97
cgcggcuaggccagcacggc

SEQ ID NO: 3183788 - RNA, 16 nt, Mycobacterium bovis subsp bovis AF2122/97
cgcggcuauggcgccg

SEQ ID NO: 3183789 - RNA, 17 nt, Mycobacterium bovis subsp bovis AF2122/97
cgcggcuauggcgccgc

SEQ ID NO: 3183790 - RNA, 17 nt, Mycobacterium bovis subsp bovis AF2122/97
cgcggcucaaucuccuc

SEQ ID NO: 3183791 - RNA, 23 nt, Mycobacterium bovis subsp bovis AF2122/97
cgcggcuccguuguccagcgcga

SEQ ID NO: 3183792 - RNA, 15 nt, Mycobacterium bovis subsp bovis AF2122/97
cgcggcucguuggca

SEQ ID NO: 3183793 - RNA, 16 nt, Mycobacterium bovis subsp bovis AF2122/97
cgcggcugacaagccu

SEQ ID NO: 3183794 - RNA, 16 nt, Mycobacterium bovis subsp bovis AF2122/97
cgcggcugccagaaug

SEQ ID NO: 3183795 - RNA, 22 nt, Mycobacterium bovis subsp bovis AF2122/97
cgcggcugccagaaugggcggc

SEQ ID NO: 3183796 - RNA, 23 nt, Mycobacterium bovis subsp bovis AF2122/97
cgcggcugccagaaugggcggca

SEQ ID NO: 3183797 - RNA, 15 nt, Mycobacterium bovis subsp bovis AF2122/97
cgcggcugcguugug

SEQ ID NO: 3183798 - RNA, 18 nt, Mycobacterium bovis subsp bovis AF2122/97
cgcggcugcuccgucgcc

SEQ ID NO: 3183799 - RNA, 14 nt, Mycobacterium bovis subsp bovis AF2122/97
cgcggcuggggccc

SEQ ID NO: 3183800 - RNA, 16 nt, Mycobacterium bovis subsp bovis AF2122/97
cgcggcuggugucggg

SEQ ID NO: 3183801 - RNA, 19 nt, Mycobacterium bovis subsp bovis AF2122/97
cgcggcuggugucgggcgu

SEQ ID NO: 3183802 - RNA, 21 nt, Mycobacterium bovis subsp bovis AF2122/97
cgcggcugucacgccugccac

SEQ ID NO: 3183803 - RNA, 22 nt, Mycobacterium bovis subsp bovis AF2122/97
cgcggcugugcccgaucagccg

SEQ ID NO: 3183804 - RNA, 17 nt, Mycobacterium bovis subsp bovis AF2122/97
cgcggcuucacugcuag

SEQ ID NO: 3183805 - RNA, 18 nt, Mycobacterium bovis subsp bovis AF2122/97
cgcggcuucaguccggcc

SEQ ID NO: 3183806 - RNA, 19 nt, Mycobacterium bovis subsp bovis AF2122/97
cgcggcuucaguccggccc

SEQ ID NO: 3183807 - RNA, 20 nt, Mycobacterium bovis subsp bovis AF2122/97
cgcggcuucaguccggcccc

SEQ ID NO: 3183808 - RNA, 22 nt, Mycobacterium bovis subsp bovis AF2122/97
cgcggcuucaguccggcccccg

SEQ ID NO: 3183809 - RNA, 20 nt, Mycobacterium bovis subsp bovis AF2122/97
cgcggcuuggccuagccgcg

SEQ ID NO: 3183810 - RNA, 21 nt, Mycobacterium bovis subsp bovis AF2122/97
cgcggcuuggccuagccgcgg

SEQ ID NO: 3183811 - RNA, 23 nt, Mycobacterium bovis subsp bovis AF2122/97
cgcggcuuggccuagccgcggca

SEQ ID NO: 3183812 - RNA, 20 nt, Mycobacterium bovis subsp bovis AF2122/97
cgcggcuugggcuugcgccg

SEQ ID NO: 3183813 - RNA, 16 nt, Mycobacterium bovis subsp bovis AF2122/97
cgcggcuugucgcccc

SEQ ID NO: 3183814 - RNA, 18 nt, Mycobacterium bovis subsp bovis AF2122/97
cgcggcuugucgcggugc

SEQ ID NO: 3183815 - RNA, 19 nt, Mycobacterium bovis subsp bovis AF2122/97
cgcggcuugucgcggugcg

SEQ ID NO: 3183816 - RNA, 18 nt, Mycobacterium bovis subsp bovis AF2122/97
cgcggcuuugacgcccgg

SEQ ID NO: 3183817 - RNA, 20 nt, Mycobacterium bovis subsp bovis AF2122/97
cgcggcuuugacgcccggca

SEQ ID NO: 3183818 - RNA, 18 nt, Mycobacterium bovis subsp bovis AF2122/97
cgcgggaaaacggggugg

SEQ ID NO: 3183819 - RNA, 16 nt, Mycobacterium bovis subsp bovis AF2122/97
cgcgggaacgaugccg

SEQ ID NO: 3183820 - RNA, 19 nt, Mycobacterium bovis subsp bovis AF2122/97
cgcgggaacgaugccgccg

SEQ ID NO: 3183821 - RNA, 22 nt, Mycobacterium bovis subsp bovis AF2122/97
cgcgggaacgaugccgccggcg

SEQ ID NO: 3183822 - RNA, 24 nt, Mycobacterium bovis subsp bovis AF2122/97
cgcgggaagucccgaguggccggu

SEQ ID NO: 3183823 - RNA, 19 nt, Mycobacterium bovis subsp bovis AF2122/97
cgcgggaaguucgccgguc

SEQ ID NO: 3183824 - RNA, 15 nt, Mycobacterium bovis subsp bovis AF2122/97
cgcgggacaccaccg

SEQ ID NO: 3183825 - RNA, 16 nt, Mycobacterium bovis subsp bovis AF2122/97
cgcgggacaccaccgc

SEQ ID NO: 3183826 - RNA, 20 nt, Mycobacterium bovis subsp bovis AF2122/97
cgcgggacagauggcggccg

SEQ ID NO: 3183827 - RNA, 19 nt, Mycobacterium bovis subsp bovis AF2122/97
cgcgggaccuucgagccgc

SEQ ID NO: 3183828 - RNA, 21 nt, Mycobacterium bovis subsp bovis AF2122/97
cgcgggaccuucgagccgcac

SEQ ID NO: 3183829 - RNA, 18 nt, Mycobacterium bovis subsp bovis AF2122/97
cgcgggagaaaacggcgg

SEQ ID NO: 3183830 - RNA, 20 nt, Mycobacterium bovis subsp bovis AF2122/97
cgcgggagaaaacggcggcg

SEQ ID NO: 3183831 - RNA, 22 nt, Mycobacterium bovis subsp bovis AF2122/97
cgcgggagaaaacggcggcgcc

SEQ ID NO: 3183832 - RNA, 18 nt, Mycobacterium bovis subsp bovis AF2122/97
cgcgggagguacccccag

SEQ ID NO: 3183833 - RNA, 22 nt, Mycobacterium bovis subsp bovis AF2122/97
cgcgggagguacccccagcacc

SEQ ID NO: 3183834 - RNA, 20 nt, Mycobacterium bovis subsp bovis AF2122/97
cgcgggauccaggcccagcc

SEQ ID NO: 3183835 - RNA, 13 nt, Mycobacterium bovis subsp bovis AF2122/97
cgcgggaucggug

SEQ ID NO: 3183836 - RNA, 20 nt, Mycobacterium bovis subsp bovis AF2122/97
cgcgggaucgguggcggcac

SEQ ID NO: 3183837 - RNA, 21 nt, Mycobacterium bovis subsp bovis AF2122/97
cgcgggauugcgcgcugagcu

SEQ ID NO: 3183838 - RNA, 19 nt, Mycobacterium bovis subsp bovis AF2122/97
cgcgggcacgcccucgucg

SEQ ID NO: 3183839 - RNA, 18 nt, Mycobacterium bovis subsp bovis AF2122/97
cgcgggcacugguggcga

SEQ ID NO: 3183840 - RNA, 17 nt, Mycobacterium bovis subsp bovis AF2122/97
cgcgggcaguggcagcc

SEQ ID NO: 3183841 - RNA, 18 nt, Mycobacterium bovis subsp bovis AF2122/97
cgcgggcaguggcagccc

SEQ ID NO: 3183842 - RNA, 13 nt, Mycobacterium bovis subsp bovis AF2122/97
cgcgggccaccac

SEQ ID NO: 3183843 - RNA, 16 nt, Mycobacterium bovis subsp bovis AF2122/97
cgcgggccaccacgcg

SEQ ID NO: 3183844 - RNA, 21 nt, Mycobacterium bovis subsp bovis AF2122/97
cgcgggccaccacgcgccgca

SEQ ID NO: 3183845 - RNA, 13 nt, Mycobacterium bovis subsp bovis AF2122/97
cgcgggccaccgc

SEQ ID NO: 3183846 - RNA, 18 nt, Mycobacterium bovis subsp bovis AF2122/97
cgcgggccaccgcuguca

SEQ ID NO: 3183847 - RNA, 18 nt, Mycobacterium bovis subsp bovis AF2122/97
cgcgggccagcaccucga

SEQ ID NO: 3183848 - RNA, 19 nt, Mycobacterium bovis subsp bovis AF2122/97
cgcgggcccgcgcggcggu

SEQ ID NO: 3183849 - RNA, 13 nt, Mycobacterium bovis subsp bovis AF2122/97
cgcgggccgacca

SEQ ID NO: 3183850 - RNA, 16 nt, Mycobacterium bovis subsp bovis AF2122/97
cgcgggccgacgcagg

SEQ ID NO: 3183851 - RNA, 19 nt, Mycobacterium bovis subsp bovis AF2122/97
cgcgggccgaggccgucgc

SEQ ID NO: 3183852 - RNA, 21 nt, Mycobacterium bovis subsp bovis AF2122/97
cgcgggccgccaucucguagg

SEQ ID NO: 3183853 - RNA, 13 nt, Mycobacterium bovis subsp bovis AF2122/97
cgcgggccgcguc

SEQ ID NO: 3183854 - RNA, 14 nt, Mycobacterium bovis subsp bovis AF2122/97
cgcgggccgcgucg

SEQ ID NO: 3183855 - RNA, 15 nt, Mycobacterium bovis subsp bovis AF2122/97
cgcgggccgcgucga

SEQ ID NO: 3183856 - RNA, 16 nt, Mycobacterium bovis subsp bovis AF2122/97
cgcgggccgcgucgaa

SEQ ID NO: 3183857 - RNA, 16 nt, Mycobacterium bovis subsp bovis AF2122/97
cgcgggccggcgacug

SEQ ID NO: 3183858 - RNA, 15 nt, Mycobacterium bovis subsp bovis AF2122/97
cgcgggccuggccca

SEQ ID NO: 3183859 - RNA, 13 nt, Mycobacterium bovis subsp bovis AF2122/97
cgcgggcgaccac

SEQ ID NO: 3183860 - RNA, 17 nt, Mycobacterium bovis subsp bovis AF2122/97
cgcgggcgaccaccgcg

SEQ ID NO: 3183861 - RNA, 18 nt, Mycobacterium bovis subsp bovis AF2122/97
cgcgggcgaccaccgcgg

SEQ ID NO: 3183862 - RNA, 19 nt, Mycobacterium bovis subsp bovis AF2122/97
cgcgggcgaccaccgcggc

SEQ ID NO: 3183863 - RNA, 16 nt, Mycobacterium bovis subsp bovis AF2122/97
cgcgggcgagcgcauc

SEQ ID NO: 3183864 - RNA, 22 nt, Mycobacterium bovis subsp bovis AF2122/97
cgcgggcgaguagucgacgucg

SEQ ID NO: 3183865 - RNA, 16 nt, Mycobacterium bovis subsp bovis AF2122/97
cgcgggcgaucggcau

SEQ ID NO: 3183866 - RNA, 13 nt, Mycobacterium bovis subsp bovis AF2122/97
cgcgggcgauggc

SEQ ID NO: 3183867 - RNA, 14 nt, Mycobacterium bovis subsp bovis AF2122/97
cgcgggcgccggga

SEQ ID NO: 3183868 - RNA, 16 nt, Mycobacterium bovis subsp bovis AF2122/97
cgcgggcggaucgccg

SEQ ID NO: 3183869 - RNA, 14 nt, Mycobacterium bovis subsp bovis AF2122/97
cgcgggcggcaucg

SEQ ID NO: 3183870 - RNA, 15 nt, Mycobacterium bovis subsp bovis AF2122/97
cgcgggcggcaucgc

SEQ ID NO: 3183871 - RNA, 13 nt, Mycobacterium bovis subsp bovis AF2122/97
cgcgggcggcgcu

SEQ ID NO: 3183872 - RNA, 15 nt, Mycobacterium bovis subsp bovis AF2122/97
cgcgggcgucccgca

SEQ ID NO: 3183873 - RNA, 18 nt, Mycobacterium bovis subsp bovis AF2122/97
cgcgggcgucccgcauac

SEQ ID NO: 3183874 - RNA, 17 nt, Mycobacterium bovis subsp bovis AF2122/97
cgcgggcgugcuacacc

SEQ ID NO: 3183875 - RNA, 13 nt, Mycobacterium bovis subsp bovis AF2122/97
cgcgggcguugcu

SEQ ID NO: 3183876 - RNA, 22 nt, Mycobacterium bovis subsp bovis AF2122/97
cgcgggcguugcugauggugcc

SEQ ID NO: 3183877 - RNA, 18 nt, Mycobacterium bovis subsp bovis AF2122/97
cgcgggcguuggccagca

SEQ ID NO: 3183878 - RNA, 22 nt, Mycobacterium bovis subsp bovis AF2122/97
cgcgggcuaucgguucagcugc

SEQ ID NO: 3183879 - RNA, 12 nt, Mycobacterium bovis subsp bovis AF2122/97
cgcgggcucccc

SEQ ID NO: 3183880 - RNA, 16 nt, Mycobacterium bovis subsp bovis AF2122/97
cgcgggcucgguggcg

SEQ ID NO: 3183881 - RNA, 18 nt, Mycobacterium bovis subsp bovis AF2122/97
cgcgggcucgguggcgga

SEQ ID NO: 3183882 - RNA, 12 nt, Mycobacterium bovis subsp bovis AF2122/97
cgcgggcugacc

SEQ ID NO: 3183883 - RNA, 19 nt, Mycobacterium bovis subsp bovis AF2122/97
cgcggggaugcgaccgccg

SEQ ID NO: 3183884 - RNA, 14 nt, Mycobacterium bovis subsp bovis AF2122/97
cgcggggcagcggg

SEQ ID NO: 3183885 - RNA, 19 nt, Mycobacterium bovis subsp bovis AF2122/97
cgcggggcaucggugcggu

SEQ ID NO: 3183886 - RNA, 22 nt, Mycobacterium bovis subsp bovis AF2122/97
cgcggggcaucggugcgguucg

SEQ ID NO: 3183887 - RNA, 12 nt, Mycobacterium bovis subsp bovis AF2122/97
cgcggggccgcc

SEQ ID NO: 3183888 - RNA, 19 nt, Mycobacterium bovis subsp bovis AF2122/97
cgcggggccgccgcggccg

SEQ ID NO: 3183889 - RNA, 12 nt, Mycobacterium bovis subsp bovis AF2122/97
cgcggggccgga

SEQ ID NO: 3183890 - RNA, 13 nt, Mycobacterium bovis subsp bovis AF2122/97
cgcggggcggccu

SEQ ID NO: 3183891 - RNA, 21 nt, Mycobacterium bovis subsp bovis AF2122/97
cgcggggcggccugcccgccg

SEQ ID NO: 3183892 - RNA, 15 nt, Mycobacterium bovis subsp bovis AF2122/97
cgcgggggaccgccc

SEQ ID NO: 3183893 - RNA, 13 nt, Mycobacterium bovis subsp bovis AF2122/97
cgcgggggcggcc

SEQ ID NO: 3183894 - RNA, 19 nt, Mycobacterium bovis subsp bovis AF2122/97
cgcgggggcggccggcggc

SEQ ID NO: 3183895 - RNA, 21 nt, Mycobacterium bovis subsp bovis AF2122/97
cgcggggucugucgaacuggu

SEQ ID NO: 3183896 - RNA, 24 nt, Mycobacterium bovis subsp bovis AF2122/97
cgcggggugcgcgcgaccauaccc

SEQ ID NO: 3183897 - RNA, 20 nt, Mycobacterium bovis subsp bovis AF2122/97
cgcgggguugauugacccgu

SEQ ID NO: 3183898 - RNA, 12 nt, Mycobacterium bovis subsp bovis AF2122/97
cgcggguaaccg

SEQ ID NO: 3183899 - RNA, 22 nt, Mycobacterium bovis subsp bovis AF2122/97
cgcggguacuuacgggucgcgg

SEQ ID NO: 3183900 - RNA, 13 nt, Mycobacterium bovis subsp bovis AF2122/97
cgcggguagcggu

SEQ ID NO: 3183901 - RNA, 15 nt, Mycobacterium bovis subsp bovis AF2122/97
cgcggguccagccac

SEQ ID NO: 3183902 - RNA, 13 nt, Mycobacterium bovis subsp bovis AF2122/97
cgcgggucccggc

SEQ ID NO: 3183903 - RNA, 15 nt, Mycobacterium bovis subsp bovis AF2122/97
cgcgggucccggccg

SEQ ID NO: 3183904 - RNA, 14 nt, Mycobacterium bovis subsp bovis AF2122/97
cgcgggucgcgcga

SEQ ID NO: 3183905 - RNA, 13 nt, Mycobacterium bovis subsp bovis AF2122/97
cgcgggucggcga

SEQ ID NO: 3183906 - RNA, 18 nt, Mycobacterium bovis subsp bovis AF2122/97
cgcgggucguccggcggc

SEQ ID NO: 3183907 - RNA, 19 nt, Mycobacterium bovis subsp bovis AF2122/97
cgcgggucguccggcggca

SEQ ID NO: 3183908 - RNA, 19 nt, Mycobacterium bovis subsp bovis AF2122/97
cgcgggucgugccagcagc

SEQ ID NO: 3183909 - RNA, 22 nt, Mycobacterium bovis subsp bovis AF2122/97
cgcgggucuuggcacacagguc

SEQ ID NO: 3183910 - RNA, 16 nt, Mycobacterium bovis subsp bovis AF2122/97
cgcgggugaccaacac

SEQ ID NO: 3183911 - RNA, 19 nt, Mycobacterium bovis subsp bovis AF2122/97
cgcgggugaccaggcggcg

SEQ ID NO: 3183912 - RNA, 13 nt, Mycobacterium bovis subsp bovis AF2122/97
cgcgggugaucuc

SEQ ID NO: 3183913 - RNA, 20 nt, Mycobacterium bovis subsp bovis AF2122/97
cgcgggugaucuccaccggc

SEQ ID NO: 3183914 - RNA, 21 nt, Mycobacterium bovis subsp bovis AF2122/97
cgcgggugaucuccaccggcg

SEQ ID NO: 3183915 - RNA, 22 nt, Mycobacterium bovis subsp bovis AF2122/97
cgcgggugaucuccaccggcga

SEQ ID NO: 3183916 - RNA, 19 nt, Mycobacterium bovis subsp bovis AF2122/97
cgcgggugaucugggcggu

SEQ ID NO: 3183917 - RNA, 17 nt, Mycobacterium bovis subsp bovis AF2122/97
cgcgggugccgacgucg

SEQ ID NO: 3183918 - RNA, 19 nt, Mycobacterium bovis subsp bovis AF2122/97
cgcgggugccgggcaugau

SEQ ID NO: 3183919 - RNA, 22 nt, Mycobacterium bovis subsp bovis AF2122/97
cgcgggugccgggcaugaucac

SEQ ID NO: 3183920 - RNA, 18 nt, Mycobacterium bovis subsp bovis AF2122/97
cgcgggugcgcugcagcg

SEQ ID NO: 3183921 - RNA, 21 nt, Mycobacterium bovis subsp bovis AF2122/97
cgcgggugcgcugcagcgaga

SEQ ID NO: 3183922 - RNA, 13 nt, Mycobacterium bovis subsp bovis AF2122/97
cgcgggugcggca

SEQ ID NO: 3183923 - RNA, 19 nt, Mycobacterium bovis subsp bovis AF2122/97
cgcggguggaaguacuucg

SEQ ID NO: 3183924 - RNA, 13 nt, Mycobacterium bovis subsp bovis AF2122/97
cgcggguggcggc

SEQ ID NO: 3183925 - RNA, 16 nt, Mycobacterium bovis subsp bovis AF2122/97
cgcggguguuccacac

SEQ ID NO: 3183926 - RNA, 20 nt, Mycobacterium bovis subsp bovis AF2122/97
cgcggguguuccacaccagg

SEQ ID NO: 3183927 - RNA, 23 nt, Mycobacterium bovis subsp bovis AF2122/97
cgcggguguuccacaccaggccg

SEQ ID NO: 3183928 - RNA, 23 nt, Mycobacterium bovis subsp bovis AF2122/97
cgcggguuacccgcagcgugccc

SEQ ID NO: 3183929 - RNA, 15 nt, Mycobacterium bovis subsp bovis AF2122/97
cgcggguugcgcggc

SEQ ID NO: 3183930 - RNA, 17 nt, Mycobacterium bovis subsp bovis AF2122/97
cgcggguuggguguguu

SEQ ID NO: 3183931 - RNA, 19 nt, Mycobacterium bovis subsp bovis AF2122/97
cgcggguuugaucuccacc

SEQ ID NO: 3183932 - RNA, 16 nt, Mycobacterium bovis subsp bovis AF2122/97
cgcggguuugcgguag

SEQ ID NO: 3183933 - RNA, 14 nt, Mycobacterium bovis subsp bovis AF2122/97
cgcgguaaccacgc

SEQ ID NO: 3183934 - RNA, 17 nt, Mycobacterium bovis subsp bovis AF2122/97
cgcgguaaccacgcgga

SEQ ID NO: 3183935 - RNA, 18 nt, Mycobacterium bovis subsp bovis AF2122/97
cgcgguaccaucaccgcg

SEQ ID NO: 3183936 - RNA, 14 nt, Mycobacterium bovis subsp bovis AF2122/97
cgcgguaccgcucg

SEQ ID NO: 3183937 - RNA, 17 nt, Mycobacterium bovis subsp bovis AF2122/97
cgcgguaccgcucgggc

SEQ ID NO: 3183938 - RNA, 19 nt, Mycobacterium bovis subsp bovis AF2122/97
cgcgguacgccggucggug

SEQ ID NO: 3183939 - RNA, 14 nt, Mycobacterium bovis subsp bovis AF2122/97
cgcgguacugcgca

SEQ ID NO: 3183940 - RNA, 15 nt, Mycobacterium bovis subsp bovis AF2122/97
cgcgguacugcgcag

SEQ ID NO: 3183941 - RNA, 14 nt, Mycobacterium bovis subsp bovis AF2122/97
cgcgguagacgccg

SEQ ID NO: 3183942 - RNA, 15 nt, Mycobacterium bovis subsp bovis AF2122/97
cgcgguagacgccgc

SEQ ID NO: 3183943 - RNA, 17 nt, Mycobacterium bovis subsp bovis AF2122/97
cgcgguagacgccgccg

SEQ ID NO: 3183944 - RNA, 19 nt, Mycobacterium bovis subsp bovis AF2122/97
cgcgguagccgcggccaca

SEQ ID NO: 3183945 - RNA, 13 nt, Mycobacterium bovis subsp bovis AF2122/97
cgcgguagcgccg

SEQ ID NO: 3183946 - RNA, 14 nt, Mycobacterium bovis subsp bovis AF2122/97
cgcgguagcucguc

SEQ ID NO: 3183947 - RNA, 18 nt, Mycobacterium bovis subsp bovis AF2122/97
cgcgguagcucgucgagg

SEQ ID NO: 3183948 - RNA, 19 nt, Mycobacterium bovis subsp bovis AF2122/97
cgcgguaggugcaugucga

SEQ ID NO: 3183949 - RNA, 15 nt, Mycobacterium bovis subsp bovis AF2122/97
cgcgguagucguugc

SEQ ID NO: 3183950 - RNA, 19 nt, Mycobacterium bovis subsp bovis AF2122/97
cgcgguaguugucccgccg

SEQ ID NO: 3183951 - RNA, 19 nt, Mycobacterium bovis subsp bovis AF2122/97
cgcggucaaauccagcagc

SEQ ID NO: 3183952 - RNA, 21 nt, Mycobacterium bovis subsp bovis AF2122/97
cgcggucaaauccagcagcca

SEQ ID NO: 3183953 - RNA, 13 nt, Mycobacterium bovis subsp bovis AF2122/97
cgcggucaccccg

SEQ ID NO: 3183954 - RNA, 17 nt, Mycobacterium bovis subsp bovis AF2122/97
cgcggucaccgacgcag

SEQ ID NO: 3183955 - RNA, 16 nt, Mycobacterium bovis subsp bovis AF2122/97
cgcggucaccgcguca

SEQ ID NO: 3183956 - RNA, 18 nt, Mycobacterium bovis subsp bovis AF2122/97
cgcggucagccauguccg

SEQ ID NO: 3183957 - RNA, 21 nt, Mycobacterium bovis subsp bovis AF2122/97
cgcggucagccauguccgcag

SEQ ID NO: 3183958 - RNA, 12 nt, Mycobacterium bovis subsp bovis AF2122/97
cgcggucagcgg

SEQ ID NO: 3183959 - RNA, 13 nt, Mycobacterium bovis subsp bovis AF2122/97
cgcggucagcggg

SEQ ID NO: 3183960 - RNA, 17 nt, Mycobacterium bovis subsp bovis AF2122/97
cgcggucagcgggucga

SEQ ID NO: 3183961 - RNA, 18 nt, Mycobacterium bovis subsp bovis AF2122/97
cgcggucagcucggcagc

SEQ ID NO: 3183962 - RNA, 19 nt, Mycobacterium bovis subsp bovis AF2122/97
cgcggucagcucggcagca

SEQ ID NO: 3183963 - RNA, 17 nt, Mycobacterium bovis subsp bovis AF2122/97
cgcggucaucauggccg

SEQ ID NO: 3183964 - RNA, 19 nt, Mycobacterium bovis subsp bovis AF2122/97
cgcggucaucgagcugacc

SEQ ID NO: 3183965 - RNA, 14 nt, Mycobacterium bovis subsp bovis AF2122/97
cgcggucauggcga

SEQ ID NO: 3183966 - RNA, 16 nt, Mycobacterium bovis subsp bovis AF2122/97
cgcggucauggcgacg

SEQ ID NO: 3183967 - RNA, 15 nt, Mycobacterium bovis subsp bovis AF2122/97
cgcgguccaacagcg

SEQ ID NO: 3183968 - RNA, 24 nt, Mycobacterium bovis subsp bovis AF2122/97
cgcgguccagaaugucgcgggugg

SEQ ID NO: 3183969 - RNA, 19 nt, Mycobacterium bovis subsp bovis AF2122/97
cgcgguccaucccgagcuc

SEQ ID NO: 3183970 - RNA, 14 nt, Mycobacterium bovis subsp bovis AF2122/97
cgcggucccacggc

SEQ ID NO: 3183971 - RNA, 18 nt, Mycobacterium bovis subsp bovis AF2122/97
cgcggucccacggccggc

SEQ ID NO: 3183972 - RNA, 22 nt, Mycobacterium bovis subsp bovis AF2122/97
cgcggucccacggccggccgcu

SEQ ID NO: 3183973 - RNA, 21 nt, Mycobacterium bovis subsp bovis AF2122/97
cgcggucccacucgucgucgg

SEQ ID NO: 3183974 - RNA, 16 nt, Mycobacterium bovis subsp bovis AF2122/97
cgcggucgacagcgca

SEQ ID NO: 3183975 - RNA, 16 nt, Mycobacterium bovis subsp bovis AF2122/97
cgcggucgacgacgcc

SEQ ID NO: 3183976 - RNA, 15 nt, Mycobacterium bovis subsp bovis AF2122/97
cgcggucgagcaggu

SEQ ID NO: 3183977 - RNA, 17 nt, Mycobacterium bovis subsp bovis AF2122/97
cgcggucgagcaggugu

SEQ ID NO: 3183978 - RNA, 19 nt, Mycobacterium bovis subsp bovis AF2122/97
cgcggucgagguggcgggc

SEQ ID NO: 3183979 - RNA, 17 nt, Mycobacterium bovis subsp bovis AF2122/97
cgcggucgaucaggccg

SEQ ID NO: 3183980 - RNA, 18 nt, Mycobacterium bovis subsp bovis AF2122/97
cgcggucgaucaggccgu

SEQ ID NO: 3183981 - RNA, 18 nt, Mycobacterium bovis subsp bovis AF2122/97
cgcggucgauguccgcag

SEQ ID NO: 3183982 - RNA, 22 nt, Mycobacterium bovis subsp bovis AF2122/97
cgcggucgauguccgcagcacc

SEQ ID NO: 3183983 - RNA, 13 nt, Mycobacterium bovis subsp bovis AF2122/97
cgcggucgcagca

SEQ ID NO: 3183984 - RNA, 14 nt, Mycobacterium bovis subsp bovis AF2122/97
cgcggucgccaccg

SEQ ID NO: 3183985 - RNA, 21 nt, Mycobacterium bovis subsp bovis AF2122/97
cgcggucgccaccgugucacg

SEQ ID NO: 3183986 - RNA, 23 nt, Mycobacterium bovis subsp bovis AF2122/97
cgcggucgccaccgugucacgcg

SEQ ID NO: 3183987 - RNA, 23 nt, Mycobacterium bovis subsp bovis AF2122/97
cgcggucgcgacuaccaucgccg

SEQ ID NO: 3183988 - RNA, 12 nt, Mycobacterium bovis subsp bovis AF2122/97
cgcggucgcgcg

SEQ ID NO: 3183989 - RNA, 13 nt, Mycobacterium bovis subsp bovis AF2122/97
cgcggucgcgcga

SEQ ID NO: 3183990 - RNA, 12 nt, Mycobacterium bovis subsp bovis AF2122/97
cgcggucggacc

SEQ ID NO: 3183991 - RNA, 19 nt, Mycobacterium bovis subsp bovis AF2122/97
cgcggucggaccacccggc

SEQ ID NO: 3183992 - RNA, 22 nt, Mycobacterium bovis subsp bovis AF2122/97
cgcggucggaccacccggcgcg

SEQ ID NO: 3183993 - RNA, 14 nt, Mycobacterium bovis subsp bovis AF2122/97
cgcggucggcagcg

SEQ ID NO: 3183994 - RNA, 14 nt, Mycobacterium bovis subsp bovis AF2122/97
cgcggucggccacc

SEQ ID NO: 3183995 - RNA, 16 nt, Mycobacterium bovis subsp bovis AF2122/97
cgcggucggcggccgc

SEQ ID NO: 3183996 - RNA, 18 nt, Mycobacterium bovis subsp bovis AF2122/97
cgcggucggcggccgcca

SEQ ID NO: 3183997 - RNA, 13 nt, Mycobacterium bovis subsp bovis AF2122/97
cgcggucggcgug

SEQ ID NO: 3183998 - RNA, 15 nt, Mycobacterium bovis subsp bovis AF2122/97
cgcggucggcgugca

SEQ ID NO: 3183999 - RNA, 22 nt, Mycobacterium bovis subsp bovis AF2122/97
cgcggucgugaucagcaggacg

SEQ ID NO: 3184000 - RNA, 17 nt, Mycobacterium bovis subsp bovis AF2122/97
cgcggucugcgcgucgc

SEQ ID NO: 3184001 - RNA, 20 nt, Mycobacterium bovis subsp bovis AF2122/97
cgcggucugcuccaggcgcg

SEQ ID NO: 3184002 - RNA, 17 nt, Mycobacterium bovis subsp bovis AF2122/97
cgcggucuuugagccgg

SEQ ID NO: 3184003 - RNA, 13 nt, Mycobacterium bovis subsp bovis AF2122/97
cgcggugacccgg

SEQ ID NO: 3184004 - RNA, 13 nt, Mycobacterium bovis subsp bovis AF2122/97
cgcggugaccggc

SEQ ID NO: 3184005 - RNA, 14 nt, Mycobacterium bovis subsp bovis AF2122/97
cgcggugacgagcc

SEQ ID NO: 3184006 - RNA, 18 nt, Mycobacterium bovis subsp bovis AF2122/97
cgcggugacgagccacca

SEQ ID NO: 3184007 - RNA, 20 nt, Mycobacterium bovis subsp bovis AF2122/97
cgcggugacgagccaccacc

SEQ ID NO: 3184008 - RNA, 21 nt, Mycobacterium bovis subsp bovis AF2122/97
cgcggugacgagccaccaccg

SEQ ID NO: 3184009 - RNA, 24 nt, Mycobacterium bovis subsp bovis AF2122/97
cgcggugacgagccaccaccgccg

SEQ ID NO: 3184010 - RNA, 13 nt, Mycobacterium bovis subsp bovis AF2122/97
cgcggugacgauu

SEQ ID NO: 3184011 - RNA, 23 nt, Mycobacterium bovis subsp bovis AF2122/97
cgcggugacgauugccaccaaug

SEQ ID NO: 3184012 - RNA, 16 nt, Mycobacterium bovis subsp bovis AF2122/97
cgcggugacgccagcc

SEQ ID NO: 3184013 - RNA, 17 nt, Mycobacterium bovis subsp bovis AF2122/97
cgcggugacgccagccu

SEQ ID NO: 3184014 - RNA, 13 nt, Mycobacterium bovis subsp bovis AF2122/97
cgcggugacggcg

SEQ ID NO: 3184015 - RNA, 16 nt, Mycobacterium bovis subsp bovis AF2122/97
cgcggugacggcggcu

SEQ ID NO: 3184016 - RNA, 22 nt, Mycobacterium bovis subsp bovis AF2122/97
cgcggugacucggccuccgccg

SEQ ID NO: 3184017 - RNA, 18 nt, Mycobacterium bovis subsp bovis AF2122/97
cgcggugaguucgccgga

SEQ ID NO: 3184018 - RNA, 16 nt, Mycobacterium bovis subsp bovis AF2122/97
cgcggugauggucacc

SEQ ID NO: 3184019 - RNA, 15 nt, Mycobacterium bovis subsp bovis AF2122/97
cgcggugauggugaa

SEQ ID NO: 3184020 - RNA, 22 nt, Mycobacterium bovis subsp bovis AF2122/97
cgcggugcccgcgaacgauccc

SEQ ID NO: 3184021 - RNA, 13 nt, Mycobacterium bovis subsp bovis AF2122/97
cgcggugcccguc

SEQ ID NO: 3184022 - RNA, 16 nt, Mycobacterium bovis subsp bovis AF2122/97
cgcggugcccugccgg

SEQ ID NO: 3184023 - RNA, 13 nt, Mycobacterium bovis subsp bovis AF2122/97
cgcggugccgcca

SEQ ID NO: 3184024 - RNA, 14 nt, Mycobacterium bovis subsp bovis AF2122/97
cgcggugccgccac

SEQ ID NO: 3184025 - RNA, 15 nt, Mycobacterium bovis subsp bovis AF2122/97
cgcggugccgccacc

SEQ ID NO: 3184026 - RNA, 16 nt, Mycobacterium bovis subsp bovis AF2122/97
cgcggugccgccaccg

SEQ ID NO: 3184027 - RNA, 18 nt, Mycobacterium bovis subsp bovis AF2122/97
cgcggugccgccaccggc

SEQ ID NO: 3184028 - RNA, 23 nt, Mycobacterium bovis subsp bovis AF2122/97
cgcggugccgccaccggcgucca

SEQ ID NO: 3184029 - RNA, 12 nt, Mycobacterium bovis subsp bovis AF2122/97
cgcggugccggc

SEQ ID NO: 3184030 - RNA, 13 nt, Mycobacterium bovis subsp bovis AF2122/97
cgcggugccggga

SEQ ID NO: 3184031 - RNA, 13 nt, Mycobacterium bovis subsp bovis AF2122/97
cgcggugcgcgca

SEQ ID NO: 3184032 - RNA, 17 nt, Mycobacterium bovis subsp bovis AF2122/97
cgcggugcgcgugacga

SEQ ID NO: 3184033 - RNA, 22 nt, Mycobacterium bovis subsp bovis AF2122/97
cgcggugcgcgugacgaccagc

SEQ ID NO: 3184034 - RNA, 19 nt, Mycobacterium bovis subsp bovis AF2122/97
cgcggugcgcucacuggcg

SEQ ID NO: 3184035 - RNA, 18 nt, Mycobacterium bovis subsp bovis AF2122/97
cgcggugcggcaacagcg

SEQ ID NO: 3184036 - RNA, 13 nt, Mycobacterium bovis subsp bovis AF2122/97
cgcggugcggcca

SEQ ID NO: 3184037 - RNA, 20 nt, Mycobacterium bovis subsp bovis AF2122/97
cgcggugcggccacucgccc

SEQ ID NO: 3184038 - RNA, 21 nt, Mycobacterium bovis subsp bovis AF2122/97
cgcgguggaccgcucgauguc

SEQ ID NO: 3184039 - RNA, 14 nt, Mycobacterium bovis subsp bovis AF2122/97
cgcgguggaccggg

SEQ ID NO: 3184040 - RNA, 23 nt, Mycobacterium bovis subsp bovis AF2122/97
cgcgguggaugcgaugcgcgccg

SEQ ID NO: 3184041 - RNA, 13 nt, Mycobacterium bovis subsp bovis AF2122/97
cgcgguggccaga

SEQ ID NO: 3184042 - RNA, 21 nt, Mycobacterium bovis subsp bovis AF2122/97
cgcgguggccagaucgaacgc

SEQ ID NO: 3184043 - RNA, 12 nt, Mycobacterium bovis subsp bovis AF2122/97
cgcgguggcggc

SEQ ID NO: 3184044 - RNA, 13 nt, Mycobacterium bovis subsp bovis AF2122/97
cgcgguggcggcg

SEQ ID NO: 3184045 - RNA, 14 nt, Mycobacterium bovis subsp bovis AF2122/97
cgcgguggcggcga

SEQ ID NO: 3184046 - RNA, 19 nt, Mycobacterium bovis subsp bovis AF2122/97
cgcgguggcggcggugcca

SEQ ID NO: 3184047 - RNA, 17 nt, Mycobacterium bovis subsp bovis AF2122/97
cgcgguggcggucgcca

SEQ ID NO: 3184048 - RNA, 23 nt, Mycobacterium bovis subsp bovis AF2122/97
cgcgguggcggucgccacacccg

SEQ ID NO: 3184049 - RNA, 13 nt, Mycobacterium bovis subsp bovis AF2122/97
cgcgguggcggug

SEQ ID NO: 3184050 - RNA, 21 nt, Mycobacterium bovis subsp bovis AF2122/97
cgcgguggcggugucggcgcc

SEQ ID NO: 3184051 - RNA, 22 nt, Mycobacterium bovis subsp bovis AF2122/97
cgcgguggcggugucggcgccg

SEQ ID NO: 3184052 - RNA, 17 nt, Mycobacterium bovis subsp bovis AF2122/97
cgcggugggcacagcca

SEQ ID NO: 3184053 - RNA, 18 nt, Mycobacterium bovis subsp bovis AF2122/97
cgcggugggcacagccag

SEQ ID NO: 3184054 - RNA, 17 nt, Mycobacterium bovis subsp bovis AF2122/97
cgcgguggggcgcgccg

SEQ ID NO: 3184055 - RNA, 14 nt, Mycobacterium bovis subsp bovis AF2122/97
cgcgguggucagca

SEQ ID NO: 3184056 - RNA, 13 nt, Mycobacterium bovis subsp bovis AF2122/97
cgcggugguggug

SEQ ID NO: 3184057 - RNA, 22 nt, Mycobacterium bovis subsp bovis AF2122/97
cgcgguguagaagcgggcgucg

SEQ ID NO: 3184058 - RNA, 23 nt, Mycobacterium bovis subsp bovis AF2122/97
cgcgguguagaagcgggcgucgc

SEQ ID NO: 3184059 - RNA, 19 nt, Mycobacterium bovis subsp bovis AF2122/97
cgcgguguauccgacgucg

SEQ ID NO: 3184060 - RNA, 20 nt, Mycobacterium bovis subsp bovis AF2122/97
cgcgguguauccgacgucgg

SEQ ID NO: 3184061 - RNA, 16 nt, Mycobacterium bovis subsp bovis AF2122/97
cgcggugugcggcagc

SEQ ID NO: 3184062 - RNA, 17 nt, Mycobacterium bovis subsp bovis AF2122/97
cgcggugugcggcagcc

SEQ ID NO: 3184063 - RNA, 18 nt, Mycobacterium bovis subsp bovis AF2122/97
cgcggugugcggcagccc

SEQ ID NO: 3184064 - RNA, 23 nt, Mycobacterium bovis subsp bovis AF2122/97
cgcggugugcggcagcccgcugg

SEQ ID NO: 3184065 - RNA, 21 nt, Mycobacterium bovis subsp bovis AF2122/97
cgcgguguugcggugaucggg

SEQ ID NO: 3184066 - RNA, 17 nt, Mycobacterium bovis subsp bovis AF2122/97
cgcgguguuggacgcgg

SEQ ID NO: 3184067 - RNA, 15 nt, Mycobacterium bovis subsp bovis AF2122/97
cgcgguucaacacca

SEQ ID NO: 3184068 - RNA, 20 nt, Mycobacterium bovis subsp bovis AF2122/97
cgcgguucaacaccaacgcg

SEQ ID NO: 3184069 - RNA, 14 nt, Mycobacterium bovis subsp bovis AF2122/97
cgcgguucaccacg

SEQ ID NO: 3184070 - RNA, 23 nt, Mycobacterium bovis subsp bovis AF2122/97
cgcgguuggcaguggcgcggcga

SEQ ID NO: 3184071 - RNA, 16 nt, Mycobacterium bovis subsp bovis AF2122/97
cgcgguuguccuccga

SEQ ID NO: 3184072 - RNA, 16 nt, Mycobacterium bovis subsp bovis AF2122/97
cgcgguuguuucggcg

SEQ ID NO: 3184073 - RNA, 16 nt, Mycobacterium bovis subsp bovis AF2122/97
cgcgguuucggcguca

SEQ ID NO: 3184074 - RNA, 19 nt, Mycobacterium bovis subsp bovis AF2122/97
cgcgguuucggcgucaccg

SEQ ID NO: 3184075 - RNA, 18 nt, Mycobacterium bovis subsp bovis AF2122/97
cgcgguuugcacgucacg

SEQ ID NO: 3184076 - RNA, 19 nt, Mycobacterium bovis subsp bovis AF2122/97
cgcgguuuggcgacgucga

SEQ ID NO: 3184077 - RNA, 18 nt, Mycobacterium bovis subsp bovis AF2122/97
cgcguaaaccggcugacc

SEQ ID NO: 3184078 - RNA, 22 nt, Mycobacterium bovis subsp bovis AF2122/97
cgcguaaaggccuugggcggca

SEQ ID NO: 3184079 - RNA, 17 nt, Mycobacterium bovis subsp bovis AF2122/97
cgcguaauucgacuucg

SEQ ID NO: 3184080 - RNA, 17 nt, Mycobacterium bovis subsp bovis AF2122/97
cgcguacaggccggcca

SEQ ID NO: 3184081 - RNA, 20 nt, Mycobacterium bovis subsp bovis AF2122/97
cgcguacaggccggccacca

SEQ ID NO: 3184082 - RNA, 17 nt, Mycobacterium bovis subsp bovis AF2122/97
cgcguacggaaccaccg

SEQ ID NO: 3184083 - RNA, 12 nt, Mycobacterium bovis subsp bovis AF2122/97
cgcguacgucgg

SEQ ID NO: 3184084 - RNA, 16 nt, Mycobacterium bovis subsp bovis AF2122/97
cgcguagaccagugac

SEQ ID NO: 3184085 - RNA, 15 nt, Mycobacterium bovis subsp bovis AF2122/97
cgcguagagcagcag

SEQ ID NO: 3184086 - RNA, 16 nt, Mycobacterium bovis subsp bovis AF2122/97
cgcguagagcagcagc

SEQ ID NO: 3184087 - RNA, 17 nt, Mycobacterium bovis subsp bovis AF2122/97
cgcguagagcagcagcg

SEQ ID NO: 3184088 - RNA, 13 nt, Mycobacterium bovis subsp bovis AF2122/97
cgcguagagccga

SEQ ID NO: 3184089 - RNA, 19 nt, Mycobacterium bovis subsp bovis AF2122/97
cgcguagagccgaucaccg

SEQ ID NO: 3184090 - RNA, 20 nt, Mycobacterium bovis subsp bovis AF2122/97
cgcguagagccgaucaccgc

SEQ ID NO: 3184091 - RNA, 21 nt, Mycobacterium bovis subsp bovis AF2122/97
cgcguagagccgaucaccgcc

SEQ ID NO: 3184092 - RNA, 22 nt, Mycobacterium bovis subsp bovis AF2122/97
cgcguagcuggccagguugccg

SEQ ID NO: 3184093 - RNA, 15 nt, Mycobacterium bovis subsp bovis AF2122/97
cgcguagggccagcg

SEQ ID NO: 3184094 - RNA, 16 nt, Mycobacterium bovis subsp bovis AF2122/97
cgcguagggccagcgc

SEQ ID NO: 3184095 - RNA, 18 nt, Mycobacterium bovis subsp bovis AF2122/97
cgcguagguggccagcgc

SEQ ID NO: 3184096 - RNA, 22 nt, Mycobacterium bovis subsp bovis AF2122/97
cgcguaguaaugcucgacguag

SEQ ID NO: 3184097 - RNA, 13 nt, Mycobacterium bovis subsp bovis AF2122/97
cgcguagucgcgg

SEQ ID NO: 3184098 - RNA, 19 nt, Mycobacterium bovis subsp bovis AF2122/97
cgcguagugccacgaggac

SEQ ID NO: 3184099 - RNA, 13 nt, Mycobacterium bovis subsp bovis AF2122/97
cgcguaguggugg

SEQ ID NO: 3184100 - RNA, 12 nt, Mycobacterium bovis subsp bovis AF2122/97
cgcguaugccag

SEQ ID NO: 3184101 - RNA, 17 nt, Mycobacterium bovis subsp bovis AF2122/97
cgcguauucggcaucgc

SEQ ID NO: 3184102 - RNA, 19 nt, Mycobacterium bovis subsp bovis AF2122/97
cgcguauucggcaucgccg

SEQ ID NO: 3184103 - RNA, 12 nt, Mycobacterium bovis subsp bovis AF2122/97
cgcgucaacgcu

SEQ ID NO: 3184104 - RNA, 23 nt, Mycobacterium bovis subsp bovis AF2122/97
cgcgucaacgcuguugucgucca

SEQ ID NO: 3184105 - RNA, 23 nt, Mycobacterium bovis subsp bovis AF2122/97
cgcgucaagucugugcucacggc

SEQ ID NO: 3184106 - RNA, 14 nt, Mycobacterium bovis subsp bovis AF2122/97
cgcgucacaccagc

SEQ ID NO: 3184107 - RNA, 15 nt, Mycobacterium bovis subsp bovis AF2122/97
cgcgucacaccagcg

SEQ ID NO: 3184108 - RNA, 23 nt, Mycobacterium bovis subsp bovis AF2122/97
cgcgucacaccagcgggcaucgc

SEQ ID NO: 3184109 - RNA, 23 nt, Mycobacterium bovis subsp bovis AF2122/97
cgcgucacauccgacagcagccg

SEQ ID NO: 3184110 - RNA, 15 nt, Mycobacterium bovis subsp bovis AF2122/97
cgcgucacccggggc

SEQ ID NO: 3184111 - RNA, 19 nt, Mycobacterium bovis subsp bovis AF2122/97
cgcgucaccggaggccgcc

SEQ ID NO: 3184112 - RNA, 21 nt, Mycobacterium bovis subsp bovis AF2122/97
cgcgucaccggaggccgccgc

SEQ ID NO: 3184113 - RNA, 19 nt, Mycobacterium bovis subsp bovis AF2122/97
cgcgucacggaccuggaac

SEQ ID NO: 3184114 - RNA, 23 nt, Mycobacterium bovis subsp bovis AF2122/97
cgcgucacuucccggauagacgg

SEQ ID NO: 3184115 - RNA, 19 nt, Mycobacterium bovis subsp bovis AF2122/97
cgcgucagccgcaccccgc

SEQ ID NO: 3184116 - RNA, 15 nt, Mycobacterium bovis subsp bovis AF2122/97
cgcgucagcggcgag

SEQ ID NO: 3184117 - RNA, 17 nt, Mycobacterium bovis subsp bovis AF2122/97
cgcgucagcggcgagca

SEQ ID NO: 3184118 - RNA, 14 nt, Mycobacterium bovis subsp bovis AF2122/97
cgcgucaggccagc

SEQ ID NO: 3184119 - RNA, 16 nt, Mycobacterium bovis subsp bovis AF2122/97
cgcgucaggccagcgc

SEQ ID NO: 3184120 - RNA, 23 nt, Mycobacterium bovis subsp bovis AF2122/97
cgcgucaguccucaucgagcgcg

SEQ ID NO: 3184121 - RNA, 11 nt, Mycobacterium bovis subsp bovis AF2122/97
cgcgucaucaa

SEQ ID NO: 3184122 - RNA, 14 nt, Mycobacterium bovis subsp bovis AF2122/97
cgcgucaucaccgg

SEQ ID NO: 3184123 - RNA, 22 nt, Mycobacterium bovis subsp bovis AF2122/97
cgcgucauggcgaguacggccu

SEQ ID NO: 3184124 - RNA, 15 nt, Mycobacterium bovis subsp bovis AF2122/97
cgcguccaaggcgcg

SEQ ID NO: 3184125 - RNA, 22 nt, Mycobacterium bovis subsp bovis AF2122/97
cgcguccacccacgaucagcag

SEQ ID NO: 3184126 - RNA, 23 nt, Mycobacterium bovis subsp bovis AF2122/97
cgcguccagaccguagcggccgg

SEQ ID NO: 3184127 - RNA, 12 nt, Mycobacterium bovis subsp bovis AF2122/97
cgcguccagcgc

SEQ ID NO: 3184128 - RNA, 17 nt, Mycobacterium bovis subsp bovis AF2122/97
cgcguccagcgcggccu

SEQ ID NO: 3184129 - RNA, 14 nt, Mycobacterium bovis subsp bovis AF2122/97
cgcguccagcuggc

SEQ ID NO: 3184130 - RNA, 16 nt, Mycobacterium bovis subsp bovis AF2122/97
cgcguccaggugcgcc

SEQ ID NO: 3184131 - RNA, 20 nt, Mycobacterium bovis subsp bovis AF2122/97
cgcguccaggugcgccgugg

SEQ ID NO: 3184132 - RNA, 21 nt, Mycobacterium bovis subsp bovis AF2122/97
cgcguccaggugcgccguggc

SEQ ID NO: 3184133 - RNA, 16 nt, Mycobacterium bovis subsp bovis AF2122/97
cgcguccccagcgcca

SEQ ID NO: 3184134 - RNA, 20 nt, Mycobacterium bovis subsp bovis AF2122/97
cgcguccccagcgccaccgu

SEQ ID NO: 3184135 - RNA, 13 nt, Mycobacterium bovis subsp bovis AF2122/97
cgcgucccgccgc

SEQ ID NO: 3184136 - RNA, 14 nt, Mycobacterium bovis subsp bovis AF2122/97
cgcgucccgccgca

SEQ ID NO: 3184137 - RNA, 18 nt, Mycobacterium bovis subsp bovis AF2122/97
cgcgucccgccgcaccgc

SEQ ID NO: 3184138 - RNA, 20 nt, Mycobacterium bovis subsp bovis AF2122/97
cgcguccgcaggcgauugca

SEQ ID NO: 3184139 - RNA, 11 nt, Mycobacterium bovis subsp bovis AF2122/97
cgcguccgcga

SEQ ID NO: 3184140 - RNA, 16 nt, Mycobacterium bovis subsp bovis AF2122/97
cgcguccgggcagccg

SEQ ID NO: 3184141 - RNA, 17 nt, Mycobacterium bovis subsp bovis AF2122/97
cgcguccgggcagccgc

SEQ ID NO: 3184142 - RNA, 18 nt, Mycobacterium bovis subsp bovis AF2122/97
cgcguccgggcagccgcg

SEQ ID NO: 3184143 - RNA, 16 nt, Mycobacterium bovis subsp bovis AF2122/97
cgcguccggugcacca

SEQ ID NO: 3184144 - RNA, 18 nt, Mycobacterium bovis subsp bovis AF2122/97
cgcguccggugcaccagg

SEQ ID NO: 3184145 - RNA, 20 nt, Mycobacterium bovis subsp bovis AF2122/97
cgcguccggugcaccaggua

SEQ ID NO: 3184146 - RNA, 19 nt, Mycobacterium bovis subsp bovis AF2122/97
cgcguccucgcccuggccg

SEQ ID NO: 3184147 - RNA, 15 nt, Mycobacterium bovis subsp bovis AF2122/97
cgcguccucgccgca

SEQ ID NO: 3184148 - RNA, 23 nt, Mycobacterium bovis subsp bovis AF2122/97
cgcguccucgccgcacgccggca

SEQ ID NO: 3184149 - RNA, 19 nt, Mycobacterium bovis subsp bovis AF2122/97
cgcgucgaacugggcgccc

SEQ ID NO: 3184150 - RNA, 22 nt, Mycobacterium bovis subsp bovis AF2122/97
cgcgucgaacugggcgcccgcg

SEQ ID NO: 3184151 - RNA, 15 nt, Mycobacterium bovis subsp bovis AF2122/97
cgcgucgaagccggg

SEQ ID NO: 3184152 - RNA, 16 nt, Mycobacterium bovis subsp bovis AF2122/97
cgcgucgaagccgggg

SEQ ID NO: 3184153 - RNA, 21 nt, Mycobacterium bovis subsp bovis AF2122/97
cgcgucgaauuccggcucacc

SEQ ID NO: 3184154 - RNA, 23 nt, Mycobacterium bovis subsp bovis AF2122/97
cgcgucgaauuccggcucaccga

SEQ ID NO: 3184155 - RNA, 15 nt, Mycobacterium bovis subsp bovis AF2122/97
cgcgucgaccggaca

SEQ ID NO: 3184156 - RNA, 14 nt, Mycobacterium bovis subsp bovis AF2122/97
cgcgucgagcagca

SEQ ID NO: 3184157 - RNA, 15 nt, Mycobacterium bovis subsp bovis AF2122/97
cgcgucgagcagcac

SEQ ID NO: 3184158 - RNA, 22 nt, Mycobacterium bovis subsp bovis AF2122/97
cgcgucgagcagcaccacccgc

SEQ ID NO: 3184159 - RNA, 15 nt, Mycobacterium bovis subsp bovis AF2122/97
cgcgucgagcgccgg

SEQ ID NO: 3184160 - RNA, 17 nt, Mycobacterium bovis subsp bovis AF2122/97
cgcgucgagcgccggcc

SEQ ID NO: 3184161 - RNA, 20 nt, Mycobacterium bovis subsp bovis AF2122/97
cgcgucgagcgccggccgcg

SEQ ID NO: 3184162 - RNA, 15 nt, Mycobacterium bovis subsp bovis AF2122/97
cgcgucgagugccgc

SEQ ID NO: 3184163 - RNA, 13 nt, Mycobacterium bovis subsp bovis AF2122/97
cgcgucgauaucg

SEQ ID NO: 3184164 - RNA, 24 nt, Mycobacterium bovis subsp bovis AF2122/97
cgcgucgaucguuccgcuggacgg

SEQ ID NO: 3184165 - RNA, 15 nt, Mycobacterium bovis subsp bovis AF2122/97
cgcgucgaucugugg

SEQ ID NO: 3184166 - RNA, 14 nt, Mycobacterium bovis subsp bovis AF2122/97
cgcgucgccagaua

SEQ ID NO: 3184167 - RNA, 13 nt, Mycobacterium bovis subsp bovis AF2122/97
cgcgucgccaggc

SEQ ID NO: 3184168 - RNA, 14 nt, Mycobacterium bovis subsp bovis AF2122/97
cgcgucgccaggcc

SEQ ID NO: 3184169 - RNA, 12 nt, Mycobacterium bovis subsp bovis AF2122/97
cgcgucgcccgc

SEQ ID NO: 3184170 - RNA, 13 nt, Mycobacterium bovis subsp bovis AF2122/97
cgcgucgccgacg

SEQ ID NO: 3184171 - RNA, 13 nt, Mycobacterium bovis subsp bovis AF2122/97
cgcgucgccgaug

SEQ ID NO: 3184172 - RNA, 14 nt, Mycobacterium bovis subsp bovis AF2122/97
cgcgucgccgauga

SEQ ID NO: 3184173 - RNA, 14 nt, Mycobacterium bovis subsp bovis AF2122/97
cgcgucgccggccu

SEQ ID NO: 3184174 - RNA, 15 nt, Mycobacterium bovis subsp bovis AF2122/97
cgcgucgcgcgcggc

SEQ ID NO: 3184175 - RNA, 17 nt, Mycobacterium bovis subsp bovis AF2122/97
cgcgucgcgcgcggcau

SEQ ID NO: 3184176 - RNA, 20 nt, Mycobacterium bovis subsp bovis AF2122/97
cgcgucgcuguuggcgaagg

SEQ ID NO: 3184177 - RNA, 17 nt, Mycobacterium bovis subsp bovis AF2122/97
cgcgucggaccguuucg

SEQ ID NO: 3184178 - RNA, 14 nt, Mycobacterium bovis subsp bovis AF2122/97
cgcgucggagccgg

SEQ ID NO: 3184179 - RNA, 14 nt, Mycobacterium bovis subsp bovis AF2122/97
cgcgucggcgauga

SEQ ID NO: 3184180 - RNA, 13 nt, Mycobacterium bovis subsp bovis AF2122/97
cgcgucggcggcc

SEQ ID NO: 3184181 - RNA, 15 nt, Mycobacterium bovis subsp bovis AF2122/97
cgcgucggcggccag

SEQ ID NO: 3184182 - RNA, 17 nt, Mycobacterium bovis subsp bovis AF2122/97
cgcgucggcggccagua

SEQ ID NO: 3184183 - RNA, 17 nt, Mycobacterium bovis subsp bovis AF2122/97
cgcgucggcggcgaccg

SEQ ID NO: 3184184 - RNA, 19 nt, Mycobacterium bovis subsp bovis AF2122/97
cgcgucggcggcgaccgcc

SEQ ID NO: 3184185 - RNA, 22 nt, Mycobacterium bovis subsp bovis AF2122/97
cgcgucggcggcgaccgccagc

SEQ ID NO: 3184186 - RNA, 14 nt, Mycobacterium bovis subsp bovis AF2122/97
cgcgucggcguugg

SEQ ID NO: 3184187 - RNA, 17 nt, Mycobacterium bovis subsp bovis AF2122/97
cgcgucggcguuggggc

SEQ ID NO: 3184188 - RNA, 21 nt, Mycobacterium bovis subsp bovis AF2122/97
cgcgucggcguuggggcucgu

SEQ ID NO: 3184189 - RNA, 13 nt, Mycobacterium bovis subsp bovis AF2122/97
cgcgucggcugcc

SEQ ID NO: 3184190 - RNA, 15 nt, Mycobacterium bovis subsp bovis AF2122/97
cgcgucggcugccgc

SEQ ID NO: 3184191 - RNA, 18 nt, Mycobacterium bovis subsp bovis AF2122/97
cgcgucggcugccgcggc

SEQ ID NO: 3184192 - RNA, 12 nt, Mycobacterium bovis subsp bovis AF2122/97
cgcgucgggccg

SEQ ID NO: 3184193 - RNA, 14 nt, Mycobacterium bovis subsp bovis AF2122/97
cgcgucgggccgca

SEQ ID NO: 3184194 - RNA, 14 nt, Mycobacterium bovis subsp bovis AF2122/97
cgcgucggucaccg

SEQ ID NO: 3184195 - RNA, 18 nt, Mycobacterium bovis subsp bovis AF2122/97
cgcgucggugucgaugcu

SEQ ID NO: 3184196 - RNA, 23 nt, Mycobacterium bovis subsp bovis AF2122/97
cgcgucggugugguccucgauca

SEQ ID NO: 3184197 - RNA, 16 nt, Mycobacterium bovis subsp bovis AF2122/97
cgcgucguagcgcucg

SEQ ID NO: 3184198 - RNA, 14 nt, Mycobacterium bovis subsp bovis AF2122/97
cgcgucgucacgau

SEQ ID NO: 3184199 - RNA, 15 nt, Mycobacterium bovis subsp bovis AF2122/97
cgcgucgucccagug

SEQ ID NO: 3184200 - RNA, 14 nt, Mycobacterium bovis subsp bovis AF2122/97
cgcgucgucgcgcu

SEQ ID NO: 3184201 - RNA, 17 nt, Mycobacterium bovis subsp bovis AF2122/97
cgcgucgugccacuucc

SEQ ID NO: 3184202 - RNA, 16 nt, Mycobacterium bovis subsp bovis AF2122/97
cgcgucguugccgggg

SEQ ID NO: 3184203 - RNA, 22 nt, Mycobacterium bovis subsp bovis AF2122/97
cgcgucguugucgucgccggcg

SEQ ID NO: 3184204 - RNA, 23 nt, Mycobacterium bovis subsp bovis AF2122/97
cgcgucguugucgucgccggcgg

SEQ ID NO: 3184205 - RNA, 22 nt, Mycobacterium bovis subsp bovis AF2122/97
cgcgucguuugggugcgccguc

SEQ ID NO: 3184206 - RNA, 20 nt, Mycobacterium bovis subsp bovis AF2122/97
cgcgucuacgucguccagca

SEQ ID NO: 3184207 - RNA, 23 nt, Mycobacterium bovis subsp bovis AF2122/97
cgcgucuacgucguccagcacca

SEQ ID NO: 3184208 - RNA, 15 nt, Mycobacterium bovis subsp bovis AF2122/97
cgcgucucgagcgcg

SEQ ID NO: 3184209 - RNA, 19 nt, Mycobacterium bovis subsp bovis AF2122/97
cgcgucucggugcagcagc

SEQ ID NO: 3184210 - RNA, 13 nt, Mycobacterium bovis subsp bovis AF2122/97
cgcgucugcucgc

SEQ ID NO: 3184211 - RNA, 19 nt, Mycobacterium bovis subsp bovis AF2122/97
cgcgucugcucgccagcgg

SEQ ID NO: 3184212 - RNA, 20 nt, Mycobacterium bovis subsp bovis AF2122/97
cgcgucugcucgccagcggg

SEQ ID NO: 3184213 - RNA, 14 nt, Mycobacterium bovis subsp bovis AF2122/97
cgcgucugcucgcg

SEQ ID NO: 3184214 - RNA, 14 nt, Mycobacterium bovis subsp bovis AF2122/97
cgcgucugcucggc

SEQ ID NO: 3184215 - RNA, 19 nt, Mycobacterium bovis subsp bovis AF2122/97
cgcgucugcucggcggugc

SEQ ID NO: 3184216 - RNA, 17 nt, Mycobacterium bovis subsp bovis AF2122/97
cgcgucugggugcaggu

SEQ ID NO: 3184217 - RNA, 13 nt, Mycobacterium bovis subsp bovis AF2122/97
cgcgugaccaggg

SEQ ID NO: 3184218 - RNA, 15 nt, Mycobacterium bovis subsp bovis AF2122/97
cgcgugacgaccagc

SEQ ID NO: 3184219 - RNA, 17 nt, Mycobacterium bovis subsp bovis AF2122/97
cgcgugacgaccagccc

SEQ ID NO: 3184220 - RNA, 19 nt, Mycobacterium bovis subsp bovis AF2122/97
cgcgugcagcggcgccgcc

SEQ ID NO: 3184221 - RNA, 20 nt, Mycobacterium bovis subsp bovis AF2122/97
cgcgugcagcggcgccgcca

SEQ ID NO: 3184222 - RNA, 14 nt, Mycobacterium bovis subsp bovis AF2122/97
cgcgugcaggcugu

SEQ ID NO: 3184223 - RNA, 19 nt, Mycobacterium bovis subsp bovis AF2122/97
cgcgugcaucgccugcgcc

SEQ ID NO: 3184224 - RNA, 13 nt, Mycobacterium bovis subsp bovis AF2122/97
cgcgugccacagc

SEQ ID NO: 3184225 - RNA, 14 nt, Mycobacterium bovis subsp bovis AF2122/97
cgcgugccacucga

SEQ ID NO: 3184226 - RNA, 16 nt, Mycobacterium bovis subsp bovis AF2122/97
cgcgugccacucgaug

SEQ ID NO: 3184227 - RNA, 18 nt, Mycobacterium bovis subsp bovis AF2122/97
cgcgugccacucgaugcu

SEQ ID NO: 3184228 - RNA, 15 nt, Mycobacterium bovis subsp bovis AF2122/97
cgcgugccagcgccc

SEQ ID NO: 3184229 - RNA, 18 nt, Mycobacterium bovis subsp bovis AF2122/97
cgcgugccagcgccccgc

SEQ ID NO: 3184230 - RNA, 21 nt, Mycobacterium bovis subsp bovis AF2122/97
cgcgugccagcgccccgcggu

SEQ ID NO: 3184231 - RNA, 22 nt, Mycobacterium bovis subsp bovis AF2122/97
cgcgugccgcaaccggcgaucg

SEQ ID NO: 3184232 - RNA, 13 nt, Mycobacterium bovis subsp bovis AF2122/97
cgcgugccgcccg

SEQ ID NO: 3184233 - RNA, 17 nt, Mycobacterium bovis subsp bovis AF2122/97
cgcgugccgcccgccuc

SEQ ID NO: 3184234 - RNA, 23 nt, Mycobacterium bovis subsp bovis AF2122/97
cgcgugcgacgauaucgggagcg

SEQ ID NO: 3184235 - RNA, 17 nt, Mycobacterium bovis subsp bovis AF2122/97
cgcgugcgcaucccgaa

SEQ ID NO: 3184236 - RNA, 18 nt, Mycobacterium bovis subsp bovis AF2122/97
cgcgugcgcaucccgaag

SEQ ID NO: 3184237 - RNA, 16 nt, Mycobacterium bovis subsp bovis AF2122/97
cgcgugcggcugccag

SEQ ID NO: 3184238 - RNA, 20 nt, Mycobacterium bovis subsp bovis AF2122/97
cgcgugcggcugccagugcc

SEQ ID NO: 3184239 - RNA, 19 nt, Mycobacterium bovis subsp bovis AF2122/97
cgcgugcggugccguggug

SEQ ID NO: 3184240 - RNA, 20 nt, Mycobacterium bovis subsp bovis AF2122/97
cgcgugcgguggcgcgcagc

SEQ ID NO: 3184241 - RNA, 17 nt, Mycobacterium bovis subsp bovis AF2122/97
cgcgugcucgagcaccu

SEQ ID NO: 3184242 - RNA, 20 nt, Mycobacterium bovis subsp bovis AF2122/97
cgcgugcucgagcaccucgg

SEQ ID NO: 3184243 - RNA, 22 nt, Mycobacterium bovis subsp bovis AF2122/97
cgcgugcucgagcaccucggcc

SEQ ID NO: 3184244 - RNA, 21 nt, Mycobacterium bovis subsp bovis AF2122/97
cgcgugcugccguauccaggc

SEQ ID NO: 3184245 - RNA, 16 nt, Mycobacterium bovis subsp bovis AF2122/97
cgcgugcuuggcagcg

SEQ ID NO: 3184246 - RNA, 23 nt, Mycobacterium bovis subsp bovis AF2122/97
cgcguggaguggugauccagccg

SEQ ID NO: 3184247 - RNA, 15 nt, Mycobacterium bovis subsp bovis AF2122/97
cgcguggaucgcgcu

SEQ ID NO: 3184248 - RNA, 12 nt, Mycobacterium bovis subsp bovis AF2122/97
cgcguggcaccg

SEQ ID NO: 3184249 - RNA, 15 nt, Mycobacterium bovis subsp bovis AF2122/97
cgcguggcaccgaca

SEQ ID NO: 3184250 - RNA, 14 nt, Mycobacterium bovis subsp bovis AF2122/97
cgcguggcauccag

SEQ ID NO: 3184251 - RNA, 17 nt, Mycobacterium bovis subsp bovis AF2122/97
cgcguggcauccagcag

SEQ ID NO: 3184252 - RNA, 13 nt, Mycobacterium bovis subsp bovis AF2122/97
cgcguggccgccg

SEQ ID NO: 3184253 - RNA, 17 nt, Mycobacterium bovis subsp bovis AF2122/97
cgcguggccgccggcgc

SEQ ID NO: 3184254 - RNA, 20 nt, Mycobacterium bovis subsp bovis AF2122/97
cgcguggccgccggcgcugg

SEQ ID NO: 3184255 - RNA, 14 nt, Mycobacterium bovis subsp bovis AF2122/97
cgcguggcgcacca

SEQ ID NO: 3184256 - RNA, 19 nt, Mycobacterium bovis subsp bovis AF2122/97
cgcguggcgcaccaccgcc

SEQ ID NO: 3184257 - RNA, 20 nt, Mycobacterium bovis subsp bovis AF2122/97
cgcguggcgcaccaccgccc

SEQ ID NO: 3184258 - RNA, 23 nt, Mycobacterium bovis subsp bovis AF2122/97
cgcguggcgcaccaccgccccgc

SEQ ID NO: 3184259 - RNA, 19 nt, Mycobacterium bovis subsp bovis AF2122/97
cgcguggcggggccgcgcc

SEQ ID NO: 3184260 - RNA, 20 nt, Mycobacterium bovis subsp bovis AF2122/97
cgcgugggcgugcaggcugg

SEQ ID NO: 3184261 - RNA, 17 nt, Mycobacterium bovis subsp bovis AF2122/97
cgcgugguaccgcuugu

SEQ ID NO: 3184262 - RNA, 22 nt, Mycobacterium bovis subsp bovis AF2122/97
cgcgugguaccgcuuguccacc

SEQ ID NO: 3184263 - RNA, 16 nt, Mycobacterium bovis subsp bovis AF2122/97
cgcguggucgccccga

SEQ ID NO: 3184264 - RNA, 15 nt, Mycobacterium bovis subsp bovis AF2122/97
cgcguggucgggaac

SEQ ID NO: 3184265 - RNA, 20 nt, Mycobacterium bovis subsp bovis AF2122/97
cgcguggugccuacaccggc

SEQ ID NO: 3184266 - RNA, 21 nt, Mycobacterium bovis subsp bovis AF2122/97
cgcguggugcugaccgcgccg

SEQ ID NO: 3184267 - RNA, 19 nt, Mycobacterium bovis subsp bovis AF2122/97
cgcguguaccgcgacguag

SEQ ID NO: 3184268 - RNA, 18 nt, Mycobacterium bovis subsp bovis AF2122/97
cgcgugugcgucgcacga

SEQ ID NO: 3184269 - RNA, 16 nt, Mycobacterium bovis subsp bovis AF2122/97
cgcguuaugccaggcg

SEQ ID NO: 3184270 - RNA, 18 nt, Mycobacterium bovis subsp bovis AF2122/97
cgcguuaugccaggcgca

SEQ ID NO: 3184271 - RNA, 16 nt, Mycobacterium bovis subsp bovis AF2122/97
cgcguucaggaugcca

SEQ ID NO: 3184272 - RNA, 16 nt, Mycobacterium bovis subsp bovis AF2122/97
cgcguucccacgguuc

SEQ ID NO: 3184273 - RNA, 17 nt, Mycobacterium bovis subsp bovis AF2122/97
cgcguuccuccagcagc

SEQ ID NO: 3184274 - RNA, 14 nt, Mycobacterium bovis subsp bovis AF2122/97
cgcguucgagugcg

SEQ ID NO: 3184275 - RNA, 12 nt, Mycobacterium bovis subsp bovis AF2122/97
cgcguucgcgca

SEQ ID NO: 3184276 - RNA, 13 nt, Mycobacterium bovis subsp bovis AF2122/97
cgcguucgcgcaa

SEQ ID NO: 3184277 - RNA, 13 nt, Mycobacterium bovis subsp bovis AF2122/97
cgcguucggcgcu

SEQ ID NO: 3184278 - RNA, 17 nt, Mycobacterium bovis subsp bovis AF2122/97
cgcguucuccggcaccg

SEQ ID NO: 3184279 - RNA, 16 nt, Mycobacterium bovis subsp bovis AF2122/97
cgcguucucggcaccc

SEQ ID NO: 3184280 - RNA, 14 nt, Mycobacterium bovis subsp bovis AF2122/97
cgcguucugguugu

SEQ ID NO: 3184281 - RNA, 17 nt, Mycobacterium bovis subsp bovis AF2122/97
cgcguugaaggcgccgg

SEQ ID NO: 3184282 - RNA, 20 nt, Mycobacterium bovis subsp bovis AF2122/97
cgcguugaagucgccgguga

SEQ ID NO: 3184283 - RNA, 19 nt, Mycobacterium bovis subsp bovis AF2122/97
cgcguugaccaucacgccc

SEQ ID NO: 3184284 - RNA, 22 nt, Mycobacterium bovis subsp bovis AF2122/97
cgcguugagcucaauggcuucg

SEQ ID NO: 3184285 - RNA, 19 nt, Mycobacterium bovis subsp bovis AF2122/97
cgcguugaugaccgccgcc

SEQ ID NO: 3184286 - RNA, 20 nt, Mycobacterium bovis subsp bovis AF2122/97
cgcguugaugaccgccgccg

SEQ ID NO: 3184287 - RNA, 17 nt, Mycobacterium bovis subsp bovis AF2122/97
cgcguugcacagcagcg

SEQ ID NO: 3184288 - RNA, 15 nt, Mycobacterium bovis subsp bovis AF2122/97
cgcguugccaaagcc

SEQ ID NO: 3184289 - RNA, 17 nt, Mycobacterium bovis subsp bovis AF2122/97
cgcguugccaaagccca

SEQ ID NO: 3184290 - RNA, 12 nt, Mycobacterium bovis subsp bovis AF2122/97
cgcguuggccac

SEQ ID NO: 3184291 - RNA, 14 nt, Mycobacterium bovis subsp bovis AF2122/97
cgcguuggcccgcc

SEQ ID NO: 3184292 - RNA, 16 nt, Mycobacterium bovis subsp bovis AF2122/97
cgcguuggcccgccug

SEQ ID NO: 3184293 - RNA, 14 nt, Mycobacterium bovis subsp bovis AF2122/97
cgcguugggcaccu

SEQ ID NO: 3184294 - RNA, 23 nt, Mycobacterium bovis subsp bovis AF2122/97
cgcguugggcaccuuggccagga

SEQ ID NO: 3184295 - RNA, 15 nt, Mycobacterium bovis subsp bovis AF2122/97
cgcguuguccgcggc

SEQ ID NO: 3184296 - RNA, 17 nt, Mycobacterium bovis subsp bovis AF2122/97
cgcguuguccgcggcca

SEQ ID NO: 3184297 - RNA, 21 nt, Mycobacterium bovis subsp bovis AF2122/97
cgcguuuauaccucgccgccc

SEQ ID NO: 3184298 - RNA, 20 nt, Mycobacterium bovis subsp bovis AF2122/97
cgcguuucacgaaacccagu

SEQ ID NO: 3184299 - RNA, 22 nt, Mycobacterium bovis subsp bovis AF2122/97
cgcguuucgaaccgcacgguga

SEQ ID NO: 3184300 - RNA, 15 nt, Mycobacterium bovis subsp bovis AF2122/97
cgcguuucgcagccg

SEQ ID NO: 3184301 - RNA, 17 nt, Mycobacterium bovis subsp bovis AF2122/97
cgcguuugcgaagccca

SEQ ID NO: 3184302 - RNA, 20 nt, Mycobacterium bovis subsp bovis AF2122/97
cgcguuuugcaggcccgagu

SEQ ID NO: 3184303 - RNA, 23 nt, Mycobacterium bovis subsp bovis AF2122/97
cgcuaaaacgccagucgagcacc

SEQ ID NO: 3184304 - RNA, 14 nt, Mycobacterium bovis subsp bovis AF2122/97
cgcuaaguccccgc

SEQ ID NO: 3184305 - RNA, 18 nt, Mycobacterium bovis subsp bovis AF2122/97
cgcuaauggauccagccc

SEQ ID NO: 3184306 - RNA, 17 nt, Mycobacterium bovis subsp bovis AF2122/97
cgcuaauugcggccgcc

SEQ ID NO: 3184307 - RNA, 23 nt, Mycobacterium bovis subsp bovis AF2122/97
cgcuaccaacgcaacacgggcgc

SEQ ID NO: 3184308 - RNA, 16 nt, Mycobacterium bovis subsp bovis AF2122/97
cgcuaccagcucacgg

SEQ ID NO: 3184309 - RNA, 15 nt, Mycobacterium bovis subsp bovis AF2122/97
cgcuacccccgaugg

SEQ ID NO: 3184310 - RNA, 19 nt, Mycobacterium bovis subsp bovis AF2122/97
cgcuacccggacagggcgg

SEQ ID NO: 3184311 - RNA, 16 nt, Mycobacterium bovis subsp bovis AF2122/97
cgcuaccgcccgcgcc

SEQ ID NO: 3184312 - RNA, 13 nt, Mycobacterium bovis subsp bovis AF2122/97
cgcuaccgccgga

SEQ ID NO: 3184313 - RNA, 22 nt, Mycobacterium bovis subsp bovis AF2122/97
cgcuaccgucaguagccacgcc

SEQ ID NO: 3184314 - RNA, 15 nt, Mycobacterium bovis subsp bovis AF2122/97
cgcuaccuucuuggc

SEQ ID NO: 3184315 - RNA, 18 nt, Mycobacterium bovis subsp bovis AF2122/97
cgcuaccuucuuggcugc

SEQ ID NO: 3184316 - RNA, 21 nt, Mycobacterium bovis subsp bovis AF2122/97
cgcuacgcaacgggucggguc

SEQ ID NO: 3184317 - RNA, 20 nt, Mycobacterium bovis subsp bovis AF2122/97
cgcuacgcgcgcucgcucac

SEQ ID NO: 3184318 - RNA, 13 nt, Mycobacterium bovis subsp bovis AF2122/97
cgcuacgcggccg

SEQ ID NO: 3184319 - RNA, 13 nt, Mycobacterium bovis subsp bovis AF2122/97
cgcuacggcagcc

SEQ ID NO: 3184320 - RNA, 19 nt, Mycobacterium bovis subsp bovis AF2122/97
cgcuacgucaagccgugcu

SEQ ID NO: 3184321 - RNA, 20 nt, Mycobacterium bovis subsp bovis AF2122/97
cgcuagccagggaucagccg

SEQ ID NO: 3184322 - RNA, 14 nt, Mycobacterium bovis subsp bovis AF2122/97
cgcuagcccaccac

SEQ ID NO: 3184323 - RNA, 18 nt, Mycobacterium bovis subsp bovis AF2122/97
cgcuagccgggcgcgccg

SEQ ID NO: 3184324 - RNA, 19 nt, Mycobacterium bovis subsp bovis AF2122/97
cgcuagcgccaaauccggc

SEQ ID NO: 3184325 - RNA, 15 nt, Mycobacterium bovis subsp bovis AF2122/97
cgcuagcgccgcgcu

SEQ ID NO: 3184326 - RNA, 23 nt, Mycobacterium bovis subsp bovis AF2122/97
cgcuagcggauucagcgucgcca

SEQ ID NO: 3184327 - RNA, 19 nt, Mycobacterium bovis subsp bovis AF2122/97
cgcuaggaccgcgguggcc

SEQ ID NO: 3184328 - RNA, 20 nt, Mycobacterium bovis subsp bovis AF2122/97
cgcuaggacggcgcgagccg

SEQ ID NO: 3184329 - RNA, 20 nt, Mycobacterium bovis subsp bovis AF2122/97
cgcuaggacggcugccguca

SEQ ID NO: 3184330 - RNA, 24 nt, Mycobacterium bovis subsp bovis AF2122/97
cgcuaggacggcugccgucagccg

SEQ ID NO: 3184331 - RNA, 15 nt, Mycobacterium bovis subsp bovis AF2122/97
cgcuagggugagccc

SEQ ID NO: 3184332 - RNA, 14 nt, Mycobacterium bovis subsp bovis AF2122/97
cgcuaggucaggug

SEQ ID NO: 3184333 - RNA, 18 nt, Mycobacterium bovis subsp bovis AF2122/97
cgcuaggugacgccgcca

SEQ ID NO: 3184334 - RNA, 23 nt, Mycobacterium bovis subsp bovis AF2122/97
cgcuaggugcaacaggcgcgucg

SEQ ID NO: 3184335 - RNA, 15 nt, Mycobacterium bovis subsp bovis AF2122/97
cgcuagucgucggcg

SEQ ID NO: 3184336 - RNA, 12 nt, Mycobacterium bovis subsp bovis AF2122/97
cgcuaucaccgc

SEQ ID NO: 3184337 - RNA, 18 nt, Mycobacterium bovis subsp bovis AF2122/97
cgcuauccaggccgucag

SEQ ID NO: 3184338 - RNA, 15 nt, Mycobacterium bovis subsp bovis AF2122/97
cgcuauccggcggcc

SEQ ID NO: 3184339 - RNA, 16 nt, Mycobacterium bovis subsp bovis AF2122/97
cgcuauccggcggcca

SEQ ID NO: 3184340 - RNA, 22 nt, Mycobacterium bovis subsp bovis AF2122/97
cgcuaucgugcgccgacggugc

SEQ ID NO: 3184341 - RNA, 20 nt, Mycobacterium bovis subsp bovis AF2122/97
cgcuauggcccgggccgaag

SEQ ID NO: 3184342 - RNA, 18 nt, Mycobacterium bovis subsp bovis AF2122/97
cgcuauggcggcuucgac

SEQ ID NO: 3184343 - RNA, 22 nt, Mycobacterium bovis subsp bovis AF2122/97
cgcucaacaaucgguggucgua

SEQ ID NO: 3184344 - RNA, 16 nt, Mycobacterium bovis subsp bovis AF2122/97
cgcucaacgggccgca

SEQ ID NO: 3184345 - RNA, 19 nt, Mycobacterium bovis subsp bovis AF2122/97
cgcucaacgggccgcaucg

SEQ ID NO: 3184346 - RNA, 19 nt, Mycobacterium bovis subsp bovis AF2122/97
cgcucaaugaucgcggcgg

SEQ ID NO: 3184347 - RNA, 17 nt, Mycobacterium bovis subsp bovis AF2122/97
cgcucaccaccgaccuc

SEQ ID NO: 3184348 - RNA, 15 nt, Mycobacterium bovis subsp bovis AF2122/97
cgcucaccccgcgcu

SEQ ID NO: 3184349 - RNA, 18 nt, Mycobacterium bovis subsp bovis AF2122/97
cgcucacccgcccggaac

SEQ ID NO: 3184350 - RNA, 15 nt, Mycobacterium bovis subsp bovis AF2122/97
cgcucacccgccgcg

SEQ ID NO: 3184351 - RNA, 20 nt, Mycobacterium bovis subsp bovis AF2122/97
cgcucacccggcgucucgca

SEQ ID NO: 3184352 - RNA, 14 nt, Mycobacterium bovis subsp bovis AF2122/97
cgcucacccgguua

SEQ ID NO: 3184353 - RNA, 13 nt, Mycobacterium bovis subsp bovis AF2122/97
cgcucaccggcgu

SEQ ID NO: 3184354 - RNA, 14 nt, Mycobacterium bovis subsp bovis AF2122/97
cgcucaccggcguc

SEQ ID NO: 3184355 - RNA, 15 nt, Mycobacterium bovis subsp bovis AF2122/97
cgcucaccggcgucg

SEQ ID NO: 3184356 - RNA, 21 nt, Mycobacterium bovis subsp bovis AF2122/97
cgcucaccuuuggccgcgacc

SEQ ID NO: 3184357 - RNA, 14 nt, Mycobacterium bovis subsp bovis AF2122/97
cgcucacgaagacc

SEQ ID NO: 3184358 - RNA, 17 nt, Mycobacterium bovis subsp bovis AF2122/97
cgcucacgcucacccgg

SEQ ID NO: 3184359 - RNA, 20 nt, Mycobacterium bovis subsp bovis AF2122/97
cgcucacugcagcgccucga

SEQ ID NO: 3184360 - RNA, 16 nt, Mycobacterium bovis subsp bovis AF2122/97
cgcucagcgcggccac

SEQ ID NO: 3184361 - RNA, 17 nt, Mycobacterium bovis subsp bovis AF2122/97
cgcucagcgcggccacg

SEQ ID NO: 3184362 - RNA, 18 nt, Mycobacterium bovis subsp bovis AF2122/97
cgcucagcgcggccacgc

SEQ ID NO: 3184363 - RNA, 11 nt, Mycobacterium bovis subsp bovis AF2122/97
cgcucagggug

SEQ ID NO: 3184364 - RNA, 19 nt, Mycobacterium bovis subsp bovis AF2122/97
cgcucagggugcgccgcag

SEQ ID NO: 3184365 - RNA, 17 nt, Mycobacterium bovis subsp bovis AF2122/97
cgcucauaggccggcgg

SEQ ID NO: 3184366 - RNA, 12 nt, Mycobacterium bovis subsp bovis AF2122/97
cgcucaucgacc

SEQ ID NO: 3184367 - RNA, 13 nt, Mycobacterium bovis subsp bovis AF2122/97
cgcucaucgaccg

SEQ ID NO: 3184368 - RNA, 15 nt, Mycobacterium bovis subsp bovis AF2122/97
cgcucaucgaccgcg

SEQ ID NO: 3184369 - RNA, 17 nt, Mycobacterium bovis subsp bovis AF2122/97
cgcucaucgaccggggc

SEQ ID NO: 3184370 - RNA, 15 nt, Mycobacterium bovis subsp bovis AF2122/97
cgcucaucgcggcga

SEQ ID NO: 3184371 - RNA, 21 nt, Mycobacterium bovis subsp bovis AF2122/97
cgcucaucugcgcgcggaagc

SEQ ID NO: 3184372 - RNA, 21 nt, Mycobacterium bovis subsp bovis AF2122/97
cgcucaucuguaaccuccucg

SEQ ID NO: 3184373 - RNA, 22 nt, Mycobacterium bovis subsp bovis AF2122/97
cgcucaucuguaaccuccucga

SEQ ID NO: 3184374 - RNA, 19 nt, Mycobacterium bovis subsp bovis AF2122/97
cgcucaugaccgcucggag

SEQ ID NO: 3184375 - RNA, 20 nt, Mycobacterium bovis subsp bovis AF2122/97
cgcucauguucucgaccgcg

SEQ ID NO: 3184376 - RNA, 22 nt, Mycobacterium bovis subsp bovis AF2122/97
cgcucauguucucgaccgcguc

SEQ ID NO: 3184377 - RNA, 18 nt, Mycobacterium bovis subsp bovis AF2122/97
cgcucauucgugcccggg

SEQ ID NO: 3184378 - RNA, 21 nt, Mycobacterium bovis subsp bovis AF2122/97
cgcucauucgugcccgggcgg

SEQ ID NO: 3184379 - RNA, 22 nt, Mycobacterium bovis subsp bovis AF2122/97
cgcucauucgugcccgggcggu

SEQ ID NO: 3184380 - RNA, 15 nt, Mycobacterium bovis subsp bovis AF2122/97
cgcuccaaaagccuc

SEQ ID NO: 3184381 - RNA, 20 nt, Mycobacterium bovis subsp bovis AF2122/97
cgcuccaaaagccucagccg

SEQ ID NO: 3184382 - RNA, 15 nt, Mycobacterium bovis subsp bovis AF2122/97
cgcuccaacaacucc

SEQ ID NO: 3184383 - RNA, 17 nt, Mycobacterium bovis subsp bovis AF2122/97
cgcuccaacaacuccag

SEQ ID NO: 3184384 - RNA, 18 nt, Mycobacterium bovis subsp bovis AF2122/97
cgcuccaacacccgccgg

SEQ ID NO: 3184385 - RNA, 19 nt, Mycobacterium bovis subsp bovis AF2122/97
cgcuccaccacgaccgcga

SEQ ID NO: 3184386 - RNA, 18 nt, Mycobacterium bovis subsp bovis AF2122/97
cgcuccaccucggcguug

SEQ ID NO: 3184387 - RNA, 13 nt, Mycobacterium bovis subsp bovis AF2122/97
cgcuccagcaccc

SEQ ID NO: 3184388 - RNA, 15 nt, Mycobacterium bovis subsp bovis AF2122/97
cgcuccagccgcgcg

SEQ ID NO: 3184389 - RNA, 20 nt, Mycobacterium bovis subsp bovis AF2122/97
cgcuccagccgcgcguccgg

SEQ ID NO: 3184390 - RNA, 19 nt, Mycobacterium bovis subsp bovis AF2122/97
cgcuccagcucggccagug

SEQ ID NO: 3184391 - RNA, 21 nt, Mycobacterium bovis subsp bovis AF2122/97
cgcuccagcucggccagugcc

SEQ ID NO: 3184392 - RNA, 19 nt, Mycobacterium bovis subsp bovis AF2122/97
cgcuccagcugagcggccg

SEQ ID NO: 3184393 - RNA, 21 nt, Mycobacterium bovis subsp bovis AF2122/97
cgcuccagcugagcggccggc

SEQ ID NO: 3184394 - RNA, 15 nt, Mycobacterium bovis subsp bovis AF2122/97
cgcuccaggucgaca

SEQ ID NO: 3184395 - RNA, 21 nt, Mycobacterium bovis subsp bovis AF2122/97
cgcuccaguggcgccagggcc

SEQ ID NO: 3184396 - RNA, 23 nt, Mycobacterium bovis subsp bovis AF2122/97
cgcuccauaucgucgggcguccc

SEQ ID NO: 3184397 - RNA, 18 nt, Mycobacterium bovis subsp bovis AF2122/97
cgcucccccgccaacccc

SEQ ID NO: 3184398 - RNA, 13 nt, Mycobacterium bovis subsp bovis AF2122/97
cgcucccccgcua

SEQ ID NO: 3184399 - RNA, 21 nt, Mycobacterium bovis subsp bovis AF2122/97
cgcucccccgcuacgcgcgcu

SEQ ID NO: 3184400 - RNA, 22 nt, Mycobacterium bovis subsp bovis AF2122/97
cgcucccugcacccagccgugc

SEQ ID NO: 3184401 - RNA, 13 nt, Mycobacterium bovis subsp bovis AF2122/97
cgcuccgaccggu

SEQ ID NO: 3184402 - RNA, 15 nt, Mycobacterium bovis subsp bovis AF2122/97
cgcuccgaccggugg

SEQ ID NO: 3184403 - RNA, 13 nt, Mycobacterium bovis subsp bovis AF2122/97
cgcuccgccgggu

SEQ ID NO: 3184404 - RNA, 18 nt, Mycobacterium bovis subsp bovis AF2122/97
cgcuccgccgucgccgcc

SEQ ID NO: 3184405 - RNA, 21 nt, Mycobacterium bovis subsp bovis AF2122/97
cgcuccgccgucgccgccggc

SEQ ID NO: 3184406 - RNA, 13 nt, Mycobacterium bovis subsp bovis AF2122/97
cgcuccgcggcgc

SEQ ID NO: 3184407 - RNA, 15 nt, Mycobacterium bovis subsp bovis AF2122/97
cgcuccggcccugcc

SEQ ID NO: 3184408 - RNA, 18 nt, Mycobacterium bovis subsp bovis AF2122/97
cgcuccggcccugccgcc

SEQ ID NO: 3184409 - RNA, 13 nt, Mycobacterium bovis subsp bovis AF2122/97
cgcuccggcgcga

SEQ ID NO: 3184410 - RNA, 23 nt, Mycobacterium bovis subsp bovis AF2122/97
cgcuccgggaauggcgaccaccc

SEQ ID NO: 3184411 - RNA, 18 nt, Mycobacterium bovis subsp bovis AF2122/97
cgcuccuccggcaccaac

SEQ ID NO: 3184412 - RNA, 19 nt, Mycobacterium bovis subsp bovis AF2122/97
cgcuccuccggcaccaacg

SEQ ID NO: 3184413 - RNA, 20 nt, Mycobacterium bovis subsp bovis AF2122/97
cgcuccuucagggcgucgaa

SEQ ID NO: 3184414 - RNA, 22 nt, Mycobacterium bovis subsp bovis AF2122/97
cgcuccuugugccugcuguucc

SEQ ID NO: 3184415 - RNA, 17 nt, Mycobacterium bovis subsp bovis AF2122/97
cgcucgaaaaccucgga

SEQ ID NO: 3184416 - RNA, 21 nt, Mycobacterium bovis subsp bovis AF2122/97
cgcucgaaagcgucgaucacc

SEQ ID NO: 3184417 - RNA, 20 nt, Mycobacterium bovis subsp bovis AF2122/97
cgcucgaaauccugguggca

SEQ ID NO: 3184418 - RNA, 15 nt, Mycobacterium bovis subsp bovis AF2122/97
cgcucgaacuccccg

SEQ ID NO: 3184419 - RNA, 15 nt, Mycobacterium bovis subsp bovis AF2122/97
cgcucgaccagacgc

SEQ ID NO: 3184420 - RNA, 18 nt, Mycobacterium bovis subsp bovis AF2122/97
cgcucgaccccgcgcugg

SEQ ID NO: 3184421 - RNA, 18 nt, Mycobacterium bovis subsp bovis AF2122/97
cgcucgacgacgggcgcc

SEQ ID NO: 3184422 - RNA, 21 nt, Mycobacterium bovis subsp bovis AF2122/97
cgcucgacgacgggcgccaac

SEQ ID NO: 3184423 - RNA, 15 nt, Mycobacterium bovis subsp bovis AF2122/97
cgcucgacggcccgc

SEQ ID NO: 3184424 - RNA, 16 nt, Mycobacterium bovis subsp bovis AF2122/97
cgcucgacggcccgcc

SEQ ID NO: 3184425 - RNA, 22 nt, Mycobacterium bovis subsp bovis AF2122/97
cgcucgacguacagcgcggcgu

SEQ ID NO: 3184426 - RNA, 19 nt, Mycobacterium bovis subsp bovis AF2122/97
cgcucgagcagcgcgccgu

SEQ ID NO: 3184427 - RNA, 16 nt, Mycobacterium bovis subsp bovis AF2122/97
cgcucgagguggucuc

SEQ ID NO: 3184428 - RNA, 13 nt, Mycobacterium bovis subsp bovis AF2122/97
cgcucgaucaggu

SEQ ID NO: 3184429 - RNA, 15 nt, Mycobacterium bovis subsp bovis AF2122/97
cgcucgaucggcagc

SEQ ID NO: 3184430 - RNA, 24 nt, Mycobacterium bovis subsp bovis AF2122/97
cgcucgaucggcagccagggcgcc

SEQ ID NO: 3184431 - RNA, 16 nt, Mycobacterium bovis subsp bovis AF2122/97
cgcucgauggcggcca

SEQ ID NO: 3184432 - RNA, 19 nt, Mycobacterium bovis subsp bovis AF2122/97
cgcucgauggcggccacca

SEQ ID NO: 3184433 - RNA, 22 nt, Mycobacterium bovis subsp bovis AF2122/97
cgcucgaugucccgagcccgcu

SEQ ID NO: 3184434 - RNA, 19 nt, Mycobacterium bovis subsp bovis AF2122/97
cgcucgaugucggucgggu

SEQ ID NO: 3184435 - RNA, 19 nt, Mycobacterium bovis subsp bovis AF2122/97
cgcucgcacccgcucggcg

SEQ ID NO: 3184436 - RNA, 12 nt, Mycobacterium bovis subsp bovis AF2122/97
cgcucgcaccgc

SEQ ID NO: 3184437 - RNA, 18 nt, Mycobacterium bovis subsp bovis AF2122/97
cgcucgcaccgcccgccg

SEQ ID NO: 3184438 - RNA, 13 nt, Mycobacterium bovis subsp bovis AF2122/97
cgcucgcaggccg

SEQ ID NO: 3184439 - RNA, 14 nt, Mycobacterium bovis subsp bovis AF2122/97
cgcucgcaggccgg

SEQ ID NO: 3184440 - RNA, 14 nt, Mycobacterium bovis subsp bovis AF2122/97
cgcucgcccgccgc

SEQ ID NO: 3184441 - RNA, 15 nt, Mycobacterium bovis subsp bovis AF2122/97
cgcucgcccgccgcc

SEQ ID NO: 3184442 - RNA, 21 nt, Mycobacterium bovis subsp bovis AF2122/97
cgcucgcccgccgccaccagc

SEQ ID NO: 3184443 - RNA, 20 nt, Mycobacterium bovis subsp bovis AF2122/97
cgcucgccgguaggcggcca

SEQ ID NO: 3184444 - RNA, 23 nt, Mycobacterium bovis subsp bovis AF2122/97
cgcucgccgguaggcggccagcg

SEQ ID NO: 3184445 - RNA, 13 nt, Mycobacterium bovis subsp bovis AF2122/97
cgcucgccguuuc

SEQ ID NO: 3184446 - RNA, 15 nt, Mycobacterium bovis subsp bovis AF2122/97
cgcucgccucgaugg

SEQ ID NO: 3184447 - RNA, 19 nt, Mycobacterium bovis subsp bovis AF2122/97
cgcucgcgcaagcggaccc

SEQ ID NO: 3184448 - RNA, 15 nt, Mycobacterium bovis subsp bovis AF2122/97
cgcucgcgccagguc

SEQ ID NO: 3184449 - RNA, 16 nt, Mycobacterium bovis subsp bovis AF2122/97
cgcucgcgccaggucg

SEQ ID NO: 3184450 - RNA, 12 nt, Mycobacterium bovis subsp bovis AF2122/97
cgcucgcgcgcu

SEQ ID NO: 3184451 - RNA, 14 nt, Mycobacterium bovis subsp bovis AF2122/97
cgcucgcgcgcugg

SEQ ID NO: 3184452 - RNA, 21 nt, Mycobacterium bovis subsp bovis AF2122/97
cgcucgcgcgcugggcgcgcu

SEQ ID NO: 3184453 - RNA, 15 nt, Mycobacterium bovis subsp bovis AF2122/97
cgcucgcggauuggc

SEQ ID NO: 3184454 - RNA, 12 nt, Mycobacterium bovis subsp bovis AF2122/97
cgcucgcggcgg

SEQ ID NO: 3184455 - RNA, 14 nt, Mycobacterium bovis subsp bovis AF2122/97
cgcucgcggcggcg

SEQ ID NO: 3184456 - RNA, 17 nt, Mycobacterium bovis subsp bovis AF2122/97
cgcucgcggcggcgcug

SEQ ID NO: 3184457 - RNA, 22 nt, Mycobacterium bovis subsp bovis AF2122/97
cgcucgcggcggcgcuggcggg

SEQ ID NO: 3184458 - RNA, 14 nt, Mycobacterium bovis subsp bovis AF2122/97
cgcucgcucaccgg

SEQ ID NO: 3184459 - RNA, 16 nt, Mycobacterium bovis subsp bovis AF2122/97
cgcucgcucaccggcg

SEQ ID NO: 3184460 - RNA, 20 nt, Mycobacterium bovis subsp bovis AF2122/97
cgcucggagaucgccacuac

SEQ ID NO: 3184461 - RNA, 12 nt, Mycobacterium bovis subsp bovis AF2122/97
cgcucggaguug

SEQ ID NO: 3184462 - RNA, 20 nt, Mycobacterium bovis subsp bovis AF2122/97
cgcucggaguugagcugucg

SEQ ID NO: 3184463 - RNA, 20 nt, Mycobacterium bovis subsp bovis AF2122/97
cgcucggcaaccugcgacca

SEQ ID NO: 3184464 - RNA, 13 nt, Mycobacterium bovis subsp bovis AF2122/97
cgcucggcagccg

SEQ ID NO: 3184465 - RNA, 18 nt, Mycobacterium bovis subsp bovis AF2122/97
cgcucggcagccggcuug

SEQ ID NO: 3184466 - RNA, 18 nt, Mycobacterium bovis subsp bovis AF2122/97
cgcucggccagcaucagc

SEQ ID NO: 3184467 - RNA, 18 nt, Mycobacterium bovis subsp bovis AF2122/97
cgcucggccauagcgccg

SEQ ID NO: 3184468 - RNA, 15 nt, Mycobacterium bovis subsp bovis AF2122/97
cgcucggccgcagcc

SEQ ID NO: 3184469 - RNA, 14 nt, Mycobacterium bovis subsp bovis AF2122/97
cgcucggccgccgg

SEQ ID NO: 3184470 - RNA, 16 nt, Mycobacterium bovis subsp bovis AF2122/97
cgcucggccgccgggu

SEQ ID NO: 3184471 - RNA, 17 nt, Mycobacterium bovis subsp bovis AF2122/97
cgcucggccgccggguc

SEQ ID NO: 3184472 - RNA, 12 nt, Mycobacterium bovis subsp bovis AF2122/97
cgcucggccugc

SEQ ID NO: 3184473 - RNA, 19 nt, Mycobacterium bovis subsp bovis AF2122/97
cgcucggccugcugcugca

SEQ ID NO: 3184474 - RNA, 15 nt, Mycobacterium bovis subsp bovis AF2122/97
cgcucggcgagcuca

SEQ ID NO: 3184475 - RNA, 20 nt, Mycobacterium bovis subsp bovis AF2122/97
cgcucggcgaucugcguuug

SEQ ID NO: 3184476 - RNA, 14 nt, Mycobacterium bovis subsp bovis AF2122/97
cgcucggcgcgcgg

SEQ ID NO: 3184477 - RNA, 15 nt, Mycobacterium bovis subsp bovis AF2122/97
cgcucggcgcgcggg

SEQ ID NO: 3184478 - RNA, 16 nt, Mycobacterium bovis subsp bovis AF2122/97
cgcucggcgcgcgggu

SEQ ID NO: 3184479 - RNA, 22 nt, Mycobacterium bovis subsp bovis AF2122/97
cgcucggcggggaccgcgguca

SEQ ID NO: 3184480 - RNA, 14 nt, Mycobacterium bovis subsp bovis AF2122/97
cgcucggcggucgg

SEQ ID NO: 3184481 - RNA, 13 nt, Mycobacterium bovis subsp bovis AF2122/97
cgcucggcguccg

SEQ ID NO: 3184482 - RNA, 16 nt, Mycobacterium bovis subsp bovis AF2122/97
cgcucggcgugucggg

SEQ ID NO: 3184483 - RNA, 19 nt, Mycobacterium bovis subsp bovis AF2122/97
cgcucgggcaacgccucga

SEQ ID NO: 3184484 - RNA, 15 nt, Mycobacterium bovis subsp bovis AF2122/97
cgcucgggcgcgagg

SEQ ID NO: 3184485 - RNA, 15 nt, Mycobacterium bovis subsp bovis AF2122/97
cgcucgggcgcgcuc

SEQ ID NO: 3184486 - RNA, 18 nt, Mycobacterium bovis subsp bovis AF2122/97
cgcucgggguugcucgcg

SEQ ID NO: 3184487 - RNA, 15 nt, Mycobacterium bovis subsp bovis AF2122/97
cgcucgguccagccg

SEQ ID NO: 3184488 - RNA, 22 nt, Mycobacterium bovis subsp bovis AF2122/97
cgcucgguccccgcagcucgac

SEQ ID NO: 3184489 - RNA, 14 nt, Mycobacterium bovis subsp bovis AF2122/97
cgcucggucgccac

SEQ ID NO: 3184490 - RNA, 17 nt, Mycobacterium bovis subsp bovis AF2122/97
cgcucggucgccaccgc

SEQ ID NO: 3184491 - RNA, 19 nt, Mycobacterium bovis subsp bovis AF2122/97
cgcucggucgccaccgccg

SEQ ID NO: 3184492 - RNA, 21 nt, Mycobacterium bovis subsp bovis AF2122/97
cgcucggucgccaccgccggc

SEQ ID NO: 3184493 - RNA, 23 nt, Mycobacterium bovis subsp bovis AF2122/97
cgcucggucgccaccgccggcag

SEQ ID NO: 3184494 - RNA, 22 nt, Mycobacterium bovis subsp bovis AF2122/97
cgcucggucuccaccaccgacg

SEQ ID NO: 3184495 - RNA, 14 nt, Mycobacterium bovis subsp bovis AF2122/97
cgcucggugccgcc

SEQ ID NO: 3184496 - RNA, 17 nt, Mycobacterium bovis subsp bovis AF2122/97
cgcucggugcugcgccg

SEQ ID NO: 3184497 - RNA, 18 nt, Mycobacterium bovis subsp bovis AF2122/97
cgcucggugcugcgccga

SEQ ID NO: 3184498 - RNA, 22 nt, Mycobacterium bovis subsp bovis AF2122/97
cgcucggugcugcgccgauacg

SEQ ID NO: 3184499 - RNA, 12 nt, Mycobacterium bovis subsp bovis AF2122/97
cgcucgguuugc

SEQ ID NO: 3184500 - RNA, 19 nt, Mycobacterium bovis subsp bovis AF2122/97
cgcucguagaaucggcuca

SEQ ID NO: 3184501 - RNA, 16 nt, Mycobacterium bovis subsp bovis AF2122/97
cgcucguagacuuccu

SEQ ID NO: 3184502 - RNA, 18 nt, Mycobacterium bovis subsp bovis AF2122/97
cgcucgucgaaguagccg

SEQ ID NO: 3184503 - RNA, 21 nt, Mycobacterium bovis subsp bovis AF2122/97
cgcucgucgaccggcccccgg

SEQ ID NO: 3184504 - RNA, 13 nt, Mycobacterium bovis subsp bovis AF2122/97
cgcucgucgaucu

SEQ ID NO: 3184505 - RNA, 16 nt, Mycobacterium bovis subsp bovis AF2122/97
cgcucgucgccggugg

SEQ ID NO: 3184506 - RNA, 14 nt, Mycobacterium bovis subsp bovis AF2122/97
cgcucgucgcggcc

SEQ ID NO: 3184507 - RNA, 18 nt, Mycobacterium bovis subsp bovis AF2122/97
cgcucgucgcggcccgcg

SEQ ID NO: 3184508 - RNA, 16 nt, Mycobacterium bovis subsp bovis AF2122/97
cgcucgucgucaccga

SEQ ID NO: 3184509 - RNA, 18 nt, Mycobacterium bovis subsp bovis AF2122/97
cgcucgucguccggccac

SEQ ID NO: 3184510 - RNA, 24 nt, Mycobacterium bovis subsp bovis AF2122/97
cgcucgucguccggccacgguccg

SEQ ID NO: 3184511 - RNA, 23 nt, Mycobacterium bovis subsp bovis AF2122/97
cgcucguggucgacgugaucgcg

SEQ ID NO: 3184512 - RNA, 19 nt, Mycobacterium bovis subsp bovis AF2122/97
cgcucguuagcggcgggca

SEQ ID NO: 3184513 - RNA, 19 nt, Mycobacterium bovis subsp bovis AF2122/97
cgcucguugcguugcauca

SEQ ID NO: 3184514 - RNA, 20 nt, Mycobacterium bovis subsp bovis AF2122/97
cgcucguugguucagcucga

SEQ ID NO: 3184515 - RNA, 22 nt, Mycobacterium bovis subsp bovis AF2122/97
cgcucguugguucagcucgagg

SEQ ID NO: 3184516 - RNA, 19 nt, Mycobacterium bovis subsp bovis AF2122/97
cgcucguuugcgagcaggg

SEQ ID NO: 3184517 - RNA, 18 nt, Mycobacterium bovis subsp bovis AF2122/97
cgcucucauagcgacggc

SEQ ID NO: 3184518 - RNA, 17 nt, Mycobacterium bovis subsp bovis AF2122/97
cgcucucggucaguucc

SEQ ID NO: 3184519 - RNA, 19 nt, Mycobacterium bovis subsp bovis AF2122/97
cgcucugcgccacagcagc

SEQ ID NO: 3184520 - RNA, 23 nt, Mycobacterium bovis subsp bovis AF2122/97
cgcucugcgccacagcagcguug

SEQ ID NO: 3184521 - RNA, 12 nt, Mycobacterium bovis subsp bovis AF2122/97
cgcucugcgcgg

SEQ ID NO: 3184522 - RNA, 14 nt, Mycobacterium bovis subsp bovis AF2122/97
cgcucugcgcggcu

SEQ ID NO: 3184523 - RNA, 13 nt, Mycobacterium bovis subsp bovis AF2122/97
cgcucugcggcca

SEQ ID NO: 3184524 - RNA, 15 nt, Mycobacterium bovis subsp bovis AF2122/97
cgcucugcggccacg

SEQ ID NO: 3184525 - RNA, 16 nt, Mycobacterium bovis subsp bovis AF2122/97
cgcucugcggccacgc

SEQ ID NO: 3184526 - RNA, 14 nt, Mycobacterium bovis subsp bovis AF2122/97
cgcucugcugaaau

SEQ ID NO: 3184527 - RNA, 18 nt, Mycobacterium bovis subsp bovis AF2122/97
cgcucuggugucgucggu

SEQ ID NO: 3184528 - RNA, 21 nt, Mycobacterium bovis subsp bovis AF2122/97
cgcucugugucgccgaucacc

SEQ ID NO: 3184529 - RNA, 22 nt, Mycobacterium bovis subsp bovis AF2122/97
cgcucugugucgccgaucaccg

SEQ ID NO: 3184530 - RNA, 13 nt, Mycobacterium bovis subsp bovis AF2122/97
cgcucuucgaugg

SEQ ID NO: 3184531 - RNA, 23 nt, Mycobacterium bovis subsp bovis AF2122/97
cgcucuucuccagauguccgacg

SEQ ID NO: 3184532 - RNA, 15 nt, Mycobacterium bovis subsp bovis AF2122/97
cgcucuugaauagga

SEQ ID NO: 3184533 - RNA, 14 nt, Mycobacterium bovis subsp bovis AF2122/97
cgcugaaaucggug

SEQ ID NO: 3184534 - RNA, 22 nt, Mycobacterium bovis subsp bovis AF2122/97
cgcugaaaucgguggccaccac

SEQ ID NO: 3184535 - RNA, 21 nt, Mycobacterium bovis subsp bovis AF2122/97
cgcugaacagacggcucagcg

SEQ ID NO: 3184536 - RNA, 14 nt, Mycobacterium bovis subsp bovis AF2122/97
cgcugaacucaacg

SEQ ID NO: 3184537 - RNA, 18 nt, Mycobacterium bovis subsp bovis AF2122/97
cgcugaagccgacgaucc

SEQ ID NO: 3184538 - RNA, 21 nt, Mycobacterium bovis subsp bovis AF2122/97
cgcugaaggccgguagcgcgg

SEQ ID NO: 3184539 - RNA, 19 nt, Mycobacterium bovis subsp bovis AF2122/97
cgcugaaucaccccggcgg

SEQ ID NO: 3184540 - RNA, 14 nt, Mycobacterium bovis subsp bovis AF2122/97
cgcugaaugcgccg

SEQ ID NO: 3184541 - RNA, 22 nt, Mycobacterium bovis subsp bovis AF2122/97
cgcugaauuccacugcgccaca

SEQ ID NO: 3184542 - RNA, 18 nt, Mycobacterium bovis subsp bovis AF2122/97
cgcugaccacaaccguga

SEQ ID NO: 3184543 - RNA, 13 nt, Mycobacterium bovis subsp bovis AF2122/97
cgcugaccaucac

SEQ ID NO: 3184544 - RNA, 19 nt, Mycobacterium bovis subsp bovis AF2122/97
cgcugacccgggccgggcc

SEQ ID NO: 3184545 - RNA, 14 nt, Mycobacterium bovis subsp bovis AF2122/97
cgcugaccgcguag

SEQ ID NO: 3184546 - RNA, 23 nt, Mycobacterium bovis subsp bovis AF2122/97
cgcugaccgcuaccagcugggcg

SEQ ID NO: 3184547 - RNA, 21 nt, Mycobacterium bovis subsp bovis AF2122/97
cgcugaccguuucgaucucga

SEQ ID NO: 3184548 - RNA, 22 nt, Mycobacterium bovis subsp bovis AF2122/97
cgcugaccuuguugaccaccac

SEQ ID NO: 3184549 - RNA, 18 nt, Mycobacterium bovis subsp bovis AF2122/97
cgcugaccuuuucccgca

SEQ ID NO: 3184550 - RNA, 21 nt, Mycobacterium bovis subsp bovis AF2122/97
cgcugaccuuuucccgcaggc

SEQ ID NO: 3184551 - RNA, 13 nt, Mycobacterium bovis subsp bovis AF2122/97
cgcugacgacccu

SEQ ID NO: 3184552 - RNA, 19 nt, Mycobacterium bovis subsp bovis AF2122/97
cgcugacuagggucaccga

SEQ ID NO: 3184553 - RNA, 22 nt, Mycobacterium bovis subsp bovis AF2122/97
cgcugacuccugcggcaccgcu

SEQ ID NO: 3184554 - RNA, 14 nt, Mycobacterium bovis subsp bovis AF2122/97
cgcugagcacggcg

SEQ ID NO: 3184555 - RNA, 22 nt, Mycobacterium bovis subsp bovis AF2122/97
cgcugagcacggcgcggcggag

SEQ ID NO: 3184556 - RNA, 14 nt, Mycobacterium bovis subsp bovis AF2122/97
cgcugagcagcgcc

SEQ ID NO: 3184557 - RNA, 18 nt, Mycobacterium bovis subsp bovis AF2122/97
cgcugagcagcgccgcgu

SEQ ID NO: 3184558 - RNA, 15 nt, Mycobacterium bovis subsp bovis AF2122/97
cgcugagcccugcgc

SEQ ID NO: 3184559 - RNA, 16 nt, Mycobacterium bovis subsp bovis AF2122/97
cgcugagcccugcgcc

SEQ ID NO: 3184560 - RNA, 13 nt, Mycobacterium bovis subsp bovis AF2122/97
cgcugagcgacug

SEQ ID NO: 3184561 - RNA, 21 nt, Mycobacterium bovis subsp bovis AF2122/97
cgcugagcgacugcagcggcg

SEQ ID NO: 3184562 - RNA, 17 nt, Mycobacterium bovis subsp bovis AF2122/97
cgcugaggaagcggcgg

SEQ ID NO: 3184563 - RNA, 18 nt, Mycobacterium bovis subsp bovis AF2122/97
cgcugaggaagcggcggc

SEQ ID NO: 3184564 - RNA, 19 nt, Mycobacterium bovis subsp bovis AF2122/97
cgcugaggaagcggcggca

SEQ ID NO: 3184565 - RNA, 22 nt, Mycobacterium bovis subsp bovis AF2122/97
cgcugagguggcggugcggcga

SEQ ID NO: 3184566 - RNA, 17 nt, Mycobacterium bovis subsp bovis AF2122/97
cgcugaguccccaggug

SEQ ID NO: 3184567 - RNA, 17 nt, Mycobacterium bovis subsp bovis AF2122/97
cgcugauagcggucggu

SEQ ID NO: 3184568 - RNA, 22 nt, Mycobacterium bovis subsp bovis AF2122/97
cgcugauagcggucggucacca

SEQ ID NO: 3184569 - RNA, 18 nt, Mycobacterium bovis subsp bovis AF2122/97
cgcugaucagauccucga

SEQ ID NO: 3184570 - RNA, 20 nt, Mycobacterium bovis subsp bovis AF2122/97
cgcugaucagcaugcggcca

SEQ ID NO: 3184571 - RNA, 14 nt, Mycobacterium bovis subsp bovis AF2122/97
cgcugaucagccca

SEQ ID NO: 3184572 - RNA, 22 nt, Mycobacterium bovis subsp bovis AF2122/97
cgcugaucaggucuucgauggc

SEQ ID NO: 3184573 - RNA, 15 nt, Mycobacterium bovis subsp bovis AF2122/97
cgcugaucggcaggg

SEQ ID NO: 3184574 - RNA, 17 nt, Mycobacterium bovis subsp bovis AF2122/97
cgcugaucugccgccgc

SEQ ID NO: 3184575 - RNA, 20 nt, Mycobacterium bovis subsp bovis AF2122/97
cgcugaucugccgccgcggc

SEQ ID NO: 3184576 - RNA, 20 nt, Mycobacterium bovis subsp bovis AF2122/97
cgcugaucuggggcaccacg

SEQ ID NO: 3184577 - RNA, 21 nt, Mycobacterium bovis subsp bovis AF2122/97
cgcugaucuuccccucggccg

SEQ ID NO: 3184578 - RNA, 20 nt, Mycobacterium bovis subsp bovis AF2122/97
cgcugaugaccguauagccg

SEQ ID NO: 3184579 - RNA, 22 nt, Mycobacterium bovis subsp bovis AF2122/97
cgcugaugcuggccauguucgg

SEQ ID NO: 3184580 - RNA, 20 nt, Mycobacterium bovis subsp bovis AF2122/97
cgcugauggugcugcggcgu

SEQ ID NO: 3184581 - RNA, 16 nt, Mycobacterium bovis subsp bovis AF2122/97
cgcugauugcggucgu

SEQ ID NO: 3184582 - RNA, 15 nt, Mycobacterium bovis subsp bovis AF2122/97
cgcugcaaccgccgg

SEQ ID NO: 3184583 - RNA, 21 nt, Mycobacterium bovis subsp bovis AF2122/97
cgcugcaaccgccggugccga

SEQ ID NO: 3184584 - RNA, 16 nt, Mycobacterium bovis subsp bovis AF2122/97
cgcugcaccgggucaa

SEQ ID NO: 3184585 - RNA, 23 nt, Mycobacterium bovis subsp bovis AF2122/97
cgcugcaccgggucaacgccauc

SEQ ID NO: 3184586 - RNA, 15 nt, Mycobacterium bovis subsp bovis AF2122/97
cgcugcacgacaucg

SEQ ID NO: 3184587 - RNA, 12 nt, Mycobacterium bovis subsp bovis AF2122/97
cgcugcacgugg

SEQ ID NO: 3184588 - RNA, 17 nt, Mycobacterium bovis subsp bovis AF2122/97
cgcugcacguggccacg

SEQ ID NO: 3184589 - RNA, 20 nt, Mycobacterium bovis subsp bovis AF2122/97
cgcugcagacgccccuuccc

SEQ ID NO: 3184590 - RNA, 17 nt, Mycobacterium bovis subsp bovis AF2122/97
cgcugcagcaccgcagc

SEQ ID NO: 3184591 - RNA, 18 nt, Mycobacterium bovis subsp bovis AF2122/97
cgcugcagcugcucgucg

SEQ ID NO: 3184592 - RNA, 15 nt, Mycobacterium bovis subsp bovis AF2122/97
cgcugcaggcggccg

SEQ ID NO: 3184593 - RNA, 16 nt, Mycobacterium bovis subsp bovis AF2122/97
cgcugcaggcggccga

SEQ ID NO: 3184594 - RNA, 19 nt, Mycobacterium bovis subsp bovis AF2122/97
cgcugcagugguaccggcg

SEQ ID NO: 3184595 - RNA, 21 nt, Mycobacterium bovis subsp bovis AF2122/97
cgcugcagugguaccggcgcc

SEQ ID NO: 3184596 - RNA, 22 nt, Mycobacterium bovis subsp bovis AF2122/97
cgcugcagugguaccggcgccg

SEQ ID NO: 3184597 - RNA, 17 nt, Mycobacterium bovis subsp bovis AF2122/97
cgcugcauacaaccccg

SEQ ID NO: 3184598 - RNA, 23 nt, Mycobacterium bovis subsp bovis AF2122/97
cgcugcauacaaccccgcgcugu

SEQ ID NO: 3184599 - RNA, 14 nt, Mycobacterium bovis subsp bovis AF2122/97
cgcugcauccgcag

SEQ ID NO: 3184600 - RNA, 21 nt, Mycobacterium bovis subsp bovis AF2122/97
cgcugcauccgcagcaccaag

SEQ ID NO: 3184601 - RNA, 13 nt, Mycobacterium bovis subsp bovis AF2122/97
cgcugccacccau

SEQ ID NO: 3184602 - RNA, 20 nt, Mycobacterium bovis subsp bovis AF2122/97
cgcugccacccaucgcacgg

SEQ ID NO: 3184603 - RNA, 12 nt, Mycobacterium bovis subsp bovis AF2122/97
cgcugccaccgc

SEQ ID NO: 3184604 - RNA, 13 nt, Mycobacterium bovis subsp bovis AF2122/97
cgcugccaccgcg

SEQ ID NO: 3184605 - RNA, 17 nt, Mycobacterium bovis subsp bovis AF2122/97
cgcugccagccguuccc

SEQ ID NO: 3184606 - RNA, 13 nt, Mycobacterium bovis subsp bovis AF2122/97
cgcugccagcggc

SEQ ID NO: 3184607 - RNA, 14 nt, Mycobacterium bovis subsp bovis AF2122/97
cgcugccagcggcc

SEQ ID NO: 3184608 - RNA, 15 nt, Mycobacterium bovis subsp bovis AF2122/97
cgcugccagcggccg

SEQ ID NO: 3184609 - RNA, 18 nt, Mycobacterium bovis subsp bovis AF2122/97
cgcugccagggugcgccg

SEQ ID NO: 3184610 - RNA, 15 nt, Mycobacterium bovis subsp bovis AF2122/97
cgcugccaucgccuu

SEQ ID NO: 3184611 - RNA, 14 nt, Mycobacterium bovis subsp bovis AF2122/97
cgcugcccacgggc

SEQ ID NO: 3184612 - RNA, 19 nt, Mycobacterium bovis subsp bovis AF2122/97
cgcugcccacgggccggcc

SEQ ID NO: 3184613 - RNA, 20 nt, Mycobacterium bovis subsp bovis AF2122/97
cgcugcccacgggccggccg

SEQ ID NO: 3184614 - RNA, 19 nt, Mycobacterium bovis subsp bovis AF2122/97
cgcugcccaucacacccgg

SEQ ID NO: 3184615 - RNA, 20 nt, Mycobacterium bovis subsp bovis AF2122/97
cgcugcccaucacacccggu

SEQ ID NO: 3184616 - RNA, 21 nt, Mycobacterium bovis subsp bovis AF2122/97
cgcugcccaucacacccggua

SEQ ID NO: 3184617 - RNA, 14 nt, Mycobacterium bovis subsp bovis AF2122/97
cgcugcccaugcgg

SEQ ID NO: 3184618 - RNA, 13 nt, Mycobacterium bovis subsp bovis AF2122/97
cgcugcccgccgc

SEQ ID NO: 3184619 - RNA, 16 nt, Mycobacterium bovis subsp bovis AF2122/97
cgcugcccgcgcggcc

SEQ ID NO: 3184620 - RNA, 12 nt, Mycobacterium bovis subsp bovis AF2122/97
cgcugcccgcgg

SEQ ID NO: 3184621 - RNA, 15 nt, Mycobacterium bovis subsp bovis AF2122/97
cgcugcccgggcugc

SEQ ID NO: 3184622 - RNA, 19 nt, Mycobacterium bovis subsp bovis AF2122/97
cgcugcccgggcugccgcc

SEQ ID NO: 3184623 - RNA, 20 nt, Mycobacterium bovis subsp bovis AF2122/97
cgcugccgaagcggccaccg

SEQ ID NO: 3184624 - RNA, 21 nt, Mycobacterium bovis subsp bovis AF2122/97
cgcugccgaagcggccaccgc

SEQ ID NO: 3184625 - RNA, 14 nt, Mycobacterium bovis subsp bovis AF2122/97
cgcugccgacgcgu

SEQ ID NO: 3184626 - RNA, 14 nt, Mycobacterium bovis subsp bovis AF2122/97
cgcugccgaucagu

SEQ ID NO: 3184627 - RNA, 21 nt, Mycobacterium bovis subsp bovis AF2122/97
cgcugccgaucaguccggcgu

SEQ ID NO: 3184628 - RNA, 19 nt, Mycobacterium bovis subsp bovis AF2122/97
cgcugccgccaggcucgag

SEQ ID NO: 3184629 - RNA, 14 nt, Mycobacterium bovis subsp bovis AF2122/97
cgcugccgcccgcg

SEQ ID NO: 3184630 - RNA, 16 nt, Mycobacterium bovis subsp bovis AF2122/97
cgcugccgcccuugcc

SEQ ID NO: 3184631 - RNA, 15 nt, Mycobacterium bovis subsp bovis AF2122/97
cgcugccgccgagcu

SEQ ID NO: 3184632 - RNA, 15 nt, Mycobacterium bovis subsp bovis AF2122/97
cgcugccgccgaucg

SEQ ID NO: 3184633 - RNA, 18 nt, Mycobacterium bovis subsp bovis AF2122/97
cgcugccgccgaucgaca

SEQ ID NO: 3184634 - RNA, 22 nt, Mycobacterium bovis subsp bovis AF2122/97
cgcugccgccgaucgacacccg

SEQ ID NO: 3184635 - RNA, 14 nt, Mycobacterium bovis subsp bovis AF2122/97
cgcugccgccgccg

SEQ ID NO: 3184636 - RNA, 16 nt, Mycobacterium bovis subsp bovis AF2122/97
cgcugccgccgccggc

SEQ ID NO: 3184637 - RNA, 18 nt, Mycobacterium bovis subsp bovis AF2122/97
cgcugccgccgccggcgg

SEQ ID NO: 3184638 - RNA, 12 nt, Mycobacterium bovis subsp bovis AF2122/97
cgcugccgccgg

SEQ ID NO: 3184639 - RNA, 15 nt, Mycobacterium bovis subsp bovis AF2122/97
cgcugccgccgucgc

SEQ ID NO: 3184640 - RNA, 14 nt, Mycobacterium bovis subsp bovis AF2122/97
cgcugccggcacgc

SEQ ID NO: 3184641 - RNA, 13 nt, Mycobacterium bovis subsp bovis AF2122/97
cgcugccggccgc

SEQ ID NO: 3184642 - RNA, 14 nt, Mycobacterium bovis subsp bovis AF2122/97
cgcugccggccgcg

SEQ ID NO: 3184643 - RNA, 18 nt, Mycobacterium bovis subsp bovis AF2122/97
cgcugccggcgccgccac

SEQ ID NO: 3184644 - RNA, 21 nt, Mycobacterium bovis subsp bovis AF2122/97
cgcugccgggauccuccgggu

SEQ ID NO: 3184645 - RNA, 14 nt, Mycobacterium bovis subsp bovis AF2122/97
cgcugccgguggcg

SEQ ID NO: 3184646 - RNA, 16 nt, Mycobacterium bovis subsp bovis AF2122/97
cgcugccggugucucc

SEQ ID NO: 3184647 - RNA, 14 nt, Mycobacterium bovis subsp bovis AF2122/97
cgcugccgguguug

SEQ ID NO: 3184648 - RNA, 21 nt, Mycobacterium bovis subsp bovis AF2122/97
cgcugccgucggagaccagcu

SEQ ID NO: 3184649 - RNA, 23 nt, Mycobacterium bovis subsp bovis AF2122/97
cgcugccgucggagaccagcucg

SEQ ID NO: 3184650 - RNA, 18 nt, Mycobacterium bovis subsp bovis AF2122/97
cgcugccucuugcucggc

SEQ ID NO: 3184651 - RNA, 21 nt, Mycobacterium bovis subsp bovis AF2122/97
cgcugccucuugcucggcgug

SEQ ID NO: 3184652 - RNA, 22 nt, Mycobacterium bovis subsp bovis AF2122/97
cgcugccucuugcucggcgugc

SEQ ID NO: 3184653 - RNA, 23 nt, Mycobacterium bovis subsp bovis AF2122/97
cgcugccucuugcucggcgugcu

SEQ ID NO: 3184654 - RNA, 15 nt, Mycobacterium bovis subsp bovis AF2122/97
cgcugccuggccggg

SEQ ID NO: 3184655 - RNA, 18 nt, Mycobacterium bovis subsp bovis AF2122/97
cgcugccuggccgggacc

SEQ ID NO: 3184656 - RNA, 14 nt, Mycobacterium bovis subsp bovis AF2122/97
cgcugccuucuuug

SEQ ID NO: 3184657 - RNA, 22 nt, Mycobacterium bovis subsp bovis AF2122/97
cgcugccuucuuugccggcgcc

SEQ ID NO: 3184658 - RNA, 16 nt, Mycobacterium bovis subsp bovis AF2122/97
cgcugccuuggcgcgg

SEQ ID NO: 3184659 - RNA, 18 nt, Mycobacterium bovis subsp bovis AF2122/97
cgcugcgaaagcacgugc

SEQ ID NO: 3184660 - RNA, 18 nt, Mycobacterium bovis subsp bovis AF2122/97
cgcugcgagaucgcggcg

SEQ ID NO: 3184661 - RNA, 14 nt, Mycobacterium bovis subsp bovis AF2122/97
cgcugcgcaccgcc

SEQ ID NO: 3184662 - RNA, 15 nt, Mycobacterium bovis subsp bovis AF2122/97
cgcugcgcaccgccg

SEQ ID NO: 3184663 - RNA, 20 nt, Mycobacterium bovis subsp bovis AF2122/97
cgcugcgccaggucagcucc

SEQ ID NO: 3184664 - RNA, 13 nt, Mycobacterium bovis subsp bovis AF2122/97
cgcugcgcccgga

SEQ ID NO: 3184665 - RNA, 18 nt, Mycobacterium bovis subsp bovis AF2122/97
cgcugcgccgaggcauug

SEQ ID NO: 3184666 - RNA, 20 nt, Mycobacterium bovis subsp bovis AF2122/97
cgcugcgccgucgcagccag

SEQ ID NO: 3184667 - RNA, 18 nt, Mycobacterium bovis subsp bovis AF2122/97
cgcugcgcgacugauccu

SEQ ID NO: 3184668 - RNA, 17 nt, Mycobacterium bovis subsp bovis AF2122/97
cgcugcgcgccagacac

SEQ ID NO: 3184669 - RNA, 14 nt, Mycobacterium bovis subsp bovis AF2122/97
cgcugcgcgcccac

SEQ ID NO: 3184670 - RNA, 21 nt, Mycobacterium bovis subsp bovis AF2122/97
cgcugcggaucguggcgcccg

SEQ ID NO: 3184671 - RNA, 15 nt, Mycobacterium bovis subsp bovis AF2122/97
cgcugcggcaccacc

SEQ ID NO: 3184672 - RNA, 17 nt, Mycobacterium bovis subsp bovis AF2122/97
cgcugcggcaccacccg

SEQ ID NO: 3184673 - RNA, 21 nt, Mycobacterium bovis subsp bovis AF2122/97
cgcugcggcaccacccggcga

SEQ ID NO: 3184674 - RNA, 13 nt, Mycobacterium bovis subsp bovis AF2122/97
cgcugcggcaccg

SEQ ID NO: 3184675 - RNA, 16 nt, Mycobacterium bovis subsp bovis AF2122/97
cgcugcggccagcgcg

SEQ ID NO: 3184676 - RNA, 18 nt, Mycobacterium bovis subsp bovis AF2122/97
cgcugcggcccacaccag

SEQ ID NO: 3184677 - RNA, 22 nt, Mycobacterium bovis subsp bovis AF2122/97
cgcugcggcccacaccagcgca

SEQ ID NO: 3184678 - RNA, 12 nt, Mycobacterium bovis subsp bovis AF2122/97
cgcugcggcccg

SEQ ID NO: 3184679 - RNA, 12 nt, Mycobacterium bovis subsp bovis AF2122/97
cgcugcggcgcu

SEQ ID NO: 3184680 - RNA, 13 nt, Mycobacterium bovis subsp bovis AF2122/97
cgcugcggcggcu

SEQ ID NO: 3184681 - RNA, 16 nt, Mycobacterium bovis subsp bovis AF2122/97
cgcugcggcggcuuug

SEQ ID NO: 3184682 - RNA, 22 nt, Mycobacterium bovis subsp bovis AF2122/97
cgcugcggcggcuuuggccgcc

SEQ ID NO: 3184683 - RNA, 18 nt, Mycobacterium bovis subsp bovis AF2122/97
cgcugcggguagccgucg

SEQ ID NO: 3184684 - RNA, 19 nt, Mycobacterium bovis subsp bovis AF2122/97
cgcugcggguagccgucga

SEQ ID NO: 3184685 - RNA, 15 nt, Mycobacterium bovis subsp bovis AF2122/97
cgcugcgggucccaa

SEQ ID NO: 3184686 - RNA, 21 nt, Mycobacterium bovis subsp bovis AF2122/97
cgcugcgggucgaagcgaucc

SEQ ID NO: 3184687 - RNA, 17 nt, Mycobacterium bovis subsp bovis AF2122/97
cgcugcggugccggccc

SEQ ID NO: 3184688 - RNA, 18 nt, Mycobacterium bovis subsp bovis AF2122/97
cgcugcggugccggcccu

SEQ ID NO: 3184689 - RNA, 16 nt, Mycobacterium bovis subsp bovis AF2122/97
cgcugcggugggccag

SEQ ID NO: 3184690 - RNA, 18 nt, Mycobacterium bovis subsp bovis AF2122/97
cgcugcggugggccaggu

SEQ ID NO: 3184691 - RNA, 13 nt, Mycobacterium bovis subsp bovis AF2122/97
cgcugcgucgugg

SEQ ID NO: 3184692 - RNA, 13 nt, Mycobacterium bovis subsp bovis AF2122/97
cgcugcucacgca

SEQ ID NO: 3184693 - RNA, 15 nt, Mycobacterium bovis subsp bovis AF2122/97
cgcugcucuggacgg

SEQ ID NO: 3184694 - RNA, 22 nt, Mycobacterium bovis subsp bovis AF2122/97
cgcugcugaacaaccagcaugg

SEQ ID NO: 3184695 - RNA, 19 nt, Mycobacterium bovis subsp bovis AF2122/97
cgcugcugccauugccgau

SEQ ID NO: 3184696 - RNA, 20 nt, Mycobacterium bovis subsp bovis AF2122/97
cgcugcugccgcaccggugc

SEQ ID NO: 3184697 - RNA, 14 nt, Mycobacterium bovis subsp bovis AF2122/97
cgcugcugcgaucg

SEQ ID NO: 3184698 - RNA, 16 nt, Mycobacterium bovis subsp bovis AF2122/97
cgcugcugcgaucgcc

SEQ ID NO: 3184699 - RNA, 14 nt, Mycobacterium bovis subsp bovis AF2122/97
cgcugcugcgggug

SEQ ID NO: 3184700 - RNA, 14 nt, Mycobacterium bovis subsp bovis AF2122/97
cgcugcugucgauu

SEQ ID NO: 3184701 - RNA, 21 nt, Mycobacterium bovis subsp bovis AF2122/97
cgcugcuugaggucccgugcg

SEQ ID NO: 3184702 - RNA, 22 nt, Mycobacterium bovis subsp bovis AF2122/97
cgcugcuugaggucccgugcgc

SEQ ID NO: 3184703 - RNA, 14 nt, Mycobacterium bovis subsp bovis AF2122/97
cgcugcuugcgggc

SEQ ID NO: 3184704 - RNA, 22 nt, Mycobacterium bovis subsp bovis AF2122/97
cgcuggaaaccucuucgggugc

SEQ ID NO: 3184705 - RNA, 21 nt, Mycobacterium bovis subsp bovis AF2122/97
cgcuggacaguuacgcuggca

SEQ ID NO: 3184706 - RNA, 23 nt, Mycobacterium bovis subsp bovis AF2122/97
cgcuggacaguuacgcuggcaca

SEQ ID NO: 3184707 - RNA, 14 nt, Mycobacterium bovis subsp bovis AF2122/97
cgcuggaccggguc

SEQ ID NO: 3184708 - RNA, 14 nt, Mycobacterium bovis subsp bovis AF2122/97
cgcuggaccugaug

SEQ ID NO: 3184709 - RNA, 16 nt, Mycobacterium bovis subsp bovis AF2122/97
cgcuggacggcgggcc

SEQ ID NO: 3184710 - RNA, 17 nt, Mycobacterium bovis subsp bovis AF2122/97
cgcuggaggcuccuggu

SEQ ID NO: 3184711 - RNA, 18 nt, Mycobacterium bovis subsp bovis AF2122/97
cgcuggaggcuccugguc

SEQ ID NO: 3184712 - RNA, 19 nt, Mycobacterium bovis subsp bovis AF2122/97
cgcuggaggcuccuggucg

SEQ ID NO: 3184713 - RNA, 17 nt, Mycobacterium bovis subsp bovis AF2122/97
cgcuggaucaacccggc

SEQ ID NO: 3184714 - RNA, 19 nt, Mycobacterium bovis subsp bovis AF2122/97
cgcuggaucgacuucggug

SEQ ID NO: 3184715 - RNA, 13 nt, Mycobacterium bovis subsp bovis AF2122/97
cgcuggaucgcgu

SEQ ID NO: 3184716 - RNA, 17 nt, Mycobacterium bovis subsp bovis AF2122/97
cgcuggaucgugcuggu

SEQ ID NO: 3184717 - RNA, 22 nt, Mycobacterium bovis subsp bovis AF2122/97
cgcuggaucuucgacaggccac

SEQ ID NO: 3184718 - RNA, 20 nt, Mycobacterium bovis subsp bovis AF2122/97
cgcuggaugugggcgcucgc

SEQ ID NO: 3184719 - RNA, 21 nt, Mycobacterium bovis subsp bovis AF2122/97
cgcuggcaaucccgcggucga

SEQ ID NO: 3184720 - RNA, 21 nt, Mycobacterium bovis subsp bovis AF2122/97
cgcuggcacacuccugcacca

SEQ ID NO: 3184721 - RNA, 20 nt, Mycobacterium bovis subsp bovis AF2122/97
cgcuggcaggccgggcacca

SEQ ID NO: 3184722 - RNA, 15 nt, Mycobacterium bovis subsp bovis AF2122/97
cgcuggcauaucccu

SEQ ID NO: 3184723 - RNA, 11 nt, Mycobacterium bovis subsp bovis AF2122/97
cgcuggccacg

SEQ ID NO: 3184724 - RNA, 18 nt, Mycobacterium bovis subsp bovis AF2122/97
cgcuggccacgauccgcg

SEQ ID NO: 3184725 - RNA, 19 nt, Mycobacterium bovis subsp bovis AF2122/97
cgcuggccacgauccgcgg

SEQ ID NO: 3184726 - RNA, 17 nt, Mycobacterium bovis subsp bovis AF2122/97
cgcuggccagcacaccg

SEQ ID NO: 3184727 - RNA, 20 nt, Mycobacterium bovis subsp bovis AF2122/97
cgcuggccagcacaccgucg

SEQ ID NO: 3184728 - RNA, 20 nt, Mycobacterium bovis subsp bovis AF2122/97
cgcuggccaugguggcgccg

SEQ ID NO: 3184729 - RNA, 23 nt, Mycobacterium bovis subsp bovis AF2122/97
cgcuggccaugguggcgccgacg

SEQ ID NO: 3184730 - RNA, 12 nt, Mycobacterium bovis subsp bovis AF2122/97
cgcuggcccgcc

SEQ ID NO: 3184731 - RNA, 15 nt, Mycobacterium bovis subsp bovis AF2122/97
cgcuggcccgccaga

SEQ ID NO: 3184732 - RNA, 20 nt, Mycobacterium bovis subsp bovis AF2122/97
cgcuggcccgccagaacggc

SEQ ID NO: 3184733 - RNA, 15 nt, Mycobacterium bovis subsp bovis AF2122/97
cgcuggcccggcgcu

SEQ ID NO: 3184734 - RNA, 13 nt, Mycobacterium bovis subsp bovis AF2122/97
cgcuggccggcac

SEQ ID NO: 3184735 - RNA, 19 nt, Mycobacterium bovis subsp bovis AF2122/97
cgcuggccgucgaagacga

SEQ ID NO: 3184736 - RNA, 20 nt, Mycobacterium bovis subsp bovis AF2122/97
cgcuggccgucgaagacgaa

SEQ ID NO: 3184737 - RNA, 17 nt, Mycobacterium bovis subsp bovis AF2122/97
cgcuggccuccagcuug

SEQ ID NO: 3184738 - RNA, 22 nt, Mycobacterium bovis subsp bovis AF2122/97
cgcuggccucgucgcugcccau

SEQ ID NO: 3184739 - RNA, 19 nt, Mycobacterium bovis subsp bovis AF2122/97
cgcuggcgagcagacgcga

SEQ ID NO: 3184740 - RNA, 14 nt, Mycobacterium bovis subsp bovis AF2122/97
cgcuggcgcccccg

SEQ ID NO: 3184741 - RNA, 21 nt, Mycobacterium bovis subsp bovis AF2122/97
cgcuggcgcccccgacgacgg

SEQ ID NO: 3184742 - RNA, 19 nt, Mycobacterium bovis subsp bovis AF2122/97
cgcuggcgcccuugccggc

SEQ ID NO: 3184743 - RNA, 20 nt, Mycobacterium bovis subsp bovis AF2122/97
cgcuggcgcccuugccggcg

SEQ ID NO: 3184744 - RNA, 13 nt, Mycobacterium bovis subsp bovis AF2122/97
cgcuggcgccgcc

SEQ ID NO: 3184745 - RNA, 23 nt, Mycobacterium bovis subsp bovis AF2122/97
cgcuggcgccggccagccagcga

SEQ ID NO: 3184746 - RNA, 16 nt, Mycobacterium bovis subsp bovis AF2122/97
cgcuggcggcgcagcg

SEQ ID NO: 3184747 - RNA, 22 nt, Mycobacterium bovis subsp bovis AF2122/97
cgcuggcgggcgaucgcggcga

SEQ ID NO: 3184748 - RNA, 14 nt, Mycobacterium bovis subsp bovis AF2122/97
cgcuggcgggcggc

SEQ ID NO: 3184749 - RNA, 20 nt, Mycobacterium bovis subsp bovis AF2122/97
cgcuggcgguguagccgcgg

SEQ ID NO: 3184750 - RNA, 20 nt, Mycobacterium bovis subsp bovis AF2122/97
cgcuggcuacccaccggccg

SEQ ID NO: 3184751 - RNA, 21 nt, Mycobacterium bovis subsp bovis AF2122/97
cgcuggcuacccaccggccgg

SEQ ID NO: 3184752 - RNA, 14 nt, Mycobacterium bovis subsp bovis AF2122/97
cgcuggcucaucga

SEQ ID NO: 3184753 - RNA, 16 nt, Mycobacterium bovis subsp bovis AF2122/97
cgcuggcugacaccga

SEQ ID NO: 3184754 - RNA, 14 nt, Mycobacterium bovis subsp bovis AF2122/97
cgcuggcuugggcc

SEQ ID NO: 3184755 - RNA, 20 nt, Mycobacterium bovis subsp bovis AF2122/97
cgcugggacaacgugccgaa

SEQ ID NO: 3184756 - RNA, 13 nt, Mycobacterium bovis subsp bovis AF2122/97
cgcugggacgggc

SEQ ID NO: 3184757 - RNA, 16 nt, Mycobacterium bovis subsp bovis AF2122/97
cgcugggacgggcgcg

SEQ ID NO: 3184758 - RNA, 19 nt, Mycobacterium bovis subsp bovis AF2122/97
cgcugggacgggcgcgucg

SEQ ID NO: 3184759 - RNA, 20 nt, Mycobacterium bovis subsp bovis AF2122/97
cgcugggacgggcgcgucgg

SEQ ID NO: 3184760 - RNA, 22 nt, Mycobacterium bovis subsp bovis AF2122/97
cgcugggacgggcgcgucggcg

SEQ ID NO: 3184761 - RNA, 16 nt, Mycobacterium bovis subsp bovis AF2122/97
cgcugggacggucgcu

SEQ ID NO: 3184762 - RNA, 21 nt, Mycobacterium bovis subsp bovis AF2122/97
cgcugggacggucgcucggca

SEQ ID NO: 3184763 - RNA, 22 nt, Mycobacterium bovis subsp bovis AF2122/97
cgcugggacggucgcucggcau

SEQ ID NO: 3184764 - RNA, 19 nt, Mycobacterium bovis subsp bovis AF2122/97
cgcugggaggcgcggucga

SEQ ID NO: 3184765 - RNA, 21 nt, Mycobacterium bovis subsp bovis AF2122/97
cgcugggaggcgcggucgacc

SEQ ID NO: 3184766 - RNA, 16 nt, Mycobacterium bovis subsp bovis AF2122/97
cgcugggcacucggcc

SEQ ID NO: 3184767 - RNA, 16 nt, Mycobacterium bovis subsp bovis AF2122/97
cgcugggcccgagcgc

SEQ ID NO: 3184768 - RNA, 13 nt, Mycobacterium bovis subsp bovis AF2122/97
cgcugggccgacc

SEQ ID NO: 3184769 - RNA, 15 nt, Mycobacterium bovis subsp bovis AF2122/97
cgcugggccgaccgc

SEQ ID NO: 3184770 - RNA, 16 nt, Mycobacterium bovis subsp bovis AF2122/97
cgcugggccgaccgcc

SEQ ID NO: 3184771 - RNA, 13 nt, Mycobacterium bovis subsp bovis AF2122/97
cgcugggccgggg

SEQ ID NO: 3184772 - RNA, 13 nt, Mycobacterium bovis subsp bovis AF2122/97
cgcugggcgcaac

SEQ ID NO: 3184773 - RNA, 13 nt, Mycobacterium bovis subsp bovis AF2122/97
cgcugggcgccgu

SEQ ID NO: 3184774 - RNA, 19 nt, Mycobacterium bovis subsp bovis AF2122/97
cgcugggcgcgcucaucga

SEQ ID NO: 3184775 - RNA, 22 nt, Mycobacterium bovis subsp bovis AF2122/97
cgcugggcgcgcucaucgaccg

SEQ ID NO: 3184776 - RNA, 14 nt, Mycobacterium bovis subsp bovis AF2122/97
cgcugggcgguagc

SEQ ID NO: 3184777 - RNA, 21 nt, Mycobacterium bovis subsp bovis AF2122/97
cgcuggggcuguagucgaugu

SEQ ID NO: 3184778 - RNA, 16 nt, Mycobacterium bovis subsp bovis AF2122/97
cgcugggggcggucgc

SEQ ID NO: 3184779 - RNA, 18 nt, Mycobacterium bovis subsp bovis AF2122/97
cgcugggguccgcgucgg

SEQ ID NO: 3184780 - RNA, 21 nt, Mycobacterium bovis subsp bovis AF2122/97
cgcuggguccccucccaccag

SEQ ID NO: 3184781 - RNA, 22 nt, Mycobacterium bovis subsp bovis AF2122/97
cgcugggucgugucgccacacc

SEQ ID NO: 3184782 - RNA, 18 nt, Mycobacterium bovis subsp bovis AF2122/97
cgcugggugaccaggaag

SEQ ID NO: 3184783 - RNA, 15 nt, Mycobacterium bovis subsp bovis AF2122/97
cgcuggguggcgggc

SEQ ID NO: 3184784 - RNA, 21 nt, Mycobacterium bovis subsp bovis AF2122/97
cgcuggguggcgggccggaug

SEQ ID NO: 3184785 - RNA, 19 nt, Mycobacterium bovis subsp bovis AF2122/97
cgcugguaguguucagcuu

SEQ ID NO: 3184786 - RNA, 22 nt, Mycobacterium bovis subsp bovis AF2122/97
cgcugguauagcucacgguggc

SEQ ID NO: 3184787 - RNA, 19 nt, Mycobacterium bovis subsp bovis AF2122/97
cgcuggucaacuccacgcg

SEQ ID NO: 3184788 - RNA, 17 nt, Mycobacterium bovis subsp bovis AF2122/97
cgcuggucagccgugcc

SEQ ID NO: 3184789 - RNA, 17 nt, Mycobacterium bovis subsp bovis AF2122/97
cgcuggucgaugccuuc

SEQ ID NO: 3184790 - RNA, 19 nt, Mycobacterium bovis subsp bovis AF2122/97
cgcuggucggagaccagcg

SEQ ID NO: 3184791 - RNA, 16 nt, Mycobacterium bovis subsp bovis AF2122/97
cgcuggucggcggcuu

SEQ ID NO: 3184792 - RNA, 17 nt, Mycobacterium bovis subsp bovis AF2122/97
cgcuggucggcggcuuc

SEQ ID NO: 3184793 - RNA, 20 nt, Mycobacterium bovis subsp bovis AF2122/97
cgcuggucggcuaccgccga

SEQ ID NO: 3184794 - RNA, 18 nt, Mycobacterium bovis subsp bovis AF2122/97
cgcuggugaaccacucgg

SEQ ID NO: 3184795 - RNA, 14 nt, Mycobacterium bovis subsp bovis AF2122/97
cgcuggugcacggc

SEQ ID NO: 3184796 - RNA, 19 nt, Mycobacterium bovis subsp bovis AF2122/97
cgcuggugcgccacgccac

SEQ ID NO: 3184797 - RNA, 20 nt, Mycobacterium bovis subsp bovis AF2122/97
cgcuggugcgccacgccacc

SEQ ID NO: 3184798 - RNA, 22 nt, Mycobacterium bovis subsp bovis AF2122/97
cgcuggugcgccacgccaccgc

SEQ ID NO: 3184799 - RNA, 16 nt, Mycobacterium bovis subsp bovis AF2122/97
cgcugguggcggcgac

SEQ ID NO: 3184800 - RNA, 14 nt, Mycobacterium bovis subsp bovis AF2122/97
cgcugguggugauu

SEQ ID NO: 3184801 - RNA, 19 nt, Mycobacterium bovis subsp bovis AF2122/97
cgcuggugguucccgacau

SEQ ID NO: 3184802 - RNA, 19 nt, Mycobacterium bovis subsp bovis AF2122/97
cgcugguuugcuucucccg

SEQ ID NO: 3184803 - RNA, 13 nt, Mycobacterium bovis subsp bovis AF2122/97
cgcuguaaccggu

SEQ ID NO: 3184804 - RNA, 14 nt, Mycobacterium bovis subsp bovis AF2122/97
cgcuguaaccggua

SEQ ID NO: 3184805 - RNA, 18 nt, Mycobacterium bovis subsp bovis AF2122/97
cgcuguaagcaugccguu

SEQ ID NO: 3184806 - RNA, 14 nt, Mycobacterium bovis subsp bovis AF2122/97
cgcuguaggcagcc

SEQ ID NO: 3184807 - RNA, 16 nt, Mycobacterium bovis subsp bovis AF2122/97
cgcuguaggccagccc

SEQ ID NO: 3184808 - RNA, 14 nt, Mycobacterium bovis subsp bovis AF2122/97
cgcuguagucgcgc

SEQ ID NO: 3184809 - RNA, 20 nt, Mycobacterium bovis subsp bovis AF2122/97
cgcuguccacugccaccgcg

SEQ ID NO: 3184810 - RNA, 18 nt, Mycobacterium bovis subsp bovis AF2122/97
cgcugucccagcccggcc

SEQ ID NO: 3184811 - RNA, 20 nt, Mycobacterium bovis subsp bovis AF2122/97
cgcugucccgcgggccagca

SEQ ID NO: 3184812 - RNA, 18 nt, Mycobacterium bovis subsp bovis AF2122/97
cgcugucgagccggugcc

SEQ ID NO: 3184813 - RNA, 17 nt, Mycobacterium bovis subsp bovis AF2122/97
cgcugucgaucagcgac

SEQ ID NO: 3184814 - RNA, 12 nt, Mycobacterium bovis subsp bovis AF2122/97
cgcugucgaucu

SEQ ID NO: 3184815 - RNA, 17 nt, Mycobacterium bovis subsp bovis AF2122/97
cgcugucgcccucgauc

SEQ ID NO: 3184816 - RNA, 14 nt, Mycobacterium bovis subsp bovis AF2122/97
cgcugucggcagua

SEQ ID NO: 3184817 - RNA, 15 nt, Mycobacterium bovis subsp bovis AF2122/97
cgcugucggcaguag

SEQ ID NO: 3184818 - RNA, 17 nt, Mycobacterium bovis subsp bovis AF2122/97
cgcugucguaccgcucg

SEQ ID NO: 3184819 - RNA, 19 nt, Mycobacterium bovis subsp bovis AF2122/97
cgcugucguaccgcucggc

SEQ ID NO: 3184820 - RNA, 17 nt, Mycobacterium bovis subsp bovis AF2122/97
cgcugugauagcgccgu

SEQ ID NO: 3184821 - RNA, 12 nt, Mycobacterium bovis subsp bovis AF2122/97
cgcugugcagcg

SEQ ID NO: 3184822 - RNA, 19 nt, Mycobacterium bovis subsp bovis AF2122/97
cgcuguggcgggagaucgu

SEQ ID NO: 3184823 - RNA, 14 nt, Mycobacterium bovis subsp bovis AF2122/97
cgcuguggcucgac

SEQ ID NO: 3184824 - RNA, 15 nt, Mycobacterium bovis subsp bovis AF2122/97
cgcuguggcucgacg

SEQ ID NO: 3184825 - RNA, 19 nt, Mycobacterium bovis subsp bovis AF2122/97
cgcuguuccucgaguucgg

SEQ ID NO: 3184826 - RNA, 21 nt, Mycobacterium bovis subsp bovis AF2122/97
cgcuguuccucgaguucgggc

SEQ ID NO: 3184827 - RNA, 22 nt, Mycobacterium bovis subsp bovis AF2122/97
cgcuguucggucuugccggccu

SEQ ID NO: 3184828 - RNA, 23 nt, Mycobacterium bovis subsp bovis AF2122/97
cgcuguuguggaacaccgcggca

SEQ ID NO: 3184829 - RNA, 22 nt, Mycobacterium bovis subsp bovis AF2122/97
cgcuuaacagcggguccuucug

SEQ ID NO: 3184830 - RNA, 14 nt, Mycobacterium bovis subsp bovis AF2122/97
cgcuuacccagccc

SEQ ID NO: 3184831 - RNA, 15 nt, Mycobacterium bovis subsp bovis AF2122/97
cgcuucacgggccgu

SEQ ID NO: 3184832 - RNA, 24 nt, Mycobacterium bovis subsp bovis AF2122/97
cgcuucacgggccguccaggacgg

SEQ ID NO: 3184833 - RNA, 14 nt, Mycobacterium bovis subsp bovis AF2122/97
cgcuucaggcgcca

SEQ ID NO: 3184834 - RNA, 19 nt, Mycobacterium bovis subsp bovis AF2122/97
cgcuucaugagccgcugcg

SEQ ID NO: 3184835 - RNA, 15 nt, Mycobacterium bovis subsp bovis AF2122/97
cgcuuccaucgccac

SEQ ID NO: 3184836 - RNA, 15 nt, Mycobacterium bovis subsp bovis AF2122/97
cgcuuccguggccca

SEQ ID NO: 3184837 - RNA, 21 nt, Mycobacterium bovis subsp bovis AF2122/97
cgcuuccguggcccaacccgg

SEQ ID NO: 3184838 - RNA, 15 nt, Mycobacterium bovis subsp bovis AF2122/97
cgcuuccucguaggc

SEQ ID NO: 3184839 - RNA, 22 nt, Mycobacterium bovis subsp bovis AF2122/97
cgcuuccugggcacggagaccg

SEQ ID NO: 3184840 - RNA, 17 nt, Mycobacterium bovis subsp bovis AF2122/97
cgcuucgacgucguugc

SEQ ID NO: 3184841 - RNA, 21 nt, Mycobacterium bovis subsp bovis AF2122/97
cgcuucgacgucguugccguc

SEQ ID NO: 3184842 - RNA, 18 nt, Mycobacterium bovis subsp bovis AF2122/97
cgcuucgcaagucaucca

SEQ ID NO: 3184843 - RNA, 20 nt, Mycobacterium bovis subsp bovis AF2122/97
cgcuucgcaagucauccagg

SEQ ID NO: 3184844 - RNA, 14 nt, Mycobacterium bovis subsp bovis AF2122/97
cgcuucgcccuugc

SEQ ID NO: 3184845 - RNA, 22 nt, Mycobacterium bovis subsp bovis AF2122/97
cgcuucggcaccgacugcuguc

SEQ ID NO: 3184846 - RNA, 20 nt, Mycobacterium bovis subsp bovis AF2122/97
cgcuucggcagcucccgcca

SEQ ID NO: 3184847 - RNA, 13 nt, Mycobacterium bovis subsp bovis AF2122/97
cgcuucggccacu

SEQ ID NO: 3184848 - RNA, 16 nt, Mycobacterium bovis subsp bovis AF2122/97
cgcuucggcggucagc

SEQ ID NO: 3184849 - RNA, 19 nt, Mycobacterium bovis subsp bovis AF2122/97
cgcuucgucggccggcacc

SEQ ID NO: 3184850 - RNA, 16 nt, Mycobacterium bovis subsp bovis AF2122/97
cgcuucuuccgcgcgc

SEQ ID NO: 3184851 - RNA, 19 nt, Mycobacterium bovis subsp bovis AF2122/97
cgcuucuuccgcgcgccgg

SEQ ID NO: 3184852 - RNA, 23 nt, Mycobacterium bovis subsp bovis AF2122/97
cgcuucuugguugaacuggcggu

SEQ ID NO: 3184853 - RNA, 21 nt, Mycobacterium bovis subsp bovis AF2122/97
cgcuugaagguucgaucgcgg

SEQ ID NO: 3184854 - RNA, 22 nt, Mycobacterium bovis subsp bovis AF2122/97
cgcuugaagguucgaucgcggu

SEQ ID NO: 3184855 - RNA, 18 nt, Mycobacterium bovis subsp bovis AF2122/97
cgcuugaccccgccgaac

SEQ ID NO: 3184856 - RNA, 14 nt, Mycobacterium bovis subsp bovis AF2122/97
cgcuugacccgcgg

SEQ ID NO: 3184857 - RNA, 22 nt, Mycobacterium bovis subsp bovis AF2122/97
cgcuugaucugggcugcggccg

SEQ ID NO: 3184858 - RNA, 13 nt, Mycobacterium bovis subsp bovis AF2122/97
cgcuugcaccagg

SEQ ID NO: 3184859 - RNA, 17 nt, Mycobacterium bovis subsp bovis AF2122/97
cgcuugccccgccgagc

SEQ ID NO: 3184860 - RNA, 23 nt, Mycobacterium bovis subsp bovis AF2122/97
cgcuugccccgccgagcaccggg

SEQ ID NO: 3184861 - RNA, 20 nt, Mycobacterium bovis subsp bovis AF2122/97
cgcuugccccgccuuggcca

SEQ ID NO: 3184862 - RNA, 17 nt, Mycobacterium bovis subsp bovis AF2122/97
cgcuugcccgcgcagca

SEQ ID NO: 3184863 - RNA, 20 nt, Mycobacterium bovis subsp bovis AF2122/97
cgcuugcgaccccggcugcg

SEQ ID NO: 3184864 - RNA, 21 nt, Mycobacterium bovis subsp bovis AF2122/97
cgcuugcgaccccggcugcgc

SEQ ID NO: 3184865 - RNA, 14 nt, Mycobacterium bovis subsp bovis AF2122/97
cgcuugcgaucggc

SEQ ID NO: 3184866 - RNA, 13 nt, Mycobacterium bovis subsp bovis AF2122/97
cgcuugcggccgc

SEQ ID NO: 3184867 - RNA, 19 nt, Mycobacterium bovis subsp bovis AF2122/97
cgcuugcggccgcgcgccg

SEQ ID NO: 3184868 - RNA, 18 nt, Mycobacterium bovis subsp bovis AF2122/97
cgcuugcggggccgggcg

SEQ ID NO: 3184869 - RNA, 19 nt, Mycobacterium bovis subsp bovis AF2122/97
cgcuugcggggccgggcga

SEQ ID NO: 3184870 - RNA, 22 nt, Mycobacterium bovis subsp bovis AF2122/97
cgcuuggaccguugccgauggu

SEQ ID NO: 3184871 - RNA, 23 nt, Mycobacterium bovis subsp bovis AF2122/97
cgcuuggagcggguccccaccgg

SEQ ID NO: 3184872 - RNA, 21 nt, Mycobacterium bovis subsp bovis AF2122/97
cgcuuggcaaucaucucccga

SEQ ID NO: 3184873 - RNA, 14 nt, Mycobacterium bovis subsp bovis AF2122/97
cgcuuggcccuggg

SEQ ID NO: 3184874 - RNA, 20 nt, Mycobacterium bovis subsp bovis AF2122/97
cgcuuggccgcugccuucuu

SEQ ID NO: 3184875 - RNA, 19 nt, Mycobacterium bovis subsp bovis AF2122/97
cgcuuggccggauccucga

SEQ ID NO: 3184876 - RNA, 18 nt, Mycobacterium bovis subsp bovis AF2122/97
cgcuuggccuaugcugcc

SEQ ID NO: 3184877 - RNA, 16 nt, Mycobacterium bovis subsp bovis AF2122/97
cgcuuggcgugaccua

SEQ ID NO: 3184878 - RNA, 22 nt, Mycobacterium bovis subsp bovis AF2122/97
cgcuugggcggugucgucgagg

SEQ ID NO: 3184879 - RNA, 17 nt, Mycobacterium bovis subsp bovis AF2122/97
cgcuugggguccggaug

SEQ ID NO: 3184880 - RNA, 18 nt, Mycobacterium bovis subsp bovis AF2122/97
cgcuugggguugggcggg

SEQ ID NO: 3184881 - RNA, 19 nt, Mycobacterium bovis subsp bovis AF2122/97
cgcuuguacaagucgacca

SEQ ID NO: 3184882 - RNA, 22 nt, Mycobacterium bovis subsp bovis AF2122/97
cgcuuguugaccucacgggcgc

SEQ ID NO: 3184883 - RNA, 18 nt, Mycobacterium bovis subsp bovis AF2122/97
cgcuuucuuggcgggcgc

SEQ ID NO: 3184884 - RNA, 21 nt, Mycobacterium bovis subsp bovis AF2122/97
cgcuuugaauugcgcgcccgg

SEQ ID NO: 3184885 - RNA, 16 nt, Mycobacterium bovis subsp bovis AF2122/97
cgcuuugaugccgaug

SEQ ID NO: 3184886 - RNA, 14 nt, Mycobacterium bovis subsp bovis AF2122/97
cgcuuugcacagcg

SEQ ID NO: 3184887 - RNA, 16 nt, Mycobacterium bovis subsp bovis AF2122/97
cgcuuugcacugugga

SEQ ID NO: 3184888 - RNA, 22 nt, Mycobacterium bovis subsp bovis AF2122/97
cgcuuuggaggugcaguacgcg

SEQ ID NO: 3184889 - RNA, 14 nt, Mycobacterium bovis subsp bovis AF2122/97
cgcuuuggcguucg

SEQ ID NO: 3184890 - RNA, 15 nt, Mycobacterium bovis subsp bovis AF2122/97
cgcuuugggcugccg

SEQ ID NO: 3184891 - RNA, 15 nt, Mycobacterium bovis subsp bovis AF2122/97
cgcuuuggucgucgg

SEQ ID NO: 3184892 - RNA, 20 nt, Mycobacterium bovis subsp bovis AF2122/97
cgcuuuucgauggugucgcg

SEQ ID NO: 3184893 - RNA, 14 nt, Mycobacterium bovis subsp bovis AF2122/97
cggaaaaucaccau

SEQ ID NO: 3184894 - RNA, 15 nt, Mycobacterium bovis subsp bovis AF2122/97
cggaaacaagcaagc

SEQ ID NO: 3184895 - RNA, 17 nt, Mycobacterium bovis subsp bovis AF2122/97
cggaaaccacagcgcca

SEQ ID NO: 3184896 - RNA, 19 nt, Mycobacterium bovis subsp bovis AF2122/97
cggaaaccaucgccagccg

SEQ ID NO: 3184897 - RNA, 20 nt, Mycobacterium bovis subsp bovis AF2122/97
cggaaaccaucgccagccgg

SEQ ID NO: 3184898 - RNA, 16 nt, Mycobacterium bovis subsp bovis AF2122/97
cggaaacccggccgcc

SEQ ID NO: 3184899 - RNA, 17 nt, Mycobacterium bovis subsp bovis AF2122/97
cggaaacccggccgccg

SEQ ID NO: 3184900 - RNA, 20 nt, Mycobacterium bovis subsp bovis AF2122/97
cggaaacccggccgccgaga

SEQ ID NO: 3184901 - RNA, 14 nt, Mycobacterium bovis subsp bovis AF2122/97
cggaaagaucucgg

SEQ ID NO: 3184902 - RNA, 23 nt, Mycobacterium bovis subsp bovis AF2122/97
cggaaagcccgucgggccgucgg

SEQ ID NO: 3184903 - RNA, 22 nt, Mycobacterium bovis subsp bovis AF2122/97
cggaaagcucuugcacucggcg

SEQ ID NO: 3184904 - RNA, 13 nt, Mycobacterium bovis subsp bovis AF2122/97
cggaaaggcuucc

SEQ ID NO: 3184905 - RNA, 13 nt, Mycobacterium bovis subsp bovis AF2122/97
cggaaaucggacg

SEQ ID NO: 3184906 - RNA, 20 nt, Mycobacterium bovis subsp bovis AF2122/97
cggaaauggcgucgccggca

SEQ ID NO: 3184907 - RNA, 14 nt, Mycobacterium bovis subsp bovis AF2122/97
cggaaauuccaagc

SEQ ID NO: 3184908 - RNA, 15 nt, Mycobacterium bovis subsp bovis AF2122/97
cggaaauuccaagcg

SEQ ID NO: 3184909 - RNA, 21 nt, Mycobacterium bovis subsp bovis AF2122/97
cggaaauuccggcgcggccgg

SEQ ID NO: 3184910 - RNA, 16 nt, Mycobacterium bovis subsp bovis AF2122/97
cggaacaccgacgaca

SEQ ID NO: 3184911 - RNA, 21 nt, Mycobacterium bovis subsp bovis AF2122/97
cggaacaccgacgucaggcuc

SEQ ID NO: 3184912 - RNA, 13 nt, Mycobacterium bovis subsp bovis AF2122/97
cggaacaccgagg

SEQ ID NO: 3184913 - RNA, 15 nt, Mycobacterium bovis subsp bovis AF2122/97
cggaacaccgcccgg

SEQ ID NO: 3184914 - RNA, 19 nt, Mycobacterium bovis subsp bovis AF2122/97
cggaacaccgcccggcccg

SEQ ID NO: 3184915 - RNA, 13 nt, Mycobacterium bovis subsp bovis AF2122/97
cggaacacgaugc

SEQ ID NO: 3184916 - RNA, 23 nt, Mycobacterium bovis subsp bovis AF2122/97
cggaacagccuugugcaacggug

SEQ ID NO: 3184917 - RNA, 13 nt, Mycobacterium bovis subsp bovis AF2122/97
cggaacaucguca

SEQ ID NO: 3184918 - RNA, 22 nt, Mycobacterium bovis subsp bovis AF2122/97
cggaaccaccaguaccaccggc

SEQ ID NO: 3184919 - RNA, 12 nt, Mycobacterium bovis subsp bovis AF2122/97
cggaaccagcgu

SEQ ID NO: 3184920 - RNA, 22 nt, Mycobacterium bovis subsp bovis AF2122/97
cggaaccagcguaucggccggc

SEQ ID NO: 3184921 - RNA, 19 nt, Mycobacterium bovis subsp bovis AF2122/97
cggaaccaguugacgaaga

SEQ ID NO: 3184922 - RNA, 14 nt, Mycobacterium bovis subsp bovis AF2122/97
cggaacccagcacu

SEQ ID NO: 3184923 - RNA, 19 nt, Mycobacterium bovis subsp bovis AF2122/97
cggaacccccagcugcagg

SEQ ID NO: 3184924 - RNA, 15 nt, Mycobacterium bovis subsp bovis AF2122/97
cggaacccgagccgg

SEQ ID NO: 3184925 - RNA, 13 nt, Mycobacterium bovis subsp bovis AF2122/97
cggaaccggcgug

SEQ ID NO: 3184926 - RNA, 14 nt, Mycobacterium bovis subsp bovis AF2122/97
cggaaccggcgugc

SEQ ID NO: 3184927 - RNA, 18 nt, Mycobacterium bovis subsp bovis AF2122/97
cggaaccggcgugcagca

SEQ ID NO: 3184928 - RNA, 18 nt, Mycobacterium bovis subsp bovis AF2122/97
cggaaccgguaucgccaa

SEQ ID NO: 3184929 - RNA, 23 nt, Mycobacterium bovis subsp bovis AF2122/97
cggaaccguuugacgcgcucgcg

SEQ ID NO: 3184930 - RNA, 23 nt, Mycobacterium bovis subsp bovis AF2122/97
cggaacgaaugucaccccgccca

SEQ ID NO: 3184931 - RNA, 17 nt, Mycobacterium bovis subsp bovis AF2122/97
cggaacgagcggccgcg

SEQ ID NO: 3184932 - RNA, 19 nt, Mycobacterium bovis subsp bovis AF2122/97
cggaacgagcggccgcgcg

SEQ ID NO: 3184933 - RNA, 19 nt, Mycobacterium bovis subsp bovis AF2122/97
cggaacgauggacgcccag

SEQ ID NO: 3184934 - RNA, 20 nt, Mycobacterium bovis subsp bovis AF2122/97
cggaacgccgagcacgccga

SEQ ID NO: 3184935 - RNA, 19 nt, Mycobacterium bovis subsp bovis AF2122/97
cggaacgccgccagcgcgg

SEQ ID NO: 3184936 - RNA, 13 nt, Mycobacterium bovis subsp bovis AF2122/97
cggaacgccgucg

SEQ ID NO: 3184937 - RNA, 16 nt, Mycobacterium bovis subsp bovis AF2122/97
cggaacgccgucgagc

SEQ ID NO: 3184938 - RNA, 20 nt, Mycobacterium bovis subsp bovis AF2122/97
cggaacgccuaacgcguagc

SEQ ID NO: 3184939 - RNA, 16 nt, Mycobacterium bovis subsp bovis AF2122/97
cggaacgcgucgccga

SEQ ID NO: 3184940 - RNA, 16 nt, Mycobacterium bovis subsp bovis AF2122/97
cggaacgggucguugc

SEQ ID NO: 3184941 - RNA, 18 nt, Mycobacterium bovis subsp bovis AF2122/97
cggaacucgucgcugccc

SEQ ID NO: 3184942 - RNA, 18 nt, Mycobacterium bovis subsp bovis AF2122/97
cggaacugaccacgucgg

SEQ ID NO: 3184943 - RNA, 14 nt, Mycobacterium bovis subsp bovis AF2122/97
cggaacugggcccc

SEQ ID NO: 3184944 - RNA, 20 nt, Mycobacterium bovis subsp bovis AF2122/97
cggaacuguaggucacagcu

SEQ ID NO: 3184945 - RNA, 23 nt, Mycobacterium bovis subsp bovis AF2122/97
cggaacuguaggucacagcugcg

SEQ ID NO: 3184946 - RNA, 19 nt, Mycobacterium bovis subsp bovis AF2122/97
cggaagaagcaguagcugc

SEQ ID NO: 3184947 - RNA, 19 nt, Mycobacterium bovis subsp bovis AF2122/97
cggaagaagugcacugcga

SEQ ID NO: 3184948 - RNA, 13 nt, Mycobacterium bovis subsp bovis AF2122/97
cggaagaccgcgg

SEQ ID NO: 3184949 - RNA, 18 nt, Mycobacterium bovis subsp bovis AF2122/97
cggaagacgugguagagg

SEQ ID NO: 3184950 - RNA, 17 nt, Mycobacterium bovis subsp bovis AF2122/97
cggaagccgccuaggac

SEQ ID NO: 3184951 - RNA, 12 nt, Mycobacterium bovis subsp bovis AF2122/97
cggaagcgccgg

SEQ ID NO: 3184952 - RNA, 13 nt, Mycobacterium bovis subsp bovis AF2122/97
cggaagcgccggc

SEQ ID NO: 3184953 - RNA, 16 nt, Mycobacterium bovis subsp bovis AF2122/97
cggaagcgccggccca

SEQ ID NO: 3184954 - RNA, 15 nt, Mycobacterium bovis subsp bovis AF2122/97
cggaagcgccggccg

SEQ ID NO: 3184955 - RNA, 17 nt, Mycobacterium bovis subsp bovis AF2122/97
cggaagcgccggccgau

SEQ ID NO: 3184956 - RNA, 15 nt, Mycobacterium bovis subsp bovis AF2122/97
cggaagcggcggccc

SEQ ID NO: 3184957 - RNA, 19 nt, Mycobacterium bovis subsp bovis AF2122/97
cggaagcggcguucgaugc

SEQ ID NO: 3184958 - RNA, 17 nt, Mycobacterium bovis subsp bovis AF2122/97
cggaaggacggcagcca

SEQ ID NO: 3184959 - RNA, 23 nt, Mycobacterium bovis subsp bovis AF2122/97
cggaaggacggcagccaccagcg

SEQ ID NO: 3184960 - RNA, 19 nt, Mycobacterium bovis subsp bovis AF2122/97
cggaaggcccggcgcggcc

SEQ ID NO: 3184961 - RNA, 14 nt, Mycobacterium bovis subsp bovis AF2122/97
cggaagggcccggu

SEQ ID NO: 3184962 - RNA, 23 nt, Mycobacterium bovis subsp bovis AF2122/97
cggaaguacuccacccaggccga

SEQ ID NO: 3184963 - RNA, 22 nt, Mycobacterium bovis subsp bovis AF2122/97
cggaaguagcgcaaugcggccc

SEQ ID NO: 3184964 - RNA, 18 nt, Mycobacterium bovis subsp bovis AF2122/97
cggaaguaucgccggccg

SEQ ID NO: 3184965 - RNA, 13 nt, Mycobacterium bovis subsp bovis AF2122/97
cggaaguccuaca

SEQ ID NO: 3184966 - RNA, 21 nt, Mycobacterium bovis subsp bovis AF2122/97
cggaaguccuacaugggggcg

SEQ ID NO: 3184967 - RNA, 15 nt, Mycobacterium bovis subsp bovis AF2122/97
cggaagugucgucgg

SEQ ID NO: 3184968 - RNA, 21 nt, Mycobacterium bovis subsp bovis AF2122/97
cggaauacccggcccauuguc

SEQ ID NO: 3184969 - RNA, 14 nt, Mycobacterium bovis subsp bovis AF2122/97
cggaauacgcgccg

SEQ ID NO: 3184970 - RNA, 18 nt, Mycobacterium bovis subsp bovis AF2122/97
cggaauacgcgccgccgg

SEQ ID NO: 3184971 - RNA, 14 nt, Mycobacterium bovis subsp bovis AF2122/97
cggaauaucggccg

SEQ ID NO: 3184972 - RNA, 14 nt, Mycobacterium bovis subsp bovis AF2122/97
cggaauauggcggc

SEQ ID NO: 3184973 - RNA, 16 nt, Mycobacterium bovis subsp bovis AF2122/97
cggaauauggcggccg

SEQ ID NO: 3184974 - RNA, 17 nt, Mycobacterium bovis subsp bovis AF2122/97
cggaauauggcggccgg

SEQ ID NO: 3184975 - RNA, 18 nt, Mycobacterium bovis subsp bovis AF2122/97
cggaauauggcggccggg

SEQ ID NO: 3184976 - RNA, 14 nt, Mycobacterium bovis subsp bovis AF2122/97
cggaaucagcaccc

SEQ ID NO: 3184977 - RNA, 17 nt, Mycobacterium bovis subsp bovis AF2122/97
cggaauccuggccgccg

SEQ ID NO: 3184978 - RNA, 21 nt, Mycobacterium bovis subsp bovis AF2122/97
cggaauccuggccgccgcccc

SEQ ID NO: 3184979 - RNA, 21 nt, Mycobacterium bovis subsp bovis AF2122/97
cggaaucgcaccgugugggcc

SEQ ID NO: 3184980 - RNA, 16 nt, Mycobacterium bovis subsp bovis AF2122/97
cggaaucgcaucggcg

SEQ ID NO: 3184981 - RNA, 17 nt, Mycobacterium bovis subsp bovis AF2122/97
cggaaucgcaucggcgg

SEQ ID NO: 3184982 - RNA, 21 nt, Mycobacterium bovis subsp bovis AF2122/97
cggaaucgcgagcuuggccgg

SEQ ID NO: 3184983 - RNA, 15 nt, Mycobacterium bovis subsp bovis AF2122/97
cggaaucggagucuu

SEQ ID NO: 3184984 - RNA, 17 nt, Mycobacterium bovis subsp bovis AF2122/97
cggaaucgucgcggccg

SEQ ID NO: 3184985 - RNA, 18 nt, Mycobacterium bovis subsp bovis AF2122/97
cggaaucgucgcggccgu

SEQ ID NO: 3184986 - RNA, 17 nt, Mycobacterium bovis subsp bovis AF2122/97
cggaaugaaggcaccga

SEQ ID NO: 3184987 - RNA, 23 nt, Mycobacterium bovis subsp bovis AF2122/97
cggaaugccgucgccggucaggc

SEQ ID NO: 3184988 - RNA, 14 nt, Mycobacterium bovis subsp bovis AF2122/97
cggaaugcuggggc

SEQ ID NO: 3184989 - RNA, 17 nt, Mycobacterium bovis subsp bovis AF2122/97
cggaauggaggccgccg

SEQ ID NO: 3184990 - RNA, 18 nt, Mycobacterium bovis subsp bovis AF2122/97
cggaauggaggccgccga

SEQ ID NO: 3184991 - RNA, 17 nt, Mycobacterium bovis subsp bovis AF2122/97
cggaauggcgccggccg

SEQ ID NO: 3184992 - RNA, 22 nt, Mycobacterium bovis subsp bovis AF2122/97
cggaauggcgccggccggcgcg

SEQ ID NO: 3184993 - RNA, 13 nt, Mycobacterium bovis subsp bovis AF2122/97
cggaaugggcgcc

SEQ ID NO: 3184994 - RNA, 21 nt, Mycobacterium bovis subsp bovis AF2122/97
cggaauguagccgacuucguc

SEQ ID NO: 3184995 - RNA, 20 nt, Mycobacterium bovis subsp bovis AF2122/97
cggaauguaguccagcucgc

SEQ ID NO: 3184996 - RNA, 22 nt, Mycobacterium bovis subsp bovis AF2122/97
cggaauguaguccagcucgcug

SEQ ID NO: 3184997 - RNA, 23 nt, Mycobacterium bovis subsp bovis AF2122/97
cggaauguugcgagugagcucag

SEQ ID NO: 3184998 - RNA, 15 nt, Mycobacterium bovis subsp bovis AF2122/97
cggaauucgguuggc

SEQ ID NO: 3184999 - RNA, 16 nt, Mycobacterium bovis subsp bovis AF2122/97
cggacaaagccgucgc

SEQ ID NO: 3185000 - RNA, 17 nt, Mycobacterium bovis subsp bovis AF2122/97
cggacaaagccgucgcg

SEQ ID NO: 3185001 - RNA, 20 nt, Mycobacterium bovis subsp bovis AF2122/97
cggacaaagccgucgcgacg

SEQ ID NO: 3185002 - RNA, 14 nt, Mycobacterium bovis subsp bovis AF2122/97
cggacaaccugggg

SEQ ID NO: 3185003 - RNA, 18 nt, Mycobacterium bovis subsp bovis AF2122/97
cggacaauuccgcuugcu

SEQ ID NO: 3185004 - RNA, 14 nt, Mycobacterium bovis subsp bovis AF2122/97
cggacacacaggcg

SEQ ID NO: 3185005 - RNA, 15 nt, Mycobacterium bovis subsp bovis AF2122/97
cggacacacaggcgg

SEQ ID NO: 3185006 - RNA, 20 nt, Mycobacterium bovis subsp bovis AF2122/97
cggacacagcccacaggcgg

SEQ ID NO: 3185007 - RNA, 23 nt, Mycobacterium bovis subsp bovis AF2122/97
cggacacagcccacaggcggcgc

SEQ ID NO: 3185008 - RNA, 13 nt, Mycobacterium bovis subsp bovis AF2122/97
cggacaccucggg

SEQ ID NO: 3185009 - RNA, 21 nt, Mycobacterium bovis subsp bovis AF2122/97
cggacacgaucgcgucggcua

SEQ ID NO: 3185010 - RNA, 14 nt, Mycobacterium bovis subsp bovis AF2122/97
cggacagcagccgg

SEQ ID NO: 3185011 - RNA, 16 nt, Mycobacterium bovis subsp bovis AF2122/97
cggacagcagccggcg

SEQ ID NO: 3185012 - RNA, 16 nt, Mycobacterium bovis subsp bovis AF2122/97
cggacagcgccuggcc

SEQ ID NO: 3185013 - RNA, 17 nt, Mycobacterium bovis subsp bovis AF2122/97
cggacagcgccuggccg

SEQ ID NO: 3185014 - RNA, 18 nt, Mycobacterium bovis subsp bovis AF2122/97
cggacagcgccuggccgg

SEQ ID NO: 3185015 - RNA, 14 nt, Mycobacterium bovis subsp bovis AF2122/97
cggacagcucgcgg

SEQ ID NO: 3185016 - RNA, 15 nt, Mycobacterium bovis subsp bovis AF2122/97
cggacaggcccggug

SEQ ID NO: 3185017 - RNA, 16 nt, Mycobacterium bovis subsp bovis AF2122/97
cggacaggcccggugg

SEQ ID NO: 3185018 - RNA, 19 nt, Mycobacterium bovis subsp bovis AF2122/97
cggacaggcccgguggcgg

SEQ ID NO: 3185019 - RNA, 21 nt, Mycobacterium bovis subsp bovis AF2122/97
cggacaggcuugacugcacac

SEQ ID NO: 3185020 - RNA, 19 nt, Mycobacterium bovis subsp bovis AF2122/97
cggacagggcggcaacggc

SEQ ID NO: 3185021 - RNA, 21 nt, Mycobacterium bovis subsp bovis AF2122/97
cggacagggcggcaacggcgg

SEQ ID NO: 3185022 - RNA, 14 nt, Mycobacterium bovis subsp bovis AF2122/97
cggacagggcggcg

SEQ ID NO: 3185023 - RNA, 15 nt, Mycobacterium bovis subsp bovis AF2122/97
cggacagggcggcga

SEQ ID NO: 3185024 - RNA, 16 nt, Mycobacterium bovis subsp bovis AF2122/97
cggacagggcggcgag

SEQ ID NO: 3185025 - RNA, 19 nt, Mycobacterium bovis subsp bovis AF2122/97
cggacagggugcgcuugcg

SEQ ID NO: 3185026 - RNA, 18 nt, Mycobacterium bovis subsp bovis AF2122/97
cggacagguaacgcgguu

SEQ ID NO: 3185027 - RNA, 19 nt, Mycobacterium bovis subsp bovis AF2122/97
cggacagguaacgcgguuc

SEQ ID NO: 3185028 - RNA, 16 nt, Mycobacterium bovis subsp bovis AF2122/97
cggacaguuccccggg

SEQ ID NO: 3185029 - RNA, 15 nt, Mycobacterium bovis subsp bovis AF2122/97
cggacaguucccggc

SEQ ID NO: 3185030 - RNA, 15 nt, Mycobacterium bovis subsp bovis AF2122/97
cggacaucaccggca

SEQ ID NO: 3185031 - RNA, 19 nt, Mycobacterium bovis subsp bovis AF2122/97
cggacauccgggccgagcg

SEQ ID NO: 3185032 - RNA, 18 nt, Mycobacterium bovis subsp bovis AF2122/97
cggacaucguugacccgg

SEQ ID NO: 3185033 - RNA, 18 nt, Mycobacterium bovis subsp bovis AF2122/97
cggacaugcgggcagcac

SEQ ID NO: 3185034 - RNA, 19 nt, Mycobacterium bovis subsp bovis AF2122/97
cggacaugcgggcagcacu

SEQ ID NO: 3185035 - RNA, 14 nt, Mycobacterium bovis subsp bovis AF2122/97
cggaccacccggcg

SEQ ID NO: 3185036 - RNA, 13 nt, Mycobacterium bovis subsp bovis AF2122/97
cggaccaccgccg

SEQ ID NO: 3185037 - RNA, 13 nt, Mycobacterium bovis subsp bovis AF2122/97
cggaccaccgcuc

SEQ ID NO: 3185038 - RNA, 23 nt, Mycobacterium bovis subsp bovis AF2122/97
cggaccacuguuggugccgccac

SEQ ID NO: 3185039 - RNA, 18 nt, Mycobacterium bovis subsp bovis AF2122/97
cggaccagagugguggcg

SEQ ID NO: 3185040 - RNA, 15 nt, Mycobacterium bovis subsp bovis AF2122/97
cggaccagcgccgga

SEQ ID NO: 3185041 - RNA, 18 nt, Mycobacterium bovis subsp bovis AF2122/97
cggaccagcgccggaccg

SEQ ID NO: 3185042 - RNA, 14 nt, Mycobacterium bovis subsp bovis AF2122/97
cggaccagcugccg

SEQ ID NO: 3185043 - RNA, 16 nt, Mycobacterium bovis subsp bovis AF2122/97
cggaccagcugccggc

SEQ ID NO: 3185044 - RNA, 17 nt, Mycobacterium bovis subsp bovis AF2122/97
cggaccagcugccggcg

SEQ ID NO: 3185045 - RNA, 18 nt, Mycobacterium bovis subsp bovis AF2122/97
cggaccagcugccggcga

SEQ ID NO: 3185046 - RNA, 21 nt, Mycobacterium bovis subsp bovis AF2122/97
cggaccagcugccggcgacca

SEQ ID NO: 3185047 - RNA, 15 nt, Mycobacterium bovis subsp bovis AF2122/97
cggaccaggccgcgc

SEQ ID NO: 3185048 - RNA, 17 nt, Mycobacterium bovis subsp bovis AF2122/97
cggacccaaagcacuuc

SEQ ID NO: 3185049 - RNA, 19 nt, Mycobacterium bovis subsp bovis AF2122/97
cggacccacccgcaccgcc

SEQ ID NO: 3185050 - RNA, 15 nt, Mycobacterium bovis subsp bovis AF2122/97
cggacccaccgucac

SEQ ID NO: 3185051 - RNA, 21 nt, Mycobacterium bovis subsp bovis AF2122/97
cggacccaccgucacccccga

SEQ ID NO: 3185052 - RNA, 22 nt, Mycobacterium bovis subsp bovis AF2122/97
cggacccaccgucacccccgau

SEQ ID NO: 3185053 - RNA, 15 nt, Mycobacterium bovis subsp bovis AF2122/97
cggacccaccucgua

SEQ ID NO: 3185054 - RNA, 19 nt, Mycobacterium bovis subsp bovis AF2122/97
cggacccgacagccgcugc

SEQ ID NO: 3185055 - RNA, 13 nt, Mycobacterium bovis subsp bovis AF2122/97
cggacccgaccgu

SEQ ID NO: 3185056 - RNA, 12 nt, Mycobacterium bovis subsp bovis AF2122/97
cggacccgcagc

SEQ ID NO: 3185057 - RNA, 14 nt, Mycobacterium bovis subsp bovis AF2122/97
cggacccgcagcug

SEQ ID NO: 3185058 - RNA, 15 nt, Mycobacterium bovis subsp bovis AF2122/97
cggacccgcagcugc

SEQ ID NO: 3185059 - RNA, 16 nt, Mycobacterium bovis subsp bovis AF2122/97
cggacccgcagcugcg

SEQ ID NO: 3185060 - RNA, 17 nt, Mycobacterium bovis subsp bovis AF2122/97
cggacccgcagcugcgg

SEQ ID NO: 3185061 - RNA, 13 nt, Mycobacterium bovis subsp bovis AF2122/97
cggacccgcccuu

SEQ ID NO: 3185062 - RNA, 20 nt, Mycobacterium bovis subsp bovis AF2122/97
cggacccgcccuugccgccg

SEQ ID NO: 3185063 - RNA, 22 nt, Mycobacterium bovis subsp bovis AF2122/97
cggacccgcccuugccgccgag

SEQ ID NO: 3185064 - RNA, 19 nt, Mycobacterium bovis subsp bovis AF2122/97
cggacccgccggguccgcc

SEQ ID NO: 3185065 - RNA, 21 nt, Mycobacterium bovis subsp bovis AF2122/97
cggacccgccggguccgccgg

SEQ ID NO: 3185066 - RNA, 18 nt, Mycobacterium bovis subsp bovis AF2122/97
cggacccgcucgcggcga

SEQ ID NO: 3185067 - RNA, 21 nt, Mycobacterium bovis subsp bovis AF2122/97
cggacccggugacccgcuggg

SEQ ID NO: 3185068 - RNA, 15 nt, Mycobacterium bovis subsp bovis AF2122/97
cggacccgucggcgu

SEQ ID NO: 3185069 - RNA, 20 nt, Mycobacterium bovis subsp bovis AF2122/97
cggaccgaagaccuccucgg

SEQ ID NO: 3185070 - RNA, 14 nt, Mycobacterium bovis subsp bovis AF2122/97
cggaccgaugacga

SEQ ID NO: 3185071 - RNA, 13 nt, Mycobacterium bovis subsp bovis AF2122/97
cggaccgauuucu

SEQ ID NO: 3185072 - RNA, 22 nt, Mycobacterium bovis subsp bovis AF2122/97
cggaccgauuucuuuaccagca

SEQ ID NO: 3185073 - RNA, 18 nt, Mycobacterium bovis subsp bovis AF2122/97
cggaccgccaccuuggcg

SEQ ID NO: 3185074 - RNA, 14 nt, Mycobacterium bovis subsp bovis AF2122/97
cggaccgcccgugc

SEQ ID NO: 3185075 - RNA, 12 nt, Mycobacterium bovis subsp bovis AF2122/97
cggaccgccgca

SEQ ID NO: 3185076 - RNA, 20 nt, Mycobacterium bovis subsp bovis AF2122/97
cggaccgcgacggcgccggc

SEQ ID NO: 3185077 - RNA, 13 nt, Mycobacterium bovis subsp bovis AF2122/97
cggaccgcggauu

SEQ ID NO: 3185078 - RNA, 22 nt, Mycobacterium bovis subsp bovis AF2122/97
cggaccgcggauuccagcgcgu

SEQ ID NO: 3185079 - RNA, 16 nt, Mycobacterium bovis subsp bovis AF2122/97
cggaccgcgucgcggg

SEQ ID NO: 3185080 - RNA, 12 nt, Mycobacterium bovis subsp bovis AF2122/97
cggaccgcuucg

SEQ ID NO: 3185081 - RNA, 18 nt, Mycobacterium bovis subsp bovis AF2122/97
cggaccggcuuccccagc

SEQ ID NO: 3185082 - RNA, 23 nt, Mycobacterium bovis subsp bovis AF2122/97
cggaccguggcagcugcucuccg

SEQ ID NO: 3185083 - RNA, 12 nt, Mycobacterium bovis subsp bovis AF2122/97
cggaccguuucg

SEQ ID NO: 3185084 - RNA, 19 nt, Mycobacterium bovis subsp bovis AF2122/97
cggaccucgaagcccagca

SEQ ID NO: 3185085 - RNA, 20 nt, Mycobacterium bovis subsp bovis AF2122/97
cggaccucggcgaccugcuc

SEQ ID NO: 3185086 - RNA, 17 nt, Mycobacterium bovis subsp bovis AF2122/97
cggaccugcgagaucgg

SEQ ID NO: 3185087 - RNA, 15 nt, Mycobacterium bovis subsp bovis AF2122/97
cggaccugcgccggu

SEQ ID NO: 3185088 - RNA, 16 nt, Mycobacterium bovis subsp bovis AF2122/97
cggaccugcgccggug

SEQ ID NO: 3185089 - RNA, 17 nt, Mycobacterium bovis subsp bovis AF2122/97
cggaccuucggcggugc

SEQ ID NO: 3185090 - RNA, 21 nt, Mycobacterium bovis subsp bovis AF2122/97
cggaccuucggcggugccacc

SEQ ID NO: 3185091 - RNA, 19 nt, Mycobacterium bovis subsp bovis AF2122/97
cggacgaaacgaucgcgcc

SEQ ID NO: 3185092 - RNA, 20 nt, Mycobacterium bovis subsp bovis AF2122/97
cggacgaaacgaucgcgcca

SEQ ID NO: 3185093 - RNA, 14 nt, Mycobacterium bovis subsp bovis AF2122/97
cggacgaacccguu

SEQ ID NO: 3185094 - RNA, 14 nt, Mycobacterium bovis subsp bovis AF2122/97
cggacgaucagggu

SEQ ID NO: 3185095 - RNA, 16 nt, Mycobacterium bovis subsp bovis AF2122/97
cggacgcaacacccgg

SEQ ID NO: 3185096 - RNA, 20 nt, Mycobacterium bovis subsp bovis AF2122/97
cggacgcaacacccgggcga

SEQ ID NO: 3185097 - RNA, 24 nt, Mycobacterium bovis subsp bovis AF2122/97
cggacgccaugcccgcacgcucgg

SEQ ID NO: 3185098 - RNA, 18 nt, Mycobacterium bovis subsp bovis AF2122/97
cggacgcccggcgcacca

SEQ ID NO: 3185099 - RNA, 22 nt, Mycobacterium bovis subsp bovis AF2122/97
cggacgccgacaaccuuggcga

SEQ ID NO: 3185100 - RNA, 18 nt, Mycobacterium bovis subsp bovis AF2122/97
cggacgccgcgccggcgg

SEQ ID NO: 3185101 - RNA, 20 nt, Mycobacterium bovis subsp bovis AF2122/97
cggacgccgcgccggcgggc

SEQ ID NO: 3185102 - RNA, 16 nt, Mycobacterium bovis subsp bovis AF2122/97
cggacgcgccggcgug

SEQ ID NO: 3185103 - RNA, 12 nt, Mycobacterium bovis subsp bovis AF2122/97
cggacgcugggc

SEQ ID NO: 3185104 - RNA, 16 nt, Mycobacterium bovis subsp bovis AF2122/97
cggacggcagccgggc

SEQ ID NO: 3185105 - RNA, 14 nt, Mycobacterium bovis subsp bovis AF2122/97
cggacggcaggcug

SEQ ID NO: 3185106 - RNA, 18 nt, Mycobacterium bovis subsp bovis AF2122/97
cggacggcaggcuggcga

SEQ ID NO: 3185107 - RNA, 18 nt, Mycobacterium bovis subsp bovis AF2122/97
cggacggccaucgccagc

SEQ ID NO: 3185108 - RNA, 15 nt, Mycobacterium bovis subsp bovis AF2122/97
cggacggcgucgagu

SEQ ID NO: 3185109 - RNA, 19 nt, Mycobacterium bovis subsp bovis AF2122/97
cggacggcugagacagacc

SEQ ID NO: 3185110 - RNA, 18 nt, Mycobacterium bovis subsp bovis AF2122/97
cggacgggaugcuugguc

SEQ ID NO: 3185111 - RNA, 17 nt, Mycobacterium bovis subsp bovis AF2122/97
cggacgggugcagcgca

SEQ ID NO: 3185112 - RNA, 17 nt, Mycobacterium bovis subsp bovis AF2122/97
cggacgggugcgggccg

SEQ ID NO: 3185113 - RNA, 18 nt, Mycobacterium bovis subsp bovis AF2122/97
cggacguaggcaccccgg

SEQ ID NO: 3185114 - RNA, 20 nt, Mycobacterium bovis subsp bovis AF2122/97
cggacgucgacuuguugggc

SEQ ID NO: 3185115 - RNA, 14 nt, Mycobacterium bovis subsp bovis AF2122/97
cggacgucggcggc

SEQ ID NO: 3185116 - RNA, 16 nt, Mycobacterium bovis subsp bovis AF2122/97
cggacgucggcggccg

SEQ ID NO: 3185117 - RNA, 19 nt, Mycobacterium bovis subsp bovis AF2122/97
cggacgucggcggccguca

SEQ ID NO: 3185118 - RNA, 13 nt, Mycobacterium bovis subsp bovis AF2122/97
cggacgugccggu

SEQ ID NO: 3185119 - RNA, 17 nt, Mycobacterium bovis subsp bovis AF2122/97
cggacguucuggaucgu

SEQ ID NO: 3185120 - RNA, 13 nt, Mycobacterium bovis subsp bovis AF2122/97
cggacuaccgccg

SEQ ID NO: 3185121 - RNA, 16 nt, Mycobacterium bovis subsp bovis AF2122/97
cggacuaccgccggcg

SEQ ID NO: 3185122 - RNA, 17 nt, Mycobacterium bovis subsp bovis AF2122/97
cggacuaccgccggcgg

SEQ ID NO: 3185123 - RNA, 18 nt, Mycobacterium bovis subsp bovis AF2122/97
cggacucacgaggcacaa

SEQ ID NO: 3185124 - RNA, 14 nt, Mycobacterium bovis subsp bovis AF2122/97
cggacucccucgau

SEQ ID NO: 3185125 - RNA, 20 nt, Mycobacterium bovis subsp bovis AF2122/97
cggacucccucgaucacggc

SEQ ID NO: 3185126 - RNA, 14 nt, Mycobacterium bovis subsp bovis AF2122/97
cggacuccggccgg

SEQ ID NO: 3185127 - RNA, 14 nt, Mycobacterium bovis subsp bovis AF2122/97
cggacucgccgacg

SEQ ID NO: 3185128 - RNA, 18 nt, Mycobacterium bovis subsp bovis AF2122/97
cggacucggaauucggcg

SEQ ID NO: 3185129 - RNA, 14 nt, Mycobacterium bovis subsp bovis AF2122/97
cggacugacgucga

SEQ ID NO: 3185130 - RNA, 12 nt, Mycobacterium bovis subsp bovis AF2122/97
cggacugcagcg

SEQ ID NO: 3185131 - RNA, 17 nt, Mycobacterium bovis subsp bovis AF2122/97
cggacugcagcgcggcc

SEQ ID NO: 3185132 - RNA, 18 nt, Mycobacterium bovis subsp bovis AF2122/97
cggacugcagcgcggccg

SEQ ID NO: 3185133 - RNA, 14 nt, Mycobacterium bovis subsp bovis AF2122/97
cggacugcggaaca

SEQ ID NO: 3185134 - RNA, 19 nt, Mycobacterium bovis subsp bovis AF2122/97
cggacugcggaacaccagc

SEQ ID NO: 3185135 - RNA, 23 nt, Mycobacterium bovis subsp bovis AF2122/97
cggacugcggcccgacccggccg

SEQ ID NO: 3185136 - RNA, 21 nt, Mycobacterium bovis subsp bovis AF2122/97
cggacuggccucggggaucgc

SEQ ID NO: 3185137 - RNA, 15 nt, Mycobacterium bovis subsp bovis AF2122/97
cggacuucccgcgcg

SEQ ID NO: 3185138 - RNA, 20 nt, Mycobacterium bovis subsp bovis AF2122/97
cggacuucccgcgcgagccg

SEQ ID NO: 3185139 - RNA, 15 nt, Mycobacterium bovis subsp bovis AF2122/97
cggacuucgaugucg

SEQ ID NO: 3185140 - RNA, 16 nt, Mycobacterium bovis subsp bovis AF2122/97
cggacuucgaugucga

SEQ ID NO: 3185141 - RNA, 23 nt, Mycobacterium bovis subsp bovis AF2122/97
cggacuucguuccgugccgagcu

SEQ ID NO: 3185142 - RNA, 22 nt, Mycobacterium bovis subsp bovis AF2122/97
cggacuugaccagagcacgggc

SEQ ID NO: 3185143 - RNA, 23 nt, Mycobacterium bovis subsp bovis AF2122/97
cggacuugaccagagcacgggcu

SEQ ID NO: 3185144 - RNA, 14 nt, Mycobacterium bovis subsp bovis AF2122/97
cggacuugcgagcc

SEQ ID NO: 3185145 - RNA, 15 nt, Mycobacterium bovis subsp bovis AF2122/97
cggacuugcgagccg

SEQ ID NO: 3185146 - RNA, 17 nt, Mycobacterium bovis subsp bovis AF2122/97
cggagaaaagcgcgcua

SEQ ID NO: 3185147 - RNA, 17 nt, Mycobacterium bovis subsp bovis AF2122/97
cggagaaguucgugagc

SEQ ID NO: 3185148 - RNA, 22 nt, Mycobacterium bovis subsp bovis AF2122/97
cggagaauagaucagggcucgc

SEQ ID NO: 3185149 - RNA, 23 nt, Mycobacterium bovis subsp bovis AF2122/97
cggagaauagaucagggcucgcu

SEQ ID NO: 3185150 - RNA, 20 nt, Mycobacterium bovis subsp bovis AF2122/97
cggagacaccgcaacgcgug

SEQ ID NO: 3185151 - RNA, 13 nt, Mycobacterium bovis subsp bovis AF2122/97
cggagaccagcgu

SEQ ID NO: 3185152 - RNA, 15 nt, Mycobacterium bovis subsp bovis AF2122/97
cggagaccagcgucu

SEQ ID NO: 3185153 - RNA, 16 nt, Mycobacterium bovis subsp bovis AF2122/97
cggagaccccgcgcgc

SEQ ID NO: 3185154 - RNA, 17 nt, Mycobacterium bovis subsp bovis AF2122/97
cggagaccccgcgcgcu

SEQ ID NO: 3185155 - RNA, 16 nt, Mycobacterium bovis subsp bovis AF2122/97
cggagacccgggugcu

SEQ ID NO: 3185156 - RNA, 20 nt, Mycobacterium bovis subsp bovis AF2122/97
cggagacccguccggagaau

SEQ ID NO: 3185157 - RNA, 22 nt, Mycobacterium bovis subsp bovis AF2122/97
cggagaccgaaucgggucggcc

SEQ ID NO: 3185158 - RNA, 22 nt, Mycobacterium bovis subsp bovis AF2122/97
cggagaccgccucgucgaugcc

SEQ ID NO: 3185159 - RNA, 16 nt, Mycobacterium bovis subsp bovis AF2122/97
cggagacgaucgccag

SEQ ID NO: 3185160 - RNA, 16 nt, Mycobacterium bovis subsp bovis AF2122/97
cggagacgucgccgca

SEQ ID NO: 3185161 - RNA, 19 nt, Mycobacterium bovis subsp bovis AF2122/97
cggagacuccagcaaggcc

SEQ ID NO: 3185162 - RNA, 14 nt, Mycobacterium bovis subsp bovis AF2122/97
cggagacugguugc

SEQ ID NO: 3185163 - RNA, 18 nt, Mycobacterium bovis subsp bovis AF2122/97
cggagaguaggaccucgg

SEQ ID NO: 3185164 - RNA, 14 nt, Mycobacterium bovis subsp bovis AF2122/97
cggagaucgucgcg

SEQ ID NO: 3185165 - RNA, 15 nt, Mycobacterium bovis subsp bovis AF2122/97
cggagaugagcagcu

SEQ ID NO: 3185166 - RNA, 19 nt, Mycobacterium bovis subsp bovis AF2122/97
cggagaugaucauguggug

SEQ ID NO: 3185167 - RNA, 19 nt, Mycobacterium bovis subsp bovis AF2122/97
cggagcaauuccacgaucg

SEQ ID NO: 3185168 - RNA, 23 nt, Mycobacterium bovis subsp bovis AF2122/97
cggagcaauuccacgaucggcuc

SEQ ID NO: 3185169 - RNA, 24 nt, Mycobacterium bovis subsp bovis AF2122/97
cggagcaauuccacgaucggcuca

SEQ ID NO: 3185170 - RNA, 14 nt, Mycobacterium bovis subsp bovis AF2122/97
cggagcacccgggg

SEQ ID NO: 3185171 - RNA, 18 nt, Mycobacterium bovis subsp bovis AF2122/97
cggagccacucggcccgg

SEQ ID NO: 3185172 - RNA, 13 nt, Mycobacterium bovis subsp bovis AF2122/97
cggagccaggacg

SEQ ID NO: 3185173 - RNA, 21 nt, Mycobacterium bovis subsp bovis AF2122/97
cggagcccacacgcucacggg

SEQ ID NO: 3185174 - RNA, 21 nt, Mycobacterium bovis subsp bovis AF2122/97
cggagccccugucaacgccgc

SEQ ID NO: 3185175 - RNA, 17 nt, Mycobacterium bovis subsp bovis AF2122/97
cggagcccugaccgggg

SEQ ID NO: 3185176 - RNA, 17 nt, Mycobacterium bovis subsp bovis AF2122/97
cggagccgaacccaagg

SEQ ID NO: 3185177 - RNA, 17 nt, Mycobacterium bovis subsp bovis AF2122/97
cggagccgagccgauau

SEQ ID NO: 3185178 - RNA, 18 nt, Mycobacterium bovis subsp bovis AF2122/97
cggagccgaugaccugcc

SEQ ID NO: 3185179 - RNA, 16 nt, Mycobacterium bovis subsp bovis AF2122/97
cggagccgaugaucga

SEQ ID NO: 3185180 - RNA, 19 nt, Mycobacterium bovis subsp bovis AF2122/97
cggagccgaugaucgaaca

SEQ ID NO: 3185181 - RNA, 22 nt, Mycobacterium bovis subsp bovis AF2122/97
cggagccgccaggugcucgucg

SEQ ID NO: 3185182 - RNA, 23 nt, Mycobacterium bovis subsp bovis AF2122/97
cggagccgccaggugcucgucga

SEQ ID NO: 3185183 - RNA, 13 nt, Mycobacterium bovis subsp bovis AF2122/97
cggagccgcccaa

SEQ ID NO: 3185184 - RNA, 15 nt, Mycobacterium bovis subsp bovis AF2122/97
cggagccgcccaagc

SEQ ID NO: 3185185 - RNA, 12 nt, Mycobacterium bovis subsp bovis AF2122/97
cggagccgccgc

SEQ ID NO: 3185186 - RNA, 16 nt, Mycobacterium bovis subsp bovis AF2122/97
cggagccgccgcuggu

SEQ ID NO: 3185187 - RNA, 13 nt, Mycobacterium bovis subsp bovis AF2122/97
cggagccgccggc

SEQ ID NO: 3185188 - RNA, 16 nt, Mycobacterium bovis subsp bovis AF2122/97
cggagccgccggcccc

SEQ ID NO: 3185189 - RNA, 17 nt, Mycobacterium bovis subsp bovis AF2122/97
cggagccgccggccccg

SEQ ID NO: 3185190 - RNA, 22 nt, Mycobacterium bovis subsp bovis AF2122/97
cggagccgccggccccgccagc

SEQ ID NO: 3185191 - RNA, 15 nt, Mycobacterium bovis subsp bovis AF2122/97
cggagccgccggcgg

SEQ ID NO: 3185192 - RNA, 14 nt, Mycobacterium bovis subsp bovis AF2122/97
cggagccgggcagu

SEQ ID NO: 3185193 - RNA, 12 nt, Mycobacterium bovis subsp bovis AF2122/97
cggagccgggug

SEQ ID NO: 3185194 - RNA, 19 nt, Mycobacterium bovis subsp bovis AF2122/97
cggagccgggugaggcggg

SEQ ID NO: 3185195 - RNA, 12 nt, Mycobacterium bovis subsp bovis AF2122/97
cggagccgucga

SEQ ID NO: 3185196 - RNA, 14 nt, Mycobacterium bovis subsp bovis AF2122/97
cggagccgucgagc

SEQ ID NO: 3185197 - RNA, 17 nt, Mycobacterium bovis subsp bovis AF2122/97
cggagccgucgagcagc

SEQ ID NO: 3185198 - RNA, 18 nt, Mycobacterium bovis subsp bovis AF2122/97
cggagccgucgagcagcc

SEQ ID NO: 3185199 - RNA, 14 nt, Mycobacterium bovis subsp bovis AF2122/97
cggagcgauccggc

SEQ ID NO: 3185200 - RNA, 15 nt, Mycobacterium bovis subsp bovis AF2122/97
cggagcgauccggca

SEQ ID NO: 3185201 - RNA, 23 nt, Mycobacterium bovis subsp bovis AF2122/97
cggagcgcauuuguugcugcugc

SEQ ID NO: 3185202 - RNA, 21 nt, Mycobacterium bovis subsp bovis AF2122/97
cggagcgcccuugaucagcua

SEQ ID NO: 3185203 - RNA, 21 nt, Mycobacterium bovis subsp bovis AF2122/97
cggagcgccgagcucggcgcc

SEQ ID NO: 3185204 - RNA, 13 nt, Mycobacterium bovis subsp bovis AF2122/97
cggagcgggccag

SEQ ID NO: 3185205 - RNA, 17 nt, Mycobacterium bovis subsp bovis AF2122/97
cggagcgggccagcacc

SEQ ID NO: 3185206 - RNA, 18 nt, Mycobacterium bovis subsp bovis AF2122/97
cggagcgggccagcaccc

SEQ ID NO: 3185207 - RNA, 17 nt, Mycobacterium bovis subsp bovis AF2122/97
cggagcgggcuccggcu

SEQ ID NO: 3185208 - RNA, 16 nt, Mycobacterium bovis subsp bovis AF2122/97
cggagcggggaaguug

SEQ ID NO: 3185209 - RNA, 16 nt, Mycobacterium bovis subsp bovis AF2122/97
cggagcggucagcgga

SEQ ID NO: 3185210 - RNA, 15 nt, Mycobacterium bovis subsp bovis AF2122/97
cggagcggugccgac

SEQ ID NO: 3185211 - RNA, 22 nt, Mycobacterium bovis subsp bovis AF2122/97
cggagcgguguggucgcaggau

SEQ ID NO: 3185212 - RNA, 19 nt, Mycobacterium bovis subsp bovis AF2122/97
cggagcuagacccgucacc

SEQ ID NO: 3185213 - RNA, 22 nt, Mycobacterium bovis subsp bovis AF2122/97
cggagcuagacccgucaccgcc

SEQ ID NO: 3185214 - RNA, 15 nt, Mycobacterium bovis subsp bovis AF2122/97
cggagcucacgccgg

SEQ ID NO: 3185215 - RNA, 19 nt, Mycobacterium bovis subsp bovis AF2122/97
cggagcucuugcgggcagc

SEQ ID NO: 3185216 - RNA, 21 nt, Mycobacterium bovis subsp bovis AF2122/97
cggagcucuugcgggcagccg

SEQ ID NO: 3185217 - RNA, 10 nt, Mycobacterium bovis subsp bovis AF2122/97
cggagcuggg

SEQ ID NO: 3185218 - RNA, 11 nt, Mycobacterium bovis subsp bovis AF2122/97
cggagcugggc

SEQ ID NO: 3185219 - RNA, 15 nt, Mycobacterium bovis subsp bovis AF2122/97
cggaggauagggcuu

SEQ ID NO: 3185220 - RNA, 13 nt, Mycobacterium bovis subsp bovis AF2122/97
cggaggcaagcaa

SEQ ID NO: 3185221 - RNA, 12 nt, Mycobacterium bovis subsp bovis AF2122/97
cggaggccgccg

SEQ ID NO: 3185222 - RNA, 14 nt, Mycobacterium bovis subsp bovis AF2122/97
cggaggccgccgcg

SEQ ID NO: 3185223 - RNA, 16 nt, Mycobacterium bovis subsp bovis AF2122/97
cggaggccgccgcgcc

SEQ ID NO: 3185224 - RNA, 14 nt, Mycobacterium bovis subsp bovis AF2122/97
cggaggcgaccacg

SEQ ID NO: 3185225 - RNA, 20 nt, Mycobacterium bovis subsp bovis AF2122/97
cggaggcgaccacgucggcg

SEQ ID NO: 3185226 - RNA, 17 nt, Mycobacterium bovis subsp bovis AF2122/97
cggaggcgaccccggcc

SEQ ID NO: 3185227 - RNA, 16 nt, Mycobacterium bovis subsp bovis AF2122/97
cggaggcggaccaggc

SEQ ID NO: 3185228 - RNA, 12 nt, Mycobacterium bovis subsp bovis AF2122/97
cggaggcggcca

SEQ ID NO: 3185229 - RNA, 14 nt, Mycobacterium bovis subsp bovis AF2122/97
cggaggcggccagc

SEQ ID NO: 3185230 - RNA, 17 nt, Mycobacterium bovis subsp bovis AF2122/97
cggaggcgggugcggca

SEQ ID NO: 3185231 - RNA, 17 nt, Mycobacterium bovis subsp bovis AF2122/97
cggaggcugggcugagg

SEQ ID NO: 3185232 - RNA, 18 nt, Mycobacterium bovis subsp bovis AF2122/97
cggaggcuugcaacaccc

SEQ ID NO: 3185233 - RNA, 13 nt, Mycobacterium bovis subsp bovis AF2122/97
cggaggguucgga

SEQ ID NO: 3185234 - RNA, 16 nt, Mycobacterium bovis subsp bovis AF2122/97
cggaggguucggacgg

SEQ ID NO: 3185235 - RNA, 15 nt, Mycobacterium bovis subsp bovis AF2122/97
cggaggugccggcgc

SEQ ID NO: 3185236 - RNA, 16 nt, Mycobacterium bovis subsp bovis AF2122/97
cggaggugccggcgcc

SEQ ID NO: 3185237 - RNA, 16 nt, Mycobacterium bovis subsp bovis AF2122/97
cggagguggggugggg

SEQ ID NO: 3185238 - RNA, 22 nt, Mycobacterium bovis subsp bovis AF2122/97
cggaguacaagggaauugucga

SEQ ID NO: 3185239 - RNA, 15 nt, Mycobacterium bovis subsp bovis AF2122/97
cggaguaccgcgcgu

SEQ ID NO: 3185240 - RNA, 12 nt, Mycobacterium bovis subsp bovis AF2122/97
cggaguagccgc

SEQ ID NO: 3185241 - RNA, 14 nt, Mycobacterium bovis subsp bovis AF2122/97
cggagucaccagca

SEQ ID NO: 3185242 - RNA, 15 nt, Mycobacterium bovis subsp bovis AF2122/97
cggagucaccagcaa

SEQ ID NO: 3185243 - RNA, 19 nt, Mycobacterium bovis subsp bovis AF2122/97
cggaguccgucgacaccgc

SEQ ID NO: 3185244 - RNA, 21 nt, Mycobacterium bovis subsp bovis AF2122/97
cggaguccgucgacaccgcgg

SEQ ID NO: 3185245 - RNA, 15 nt, Mycobacterium bovis subsp bovis AF2122/97
cggaguccgucgggg

SEQ ID NO: 3185246 - RNA, 22 nt, Mycobacterium bovis subsp bovis AF2122/97
cggaguccgucggggacauccg

SEQ ID NO: 3185247 - RNA, 21 nt, Mycobacterium bovis subsp bovis AF2122/97
cggagucgaacaucaccggag

SEQ ID NO: 3185248 - RNA, 12 nt, Mycobacterium bovis subsp bovis AF2122/97
cggagucgacgg

SEQ ID NO: 3185249 - RNA, 14 nt, Mycobacterium bovis subsp bovis AF2122/97
cggagucgacgguu

SEQ ID NO: 3185250 - RNA, 18 nt, Mycobacterium bovis subsp bovis AF2122/97
cggagucgagcacaccga

SEQ ID NO: 3185251 - RNA, 23 nt, Mycobacterium bovis subsp bovis AF2122/97
cggagucgagcacaccgaggucg

SEQ ID NO: 3185252 - RNA, 22 nt, Mycobacterium bovis subsp bovis AF2122/97
cggagucgcccgguccgccgca

SEQ ID NO: 3185253 - RNA, 17 nt, Mycobacterium bovis subsp bovis AF2122/97
cggagucuucgucgucg

SEQ ID NO: 3185254 - RNA, 18 nt, Mycobacterium bovis subsp bovis AF2122/97
cggagugcauguccgacc

SEQ ID NO: 3185255 - RNA, 13 nt, Mycobacterium bovis subsp bovis AF2122/97
cggaguggccagu

SEQ ID NO: 3185256 - RNA, 23 nt, Mycobacterium bovis subsp bovis AF2122/97
cggaguggccaguuggccggcca

SEQ ID NO: 3185257 - RNA, 21 nt, Mycobacterium bovis subsp bovis AF2122/97
cggagugucgaugcgcgccgg

SEQ ID NO: 3185258 - RNA, 21 nt, Mycobacterium bovis subsp bovis AF2122/97
cggaguucaagguguucuggc

SEQ ID NO: 3185259 - RNA, 15 nt, Mycobacterium bovis subsp bovis AF2122/97
cggaguuccgccauu

SEQ ID NO: 3185260 - RNA, 23 nt, Mycobacterium bovis subsp bovis AF2122/97
cggaguuccgccauugccguccg

SEQ ID NO: 3185261 - RNA, 18 nt, Mycobacterium bovis subsp bovis AF2122/97
cggaguucugcgaucacg

SEQ ID NO: 3185262 - RNA, 22 nt, Mycobacterium bovis subsp bovis AF2122/97
cggaguucuucgaaggcguggg

SEQ ID NO: 3185263 - RNA, 20 nt, Mycobacterium bovis subsp bovis AF2122/97
cggaguugaagaagcccgac

SEQ ID NO: 3185264 - RNA, 22 nt, Mycobacterium bovis subsp bovis AF2122/97
cggaguugaagaagcccgacga

SEQ ID NO: 3185265 - RNA, 17 nt, Mycobacterium bovis subsp bovis AF2122/97
cggaguuggcccgacgc

SEQ ID NO: 3185266 - RNA, 23 nt, Mycobacterium bovis subsp bovis AF2122/97
cggaguugucgacggccaccccg

SEQ ID NO: 3185267 - RNA, 22 nt, Mycobacterium bovis subsp bovis AF2122/97
cggaguuuuucgggguggcggc

SEQ ID NO: 3185268 - RNA, 22 nt, Mycobacterium bovis subsp bovis AF2122/97
cggauaacccagcggcgccacg

SEQ ID NO: 3185269 - RNA, 16 nt, Mycobacterium bovis subsp bovis AF2122/97
cggauaaccggcaugc

SEQ ID NO: 3185270 - RNA, 23 nt, Mycobacterium bovis subsp bovis AF2122/97
cggauaaucauccgagcgguggu

SEQ ID NO: 3185271 - RNA, 18 nt, Mycobacterium bovis subsp bovis AF2122/97
cggauaauucaacagcac

SEQ ID NO: 3185272 - RNA, 20 nt, Mycobacterium bovis subsp bovis AF2122/97
cggauaauucaacagcaccg

SEQ ID NO: 3185273 - RNA, 15 nt, Mycobacterium bovis subsp bovis AF2122/97
cggauacagccacgc

SEQ ID NO: 3185274 - RNA, 16 nt, Mycobacterium bovis subsp bovis AF2122/97
cggauacagccgccgc

SEQ ID NO: 3185275 - RNA, 19 nt, Mycobacterium bovis subsp bovis AF2122/97
cggauacagccgccgccgg

SEQ ID NO: 3185276 - RNA, 20 nt, Mycobacterium bovis subsp bovis AF2122/97
cggauacaugguccggccgc

SEQ ID NO: 3185277 - RNA, 20 nt, Mycobacterium bovis subsp bovis AF2122/97
cggauacauuucgucgucgc

SEQ ID NO: 3185278 - RNA, 18 nt, Mycobacterium bovis subsp bovis AF2122/97
cggauacccagccggccu

SEQ ID NO: 3185279 - RNA, 14 nt, Mycobacterium bovis subsp bovis AF2122/97
cggauacgccccug

SEQ ID NO: 3185280 - RNA, 17 nt, Mycobacterium bovis subsp bovis AF2122/97
cggauacgucagcccga

SEQ ID NO: 3185281 - RNA, 14 nt, Mycobacterium bovis subsp bovis AF2122/97
cggauagacggcga

SEQ ID NO: 3185282 - RNA, 15 nt, Mycobacterium bovis subsp bovis AF2122/97
cggauagcaccggca

SEQ ID NO: 3185283 - RNA, 16 nt, Mycobacterium bovis subsp bovis AF2122/97
cggauagcaccggcac

SEQ ID NO: 3185284 - RNA, 20 nt, Mycobacterium bovis subsp bovis AF2122/97
cggauagcaccggcacccgc

SEQ ID NO: 3185285 - RNA, 16 nt, Mycobacterium bovis subsp bovis AF2122/97
cggauagccucggcgg

SEQ ID NO: 3185286 - RNA, 22 nt, Mycobacterium bovis subsp bovis AF2122/97
cggauagcgucgucccagcgcg

SEQ ID NO: 3185287 - RNA, 23 nt, Mycobacterium bovis subsp bovis AF2122/97
cggauagcgucgucccagcgcgg

SEQ ID NO: 3185288 - RNA, 20 nt, Mycobacterium bovis subsp bovis AF2122/97
cggauagcgucuggcgacau

SEQ ID NO: 3185289 - RNA, 20 nt, Mycobacterium bovis subsp bovis AF2122/97
cggauagcuguugaccgugu

SEQ ID NO: 3185290 - RNA, 22 nt, Mycobacterium bovis subsp bovis AF2122/97
cggauaggacgaacaacgcgac

SEQ ID NO: 3185291 - RNA, 19 nt, Mycobacterium bovis subsp bovis AF2122/97
cggauaggccgcgcggcgg

SEQ ID NO: 3185292 - RNA, 22 nt, Mycobacterium bovis subsp bovis AF2122/97
cggauagugguugcggccgucg

SEQ ID NO: 3185293 - RNA, 16 nt, Mycobacterium bovis subsp bovis AF2122/97
cggauaguucaccaca

SEQ ID NO: 3185294 - RNA, 16 nt, Mycobacterium bovis subsp bovis AF2122/97
cggauaucgaccaccg

SEQ ID NO: 3185295 - RNA, 14 nt, Mycobacterium bovis subsp bovis AF2122/97
cggaucaaaaacca

SEQ ID NO: 3185296 - RNA, 20 nt, Mycobacterium bovis subsp bovis AF2122/97
cggaucaaccccacacccgg

SEQ ID NO: 3185297 - RNA, 13 nt, Mycobacterium bovis subsp bovis AF2122/97
cggaucaagagcg

SEQ ID NO: 3185298 - RNA, 19 nt, Mycobacterium bovis subsp bovis AF2122/97
cggaucaagcgcacaaacg

SEQ ID NO: 3185299 - RNA, 19 nt, Mycobacterium bovis subsp bovis AF2122/97
cggaucaccaucgccgccg

SEQ ID NO: 3185300 - RNA, 20 nt, Mycobacterium bovis subsp bovis AF2122/97
cggaucaccaucgccgccgc

SEQ ID NO: 3185301 - RNA, 21 nt, Mycobacterium bovis subsp bovis AF2122/97
cggaucaccaucgccgccgcg

SEQ ID NO: 3185302 - RNA, 22 nt, Mycobacterium bovis subsp bovis AF2122/97
cggaucaccaucgccgccgcgc

SEQ ID NO: 3185303 - RNA, 19 nt, Mycobacterium bovis subsp bovis AF2122/97
cggaucaccgcgcccgccg

SEQ ID NO: 3185304 - RNA, 21 nt, Mycobacterium bovis subsp bovis AF2122/97
cggaucaccgcgcccgccgcg

SEQ ID NO: 3185305 - RNA, 23 nt, Mycobacterium bovis subsp bovis AF2122/97
cggaucacucccccacacacccg

SEQ ID NO: 3185306 - RNA, 22 nt, Mycobacterium bovis subsp bovis AF2122/97
cggaucagaggacccgugcacg

SEQ ID NO: 3185307 - RNA, 18 nt, Mycobacterium bovis subsp bovis AF2122/97
cggaucaggucuggcgcg

SEQ ID NO: 3185308 - RNA, 19 nt, Mycobacterium bovis subsp bovis AF2122/97
cggaucaggucuggcgcgg

SEQ ID NO: 3185309 - RNA, 20 nt, Mycobacterium bovis subsp bovis AF2122/97
cggaucauccuucgccggcg

SEQ ID NO: 3185310 - RNA, 22 nt, Mycobacterium bovis subsp bovis AF2122/97
cggaucauccuucgccggcgcc

SEQ ID NO: 3185311 - RNA, 23 nt, Mycobacterium bovis subsp bovis AF2122/97
cggaucauccuucgccggcgcca

SEQ ID NO: 3185312 - RNA, 16 nt, Mycobacterium bovis subsp bovis AF2122/97
cggaucaucgccgcgg

SEQ ID NO: 3185313 - RNA, 20 nt, Mycobacterium bovis subsp bovis AF2122/97
cggaucaucgccgcggccag

SEQ ID NO: 3185314 - RNA, 15 nt, Mycobacterium bovis subsp bovis AF2122/97
cggaucauuccgacg

SEQ ID NO: 3185315 - RNA, 23 nt, Mycobacterium bovis subsp bovis AF2122/97
cggaucauuccgacgaacccgac

SEQ ID NO: 3185316 - RNA, 15 nt, Mycobacterium bovis subsp bovis AF2122/97
cggaucauucugcgg

SEQ ID NO: 3185317 - RNA, 19 nt, Mycobacterium bovis subsp bovis AF2122/97
cggauccaccacgcuggcc

SEQ ID NO: 3185318 - RNA, 22 nt, Mycobacterium bovis subsp bovis AF2122/97
cggauccaccacgcuggccucg

SEQ ID NO: 3185319 - RNA, 21 nt, Mycobacterium bovis subsp bovis AF2122/97
cggauccacggagaccggccg

SEQ ID NO: 3185320 - RNA, 19 nt, Mycobacterium bovis subsp bovis AF2122/97
cggauccauuagcacaucg

SEQ ID NO: 3185321 - RNA, 15 nt, Mycobacterium bovis subsp bovis AF2122/97
cggaucccaccaccg

SEQ ID NO: 3185322 - RNA, 14 nt, Mycobacterium bovis subsp bovis AF2122/97
cggaucccagugcc

SEQ ID NO: 3185323 - RNA, 19 nt, Mycobacterium bovis subsp bovis AF2122/97
cggaucccgaggcgcccaa

SEQ ID NO: 3185324 - RNA, 22 nt, Mycobacterium bovis subsp bovis AF2122/97
cggauccgauccgcacagcaac

SEQ ID NO: 3185325 - RNA, 14 nt, Mycobacterium bovis subsp bovis AF2122/97
cggauccgaugaca

SEQ ID NO: 3185326 - RNA, 19 nt, Mycobacterium bovis subsp bovis AF2122/97
cggauccgccagaccgcgg

SEQ ID NO: 3185327 - RNA, 13 nt, Mycobacterium bovis subsp bovis AF2122/97
cggauccgcccgc

SEQ ID NO: 3185328 - RNA, 14 nt, Mycobacterium bovis subsp bovis AF2122/97
cggauccggccagg

SEQ ID NO: 3185329 - RNA, 12 nt, Mycobacterium bovis subsp bovis AF2122/97
cggauccgggcg

SEQ ID NO: 3185330 - RNA, 15 nt, Mycobacterium bovis subsp bovis AF2122/97
cggauccgggcgugg

SEQ ID NO: 3185331 - RNA, 14 nt, Mycobacterium bovis subsp bovis AF2122/97
cggaucgaagacca

SEQ ID NO: 3185332 - RNA, 15 nt, Mycobacterium bovis subsp bovis AF2122/97
cggaucgaagaccag

SEQ ID NO: 3185333 - RNA, 17 nt, Mycobacterium bovis subsp bovis AF2122/97
cggaucgaagaccagca

SEQ ID NO: 3185334 - RNA, 20 nt, Mycobacterium bovis subsp bovis AF2122/97
cggaucgaagaccagcaacg

SEQ ID NO: 3185335 - RNA, 19 nt, Mycobacterium bovis subsp bovis AF2122/97
cggaucgaaguccacauau

SEQ ID NO: 3185336 - RNA, 19 nt, Mycobacterium bovis subsp bovis AF2122/97
cggaucgacuucgacgaca

SEQ ID NO: 3185337 - RNA, 15 nt, Mycobacterium bovis subsp bovis AF2122/97
cggaucgauuccgcc

SEQ ID NO: 3185338 - RNA, 13 nt, Mycobacterium bovis subsp bovis AF2122/97
cggaucgccaggc

SEQ ID NO: 3185339 - RNA, 16 nt, Mycobacterium bovis subsp bovis AF2122/97
cggaucgccaggccgu

SEQ ID NO: 3185340 - RNA, 17 nt, Mycobacterium bovis subsp bovis AF2122/97
cggaucgccaggccguc

SEQ ID NO: 3185341 - RNA, 19 nt, Mycobacterium bovis subsp bovis AF2122/97
cggaucgccaggccgucgg

SEQ ID NO: 3185342 - RNA, 19 nt, Mycobacterium bovis subsp bovis AF2122/97
cggaucgccggggacgccg

SEQ ID NO: 3185343 - RNA, 20 nt, Mycobacterium bovis subsp bovis AF2122/97
cggaucgccggggacgccgc

SEQ ID NO: 3185344 - RNA, 15 nt, Mycobacterium bovis subsp bovis AF2122/97
cggaucgccgucgcg

SEQ ID NO: 3185345 - RNA, 14 nt, Mycobacterium bovis subsp bovis AF2122/97
cggaucgccgucgg

SEQ ID NO: 3185346 - RNA, 17 nt, Mycobacterium bovis subsp bovis AF2122/97
cggaucgccgucggcgg

SEQ ID NO: 3185347 - RNA, 22 nt, Mycobacterium bovis subsp bovis AF2122/97
cggaucgccuuggcgcccgcga

SEQ ID NO: 3185348 - RNA, 18 nt, Mycobacterium bovis subsp bovis AF2122/97
cggaucgcgagcgccgcu

SEQ ID NO: 3185349 - RNA, 19 nt, Mycobacterium bovis subsp bovis AF2122/97
cggaucgcgagcgccgcua

SEQ ID NO: 3185350 - RNA, 21 nt, Mycobacterium bovis subsp bovis AF2122/97
cggaucgcgcugaucagccca

SEQ ID NO: 3185351 - RNA, 16 nt, Mycobacterium bovis subsp bovis AF2122/97
cggaucgcgcugcggg

SEQ ID NO: 3185352 - RNA, 16 nt, Mycobacterium bovis subsp bovis AF2122/97
cggaucgcggcggcgu

SEQ ID NO: 3185353 - RNA, 18 nt, Mycobacterium bovis subsp bovis AF2122/97
cggaucgcggcggcgugc

SEQ ID NO: 3185354 - RNA, 15 nt, Mycobacterium bovis subsp bovis AF2122/97
cggaucggacaacac

SEQ ID NO: 3185355 - RNA, 13 nt, Mycobacterium bovis subsp bovis AF2122/97
cggaucggcaccc

SEQ ID NO: 3185356 - RNA, 16 nt, Mycobacterium bovis subsp bovis AF2122/97
cggaucggcaccccac

SEQ ID NO: 3185357 - RNA, 18 nt, Mycobacterium bovis subsp bovis AF2122/97
cggaucggcaccccacgc

SEQ ID NO: 3185358 - RNA, 15 nt, Mycobacterium bovis subsp bovis AF2122/97
cggaucggcgccgca

SEQ ID NO: 3185359 - RNA, 17 nt, Mycobacterium bovis subsp bovis AF2122/97
cggaucggcgccgcaua

SEQ ID NO: 3185360 - RNA, 15 nt, Mycobacterium bovis subsp bovis AF2122/97
cggaucggcggaccg

SEQ ID NO: 3185361 - RNA, 15 nt, Mycobacterium bovis subsp bovis AF2122/97
cggaucggcggccgc

SEQ ID NO: 3185362 - RNA, 16 nt, Mycobacterium bovis subsp bovis AF2122/97
cggaucggcggccgcg

SEQ ID NO: 3185363 - RNA, 17 nt, Mycobacterium bovis subsp bovis AF2122/97
cggaucggcggccgcga

SEQ ID NO: 3185364 - RNA, 20 nt, Mycobacterium bovis subsp bovis AF2122/97
cggaucggcggccgcgacca

SEQ ID NO: 3185365 - RNA, 16 nt, Mycobacterium bovis subsp bovis AF2122/97
cggaucggcggccggc

SEQ ID NO: 3185366 - RNA, 19 nt, Mycobacterium bovis subsp bovis AF2122/97
cggaucggcggccggcacg

SEQ ID NO: 3185367 - RNA, 15 nt, Mycobacterium bovis subsp bovis AF2122/97
cggaucggcuaccua

SEQ ID NO: 3185368 - RNA, 17 nt, Mycobacterium bovis subsp bovis AF2122/97
cggaucggcuaccuaac

SEQ ID NO: 3185369 - RNA, 21 nt, Mycobacterium bovis subsp bovis AF2122/97
cggaucggcuaccuaacccgc

SEQ ID NO: 3185370 - RNA, 15 nt, Mycobacterium bovis subsp bovis AF2122/97
cggaucgggaccggg

SEQ ID NO: 3185371 - RNA, 17 nt, Mycobacterium bovis subsp bovis AF2122/97
cggaucggucggcacca

SEQ ID NO: 3185372 - RNA, 20 nt, Mycobacterium bovis subsp bovis AF2122/97
cggaucgucgaacagcaccg

SEQ ID NO: 3185373 - RNA, 23 nt, Mycobacterium bovis subsp bovis AF2122/97
cggaucgucgaacagcaccgccg

SEQ ID NO: 3185374 - RNA, 23 nt, Mycobacterium bovis subsp bovis AF2122/97
cggaucgucgucguguggggcgg

SEQ ID NO: 3185375 - RNA, 19 nt, Mycobacterium bovis subsp bovis AF2122/97
cggaucgugcccuguccgg

SEQ ID NO: 3185376 - RNA, 16 nt, Mycobacterium bovis subsp bovis AF2122/97
cggaucguggcgcccg

SEQ ID NO: 3185377 - RNA, 17 nt, Mycobacterium bovis subsp bovis AF2122/97
cggaucguggcgcccgu

SEQ ID NO: 3185378 - RNA, 14 nt, Mycobacterium bovis subsp bovis AF2122/97
cggaucguugaggu

SEQ ID NO: 3185379 - RNA, 13 nt, Mycobacterium bovis subsp bovis AF2122/97
cggaucucgaccu

SEQ ID NO: 3185380 - RNA, 22 nt, Mycobacterium bovis subsp bovis AF2122/97
cggaucucgaccucgucggccg

SEQ ID NO: 3185381 - RNA, 23 nt, Mycobacterium bovis subsp bovis AF2122/97
cggaucugagcuagccguucggc

SEQ ID NO: 3185382 - RNA, 14 nt, Mycobacterium bovis subsp bovis AF2122/97
cggaucugcagcac

SEQ ID NO: 3185383 - RNA, 17 nt, Mycobacterium bovis subsp bovis AF2122/97
cggaucuggugggugcg

SEQ ID NO: 3185384 - RNA, 15 nt, Mycobacterium bovis subsp bovis AF2122/97
cggaugaaaugacgg

SEQ ID NO: 3185385 - RNA, 17 nt, Mycobacterium bovis subsp bovis AF2122/97
cggaugacaccgaccgg

SEQ ID NO: 3185386 - RNA, 19 nt, Mycobacterium bovis subsp bovis AF2122/97
cggaugacaccgaccgggu

SEQ ID NO: 3185387 - RNA, 17 nt, Mycobacterium bovis subsp bovis AF2122/97
cggaugagcucggccau

SEQ ID NO: 3185388 - RNA, 14 nt, Mycobacterium bovis subsp bovis AF2122/97
cggaugcccgcaac

SEQ ID NO: 3185389 - RNA, 13 nt, Mycobacterium bovis subsp bovis AF2122/97
cggaugccggucg

SEQ ID NO: 3185390 - RNA, 14 nt, Mycobacterium bovis subsp bovis AF2122/97
cggaugcgauggcc

SEQ ID NO: 3185391 - RNA, 20 nt, Mycobacterium bovis subsp bovis AF2122/97
cggaugcgauggccgacgcu

SEQ ID NO: 3185392 - RNA, 21 nt, Mycobacterium bovis subsp bovis AF2122/97
cggaugcgcaaccgcggcccc

SEQ ID NO: 3185393 - RNA, 12 nt, Mycobacterium bovis subsp bovis AF2122/97
cggaugcgcggc

SEQ ID NO: 3185394 - RNA, 19 nt, Mycobacterium bovis subsp bovis AF2122/97
cggaugcgcuuccaucgcc

SEQ ID NO: 3185395 - RNA, 20 nt, Mycobacterium bovis subsp bovis AF2122/97
cggaugcucaggucaccggc

SEQ ID NO: 3185396 - RNA, 23 nt, Mycobacterium bovis subsp bovis AF2122/97
cggaugcucaggucaccggccgc

SEQ ID NO: 3185397 - RNA, 20 nt, Mycobacterium bovis subsp bovis AF2122/97
cggaugcugucagcagccca

SEQ ID NO: 3185398 - RNA, 17 nt, Mycobacterium bovis subsp bovis AF2122/97
cggauggaacuggacac

SEQ ID NO: 3185399 - RNA, 17 nt, Mycobacterium bovis subsp bovis AF2122/97
cggauggaaggcggcca

SEQ ID NO: 3185400 - RNA, 24 nt, Mycobacterium bovis subsp bovis AF2122/97
cggauggaaggcggccaggugcag

SEQ ID NO: 3185401 - RNA, 14 nt, Mycobacterium bovis subsp bovis AF2122/97
cggauggccccgcc

SEQ ID NO: 3185402 - RNA, 22 nt, Mycobacterium bovis subsp bovis AF2122/97
cggauggccgccuuggcuucga

SEQ ID NO: 3185403 - RNA, 13 nt, Mycobacterium bovis subsp bovis AF2122/97
cggauggcggcca

SEQ ID NO: 3185404 - RNA, 16 nt, Mycobacterium bovis subsp bovis AF2122/97
cggaugggaccuugau

SEQ ID NO: 3185405 - RNA, 20 nt, Mycobacterium bovis subsp bovis AF2122/97
cggauggguacgacaccgca

SEQ ID NO: 3185406 - RNA, 14 nt, Mycobacterium bovis subsp bovis AF2122/97
cggauggucggcca

SEQ ID NO: 3185407 - RNA, 16 nt, Mycobacterium bovis subsp bovis AF2122/97
cggauggucggccacg

SEQ ID NO: 3185408 - RNA, 19 nt, Mycobacterium bovis subsp bovis AF2122/97
cggauggucggccacgcgc

SEQ ID NO: 3185409 - RNA, 15 nt, Mycobacterium bovis subsp bovis AF2122/97
cggauggugugucgg

SEQ ID NO: 3185410 - RNA, 16 nt, Mycobacterium bovis subsp bovis AF2122/97
cggauggugugucggg

SEQ ID NO: 3185411 - RNA, 14 nt, Mycobacterium bovis subsp bovis AF2122/97
cggauguccgccga

SEQ ID NO: 3185412 - RNA, 13 nt, Mycobacterium bovis subsp bovis AF2122/97
cggaugucgacga

SEQ ID NO: 3185413 - RNA, 16 nt, Mycobacterium bovis subsp bovis AF2122/97
cggaugucgacgagca

SEQ ID NO: 3185414 - RNA, 18 nt, Mycobacterium bovis subsp bovis AF2122/97
cggaugucgacgagcacc

SEQ ID NO: 3185415 - RNA, 18 nt, Mycobacterium bovis subsp bovis AF2122/97
cggaugucgcccaaccga

SEQ ID NO: 3185416 - RNA, 21 nt, Mycobacterium bovis subsp bovis AF2122/97
cggaugucgucgaccaggcca

SEQ ID NO: 3185417 - RNA, 19 nt, Mycobacterium bovis subsp bovis AF2122/97
cggaugucucggcaccaca

SEQ ID NO: 3185418 - RNA, 20 nt, Mycobacterium bovis subsp bovis AF2122/97
cggauguguucuccugcccu

SEQ ID NO: 3185419 - RNA, 19 nt, Mycobacterium bovis subsp bovis AF2122/97
cggauguugaccggcucga

SEQ ID NO: 3185420 - RNA, 16 nt, Mycobacterium bovis subsp bovis AF2122/97
cggauuaagucggcgg

SEQ ID NO: 3185421 - RNA, 21 nt, Mycobacterium bovis subsp bovis AF2122/97
cggauuauucgcgguagccgc

SEQ ID NO: 3185422 - RNA, 22 nt, Mycobacterium bovis subsp bovis AF2122/97
cggauucaucacgggacgacgg

SEQ ID NO: 3185423 - RNA, 18 nt, Mycobacterium bovis subsp bovis AF2122/97
cggauuccagcagccugc

SEQ ID NO: 3185424 - RNA, 17 nt, Mycobacterium bovis subsp bovis AF2122/97
cggauucccgcccagca

SEQ ID NO: 3185425 - RNA, 23 nt, Mycobacterium bovis subsp bovis AF2122/97
cggauuccgccaauccaccggug

SEQ ID NO: 3185426 - RNA, 16 nt, Mycobacterium bovis subsp bovis AF2122/97
cggauuccggcaucgg

SEQ ID NO: 3185427 - RNA, 18 nt, Mycobacterium bovis subsp bovis AF2122/97
cggauuccggcucgucag

SEQ ID NO: 3185428 - RNA, 20 nt, Mycobacterium bovis subsp bovis AF2122/97
cggauuccggcucgucaggu

SEQ ID NO: 3185429 - RNA, 17 nt, Mycobacterium bovis subsp bovis AF2122/97
cggauuccgguggcauc

SEQ ID NO: 3185430 - RNA, 15 nt, Mycobacterium bovis subsp bovis AF2122/97
cggauucgcccgggc

SEQ ID NO: 3185431 - RNA, 12 nt, Mycobacterium bovis subsp bovis AF2122/97
cggauucggcgc

SEQ ID NO: 3185432 - RNA, 16 nt, Mycobacterium bovis subsp bovis AF2122/97
cggauucggcugccac

SEQ ID NO: 3185433 - RNA, 12 nt, Mycobacterium bovis subsp bovis AF2122/97
cggauucgggcg

SEQ ID NO: 3185434 - RNA, 21 nt, Mycobacterium bovis subsp bovis AF2122/97
cggauucgguuagcgcggcca

SEQ ID NO: 3185435 - RNA, 13 nt, Mycobacterium bovis subsp bovis AF2122/97
cggauugcagcgc

SEQ ID NO: 3185436 - RNA, 15 nt, Mycobacterium bovis subsp bovis AF2122/97
cggauugcagcgcga

SEQ ID NO: 3185437 - RNA, 19 nt, Mycobacterium bovis subsp bovis AF2122/97
cggauuggccuugugcaga

SEQ ID NO: 3185438 - RNA, 13 nt, Mycobacterium bovis subsp bovis AF2122/97
cggauuggugggc

SEQ ID NO: 3185439 - RNA, 22 nt, Mycobacterium bovis subsp bovis AF2122/97
cggauuucgucgggcaccgcca

SEQ ID NO: 3185440 - RNA, 15 nt, Mycobacterium bovis subsp bovis AF2122/97
cggcaaaacacaccg

SEQ ID NO: 3185441 - RNA, 17 nt, Mycobacterium bovis subsp bovis AF2122/97
cggcaaaacacaccgaa

SEQ ID NO: 3185442 - RNA, 18 nt, Mycobacterium bovis subsp bovis AF2122/97
cggcaaaauaaccguuga

SEQ ID NO: 3185443 - RNA, 14 nt, Mycobacterium bovis subsp bovis AF2122/97
cggcaaacacugcg

SEQ ID NO: 3185444 - RNA, 19 nt, Mycobacterium bovis subsp bovis AF2122/97
cggcaaaccaagcgcgcca

SEQ ID NO: 3185445 - RNA, 20 nt, Mycobacterium bovis subsp bovis AF2122/97
cggcaaaccaagcgcgccag

SEQ ID NO: 3185446 - RNA, 18 nt, Mycobacterium bovis subsp bovis AF2122/97
cggcaaaccaguuggcga

SEQ ID NO: 3185447 - RNA, 22 nt, Mycobacterium bovis subsp bovis AF2122/97
cggcaaaggauuucaccguggg

SEQ ID NO: 3185448 - RNA, 17 nt, Mycobacterium bovis subsp bovis AF2122/97
cggcaaaguuggccgcc

SEQ ID NO: 3185449 - RNA, 20 nt, Mycobacterium bovis subsp bovis AF2122/97
cggcaaaguuggccgcccga

SEQ ID NO: 3185450 - RNA, 14 nt, Mycobacterium bovis subsp bovis AF2122/97
cggcaacaccaccu

SEQ ID NO: 3185451 - RNA, 14 nt, Mycobacterium bovis subsp bovis AF2122/97
cggcaacagcacca

SEQ ID NO: 3185452 - RNA, 15 nt, Mycobacterium bovis subsp bovis AF2122/97
cggcaacagcaccag

SEQ ID NO: 3185453 - RNA, 16 nt, Mycobacterium bovis subsp bovis AF2122/97
cggcaacagcaccagu

SEQ ID NO: 3185454 - RNA, 16 nt, Mycobacterium bovis subsp bovis AF2122/97
cggcaacagcgccaag

SEQ ID NO: 3185455 - RNA, 17 nt, Mycobacterium bovis subsp bovis AF2122/97
cggcaacagcggggugu

SEQ ID NO: 3185456 - RNA, 16 nt, Mycobacterium bovis subsp bovis AF2122/97
cggcaacagcucgccu

SEQ ID NO: 3185457 - RNA, 13 nt, Mycobacterium bovis subsp bovis AF2122/97
cggcaacaucagc

SEQ ID NO: 3185458 - RNA, 20 nt, Mycobacterium bovis subsp bovis AF2122/97
cggcaacaucagcaggacca

SEQ ID NO: 3185459 - RNA, 17 nt, Mycobacterium bovis subsp bovis AF2122/97
cggcaacaugagcgucg

SEQ ID NO: 3185460 - RNA, 24 nt, Mycobacterium bovis subsp bovis AF2122/97
cggcaacaugagcgucgcugaccg

SEQ ID NO: 3185461 - RNA, 14 nt, Mycobacterium bovis subsp bovis AF2122/97
cggcaaccaaccgc

SEQ ID NO: 3185462 - RNA, 17 nt, Mycobacterium bovis subsp bovis AF2122/97
cggcaaccaccggccgc

SEQ ID NO: 3185463 - RNA, 13 nt, Mycobacterium bovis subsp bovis AF2122/97
cggcaaccagcga

SEQ ID NO: 3185464 - RNA, 15 nt, Mycobacterium bovis subsp bovis AF2122/97
cggcaaccagcgagc

SEQ ID NO: 3185465 - RNA, 19 nt, Mycobacterium bovis subsp bovis AF2122/97
cggcaaccagcgagcccag

SEQ ID NO: 3185466 - RNA, 14 nt, Mycobacterium bovis subsp bovis AF2122/97
cggcaaccccgagc

SEQ ID NO: 3185467 - RNA, 16 nt, Mycobacterium bovis subsp bovis AF2122/97
cggcaaccccgagcgg

SEQ ID NO: 3185468 - RNA, 15 nt, Mycobacterium bovis subsp bovis AF2122/97
cggcaaccgccgcca

SEQ ID NO: 3185469 - RNA, 18 nt, Mycobacterium bovis subsp bovis AF2122/97
cggcaaccgccgccacca

SEQ ID NO: 3185470 - RNA, 23 nt, Mycobacterium bovis subsp bovis AF2122/97
cggcaaccgccgccaccagggcg

SEQ ID NO: 3185471 - RNA, 14 nt, Mycobacterium bovis subsp bovis AF2122/97
cggcaaccgccgug

SEQ ID NO: 3185472 - RNA, 21 nt, Mycobacterium bovis subsp bovis AF2122/97
cggcaaccgggaggccaccgc

SEQ ID NO: 3185473 - RNA, 13 nt, Mycobacterium bovis subsp bovis AF2122/97
cggcaaccgggau

SEQ ID NO: 3185474 - RNA, 22 nt, Mycobacterium bovis subsp bovis AF2122/97
cggcaaccgggaucugcuccgc

SEQ ID NO: 3185475 - RNA, 21 nt, Mycobacterium bovis subsp bovis AF2122/97
cggcaaccugaauccagacca

SEQ ID NO: 3185476 - RNA, 16 nt, Mycobacterium bovis subsp bovis AF2122/97
cggcaaccugcgacca

SEQ ID NO: 3185477 - RNA, 20 nt, Mycobacterium bovis subsp bovis AF2122/97
cggcaaccugcgaccaggcg

SEQ ID NO: 3185478 - RNA, 18 nt, Mycobacterium bovis subsp bovis AF2122/97
cggcaacgacugcaugaa

SEQ ID NO: 3185479 - RNA, 23 nt, Mycobacterium bovis subsp bovis AF2122/97
cggcaacgaucgacaccagggcg

SEQ ID NO: 3185480 - RNA, 17 nt, Mycobacterium bovis subsp bovis AF2122/97
cggcaacgcggccuugc

SEQ ID NO: 3185481 - RNA, 14 nt, Mycobacterium bovis subsp bovis AF2122/97
cggcaacgcggucu

SEQ ID NO: 3185482 - RNA, 19 nt, Mycobacterium bovis subsp bovis AF2122/97
cggcaacggcgcgccgacc

SEQ ID NO: 3185483 - RNA, 20 nt, Mycobacterium bovis subsp bovis AF2122/97
cggcaacggcgcgccgacca

SEQ ID NO: 3185484 - RNA, 15 nt, Mycobacterium bovis subsp bovis AF2122/97
cggcaacggcggcaa

SEQ ID NO: 3185485 - RNA, 15 nt, Mycobacterium bovis subsp bovis AF2122/97
cggcaacggcggcga

SEQ ID NO: 3185486 - RNA, 16 nt, Mycobacterium bovis subsp bovis AF2122/97
cggcaacgggggcgcc

SEQ ID NO: 3185487 - RNA, 21 nt, Mycobacterium bovis subsp bovis AF2122/97
cggcaacgggggcgccggagc

SEQ ID NO: 3185488 - RNA, 15 nt, Mycobacterium bovis subsp bovis AF2122/97
cggcaacgguggcaa

SEQ ID NO: 3185489 - RNA, 17 nt, Mycobacterium bovis subsp bovis AF2122/97
cggcaacgguggcaacg

SEQ ID NO: 3185490 - RNA, 14 nt, Mycobacterium bovis subsp bovis AF2122/97
cggcaacgugcggu

SEQ ID NO: 3185491 - RNA, 19 nt, Mycobacterium bovis subsp bovis AF2122/97
cggcaagaccgaacagcgg

SEQ ID NO: 3185492 - RNA, 14 nt, Mycobacterium bovis subsp bovis AF2122/97
cggcaagcacaccg

SEQ ID NO: 3185493 - RNA, 16 nt, Mycobacterium bovis subsp bovis AF2122/97
cggcaagcacaccgcc

SEQ ID NO: 3185494 - RNA, 17 nt, Mycobacterium bovis subsp bovis AF2122/97
cggcaagcacaccgcca

SEQ ID NO: 3185495 - RNA, 13 nt, Mycobacterium bovis subsp bovis AF2122/97
cggcaagcacggu

SEQ ID NO: 3185496 - RNA, 14 nt, Mycobacterium bovis subsp bovis AF2122/97
cggcaagcagucgg

SEQ ID NO: 3185497 - RNA, 17 nt, Mycobacterium bovis subsp bovis AF2122/97
cggcaagccaaccagcc

SEQ ID NO: 3185498 - RNA, 14 nt, Mycobacterium bovis subsp bovis AF2122/97
cggcaagccgggga

SEQ ID NO: 3185499 - RNA, 15 nt, Mycobacterium bovis subsp bovis AF2122/97
cggcaagcgcacgcu

SEQ ID NO: 3185500 - RNA, 18 nt, Mycobacterium bovis subsp bovis AF2122/97
cggcaagcgcacgcugag

SEQ ID NO: 3185501 - RNA, 14 nt, Mycobacterium bovis subsp bovis AF2122/97
cggcaagcgugacc

SEQ ID NO: 3185502 - RNA, 23 nt, Mycobacterium bovis subsp bovis AF2122/97
cggcaagcgugacccgccggcga

SEQ ID NO: 3185503 - RNA, 14 nt, Mycobacterium bovis subsp bovis AF2122/97
cggcaagcucgacg

SEQ ID NO: 3185504 - RNA, 15 nt, Mycobacterium bovis subsp bovis AF2122/97
cggcaagcucgacga

SEQ ID NO: 3185505 - RNA, 17 nt, Mycobacterium bovis subsp bovis AF2122/97
cggcaaggacggagccc

SEQ ID NO: 3185506 - RNA, 21 nt, Mycobacterium bovis subsp bovis AF2122/97
cggcaaggcauucgagcacgu

SEQ ID NO: 3185507 - RNA, 17 nt, Mycobacterium bovis subsp bovis AF2122/97
cggcaagggcggcaacg

SEQ ID NO: 3185508 - RNA, 13 nt, Mycobacterium bovis subsp bovis AF2122/97
cggcaaggguggg

SEQ ID NO: 3185509 - RNA, 17 nt, Mycobacterium bovis subsp bovis AF2122/97
cggcaaggguggggccg

SEQ ID NO: 3185510 - RNA, 21 nt, Mycobacterium bovis subsp bovis AF2122/97
cggcaaggguggggccggcgg

SEQ ID NO: 3185511 - RNA, 12 nt, Mycobacterium bovis subsp bovis AF2122/97
cggcaagucgac

SEQ ID NO: 3185512 - RNA, 14 nt, Mycobacterium bovis subsp bovis AF2122/97
cggcaagucgacgc

SEQ ID NO: 3185513 - RNA, 16 nt, Mycobacterium bovis subsp bovis AF2122/97
cggcaagucgacgccg

SEQ ID NO: 3185514 - RNA, 17 nt, Mycobacterium bovis subsp bovis AF2122/97
cggcaagucgacgccgc

SEQ ID NO: 3185515 - RNA, 18 nt, Mycobacterium bovis subsp bovis AF2122/97
cggcaagucgacgccgca

SEQ ID NO: 3185516 - RNA, 16 nt, Mycobacterium bovis subsp bovis AF2122/97
cggcaauacccgccgc

SEQ ID NO: 3185517 - RNA, 18 nt, Mycobacterium bovis subsp bovis AF2122/97
cggcaauacccgccgcga

SEQ ID NO: 3185518 - RNA, 18 nt, Mycobacterium bovis subsp bovis AF2122/97
cggcaauaccgaaccggu

SEQ ID NO: 3185519 - RNA, 15 nt, Mycobacterium bovis subsp bovis AF2122/97
cggcaauaccgccag

SEQ ID NO: 3185520 - RNA, 23 nt, Mycobacterium bovis subsp bovis AF2122/97
cggcaauaccgccagcgccaccg

SEQ ID NO: 3185521 - RNA, 16 nt, Mycobacterium bovis subsp bovis AF2122/97
cggcaauacuccgcug

SEQ ID NO: 3185522 - RNA, 14 nt, Mycobacterium bovis subsp bovis AF2122/97
cggcaaucaggucg

SEQ ID NO: 3185523 - RNA, 23 nt, Mycobacterium bovis subsp bovis AF2122/97
cggcaaucaggucgucggugucu

SEQ ID NO: 3185524 - RNA, 19 nt, Mycobacterium bovis subsp bovis AF2122/97
cggcaaucucaugcccggg

SEQ ID NO: 3185525 - RNA, 23 nt, Mycobacterium bovis subsp bovis AF2122/97
cggcaaucucccgaaucgugcgg

SEQ ID NO: 3185526 - RNA, 15 nt, Mycobacterium bovis subsp bovis AF2122/97
cggcaaugacggccu

SEQ ID NO: 3185527 - RNA, 16 nt, Mycobacterium bovis subsp bovis AF2122/97
cggcaaugccgcggcc

SEQ ID NO: 3185528 - RNA, 18 nt, Mycobacterium bovis subsp bovis AF2122/97
cggcaauggccagcacca

SEQ ID NO: 3185529 - RNA, 19 nt, Mycobacterium bovis subsp bovis AF2122/97
cggcaauggccagcaccac

SEQ ID NO: 3185530 - RNA, 18 nt, Mycobacterium bovis subsp bovis AF2122/97
cggcaauucgggcauggu

SEQ ID NO: 3185531 - RNA, 19 nt, Mycobacterium bovis subsp bovis AF2122/97
cggcaauucgggcaugguc

SEQ ID NO: 3185532 - RNA, 14 nt, Mycobacterium bovis subsp bovis AF2122/97
cggcacaaucggcg

SEQ ID NO: 3185533 - RNA, 16 nt, Mycobacterium bovis subsp bovis AF2122/97
cggcacaaucggcgcc

SEQ ID NO: 3185534 - RNA, 16 nt, Mycobacterium bovis subsp bovis AF2122/97
cggcacacccaucacc

SEQ ID NO: 3185535 - RNA, 17 nt, Mycobacterium bovis subsp bovis AF2122/97
cggcacacccaucaccg

SEQ ID NO: 3185536 - RNA, 19 nt, Mycobacterium bovis subsp bovis AF2122/97
cggcacacccaucaccgcc

SEQ ID NO: 3185537 - RNA, 20 nt, Mycobacterium bovis subsp bovis AF2122/97
cggcacacccaucaccgcca

SEQ ID NO: 3185538 - RNA, 21 nt, Mycobacterium bovis subsp bovis AF2122/97
cggcacacgaguacagaucga

SEQ ID NO: 3185539 - RNA, 16 nt, Mycobacterium bovis subsp bovis AF2122/97
cggcacacggccuugc

SEQ ID NO: 3185540 - RNA, 17 nt, Mycobacterium bovis subsp bovis AF2122/97
cggcacaggcggccagc

SEQ ID NO: 3185541 - RNA, 20 nt, Mycobacterium bovis subsp bovis AF2122/97
cggcacaggcggccagcauc

SEQ ID NO: 3185542 - RNA, 16 nt, Mycobacterium bovis subsp bovis AF2122/97
cggcacaucaugggcg

SEQ ID NO: 3185543 - RNA, 22 nt, Mycobacterium bovis subsp bovis AF2122/97
cggcacaucaugggcgcugcca

SEQ ID NO: 3185544 - RNA, 20 nt, Mycobacterium bovis subsp bovis AF2122/97
cggcacaugcgcguccagcu

SEQ ID NO: 3185545 - RNA, 20 nt, Mycobacterium bovis subsp bovis AF2122/97
cggcacauugaucgacggcc

SEQ ID NO: 3185546 - RNA, 21 nt, Mycobacterium bovis subsp bovis AF2122/97
cggcacauugaucgacggcca

SEQ ID NO: 3185547 - RNA, 13 nt, Mycobacterium bovis subsp bovis AF2122/97
cggcaccaaccac

SEQ ID NO: 3185548 - RNA, 15 nt, Mycobacterium bovis subsp bovis AF2122/97
cggcaccaaccaccg

SEQ ID NO: 3185549 - RNA, 17 nt, Mycobacterium bovis subsp bovis AF2122/97
cggcaccaaccaccgac

SEQ ID NO: 3185550 - RNA, 18 nt, Mycobacterium bovis subsp bovis AF2122/97
cggcaccaacgccaccgu

SEQ ID NO: 3185551 - RNA, 20 nt, Mycobacterium bovis subsp bovis AF2122/97
cggcaccaacgccaccgucg

SEQ ID NO: 3185552 - RNA, 16 nt, Mycobacterium bovis subsp bovis AF2122/97
cggcaccaaugcggug

SEQ ID NO: 3185553 - RNA, 21 nt, Mycobacterium bovis subsp bovis AF2122/97
cggcaccaaugcggugacaac

SEQ ID NO: 3185554 - RNA, 11 nt, Mycobacterium bovis subsp bovis AF2122/97
cggcaccacca

SEQ ID NO: 3185555 - RNA, 16 nt, Mycobacterium bovis subsp bovis AF2122/97
cggcaccaccgcgacc

SEQ ID NO: 3185556 - RNA, 22 nt, Mycobacterium bovis subsp bovis AF2122/97
cggcaccaccgcgaccucgcgg

SEQ ID NO: 3185557 - RNA, 13 nt, Mycobacterium bovis subsp bovis AF2122/97
cggcaccacgucg

SEQ ID NO: 3185558 - RNA, 21 nt, Mycobacterium bovis subsp bovis AF2122/97
cggcaccagaucaacaucauc

SEQ ID NO: 3185559 - RNA, 17 nt, Mycobacterium bovis subsp bovis AF2122/97
cggcaccagaucuucga

SEQ ID NO: 3185560 - RNA, 18 nt, Mycobacterium bovis subsp bovis AF2122/97
cggcaccagcagccagcc

SEQ ID NO: 3185561 - RNA, 14 nt, Mycobacterium bovis subsp bovis AF2122/97
cggcaccagcgcgc

SEQ ID NO: 3185562 - RNA, 16 nt, Mycobacterium bovis subsp bovis AF2122/97
cggcaccagcggcacc

SEQ ID NO: 3185563 - RNA, 15 nt, Mycobacterium bovis subsp bovis AF2122/97
cggcaccagcggguc

SEQ ID NO: 3185564 - RNA, 20 nt, Mycobacterium bovis subsp bovis AF2122/97
cggcaccagcgggucggcgg

SEQ ID NO: 3185565 - RNA, 21 nt, Mycobacterium bovis subsp bovis AF2122/97
cggcaccagcgggucggcggu

SEQ ID NO: 3185566 - RNA, 19 nt, Mycobacterium bovis subsp bovis AF2122/97
cggcaccagguugccgagg

SEQ ID NO: 3185567 - RNA, 20 nt, Mycobacterium bovis subsp bovis AF2122/97
cggcaccagguugccgaggu

SEQ ID NO: 3185568 - RNA, 14 nt, Mycobacterium bovis subsp bovis AF2122/97
cggcaccauagcug

SEQ ID NO: 3185569 - RNA, 14 nt, Mycobacterium bovis subsp bovis AF2122/97
cggcacccaccagu

SEQ ID NO: 3185570 - RNA, 18 nt, Mycobacterium bovis subsp bovis AF2122/97
cggcacccacccguucgg

SEQ ID NO: 3185571 - RNA, 14 nt, Mycobacterium bovis subsp bovis AF2122/97
cggcacccagucgg

SEQ ID NO: 3185572 - RNA, 20 nt, Mycobacterium bovis subsp bovis AF2122/97
cggcacccagucggcgccgc

SEQ ID NO: 3185573 - RNA, 23 nt, Mycobacterium bovis subsp bovis AF2122/97
cggcacccagucggcgccgccgu

SEQ ID NO: 3185574 - RNA, 15 nt, Mycobacterium bovis subsp bovis AF2122/97
cggcacccaguucca

SEQ ID NO: 3185575 - RNA, 19 nt, Mycobacterium bovis subsp bovis AF2122/97
cggcaccccacgccugccg

SEQ ID NO: 3185576 - RNA, 18 nt, Mycobacterium bovis subsp bovis AF2122/97
cggcacccccgacgagau

SEQ ID NO: 3185577 - RNA, 18 nt, Mycobacterium bovis subsp bovis AF2122/97
cggcacccccgucgccac

SEQ ID NO: 3185578 - RNA, 20 nt, Mycobacterium bovis subsp bovis AF2122/97
cggcacccccgucgccaccg

SEQ ID NO: 3185579 - RNA, 14 nt, Mycobacterium bovis subsp bovis AF2122/97
cggcaccccggcca

SEQ ID NO: 3185580 - RNA, 15 nt, Mycobacterium bovis subsp bovis AF2122/97
cggcaccccggccac

SEQ ID NO: 3185581 - RNA, 18 nt, Mycobacterium bovis subsp bovis AF2122/97
cggcaccccuuugacgcc

SEQ ID NO: 3185582 - RNA, 22 nt, Mycobacterium bovis subsp bovis AF2122/97
cggcacccgaaaacugaccccc

SEQ ID NO: 3185583 - RNA, 23 nt, Mycobacterium bovis subsp bovis AF2122/97
cggcacccgaaaacugacccccu

SEQ ID NO: 3185584 - RNA, 14 nt, Mycobacterium bovis subsp bovis AF2122/97
cggcacccgacucg

SEQ ID NO: 3185585 - RNA, 20 nt, Mycobacterium bovis subsp bovis AF2122/97
cggcacccgacucgucggcc

SEQ ID NO: 3185586 - RNA, 13 nt, Mycobacterium bovis subsp bovis AF2122/97
cggcacccgaguu

SEQ ID NO: 3185587 - RNA, 13 nt, Mycobacterium bovis subsp bovis AF2122/97
cggcacccgcacg

SEQ ID NO: 3185588 - RNA, 17 nt, Mycobacterium bovis subsp bovis AF2122/97
cggcacccgcacggccu

SEQ ID NO: 3185589 - RNA, 23 nt, Mycobacterium bovis subsp bovis AF2122/97
cggcacccgcacggccuccggac

SEQ ID NO: 3185590 - RNA, 15 nt, Mycobacterium bovis subsp bovis AF2122/97
cggcacccgcggcga

SEQ ID NO: 3185591 - RNA, 15 nt, Mycobacterium bovis subsp bovis AF2122/97
cggcacccgcuggcg

SEQ ID NO: 3185592 - RNA, 14 nt, Mycobacterium bovis subsp bovis AF2122/97
cggcacccgggugg

SEQ ID NO: 3185593 - RNA, 14 nt, Mycobacterium bovis subsp bovis AF2122/97
cggcacccggucgg

SEQ ID NO: 3185594 - RNA, 16 nt, Mycobacterium bovis subsp bovis AF2122/97
cggcacccggucggcc

SEQ ID NO: 3185595 - RNA, 17 nt, Mycobacterium bovis subsp bovis AF2122/97
cggcacccggucggcca

SEQ ID NO: 3185596 - RNA, 21 nt, Mycobacterium bovis subsp bovis AF2122/97
cggcacccggugagaagaagc

SEQ ID NO: 3185597 - RNA, 22 nt, Mycobacterium bovis subsp bovis AF2122/97
cggcacccggugagaagaagcc

SEQ ID NO: 3185598 - RNA, 14 nt, Mycobacterium bovis subsp bovis AF2122/97
cggcacccucggcg

SEQ ID NO: 3185599 - RNA, 16 nt, Mycobacterium bovis subsp bovis AF2122/97
cggcacccugcggcac

SEQ ID NO: 3185600 - RNA, 17 nt, Mycobacterium bovis subsp bovis AF2122/97
cggcacccugcggcacc

SEQ ID NO: 3185601 - RNA, 20 nt, Mycobacterium bovis subsp bovis AF2122/97
cggcaccgaagucgaugaug

SEQ ID NO: 3185602 - RNA, 17 nt, Mycobacterium bovis subsp bovis AF2122/97
cggcaccgauggcgcac

SEQ ID NO: 3185603 - RNA, 22 nt, Mycobacterium bovis subsp bovis AF2122/97
cggcaccgcagcggaacugggc

SEQ ID NO: 3185604 - RNA, 12 nt, Mycobacterium bovis subsp bovis AF2122/97
cggcaccgccag

SEQ ID NO: 3185605 - RNA, 16 nt, Mycobacterium bovis subsp bovis AF2122/97
cggcaccgccagugcc

SEQ ID NO: 3185606 - RNA, 12 nt, Mycobacterium bovis subsp bovis AF2122/97
cggcaccgcccc

SEQ ID NO: 3185607 - RNA, 13 nt, Mycobacterium bovis subsp bovis AF2122/97
cggcaccgccccg

SEQ ID NO: 3185608 - RNA, 13 nt, Mycobacterium bovis subsp bovis AF2122/97
cggcaccgccgcc

SEQ ID NO: 3185609 - RNA, 16 nt, Mycobacterium bovis subsp bovis AF2122/97
cggcaccgccgccccc

SEQ ID NO: 3185610 - RNA, 12 nt, Mycobacterium bovis subsp bovis AF2122/97
cggcaccgccgg

SEQ ID NO: 3185611 - RNA, 18 nt, Mycobacterium bovis subsp bovis AF2122/97
cggcaccgccggcaccgc

SEQ ID NO: 3185612 - RNA, 21 nt, Mycobacterium bovis subsp bovis AF2122/97
cggcaccgccggcgcccaggc

SEQ ID NO: 3185613 - RNA, 22 nt, Mycobacterium bovis subsp bovis AF2122/97
cggcaccgccggcgcccaggcc

SEQ ID NO: 3185614 - RNA, 15 nt, Mycobacterium bovis subsp bovis AF2122/97
cggcaccgccggcuc

SEQ ID NO: 3185615 - RNA, 19 nt, Mycobacterium bovis subsp bovis AF2122/97
cggcaccgccggcuccgcc

SEQ ID NO: 3185616 - RNA, 14 nt, Mycobacterium bovis subsp bovis AF2122/97
cggcaccgccggug

SEQ ID NO: 3185617 - RNA, 15 nt, Mycobacterium bovis subsp bovis AF2122/97
cggcaccgccggugg

SEQ ID NO: 3185618 - RNA, 22 nt, Mycobacterium bovis subsp bovis AF2122/97
cggcaccgccgguggcgccggg

SEQ ID NO: 3185619 - RNA, 11 nt, Mycobacterium bovis subsp bovis AF2122/97
cggcaccgccu

SEQ ID NO: 3185620 - RNA, 16 nt, Mycobacterium bovis subsp bovis AF2122/97
cggcaccgccugcgcc

SEQ ID NO: 3185621 - RNA, 11 nt, Mycobacterium bovis subsp bovis AF2122/97
cggcaccgcgc

SEQ ID NO: 3185622 - RNA, 12 nt, Mycobacterium bovis subsp bovis AF2122/97
cggcaccgcgcc

SEQ ID NO: 3185623 - RNA, 14 nt, Mycobacterium bovis subsp bovis AF2122/97
cggcaccgcgccca

SEQ ID NO: 3185624 - RNA, 20 nt, Mycobacterium bovis subsp bovis AF2122/97
cggcaccgcgcccaccagcg

SEQ ID NO: 3185625 - RNA, 15 nt, Mycobacterium bovis subsp bovis AF2122/97
cggcaccgcgccggc

SEQ ID NO: 3185626 - RNA, 17 nt, Mycobacterium bovis subsp bovis AF2122/97
cggcaccgcgccggcgg

SEQ ID NO: 3185627 - RNA, 15 nt, Mycobacterium bovis subsp bovis AF2122/97
cggcaccgcggccag

SEQ ID NO: 3185628 - RNA, 23 nt, Mycobacterium bovis subsp bovis AF2122/97
cggcaccgcguaauucgacuucg

SEQ ID NO: 3185629 - RNA, 14 nt, Mycobacterium bovis subsp bovis AF2122/97
cggcaccgcugccg

SEQ ID NO: 3185630 - RNA, 18 nt, Mycobacterium bovis subsp bovis AF2122/97
cggcaccgcugccgcugc

SEQ ID NO: 3185631 - RNA, 21 nt, Mycobacterium bovis subsp bovis AF2122/97
cggcaccgcugccgcugccga

SEQ ID NO: 3185632 - RNA, 13 nt, Mycobacterium bovis subsp bovis AF2122/97
cggcaccgcuuca

SEQ ID NO: 3185633 - RNA, 16 nt, Mycobacterium bovis subsp bovis AF2122/97
cggcaccgcuucaggc

SEQ ID NO: 3185634 - RNA, 17 nt, Mycobacterium bovis subsp bovis AF2122/97
cggcaccgcuucaggcg

SEQ ID NO: 3185635 - RNA, 13 nt, Mycobacterium bovis subsp bovis AF2122/97
cggcaccggcaac

SEQ ID NO: 3185636 - RNA, 14 nt, Mycobacterium bovis subsp bovis AF2122/97
cggcaccggcccag

SEQ ID NO: 3185637 - RNA, 13 nt, Mycobacterium bovis subsp bovis AF2122/97
cggcaccggccgu

SEQ ID NO: 3185638 - RNA, 22 nt, Mycobacterium bovis subsp bovis AF2122/97
cggcaccggccgugccgccgac

SEQ ID NO: 3185639 - RNA, 15 nt, Mycobacterium bovis subsp bovis AF2122/97
cggcaccggcucagg

SEQ ID NO: 3185640 - RNA, 16 nt, Mycobacterium bovis subsp bovis AF2122/97
cggcaccggcucaggg

SEQ ID NO: 3185641 - RNA, 15 nt, Mycobacterium bovis subsp bovis AF2122/97
cggcaccggugccca

SEQ ID NO: 3185642 - RNA, 21 nt, Mycobacterium bovis subsp bovis AF2122/97
cggcaccgguuuucgccggcu

SEQ ID NO: 3185643 - RNA, 23 nt, Mycobacterium bovis subsp bovis AF2122/97
cggcaccgguuuucgccggcucc

SEQ ID NO: 3185644 - RNA, 20 nt, Mycobacterium bovis subsp bovis AF2122/97
cggcaccguagagcaugccg

SEQ ID NO: 3185645 - RNA, 21 nt, Mycobacterium bovis subsp bovis AF2122/97
cggcaccguagagcaugccgc

SEQ ID NO: 3185646 - RNA, 15 nt, Mycobacterium bovis subsp bovis AF2122/97
cggcaccgucucgca

SEQ ID NO: 3185647 - RNA, 12 nt, Mycobacterium bovis subsp bovis AF2122/97
cggcaccgugcg

SEQ ID NO: 3185648 - RNA, 18 nt, Mycobacterium bovis subsp bovis AF2122/97
cggcaccgugcggggggc

SEQ ID NO: 3185649 - RNA, 16 nt, Mycobacterium bovis subsp bovis AF2122/97
cggcaccgugucgacg

SEQ ID NO: 3185650 - RNA, 16 nt, Mycobacterium bovis subsp bovis AF2122/97
cggcaccuccagcacc

SEQ ID NO: 3185651 - RNA, 20 nt, Mycobacterium bovis subsp bovis AF2122/97
cggcaccuccagcaccaccg

SEQ ID NO: 3185652 - RNA, 19 nt, Mycobacterium bovis subsp bovis AF2122/97
cggcaccuuguagcgggca

SEQ ID NO: 3185653 - RNA, 23 nt, Mycobacterium bovis subsp bovis AF2122/97
cggcacgaaaaugggggcuggua

SEQ ID NO: 3185654 - RNA, 20 nt, Mycobacterium bovis subsp bovis AF2122/97
cggcacgaaauugggcgauu

SEQ ID NO: 3185655 - RNA, 14 nt, Mycobacterium bovis subsp bovis AF2122/97
cggcacgaaucccc

SEQ ID NO: 3185656 - RNA, 13 nt, Mycobacterium bovis subsp bovis AF2122/97
cggcacgacccgg

SEQ ID NO: 3185657 - RNA, 17 nt, Mycobacterium bovis subsp bovis AF2122/97
cggcacgaccgcucccg

SEQ ID NO: 3185658 - RNA, 18 nt, Mycobacterium bovis subsp bovis AF2122/97
cggcacgaccgcucccgg

SEQ ID NO: 3185659 - RNA, 20 nt, Mycobacterium bovis subsp bovis AF2122/97
cggcacgaucaucggggugg

SEQ ID NO: 3185660 - RNA, 15 nt, Mycobacterium bovis subsp bovis AF2122/97
cggcacgaucgccaa

SEQ ID NO: 3185661 - RNA, 15 nt, Mycobacterium bovis subsp bovis AF2122/97
cggcacgaucggcag

SEQ ID NO: 3185662 - RNA, 18 nt, Mycobacterium bovis subsp bovis AF2122/97
cggcacgcaaugucggca

SEQ ID NO: 3185663 - RNA, 14 nt, Mycobacterium bovis subsp bovis AF2122/97
cggcacgccauacc

SEQ ID NO: 3185664 - RNA, 19 nt, Mycobacterium bovis subsp bovis AF2122/97
cggcacgcccacagcugac

SEQ ID NO: 3185665 - RNA, 18 nt, Mycobacterium bovis subsp bovis AF2122/97
cggcacgccgaccggugg

SEQ ID NO: 3185666 - RNA, 14 nt, Mycobacterium bovis subsp bovis AF2122/97
cggcacgccggcgg

SEQ ID NO: 3185667 - RNA, 16 nt, Mycobacterium bovis subsp bovis AF2122/97
cggcacgccggcggcg

SEQ ID NO: 3185668 - RNA, 20 nt, Mycobacterium bovis subsp bovis AF2122/97
cggcacgccggcggcggagg

SEQ ID NO: 3185669 - RNA, 13 nt, Mycobacterium bovis subsp bovis AF2122/97
cggcacgccgggc

SEQ ID NO: 3185670 - RNA, 13 nt, Mycobacterium bovis subsp bovis AF2122/97
cggcacgcgcgcu

SEQ ID NO: 3185671 - RNA, 17 nt, Mycobacterium bovis subsp bovis AF2122/97
cggcacgcugaccggau

SEQ ID NO: 3185672 - RNA, 22 nt, Mycobacterium bovis subsp bovis AF2122/97
cggcacgcugaccggaucugac

SEQ ID NO: 3185673 - RNA, 17 nt, Mycobacterium bovis subsp bovis AF2122/97
cggcacggaccgcgucg

SEQ ID NO: 3185674 - RNA, 22 nt, Mycobacterium bovis subsp bovis AF2122/97
cggcacggaccgcgucgcgggu

SEQ ID NO: 3185675 - RNA, 15 nt, Mycobacterium bovis subsp bovis AF2122/97
cggcacggaugcgau

SEQ ID NO: 3185676 - RNA, 22 nt, Mycobacterium bovis subsp bovis AF2122/97
cggcacggaugcgauggccgac

SEQ ID NO: 3185677 - RNA, 19 nt, Mycobacterium bovis subsp bovis AF2122/97
cggcacgggaaucgcucgc

SEQ ID NO: 3185678 - RNA, 19 nt, Mycobacterium bovis subsp bovis AF2122/97
cggcacgggcggccauggc

SEQ ID NO: 3185679 - RNA, 20 nt, Mycobacterium bovis subsp bovis AF2122/97
cggcacggucacacgccagc

SEQ ID NO: 3185680 - RNA, 12 nt, Mycobacterium bovis subsp bovis AF2122/97
cggcacggugaa

SEQ ID NO: 3185681 - RNA, 12 nt, Mycobacterium bovis subsp bovis AF2122/97
cggcacgguguc

SEQ ID NO: 3185682 - RNA, 16 nt, Mycobacterium bovis subsp bovis AF2122/97
cggcacggugucgcgc

SEQ ID NO: 3185683 - RNA, 17 nt, Mycobacterium bovis subsp bovis AF2122/97
cggcacgucgcccccgg

SEQ ID NO: 3185684 - RNA, 15 nt, Mycobacterium bovis subsp bovis AF2122/97
cggcacgucguuggg

SEQ ID NO: 3185685 - RNA, 16 nt, Mycobacterium bovis subsp bovis AF2122/97
cggcacuacgcagccg

SEQ ID NO: 3185686 - RNA, 24 nt, Mycobacterium bovis subsp bovis AF2122/97
cggcacuacgcagccguagcuggg

SEQ ID NO: 3185687 - RNA, 17 nt, Mycobacterium bovis subsp bovis AF2122/97
cggcacuagcgagccgg

SEQ ID NO: 3185688 - RNA, 14 nt, Mycobacterium bovis subsp bovis AF2122/97
cggcacucccuggg

SEQ ID NO: 3185689 - RNA, 15 nt, Mycobacterium bovis subsp bovis AF2122/97
cggcacucccugggg

SEQ ID NO: 3185690 - RNA, 16 nt, Mycobacterium bovis subsp bovis AF2122/97
cggcacucccuggggu

SEQ ID NO: 3185691 - RNA, 13 nt, Mycobacterium bovis subsp bovis AF2122/97
cggcacugaccgc

SEQ ID NO: 3185692 - RNA, 14 nt, Mycobacterium bovis subsp bovis AF2122/97
cggcacugaccgcg

SEQ ID NO: 3185693 - RNA, 15 nt, Mycobacterium bovis subsp bovis AF2122/97
cggcacugaccgcga

SEQ ID NO: 3185694 - RNA, 16 nt, Mycobacterium bovis subsp bovis AF2122/97
cggcacugaccgcgau

SEQ ID NO: 3185695 - RNA, 20 nt, Mycobacterium bovis subsp bovis AF2122/97
cggcacugaccgcgaugauc

SEQ ID NO: 3185696 - RNA, 14 nt, Mycobacterium bovis subsp bovis AF2122/97
cggcacugaucugc

SEQ ID NO: 3185697 - RNA, 20 nt, Mycobacterium bovis subsp bovis AF2122/97
cggcacugcccagcagacca

SEQ ID NO: 3185698 - RNA, 15 nt, Mycobacterium bovis subsp bovis AF2122/97
cggcacugccgagca

SEQ ID NO: 3185699 - RNA, 22 nt, Mycobacterium bovis subsp bovis AF2122/97
cggcacugcgaaucuccgcgcg

SEQ ID NO: 3185700 - RNA, 23 nt, Mycobacterium bovis subsp bovis AF2122/97
cggcacugcgaaucuccgcgcgg

SEQ ID NO: 3185701 - RNA, 14 nt, Mycobacterium bovis subsp bovis AF2122/97
cggcacugcggcca

SEQ ID NO: 3185702 - RNA, 16 nt, Mycobacterium bovis subsp bovis AF2122/97
cggcacugcggccagu

SEQ ID NO: 3185703 - RNA, 16 nt, Mycobacterium bovis subsp bovis AF2122/97
cggcacuggauccggg

SEQ ID NO: 3185704 - RNA, 14 nt, Mycobacterium bovis subsp bovis AF2122/97
cggcacuggccccg

SEQ ID NO: 3185705 - RNA, 16 nt, Mycobacterium bovis subsp bovis AF2122/97
cggcacuggccccggu

SEQ ID NO: 3185706 - RNA, 17 nt, Mycobacterium bovis subsp bovis AF2122/97
cggcacuggccccggug

SEQ ID NO: 3185707 - RNA, 20 nt, Mycobacterium bovis subsp bovis AF2122/97
cggcacuggugcccgacccg

SEQ ID NO: 3185708 - RNA, 18 nt, Mycobacterium bovis subsp bovis AF2122/97
cggcacugugcguccgca

SEQ ID NO: 3185709 - RNA, 20 nt, Mycobacterium bovis subsp bovis AF2122/97
cggcacugugcguccgcaac

SEQ ID NO: 3185710 - RNA, 16 nt, Mycobacterium bovis subsp bovis AF2122/97
cggcacuuagcccgau

SEQ ID NO: 3185711 - RNA, 18 nt, Mycobacterium bovis subsp bovis AF2122/97
cggcacuuagcccgaugg

SEQ ID NO: 3185712 - RNA, 19 nt, Mycobacterium bovis subsp bovis AF2122/97
cggcacuuagcccgauggu

SEQ ID NO: 3185713 - RNA, 20 nt, Mycobacterium bovis subsp bovis AF2122/97
cggcacuuagcccgauggug

SEQ ID NO: 3185714 - RNA, 23 nt, Mycobacterium bovis subsp bovis AF2122/97
cggcacuuagcccgauggugccg

SEQ ID NO: 3185715 - RNA, 23 nt, Mycobacterium bovis subsp bovis AF2122/97
cggcacuugggaaggauggucga

SEQ ID NO: 3185716 - RNA, 20 nt, Mycobacterium bovis subsp bovis AF2122/97
cggcacuuuguagcccgcga

SEQ ID NO: 3185717 - RNA, 17 nt, Mycobacterium bovis subsp bovis AF2122/97
cggcagaauccggucga

SEQ ID NO: 3185718 - RNA, 19 nt, Mycobacterium bovis subsp bovis AF2122/97
cggcagaauccggucgaug

SEQ ID NO: 3185719 - RNA, 21 nt, Mycobacterium bovis subsp bovis AF2122/97
cggcagaauguucuccacgag

SEQ ID NO: 3185720 - RNA, 18 nt, Mycobacterium bovis subsp bovis AF2122/97
cggcagacaucuggguga

SEQ ID NO: 3185721 - RNA, 15 nt, Mycobacterium bovis subsp bovis AF2122/97
cggcagaccaagccc

SEQ ID NO: 3185722 - RNA, 22 nt, Mycobacterium bovis subsp bovis AF2122/97
cggcagaccaagcccgucgucg

SEQ ID NO: 3185723 - RNA, 15 nt, Mycobacterium bovis subsp bovis AF2122/97
cggcagaccaugguc

SEQ ID NO: 3185724 - RNA, 12 nt, Mycobacterium bovis subsp bovis AF2122/97
cggcagaccgac

SEQ ID NO: 3185725 - RNA, 13 nt, Mycobacterium bovis subsp bovis AF2122/97
cggcagaccgacc

SEQ ID NO: 3185726 - RNA, 19 nt, Mycobacterium bovis subsp bovis AF2122/97
cggcagaccgaccucggcg

SEQ ID NO: 3185727 - RNA, 16 nt, Mycobacterium bovis subsp bovis AF2122/97
cggcagacgcguuucg

SEQ ID NO: 3185728 - RNA, 20 nt, Mycobacterium bovis subsp bovis AF2122/97
cggcagacgcguuucgucga

SEQ ID NO: 3185729 - RNA, 18 nt, Mycobacterium bovis subsp bovis AF2122/97
cggcagagcacgcgcggc

SEQ ID NO: 3185730 - RNA, 16 nt, Mycobacterium bovis subsp bovis AF2122/97
cggcagauacucggcg

SEQ ID NO: 3185731 - RNA, 18 nt, Mycobacterium bovis subsp bovis AF2122/97
cggcagaucccacgccag

SEQ ID NO: 3185732 - RNA, 19 nt, Mycobacterium bovis subsp bovis AF2122/97
cggcagaucccacgccagg

SEQ ID NO: 3185733 - RNA, 20 nt, Mycobacterium bovis subsp bovis AF2122/97
cggcagaugagucaaaaucc

SEQ ID NO: 3185734 - RNA, 22 nt, Mycobacterium bovis subsp bovis AF2122/97
cggcagaugcagcgggucgccg

SEQ ID NO: 3185735 - RNA, 20 nt, Mycobacterium bovis subsp bovis AF2122/97
cggcagauguguccggcauc

SEQ ID NO: 3185736 - RNA, 20 nt, Mycobacterium bovis subsp bovis AF2122/97
cggcagcaacgacgucgucg

SEQ ID NO: 3185737 - RNA, 16 nt, Mycobacterium bovis subsp bovis AF2122/97
cggcagcacccacauc

SEQ ID NO: 3185738 - RNA, 23 nt, Mycobacterium bovis subsp bovis AF2122/97
cggcagcacccacaucagccgca

SEQ ID NO: 3185739 - RNA, 21 nt, Mycobacterium bovis subsp bovis AF2122/97
cggcagcagaguucccugaug

SEQ ID NO: 3185740 - RNA, 17 nt, Mycobacterium bovis subsp bovis AF2122/97
cggcagcagcgggcgcg

SEQ ID NO: 3185741 - RNA, 14 nt, Mycobacterium bovis subsp bovis AF2122/97
cggcagcagcggug

SEQ ID NO: 3185742 - RNA, 15 nt, Mycobacterium bovis subsp bovis AF2122/97
cggcagcagcggugc

SEQ ID NO: 3185743 - RNA, 19 nt, Mycobacterium bovis subsp bovis AF2122/97
cggcagcagcggugcagcc

SEQ ID NO: 3185744 - RNA, 15 nt, Mycobacterium bovis subsp bovis AF2122/97
cggcagcaggacacc

SEQ ID NO: 3185745 - RNA, 20 nt, Mycobacterium bovis subsp bovis AF2122/97
cggcagcaggacaccuaccg

SEQ ID NO: 3185746 - RNA, 21 nt, Mycobacterium bovis subsp bovis AF2122/97
cggcagcauauccgccggcga

SEQ ID NO: 3185747 - RNA, 14 nt, Mycobacterium bovis subsp bovis AF2122/97
cggcagcaucggca

SEQ ID NO: 3185748 - RNA, 16 nt, Mycobacterium bovis subsp bovis AF2122/97
cggcagcaucggcacc

SEQ ID NO: 3185749 - RNA, 21 nt, Mycobacterium bovis subsp bovis AF2122/97
cggcagcaucggcaccccggc

SEQ ID NO: 3185750 - RNA, 18 nt, Mycobacterium bovis subsp bovis AF2122/97
cggcagcaucuccgucgg

SEQ ID NO: 3185751 - RNA, 16 nt, Mycobacterium bovis subsp bovis AF2122/97
cggcagccaaccggcg

SEQ ID NO: 3185752 - RNA, 13 nt, Mycobacterium bovis subsp bovis AF2122/97
cggcagccaccgu

SEQ ID NO: 3185753 - RNA, 17 nt, Mycobacterium bovis subsp bovis AF2122/97
cggcagccagccaccgg

SEQ ID NO: 3185754 - RNA, 20 nt, Mycobacterium bovis subsp bovis AF2122/97
cggcagccagggcgccgaau

SEQ ID NO: 3185755 - RNA, 17 nt, Mycobacterium bovis subsp bovis AF2122/97
cggcagccaugcggcug

SEQ ID NO: 3185756 - RNA, 20 nt, Mycobacterium bovis subsp bovis AF2122/97
cggcagcccaaagcgccagc

SEQ ID NO: 3185757 - RNA, 23 nt, Mycobacterium bovis subsp bovis AF2122/97
cggcagcccaaagcgccagcagc

SEQ ID NO: 3185758 - RNA, 24 nt, Mycobacterium bovis subsp bovis AF2122/97
cggcagcccaaagcgccagcagcc

SEQ ID NO: 3185759 - RNA, 18 nt, Mycobacterium bovis subsp bovis AF2122/97
cggcagccccugccgauc

SEQ ID NO: 3185760 - RNA, 14 nt, Mycobacterium bovis subsp bovis AF2122/97
cggcagcccgcugg

SEQ ID NO: 3185761 - RNA, 14 nt, Mycobacterium bovis subsp bovis AF2122/97
cggcagcccggcgg

SEQ ID NO: 3185762 - RNA, 19 nt, Mycobacterium bovis subsp bovis AF2122/97
cggcagcccggcggccgcu

SEQ ID NO: 3185763 - RNA, 13 nt, Mycobacterium bovis subsp bovis AF2122/97
cggcagcccgggc

SEQ ID NO: 3185764 - RNA, 14 nt, Mycobacterium bovis subsp bovis AF2122/97
cggcagcccgggcg

SEQ ID NO: 3185765 - RNA, 19 nt, Mycobacterium bovis subsp bovis AF2122/97
cggcagcccgggcgugggc

SEQ ID NO: 3185766 - RNA, 13 nt, Mycobacterium bovis subsp bovis AF2122/97
cggcagcccggug

SEQ ID NO: 3185767 - RNA, 13 nt, Mycobacterium bovis subsp bovis AF2122/97
cggcagccgcaua

SEQ ID NO: 3185768 - RNA, 15 nt, Mycobacterium bovis subsp bovis AF2122/97
cggcagccgcauagg

SEQ ID NO: 3185769 - RNA, 13 nt, Mycobacterium bovis subsp bovis AF2122/97
cggcagccggcgg

SEQ ID NO: 3185770 - RNA, 15 nt, Mycobacterium bovis subsp bovis AF2122/97
cggcagccgggcggc

SEQ ID NO: 3185771 - RNA, 19 nt, Mycobacterium bovis subsp bovis AF2122/97
cggcagccgggcggcagcg

SEQ ID NO: 3185772 - RNA, 22 nt, Mycobacterium bovis subsp bovis AF2122/97
cggcagccuugaucucguccca

SEQ ID NO: 3185773 - RNA, 21 nt, Mycobacterium bovis subsp bovis AF2122/97
cggcagcgaaaggagcuccau

SEQ ID NO: 3185774 - RNA, 15 nt, Mycobacterium bovis subsp bovis AF2122/97
cggcagcgacgccgg

SEQ ID NO: 3185775 - RNA, 18 nt, Mycobacterium bovis subsp bovis AF2122/97
cggcagcgacgccggccc

SEQ ID NO: 3185776 - RNA, 20 nt, Mycobacterium bovis subsp bovis AF2122/97
cggcagcgagacuucgacgc

SEQ ID NO: 3185777 - RNA, 18 nt, Mycobacterium bovis subsp bovis AF2122/97
cggcagcgaggccauguu

SEQ ID NO: 3185778 - RNA, 14 nt, Mycobacterium bovis subsp bovis AF2122/97
cggcagcgagucga

SEQ ID NO: 3185779 - RNA, 14 nt, Mycobacterium bovis subsp bovis AF2122/97
cggcagcgaugcgg

SEQ ID NO: 3185780 - RNA, 12 nt, Mycobacterium bovis subsp bovis AF2122/97
cggcagcgccca

SEQ ID NO: 3185781 - RNA, 15 nt, Mycobacterium bovis subsp bovis AF2122/97
cggcagcgcccccgg

SEQ ID NO: 3185782 - RNA, 14 nt, Mycobacterium bovis subsp bovis AF2122/97
cggcagcgccgguc

SEQ ID NO: 3185783 - RNA, 15 nt, Mycobacterium bovis subsp bovis AF2122/97
cggcagcgccggucg

SEQ ID NO: 3185784 - RNA, 16 nt, Mycobacterium bovis subsp bovis AF2122/97
cggcagcgccggucgg

SEQ ID NO: 3185785 - RNA, 19 nt, Mycobacterium bovis subsp bovis AF2122/97
cggcagcgccggucggauc

SEQ ID NO: 3185786 - RNA, 14 nt, Mycobacterium bovis subsp bovis AF2122/97
cggcagcgcggcac

SEQ ID NO: 3185787 - RNA, 17 nt, Mycobacterium bovis subsp bovis AF2122/97
cggcagcgcggcaccca

SEQ ID NO: 3185788 - RNA, 14 nt, Mycobacterium bovis subsp bovis AF2122/97
cggcagcgcggcca

SEQ ID NO: 3185789 - RNA, 17 nt, Mycobacterium bovis subsp bovis AF2122/97
cggcagcgcggccaauu

SEQ ID NO: 3185790 - RNA, 12 nt, Mycobacterium bovis subsp bovis AF2122/97
cggcagcggcga

SEQ ID NO: 3185791 - RNA, 15 nt, Mycobacterium bovis subsp bovis AF2122/97
cggcagcggcgaguu

SEQ ID NO: 3185792 - RNA, 13 nt, Mycobacterium bovis subsp bovis AF2122/97
cggcagcggcgau

SEQ ID NO: 3185793 - RNA, 15 nt, Mycobacterium bovis subsp bovis AF2122/97
cggcagcggcgauca

SEQ ID NO: 3185794 - RNA, 20 nt, Mycobacterium bovis subsp bovis AF2122/97
cggcagcggcgaucaggcgg

SEQ ID NO: 3185795 - RNA, 20 nt, Mycobacterium bovis subsp bovis AF2122/97
cggcagcggcgccgccugga

SEQ ID NO: 3185796 - RNA, 13 nt, Mycobacterium bovis subsp bovis AF2122/97
cggcagcggcgcg

SEQ ID NO: 3185797 - RNA, 17 nt, Mycobacterium bovis subsp bovis AF2122/97
cggcagcggcgcgcugc

SEQ ID NO: 3185798 - RNA, 18 nt, Mycobacterium bovis subsp bovis AF2122/97
cggcagcggcgcgcugca

SEQ ID NO: 3185799 - RNA, 14 nt, Mycobacterium bovis subsp bovis AF2122/97
cggcagcggcgguc

SEQ ID NO: 3185800 - RNA, 17 nt, Mycobacterium bovis subsp bovis AF2122/97
cggcagcggcgucgucg

SEQ ID NO: 3185801 - RNA, 21 nt, Mycobacterium bovis subsp bovis AF2122/97
cggcagcggcgucgucgucga

SEQ ID NO: 3185802 - RNA, 20 nt, Mycobacterium bovis subsp bovis AF2122/97
cggcagcggguuugccgggc

SEQ ID NO: 3185803 - RNA, 21 nt, Mycobacterium bovis subsp bovis AF2122/97
cggcagcggguuugccgggcg

SEQ ID NO: 3185804 - RNA, 23 nt, Mycobacterium bovis subsp bovis AF2122/97
cggcagcggguuugccgggcgcu

SEQ ID NO: 3185805 - RNA, 15 nt, Mycobacterium bovis subsp bovis AF2122/97
cggcagcggugcugg

SEQ ID NO: 3185806 - RNA, 22 nt, Mycobacterium bovis subsp bovis AF2122/97
cggcagcgguggcuugccccgc

SEQ ID NO: 3185807 - RNA, 22 nt, Mycobacterium bovis subsp bovis AF2122/97
cggcagcgguuuuaggcagccc

SEQ ID NO: 3185808 - RNA, 19 nt, Mycobacterium bovis subsp bovis AF2122/97
cggcagcguccgaaccacc

SEQ ID NO: 3185809 - RNA, 16 nt, Mycobacterium bovis subsp bovis AF2122/97
cggcagcgugcggggc

SEQ ID NO: 3185810 - RNA, 21 nt, Mycobacterium bovis subsp bovis AF2122/97
cggcagcguggacaucgggcg

SEQ ID NO: 3185811 - RNA, 13 nt, Mycobacterium bovis subsp bovis AF2122/97
cggcagcuccagc

SEQ ID NO: 3185812 - RNA, 14 nt, Mycobacterium bovis subsp bovis AF2122/97
cggcagcuccagca

SEQ ID NO: 3185813 - RNA, 15 nt, Mycobacterium bovis subsp bovis AF2122/97
cggcagcucccgcca

SEQ ID NO: 3185814 - RNA, 17 nt, Mycobacterium bovis subsp bovis AF2122/97
cggcagcucggggcaca

SEQ ID NO: 3185815 - RNA, 14 nt, Mycobacterium bovis subsp bovis AF2122/97
cggcagcuggcgca

SEQ ID NO: 3185816 - RNA, 20 nt, Mycobacterium bovis subsp bovis AF2122/97
cggcagcuggcgcagccugc

SEQ ID NO: 3185817 - RNA, 16 nt, Mycobacterium bovis subsp bovis AF2122/97
cggcagcuucucgccg

SEQ ID NO: 3185818 - RNA, 17 nt, Mycobacterium bovis subsp bovis AF2122/97
cggcagcuucucgccga

SEQ ID NO: 3185819 - RNA, 20 nt, Mycobacterium bovis subsp bovis AF2122/97
cggcagcuucucgccgacga

SEQ ID NO: 3185820 - RNA, 19 nt, Mycobacterium bovis subsp bovis AF2122/97
cggcagcuugcagugccgc

SEQ ID NO: 3185821 - RNA, 20 nt, Mycobacterium bovis subsp bovis AF2122/97
cggcagcuuugacgcccucg

SEQ ID NO: 3185822 - RNA, 23 nt, Mycobacterium bovis subsp bovis AF2122/97
cggcaggaaucgggucagcacca

SEQ ID NO: 3185823 - RNA, 17 nt, Mycobacterium bovis subsp bovis AF2122/97
cggcaggaaugccgcgg

SEQ ID NO: 3185824 - RNA, 19 nt, Mycobacterium bovis subsp bovis AF2122/97
cggcaggaaugccgcgggg

SEQ ID NO: 3185825 - RNA, 17 nt, Mycobacterium bovis subsp bovis AF2122/97
cggcaggauucccucga

SEQ ID NO: 3185826 - RNA, 20 nt, Mycobacterium bovis subsp bovis AF2122/97
cggcaggauucccucgacag

SEQ ID NO: 3185827 - RNA, 13 nt, Mycobacterium bovis subsp bovis AF2122/97
cggcaggcagggc

SEQ ID NO: 3185828 - RNA, 13 nt, Mycobacterium bovis subsp bovis AF2122/97
cggcaggccggcc

SEQ ID NO: 3185829 - RNA, 14 nt, Mycobacterium bovis subsp bovis AF2122/97
cggcaggccggcca

SEQ ID NO: 3185830 - RNA, 18 nt, Mycobacterium bovis subsp bovis AF2122/97
cggcaggccggccaccga

SEQ ID NO: 3185831 - RNA, 17 nt, Mycobacterium bovis subsp bovis AF2122/97
cggcaggcggccgccgg

SEQ ID NO: 3185832 - RNA, 18 nt, Mycobacterium bovis subsp bovis AF2122/97
cggcaggcggccgccggg

SEQ ID NO: 3185833 - RNA, 14 nt, Mycobacterium bovis subsp bovis AF2122/97
cggcaggcucgggc

SEQ ID NO: 3185834 - RNA, 15 nt, Mycobacterium bovis subsp bovis AF2122/97
cggcaggcucgggca

SEQ ID NO: 3185835 - RNA, 18 nt, Mycobacterium bovis subsp bovis AF2122/97
cggcaggcucgggcaagg

SEQ ID NO: 3185836 - RNA, 14 nt, Mycobacterium bovis subsp bovis AF2122/97
cggcagggccccca

SEQ ID NO: 3185837 - RNA, 16 nt, Mycobacterium bovis subsp bovis AF2122/97
cggcagggcggugcca

SEQ ID NO: 3185838 - RNA, 20 nt, Mycobacterium bovis subsp bovis AF2122/97
cggcaggguggccagcaggc

SEQ ID NO: 3185839 - RNA, 23 nt, Mycobacterium bovis subsp bovis AF2122/97
cggcagguaccaccgcggugugg

SEQ ID NO: 3185840 - RNA, 20 nt, Mycobacterium bovis subsp bovis AF2122/97
cggcagguacggguaacgca

SEQ ID NO: 3185841 - RNA, 22 nt, Mycobacterium bovis subsp bovis AF2122/97
cggcagguccaucuggcgcgcc

SEQ ID NO: 3185842 - RNA, 15 nt, Mycobacterium bovis subsp bovis AF2122/97
cggcaggucgaugcu

SEQ ID NO: 3185843 - RNA, 18 nt, Mycobacterium bovis subsp bovis AF2122/97
cggcaggucuucgcuguc

SEQ ID NO: 3185844 - RNA, 21 nt, Mycobacterium bovis subsp bovis AF2122/97
cggcaggugcccaucgggugg

SEQ ID NO: 3185845 - RNA, 17 nt, Mycobacterium bovis subsp bovis AF2122/97
cggcaggugcggcggca

SEQ ID NO: 3185846 - RNA, 15 nt, Mycobacterium bovis subsp bovis AF2122/97
cggcaggugcgguca

SEQ ID NO: 3185847 - RNA, 16 nt, Mycobacterium bovis subsp bovis AF2122/97
cggcaggugcggucaa

SEQ ID NO: 3185848 - RNA, 17 nt, Mycobacterium bovis subsp bovis AF2122/97
cggcaguaccccucgca

SEQ ID NO: 3185849 - RNA, 19 nt, Mycobacterium bovis subsp bovis AF2122/97
cggcagucccagcgccgca

SEQ ID NO: 3185850 - RNA, 23 nt, Mycobacterium bovis subsp bovis AF2122/97
cggcagucccagcgccgcacaga

SEQ ID NO: 3185851 - RNA, 20 nt, Mycobacterium bovis subsp bovis AF2122/97
cggcaguccgagcuuggccg

SEQ ID NO: 3185852 - RNA, 16 nt, Mycobacterium bovis subsp bovis AF2122/97
cggcagucgcgguacc

SEQ ID NO: 3185853 - RNA, 21 nt, Mycobacterium bovis subsp bovis AF2122/97
cggcagucgcgguaccaucac

SEQ ID NO: 3185854 - RNA, 17 nt, Mycobacterium bovis subsp bovis AF2122/97
cggcagugagucgguga

SEQ ID NO: 3185855 - RNA, 16 nt, Mycobacterium bovis subsp bovis AF2122/97
cggcagugcugcagac

SEQ ID NO: 3185856 - RNA, 17 nt, Mycobacterium bovis subsp bovis AF2122/97
cggcaguggccagaccc

SEQ ID NO: 3185857 - RNA, 20 nt, Mycobacterium bovis subsp bovis AF2122/97
cggcagugggggugguaccg

SEQ ID NO: 3185858 - RNA, 16 nt, Mycobacterium bovis subsp bovis AF2122/97
cggcaguuccugacgc

SEQ ID NO: 3185859 - RNA, 18 nt, Mycobacterium bovis subsp bovis AF2122/97
cggcaguuccugacgcca

SEQ ID NO: 3185860 - RNA, 23 nt, Mycobacterium bovis subsp bovis AF2122/97
cggcaguucgcggccaucgccga

SEQ ID NO: 3185861 - RNA, 15 nt, Mycobacterium bovis subsp bovis AF2122/97
cggcaguuguggcgc

SEQ ID NO: 3185862 - RNA, 16 nt, Mycobacterium bovis subsp bovis AF2122/97
cggcaguuguggcgcu

SEQ ID NO: 3185863 - RNA, 17 nt, Mycobacterium bovis subsp bovis AF2122/97
cggcauaacccuggccg

SEQ ID NO: 3185864 - RNA, 18 nt, Mycobacterium bovis subsp bovis AF2122/97
cggcauaacccuggccgg

SEQ ID NO: 3185865 - RNA, 19 nt, Mycobacterium bovis subsp bovis AF2122/97
cggcauaacccuggccggu

SEQ ID NO: 3185866 - RNA, 12 nt, Mycobacterium bovis subsp bovis AF2122/97
cggcauacaucc

SEQ ID NO: 3185867 - RNA, 20 nt, Mycobacterium bovis subsp bovis AF2122/97
cggcauacccaucaacaucg

SEQ ID NO: 3185868 - RNA, 19 nt, Mycobacterium bovis subsp bovis AF2122/97
cggcauagccgaacagcgg

SEQ ID NO: 3185869 - RNA, 14 nt, Mycobacterium bovis subsp bovis AF2122/97
cggcauagcggccc

SEQ ID NO: 3185870 - RNA, 16 nt, Mycobacterium bovis subsp bovis AF2122/97
cggcauagcucagacc

SEQ ID NO: 3185871 - RNA, 21 nt, Mycobacterium bovis subsp bovis AF2122/97
cggcauagcucagaccggcgc

SEQ ID NO: 3185872 - RNA, 16 nt, Mycobacterium bovis subsp bovis AF2122/97
cggcaucaacgcgggc

SEQ ID NO: 3185873 - RNA, 19 nt, Mycobacterium bovis subsp bovis AF2122/97
cggcaucaacgcgggcgcu

SEQ ID NO: 3185874 - RNA, 23 nt, Mycobacterium bovis subsp bovis AF2122/97
cggcauccagcuucgcucggguc

SEQ ID NO: 3185875 - RNA, 22 nt, Mycobacterium bovis subsp bovis AF2122/97
cggcauccccaguugugcggcc

SEQ ID NO: 3185876 - RNA, 15 nt, Mycobacterium bovis subsp bovis AF2122/97
cggcaucccgccaca

SEQ ID NO: 3185877 - RNA, 18 nt, Mycobacterium bovis subsp bovis AF2122/97
cggcaucccgccacacca

SEQ ID NO: 3185878 - RNA, 21 nt, Mycobacterium bovis subsp bovis AF2122/97
cggcaucccggaacgccgcca

SEQ ID NO: 3185879 - RNA, 21 nt, Mycobacterium bovis subsp bovis AF2122/97
cggcauccgguucgccgccgu

SEQ ID NO: 3185880 - RNA, 19 nt, Mycobacterium bovis subsp bovis AF2122/97
cggcauccucugaaccagc

SEQ ID NO: 3185881 - RNA, 21 nt, Mycobacterium bovis subsp bovis AF2122/97
cggcaucgaagugcggcccgg

SEQ ID NO: 3185882 - RNA, 21 nt, Mycobacterium bovis subsp bovis AF2122/97
cggcaucgacgcggccaacga

SEQ ID NO: 3185883 - RNA, 14 nt, Mycobacterium bovis subsp bovis AF2122/97
cggcaucgacugcc

SEQ ID NO: 3185884 - RNA, 17 nt, Mycobacterium bovis subsp bovis AF2122/97
cggcaucgacugccagc

SEQ ID NO: 3185885 - RNA, 21 nt, Mycobacterium bovis subsp bovis AF2122/97
cggcaucgacugccagcgccg

SEQ ID NO: 3185886 - RNA, 19 nt, Mycobacterium bovis subsp bovis AF2122/97
cggcaucgagacgcacggc

SEQ ID NO: 3185887 - RNA, 20 nt, Mycobacterium bovis subsp bovis AF2122/97
cggcaucgagacgcacggcc

SEQ ID NO: 3185888 - RNA, 23 nt, Mycobacterium bovis subsp bovis AF2122/97
cggcaucgagacgcacggccacc

SEQ ID NO: 3185889 - RNA, 13 nt, Mycobacterium bovis subsp bovis AF2122/97
cggcaucgagcag

SEQ ID NO: 3185890 - RNA, 18 nt, Mycobacterium bovis subsp bovis AF2122/97
cggcaucgaucaacacca

SEQ ID NO: 3185891 - RNA, 15 nt, Mycobacterium bovis subsp bovis AF2122/97
cggcaucgccgagcu

SEQ ID NO: 3185892 - RNA, 20 nt, Mycobacterium bovis subsp bovis AF2122/97
cggcaucgccgagguggaca

SEQ ID NO: 3185893 - RNA, 14 nt, Mycobacterium bovis subsp bovis AF2122/97
cggcaucgccgcgg

SEQ ID NO: 3185894 - RNA, 23 nt, Mycobacterium bovis subsp bovis AF2122/97
cggcaucgcgaucggggcgacga

SEQ ID NO: 3185895 - RNA, 13 nt, Mycobacterium bovis subsp bovis AF2122/97
cggcaucgcgggc

SEQ ID NO: 3185896 - RNA, 17 nt, Mycobacterium bovis subsp bovis AF2122/97
cggcaucgcgggcggcg

SEQ ID NO: 3185897 - RNA, 18 nt, Mycobacterium bovis subsp bovis AF2122/97
cggcaucgcgggcggcgc

SEQ ID NO: 3185898 - RNA, 22 nt, Mycobacterium bovis subsp bovis AF2122/97
cggcaucgcgggcggcgcuggc

SEQ ID NO: 3185899 - RNA, 15 nt, Mycobacterium bovis subsp bovis AF2122/97
cggcaucggccaccu

SEQ ID NO: 3185900 - RNA, 16 nt, Mycobacterium bovis subsp bovis AF2122/97
cggcaucggccagccg

SEQ ID NO: 3185901 - RNA, 14 nt, Mycobacterium bovis subsp bovis AF2122/97
cggcaucggcgacg

SEQ ID NO: 3185902 - RNA, 15 nt, Mycobacterium bovis subsp bovis AF2122/97
cggcaucggcgacga

SEQ ID NO: 3185903 - RNA, 18 nt, Mycobacterium bovis subsp bovis AF2122/97
cggcaucggcggcaaggg

SEQ ID NO: 3185904 - RNA, 20 nt, Mycobacterium bovis subsp bovis AF2122/97
cggcaucggucaccgcggca

SEQ ID NO: 3185905 - RNA, 13 nt, Mycobacterium bovis subsp bovis AF2122/97
cggcaucggugau

SEQ ID NO: 3185906 - RNA, 16 nt, Mycobacterium bovis subsp bovis AF2122/97
cggcaucggugguaac

SEQ ID NO: 3185907 - RNA, 21 nt, Mycobacterium bovis subsp bovis AF2122/97
cggcaucgguucguagcgggc

SEQ ID NO: 3185908 - RNA, 15 nt, Mycobacterium bovis subsp bovis AF2122/97
cggcaucgucggguc

SEQ ID NO: 3185909 - RNA, 14 nt, Mycobacterium bovis subsp bovis AF2122/97
cggcaucuccaccg

SEQ ID NO: 3185910 - RNA, 16 nt, Mycobacterium bovis subsp bovis AF2122/97
cggcaucucgcaccgc

SEQ ID NO: 3185911 - RNA, 20 nt, Mycobacterium bovis subsp bovis AF2122/97
cggcaugacgaaugcgggug

SEQ ID NO: 3185912 - RNA, 16 nt, Mycobacterium bovis subsp bovis AF2122/97
cggcaugagucgaacc

SEQ ID NO: 3185913 - RNA, 17 nt, Mycobacterium bovis subsp bovis AF2122/97
cggcaugaucuuccgga

SEQ ID NO: 3185914 - RNA, 15 nt, Mycobacterium bovis subsp bovis AF2122/97
cggcaugcaaugcug

SEQ ID NO: 3185915 - RNA, 17 nt, Mycobacterium bovis subsp bovis AF2122/97
cggcaugcaaugcuggc

SEQ ID NO: 3185916 - RNA, 23 nt, Mycobacterium bovis subsp bovis AF2122/97
cggcaugcaaugcuggcggcgcg

SEQ ID NO: 3185917 - RNA, 21 nt, Mycobacterium bovis subsp bovis AF2122/97
cggcaugcagccccacuucgg

SEQ ID NO: 3185918 - RNA, 21 nt, Mycobacterium bovis subsp bovis AF2122/97
cggcaugcccgcggugaccac

SEQ ID NO: 3185919 - RNA, 23 nt, Mycobacterium bovis subsp bovis AF2122/97
cggcaugccgccaugcgcaccag

SEQ ID NO: 3185920 - RNA, 23 nt, Mycobacterium bovis subsp bovis AF2122/97
cggcaugccggucuucgcgggac

SEQ ID NO: 3185921 - RNA, 17 nt, Mycobacterium bovis subsp bovis AF2122/97
cggcaugcgcagaaacg

SEQ ID NO: 3185922 - RNA, 13 nt, Mycobacterium bovis subsp bovis AF2122/97
cggcaugggccgg

SEQ ID NO: 3185923 - RNA, 19 nt, Mycobacterium bovis subsp bovis AF2122/97
cggcaugggccggcgccgc

SEQ ID NO: 3185924 - RNA, 23 nt, Mycobacterium bovis subsp bovis AF2122/97
cggcaugggccggcgccgcacca

SEQ ID NO: 3185925 - RNA, 21 nt, Mycobacterium bovis subsp bovis AF2122/97
cggcaugggucgugcaggcga

SEQ ID NO: 3185926 - RNA, 17 nt, Mycobacterium bovis subsp bovis AF2122/97
cggcauguaccgaccgc

SEQ ID NO: 3185927 - RNA, 20 nt, Mycobacterium bovis subsp bovis AF2122/97
cggcauguaccgaccgcguu

SEQ ID NO: 3185928 - RNA, 18 nt, Mycobacterium bovis subsp bovis AF2122/97
cggcauguagaguaucga

SEQ ID NO: 3185929 - RNA, 21 nt, Mycobacterium bovis subsp bovis AF2122/97
cggcaugugacaucgggccgc

SEQ ID NO: 3185930 - RNA, 16 nt, Mycobacterium bovis subsp bovis AF2122/97
cggcauguucagcccg

SEQ ID NO: 3185931 - RNA, 17 nt, Mycobacterium bovis subsp bovis AF2122/97
cggcauguuccuugcgg

SEQ ID NO: 3185932 - RNA, 20 nt, Mycobacterium bovis subsp bovis AF2122/97
cggcauguuccuugcggccg

SEQ ID NO: 3185933 - RNA, 21 nt, Mycobacterium bovis subsp bovis AF2122/97
cggcauguuccuugcggccgc

SEQ ID NO: 3185934 - RNA, 15 nt, Mycobacterium bovis subsp bovis AF2122/97
cggcauucaccgcgg

SEQ ID NO: 3185935 - RNA, 23 nt, Mycobacterium bovis subsp bovis AF2122/97
cggcauuccacaggggccagcgc

SEQ ID NO: 3185936 - RNA, 17 nt, Mycobacterium bovis subsp bovis AF2122/97
cggcauucgcaccaccu

SEQ ID NO: 3185937 - RNA, 17 nt, Mycobacterium bovis subsp bovis AF2122/97
cggcauucucgagcacc

SEQ ID NO: 3185938 - RNA, 19 nt, Mycobacterium bovis subsp bovis AF2122/97
cggcauucucgagcacccg

SEQ ID NO: 3185939 - RNA, 20 nt, Mycobacterium bovis subsp bovis AF2122/97
cggcauucucgagcacccgc

SEQ ID NO: 3185940 - RNA, 19 nt, Mycobacterium bovis subsp bovis AF2122/97
cggcauugagccgggcuau

SEQ ID NO: 3185941 - RNA, 15 nt, Mycobacterium bovis subsp bovis AF2122/97
cggcauugaucggug

SEQ ID NO: 3185942 - RNA, 17 nt, Mycobacterium bovis subsp bovis AF2122/97
cggcauugaucggugcc

SEQ ID NO: 3185943 - RNA, 18 nt, Mycobacterium bovis subsp bovis AF2122/97
cggcauugccgccguugc

SEQ ID NO: 3185944 - RNA, 20 nt, Mycobacterium bovis subsp bovis AF2122/97
cggcauugccgccguugccg

SEQ ID NO: 3185945 - RNA, 16 nt, Mycobacterium bovis subsp bovis AF2122/97
cggcauugcgcaggau

SEQ ID NO: 3185946 - RNA, 18 nt, Mycobacterium bovis subsp bovis AF2122/97
cggcauuggcgucgucgc

SEQ ID NO: 3185947 - RNA, 17 nt, Mycobacterium bovis subsp bovis AF2122/97
cggcauugguaccggcu

SEQ ID NO: 3185948 - RNA, 17 nt, Mycobacterium bovis subsp bovis AF2122/97
cggcauuucagcgcgcc

SEQ ID NO: 3185949 - RNA, 19 nt, Mycobacterium bovis subsp bovis AF2122/97
cggcauuucagcgcgccgc

SEQ ID NO: 3185950 - RNA, 23 nt, Mycobacterium bovis subsp bovis AF2122/97
cggcauuuucgagguacagcggg

SEQ ID NO: 3185951 - RNA, 21 nt, Mycobacterium bovis subsp bovis AF2122/97
cggccaaaacauaucggugcc

SEQ ID NO: 3185952 - RNA, 13 nt, Mycobacterium bovis subsp bovis AF2122/97
cggccaaaauggc

SEQ ID NO: 3185953 - RNA, 17 nt, Mycobacterium bovis subsp bovis AF2122/97
cggccaaagacccggca

SEQ ID NO: 3185954 - RNA, 20 nt, Mycobacterium bovis subsp bovis AF2122/97
cggccaaagacccggcaccc

SEQ ID NO: 3185955 - RNA, 22 nt, Mycobacterium bovis subsp bovis AF2122/97
cggccaaaugccuuugggcugu

SEQ ID NO: 3185956 - RNA, 22 nt, Mycobacterium bovis subsp bovis AF2122/97
cggccaacaccacuagcggcuc

SEQ ID NO: 3185957 - RNA, 13 nt, Mycobacterium bovis subsp bovis AF2122/97
cggccaacagcac

SEQ ID NO: 3185958 - RNA, 21 nt, Mycobacterium bovis subsp bovis AF2122/97
cggccaacagggcgccgacga

SEQ ID NO: 3185959 - RNA, 21 nt, Mycobacterium bovis subsp bovis AF2122/97
cggccaacagguccaccggcc

SEQ ID NO: 3185960 - RNA, 16 nt, Mycobacterium bovis subsp bovis AF2122/97
cggccaaccaccaacu

SEQ ID NO: 3185961 - RNA, 23 nt, Mycobacterium bovis subsp bovis AF2122/97
cggccaacccauuucgucagcga

SEQ ID NO: 3185962 - RNA, 14 nt, Mycobacterium bovis subsp bovis AF2122/97
cggccaacccgggc

SEQ ID NO: 3185963 - RNA, 16 nt, Mycobacterium bovis subsp bovis AF2122/97
cggccaacccgggccg

SEQ ID NO: 3185964 - RNA, 22 nt, Mycobacterium bovis subsp bovis AF2122/97
cggccaacccgggccgccaggg

SEQ ID NO: 3185965 - RNA, 23 nt, Mycobacterium bovis subsp bovis AF2122/97
cggccaacccgggccgccagggc

SEQ ID NO: 3185966 - RNA, 12 nt, Mycobacterium bovis subsp bovis AF2122/97
cggccaacccgu

SEQ ID NO: 3185967 - RNA, 20 nt, Mycobacterium bovis subsp bovis AF2122/97
cggccaacgacgacccguug

SEQ ID NO: 3185968 - RNA, 22 nt, Mycobacterium bovis subsp bovis AF2122/97
cggccaacgacggccgacaacc

SEQ ID NO: 3185969 - RNA, 16 nt, Mycobacterium bovis subsp bovis AF2122/97
cggccaacgccgccgc

SEQ ID NO: 3185970 - RNA, 17 nt, Mycobacterium bovis subsp bovis AF2122/97
cggccaacgccgccgca

SEQ ID NO: 3185971 - RNA, 15 nt, Mycobacterium bovis subsp bovis AF2122/97
cggccaacggcaccc

SEQ ID NO: 3185972 - RNA, 14 nt, Mycobacterium bovis subsp bovis AF2122/97
cggccaacugggcc

SEQ ID NO: 3185973 - RNA, 19 nt, Mycobacterium bovis subsp bovis AF2122/97
cggccaacugggccgagcg

SEQ ID NO: 3185974 - RNA, 22 nt, Mycobacterium bovis subsp bovis AF2122/97
cggccaacugggccgagcgcgc

SEQ ID NO: 3185975 - RNA, 21 nt, Mycobacterium bovis subsp bovis AF2122/97
cggccaacuucugcacgaacg

SEQ ID NO: 3185976 - RNA, 22 nt, Mycobacterium bovis subsp bovis AF2122/97
cggccaagaucggcgccccugc

SEQ ID NO: 3185977 - RNA, 12 nt, Mycobacterium bovis subsp bovis AF2122/97
cggccaaggucg

SEQ ID NO: 3185978 - RNA, 14 nt, Mycobacterium bovis subsp bovis AF2122/97
cggccaaggucgac

SEQ ID NO: 3185979 - RNA, 14 nt, Mycobacterium bovis subsp bovis AF2122/97
cggccaagucacca

SEQ ID NO: 3185980 - RNA, 15 nt, Mycobacterium bovis subsp bovis AF2122/97
cggccaagucaccau

SEQ ID NO: 3185981 - RNA, 17 nt, Mycobacterium bovis subsp bovis AF2122/97
cggccaaguugaccccc

SEQ ID NO: 3185982 - RNA, 18 nt, Mycobacterium bovis subsp bovis AF2122/97
cggccaauccggggcccg

SEQ ID NO: 3185983 - RNA, 20 nt, Mycobacterium bovis subsp bovis AF2122/97
cggccaaugacgucggacca

SEQ ID NO: 3185984 - RNA, 18 nt, Mycobacterium bovis subsp bovis AF2122/97
cggccaauggccgcggca

SEQ ID NO: 3185985 - RNA, 23 nt, Mycobacterium bovis subsp bovis AF2122/97
cggccaauggccgcggcacccag

SEQ ID NO: 3185986 - RNA, 15 nt, Mycobacterium bovis subsp bovis AF2122/97
cggccaauggccugc

SEQ ID NO: 3185987 - RNA, 20 nt, Mycobacterium bovis subsp bovis AF2122/97
cggccaauggugggcgagcu

SEQ ID NO: 3185988 - RNA, 15 nt, Mycobacterium bovis subsp bovis AF2122/97
cggccaauugcgccg

SEQ ID NO: 3185989 - RNA, 16 nt, Mycobacterium bovis subsp bovis AF2122/97
cggccaauugcgccgc

SEQ ID NO: 3185990 - RNA, 18 nt, Mycobacterium bovis subsp bovis AF2122/97
cggccaauugcgccgcca

SEQ ID NO: 3185991 - RNA, 20 nt, Mycobacterium bovis subsp bovis AF2122/97
cggccaauugcgccgccaac

SEQ ID NO: 3185992 - RNA, 23 nt, Mycobacterium bovis subsp bovis AF2122/97
cggccaauugcgccgccaacucc

SEQ ID NO: 3185993 - RNA, 18 nt, Mycobacterium bovis subsp bovis AF2122/97
cggccacaaccucgucgu

SEQ ID NO: 3185994 - RNA, 12 nt, Mycobacterium bovis subsp bovis AF2122/97
cggccacaccgu

SEQ ID NO: 3185995 - RNA, 16 nt, Mycobacterium bovis subsp bovis AF2122/97
cggccacaccgucacg

SEQ ID NO: 3185996 - RNA, 21 nt, Mycobacterium bovis subsp bovis AF2122/97
cggccacaccuuggccgccgg

SEQ ID NO: 3185997 - RNA, 22 nt, Mycobacterium bovis subsp bovis AF2122/97
cggccacaccuuggccgccggc

SEQ ID NO: 3185998 - RNA, 13 nt, Mycobacterium bovis subsp bovis AF2122/97
cggccacagugca

SEQ ID NO: 3185999 - RNA, 20 nt, Mycobacterium bovis subsp bovis AF2122/97
cggccacauaccaccacgug

SEQ ID NO: 3186000 - RNA, 18 nt, Mycobacterium bovis subsp bovis AF2122/97
cggccacauccagcgcuu

SEQ ID NO: 3186001 - RNA, 19 nt, Mycobacterium bovis subsp bovis AF2122/97
cggccacauccagcgcuuc

SEQ ID NO: 3186002 - RNA, 15 nt, Mycobacterium bovis subsp bovis AF2122/97
cggccacaucgccag

SEQ ID NO: 3186003 - RNA, 16 nt, Mycobacterium bovis subsp bovis AF2122/97
cggccacaucgccagc

SEQ ID NO: 3186004 - RNA, 23 nt, Mycobacterium bovis subsp bovis AF2122/97
cggccacaucgccagcagcaaac

SEQ ID NO: 3186005 - RNA, 17 nt, Mycobacterium bovis subsp bovis AF2122/97
cggccacaugccacagc

SEQ ID NO: 3186006 - RNA, 21 nt, Mycobacterium bovis subsp bovis AF2122/97
cggccacaugccacagcggcg

SEQ ID NO: 3186007 - RNA, 22 nt, Mycobacterium bovis subsp bovis AF2122/97
cggccacaugccacagcggcga

SEQ ID NO: 3186008 - RNA, 13 nt, Mycobacterium bovis subsp bovis AF2122/97
cggccaccaaccu

SEQ ID NO: 3186009 - RNA, 21 nt, Mycobacterium bovis subsp bovis AF2122/97
cggccaccaaccucaucgcgg

SEQ ID NO: 3186010 - RNA, 21 nt, Mycobacterium bovis subsp bovis AF2122/97
cggccaccaacucggcgaccu

SEQ ID NO: 3186011 - RNA, 14 nt, Mycobacterium bovis subsp bovis AF2122/97
cggccaccacaacg

SEQ ID NO: 3186012 - RNA, 12 nt, Mycobacterium bovis subsp bovis AF2122/97
cggccaccacca

SEQ ID NO: 3186013 - RNA, 13 nt, Mycobacterium bovis subsp bovis AF2122/97
cggccaccaccag

SEQ ID NO: 3186014 - RNA, 12 nt, Mycobacterium bovis subsp bovis AF2122/97
cggccaccaccg

SEQ ID NO: 3186015 - RNA, 15 nt, Mycobacterium bovis subsp bovis AF2122/97
cggccaccaccgccg

SEQ ID NO: 3186016 - RNA, 17 nt, Mycobacterium bovis subsp bovis AF2122/97
cggccaccaccgccgcc

SEQ ID NO: 3186017 - RNA, 18 nt, Mycobacterium bovis subsp bovis AF2122/97
cggccaccaccgccgccg

SEQ ID NO: 3186018 - RNA, 19 nt, Mycobacterium bovis subsp bovis AF2122/97
cggccaccaccgccgccgg

SEQ ID NO: 3186019 - RNA, 21 nt, Mycobacterium bovis subsp bovis AF2122/97
cggccaccaccgccgccggca

SEQ ID NO: 3186020 - RNA, 22 nt, Mycobacterium bovis subsp bovis AF2122/97
cggccaccaccgccgccggcac

SEQ ID NO: 3186021 - RNA, 14 nt, Mycobacterium bovis subsp bovis AF2122/97
cggccaccaccgcg

SEQ ID NO: 3186022 - RNA, 17 nt, Mycobacterium bovis subsp bovis AF2122/97
cggccaccaccgcgccg

SEQ ID NO: 3186023 - RNA, 18 nt, Mycobacterium bovis subsp bovis AF2122/97
cggccaccaccgcgccgu

SEQ ID NO: 3186024 - RNA, 14 nt, Mycobacterium bovis subsp bovis AF2122/97
cggccaccagcaug

SEQ ID NO: 3186025 - RNA, 12 nt, Mycobacterium bovis subsp bovis AF2122/97
cggccaccagcc

SEQ ID NO: 3186026 - RNA, 14 nt, Mycobacterium bovis subsp bovis AF2122/97
cggccaccagccgg

SEQ ID NO: 3186027 - RNA, 15 nt, Mycobacterium bovis subsp bovis AF2122/97
cggccaccagcgccc

SEQ ID NO: 3186028 - RNA, 17 nt, Mycobacterium bovis subsp bovis AF2122/97
cggccaccagcgcccgg

SEQ ID NO: 3186029 - RNA, 15 nt, Mycobacterium bovis subsp bovis AF2122/97
cggccaccagggcca

SEQ ID NO: 3186030 - RNA, 16 nt, Mycobacterium bovis subsp bovis AF2122/97
cggccaccagggccac

SEQ ID NO: 3186031 - RNA, 17 nt, Mycobacterium bovis subsp bovis AF2122/97
cggccaccagggccacc

SEQ ID NO: 3186032 - RNA, 18 nt, Mycobacterium bovis subsp bovis AF2122/97
cggccaccagggccaccg

SEQ ID NO: 3186033 - RNA, 20 nt, Mycobacterium bovis subsp bovis AF2122/97
cggccaccagggccaccgcg

SEQ ID NO: 3186034 - RNA, 23 nt, Mycobacterium bovis subsp bovis AF2122/97
cggccaccagggccaccgcgccg

SEQ ID NO: 3186035 - RNA, 16 nt, Mycobacterium bovis subsp bovis AF2122/97
cggccaccaggugccg

SEQ ID NO: 3186036 - RNA, 17 nt, Mycobacterium bovis subsp bovis AF2122/97
cggccaccaucgccccg

SEQ ID NO: 3186037 - RNA, 19 nt, Mycobacterium bovis subsp bovis AF2122/97
cggccacccacauggcggc

SEQ ID NO: 3186038 - RNA, 22 nt, Mycobacterium bovis subsp bovis AF2122/97
cggccacccacauggcggcccg

SEQ ID NO: 3186039 - RNA, 17 nt, Mycobacterium bovis subsp bovis AF2122/97
cggccaccccacagucg

SEQ ID NO: 3186040 - RNA, 20 nt, Mycobacterium bovis subsp bovis AF2122/97
cggccacccgcaggucgcac

SEQ ID NO: 3186041 - RNA, 20 nt, Mycobacterium bovis subsp bovis AF2122/97
cggccacccggacauagccg

SEQ ID NO: 3186042 - RNA, 19 nt, Mycobacterium bovis subsp bovis AF2122/97
cggccaccgaccgcaugau

SEQ ID NO: 3186043 - RNA, 15 nt, Mycobacterium bovis subsp bovis AF2122/97
cggccaccgaggcgu

SEQ ID NO: 3186044 - RNA, 19 nt, Mycobacterium bovis subsp bovis AF2122/97
cggccaccgaggcguucag

SEQ ID NO: 3186045 - RNA, 15 nt, Mycobacterium bovis subsp bovis AF2122/97
cggccaccgcacgcu

SEQ ID NO: 3186046 - RNA, 12 nt, Mycobacterium bovis subsp bovis AF2122/97
cggccaccgccg

SEQ ID NO: 3186047 - RNA, 19 nt, Mycobacterium bovis subsp bovis AF2122/97
cggccaccgccgccgccga

SEQ ID NO: 3186048 - RNA, 21 nt, Mycobacterium bovis subsp bovis AF2122/97
cggccaccgccgccgccgacg

SEQ ID NO: 3186049 - RNA, 17 nt, Mycobacterium bovis subsp bovis AF2122/97
cggccaccgccugagcg

SEQ ID NO: 3186050 - RNA, 15 nt, Mycobacterium bovis subsp bovis AF2122/97
cggccaccgcggcgu

SEQ ID NO: 3186051 - RNA, 17 nt, Mycobacterium bovis subsp bovis AF2122/97
cggccaccgucagcgcg

SEQ ID NO: 3186052 - RNA, 18 nt, Mycobacterium bovis subsp bovis AF2122/97
cggccaccucaucgccau

SEQ ID NO: 3186053 - RNA, 23 nt, Mycobacterium bovis subsp bovis AF2122/97
cggccaccucggugcggaacacc

SEQ ID NO: 3186054 - RNA, 15 nt, Mycobacterium bovis subsp bovis AF2122/97
cggccaccugcucgu

SEQ ID NO: 3186055 - RNA, 17 nt, Mycobacterium bovis subsp bovis AF2122/97
cggccaccugcucgucg

SEQ ID NO: 3186056 - RNA, 17 nt, Mycobacterium bovis subsp bovis AF2122/97
cggccaccugcuggccg

SEQ ID NO: 3186057 - RNA, 14 nt, Mycobacterium bovis subsp bovis AF2122/97
cggccaccuggucg

SEQ ID NO: 3186058 - RNA, 17 nt, Mycobacterium bovis subsp bovis AF2122/97
cggccacgacgacugga

SEQ ID NO: 3186059 - RNA, 15 nt, Mycobacterium bovis subsp bovis AF2122/97
cggccacgagucgca

SEQ ID NO: 3186060 - RNA, 13 nt, Mycobacterium bovis subsp bovis AF2122/97
cggccacgccgau

SEQ ID NO: 3186061 - RNA, 14 nt, Mycobacterium bovis subsp bovis AF2122/97
cggccacgccgaug

SEQ ID NO: 3186062 - RNA, 14 nt, Mycobacterium bovis subsp bovis AF2122/97
cggccacgccggcg

SEQ ID NO: 3186063 - RNA, 15 nt, Mycobacterium bovis subsp bovis AF2122/97
cggccacgccggcgu

SEQ ID NO: 3186064 - RNA, 13 nt, Mycobacterium bovis subsp bovis AF2122/97
cggccacgcgcac

SEQ ID NO: 3186065 - RNA, 19 nt, Mycobacterium bovis subsp bovis AF2122/97
cggccacgcgcacucgacg

SEQ ID NO: 3186066 - RNA, 17 nt, Mycobacterium bovis subsp bovis AF2122/97
cggccacggcgucggcc

SEQ ID NO: 3186067 - RNA, 18 nt, Mycobacterium bovis subsp bovis AF2122/97
cggccacggcgucggcca

SEQ ID NO: 3186068 - RNA, 20 nt, Mycobacterium bovis subsp bovis AF2122/97
cggccacggcgucggccacc

SEQ ID NO: 3186069 - RNA, 22 nt, Mycobacterium bovis subsp bovis AF2122/97
cggccacggcgucggccacccg

SEQ ID NO: 3186070 - RNA, 23 nt, Mycobacterium bovis subsp bovis AF2122/97
cggccacggcgucggccacccgg

SEQ ID NO: 3186071 - RNA, 14 nt, Mycobacterium bovis subsp bovis AF2122/97
cggccacgguccgg

SEQ ID NO: 3186072 - RNA, 15 nt, Mycobacterium bovis subsp bovis AF2122/97
cggccacgguccggc

SEQ ID NO: 3186073 - RNA, 15 nt, Mycobacterium bovis subsp bovis AF2122/97
cggccacgucccaga

SEQ ID NO: 3186074 - RNA, 15 nt, Mycobacterium bovis subsp bovis AF2122/97
cggccacgucgaugu

SEQ ID NO: 3186075 - RNA, 19 nt, Mycobacterium bovis subsp bovis AF2122/97
cggccacgucgaugugcgc

SEQ ID NO: 3186076 - RNA, 18 nt, Mycobacterium bovis subsp bovis AF2122/97
cggccacguuguccgcga

SEQ ID NO: 3186077 - RNA, 20 nt, Mycobacterium bovis subsp bovis AF2122/97
cggccacguuguccgcgacg

SEQ ID NO: 3186078 - RNA, 15 nt, Mycobacterium bovis subsp bovis AF2122/97
cggccacuacggccu

SEQ ID NO: 3186079 - RNA, 17 nt, Mycobacterium bovis subsp bovis AF2122/97
cggccacucaacgaccu

SEQ ID NO: 3186080 - RNA, 15 nt, Mycobacterium bovis subsp bovis AF2122/97
cggccacucgcccga

SEQ ID NO: 3186081 - RNA, 21 nt, Mycobacterium bovis subsp bovis AF2122/97
cggccacucgcccgauccgga

SEQ ID NO: 3186082 - RNA, 22 nt, Mycobacterium bovis subsp bovis AF2122/97
cggccacucgcccgauccggau

SEQ ID NO: 3186083 - RNA, 13 nt, Mycobacterium bovis subsp bovis AF2122/97
cggccacucggga

SEQ ID NO: 3186084 - RNA, 20 nt, Mycobacterium bovis subsp bovis AF2122/97
cggccacugauucgcaggcu

SEQ ID NO: 3186085 - RNA, 17 nt, Mycobacterium bovis subsp bovis AF2122/97
cggccagaaacccggcg

SEQ ID NO: 3186086 - RNA, 21 nt, Mycobacterium bovis subsp bovis AF2122/97
cggccagaaacccggcgacca

SEQ ID NO: 3186087 - RNA, 22 nt, Mycobacterium bovis subsp bovis AF2122/97
cggccagaaacccggcgaccac

SEQ ID NO: 3186088 - RNA, 20 nt, Mycobacterium bovis subsp bovis AF2122/97
cggccagaaagaucgguuga

SEQ ID NO: 3186089 - RNA, 17 nt, Mycobacterium bovis subsp bovis AF2122/97
cggccagacccuggccg

SEQ ID NO: 3186090 - RNA, 19 nt, Mycobacterium bovis subsp bovis AF2122/97
cggccagacggugcagcuc

SEQ ID NO: 3186091 - RNA, 19 nt, Mycobacterium bovis subsp bovis AF2122/97
cggccagacucgcggucga

SEQ ID NO: 3186092 - RNA, 14 nt, Mycobacterium bovis subsp bovis AF2122/97
cggccagagccgcg

SEQ ID NO: 3186093 - RNA, 15 nt, Mycobacterium bovis subsp bovis AF2122/97
cggccagagccgcgc

SEQ ID NO: 3186094 - RNA, 16 nt, Mycobacterium bovis subsp bovis AF2122/97
cggccagagccgcgcg

SEQ ID NO: 3186095 - RNA, 21 nt, Mycobacterium bovis subsp bovis AF2122/97
cggccagagccgcgcgccggu

SEQ ID NO: 3186096 - RNA, 21 nt, Mycobacterium bovis subsp bovis AF2122/97
cggccagauagguuccaccgg

SEQ ID NO: 3186097 - RNA, 20 nt, Mycobacterium bovis subsp bovis AF2122/97
cggccagaugguggcaugcu

SEQ ID NO: 3186098 - RNA, 22 nt, Mycobacterium bovis subsp bovis AF2122/97
cggccagcacccgaaccgggga

SEQ ID NO: 3186099 - RNA, 18 nt, Mycobacterium bovis subsp bovis AF2122/97
cggccagcacgccgccgg

SEQ ID NO: 3186100 - RNA, 19 nt, Mycobacterium bovis subsp bovis AF2122/97
cggccagcacgccgccggc

SEQ ID NO: 3186101 - RNA, 13 nt, Mycobacterium bovis subsp bovis AF2122/97
cggccagcacguc

SEQ ID NO: 3186102 - RNA, 17 nt, Mycobacterium bovis subsp bovis AF2122/97
cggccagcacuccgcgg

SEQ ID NO: 3186103 - RNA, 16 nt, Mycobacterium bovis subsp bovis AF2122/97
cggccagcagcagaug

SEQ ID NO: 3186104 - RNA, 20 nt, Mycobacterium bovis subsp bovis AF2122/97
cggccagcagcagugccacc

SEQ ID NO: 3186105 - RNA, 14 nt, Mycobacterium bovis subsp bovis AF2122/97
cggccagcagugcg

SEQ ID NO: 3186106 - RNA, 18 nt, Mycobacterium bovis subsp bovis AF2122/97
cggccagcaucagcucga

SEQ ID NO: 3186107 - RNA, 21 nt, Mycobacterium bovis subsp bovis AF2122/97
cggccagcauuagccaggccc

SEQ ID NO: 3186108 - RNA, 16 nt, Mycobacterium bovis subsp bovis AF2122/97
cggccagccagcgauc

SEQ ID NO: 3186109 - RNA, 17 nt, Mycobacterium bovis subsp bovis AF2122/97
cggccagccagcgaucc

SEQ ID NO: 3186110 - RNA, 20 nt, Mycobacterium bovis subsp bovis AF2122/97
cggccagccagcgggcgaug

SEQ ID NO: 3186111 - RNA, 18 nt, Mycobacterium bovis subsp bovis AF2122/97
cggccagccauggcagcg

SEQ ID NO: 3186112 - RNA, 20 nt, Mycobacterium bovis subsp bovis AF2122/97
cggccagccauggcagcgcc

SEQ ID NO: 3186113 - RNA, 24 nt, Mycobacterium bovis subsp bovis AF2122/97
cggccagccauggcagcgccgcag

SEQ ID NO: 3186114 - RNA, 13 nt, Mycobacterium bovis subsp bovis AF2122/97
cggccagccgacg

SEQ ID NO: 3186115 - RNA, 18 nt, Mycobacterium bovis subsp bovis AF2122/97
cggccagccgacgcggcg

SEQ ID NO: 3186116 - RNA, 13 nt, Mycobacterium bovis subsp bovis AF2122/97
cggccagccgcac

SEQ ID NO: 3186117 - RNA, 13 nt, Mycobacterium bovis subsp bovis AF2122/97
cggccagccgcgg

SEQ ID NO: 3186118 - RNA, 13 nt, Mycobacterium bovis subsp bovis AF2122/97
cggccagccgcuc

SEQ ID NO: 3186119 - RNA, 15 nt, Mycobacterium bovis subsp bovis AF2122/97
cggccagccgcucca

SEQ ID NO: 3186120 - RNA, 17 nt, Mycobacterium bovis subsp bovis AF2122/97
cggccagccgcuccacg

SEQ ID NO: 3186121 - RNA, 19 nt, Mycobacterium bovis subsp bovis AF2122/97
cggccagccuaccggcuac

SEQ ID NO: 3186122 - RNA, 14 nt, Mycobacterium bovis subsp bovis AF2122/97
cggccagccucauc

SEQ ID NO: 3186123 - RNA, 20 nt, Mycobacterium bovis subsp bovis AF2122/97
cggccagccucaucugaggc

SEQ ID NO: 3186124 - RNA, 20 nt, Mycobacterium bovis subsp bovis AF2122/97
cggccagcgaaaguguggaa

SEQ ID NO: 3186125 - RNA, 13 nt, Mycobacterium bovis subsp bovis AF2122/97
cggccagcgcacc

SEQ ID NO: 3186126 - RNA, 16 nt, Mycobacterium bovis subsp bovis AF2122/97
cggccagcgcaccgcc

SEQ ID NO: 3186127 - RNA, 13 nt, Mycobacterium bovis subsp bovis AF2122/97
cggccagcgcccg

SEQ ID NO: 3186128 - RNA, 14 nt, Mycobacterium bovis subsp bovis AF2122/97
cggccagcgcccgc

SEQ ID NO: 3186129 - RNA, 15 nt, Mycobacterium bovis subsp bovis AF2122/97
cggccagcgcccgca

SEQ ID NO: 3186130 - RNA, 15 nt, Mycobacterium bovis subsp bovis AF2122/97
cggccagcgcgcgcg

SEQ ID NO: 3186131 - RNA, 19 nt, Mycobacterium bovis subsp bovis AF2122/97
cggccagcgcgcgcgggug

SEQ ID NO: 3186132 - RNA, 12 nt, Mycobacterium bovis subsp bovis AF2122/97
cggccagcgcgg

SEQ ID NO: 3186133 - RNA, 15 nt, Mycobacterium bovis subsp bovis AF2122/97
cggccagcgcggcgc

SEQ ID NO: 3186134 - RNA, 16 nt, Mycobacterium bovis subsp bovis AF2122/97
cggccagcgcggcgcg

SEQ ID NO: 3186135 - RNA, 13 nt, Mycobacterium bovis subsp bovis AF2122/97
cggccagcgcugc

SEQ ID NO: 3186136 - RNA, 17 nt, Mycobacterium bovis subsp bovis AF2122/97
cggccagcgcugcugcc

SEQ ID NO: 3186137 - RNA, 21 nt, Mycobacterium bovis subsp bovis AF2122/97
cggccagcggccauccggcgg

SEQ ID NO: 3186138 - RNA, 13 nt, Mycobacterium bovis subsp bovis AF2122/97
cggccagcggccc

SEQ ID NO: 3186139 - RNA, 16 nt, Mycobacterium bovis subsp bovis AF2122/97
cggccagcggcccguc

SEQ ID NO: 3186140 - RNA, 19 nt, Mycobacterium bovis subsp bovis AF2122/97
cggccagcgggaacacacc

SEQ ID NO: 3186141 - RNA, 21 nt, Mycobacterium bovis subsp bovis AF2122/97
cggccagcgucagcuguuugc

SEQ ID NO: 3186142 - RNA, 23 nt, Mycobacterium bovis subsp bovis AF2122/97
cggccagcgucagcuguuugccg

SEQ ID NO: 3186143 - RNA, 18 nt, Mycobacterium bovis subsp bovis AF2122/97
cggccagcgugucccaac

SEQ ID NO: 3186144 - RNA, 20 nt, Mycobacterium bovis subsp bovis AF2122/97
cggccagcgugucccaacgc

SEQ ID NO: 3186145 - RNA, 21 nt, Mycobacterium bovis subsp bovis AF2122/97
cggccagcgugucccaacgcc

SEQ ID NO: 3186146 - RNA, 16 nt, Mycobacterium bovis subsp bovis AF2122/97
cggccagcgugucgug

SEQ ID NO: 3186147 - RNA, 13 nt, Mycobacterium bovis subsp bovis AF2122/97
cggccagcucccg

SEQ ID NO: 3186148 - RNA, 15 nt, Mycobacterium bovis subsp bovis AF2122/97
cggccagcucccggg

SEQ ID NO: 3186149 - RNA, 18 nt, Mycobacterium bovis subsp bovis AF2122/97
cggccagcuccgccugcc

SEQ ID NO: 3186150 - RNA, 12 nt, Mycobacterium bovis subsp bovis AF2122/97
cggccagcucgc

SEQ ID NO: 3186151 - RNA, 17 nt, Mycobacterium bovis subsp bovis AF2122/97
cggccagcucgcgggcc

SEQ ID NO: 3186152 - RNA, 14 nt, Mycobacterium bovis subsp bovis AF2122/97
cggccagcucggcc

SEQ ID NO: 3186153 - RNA, 15 nt, Mycobacterium bovis subsp bovis AF2122/97
cggccagcucggcca

SEQ ID NO: 3186154 - RNA, 18 nt, Mycobacterium bovis subsp bovis AF2122/97
cggccagcucggccagcu

SEQ ID NO: 3186155 - RNA, 15 nt, Mycobacterium bovis subsp bovis AF2122/97
cggccagcugcagca

SEQ ID NO: 3186156 - RNA, 20 nt, Mycobacterium bovis subsp bovis AF2122/97
cggccagcugcguggcgaac

SEQ ID NO: 3186157 - RNA, 14 nt, Mycobacterium bovis subsp bovis AF2122/97
cggccagcuguucg

SEQ ID NO: 3186158 - RNA, 17 nt, Mycobacterium bovis subsp bovis AF2122/97
cggccagcuguucgagc

SEQ ID NO: 3186159 - RNA, 18 nt, Mycobacterium bovis subsp bovis AF2122/97
cggccagcuugagguccg

SEQ ID NO: 3186160 - RNA, 17 nt, Mycobacterium bovis subsp bovis AF2122/97
cggccagcuugcggagc

SEQ ID NO: 3186161 - RNA, 19 nt, Mycobacterium bovis subsp bovis AF2122/97
cggccagcuugcggagccg

SEQ ID NO: 3186162 - RNA, 20 nt, Mycobacterium bovis subsp bovis AF2122/97
cggccagcuugcggagccgc

SEQ ID NO: 3186163 - RNA, 18 nt, Mycobacterium bovis subsp bovis AF2122/97
cggccaggacaacgcacc

SEQ ID NO: 3186164 - RNA, 21 nt, Mycobacterium bovis subsp bovis AF2122/97
cggccaggaguuugaccaccu

SEQ ID NO: 3186165 - RNA, 22 nt, Mycobacterium bovis subsp bovis AF2122/97
cggccaggaguuugaccaccug

SEQ ID NO: 3186166 - RNA, 19 nt, Mycobacterium bovis subsp bovis AF2122/97
cggccaggaucgcuacguc

SEQ ID NO: 3186167 - RNA, 23 nt, Mycobacterium bovis subsp bovis AF2122/97
cggccaggaugaauuuggugaag

SEQ ID NO: 3186168 - RNA, 21 nt, Mycobacterium bovis subsp bovis AF2122/97
cggccaggaugccugccaccc

SEQ ID NO: 3186169 - RNA, 23 nt, Mycobacterium bovis subsp bovis AF2122/97
cggccaggaugccugccacccgu

SEQ ID NO: 3186170 - RNA, 11 nt, Mycobacterium bovis subsp bovis AF2122/97
cggccaggccg

SEQ ID NO: 3186171 - RNA, 12 nt, Mycobacterium bovis subsp bovis AF2122/97
cggccaggccga

SEQ ID NO: 3186172 - RNA, 12 nt, Mycobacterium bovis subsp bovis AF2122/97
cggccaggccgg

SEQ ID NO: 3186173 - RNA, 21 nt, Mycobacterium bovis subsp bovis AF2122/97
cggccaggccggcggcggcgc

SEQ ID NO: 3186174 - RNA, 18 nt, Mycobacterium bovis subsp bovis AF2122/97
cggccaggccgucggcgu

SEQ ID NO: 3186175 - RNA, 19 nt, Mycobacterium bovis subsp bovis AF2122/97
cggccaggccgucggcguc

SEQ ID NO: 3186176 - RNA, 15 nt, Mycobacterium bovis subsp bovis AF2122/97
cggccaggcgcgacg

SEQ ID NO: 3186177 - RNA, 16 nt, Mycobacterium bovis subsp bovis AF2122/97
cggccaggcgcgacgu

SEQ ID NO: 3186178 - RNA, 21 nt, Mycobacterium bovis subsp bovis AF2122/97
cggccaggcgcgacguagacg

SEQ ID NO: 3186179 - RNA, 12 nt, Mycobacterium bovis subsp bovis AF2122/97
cggccaggcggu

SEQ ID NO: 3186180 - RNA, 14 nt, Mycobacterium bovis subsp bovis AF2122/97
cggccaggcuggcc

SEQ ID NO: 3186181 - RNA, 18 nt, Mycobacterium bovis subsp bovis AF2122/97
cggccaggcuggccaacu

SEQ ID NO: 3186182 - RNA, 19 nt, Mycobacterium bovis subsp bovis AF2122/97
cggccagggcacccauccc

SEQ ID NO: 3186183 - RNA, 17 nt, Mycobacterium bovis subsp bovis AF2122/97
cggccaggggcgcagcg

SEQ ID NO: 3186184 - RNA, 21 nt, Mycobacterium bovis subsp bovis AF2122/97
cggccaggggcgcagcgcggc

SEQ ID NO: 3186185 - RNA, 20 nt, Mycobacterium bovis subsp bovis AF2122/97
cggccagggugcccucggcc

SEQ ID NO: 3186186 - RNA, 21 nt, Mycobacterium bovis subsp bovis AF2122/97
cggccagguaauugccgaccg

SEQ ID NO: 3186187 - RNA, 22 nt, Mycobacterium bovis subsp bovis AF2122/97
cggccagguaauugccgaccgc

SEQ ID NO: 3186188 - RNA, 19 nt, Mycobacterium bovis subsp bovis AF2122/97
cggccagguauguccgcca

SEQ ID NO: 3186189 - RNA, 18 nt, Mycobacterium bovis subsp bovis AF2122/97
cggccaggucgacaccgc

SEQ ID NO: 3186190 - RNA, 19 nt, Mycobacterium bovis subsp bovis AF2122/97
cggccaggucgacaccgcg

SEQ ID NO: 3186191 - RNA, 14 nt, Mycobacterium bovis subsp bovis AF2122/97
cggccaggucgacg

SEQ ID NO: 3186192 - RNA, 20 nt, Mycobacterium bovis subsp bovis AF2122/97
cggccaggucgagcaccggc

SEQ ID NO: 3186193 - RNA, 24 nt, Mycobacterium bovis subsp bovis AF2122/97
cggccaggucgcgauagccgccgc

SEQ ID NO: 3186194 - RNA, 17 nt, Mycobacterium bovis subsp bovis AF2122/97
cggccaggucggcguug

SEQ ID NO: 3186195 - RNA, 12 nt, Mycobacterium bovis subsp bovis AF2122/97
cggccaguacga

SEQ ID NO: 3186196 - RNA, 18 nt, Mycobacterium bovis subsp bovis AF2122/97
cggccaguacgucgauca

SEQ ID NO: 3186197 - RNA, 23 nt, Mycobacterium bovis subsp bovis AF2122/97
cggccagucaggaaaccggcgcg

SEQ ID NO: 3186198 - RNA, 16 nt, Mycobacterium bovis subsp bovis AF2122/97
cggccaguccaagcug

SEQ ID NO: 3186199 - RNA, 16 nt, Mycobacterium bovis subsp bovis AF2122/97
cggccaguccgcgcgc

SEQ ID NO: 3186200 - RNA, 17 nt, Mycobacterium bovis subsp bovis AF2122/97
cggccaguccgcgcgca

SEQ ID NO: 3186201 - RNA, 15 nt, Mycobacterium bovis subsp bovis AF2122/97
cggccaguccgggga

SEQ ID NO: 3186202 - RNA, 16 nt, Mycobacterium bovis subsp bovis AF2122/97
cggccagugacaacgc

SEQ ID NO: 3186203 - RNA, 15 nt, Mycobacterium bovis subsp bovis AF2122/97
cggccagugcucgca

SEQ ID NO: 3186204 - RNA, 15 nt, Mycobacterium bovis subsp bovis AF2122/97
cggccagugucagca

SEQ ID NO: 3186205 - RNA, 21 nt, Mycobacterium bovis subsp bovis AF2122/97
cggccagugucagcacgacga

SEQ ID NO: 3186206 - RNA, 16 nt, Mycobacterium bovis subsp bovis AF2122/97
cggccaguucggccuu

SEQ ID NO: 3186207 - RNA, 20 nt, Mycobacterium bovis subsp bovis AF2122/97
cggccaguugcacaucggug

SEQ ID NO: 3186208 - RNA, 21 nt, Mycobacterium bovis subsp bovis AF2122/97
cggccaguugcacaucggugg

SEQ ID NO: 3186209 - RNA, 22 nt, Mycobacterium bovis subsp bovis AF2122/97
cggccaguugcacaucgguggu

SEQ ID NO: 3186210 - RNA, 19 nt, Mycobacterium bovis subsp bovis AF2122/97
cggccaguugguagccgcc

SEQ ID NO: 3186211 - RNA, 15 nt, Mycobacterium bovis subsp bovis AF2122/97
cggccaguuuccaga

SEQ ID NO: 3186212 - RNA, 15 nt, Mycobacterium bovis subsp bovis AF2122/97
cggccauacgcgcgc

SEQ ID NO: 3186213 - RNA, 19 nt, Mycobacterium bovis subsp bovis AF2122/97
cggccauacgcgcgcgguc

SEQ ID NO: 3186214 - RNA, 23 nt, Mycobacterium bovis subsp bovis AF2122/97
cggccauacgcgcgcggucgagg

SEQ ID NO: 3186215 - RNA, 15 nt, Mycobacterium bovis subsp bovis AF2122/97
cggccauagcgccgc

SEQ ID NO: 3186216 - RNA, 19 nt, Mycobacterium bovis subsp bovis AF2122/97
cggccauagcgccgcgccc

SEQ ID NO: 3186217 - RNA, 19 nt, Mycobacterium bovis subsp bovis AF2122/97
cggccauagugaggccgac

SEQ ID NO: 3186218 - RNA, 21 nt, Mycobacterium bovis subsp bovis AF2122/97
cggccauagugaggccgacca

SEQ ID NO: 3186219 - RNA, 23 nt, Mycobacterium bovis subsp bovis AF2122/97
cggccauagugaggccgaccagc

SEQ ID NO: 3186220 - RNA, 20 nt, Mycobacterium bovis subsp bovis AF2122/97
cggccauaucgcccaccacg

SEQ ID NO: 3186221 - RNA, 23 nt, Mycobacterium bovis subsp bovis AF2122/97
cggccauauugggaguccggccg

SEQ ID NO: 3186222 - RNA, 21 nt, Mycobacterium bovis subsp bovis AF2122/97
cggccaucagaaccuccucgg

SEQ ID NO: 3186223 - RNA, 18 nt, Mycobacterium bovis subsp bovis AF2122/97
cggccaucccgcguucga

SEQ ID NO: 3186224 - RNA, 18 nt, Mycobacterium bovis subsp bovis AF2122/97
cggccauccggcggcggc

SEQ ID NO: 3186225 - RNA, 20 nt, Mycobacterium bovis subsp bovis AF2122/97
cggccauccggcggcggcca

SEQ ID NO: 3186226 - RNA, 14 nt, Mycobacterium bovis subsp bovis AF2122/97
cggccaucgaccgu

SEQ ID NO: 3186227 - RNA, 19 nt, Mycobacterium bovis subsp bovis AF2122/97
cggccaucgaccguccggg

SEQ ID NO: 3186228 - RNA, 12 nt, Mycobacterium bovis subsp bovis AF2122/97
cggccaucgacg

SEQ ID NO: 3186229 - RNA, 20 nt, Mycobacterium bovis subsp bovis AF2122/97
cggccaucgaguccaccacc

SEQ ID NO: 3186230 - RNA, 21 nt, Mycobacterium bovis subsp bovis AF2122/97
cggccaucgaguccaccaccu

SEQ ID NO: 3186231 - RNA, 14 nt, Mycobacterium bovis subsp bovis AF2122/97
cggccaucgccagc

SEQ ID NO: 3186232 - RNA, 16 nt, Mycobacterium bovis subsp bovis AF2122/97
cggccaucgccagccu

SEQ ID NO: 3186233 - RNA, 22 nt, Mycobacterium bovis subsp bovis AF2122/97
cggccaucgccagccugugcug

SEQ ID NO: 3186234 - RNA, 14 nt, Mycobacterium bovis subsp bovis AF2122/97
cggccaucgcccga

SEQ ID NO: 3186235 - RNA, 17 nt, Mycobacterium bovis subsp bovis AF2122/97
cggccaucgccgacacc

SEQ ID NO: 3186236 - RNA, 13 nt, Mycobacterium bovis subsp bovis AF2122/97
cggccaucgcgag

SEQ ID NO: 3186237 - RNA, 14 nt, Mycobacterium bovis subsp bovis AF2122/97
cggccaucgcgagc

SEQ ID NO: 3186238 - RNA, 13 nt, Mycobacterium bovis subsp bovis AF2122/97
cggccaucgucca

SEQ ID NO: 3186239 - RNA, 14 nt, Mycobacterium bovis subsp bovis AF2122/97
cggccaucgugcgg

SEQ ID NO: 3186240 - RNA, 15 nt, Mycobacterium bovis subsp bovis AF2122/97
cggccaucucgucga

SEQ ID NO: 3186241 - RNA, 15 nt, Mycobacterium bovis subsp bovis AF2122/97
cggccaucugcucgu

SEQ ID NO: 3186242 - RNA, 18 nt, Mycobacterium bovis subsp bovis AF2122/97
cggccaugaaaaucggca

SEQ ID NO: 3186243 - RNA, 22 nt, Mycobacterium bovis subsp bovis AF2122/97
cggccaugaaaaucggcaagac

SEQ ID NO: 3186244 - RNA, 19 nt, Mycobacterium bovis subsp bovis AF2122/97
cggccaugaucacaccgcu

SEQ ID NO: 3186245 - RNA, 17 nt, Mycobacterium bovis subsp bovis AF2122/97
cggccaugaugaugaca

SEQ ID NO: 3186246 - RNA, 17 nt, Mycobacterium bovis subsp bovis AF2122/97
cggccaugccuucggug

SEQ ID NO: 3186247 - RNA, 14 nt, Mycobacterium bovis subsp bovis AF2122/97
cggccauggacgcc

SEQ ID NO: 3186248 - RNA, 21 nt, Mycobacterium bovis subsp bovis AF2122/97
cggccauggcacugccggcac

SEQ ID NO: 3186249 - RNA, 22 nt, Mycobacterium bovis subsp bovis AF2122/97
cggccauggcacugccggcacg

SEQ ID NO: 3186250 - RNA, 15 nt, Mycobacterium bovis subsp bovis AF2122/97
cggccauggcagcgc

SEQ ID NO: 3186251 - RNA, 20 nt, Mycobacterium bovis subsp bovis AF2122/97
cggccauggcagcgcgcuga

SEQ ID NO: 3186252 - RNA, 15 nt, Mycobacterium bovis subsp bovis AF2122/97
cggccauggcgcgca

SEQ ID NO: 3186253 - RNA, 20 nt, Mycobacterium bovis subsp bovis AF2122/97
cggccauggcgcgcaaccgc

SEQ ID NO: 3186254 - RNA, 22 nt, Mycobacterium bovis subsp bovis AF2122/97
cggccauggcgcgcaaccgcug

SEQ ID NO: 3186255 - RNA, 13 nt, Mycobacterium bovis subsp bovis AF2122/97
cggccauggcggc

SEQ ID NO: 3186256 - RNA, 15 nt, Mycobacterium bovis subsp bovis AF2122/97
cggccauggcggcgc

SEQ ID NO: 3186257 - RNA, 18 nt, Mycobacterium bovis subsp bovis AF2122/97
cggccauggcggcgccgg

SEQ ID NO: 3186258 - RNA, 22 nt, Mycobacterium bovis subsp bovis AF2122/97
cggccauggcgggucggucggu

SEQ ID NO: 3186259 - RNA, 16 nt, Mycobacterium bovis subsp bovis AF2122/97
cggccauguagccguu

SEQ ID NO: 3186260 - RNA, 19 nt, Mycobacterium bovis subsp bovis AF2122/97
cggccaugucagcggccug

SEQ ID NO: 3186261 - RNA, 24 nt, Mycobacterium bovis subsp bovis AF2122/97
cggccaugucuccgacauuggccg

SEQ ID NO: 3186262 - RNA, 18 nt, Mycobacterium bovis subsp bovis AF2122/97
cggccauuagcagcaccc

SEQ ID NO: 3186263 - RNA, 21 nt, Mycobacterium bovis subsp bovis AF2122/97
cggccauuagcagcacccggg

SEQ ID NO: 3186264 - RNA, 23 nt, Mycobacterium bovis subsp bovis AF2122/97
cggccauuagcagcacccgggcc

SEQ ID NO: 3186265 - RNA, 19 nt, Mycobacterium bovis subsp bovis AF2122/97
cggccauucuuggugaucg

SEQ ID NO: 3186266 - RNA, 16 nt, Mycobacterium bovis subsp bovis AF2122/97
cggccauugcccgggc

SEQ ID NO: 3186267 - RNA, 16 nt, Mycobacterium bovis subsp bovis AF2122/97
cggccauugcgggcuc

SEQ ID NO: 3186268 - RNA, 20 nt, Mycobacterium bovis subsp bovis AF2122/97
cggcccaaacggcgugucgg

SEQ ID NO: 3186269 - RNA, 22 nt, Mycobacterium bovis subsp bovis AF2122/97
cggcccaaacggcgugucggug

SEQ ID NO: 3186270 - RNA, 20 nt, Mycobacterium bovis subsp bovis AF2122/97
cggcccacaccagcgcagca

SEQ ID NO: 3186271 - RNA, 21 nt, Mycobacterium bovis subsp bovis AF2122/97
cggcccacaccagcgcagcau

SEQ ID NO: 3186272 - RNA, 19 nt, Mycobacterium bovis subsp bovis AF2122/97
cggcccacacggucgucgc

SEQ ID NO: 3186273 - RNA, 12 nt, Mycobacterium bovis subsp bovis AF2122/97
cggcccaccagg

SEQ ID NO: 3186274 - RNA, 14 nt, Mycobacterium bovis subsp bovis AF2122/97
cggcccaccgacgg

SEQ ID NO: 3186275 - RNA, 11 nt, Mycobacterium bovis subsp bovis AF2122/97
cggcccaccgg

SEQ ID NO: 3186276 - RNA, 14 nt, Mycobacterium bovis subsp bovis AF2122/97
cggcccaccggcca

SEQ ID NO: 3186277 - RNA, 17 nt, Mycobacterium bovis subsp bovis AF2122/97
cggcccaccggucgcgc

SEQ ID NO: 3186278 - RNA, 14 nt, Mycobacterium bovis subsp bovis AF2122/97
cggcccacgcgcac

SEQ ID NO: 3186279 - RNA, 20 nt, Mycobacterium bovis subsp bovis AF2122/97
cggcccacggugucccgcga

SEQ ID NO: 3186280 - RNA, 18 nt, Mycobacterium bovis subsp bovis AF2122/97
cggcccacuucccaggau

SEQ ID NO: 3186281 - RNA, 16 nt, Mycobacterium bovis subsp bovis AF2122/97
cggcccagaucgguug

SEQ ID NO: 3186282 - RNA, 12 nt, Mycobacterium bovis subsp bovis AF2122/97
cggcccagcccu

SEQ ID NO: 3186283 - RNA, 23 nt, Mycobacterium bovis subsp bovis AF2122/97
cggcccagcccuucagcguccug

SEQ ID NO: 3186284 - RNA, 13 nt, Mycobacterium bovis subsp bovis AF2122/97
cggcccagcgcgc

SEQ ID NO: 3186285 - RNA, 23 nt, Mycobacterium bovis subsp bovis AF2122/97
cggcccagguccgcgugcugccg

SEQ ID NO: 3186286 - RNA, 13 nt, Mycobacterium bovis subsp bovis AF2122/97
cggcccagguugc

SEQ ID NO: 3186287 - RNA, 14 nt, Mycobacterium bovis subsp bovis AF2122/97
cggcccagguugcc

SEQ ID NO: 3186288 - RNA, 17 nt, Mycobacterium bovis subsp bovis AF2122/97
cggcccagguugccaac

SEQ ID NO: 3186289 - RNA, 20 nt, Mycobacterium bovis subsp bovis AF2122/97
cggcccagguugccuuggcg

SEQ ID NO: 3186290 - RNA, 22 nt, Mycobacterium bovis subsp bovis AF2122/97
cggcccagguugccuuggcggc

SEQ ID NO: 3186291 - RNA, 20 nt, Mycobacterium bovis subsp bovis AF2122/97
cggcccagugggacaggucg

SEQ ID NO: 3186292 - RNA, 18 nt, Mycobacterium bovis subsp bovis AF2122/97
cggcccaguucugcagga

SEQ ID NO: 3186293 - RNA, 16 nt, Mycobacterium bovis subsp bovis AF2122/97
cggcccaucgggcgcc

SEQ ID NO: 3186294 - RNA, 19 nt, Mycobacterium bovis subsp bovis AF2122/97
cggcccaucgggcgcccau

SEQ ID NO: 3186295 - RNA, 22 nt, Mycobacterium bovis subsp bovis AF2122/97
cggcccaucuucggacgccagc

SEQ ID NO: 3186296 - RNA, 19 nt, Mycobacterium bovis subsp bovis AF2122/97
cggcccaugaucucggcga

SEQ ID NO: 3186297 - RNA, 23 nt, Mycobacterium bovis subsp bovis AF2122/97
cggcccaugaucucggcgaacgc

SEQ ID NO: 3186298 - RNA, 16 nt, Mycobacterium bovis subsp bovis AF2122/97
cggcccaugcagcggc

SEQ ID NO: 3186299 - RNA, 19 nt, Mycobacterium bovis subsp bovis AF2122/97
cggcccaugcagcggcgaa

SEQ ID NO: 3186300 - RNA, 19 nt, Mycobacterium bovis subsp bovis AF2122/97
cggcccauugucgaucacc

SEQ ID NO: 3186301 - RNA, 20 nt, Mycobacterium bovis subsp bovis AF2122/97
cggcccauugucgaucaccu

SEQ ID NO: 3186302 - RNA, 12 nt, Mycobacterium bovis subsp bovis AF2122/97
cggccccaccgg

SEQ ID NO: 3186303 - RNA, 17 nt, Mycobacterium bovis subsp bovis AF2122/97
cggccccaccggcaccc

SEQ ID NO: 3186304 - RNA, 19 nt, Mycobacterium bovis subsp bovis AF2122/97
cggccccaccggcaccccc

SEQ ID NO: 3186305 - RNA, 14 nt, Mycobacterium bovis subsp bovis AF2122/97
cggccccaccggug

SEQ ID NO: 3186306 - RNA, 20 nt, Mycobacterium bovis subsp bovis AF2122/97
cggccccaccggugccgccg

SEQ ID NO: 3186307 - RNA, 23 nt, Mycobacterium bovis subsp bovis AF2122/97
cggccccaccggugccgccguug

SEQ ID NO: 3186308 - RNA, 13 nt, Mycobacterium bovis subsp bovis AF2122/97
cggccccaggggc

SEQ ID NO: 3186309 - RNA, 17 nt, Mycobacterium bovis subsp bovis AF2122/97
cggccccaugcgccagc

SEQ ID NO: 3186310 - RNA, 14 nt, Mycobacterium bovis subsp bovis AF2122/97
cggccccccccagg

SEQ ID NO: 3186311 - RNA, 17 nt, Mycobacterium bovis subsp bovis AF2122/97
cggcccccgacuccggc

SEQ ID NO: 3186312 - RNA, 17 nt, Mycobacterium bovis subsp bovis AF2122/97
cggcccccgagaggcac

SEQ ID NO: 3186313 - RNA, 18 nt, Mycobacterium bovis subsp bovis AF2122/97
cggcccccgaggcuggca

SEQ ID NO: 3186314 - RNA, 14 nt, Mycobacterium bovis subsp bovis AF2122/97
cggcccccggcagc

SEQ ID NO: 3186315 - RNA, 16 nt, Mycobacterium bovis subsp bovis AF2122/97
cggcccccggucgagc

SEQ ID NO: 3186316 - RNA, 17 nt, Mycobacterium bovis subsp bovis AF2122/97
cggcccccggucgagcu

SEQ ID NO: 3186317 - RNA, 16 nt, Mycobacterium bovis subsp bovis AF2122/97
cggccccgaaacgaug

SEQ ID NO: 3186318 - RNA, 22 nt, Mycobacterium bovis subsp bovis AF2122/97
cggccccgacacagcggcgggu

SEQ ID NO: 3186319 - RNA, 22 nt, Mycobacterium bovis subsp bovis AF2122/97
cggccccgacauacgucggggc

SEQ ID NO: 3186320 - RNA, 15 nt, Mycobacterium bovis subsp bovis AF2122/97
cggccccgacugccg

SEQ ID NO: 3186321 - RNA, 18 nt, Mycobacterium bovis subsp bovis AF2122/97
cggccccgacugccgcgg

SEQ ID NO: 3186322 - RNA, 20 nt, Mycobacterium bovis subsp bovis AF2122/97
cggccccgccagcgccgccg

SEQ ID NO: 3186323 - RNA, 21 nt, Mycobacterium bovis subsp bovis AF2122/97
cggccccgccagcgccgccgg

SEQ ID NO: 3186324 - RNA, 22 nt, Mycobacterium bovis subsp bovis AF2122/97
cggccccgccagcgccgccgga

SEQ ID NO: 3186325 - RNA, 13 nt, Mycobacterium bovis subsp bovis AF2122/97
cggccccgcccgc

SEQ ID NO: 3186326 - RNA, 18 nt, Mycobacterium bovis subsp bovis AF2122/97
cggccccgcccgcgcggu

SEQ ID NO: 3186327 - RNA, 14 nt, Mycobacterium bovis subsp bovis AF2122/97
cggccccgccgaug

SEQ ID NO: 3186328 - RNA, 22 nt, Mycobacterium bovis subsp bovis AF2122/97
cggccccgccgaugccgccggc

SEQ ID NO: 3186329 - RNA, 14 nt, Mycobacterium bovis subsp bovis AF2122/97
cggccccgccgccg

SEQ ID NO: 3186330 - RNA, 15 nt, Mycobacterium bovis subsp bovis AF2122/97
cggccccgccgccgg

SEQ ID NO: 3186331 - RNA, 13 nt, Mycobacterium bovis subsp bovis AF2122/97
cggccccgccgcu

SEQ ID NO: 3186332 - RNA, 15 nt, Mycobacterium bovis subsp bovis AF2122/97
cggccccgccggcgc

SEQ ID NO: 3186333 - RNA, 16 nt, Mycobacterium bovis subsp bovis AF2122/97
cggccccgccggcgcc

SEQ ID NO: 3186334 - RNA, 19 nt, Mycobacterium bovis subsp bovis AF2122/97
cggccccgccggcgccgcc

SEQ ID NO: 3186335 - RNA, 20 nt, Mycobacterium bovis subsp bovis AF2122/97
cggccccgccggcgccgccc

SEQ ID NO: 3186336 - RNA, 16 nt, Mycobacterium bovis subsp bovis AF2122/97
cggccccgccgucacc

SEQ ID NO: 3186337 - RNA, 18 nt, Mycobacterium bovis subsp bovis AF2122/97
cggccccgccgucaccgc

SEQ ID NO: 3186338 - RNA, 19 nt, Mycobacterium bovis subsp bovis AF2122/97
cggccccgccgucaccgcc

SEQ ID NO: 3186339 - RNA, 14 nt, Mycobacterium bovis subsp bovis AF2122/97
cggccccgccgucg

SEQ ID NO: 3186340 - RNA, 21 nt, Mycobacterium bovis subsp bovis AF2122/97
cggccccgccgucgccgccgg

SEQ ID NO: 3186341 - RNA, 23 nt, Mycobacterium bovis subsp bovis AF2122/97
cggccccgccguuaccgccguug

SEQ ID NO: 3186342 - RNA, 22 nt, Mycobacterium bovis subsp bovis AF2122/97
cggccccgccguugccgccgac

SEQ ID NO: 3186343 - RNA, 14 nt, Mycobacterium bovis subsp bovis AF2122/97
cggccccgccguuu

SEQ ID NO: 3186344 - RNA, 23 nt, Mycobacterium bovis subsp bovis AF2122/97
cggccccgccguuuccgccgccg

SEQ ID NO: 3186345 - RNA, 14 nt, Mycobacterium bovis subsp bovis AF2122/97
cggccccgcgcagc

SEQ ID NO: 3186346 - RNA, 17 nt, Mycobacterium bovis subsp bovis AF2122/97
cggccccgcgccaccuc

SEQ ID NO: 3186347 - RNA, 16 nt, Mycobacterium bovis subsp bovis AF2122/97
cggccccgcggccagc

SEQ ID NO: 3186348 - RNA, 18 nt, Mycobacterium bovis subsp bovis AF2122/97
cggccccgcggccagcac

SEQ ID NO: 3186349 - RNA, 13 nt, Mycobacterium bovis subsp bovis AF2122/97
cggccccggccgc

SEQ ID NO: 3186350 - RNA, 21 nt, Mycobacterium bovis subsp bovis AF2122/97
cggccccgggggaagcgccaa

SEQ ID NO: 3186351 - RNA, 15 nt, Mycobacterium bovis subsp bovis AF2122/97
cggccccgucgccga

SEQ ID NO: 3186352 - RNA, 16 nt, Mycobacterium bovis subsp bovis AF2122/97
cggccccgucgucuag

SEQ ID NO: 3186353 - RNA, 20 nt, Mycobacterium bovis subsp bovis AF2122/97
cggccccgucgucuagcggc

SEQ ID NO: 3186354 - RNA, 13 nt, Mycobacterium bovis subsp bovis AF2122/97
cggccccugccac

SEQ ID NO: 3186355 - RNA, 18 nt, Mycobacterium bovis subsp bovis AF2122/97
cggcccgaauuugggcga

SEQ ID NO: 3186356 - RNA, 15 nt, Mycobacterium bovis subsp bovis AF2122/97
cggcccgacccggcc

SEQ ID NO: 3186357 - RNA, 16 nt, Mycobacterium bovis subsp bovis AF2122/97
cggcccgacccggccg

SEQ ID NO: 3186358 - RNA, 20 nt, Mycobacterium bovis subsp bovis AF2122/97
cggcccgacccggccgaugg

SEQ ID NO: 3186359 - RNA, 22 nt, Mycobacterium bovis subsp bovis AF2122/97
cggcccgagccgcgugggccgc

SEQ ID NO: 3186360 - RNA, 16 nt, Mycobacterium bovis subsp bovis AF2122/97
cggcccgagccgcuag

SEQ ID NO: 3186361 - RNA, 16 nt, Mycobacterium bovis subsp bovis AF2122/97
cggcccgaggcucggg

SEQ ID NO: 3186362 - RNA, 17 nt, Mycobacterium bovis subsp bovis AF2122/97
cggcccgaggcucgggc

SEQ ID NO: 3186363 - RNA, 20 nt, Mycobacterium bovis subsp bovis AF2122/97
cggcccgaggcucgggccgc

SEQ ID NO: 3186364 - RNA, 19 nt, Mycobacterium bovis subsp bovis AF2122/97
cggcccgaggugccggggc

SEQ ID NO: 3186365 - RNA, 19 nt, Mycobacterium bovis subsp bovis AF2122/97
cggcccgauagaucgcgug

SEQ ID NO: 3186366 - RNA, 13 nt, Mycobacterium bovis subsp bovis AF2122/97
cggcccgaucacc

SEQ ID NO: 3186367 - RNA, 14 nt, Mycobacterium bovis subsp bovis AF2122/97
cggcccgaucacca

SEQ ID NO: 3186368 - RNA, 15 nt, Mycobacterium bovis subsp bovis AF2122/97
cggcccgaucaccau

SEQ ID NO: 3186369 - RNA, 23 nt, Mycobacterium bovis subsp bovis AF2122/97
cggcccgaucaccauccagccca

SEQ ID NO: 3186370 - RNA, 14 nt, Mycobacterium bovis subsp bovis AF2122/97
cggcccgauccagu

SEQ ID NO: 3186371 - RNA, 16 nt, Mycobacterium bovis subsp bovis AF2122/97
cggcccgauccagugg

SEQ ID NO: 3186372 - RNA, 21 nt, Mycobacterium bovis subsp bovis AF2122/97
cggcccgaucccgaucgauca

SEQ ID NO: 3186373 - RNA, 16 nt, Mycobacterium bovis subsp bovis AF2122/97
cggcccgaucggcaac

SEQ ID NO: 3186374 - RNA, 16 nt, Mycobacterium bovis subsp bovis AF2122/97
cggcccgaugccgagg

SEQ ID NO: 3186375 - RNA, 18 nt, Mycobacterium bovis subsp bovis AF2122/97
cggcccgcaacgcgucgg

SEQ ID NO: 3186376 - RNA, 19 nt, Mycobacterium bovis subsp bovis AF2122/97
cggcccgcaacgcgucggu

SEQ ID NO: 3186377 - RNA, 22 nt, Mycobacterium bovis subsp bovis AF2122/97
cggcccgcacccguccggccgg

SEQ ID NO: 3186378 - RNA, 19 nt, Mycobacterium bovis subsp bovis AF2122/97
cggcccgcagcccgccggg

SEQ ID NO: 3186379 - RNA, 20 nt, Mycobacterium bovis subsp bovis AF2122/97
cggcccgcaggcuuccccga

SEQ ID NO: 3186380 - RNA, 20 nt, Mycobacterium bovis subsp bovis AF2122/97
cggcccgcauccgcaccgaa

SEQ ID NO: 3186381 - RNA, 12 nt, Mycobacterium bovis subsp bovis AF2122/97
cggcccgccacc

SEQ ID NO: 3186382 - RNA, 12 nt, Mycobacterium bovis subsp bovis AF2122/97
cggcccgccgag

SEQ ID NO: 3186383 - RNA, 13 nt, Mycobacterium bovis subsp bovis AF2122/97
cggcccgccgagu

SEQ ID NO: 3186384 - RNA, 15 nt, Mycobacterium bovis subsp bovis AF2122/97
cggcccgccguccgg

SEQ ID NO: 3186385 - RNA, 19 nt, Mycobacterium bovis subsp bovis AF2122/97
cggcccgccguccggcgcc

SEQ ID NO: 3186386 - RNA, 14 nt, Mycobacterium bovis subsp bovis AF2122/97
cggcccgccucggc

SEQ ID NO: 3186387 - RNA, 18 nt, Mycobacterium bovis subsp bovis AF2122/97
cggcccgccucggcggcg

SEQ ID NO: 3186388 - RNA, 15 nt, Mycobacterium bovis subsp bovis AF2122/97
cggcccgcgaucggg

SEQ ID NO: 3186389 - RNA, 16 nt, Mycobacterium bovis subsp bovis AF2122/97
cggcccgcgaucgggc

SEQ ID NO: 3186390 - RNA, 13 nt, Mycobacterium bovis subsp bovis AF2122/97
cggcccgcggucg

SEQ ID NO: 3186391 - RNA, 14 nt, Mycobacterium bovis subsp bovis AF2122/97
cggcccgcucaacg

SEQ ID NO: 3186392 - RNA, 21 nt, Mycobacterium bovis subsp bovis AF2122/97
cggcccgcucaacgggccgca

SEQ ID NO: 3186393 - RNA, 13 nt, Mycobacterium bovis subsp bovis AF2122/97
cggcccgcucagc

SEQ ID NO: 3186394 - RNA, 18 nt, Mycobacterium bovis subsp bovis AF2122/97
cggcccggacgucggcgg

SEQ ID NO: 3186395 - RNA, 19 nt, Mycobacterium bovis subsp bovis AF2122/97
cggcccggacgucggcggc

SEQ ID NO: 3186396 - RNA, 14 nt, Mycobacterium bovis subsp bovis AF2122/97
cggcccggcacccg

SEQ ID NO: 3186397 - RNA, 24 nt, Mycobacterium bovis subsp bovis AF2122/97
cggcccggcacccggugagaagaa

SEQ ID NO: 3186398 - RNA, 15 nt, Mycobacterium bovis subsp bovis AF2122/97
cggcccggcaggacu

SEQ ID NO: 3186399 - RNA, 12 nt, Mycobacterium bovis subsp bovis AF2122/97
cggcccggcccg

SEQ ID NO: 3186400 - RNA, 23 nt, Mycobacterium bovis subsp bovis AF2122/97
cggcccggcccuccgggcccauc

SEQ ID NO: 3186401 - RNA, 12 nt, Mycobacterium bovis subsp bovis AF2122/97
cggcccggccga

SEQ ID NO: 3186402 - RNA, 15 nt, Mycobacterium bovis subsp bovis AF2122/97
cggcccgggcucggc

SEQ ID NO: 3186403 - RNA, 18 nt, Mycobacterium bovis subsp bovis AF2122/97
cggcccggguaucgccag

SEQ ID NO: 3186404 - RNA, 19 nt, Mycobacterium bovis subsp bovis AF2122/97
cggcccgggucagcgaccu

SEQ ID NO: 3186405 - RNA, 20 nt, Mycobacterium bovis subsp bovis AF2122/97
cggcccggguggcccggaac

SEQ ID NO: 3186406 - RNA, 15 nt, Mycobacterium bovis subsp bovis AF2122/97
cggcccggucuacgc

SEQ ID NO: 3186407 - RNA, 22 nt, Mycobacterium bovis subsp bovis AF2122/97
cggcccggucuacgccaccgag

SEQ ID NO: 3186408 - RNA, 20 nt, Mycobacterium bovis subsp bovis AF2122/97
cggcccgguuggaccacgug

SEQ ID NO: 3186409 - RNA, 22 nt, Mycobacterium bovis subsp bovis AF2122/97
cggcccgguuggaccacgugau

SEQ ID NO: 3186410 - RNA, 16 nt, Mycobacterium bovis subsp bovis AF2122/97
cggcccguagcugcgc

SEQ ID NO: 3186411 - RNA, 17 nt, Mycobacterium bovis subsp bovis AF2122/97
cggcccguagcugcgca

SEQ ID NO: 3186412 - RNA, 19 nt, Mycobacterium bovis subsp bovis AF2122/97
cggcccguagcugcgcagc

SEQ ID NO: 3186413 - RNA, 14 nt, Mycobacterium bovis subsp bovis AF2122/97
cggcccgucaccgc

SEQ ID NO: 3186414 - RNA, 18 nt, Mycobacterium bovis subsp bovis AF2122/97
cggcccgucaccgcgggc

SEQ ID NO: 3186415 - RNA, 19 nt, Mycobacterium bovis subsp bovis AF2122/97
cggcccguguggucccggc

SEQ ID NO: 3186416 - RNA, 18 nt, Mycobacterium bovis subsp bovis AF2122/97
cggcccguuugccgguuc

SEQ ID NO: 3186417 - RNA, 14 nt, Mycobacterium bovis subsp bovis AF2122/97
cggcccuaaacacc

SEQ ID NO: 3186418 - RNA, 16 nt, Mycobacterium bovis subsp bovis AF2122/97
cggcccuaaacaccgc

SEQ ID NO: 3186419 - RNA, 18 nt, Mycobacterium bovis subsp bovis AF2122/97
cggcccuacgcagcgcgg

SEQ ID NO: 3186420 - RNA, 19 nt, Mycobacterium bovis subsp bovis AF2122/97
cggcccuacgcagcgcggc

SEQ ID NO: 3186421 - RNA, 22 nt, Mycobacterium bovis subsp bovis AF2122/97
cggcccuacgcagcgcggcugg

SEQ ID NO: 3186422 - RNA, 17 nt, Mycobacterium bovis subsp bovis AF2122/97
cggcccuaucguuaucg

SEQ ID NO: 3186423 - RNA, 20 nt, Mycobacterium bovis subsp bovis AF2122/97
cggcccuaucguuaucgaca

SEQ ID NO: 3186424 - RNA, 16 nt, Mycobacterium bovis subsp bovis AF2122/97
cggcccuccaccggug

SEQ ID NO: 3186425 - RNA, 17 nt, Mycobacterium bovis subsp bovis AF2122/97
cggcccuccaccggugu

SEQ ID NO: 3186426 - RNA, 18 nt, Mycobacterium bovis subsp bovis AF2122/97
cggcccuccaccgguguu

SEQ ID NO: 3186427 - RNA, 13 nt, Mycobacterium bovis subsp bovis AF2122/97
cggcccuccgggc

SEQ ID NO: 3186428 - RNA, 15 nt, Mycobacterium bovis subsp bovis AF2122/97
cggcccucgaauucg

SEQ ID NO: 3186429 - RNA, 20 nt, Mycobacterium bovis subsp bovis AF2122/97
cggcccucgaauucggccgg

SEQ ID NO: 3186430 - RNA, 21 nt, Mycobacterium bovis subsp bovis AF2122/97
cggcccucgaauucggccggc

SEQ ID NO: 3186431 - RNA, 24 nt, Mycobacterium bovis subsp bovis AF2122/97
cggcccucgaugccgcguagcugg

SEQ ID NO: 3186432 - RNA, 16 nt, Mycobacterium bovis subsp bovis AF2122/97
cggcccugaacgguuc

SEQ ID NO: 3186433 - RNA, 23 nt, Mycobacterium bovis subsp bovis AF2122/97
cggcccugaacgguucggccggg

SEQ ID NO: 3186434 - RNA, 18 nt, Mycobacterium bovis subsp bovis AF2122/97
cggcccugaccucauguc

SEQ ID NO: 3186435 - RNA, 21 nt, Mycobacterium bovis subsp bovis AF2122/97
cggcccugaccucauguccgc

SEQ ID NO: 3186436 - RNA, 17 nt, Mycobacterium bovis subsp bovis AF2122/97
cggcccugagcugccga

SEQ ID NO: 3186437 - RNA, 20 nt, Mycobacterium bovis subsp bovis AF2122/97
cggcccugagcugccgagcg

SEQ ID NO: 3186438 - RNA, 21 nt, Mycobacterium bovis subsp bovis AF2122/97
cggcccugccgccggccccgc

SEQ ID NO: 3186439 - RNA, 12 nt, Mycobacterium bovis subsp bovis AF2122/97
cggcccuggaca

SEQ ID NO: 3186440 - RNA, 17 nt, Mycobacterium bovis subsp bovis AF2122/97
cggcccuguucggcccu

SEQ ID NO: 3186441 - RNA, 15 nt, Mycobacterium bovis subsp bovis AF2122/97
cggcccuucaccagc

SEQ ID NO: 3186442 - RNA, 22 nt, Mycobacterium bovis subsp bovis AF2122/97
cggcccuuguggaguacggcga

SEQ ID NO: 3186443 - RNA, 15 nt, Mycobacterium bovis subsp bovis AF2122/97
cggccgaaacuucgc

SEQ ID NO: 3186444 - RNA, 21 nt, Mycobacterium bovis subsp bovis AF2122/97
cggccgaaacuucgcccgggc

SEQ ID NO: 3186445 - RNA, 16 nt, Mycobacterium bovis subsp bovis AF2122/97
cggccgaacgccucgc

SEQ ID NO: 3186446 - RNA, 23 nt, Mycobacterium bovis subsp bovis AF2122/97
cggccgaacgccucgccggccac

SEQ ID NO: 3186447 - RNA, 17 nt, Mycobacterium bovis subsp bovis AF2122/97
cggccgaaucuccgccg

SEQ ID NO: 3186448 - RNA, 20 nt, Mycobacterium bovis subsp bovis AF2122/97
cggccgaaucuccgccguga

SEQ ID NO: 3186449 - RNA, 14 nt, Mycobacterium bovis subsp bovis AF2122/97
cggccgacaacccg

SEQ ID NO: 3186450 - RNA, 20 nt, Mycobacterium bovis subsp bovis AF2122/97
cggccgacaacccggccggg

SEQ ID NO: 3186451 - RNA, 19 nt, Mycobacterium bovis subsp bovis AF2122/97
cggccgacaccgccaccac

SEQ ID NO: 3186452 - RNA, 20 nt, Mycobacterium bovis subsp bovis AF2122/97
cggccgacaccgccaccacg

SEQ ID NO: 3186453 - RNA, 13 nt, Mycobacterium bovis subsp bovis AF2122/97
cggccgacacgcc

SEQ ID NO: 3186454 - RNA, 17 nt, Mycobacterium bovis subsp bovis AF2122/97
cggccgacacgccgaug

SEQ ID NO: 3186455 - RNA, 12 nt, Mycobacterium bovis subsp bovis AF2122/97
cggccgacccgg

SEQ ID NO: 3186456 - RNA, 13 nt, Mycobacterium bovis subsp bovis AF2122/97
cggccgacccgga

SEQ ID NO: 3186457 - RNA, 13 nt, Mycobacterium bovis subsp bovis AF2122/97
cggccgaccgcga

SEQ ID NO: 3186458 - RNA, 16 nt, Mycobacterium bovis subsp bovis AF2122/97
cggccgaccgcgaccc

SEQ ID NO: 3186459 - RNA, 17 nt, Mycobacterium bovis subsp bovis AF2122/97
cggccgaccucggcaac

SEQ ID NO: 3186460 - RNA, 14 nt, Mycobacterium bovis subsp bovis AF2122/97
cggccgacgcuggc

SEQ ID NO: 3186461 - RNA, 19 nt, Mycobacterium bovis subsp bovis AF2122/97
cggccgacgcuggcggugu

SEQ ID NO: 3186462 - RNA, 23 nt, Mycobacterium bovis subsp bovis AF2122/97
cggccgacucggucucauagugc

SEQ ID NO: 3186463 - RNA, 20 nt, Mycobacterium bovis subsp bovis AF2122/97
cggccgagccguugcgccuc

SEQ ID NO: 3186464 - RNA, 13 nt, Mycobacterium bovis subsp bovis AF2122/97
cggccgagcgcac

SEQ ID NO: 3186465 - RNA, 17 nt, Mycobacterium bovis subsp bovis AF2122/97
cggccgagcgcaccgcu

SEQ ID NO: 3186466 - RNA, 18 nt, Mycobacterium bovis subsp bovis AF2122/97
cggccgagcgcacugggg

SEQ ID NO: 3186467 - RNA, 16 nt, Mycobacterium bovis subsp bovis AF2122/97
cggccgaggaccagag

SEQ ID NO: 3186468 - RNA, 20 nt, Mycobacterium bovis subsp bovis AF2122/97
cggccgaggaccagaggcgc

SEQ ID NO: 3186469 - RNA, 22 nt, Mycobacterium bovis subsp bovis AF2122/97
cggccgagggauugccgugcuc

SEQ ID NO: 3186470 - RNA, 17 nt, Mycobacterium bovis subsp bovis AF2122/97
cggccgaggucgcgguc

SEQ ID NO: 3186471 - RNA, 16 nt, Mycobacterium bovis subsp bovis AF2122/97
cggccgaguaccagcc

SEQ ID NO: 3186472 - RNA, 23 nt, Mycobacterium bovis subsp bovis AF2122/97
cggccgaguaccagcccaccggc

SEQ ID NO: 3186473 - RNA, 23 nt, Mycobacterium bovis subsp bovis AF2122/97
cggccgauacagaucuggguucc

SEQ ID NO: 3186474 - RNA, 22 nt, Mycobacterium bovis subsp bovis AF2122/97
cggccgaucagcagcuguuggc

SEQ ID NO: 3186475 - RNA, 15 nt, Mycobacterium bovis subsp bovis AF2122/97
cggccgaugcgaccc

SEQ ID NO: 3186476 - RNA, 17 nt, Mycobacterium bovis subsp bovis AF2122/97
cggccgaugcgacccgc

SEQ ID NO: 3186477 - RNA, 21 nt, Mycobacterium bovis subsp bovis AF2122/97
cggccgaugcgacccgcagac

SEQ ID NO: 3186478 - RNA, 14 nt, Mycobacterium bovis subsp bovis AF2122/97
cggccgaugcgcag

SEQ ID NO: 3186479 - RNA, 16 nt, Mycobacterium bovis subsp bovis AF2122/97
cggccgcaagccgcga

SEQ ID NO: 3186480 - RNA, 17 nt, Mycobacterium bovis subsp bovis AF2122/97
cggccgcaagccgcgag

SEQ ID NO: 3186481 - RNA, 13 nt, Mycobacterium bovis subsp bovis AF2122/97
cggccgcaaggcg

SEQ ID NO: 3186482 - RNA, 22 nt, Mycobacterium bovis subsp bovis AF2122/97
cggccgcaaggcgccgauaccg

SEQ ID NO: 3186483 - RNA, 15 nt, Mycobacterium bovis subsp bovis AF2122/97
cggccgcaccagcau

SEQ ID NO: 3186484 - RNA, 12 nt, Mycobacterium bovis subsp bovis AF2122/97
cggccgcacccg

SEQ ID NO: 3186485 - RNA, 13 nt, Mycobacterium bovis subsp bovis AF2122/97
cggccgcacccgu

SEQ ID NO: 3186486 - RNA, 14 nt, Mycobacterium bovis subsp bovis AF2122/97
cggccgcacccguu

SEQ ID NO: 3186487 - RNA, 16 nt, Mycobacterium bovis subsp bovis AF2122/97
cggccgcacgccgacc

SEQ ID NO: 3186488 - RNA, 19 nt, Mycobacterium bovis subsp bovis AF2122/97
cggccgcacgccggccagc

SEQ ID NO: 3186489 - RNA, 16 nt, Mycobacterium bovis subsp bovis AF2122/97
cggccgcacgccuacg

SEQ ID NO: 3186490 - RNA, 15 nt, Mycobacterium bovis subsp bovis AF2122/97
cggccgcagccagca

SEQ ID NO: 3186491 - RNA, 15 nt, Mycobacterium bovis subsp bovis AF2122/97
cggccgcagccagcg

SEQ ID NO: 3186492 - RNA, 16 nt, Mycobacterium bovis subsp bovis AF2122/97
cggccgcagcggccag

SEQ ID NO: 3186493 - RNA, 18 nt, Mycobacterium bovis subsp bovis AF2122/97
cggccgcagcggccagcc

SEQ ID NO: 3186494 - RNA, 13 nt, Mycobacterium bovis subsp bovis AF2122/97
cggccgcaggcga

SEQ ID NO: 3186495 - RNA, 23 nt, Mycobacterium bovis subsp bovis AF2122/97
cggccgcaucggucaaugccacu

SEQ ID NO: 3186496 - RNA, 18 nt, Mycobacterium bovis subsp bovis AF2122/97
cggccgcauucgugacga

SEQ ID NO: 3186497 - RNA, 23 nt, Mycobacterium bovis subsp bovis AF2122/97
cggccgccaacuccagcacccgc

SEQ ID NO: 3186498 - RNA, 21 nt, Mycobacterium bovis subsp bovis AF2122/97
cggccgccaacuucaccaccc

SEQ ID NO: 3186499 - RNA, 14 nt, Mycobacterium bovis subsp bovis AF2122/97
cggccgccagcccc

SEQ ID NO: 3186500 - RNA, 16 nt, Mycobacterium bovis subsp bovis AF2122/97
cggccgccagccccac

SEQ ID NO: 3186501 - RNA, 20 nt, Mycobacterium bovis subsp bovis AF2122/97
cggccgccagccccacccgc

SEQ ID NO: 3186502 - RNA, 14 nt, Mycobacterium bovis subsp bovis AF2122/97
cggccgccagcgca

SEQ ID NO: 3186503 - RNA, 14 nt, Mycobacterium bovis subsp bovis AF2122/97
cggccgccagcgcg

SEQ ID NO: 3186504 - RNA, 15 nt, Mycobacterium bovis subsp bovis AF2122/97
cggccgccagcgcgc

SEQ ID NO: 3186505 - RNA, 17 nt, Mycobacterium bovis subsp bovis AF2122/97
cggccgccagcgcgccg

SEQ ID NO: 3186506 - RNA, 19 nt, Mycobacterium bovis subsp bovis AF2122/97
cggccgccagcgcgccgau

SEQ ID NO: 3186507 - RNA, 15 nt, Mycobacterium bovis subsp bovis AF2122/97
cggccgccaggaauc

SEQ ID NO: 3186508 - RNA, 15 nt, Mycobacterium bovis subsp bovis AF2122/97
cggccgccaguacca

SEQ ID NO: 3186509 - RNA, 20 nt, Mycobacterium bovis subsp bovis AF2122/97
cggccgccaguucggcgucg

SEQ ID NO: 3186510 - RNA, 22 nt, Mycobacterium bovis subsp bovis AF2122/97
cggccgccccaggcugguccgg

SEQ ID NO: 3186511 - RNA, 9 nt, Mycobacterium bovis subsp bovis AF2122/97
cggccgccg

SEQ ID NO: 3186512 - RNA, 22 nt, Mycobacterium bovis subsp bovis AF2122/97
cggccgccgacuccccgccggg

SEQ ID NO: 3186513 - RNA, 14 nt, Mycobacterium bovis subsp bovis AF2122/97
cggccgccgagacg

SEQ ID NO: 3186514 - RNA, 12 nt, Mycobacterium bovis subsp bovis AF2122/97
cggccgccgagg

SEQ ID NO: 3186515 - RNA, 13 nt, Mycobacterium bovis subsp bovis AF2122/97
cggccgccgcagc

SEQ ID NO: 3186516 - RNA, 14 nt, Mycobacterium bovis subsp bovis AF2122/97
cggccgccgcggcu

SEQ ID NO: 3186517 - RNA, 15 nt, Mycobacterium bovis subsp bovis AF2122/97
cggccgccgcggcuu

SEQ ID NO: 3186518 - RNA, 16 nt, Mycobacterium bovis subsp bovis AF2122/97
cggccgccgcggcuug

SEQ ID NO: 3186519 - RNA, 12 nt, Mycobacterium bovis subsp bovis AF2122/97
cggccgccgcgu

SEQ ID NO: 3186520 - RNA, 13 nt, Mycobacterium bovis subsp bovis AF2122/97
cggccgccuaccc

SEQ ID NO: 3186521 - RNA, 21 nt, Mycobacterium bovis subsp bovis AF2122/97
cggccgccuacccguucuucg

SEQ ID NO: 3186522 - RNA, 16 nt, Mycobacterium bovis subsp bovis AF2122/97
cggccgccucguacgg

SEQ ID NO: 3186523 - RNA, 19 nt, Mycobacterium bovis subsp bovis AF2122/97
cggccgccucguacggacc

SEQ ID NO: 3186524 - RNA, 21 nt, Mycobacterium bovis subsp bovis AF2122/97
cggccgccucguacggaccgu

SEQ ID NO: 3186525 - RNA, 16 nt, Mycobacterium bovis subsp bovis AF2122/97
cggccgcgaccagcgc

SEQ ID NO: 3186526 - RNA, 20 nt, Mycobacterium bovis subsp bovis AF2122/97
cggccgcgaccagcgccgca

SEQ ID NO: 3186527 - RNA, 23 nt, Mycobacterium bovis subsp bovis AF2122/97
cggccgcgaccagcgccgcaccc

SEQ ID NO: 3186528 - RNA, 15 nt, Mycobacterium bovis subsp bovis AF2122/97
cggccgcgaccgcga

SEQ ID NO: 3186529 - RNA, 17 nt, Mycobacterium bovis subsp bovis AF2122/97
cggccgcgaccgcgacc

SEQ ID NO: 3186530 - RNA, 15 nt, Mycobacterium bovis subsp bovis AF2122/97
cggccgcgacgacac

SEQ ID NO: 3186531 - RNA, 20 nt, Mycobacterium bovis subsp bovis AF2122/97
cggccgcgauccagcgcuga

SEQ ID NO: 3186532 - RNA, 20 nt, Mycobacterium bovis subsp bovis AF2122/97
cggccgcgauggugcgccgg

SEQ ID NO: 3186533 - RNA, 14 nt, Mycobacterium bovis subsp bovis AF2122/97
cggccgcgcacccg

SEQ ID NO: 3186534 - RNA, 13 nt, Mycobacterium bovis subsp bovis AF2122/97
cggccgcgcccca

SEQ ID NO: 3186535 - RNA, 14 nt, Mycobacterium bovis subsp bovis AF2122/97
cggccgcgccccau

SEQ ID NO: 3186536 - RNA, 12 nt, Mycobacterium bovis subsp bovis AF2122/97
cggccgcgccgg

SEQ ID NO: 3186537 - RNA, 13 nt, Mycobacterium bovis subsp bovis AF2122/97
cggccgcgccggc

SEQ ID NO: 3186538 - RNA, 15 nt, Mycobacterium bovis subsp bovis AF2122/97
cggccgcgccggccc

SEQ ID NO: 3186539 - RNA, 16 nt, Mycobacterium bovis subsp bovis AF2122/97
cggccgcgccggcccc

SEQ ID NO: 3186540 - RNA, 17 nt, Mycobacterium bovis subsp bovis AF2122/97
cggccgcgccggccccg

SEQ ID NO: 3186541 - RNA, 18 nt, Mycobacterium bovis subsp bovis AF2122/97
cggccgcgccggccccgg

SEQ ID NO: 3186542 - RNA, 12 nt, Mycobacterium bovis subsp bovis AF2122/97
cggccgcgcgca

SEQ ID NO: 3186543 - RNA, 13 nt, Mycobacterium bovis subsp bovis AF2122/97
cggccgcgcgggg

SEQ ID NO: 3186544 - RNA, 16 nt, Mycobacterium bovis subsp bovis AF2122/97
cggccgcgcugcagca

SEQ ID NO: 3186545 - RNA, 20 nt, Mycobacterium bovis subsp bovis AF2122/97
cggccgcgcugcagcacggc

SEQ ID NO: 3186546 - RNA, 16 nt, Mycobacterium bovis subsp bovis AF2122/97
cggccgcggaccgcga

SEQ ID NO: 3186547 - RNA, 21 nt, Mycobacterium bovis subsp bovis AF2122/97
cggccgcggacuugcgagccg

SEQ ID NO: 3186548 - RNA, 14 nt, Mycobacterium bovis subsp bovis AF2122/97
cggccgcggcagcg

SEQ ID NO: 3186549 - RNA, 13 nt, Mycobacterium bovis subsp bovis AF2122/97
cggccgcggccuc

SEQ ID NO: 3186550 - RNA, 14 nt, Mycobacterium bovis subsp bovis AF2122/97
cggccgcggccucc

SEQ ID NO: 3186551 - RNA, 16 nt, Mycobacterium bovis subsp bovis AF2122/97
cggccgcggccucccg

SEQ ID NO: 3186552 - RNA, 18 nt, Mycobacterium bovis subsp bovis AF2122/97
cggccgcggcgccuagca

SEQ ID NO: 3186553 - RNA, 13 nt, Mycobacterium bovis subsp bovis AF2122/97
cggccgcggcggc

SEQ ID NO: 3186554 - RNA, 18 nt, Mycobacterium bovis subsp bovis AF2122/97
cggccgcggcggccccgc

SEQ ID NO: 3186555 - RNA, 17 nt, Mycobacterium bovis subsp bovis AF2122/97
cggccgcgggcgcgcag

SEQ ID NO: 3186556 - RNA, 18 nt, Mycobacterium bovis subsp bovis AF2122/97
cggccgcggggcaucggu

SEQ ID NO: 3186557 - RNA, 17 nt, Mycobacterium bovis subsp bovis AF2122/97
cggccgcgggucgcugc

SEQ ID NO: 3186558 - RNA, 12 nt, Mycobacterium bovis subsp bovis AF2122/97
cggccgcggguu

SEQ ID NO: 3186559 - RNA, 16 nt, Mycobacterium bovis subsp bovis AF2122/97
cggccgcggucggcca

SEQ ID NO: 3186560 - RNA, 18 nt, Mycobacterium bovis subsp bovis AF2122/97
cggccgcggucggccacc

SEQ ID NO: 3186561 - RNA, 12 nt, Mycobacterium bovis subsp bovis AF2122/97
cggccgcggugu

SEQ ID NO: 3186562 - RNA, 22 nt, Mycobacterium bovis subsp bovis AF2122/97
cggccgcguaaaccggcugacc

SEQ ID NO: 3186563 - RNA, 18 nt, Mycobacterium bovis subsp bovis AF2122/97
cggccgcgucacggaccu

SEQ ID NO: 3186564 - RNA, 15 nt, Mycobacterium bovis subsp bovis AF2122/97
cggccgcgucgucga

SEQ ID NO: 3186565 - RNA, 17 nt, Mycobacterium bovis subsp bovis AF2122/97
cggccgcgugccgcccg

SEQ ID NO: 3186566 - RNA, 16 nt, Mycobacterium bovis subsp bovis AF2122/97
cggccgcgugcucgcc

SEQ ID NO: 3186567 - RNA, 19 nt, Mycobacterium bovis subsp bovis AF2122/97
cggccgcuauggcccgggc

SEQ ID NO: 3186568 - RNA, 21 nt, Mycobacterium bovis subsp bovis AF2122/97
cggccgcuauggcccgggccg

SEQ ID NO: 3186569 - RNA, 23 nt, Mycobacterium bovis subsp bovis AF2122/97
cggccgcucaccccgcgcuccuc

SEQ ID NO: 3186570 - RNA, 12 nt, Mycobacterium bovis subsp bovis AF2122/97
cggccgcucggg

SEQ ID NO: 3186571 - RNA, 19 nt, Mycobacterium bovis subsp bovis AF2122/97
cggccgcucguuacgccga

SEQ ID NO: 3186572 - RNA, 22 nt, Mycobacterium bovis subsp bovis AF2122/97
cggccgcucguuacgccgagca

SEQ ID NO: 3186573 - RNA, 21 nt, Mycobacterium bovis subsp bovis AF2122/97
cggccgcugaucaacagaccu

SEQ ID NO: 3186574 - RNA, 18 nt, Mycobacterium bovis subsp bovis AF2122/97
cggccgcugccacuagca

SEQ ID NO: 3186575 - RNA, 17 nt, Mycobacterium bovis subsp bovis AF2122/97
cggccgcugccuuggcg

SEQ ID NO: 3186576 - RNA, 14 nt, Mycobacterium bovis subsp bovis AF2122/97
cggccgcuggaggc

SEQ ID NO: 3186577 - RNA, 17 nt, Mycobacterium bovis subsp bovis AF2122/97
cggccgcuggaggcggc

SEQ ID NO: 3186578 - RNA, 19 nt, Mycobacterium bovis subsp bovis AF2122/97
cggccgcuggaggcggcgc

SEQ ID NO: 3186579 - RNA, 12 nt, Mycobacterium bovis subsp bovis AF2122/97
cggccgcugggc

SEQ ID NO: 3186580 - RNA, 15 nt, Mycobacterium bovis subsp bovis AF2122/97
cggccgcugggccca

SEQ ID NO: 3186581 - RNA, 19 nt, Mycobacterium bovis subsp bovis AF2122/97
cggccgcugggcccaucgc

SEQ ID NO: 3186582 - RNA, 20 nt, Mycobacterium bovis subsp bovis AF2122/97
cggccgcuugagcgaguugc

SEQ ID NO: 3186583 - RNA, 14 nt, Mycobacterium bovis subsp bovis AF2122/97
cggccgcuuggccg

SEQ ID NO: 3186584 - RNA, 19 nt, Mycobacterium bovis subsp bovis AF2122/97
cggccggaauacccggccc

SEQ ID NO: 3186585 - RNA, 13 nt, Mycobacterium bovis subsp bovis AF2122/97
cggccggacgggu

SEQ ID NO: 3186586 - RNA, 13 nt, Mycobacterium bovis subsp bovis AF2122/97
cggccggagccgc

SEQ ID NO: 3186587 - RNA, 15 nt, Mycobacterium bovis subsp bovis AF2122/97
cggccggagccgccg

SEQ ID NO: 3186588 - RNA, 16 nt, Mycobacterium bovis subsp bovis AF2122/97
cggccggagccgccgg

SEQ ID NO: 3186589 - RNA, 17 nt, Mycobacterium bovis subsp bovis AF2122/97
cggccggagccgccggc

SEQ ID NO: 3186590 - RNA, 18 nt, Mycobacterium bovis subsp bovis AF2122/97
cggccggagccgccggcc

SEQ ID NO: 3186591 - RNA, 19 nt, Mycobacterium bovis subsp bovis AF2122/97
cggccggagccgccggccc

SEQ ID NO: 3186592 - RNA, 22 nt, Mycobacterium bovis subsp bovis AF2122/97
cggccggagccgccggccccgc

SEQ ID NO: 3186593 - RNA, 13 nt, Mycobacterium bovis subsp bovis AF2122/97
cggccggaguccg

SEQ ID NO: 3186594 - RNA, 15 nt, Mycobacterium bovis subsp bovis AF2122/97
cggccggaguccguc

SEQ ID NO: 3186595 - RNA, 20 nt, Mycobacterium bovis subsp bovis AF2122/97
cggccggaguccgucgggga

SEQ ID NO: 3186596 - RNA, 16 nt, Mycobacterium bovis subsp bovis AF2122/97
cggccggauacggcga

SEQ ID NO: 3186597 - RNA, 22 nt, Mycobacterium bovis subsp bovis AF2122/97
cggccggaugagcgaacgccag

SEQ ID NO: 3186598 - RNA, 23 nt, Mycobacterium bovis subsp bovis AF2122/97
cggccggaugagcgaacgccagu

SEQ ID NO: 3186599 - RNA, 18 nt, Mycobacterium bovis subsp bovis AF2122/97
cggccggcaacgugcggu

SEQ ID NO: 3186600 - RNA, 18 nt, Mycobacterium bovis subsp bovis AF2122/97
cggccggcaaugccgcgg

SEQ ID NO: 3186601 - RNA, 21 nt, Mycobacterium bovis subsp bovis AF2122/97
cggccggcaaugccgcggcca

SEQ ID NO: 3186602 - RNA, 14 nt, Mycobacterium bovis subsp bovis AF2122/97
cggccggcacccca

SEQ ID NO: 3186603 - RNA, 19 nt, Mycobacterium bovis subsp bovis AF2122/97
cggccggcacgaccgcucc

SEQ ID NO: 3186604 - RNA, 17 nt, Mycobacterium bovis subsp bovis AF2122/97
cggccggcacgggcggg

SEQ ID NO: 3186605 - RNA, 14 nt, Mycobacterium bovis subsp bovis AF2122/97
cggccggcaugcug

SEQ ID NO: 3186606 - RNA, 14 nt, Mycobacterium bovis subsp bovis AF2122/97
cggccggccaggug

SEQ ID NO: 3186607 - RNA, 13 nt, Mycobacterium bovis subsp bovis AF2122/97
cggccggcccggg

SEQ ID NO: 3186608 - RNA, 11 nt, Mycobacterium bovis subsp bovis AF2122/97
cggccggccgc

SEQ ID NO: 3186609 - RNA, 14 nt, Mycobacterium bovis subsp bovis AF2122/97
cggccggccgcccg

SEQ ID NO: 3186610 - RNA, 20 nt, Mycobacterium bovis subsp bovis AF2122/97
cggccggccgcccgcucgau

SEQ ID NO: 3186611 - RNA, 14 nt, Mycobacterium bovis subsp bovis AF2122/97
cggccggccgcggg

SEQ ID NO: 3186612 - RNA, 13 nt, Mycobacterium bovis subsp bovis AF2122/97
cggccggccgcuc

SEQ ID NO: 3186613 - RNA, 15 nt, Mycobacterium bovis subsp bovis AF2122/97
cggccggccuagccg

SEQ ID NO: 3186614 - RNA, 13 nt, Mycobacterium bovis subsp bovis AF2122/97
cggccggcgcggc

SEQ ID NO: 3186615 - RNA, 15 nt, Mycobacterium bovis subsp bovis AF2122/97
cggccggcgcggcgu

SEQ ID NO: 3186616 - RNA, 15 nt, Mycobacterium bovis subsp bovis AF2122/97
cggccggcgcucgcg

SEQ ID NO: 3186617 - RNA, 12 nt, Mycobacterium bovis subsp bovis AF2122/97
cggccggcggcc

SEQ ID NO: 3186618 - RNA, 14 nt, Mycobacterium bovis subsp bovis AF2122/97
cggccggcggccgc

SEQ ID NO: 3186619 - RNA, 15 nt, Mycobacterium bovis subsp bovis AF2122/97
cggccggcggccgcc

SEQ ID NO: 3186620 - RNA, 13 nt, Mycobacterium bovis subsp bovis AF2122/97
cggccggcgggcc

SEQ ID NO: 3186621 - RNA, 17 nt, Mycobacterium bovis subsp bovis AF2122/97
cggccggcgggccugcc

SEQ ID NO: 3186622 - RNA, 14 nt, Mycobacterium bovis subsp bovis AF2122/97
cggccggcggucgg

SEQ ID NO: 3186623 - RNA, 20 nt, Mycobacterium bovis subsp bovis AF2122/97
cggccggcguguucugaucg

SEQ ID NO: 3186624 - RNA, 13 nt, Mycobacterium bovis subsp bovis AF2122/97
cggccggcucguc

SEQ ID NO: 3186625 - RNA, 14 nt, Mycobacterium bovis subsp bovis AF2122/97
cggccgggcccucc

SEQ ID NO: 3186626 - RNA, 15 nt, Mycobacterium bovis subsp bovis AF2122/97
cggccgggccugcac

SEQ ID NO: 3186627 - RNA, 22 nt, Mycobacterium bovis subsp bovis AF2122/97
cggccgggccugcaccacggcg

SEQ ID NO: 3186628 - RNA, 14 nt, Mycobacterium bovis subsp bovis AF2122/97
cggccgggcggcca

SEQ ID NO: 3186629 - RNA, 21 nt, Mycobacterium bovis subsp bovis AF2122/97
cggccgggcggccaggcgcga

SEQ ID NO: 3186630 - RNA, 19 nt, Mycobacterium bovis subsp bovis AF2122/97
cggccgggcggucgagucc

SEQ ID NO: 3186631 - RNA, 18 nt, Mycobacterium bovis subsp bovis AF2122/97
cggccggggccacccgca

SEQ ID NO: 3186632 - RNA, 13 nt, Mycobacterium bovis subsp bovis AF2122/97
cggccggggcgaa

SEQ ID NO: 3186633 - RNA, 21 nt, Mycobacterium bovis subsp bovis AF2122/97
cggccggggcgaacggcaccg

SEQ ID NO: 3186634 - RNA, 15 nt, Mycobacterium bovis subsp bovis AF2122/97
cggccgggucauccg

SEQ ID NO: 3186635 - RNA, 22 nt, Mycobacterium bovis subsp bovis AF2122/97
cggccgggucgaacaggccggc

SEQ ID NO: 3186636 - RNA, 19 nt, Mycobacterium bovis subsp bovis AF2122/97
cggccgggucgagugcgga

SEQ ID NO: 3186637 - RNA, 14 nt, Mycobacterium bovis subsp bovis AF2122/97
cggccgggucgcgc

SEQ ID NO: 3186638 - RNA, 17 nt, Mycobacterium bovis subsp bovis AF2122/97
cggccgggucgcgcugg

SEQ ID NO: 3186639 - RNA, 15 nt, Mycobacterium bovis subsp bovis AF2122/97
cggccgggucgguga

SEQ ID NO: 3186640 - RNA, 21 nt, Mycobacterium bovis subsp bovis AF2122/97
cggccggguguagcucggacc

SEQ ID NO: 3186641 - RNA, 22 nt, Mycobacterium bovis subsp bovis AF2122/97
cggccggguguagcucggaccc

SEQ ID NO: 3186642 - RNA, 18 nt, Mycobacterium bovis subsp bovis AF2122/97
cggccggguuaucggcag

SEQ ID NO: 3186643 - RNA, 22 nt, Mycobacterium bovis subsp bovis AF2122/97
cggccggguuaucggcagcagg

SEQ ID NO: 3186644 - RNA, 16 nt, Mycobacterium bovis subsp bovis AF2122/97
cggccggguucgcguc

SEQ ID NO: 3186645 - RNA, 23 nt, Mycobacterium bovis subsp bovis AF2122/97
cggccgguagaucuucggccgca

SEQ ID NO: 3186646 - RNA, 19 nt, Mycobacterium bovis subsp bovis AF2122/97
cggccgguaguagcugacc

SEQ ID NO: 3186647 - RNA, 18 nt, Mycobacterium bovis subsp bovis AF2122/97
cggccgguauuucggcga

SEQ ID NO: 3186648 - RNA, 20 nt, Mycobacterium bovis subsp bovis AF2122/97
cggccgguauuucggcgacu

SEQ ID NO: 3186649 - RNA, 14 nt, Mycobacterium bovis subsp bovis AF2122/97
cggccggucgagac

SEQ ID NO: 3186650 - RNA, 15 nt, Mycobacterium bovis subsp bovis AF2122/97
cggccggugcccggg

SEQ ID NO: 3186651 - RNA, 16 nt, Mycobacterium bovis subsp bovis AF2122/97
cggccggugcccgggc

SEQ ID NO: 3186652 - RNA, 18 nt, Mycobacterium bovis subsp bovis AF2122/97
cggccggugcccgggcgu

SEQ ID NO: 3186653 - RNA, 20 nt, Mycobacterium bovis subsp bovis AF2122/97
cggccgguggaaaccgggcg

SEQ ID NO: 3186654 - RNA, 22 nt, Mycobacterium bovis subsp bovis AF2122/97
cggccgguggaaaccgggcgaa

SEQ ID NO: 3186655 - RNA, 18 nt, Mycobacterium bovis subsp bovis AF2122/97
cggccgguuggccagcca

SEQ ID NO: 3186656 - RNA, 19 nt, Mycobacterium bovis subsp bovis AF2122/97
cggccgguuggccagccac

SEQ ID NO: 3186657 - RNA, 21 nt, Mycobacterium bovis subsp bovis AF2122/97
cggccgguuggccagccacag

SEQ ID NO: 3186658 - RNA, 24 nt, Mycobacterium bovis subsp bovis AF2122/97
cggccgguuggccagccacagccg

SEQ ID NO: 3186659 - RNA, 22 nt, Mycobacterium bovis subsp bovis AF2122/97
cggccguagugcacgucggcgg

SEQ ID NO: 3186660 - RNA, 21 nt, Mycobacterium bovis subsp bovis AF2122/97
cggccgucauggcccgaucga

SEQ ID NO: 3186661 - RNA, 18 nt, Mycobacterium bovis subsp bovis AF2122/97
cggccgucccgcgagcag

SEQ ID NO: 3186662 - RNA, 20 nt, Mycobacterium bovis subsp bovis AF2122/97
cggccgucccgcgagcagcc

SEQ ID NO: 3186663 - RNA, 14 nt, Mycobacterium bovis subsp bovis AF2122/97
cggccgucgacgau

SEQ ID NO: 3186664 - RNA, 13 nt, Mycobacterium bovis subsp bovis AF2122/97
cggccgucgaucu

SEQ ID NO: 3186665 - RNA, 13 nt, Mycobacterium bovis subsp bovis AF2122/97
cggccgucgaugg

SEQ ID NO: 3186666 - RNA, 15 nt, Mycobacterium bovis subsp bovis AF2122/97
cggccgucgaugguc

SEQ ID NO: 3186667 - RNA, 17 nt, Mycobacterium bovis subsp bovis AF2122/97
cggccgucgauggucag

SEQ ID NO: 3186668 - RNA, 22 nt, Mycobacterium bovis subsp bovis AF2122/97
cggccgucgauugcaggucggc

SEQ ID NO: 3186669 - RNA, 15 nt, Mycobacterium bovis subsp bovis AF2122/97
cggccgucgccggga

SEQ ID NO: 3186670 - RNA, 22 nt, Mycobacterium bovis subsp bovis AF2122/97
cggccgucgcgggacaacagca

SEQ ID NO: 3186671 - RNA, 15 nt, Mycobacterium bovis subsp bovis AF2122/97
cggccgucggccgga

SEQ ID NO: 3186672 - RNA, 14 nt, Mycobacterium bovis subsp bovis AF2122/97
cggccgucggcggg

SEQ ID NO: 3186673 - RNA, 15 nt, Mycobacterium bovis subsp bovis AF2122/97
cggccgucggcgggc

SEQ ID NO: 3186674 - RNA, 12 nt, Mycobacterium bovis subsp bovis AF2122/97
cggccgucggga

SEQ ID NO: 3186675 - RNA, 14 nt, Mycobacterium bovis subsp bovis AF2122/97
cggccgucgggacg

SEQ ID NO: 3186676 - RNA, 15 nt, Mycobacterium bovis subsp bovis AF2122/97
cggccgucgucggcc

SEQ ID NO: 3186677 - RNA, 20 nt, Mycobacterium bovis subsp bovis AF2122/97
cggccgugaacggcgcgggc

SEQ ID NO: 3186678 - RNA, 18 nt, Mycobacterium bovis subsp bovis AF2122/97
cggccgugaauucgccga

SEQ ID NO: 3186679 - RNA, 21 nt, Mycobacterium bovis subsp bovis AF2122/97
cggccgugaauucgccgaacg

SEQ ID NO: 3186680 - RNA, 23 nt, Mycobacterium bovis subsp bovis AF2122/97
cggccgugaauucgccgaacggu

SEQ ID NO: 3186681 - RNA, 19 nt, Mycobacterium bovis subsp bovis AF2122/97
cggccgugaccgagccgcg

SEQ ID NO: 3186682 - RNA, 17 nt, Mycobacterium bovis subsp bovis AF2122/97
cggccgugaugucccgc

SEQ ID NO: 3186683 - RNA, 13 nt, Mycobacterium bovis subsp bovis AF2122/97
cggccgugccgcc

SEQ ID NO: 3186684 - RNA, 17 nt, Mycobacterium bovis subsp bovis AF2122/97
cggccgugccgccgaca

SEQ ID NO: 3186685 - RNA, 18 nt, Mycobacterium bovis subsp bovis AF2122/97
cggccgugccgccgacac

SEQ ID NO: 3186686 - RNA, 19 nt, Mycobacterium bovis subsp bovis AF2122/97
cggccguggccucgauguc

SEQ ID NO: 3186687 - RNA, 19 nt, Mycobacterium bovis subsp bovis AF2122/97
cggccgugucgggcgcgaa

SEQ ID NO: 3186688 - RNA, 20 nt, Mycobacterium bovis subsp bovis AF2122/97
cggccguugggaaacaucgu

SEQ ID NO: 3186689 - RNA, 14 nt, Mycobacterium bovis subsp bovis AF2122/97
cggccguugggcca

SEQ ID NO: 3186690 - RNA, 16 nt, Mycobacterium bovis subsp bovis AF2122/97
cggccguugggccacc

SEQ ID NO: 3186691 - RNA, 22 nt, Mycobacterium bovis subsp bovis AF2122/97
cggccguugggccaccggcgcc

SEQ ID NO: 3186692 - RNA, 17 nt, Mycobacterium bovis subsp bovis AF2122/97
cggccuaacucgccugc

SEQ ID NO: 3186693 - RNA, 21 nt, Mycobacterium bovis subsp bovis AF2122/97
cggccuagggcggcggcgcga

SEQ ID NO: 3186694 - RNA, 19 nt, Mycobacterium bovis subsp bovis AF2122/97
cggccucaacacccggccg

SEQ ID NO: 3186695 - RNA, 20 nt, Mycobacterium bovis subsp bovis AF2122/97
cggccucaacacccggccga

SEQ ID NO: 3186696 - RNA, 21 nt, Mycobacterium bovis subsp bovis AF2122/97
cggccucaacacccggccgac

SEQ ID NO: 3186697 - RNA, 15 nt, Mycobacterium bovis subsp bovis AF2122/97
cggccuccaccacgu

SEQ ID NO: 3186698 - RNA, 17 nt, Mycobacterium bovis subsp bovis AF2122/97
cggccuccaucgcgaca

SEQ ID NO: 3186699 - RNA, 15 nt, Mycobacterium bovis subsp bovis AF2122/97
cggccuccccgaccu

SEQ ID NO: 3186700 - RNA, 16 nt, Mycobacterium bovis subsp bovis AF2122/97
cggccucccgggccgc

SEQ ID NO: 3186701 - RNA, 17 nt, Mycobacterium bovis subsp bovis AF2122/97
cggccucccgggccgcc

SEQ ID NO: 3186702 - RNA, 18 nt, Mycobacterium bovis subsp bovis AF2122/97
cggccuccgggccaugug

SEQ ID NO: 3186703 - RNA, 15 nt, Mycobacterium bovis subsp bovis AF2122/97
cggccuccuccccga

SEQ ID NO: 3186704 - RNA, 18 nt, Mycobacterium bovis subsp bovis AF2122/97
cggccucgaccucuucgg

SEQ ID NO: 3186705 - RNA, 21 nt, Mycobacterium bovis subsp bovis AF2122/97
cggccucgagacggucgauca

SEQ ID NO: 3186706 - RNA, 14 nt, Mycobacterium bovis subsp bovis AF2122/97
cggccucgccgaag

SEQ ID NO: 3186707 - RNA, 15 nt, Mycobacterium bovis subsp bovis AF2122/97
cggccucgccggcgc

SEQ ID NO: 3186708 - RNA, 17 nt, Mycobacterium bovis subsp bovis AF2122/97
cggccucgccggggcaa

SEQ ID NO: 3186709 - RNA, 21 nt, Mycobacterium bovis subsp bovis AF2122/97
cggccucgcugcucagcaacg

SEQ ID NO: 3186710 - RNA, 14 nt, Mycobacterium bovis subsp bovis AF2122/97
cggccucgcugggc

SEQ ID NO: 3186711 - RNA, 15 nt, Mycobacterium bovis subsp bovis AF2122/97
cggccucggcgagca

SEQ ID NO: 3186712 - RNA, 13 nt, Mycobacterium bovis subsp bovis AF2122/97
cggccucggcggu

SEQ ID NO: 3186713 - RNA, 18 nt, Mycobacterium bovis subsp bovis AF2122/97
cggccucggcggucgccu

SEQ ID NO: 3186714 - RNA, 22 nt, Mycobacterium bovis subsp bovis AF2122/97
cggccucguagucccacugcca

SEQ ID NO: 3186715 - RNA, 12 nt, Mycobacterium bovis subsp bovis AF2122/97
cggccucgucga

SEQ ID NO: 3186716 - RNA, 20 nt, Mycobacterium bovis subsp bovis AF2122/97
cggccucgucgauguucgcc

SEQ ID NO: 3186717 - RNA, 17 nt, Mycobacterium bovis subsp bovis AF2122/97
cggccucguugaccggg

SEQ ID NO: 3186718 - RNA, 17 nt, Mycobacterium bovis subsp bovis AF2122/97
cggccucguuguagccg

SEQ ID NO: 3186719 - RNA, 18 nt, Mycobacterium bovis subsp bovis AF2122/97
cggccucuagcuugacaa

SEQ ID NO: 3186720 - RNA, 22 nt, Mycobacterium bovis subsp bovis AF2122/97
cggccucuagcuugacaacccu

SEQ ID NO: 3186721 - RNA, 16 nt, Mycobacterium bovis subsp bovis AF2122/97
cggccucugaccagcc

SEQ ID NO: 3186722 - RNA, 17 nt, Mycobacterium bovis subsp bovis AF2122/97
cggccucugaccagccg

SEQ ID NO: 3186723 - RNA, 19 nt, Mycobacterium bovis subsp bovis AF2122/97
cggccucugaccagccggu

SEQ ID NO: 3186724 - RNA, 20 nt, Mycobacterium bovis subsp bovis AF2122/97
cggccucuggaucacgucga

SEQ ID NO: 3186725 - RNA, 20 nt, Mycobacterium bovis subsp bovis AF2122/97
cggccugaccggcucgccgg

SEQ ID NO: 3186726 - RNA, 17 nt, Mycobacterium bovis subsp bovis AF2122/97
cggccugaccggucacc

SEQ ID NO: 3186727 - RNA, 17 nt, Mycobacterium bovis subsp bovis AF2122/97
cggccugagcggccauc

SEQ ID NO: 3186728 - RNA, 13 nt, Mycobacterium bovis subsp bovis AF2122/97
cggccugcacggc

SEQ ID NO: 3186729 - RNA, 19 nt, Mycobacterium bovis subsp bovis AF2122/97
cggccugcacggcgcugac

SEQ ID NO: 3186730 - RNA, 22 nt, Mycobacterium bovis subsp bovis AF2122/97
cggccugcagcgaugacgacca

SEQ ID NO: 3186731 - RNA, 14 nt, Mycobacterium bovis subsp bovis AF2122/97
cggccugcccgccg

SEQ ID NO: 3186732 - RNA, 12 nt, Mycobacterium bovis subsp bovis AF2122/97
cggccugccgcu

SEQ ID NO: 3186733 - RNA, 18 nt, Mycobacterium bovis subsp bovis AF2122/97
cggccugcgaacacgcga

SEQ ID NO: 3186734 - RNA, 21 nt, Mycobacterium bovis subsp bovis AF2122/97
cggccugcgacacaacgggug

SEQ ID NO: 3186735 - RNA, 19 nt, Mycobacterium bovis subsp bovis AF2122/97
cggccugcgacgagcccac

SEQ ID NO: 3186736 - RNA, 22 nt, Mycobacterium bovis subsp bovis AF2122/97
cggccugcgacgagcccaccgu

SEQ ID NO: 3186737 - RNA, 13 nt, Mycobacterium bovis subsp bovis AF2122/97
cggccugcgccgg

SEQ ID NO: 3186738 - RNA, 14 nt, Mycobacterium bovis subsp bovis AF2122/97
cggccugcgccggc

SEQ ID NO: 3186739 - RNA, 15 nt, Mycobacterium bovis subsp bovis AF2122/97
cggccugcgccggcg

SEQ ID NO: 3186740 - RNA, 14 nt, Mycobacterium bovis subsp bovis AF2122/97
cggccugcgcgacc

SEQ ID NO: 3186741 - RNA, 17 nt, Mycobacterium bovis subsp bovis AF2122/97
cggccugcgcgaccgac

SEQ ID NO: 3186742 - RNA, 19 nt, Mycobacterium bovis subsp bovis AF2122/97
cggccugcgcgaccgacca

SEQ ID NO: 3186743 - RNA, 12 nt, Mycobacterium bovis subsp bovis AF2122/97
cggccugcgucg

SEQ ID NO: 3186744 - RNA, 13 nt, Mycobacterium bovis subsp bovis AF2122/97
cggccugcgucga

SEQ ID NO: 3186745 - RNA, 14 nt, Mycobacterium bovis subsp bovis AF2122/97
cggccugcgucgaa

SEQ ID NO: 3186746 - RNA, 13 nt, Mycobacterium bovis subsp bovis AF2122/97
cggccugcucgac

SEQ ID NO: 3186747 - RNA, 16 nt, Mycobacterium bovis subsp bovis AF2122/97
cggccugcucgaccau

SEQ ID NO: 3186748 - RNA, 15 nt, Mycobacterium bovis subsp bovis AF2122/97
cggccugcucggcga

SEQ ID NO: 3186749 - RNA, 21 nt, Mycobacterium bovis subsp bovis AF2122/97
cggccugcucggcgaguucgg

SEQ ID NO: 3186750 - RNA, 16 nt, Mycobacterium bovis subsp bovis AF2122/97
cggccugcucgggggc

SEQ ID NO: 3186751 - RNA, 20 nt, Mycobacterium bovis subsp bovis AF2122/97
cggccugcucgggggccgac

SEQ ID NO: 3186752 - RNA, 22 nt, Mycobacterium bovis subsp bovis AF2122/97
cggccugcucgggggccgacca

SEQ ID NO: 3186753 - RNA, 17 nt, Mycobacterium bovis subsp bovis AF2122/97
cggccugcugcugcagc

SEQ ID NO: 3186754 - RNA, 13 nt, Mycobacterium bovis subsp bovis AF2122/97
cggccugcugguc

SEQ ID NO: 3186755 - RNA, 14 nt, Mycobacterium bovis subsp bovis AF2122/97
cggccugcugguca

SEQ ID NO: 3186756 - RNA, 22 nt, Mycobacterium bovis subsp bovis AF2122/97
cggccugcuggucaccaucacc

SEQ ID NO: 3186757 - RNA, 18 nt, Mycobacterium bovis subsp bovis AF2122/97
cggccuggaucgugccga

SEQ ID NO: 3186758 - RNA, 14 nt, Mycobacterium bovis subsp bovis AF2122/97
cggccuggcacccg

SEQ ID NO: 3186759 - RNA, 16 nt, Mycobacterium bovis subsp bovis AF2122/97
cggccuggcacccggg

SEQ ID NO: 3186760 - RNA, 20 nt, Mycobacterium bovis subsp bovis AF2122/97
cggccuggcaggguggggcg

SEQ ID NO: 3186761 - RNA, 15 nt, Mycobacterium bovis subsp bovis AF2122/97
cggccuggccaccug

SEQ ID NO: 3186762 - RNA, 15 nt, Mycobacterium bovis subsp bovis AF2122/97
cggccugggccagcc

SEQ ID NO: 3186763 - RNA, 17 nt, Mycobacterium bovis subsp bovis AF2122/97
cggccugggccagccgc

SEQ ID NO: 3186764 - RNA, 20 nt, Mycobacterium bovis subsp bovis AF2122/97
cggccugggccagccgcuca

SEQ ID NO: 3186765 - RNA, 16 nt, Mycobacterium bovis subsp bovis AF2122/97
cggccuggggcagccg

SEQ ID NO: 3186766 - RNA, 17 nt, Mycobacterium bovis subsp bovis AF2122/97
cggccuggggcagccgg

SEQ ID NO: 3186767 - RNA, 14 nt, Mycobacterium bovis subsp bovis AF2122/97
cggccugguacucc

SEQ ID NO: 3186768 - RNA, 19 nt, Mycobacterium bovis subsp bovis AF2122/97
cggccugguacucccgcga

SEQ ID NO: 3186769 - RNA, 15 nt, Mycobacterium bovis subsp bovis AF2122/97
cggccuggucggcca

SEQ ID NO: 3186770 - RNA, 21 nt, Mycobacterium bovis subsp bovis AF2122/97
cggccuggucggccaggucga

SEQ ID NO: 3186771 - RNA, 16 nt, Mycobacterium bovis subsp bovis AF2122/97
cggccuguucgccguc

SEQ ID NO: 3186772 - RNA, 13 nt, Mycobacterium bovis subsp bovis AF2122/97
cggccuguucggc

SEQ ID NO: 3186773 - RNA, 19 nt, Mycobacterium bovis subsp bovis AF2122/97
cggccuguucggcggcugc

SEQ ID NO: 3186774 - RNA, 24 nt, Mycobacterium bovis subsp bovis AF2122/97
cggccuguuuuggguagcggauca

SEQ ID NO: 3186775 - RNA, 17 nt, Mycobacterium bovis subsp bovis AF2122/97
cggccuuauucacccgg

SEQ ID NO: 3186776 - RNA, 15 nt, Mycobacterium bovis subsp bovis AF2122/97
cggccuucucgccgu

SEQ ID NO: 3186777 - RNA, 21 nt, Mycobacterium bovis subsp bovis AF2122/97
cggccuucucgccguguucga

SEQ ID NO: 3186778 - RNA, 14 nt, Mycobacterium bovis subsp bovis AF2122/97
cggccuucuugagg

SEQ ID NO: 3186779 - RNA, 16 nt, Mycobacterium bovis subsp bovis AF2122/97
cggccuugacgcacga

SEQ ID NO: 3186780 - RNA, 16 nt, Mycobacterium bovis subsp bovis AF2122/97
cggccuugaucaccgu

SEQ ID NO: 3186781 - RNA, 20 nt, Mycobacterium bovis subsp bovis AF2122/97
cggccuugaucaccgugcgg

SEQ ID NO: 3186782 - RNA, 21 nt, Mycobacterium bovis subsp bovis AF2122/97
cggccuugaucgugcuggcga

SEQ ID NO: 3186783 - RNA, 22 nt, Mycobacterium bovis subsp bovis AF2122/97
cggccuugaucgugcuggcgac

SEQ ID NO: 3186784 - RNA, 15 nt, Mycobacterium bovis subsp bovis AF2122/97
cggccuugccaccgg

SEQ ID NO: 3186785 - RNA, 16 nt, Mycobacterium bovis subsp bovis AF2122/97
cggccuugccaccggu

SEQ ID NO: 3186786 - RNA, 22 nt, Mycobacterium bovis subsp bovis AF2122/97
cggccuugcccucaacggcggc

SEQ ID NO: 3186787 - RNA, 15 nt, Mycobacterium bovis subsp bovis AF2122/97
cggccuugccgccgg

SEQ ID NO: 3186788 - RNA, 16 nt, Mycobacterium bovis subsp bovis AF2122/97
cggccuugccgccggc

SEQ ID NO: 3186789 - RNA, 18 nt, Mycobacterium bovis subsp bovis AF2122/97
cggccuugccgccggccc

SEQ ID NO: 3186790 - RNA, 20 nt, Mycobacterium bovis subsp bovis AF2122/97
cggccuugccgccggccccg

SEQ ID NO: 3186791 - RNA, 17 nt, Mycobacterium bovis subsp bovis AF2122/97
cggccuugccgccggcg

SEQ ID NO: 3186792 - RNA, 14 nt, Mycobacterium bovis subsp bovis AF2122/97
cggccuugccgggc

SEQ ID NO: 3186793 - RNA, 16 nt, Mycobacterium bovis subsp bovis AF2122/97
cggccuugccgggccg

SEQ ID NO: 3186794 - RNA, 17 nt, Mycobacterium bovis subsp bovis AF2122/97
cggccuugccgggccgc

SEQ ID NO: 3186795 - RNA, 23 nt, Mycobacterium bovis subsp bovis AF2122/97
cggccuugccgggccgcgcgggc

SEQ ID NO: 3186796 - RNA, 21 nt, Mycobacterium bovis subsp bovis AF2122/97
cggccuugcgcacaggcgcga

SEQ ID NO: 3186797 - RNA, 21 nt, Mycobacterium bovis subsp bovis AF2122/97
cggccuuggcgacgucggcgg

SEQ ID NO: 3186798 - RNA, 17 nt, Mycobacterium bovis subsp bovis AF2122/97
cggccuuggcggccgcg

SEQ ID NO: 3186799 - RNA, 16 nt, Mycobacterium bovis subsp bovis AF2122/97
cggccuuggcggcggc

SEQ ID NO: 3186800 - RNA, 17 nt, Mycobacterium bovis subsp bovis AF2122/97
cggccuuggcggcggca

SEQ ID NO: 3186801 - RNA, 17 nt, Mycobacterium bovis subsp bovis AF2122/97
cggccuugugcucgaug

SEQ ID NO: 3186802 - RNA, 16 nt, Mycobacterium bovis subsp bovis AF2122/97
cggccuuuacccgggc

SEQ ID NO: 3186803 - RNA, 20 nt, Mycobacterium bovis subsp bovis AF2122/97
cggccuuuccagcaccccga

SEQ ID NO: 3186804 - RNA, 21 nt, Mycobacterium bovis subsp bovis AF2122/97
cggccuuuccagcaccccgau

SEQ ID NO: 3186805 - RNA, 19 nt, Mycobacterium bovis subsp bovis AF2122/97
cggccuuugucgccuucuu

SEQ ID NO: 3186806 - RNA, 21 nt, Mycobacterium bovis subsp bovis AF2122/97
cggcgaaaagacugcgccgcc

SEQ ID NO: 3186807 - RNA, 15 nt, Mycobacterium bovis subsp bovis AF2122/97
cggcgaaacucgucg

SEQ ID NO: 3186808 - RNA, 21 nt, Mycobacterium bovis subsp bovis AF2122/97
cggcgaaacucgucgauucgg

SEQ ID NO: 3186809 - RNA, 17 nt, Mycobacterium bovis subsp bovis AF2122/97
cggcgaaagcuugggcg

SEQ ID NO: 3186810 - RNA, 18 nt, Mycobacterium bovis subsp bovis AF2122/97
cggcgaaagcuugggcga

SEQ ID NO: 3186811 - RNA, 16 nt, Mycobacterium bovis subsp bovis AF2122/97
cggcgaaaggccaguc

SEQ ID NO: 3186812 - RNA, 20 nt, Mycobacterium bovis subsp bovis AF2122/97
cggcgaaaggccagucgugc

SEQ ID NO: 3186813 - RNA, 18 nt, Mycobacterium bovis subsp bovis AF2122/97
cggcgaaaguccugcagu

SEQ ID NO: 3186814 - RNA, 23 nt, Mycobacterium bovis subsp bovis AF2122/97
cggcgaaaguccugcagugcggc

SEQ ID NO: 3186815 - RNA, 23 nt, Mycobacterium bovis subsp bovis AF2122/97
cggcgaaaucgacagcagcgcga

SEQ ID NO: 3186816 - RNA, 16 nt, Mycobacterium bovis subsp bovis AF2122/97
cggcgaacaaccacgc

SEQ ID NO: 3186817 - RNA, 17 nt, Mycobacterium bovis subsp bovis AF2122/97
cggcgaacaaccgccgc

SEQ ID NO: 3186818 - RNA, 15 nt, Mycobacterium bovis subsp bovis AF2122/97
cggcgaacaggcgac

SEQ ID NO: 3186819 - RNA, 17 nt, Mycobacterium bovis subsp bovis AF2122/97
cggcgaacaggcgaccg

SEQ ID NO: 3186820 - RNA, 13 nt, Mycobacterium bovis subsp bovis AF2122/97
cggcgaaccacgg

SEQ ID NO: 3186821 - RNA, 17 nt, Mycobacterium bovis subsp bovis AF2122/97
cggcgaaccacggcagc

SEQ ID NO: 3186822 - RNA, 18 nt, Mycobacterium bovis subsp bovis AF2122/97
cggcgaaccacggcagcc

SEQ ID NO: 3186823 - RNA, 19 nt, Mycobacterium bovis subsp bovis AF2122/97
cggcgaaccacggcagcca

SEQ ID NO: 3186824 - RNA, 14 nt, Mycobacterium bovis subsp bovis AF2122/97
cggcgaaccagcgc

SEQ ID NO: 3186825 - RNA, 17 nt, Mycobacterium bovis subsp bovis AF2122/97
cggcgaacccgcagucg

SEQ ID NO: 3186826 - RNA, 15 nt, Mycobacterium bovis subsp bovis AF2122/97
cggcgaacccgccga

SEQ ID NO: 3186827 - RNA, 20 nt, Mycobacterium bovis subsp bovis AF2122/97
cggcgaacccuccgcagcua

SEQ ID NO: 3186828 - RNA, 15 nt, Mycobacterium bovis subsp bovis AF2122/97
cggcgaaccggccca

SEQ ID NO: 3186829 - RNA, 16 nt, Mycobacterium bovis subsp bovis AF2122/97
cggcgaaccggcccac

SEQ ID NO: 3186830 - RNA, 18 nt, Mycobacterium bovis subsp bovis AF2122/97
cggcgaaccggcccaccg

SEQ ID NO: 3186831 - RNA, 21 nt, Mycobacterium bovis subsp bovis AF2122/97
cggcgaacgcgaaugucgcgc

SEQ ID NO: 3186832 - RNA, 15 nt, Mycobacterium bovis subsp bovis AF2122/97
cggcgaacgcgucca

SEQ ID NO: 3186833 - RNA, 19 nt, Mycobacterium bovis subsp bovis AF2122/97
cggcgaacgcguccagcgc

SEQ ID NO: 3186834 - RNA, 23 nt, Mycobacterium bovis subsp bovis AF2122/97
cggcgaacgcguccagcgcggcc

SEQ ID NO: 3186835 - RNA, 13 nt, Mycobacterium bovis subsp bovis AF2122/97
cggcgaacggauu

SEQ ID NO: 3186836 - RNA, 21 nt, Mycobacterium bovis subsp bovis AF2122/97
cggcgaacggauucccgccca

SEQ ID NO: 3186837 - RNA, 15 nt, Mycobacterium bovis subsp bovis AF2122/97
cggcgaacggcacca

SEQ ID NO: 3186838 - RNA, 18 nt, Mycobacterium bovis subsp bovis AF2122/97
cggcgaacucgcgccgag

SEQ ID NO: 3186839 - RNA, 14 nt, Mycobacterium bovis subsp bovis AF2122/97
cggcgaacucggcg

SEQ ID NO: 3186840 - RNA, 15 nt, Mycobacterium bovis subsp bovis AF2122/97
cggcgaacucggcga

SEQ ID NO: 3186841 - RNA, 16 nt, Mycobacterium bovis subsp bovis AF2122/97
cggcgaacugcgaucg

SEQ ID NO: 3186842 - RNA, 19 nt, Mycobacterium bovis subsp bovis AF2122/97
cggcgaacugggugcgguc

SEQ ID NO: 3186843 - RNA, 20 nt, Mycobacterium bovis subsp bovis AF2122/97
cggcgaagaagccggcaagc

SEQ ID NO: 3186844 - RNA, 21 nt, Mycobacterium bovis subsp bovis AF2122/97
cggcgaagaagccggcaagcg

SEQ ID NO: 3186845 - RNA, 21 nt, Mycobacterium bovis subsp bovis AF2122/97
cggcgaagauaucggcacggu

SEQ ID NO: 3186846 - RNA, 16 nt, Mycobacterium bovis subsp bovis AF2122/97
cggcgaagccggccgg

SEQ ID NO: 3186847 - RNA, 14 nt, Mycobacterium bovis subsp bovis AF2122/97
cggcgaagccgggu

SEQ ID NO: 3186848 - RNA, 14 nt, Mycobacterium bovis subsp bovis AF2122/97
cggcgaagcgggcg

SEQ ID NO: 3186849 - RNA, 15 nt, Mycobacterium bovis subsp bovis AF2122/97
cggcgaagcgggcgu

SEQ ID NO: 3186850 - RNA, 18 nt, Mycobacterium bovis subsp bovis AF2122/97
cggcgaagcgugcgccga

SEQ ID NO: 3186851 - RNA, 22 nt, Mycobacterium bovis subsp bovis AF2122/97
cggcgaaggccagcagaaacau

SEQ ID NO: 3186852 - RNA, 15 nt, Mycobacterium bovis subsp bovis AF2122/97
cggcgaaggccgcgc

SEQ ID NO: 3186853 - RNA, 17 nt, Mycobacterium bovis subsp bovis AF2122/97
cggcgaaggccgcgcgc

SEQ ID NO: 3186854 - RNA, 20 nt, Mycobacterium bovis subsp bovis AF2122/97
cggcgaagguguccuccagc

SEQ ID NO: 3186855 - RNA, 23 nt, Mycobacterium bovis subsp bovis AF2122/97
cggcgaagguguccuccagcugc

SEQ ID NO: 3186856 - RNA, 13 nt, Mycobacterium bovis subsp bovis AF2122/97
cggcgaagucacg

SEQ ID NO: 3186857 - RNA, 20 nt, Mycobacterium bovis subsp bovis AF2122/97
cggcgaagucacgcacccgg

SEQ ID NO: 3186858 - RNA, 15 nt, Mycobacterium bovis subsp bovis AF2122/97
cggcgaagugcaccc

SEQ ID NO: 3186859 - RNA, 19 nt, Mycobacterium bovis subsp bovis AF2122/97
cggcgaagugcacccggau

SEQ ID NO: 3186860 - RNA, 15 nt, Mycobacterium bovis subsp bovis AF2122/97
cggcgaauccgccgc

SEQ ID NO: 3186861 - RNA, 16 nt, Mycobacterium bovis subsp bovis AF2122/97
cggcgaauccgccgcc

SEQ ID NO: 3186862 - RNA, 18 nt, Mycobacterium bovis subsp bovis AF2122/97
cggcgaaugcgauugccg

SEQ ID NO: 3186863 - RNA, 22 nt, Mycobacterium bovis subsp bovis AF2122/97
cggcgaaugcgauugccgucgu

SEQ ID NO: 3186864 - RNA, 17 nt, Mycobacterium bovis subsp bovis AF2122/97
cggcgacaagccgagcc

SEQ ID NO: 3186865 - RNA, 14 nt, Mycobacterium bovis subsp bovis AF2122/97
cggcgacacccugg

SEQ ID NO: 3186866 - RNA, 22 nt, Mycobacterium bovis subsp bovis AF2122/97
cggcgacacccugggugccggc

SEQ ID NO: 3186867 - RNA, 13 nt, Mycobacterium bovis subsp bovis AF2122/97
cggcgacaccgca

SEQ ID NO: 3186868 - RNA, 14 nt, Mycobacterium bovis subsp bovis AF2122/97
cggcgacaccgcag

SEQ ID NO: 3186869 - RNA, 19 nt, Mycobacterium bovis subsp bovis AF2122/97
cggcgacaccgcaggugcc

SEQ ID NO: 3186870 - RNA, 14 nt, Mycobacterium bovis subsp bovis AF2122/97
cggcgacacgccag

SEQ ID NO: 3186871 - RNA, 21 nt, Mycobacterium bovis subsp bovis AF2122/97
cggcgacacgccagccgugcc

SEQ ID NO: 3186872 - RNA, 12 nt, Mycobacterium bovis subsp bovis AF2122/97
cggcgacagcgc

SEQ ID NO: 3186873 - RNA, 15 nt, Mycobacterium bovis subsp bovis AF2122/97
cggcgacagcgcggc

SEQ ID NO: 3186874 - RNA, 17 nt, Mycobacterium bovis subsp bovis AF2122/97
cggcgacagcgcggcgg

SEQ ID NO: 3186875 - RNA, 18 nt, Mycobacterium bovis subsp bovis AF2122/97
cggcgacagcgcggcggu

SEQ ID NO: 3186876 - RNA, 20 nt, Mycobacterium bovis subsp bovis AF2122/97
cggcgacagcuuggccgguu

SEQ ID NO: 3186877 - RNA, 20 nt, Mycobacterium bovis subsp bovis AF2122/97
cggcgacaggagacgguacg

SEQ ID NO: 3186878 - RNA, 17 nt, Mycobacterium bovis subsp bovis AF2122/97
cggcgacauccacaccg

SEQ ID NO: 3186879 - RNA, 15 nt, Mycobacterium bovis subsp bovis AF2122/97
cggcgacaucggccc

SEQ ID NO: 3186880 - RNA, 18 nt, Mycobacterium bovis subsp bovis AF2122/97
cggcgacaugaucugcca

SEQ ID NO: 3186881 - RNA, 19 nt, Mycobacterium bovis subsp bovis AF2122/97
cggcgaccaaggccgaccu

SEQ ID NO: 3186882 - RNA, 14 nt, Mycobacterium bovis subsp bovis AF2122/97
cggcgaccaccccg

SEQ ID NO: 3186883 - RNA, 17 nt, Mycobacterium bovis subsp bovis AF2122/97
cggcgaccaccccguag

SEQ ID NO: 3186884 - RNA, 14 nt, Mycobacterium bovis subsp bovis AF2122/97
cggcgaccacgccg

SEQ ID NO: 3186885 - RNA, 15 nt, Mycobacterium bovis subsp bovis AF2122/97
cggcgaccacgccgc

SEQ ID NO: 3186886 - RNA, 21 nt, Mycobacterium bovis subsp bovis AF2122/97
cggcgaccacgccgccggcgc

SEQ ID NO: 3186887 - RNA, 12 nt, Mycobacterium bovis subsp bovis AF2122/97
cggcgaccacgg

SEQ ID NO: 3186888 - RNA, 17 nt, Mycobacterium bovis subsp bovis AF2122/97
cggcgaccacggcaccg

SEQ ID NO: 3186889 - RNA, 21 nt, Mycobacterium bovis subsp bovis AF2122/97
cggcgaccagaaucucgccgg

SEQ ID NO: 3186890 - RNA, 20 nt, Mycobacterium bovis subsp bovis AF2122/97
cggcgaccagaggaugucga

SEQ ID NO: 3186891 - RNA, 22 nt, Mycobacterium bovis subsp bovis AF2122/97
cggcgaccagaggaugucgaug

SEQ ID NO: 3186892 - RNA, 21 nt, Mycobacterium bovis subsp bovis AF2122/97
cggcgaccaggucggcuucga

SEQ ID NO: 3186893 - RNA, 22 nt, Mycobacterium bovis subsp bovis AF2122/97
cggcgaccauauucagcucggg

SEQ ID NO: 3186894 - RNA, 19 nt, Mycobacterium bovis subsp bovis AF2122/97
cggcgaccaucugaucggg

SEQ ID NO: 3186895 - RNA, 23 nt, Mycobacterium bovis subsp bovis AF2122/97
cggcgaccaucugaucgggcccg

SEQ ID NO: 3186896 - RNA, 15 nt, Mycobacterium bovis subsp bovis AF2122/97
cggcgacccagcggu

SEQ ID NO: 3186897 - RNA, 14 nt, Mycobacterium bovis subsp bovis AF2122/97
cggcgaccccgaac

SEQ ID NO: 3186898 - RNA, 12 nt, Mycobacterium bovis subsp bovis AF2122/97
cggcgacccggu

SEQ ID NO: 3186899 - RNA, 16 nt, Mycobacterium bovis subsp bovis AF2122/97
cggcgacccggucacu

SEQ ID NO: 3186900 - RNA, 17 nt, Mycobacterium bovis subsp bovis AF2122/97
cggcgacccggucgcgg

SEQ ID NO: 3186901 - RNA, 15 nt, Mycobacterium bovis subsp bovis AF2122/97
cggcgacccgucccc

SEQ ID NO: 3186902 - RNA, 22 nt, Mycobacterium bovis subsp bovis AF2122/97
cggcgacccgucccccgcacgc

SEQ ID NO: 3186903 - RNA, 15 nt, Mycobacterium bovis subsp bovis AF2122/97
cggcgaccgacgccg

SEQ ID NO: 3186904 - RNA, 14 nt, Mycobacterium bovis subsp bovis AF2122/97
cggcgaccgccagc

SEQ ID NO: 3186905 - RNA, 20 nt, Mycobacterium bovis subsp bovis AF2122/97
cggcgaccgcgcucaccggg

SEQ ID NO: 3186906 - RNA, 17 nt, Mycobacterium bovis subsp bovis AF2122/97
cggcgaccgcgucgucc

SEQ ID NO: 3186907 - RNA, 19 nt, Mycobacterium bovis subsp bovis AF2122/97
cggcgaccggcgagcccgc

SEQ ID NO: 3186908 - RNA, 16 nt, Mycobacterium bovis subsp bovis AF2122/97
cggcgaccggguccgg

SEQ ID NO: 3186909 - RNA, 18 nt, Mycobacterium bovis subsp bovis AF2122/97
cggcgaccggguccggcg

SEQ ID NO: 3186910 - RNA, 13 nt, Mycobacterium bovis subsp bovis AF2122/97
cggcgaccgucga

SEQ ID NO: 3186911 - RNA, 16 nt, Mycobacterium bovis subsp bovis AF2122/97
cggcgaccuccgggau

SEQ ID NO: 3186912 - RNA, 21 nt, Mycobacterium bovis subsp bovis AF2122/97
cggcgaccuccgggaugucga

SEQ ID NO: 3186913 - RNA, 19 nt, Mycobacterium bovis subsp bovis AF2122/97
cggcgaccucggcggcggc

SEQ ID NO: 3186914 - RNA, 22 nt, Mycobacterium bovis subsp bovis AF2122/97
cggcgaccugccggaccgcgga

SEQ ID NO: 3186915 - RNA, 18 nt, Mycobacterium bovis subsp bovis AF2122/97
cggcgaccuggcucaucg

SEQ ID NO: 3186916 - RNA, 20 nt, Mycobacterium bovis subsp bovis AF2122/97
cggcgacgaacucacgcagg

SEQ ID NO: 3186917 - RNA, 18 nt, Mycobacterium bovis subsp bovis AF2122/97
cggcgacgaacugaagcc

SEQ ID NO: 3186918 - RNA, 14 nt, Mycobacterium bovis subsp bovis AF2122/97
cggcgacgacccgg

SEQ ID NO: 3186919 - RNA, 15 nt, Mycobacterium bovis subsp bovis AF2122/97
cggcgacgacccggg

SEQ ID NO: 3186920 - RNA, 21 nt, Mycobacterium bovis subsp bovis AF2122/97
cggcgacgacccgggucggca

SEQ ID NO: 3186921 - RNA, 15 nt, Mycobacterium bovis subsp bovis AF2122/97
cggcgacgaccgucg

SEQ ID NO: 3186922 - RNA, 12 nt, Mycobacterium bovis subsp bovis AF2122/97
cggcgacgacgg

SEQ ID NO: 3186923 - RNA, 17 nt, Mycobacterium bovis subsp bovis AF2122/97
cggcgacgagcgcagcg

SEQ ID NO: 3186924 - RNA, 22 nt, Mycobacterium bovis subsp bovis AF2122/97
cggcgacgauauagggcuccuc

SEQ ID NO: 3186925 - RNA, 20 nt, Mycobacterium bovis subsp bovis AF2122/97
cggcgacgaucucgccgcca

SEQ ID NO: 3186926 - RNA, 15 nt, Mycobacterium bovis subsp bovis AF2122/97
cggcgacgaucucgg

SEQ ID NO: 3186927 - RNA, 19 nt, Mycobacterium bovis subsp bovis AF2122/97
cggcgacgaucucggcggc

SEQ ID NO: 3186928 - RNA, 21 nt, Mycobacterium bovis subsp bovis AF2122/97
cggcgacgaucucggcggccg

SEQ ID NO: 3186929 - RNA, 12 nt, Mycobacterium bovis subsp bovis AF2122/97
cggcgacgaugu

SEQ ID NO: 3186930 - RNA, 22 nt, Mycobacterium bovis subsp bovis AF2122/97
cggcgacgaugucgacucgugg

SEQ ID NO: 3186931 - RNA, 23 nt, Mycobacterium bovis subsp bovis AF2122/97
cggcgacgauucgagcgguugcc

SEQ ID NO: 3186932 - RNA, 15 nt, Mycobacterium bovis subsp bovis AF2122/97
cggcgacgcgccggu

SEQ ID NO: 3186933 - RNA, 18 nt, Mycobacterium bovis subsp bovis AF2122/97
cggcgacgcgccgguuca

SEQ ID NO: 3186934 - RNA, 12 nt, Mycobacterium bovis subsp bovis AF2122/97
cggcgacgcgga

SEQ ID NO: 3186935 - RNA, 17 nt, Mycobacterium bovis subsp bovis AF2122/97
cggcgacgcuaccgccg

SEQ ID NO: 3186936 - RNA, 20 nt, Mycobacterium bovis subsp bovis AF2122/97
cggcgacgcuaccgccggag

SEQ ID NO: 3186937 - RNA, 16 nt, Mycobacterium bovis subsp bovis AF2122/97
cggcgacggccagcgc

SEQ ID NO: 3186938 - RNA, 17 nt, Mycobacterium bovis subsp bovis AF2122/97
cggcgacggccagcgcg

SEQ ID NO: 3186939 - RNA, 13 nt, Mycobacterium bovis subsp bovis AF2122/97
cggcgacggccgc

SEQ ID NO: 3186940 - RNA, 14 nt, Mycobacterium bovis subsp bovis AF2122/97
cggcgacggccgcu

SEQ ID NO: 3186941 - RNA, 13 nt, Mycobacterium bovis subsp bovis AF2122/97
cggcgacggcgcc

SEQ ID NO: 3186942 - RNA, 15 nt, Mycobacterium bovis subsp bovis AF2122/97
cggcgacggcgccca

SEQ ID NO: 3186943 - RNA, 16 nt, Mycobacterium bovis subsp bovis AF2122/97
cggcgacggcggcacg

SEQ ID NO: 3186944 - RNA, 21 nt, Mycobacterium bovis subsp bovis AF2122/97
cggcgacggcggcacgggcgg

SEQ ID NO: 3186945 - RNA, 23 nt, Mycobacterium bovis subsp bovis AF2122/97
cggcgacggcggcacgggcggcc

SEQ ID NO: 3186946 - RNA, 14 nt, Mycobacterium bovis subsp bovis AF2122/97
cggcgacgggucgg

SEQ ID NO: 3186947 - RNA, 17 nt, Mycobacterium bovis subsp bovis AF2122/97
cggcgacgggucgggca

SEQ ID NO: 3186948 - RNA, 19 nt, Mycobacterium bovis subsp bovis AF2122/97
cggcgacguagacgguccg

SEQ ID NO: 3186949 - RNA, 18 nt, Mycobacterium bovis subsp bovis AF2122/97
cggcgacgucgcgcaggu

SEQ ID NO: 3186950 - RNA, 15 nt, Mycobacterium bovis subsp bovis AF2122/97
cggcgacgucggcgg

SEQ ID NO: 3186951 - RNA, 22 nt, Mycobacterium bovis subsp bovis AF2122/97
cggcgacgugaauggugguguc

SEQ ID NO: 3186952 - RNA, 17 nt, Mycobacterium bovis subsp bovis AF2122/97
cggcgacguggcgccga

SEQ ID NO: 3186953 - RNA, 18 nt, Mycobacterium bovis subsp bovis AF2122/97
cggcgacguggcgccgac

SEQ ID NO: 3186954 - RNA, 19 nt, Mycobacterium bovis subsp bovis AF2122/97
cggcgacguuccgcucgag

SEQ ID NO: 3186955 - RNA, 17 nt, Mycobacterium bovis subsp bovis AF2122/97
cggcgacuacccagcca

SEQ ID NO: 3186956 - RNA, 23 nt, Mycobacterium bovis subsp bovis AF2122/97
cggcgacuacggccucgcugggc

SEQ ID NO: 3186957 - RNA, 13 nt, Mycobacterium bovis subsp bovis AF2122/97
cggcgacuccucu

SEQ ID NO: 3186958 - RNA, 17 nt, Mycobacterium bovis subsp bovis AF2122/97
cggcgacugcgcaccug

SEQ ID NO: 3186959 - RNA, 12 nt, Mycobacterium bovis subsp bovis AF2122/97
cggcgacugcgu

SEQ ID NO: 3186960 - RNA, 15 nt, Mycobacterium bovis subsp bovis AF2122/97
cggcgacugcgucgg

SEQ ID NO: 3186961 - RNA, 20 nt, Mycobacterium bovis subsp bovis AF2122/97
cggcgacugcgucggcggcu

SEQ ID NO: 3186962 - RNA, 21 nt, Mycobacterium bovis subsp bovis AF2122/97
cggcgagaaacacgacagcca

SEQ ID NO: 3186963 - RNA, 19 nt, Mycobacterium bovis subsp bovis AF2122/97
cggcgagaagucgcagcga

SEQ ID NO: 3186964 - RNA, 14 nt, Mycobacterium bovis subsp bovis AF2122/97
cggcgagagcguca

SEQ ID NO: 3186965 - RNA, 23 nt, Mycobacterium bovis subsp bovis AF2122/97
cggcgagcaauuccucagccggu

SEQ ID NO: 3186966 - RNA, 20 nt, Mycobacterium bovis subsp bovis AF2122/97
cggcgagcacaugcugccgc

SEQ ID NO: 3186967 - RNA, 14 nt, Mycobacterium bovis subsp bovis AF2122/97
cggcgagcaccacc

SEQ ID NO: 3186968 - RNA, 15 nt, Mycobacterium bovis subsp bovis AF2122/97
cggcgagcaccaccc

SEQ ID NO: 3186969 - RNA, 23 nt, Mycobacterium bovis subsp bovis AF2122/97
cggcgagcaccaccccagcggcc

SEQ ID NO: 3186970 - RNA, 21 nt, Mycobacterium bovis subsp bovis AF2122/97
cggcgagcacccgcuggucga

SEQ ID NO: 3186971 - RNA, 14 nt, Mycobacterium bovis subsp bovis AF2122/97
cggcgagcaccgug

SEQ ID NO: 3186972 - RNA, 16 nt, Mycobacterium bovis subsp bovis AF2122/97
cggcgagcaccgugcc

SEQ ID NO: 3186973 - RNA, 16 nt, Mycobacterium bovis subsp bovis AF2122/97
cggcgagcagacgccg

SEQ ID NO: 3186974 - RNA, 17 nt, Mycobacterium bovis subsp bovis AF2122/97
cggcgagcagacgccgc

SEQ ID NO: 3186975 - RNA, 13 nt, Mycobacterium bovis subsp bovis AF2122/97
cggcgagcagggc

SEQ ID NO: 3186976 - RNA, 14 nt, Mycobacterium bovis subsp bovis AF2122/97
cggcgagcagggcg

SEQ ID NO: 3186977 - RNA, 23 nt, Mycobacterium bovis subsp bovis AF2122/97
cggcgagccaaacuacccgccca

SEQ ID NO: 3186978 - RNA, 15 nt, Mycobacterium bovis subsp bovis AF2122/97
cggcgagcccgcauc

SEQ ID NO: 3186979 - RNA, 23 nt, Mycobacterium bovis subsp bovis AF2122/97
cggcgagcgcaucggccaacacc

SEQ ID NO: 3186980 - RNA, 12 nt, Mycobacterium bovis subsp bovis AF2122/97
cggcgagcgccc

SEQ ID NO: 3186981 - RNA, 20 nt, Mycobacterium bovis subsp bovis AF2122/97
cggcgagcggccuccagcac

SEQ ID NO: 3186982 - RNA, 14 nt, Mycobacterium bovis subsp bovis AF2122/97
cggcgagcggugau

SEQ ID NO: 3186983 - RNA, 17 nt, Mycobacterium bovis subsp bovis AF2122/97
cggcgagcucggccccg

SEQ ID NO: 3186984 - RNA, 20 nt, Mycobacterium bovis subsp bovis AF2122/97
cggcgagcucggccccgccg

SEQ ID NO: 3186985 - RNA, 21 nt, Mycobacterium bovis subsp bovis AF2122/97
cggcgagcucggccccgccgc

SEQ ID NO: 3186986 - RNA, 17 nt, Mycobacterium bovis subsp bovis AF2122/97
cggcgagcugcuuggcg

SEQ ID NO: 3186987 - RNA, 14 nt, Mycobacterium bovis subsp bovis AF2122/97
cggcgaggacgcgc

SEQ ID NO: 3186988 - RNA, 16 nt, Mycobacterium bovis subsp bovis AF2122/97
cggcgaggacgcgccc

SEQ ID NO: 3186989 - RNA, 16 nt, Mycobacterium bovis subsp bovis AF2122/97
cggcgaggccucggcg

SEQ ID NO: 3186990 - RNA, 17 nt, Mycobacterium bovis subsp bovis AF2122/97
cggcgaggccucggcgg

SEQ ID NO: 3186991 - RNA, 20 nt, Mycobacterium bovis subsp bovis AF2122/97
cggcgaggccucggcggccg

SEQ ID NO: 3186992 - RNA, 22 nt, Mycobacterium bovis subsp bovis AF2122/97
cggcgaggcgagucaccggguc

SEQ ID NO: 3186993 - RNA, 12 nt, Mycobacterium bovis subsp bovis AF2122/97
cggcgaggcggu

SEQ ID NO: 3186994 - RNA, 14 nt, Mycobacterium bovis subsp bovis AF2122/97
cggcgagggcaacg

SEQ ID NO: 3186995 - RNA, 15 nt, Mycobacterium bovis subsp bovis AF2122/97
cggcgagggcgcgcc

SEQ ID NO: 3186996 - RNA, 16 nt, Mycobacterium bovis subsp bovis AF2122/97
cggcgagggcgcgccg

SEQ ID NO: 3186997 - RNA, 17 nt, Mycobacterium bovis subsp bovis AF2122/97
cggcgagggcgcgccgu

SEQ ID NO: 3186998 - RNA, 14 nt, Mycobacterium bovis subsp bovis AF2122/97
cggcgagggugagc

SEQ ID NO: 3186999 - RNA, 22 nt, Mycobacterium bovis subsp bovis AF2122/97
cggcgagguauaaacgcggcgc

SEQ ID NO: 3187000 - RNA, 13 nt, Mycobacterium bovis subsp bovis AF2122/97
cggcgaggucccg

SEQ ID NO: 3187001 - RNA, 18 nt, Mycobacterium bovis subsp bovis AF2122/97
cggcgaggucccggccga

SEQ ID NO: 3187002 - RNA, 21 nt, Mycobacterium bovis subsp bovis AF2122/97
cggcgaggucccggccgagcg

SEQ ID NO: 3187003 - RNA, 20 nt, Mycobacterium bovis subsp bovis AF2122/97
cggcgaguccacaaguaccg

SEQ ID NO: 3187004 - RNA, 14 nt, Mycobacterium bovis subsp bovis AF2122/97
cggcgagucgguug

SEQ ID NO: 3187005 - RNA, 18 nt, Mycobacterium bovis subsp bovis AF2122/97
cggcgagucgguugucgg

SEQ ID NO: 3187006 - RNA, 20 nt, Mycobacterium bovis subsp bovis AF2122/97
cggcgagugguccagccaga

SEQ ID NO: 3187007 - RNA, 17 nt, Mycobacterium bovis subsp bovis AF2122/97
cggcgaguucggcagcg

SEQ ID NO: 3187008 - RNA, 20 nt, Mycobacterium bovis subsp bovis AF2122/97
cggcgaguuggccguggcga

SEQ ID NO: 3187009 - RNA, 18 nt, Mycobacterium bovis subsp bovis AF2122/97
cggcgauaacuccgcggc

SEQ ID NO: 3187010 - RNA, 20 nt, Mycobacterium bovis subsp bovis AF2122/97
cggcgauaacuccgcggcga

SEQ ID NO: 3187011 - RNA, 22 nt, Mycobacterium bovis subsp bovis AF2122/97
cggcgauaacuccgcggcgaac

SEQ ID NO: 3187012 - RNA, 12 nt, Mycobacterium bovis subsp bovis AF2122/97
cggcgauaccga

SEQ ID NO: 3187013 - RNA, 19 nt, Mycobacterium bovis subsp bovis AF2122/97
cggcgauauaggacgccgc

SEQ ID NO: 3187014 - RNA, 16 nt, Mycobacterium bovis subsp bovis AF2122/97
cggcgaucaacgcgca

SEQ ID NO: 3187015 - RNA, 16 nt, Mycobacterium bovis subsp bovis AF2122/97
cggcgaucaacucggg

SEQ ID NO: 3187016 - RNA, 22 nt, Mycobacterium bovis subsp bovis AF2122/97
cggcgaucaacucgggcagcgc

SEQ ID NO: 3187017 - RNA, 13 nt, Mycobacterium bovis subsp bovis AF2122/97
cggcgaucaagcc

SEQ ID NO: 3187018 - RNA, 15 nt, Mycobacterium bovis subsp bovis AF2122/97
cggcgaucaagccuc

SEQ ID NO: 3187019 - RNA, 20 nt, Mycobacterium bovis subsp bovis AF2122/97
cggcgaucaauugcccggca

SEQ ID NO: 3187020 - RNA, 22 nt, Mycobacterium bovis subsp bovis AF2122/97
cggcgaucaauugcccggcacg

SEQ ID NO: 3187021 - RNA, 22 nt, Mycobacterium bovis subsp bovis AF2122/97
cggcgaucaccgagauggcgau

SEQ ID NO: 3187022 - RNA, 11 nt, Mycobacterium bovis subsp bovis AF2122/97
cggcgaucacg

SEQ ID NO: 3187023 - RNA, 23 nt, Mycobacterium bovis subsp bovis AF2122/97
cggcgaucacgcgaaugacgauc

SEQ ID NO: 3187024 - RNA, 15 nt, Mycobacterium bovis subsp bovis AF2122/97
cggcgaucaggcgga

SEQ ID NO: 3187025 - RNA, 19 nt, Mycobacterium bovis subsp bovis AF2122/97
cggcgauccagaacaacgg

SEQ ID NO: 3187026 - RNA, 14 nt, Mycobacterium bovis subsp bovis AF2122/97
cggcgauccgacga

SEQ ID NO: 3187027 - RNA, 18 nt, Mycobacterium bovis subsp bovis AF2122/97
cggcgauccggucggcca

SEQ ID NO: 3187028 - RNA, 19 nt, Mycobacterium bovis subsp bovis AF2122/97
cggcgauccggucgggggc

SEQ ID NO: 3187029 - RNA, 17 nt, Mycobacterium bovis subsp bovis AF2122/97
cggcgaucgaggugacg

SEQ ID NO: 3187030 - RNA, 18 nt, Mycobacterium bovis subsp bovis AF2122/97
cggcgaucgcuccgcggc

SEQ ID NO: 3187031 - RNA, 21 nt, Mycobacterium bovis subsp bovis AF2122/97
cggcgaucgcuccgcggcgca

SEQ ID NO: 3187032 - RNA, 20 nt, Mycobacterium bovis subsp bovis AF2122/97
cggcgaucggaggcccgcca

SEQ ID NO: 3187033 - RNA, 14 nt, Mycobacterium bovis subsp bovis AF2122/97
cggcgaucgggcgg

SEQ ID NO: 3187034 - RNA, 19 nt, Mycobacterium bovis subsp bovis AF2122/97
cggcgaucgggcgggugaa

SEQ ID NO: 3187035 - RNA, 15 nt, Mycobacterium bovis subsp bovis AF2122/97
cggcgaucgucaagc

SEQ ID NO: 3187036 - RNA, 19 nt, Mycobacterium bovis subsp bovis AF2122/97
cggcgaucgucaagccggg

SEQ ID NO: 3187037 - RNA, 24 nt, Mycobacterium bovis subsp bovis AF2122/97
cggcgaucgucaagccgggcacgg

SEQ ID NO: 3187038 - RNA, 17 nt, Mycobacterium bovis subsp bovis AF2122/97
cggcgaucuccggcgga

SEQ ID NO: 3187039 - RNA, 14 nt, Mycobacterium bovis subsp bovis AF2122/97
cggcgaucugcgac

SEQ ID NO: 3187040 - RNA, 20 nt, Mycobacterium bovis subsp bovis AF2122/97
cggcgaucugcgacaagacc

SEQ ID NO: 3187041 - RNA, 20 nt, Mycobacterium bovis subsp bovis AF2122/97
cggcgaucugcugugucgua

SEQ ID NO: 3187042 - RNA, 20 nt, Mycobacterium bovis subsp bovis AF2122/97
cggcgaucuuggaucgguug

SEQ ID NO: 3187043 - RNA, 21 nt, Mycobacterium bovis subsp bovis AF2122/97
cggcgaugaacagcgacgcca

SEQ ID NO: 3187044 - RNA, 18 nt, Mycobacterium bovis subsp bovis AF2122/97
cggcgaugaacgggaucg

SEQ ID NO: 3187045 - RNA, 16 nt, Mycobacterium bovis subsp bovis AF2122/97
cggcgaugaauagguc

SEQ ID NO: 3187046 - RNA, 17 nt, Mycobacterium bovis subsp bovis AF2122/97
cggcgaugacaucaccg

SEQ ID NO: 3187047 - RNA, 21 nt, Mycobacterium bovis subsp bovis AF2122/97
cggcgaugacaucaccgacca

SEQ ID NO: 3187048 - RNA, 18 nt, Mycobacterium bovis subsp bovis AF2122/97
cggcgaugaccgggcgau

SEQ ID NO: 3187049 - RNA, 21 nt, Mycobacterium bovis subsp bovis AF2122/97
cggcgaugaccgggcgauucg

SEQ ID NO: 3187050 - RNA, 22 nt, Mycobacterium bovis subsp bovis AF2122/97
cggcgaugaucaccagucgcug

SEQ ID NO: 3187051 - RNA, 18 nt, Mycobacterium bovis subsp bovis AF2122/97
cggcgaugaugacggcgg

SEQ ID NO: 3187052 - RNA, 22 nt, Mycobacterium bovis subsp bovis AF2122/97
cggcgaugaugacggcggcccg

SEQ ID NO: 3187053 - RNA, 17 nt, Mycobacterium bovis subsp bovis AF2122/97
cggcgaugauggcgcga

SEQ ID NO: 3187054 - RNA, 18 nt, Mycobacterium bovis subsp bovis AF2122/97
cggcgaugauggcgcgau

SEQ ID NO: 3187055 - RNA, 20 nt, Mycobacterium bovis subsp bovis AF2122/97
cggcgaugauggcgcgaucg

SEQ ID NO: 3187056 - RNA, 21 nt, Mycobacterium bovis subsp bovis AF2122/97
cggcgaugauguugagcugga

SEQ ID NO: 3187057 - RNA, 14 nt, Mycobacterium bovis subsp bovis AF2122/97
cggcgaugcagcca

SEQ ID NO: 3187058 - RNA, 15 nt, Mycobacterium bovis subsp bovis AF2122/97
cggcgaugcgcacca

SEQ ID NO: 3187059 - RNA, 17 nt, Mycobacterium bovis subsp bovis AF2122/97
cggcgaugcgcgggugg

SEQ ID NO: 3187060 - RNA, 17 nt, Mycobacterium bovis subsp bovis AF2122/97
cggcgaugcggucggcc

SEQ ID NO: 3187061 - RNA, 16 nt, Mycobacterium bovis subsp bovis AF2122/97
cggcgaugcguccgcc

SEQ ID NO: 3187062 - RNA, 18 nt, Mycobacterium bovis subsp bovis AF2122/97
cggcgaugcguccgccca

SEQ ID NO: 3187063 - RNA, 19 nt, Mycobacterium bovis subsp bovis AF2122/97
cggcgaugcguccgcccag

SEQ ID NO: 3187064 - RNA, 23 nt, Mycobacterium bovis subsp bovis AF2122/97
cggcgaugcguccgcccagccgc

SEQ ID NO: 3187065 - RNA, 14 nt, Mycobacterium bovis subsp bovis AF2122/97
cggcgaugcugagc

SEQ ID NO: 3187066 - RNA, 16 nt, Mycobacterium bovis subsp bovis AF2122/97
cggcgaugcugagccg

SEQ ID NO: 3187067 - RNA, 15 nt, Mycobacterium bovis subsp bovis AF2122/97
cggcgauggccagca

SEQ ID NO: 3187068 - RNA, 17 nt, Mycobacterium bovis subsp bovis AF2122/97
cggcgauggcggcaucg

SEQ ID NO: 3187069 - RNA, 14 nt, Mycobacterium bovis subsp bovis AF2122/97
cggcgaugggccgg

SEQ ID NO: 3187070 - RNA, 15 nt, Mycobacterium bovis subsp bovis AF2122/97
cggcgaugggccggu

SEQ ID NO: 3187071 - RNA, 22 nt, Mycobacterium bovis subsp bovis AF2122/97
cggcgaugggccgguccggggc

SEQ ID NO: 3187072 - RNA, 20 nt, Mycobacterium bovis subsp bovis AF2122/97
cggcgaugguaucgccgcua

SEQ ID NO: 3187073 - RNA, 21 nt, Mycobacterium bovis subsp bovis AF2122/97
cggcgaugguaucgccgcuag

SEQ ID NO: 3187074 - RNA, 23 nt, Mycobacterium bovis subsp bovis AF2122/97
cggcgaugucgaagccccucacc

SEQ ID NO: 3187075 - RNA, 14 nt, Mycobacterium bovis subsp bovis AF2122/97
cggcgaugucgcgc

SEQ ID NO: 3187076 - RNA, 17 nt, Mycobacterium bovis subsp bovis AF2122/97
cggcgauuaccggcacg

SEQ ID NO: 3187077 - RNA, 20 nt, Mycobacterium bovis subsp bovis AF2122/97
cggcgauuaccggcacgccg

SEQ ID NO: 3187078 - RNA, 21 nt, Mycobacterium bovis subsp bovis AF2122/97
cggcgauuaccggcacgccgg

SEQ ID NO: 3187079 - RNA, 15 nt, Mycobacterium bovis subsp bovis AF2122/97
cggcgauuacggcca

SEQ ID NO: 3187080 - RNA, 17 nt, Mycobacterium bovis subsp bovis AF2122/97
cggcgauuacggccagu

SEQ ID NO: 3187081 - RNA, 21 nt, Mycobacterium bovis subsp bovis AF2122/97
cggcgauucccgcgaagcggg

SEQ ID NO: 3187082 - RNA, 18 nt, Mycobacterium bovis subsp bovis AF2122/97
cggcgauugauccggugg

SEQ ID NO: 3187083 - RNA, 15 nt, Mycobacterium bovis subsp bovis AF2122/97
cggcgauugcccgug

SEQ ID NO: 3187084 - RNA, 18 nt, Mycobacterium bovis subsp bovis AF2122/97
cggcgauuggaccgccaa

SEQ ID NO: 3187085 - RNA, 16 nt, Mycobacterium bovis subsp bovis AF2122/97
cggcgauuggcuguga

SEQ ID NO: 3187086 - RNA, 19 nt, Mycobacterium bovis subsp bovis AF2122/97
cggcgauuggcugugaucg

SEQ ID NO: 3187087 - RNA, 16 nt, Mycobacterium bovis subsp bovis AF2122/97
cggcgcaacucgacca

SEQ ID NO: 3187088 - RNA, 21 nt, Mycobacterium bovis subsp bovis AF2122/97
cggcgcacaaacauacgccac

SEQ ID NO: 3187089 - RNA, 15 nt, Mycobacterium bovis subsp bovis AF2122/97
cggcgcacaacccgu

SEQ ID NO: 3187090 - RNA, 19 nt, Mycobacterium bovis subsp bovis AF2122/97
cggcgcaccacaccacggu

SEQ ID NO: 3187091 - RNA, 13 nt, Mycobacterium bovis subsp bovis AF2122/97
cggcgcaccaucg

SEQ ID NO: 3187092 - RNA, 19 nt, Mycobacterium bovis subsp bovis AF2122/97
cggcgcaccaucgcggccg

SEQ ID NO: 3187093 - RNA, 22 nt, Mycobacterium bovis subsp bovis AF2122/97
cggcgcaccggagucgcccggu

SEQ ID NO: 3187094 - RNA, 19 nt, Mycobacterium bovis subsp bovis AF2122/97
cggcgcaccgucgcggguc

SEQ ID NO: 3187095 - RNA, 14 nt, Mycobacterium bovis subsp bovis AF2122/97
cggcgcaccugggc

SEQ ID NO: 3187096 - RNA, 18 nt, Mycobacterium bovis subsp bovis AF2122/97
cggcgcaccugggcugcc

SEQ ID NO: 3187097 - RNA, 19 nt, Mycobacterium bovis subsp bovis AF2122/97
cggcgcaccugggcugccg

SEQ ID NO: 3187098 - RNA, 21 nt, Mycobacterium bovis subsp bovis AF2122/97
cggcgcaccugggcugccggc

SEQ ID NO: 3187099 - RNA, 23 nt, Mycobacterium bovis subsp bovis AF2122/97
cggcgcaccugggcugccggcca

SEQ ID NO: 3187100 - RNA, 18 nt, Mycobacterium bovis subsp bovis AF2122/97
cggcgcaccuugaccguc

SEQ ID NO: 3187101 - RNA, 20 nt, Mycobacterium bovis subsp bovis AF2122/97
cggcgcaccuugaccgucgc

SEQ ID NO: 3187102 - RNA, 19 nt, Mycobacterium bovis subsp bovis AF2122/97
cggcgcacgaaaccgcagc

SEQ ID NO: 3187103 - RNA, 16 nt, Mycobacterium bovis subsp bovis AF2122/97
cggcgcagcacauccu

SEQ ID NO: 3187104 - RNA, 21 nt, Mycobacterium bovis subsp bovis AF2122/97
cggcgcagcacauccugcagc

SEQ ID NO: 3187105 - RNA, 12 nt, Mycobacterium bovis subsp bovis AF2122/97
cggcgcagcacc

SEQ ID NO: 3187106 - RNA, 14 nt, Mycobacterium bovis subsp bovis AF2122/97
cggcgcagcacggc

SEQ ID NO: 3187107 - RNA, 15 nt, Mycobacterium bovis subsp bovis AF2122/97
cggcgcagcacggcg

SEQ ID NO: 3187108 - RNA, 17 nt, Mycobacterium bovis subsp bovis AF2122/97
cggcgcagcacggcggc

SEQ ID NO: 3187109 - RNA, 21 nt, Mycobacterium bovis subsp bovis AF2122/97
cggcgcagcacggcggccacg

SEQ ID NO: 3187110 - RNA, 15 nt, Mycobacterium bovis subsp bovis AF2122/97
cggcgcagccgguga

SEQ ID NO: 3187111 - RNA, 15 nt, Mycobacterium bovis subsp bovis AF2122/97
cggcgcagcgaccgg

SEQ ID NO: 3187112 - RNA, 13 nt, Mycobacterium bovis subsp bovis AF2122/97
cggcgcagcgacg

SEQ ID NO: 3187113 - RNA, 16 nt, Mycobacterium bovis subsp bovis AF2122/97
cggcgcagcgacgcga

SEQ ID NO: 3187114 - RNA, 15 nt, Mycobacterium bovis subsp bovis AF2122/97
cggcgcagcguguug

SEQ ID NO: 3187115 - RNA, 14 nt, Mycobacterium bovis subsp bovis AF2122/97
cggcgcaggcgugc

SEQ ID NO: 3187116 - RNA, 21 nt, Mycobacterium bovis subsp bovis AF2122/97
cggcgcagguauaccgagggu

SEQ ID NO: 3187117 - RNA, 17 nt, Mycobacterium bovis subsp bovis AF2122/97
cggcgcaggucgcgcag

SEQ ID NO: 3187118 - RNA, 20 nt, Mycobacterium bovis subsp bovis AF2122/97
cggcgcaggucgcgcaguug

SEQ ID NO: 3187119 - RNA, 15 nt, Mycobacterium bovis subsp bovis AF2122/97
cggcgcaguagaugc

SEQ ID NO: 3187120 - RNA, 18 nt, Mycobacterium bovis subsp bovis AF2122/97
cggcgcaguagccgacca

SEQ ID NO: 3187121 - RNA, 14 nt, Mycobacterium bovis subsp bovis AF2122/97
cggcgcagugcagg

SEQ ID NO: 3187122 - RNA, 13 nt, Mycobacterium bovis subsp bovis AF2122/97
cggcgcagugcga

SEQ ID NO: 3187123 - RNA, 23 nt, Mycobacterium bovis subsp bovis AF2122/97
cggcgcagugcgacucugcgucu

SEQ ID NO: 3187124 - RNA, 15 nt, Mycobacterium bovis subsp bovis AF2122/97
cggcgcagugguguc

SEQ ID NO: 3187125 - RNA, 21 nt, Mycobacterium bovis subsp bovis AF2122/97
cggcgcaguuggcaccagccg

SEQ ID NO: 3187126 - RNA, 20 nt, Mycobacterium bovis subsp bovis AF2122/97
cggcgcauaggcggccaucg

SEQ ID NO: 3187127 - RNA, 19 nt, Mycobacterium bovis subsp bovis AF2122/97
cggcgcauucccuugucgg

SEQ ID NO: 3187128 - RNA, 21 nt, Mycobacterium bovis subsp bovis AF2122/97
cggcgcauucccuugucgguc

SEQ ID NO: 3187129 - RNA, 17 nt, Mycobacterium bovis subsp bovis AF2122/97
cggcgccaauucagcgg

SEQ ID NO: 3187130 - RNA, 23 nt, Mycobacterium bovis subsp bovis AF2122/97
cggcgccaauucagcggcaacga

SEQ ID NO: 3187131 - RNA, 19 nt, Mycobacterium bovis subsp bovis AF2122/97
cggcgccacccccaccguc

SEQ ID NO: 3187132 - RNA, 16 nt, Mycobacterium bovis subsp bovis AF2122/97
cggcgccacccgcgcc

SEQ ID NO: 3187133 - RNA, 19 nt, Mycobacterium bovis subsp bovis AF2122/97
cggcgccacccgcgccgcc

SEQ ID NO: 3187134 - RNA, 20 nt, Mycobacterium bovis subsp bovis AF2122/97
cggcgccacccgcgccgccc

SEQ ID NO: 3187135 - RNA, 22 nt, Mycobacterium bovis subsp bovis AF2122/97
cggcgccacccgcgccgcccgc

SEQ ID NO: 3187136 - RNA, 12 nt, Mycobacterium bovis subsp bovis AF2122/97
cggcgccaccgc

SEQ ID NO: 3187137 - RNA, 14 nt, Mycobacterium bovis subsp bovis AF2122/97
cggcgccaccgccg

SEQ ID NO: 3187138 - RNA, 17 nt, Mycobacterium bovis subsp bovis AF2122/97
cggcgccaccgccgcug

SEQ ID NO: 3187139 - RNA, 21 nt, Mycobacterium bovis subsp bovis AF2122/97
cggcgccaccgccgcugccgg

SEQ ID NO: 3187140 - RNA, 21 nt, Mycobacterium bovis subsp bovis AF2122/97
cggcgccaccggcgccgcccg

SEQ ID NO: 3187141 - RNA, 12 nt, Mycobacterium bovis subsp bovis AF2122/97
cggcgccaccgu

SEQ ID NO: 3187142 - RNA, 16 nt, Mycobacterium bovis subsp bovis AF2122/97
cggcgccaccgucacc

SEQ ID NO: 3187143 - RNA, 17 nt, Mycobacterium bovis subsp bovis AF2122/97
cggcgccaccgucaccg

SEQ ID NO: 3187144 - RNA, 18 nt, Mycobacterium bovis subsp bovis AF2122/97
cggcgccaccgucaccgc

SEQ ID NO: 3187145 - RNA, 22 nt, Mycobacterium bovis subsp bovis AF2122/97
cggcgccaccgucaccgccguu

SEQ ID NO: 3187146 - RNA, 14 nt, Mycobacterium bovis subsp bovis AF2122/97
cggcgccaccgucg

SEQ ID NO: 3187147 - RNA, 16 nt, Mycobacterium bovis subsp bovis AF2122/97
cggcgccaccguggug

SEQ ID NO: 3187148 - RNA, 20 nt, Mycobacterium bovis subsp bovis AF2122/97
cggcgccaccguugccgaac

SEQ ID NO: 3187149 - RNA, 14 nt, Mycobacterium bovis subsp bovis AF2122/97
cggcgccagaucga

SEQ ID NO: 3187150 - RNA, 13 nt, Mycobacterium bovis subsp bovis AF2122/97
cggcgccagcaga

SEQ ID NO: 3187151 - RNA, 13 nt, Mycobacterium bovis subsp bovis AF2122/97
cggcgccagcgcc

SEQ ID NO: 3187152 - RNA, 14 nt, Mycobacterium bovis subsp bovis AF2122/97
cggcgccagcgccg

SEQ ID NO: 3187153 - RNA, 15 nt, Mycobacterium bovis subsp bovis AF2122/97
cggcgccaggaucga

SEQ ID NO: 3187154 - RNA, 23 nt, Mycobacterium bovis subsp bovis AF2122/97
cggcgccaggcaccacgaccgac

SEQ ID NO: 3187155 - RNA, 19 nt, Mycobacterium bovis subsp bovis AF2122/97
cggcgccaguauggccgcc

SEQ ID NO: 3187156 - RNA, 21 nt, Mycobacterium bovis subsp bovis AF2122/97
cggcgccaguauggccgccac

SEQ ID NO: 3187157 - RNA, 22 nt, Mycobacterium bovis subsp bovis AF2122/97
cggcgccaucgggucacccccg

SEQ ID NO: 3187158 - RNA, 16 nt, Mycobacterium bovis subsp bovis AF2122/97
cggcgccauucgcccc

SEQ ID NO: 3187159 - RNA, 22 nt, Mycobacterium bovis subsp bovis AF2122/97
cggcgccauuggcgucccgcaa

SEQ ID NO: 3187160 - RNA, 14 nt, Mycobacterium bovis subsp bovis AF2122/97
cggcgcccacaucg

SEQ ID NO: 3187161 - RNA, 18 nt, Mycobacterium bovis subsp bovis AF2122/97
cggcgcccacaucgucgg

SEQ ID NO: 3187162 - RNA, 22 nt, Mycobacterium bovis subsp bovis AF2122/97
cggcgcccacaucgucggcggg

SEQ ID NO: 3187163 - RNA, 19 nt, Mycobacterium bovis subsp bovis AF2122/97
cggcgcccagcgccucgau

SEQ ID NO: 3187164 - RNA, 15 nt, Mycobacterium bovis subsp bovis AF2122/97
cggcgcccagcgcua

SEQ ID NO: 3187165 - RNA, 15 nt, Mycobacterium bovis subsp bovis AF2122/97
cggcgcccagcucga

SEQ ID NO: 3187166 - RNA, 17 nt, Mycobacterium bovis subsp bovis AF2122/97
cggcgcccagcucgucg

SEQ ID NO: 3187167 - RNA, 12 nt, Mycobacterium bovis subsp bovis AF2122/97
cggcgcccagga

SEQ ID NO: 3187168 - RNA, 15 nt, Mycobacterium bovis subsp bovis AF2122/97
cggcgcccaggccga

SEQ ID NO: 3187169 - RNA, 16 nt, Mycobacterium bovis subsp bovis AF2122/97
cggcgcccaggccgau

SEQ ID NO: 3187170 - RNA, 16 nt, Mycobacterium bovis subsp bovis AF2122/97
cggcgcccauagcacc

SEQ ID NO: 3187171 - RNA, 19 nt, Mycobacterium bovis subsp bovis AF2122/97
cggcgcccaucgcgacggc

SEQ ID NO: 3187172 - RNA, 21 nt, Mycobacterium bovis subsp bovis AF2122/97
cggcgcccgagauccccaaau

SEQ ID NO: 3187173 - RNA, 14 nt, Mycobacterium bovis subsp bovis AF2122/97
cggcgcccgccacc

SEQ ID NO: 3187174 - RNA, 16 nt, Mycobacterium bovis subsp bovis AF2122/97
cggcgcccgccaccgg

SEQ ID NO: 3187175 - RNA, 12 nt, Mycobacterium bovis subsp bovis AF2122/97
cggcgcccgccg

SEQ ID NO: 3187176 - RNA, 15 nt, Mycobacterium bovis subsp bovis AF2122/97
cggcgcccgccgcga

SEQ ID NO: 3187177 - RNA, 14 nt, Mycobacterium bovis subsp bovis AF2122/97
cggcgcccgcucgg

SEQ ID NO: 3187178 - RNA, 17 nt, Mycobacterium bovis subsp bovis AF2122/97
cggcgcccgcucggccg

SEQ ID NO: 3187179 - RNA, 18 nt, Mycobacterium bovis subsp bovis AF2122/97
cggcgcccgcucggccgc

SEQ ID NO: 3187180 - RNA, 21 nt, Mycobacterium bovis subsp bovis AF2122/97
cggcgcccgcucggccgcagc

SEQ ID NO: 3187181 - RNA, 24 nt, Mycobacterium bovis subsp bovis AF2122/97
cggcgcccgcucggccgcagccag

SEQ ID NO: 3187182 - RNA, 23 nt, Mycobacterium bovis subsp bovis AF2122/97
cggcgcccgggaucggggcaccg

SEQ ID NO: 3187183 - RNA, 15 nt, Mycobacterium bovis subsp bovis AF2122/97
cggcgcccggggcgg

SEQ ID NO: 3187184 - RNA, 23 nt, Mycobacterium bovis subsp bovis AF2122/97
cggcgcccggggcggugggcgcu

SEQ ID NO: 3187185 - RNA, 13 nt, Mycobacterium bovis subsp bovis AF2122/97
cggcgcccggggu

SEQ ID NO: 3187186 - RNA, 14 nt, Mycobacterium bovis subsp bovis AF2122/97
cggcgcccggucga

SEQ ID NO: 3187187 - RNA, 21 nt, Mycobacterium bovis subsp bovis AF2122/97
cggcgcccucaugucgggcaa

SEQ ID NO: 3187188 - RNA, 22 nt, Mycobacterium bovis subsp bovis AF2122/97
cggcgccgaacaccucggcacg

SEQ ID NO: 3187189 - RNA, 19 nt, Mycobacterium bovis subsp bovis AF2122/97
cggcgccgacccgaucacc

SEQ ID NO: 3187190 - RNA, 18 nt, Mycobacterium bovis subsp bovis AF2122/97
cggcgccgagcagcccgc

SEQ ID NO: 3187191 - RNA, 23 nt, Mycobacterium bovis subsp bovis AF2122/97
cggcgccgcaaugacgucgucgg

SEQ ID NO: 3187192 - RNA, 13 nt, Mycobacterium bovis subsp bovis AF2122/97
cggcgccgcacca

SEQ ID NO: 3187193 - RNA, 14 nt, Mycobacterium bovis subsp bovis AF2122/97
cggcgccgcaccca

SEQ ID NO: 3187194 - RNA, 14 nt, Mycobacterium bovis subsp bovis AF2122/97
cggcgccgcagauc

SEQ ID NO: 3187195 - RNA, 19 nt, Mycobacterium bovis subsp bovis AF2122/97
cggcgccgcagaucaccgc

SEQ ID NO: 3187196 - RNA, 23 nt, Mycobacterium bovis subsp bovis AF2122/97
cggcgccgcagaucaccgccagc

SEQ ID NO: 3187197 - RNA, 14 nt, Mycobacterium bovis subsp bovis AF2122/97
cggcgccgcauacc

SEQ ID NO: 3187198 - RNA, 21 nt, Mycobacterium bovis subsp bovis AF2122/97
cggcgccgcauaccaguaccg

SEQ ID NO: 3187199 - RNA, 12 nt, Mycobacterium bovis subsp bovis AF2122/97
cggcgccgccac

SEQ ID NO: 3187200 - RNA, 14 nt, Mycobacterium bovis subsp bovis AF2122/97
cggcgccgccacgg

SEQ ID NO: 3187201 - RNA, 15 nt, Mycobacterium bovis subsp bovis AF2122/97
cggcgccgccacgga

SEQ ID NO: 3187202 - RNA, 21 nt, Mycobacterium bovis subsp bovis AF2122/97
cggcgccgccacugccggcag

SEQ ID NO: 3187203 - RNA, 22 nt, Mycobacterium bovis subsp bovis AF2122/97
cggcgccgccacugccggcagc

SEQ ID NO: 3187204 - RNA, 13 nt, Mycobacterium bovis subsp bovis AF2122/97
cggcgccgccagc

SEQ ID NO: 3187205 - RNA, 16 nt, Mycobacterium bovis subsp bovis AF2122/97
cggcgccgccagcacc

SEQ ID NO: 3187206 - RNA, 23 nt, Mycobacterium bovis subsp bovis AF2122/97
cggcgccgccagcaccaccggcu

SEQ ID NO: 3187207 - RNA, 11 nt, Mycobacterium bovis subsp bovis AF2122/97
cggcgccgccc

SEQ ID NO: 3187208 - RNA, 13 nt, Mycobacterium bovis subsp bovis AF2122/97
cggcgccgcccaa

SEQ ID NO: 3187209 - RNA, 19 nt, Mycobacterium bovis subsp bovis AF2122/97
cggcgccgcccaacgcgag

SEQ ID NO: 3187210 - RNA, 20 nt, Mycobacterium bovis subsp bovis AF2122/97
cggcgccgcccaacgcgagc

SEQ ID NO: 3187211 - RNA, 21 nt, Mycobacterium bovis subsp bovis AF2122/97
cggcgccgcccaauccaccga

SEQ ID NO: 3187212 - RNA, 13 nt, Mycobacterium bovis subsp bovis AF2122/97
cggcgccgcccgc

SEQ ID NO: 3187213 - RNA, 20 nt, Mycobacterium bovis subsp bovis AF2122/97
cggcgccgcccgcgccacca

SEQ ID NO: 3187214 - RNA, 22 nt, Mycobacterium bovis subsp bovis AF2122/97
cggcgccgcccgcgccaccagc

SEQ ID NO: 3187215 - RNA, 18 nt, Mycobacterium bovis subsp bovis AF2122/97
cggcgccgcccgcgccgc

SEQ ID NO: 3187216 - RNA, 21 nt, Mycobacterium bovis subsp bovis AF2122/97
cggcgccgcccgcgccgccgc

SEQ ID NO: 3187217 - RNA, 20 nt, Mycobacterium bovis subsp bovis AF2122/97
cggcgccgcccuaaggggca

SEQ ID NO: 3187218 - RNA, 20 nt, Mycobacterium bovis subsp bovis AF2122/97
cggcgccgcccuugccgccg

SEQ ID NO: 3187219 - RNA, 21 nt, Mycobacterium bovis subsp bovis AF2122/97
cggcgccgcccuugccgccgg

SEQ ID NO: 3187220 - RNA, 12 nt, Mycobacterium bovis subsp bovis AF2122/97
cggcgccgccga

SEQ ID NO: 3187221 - RNA, 12 nt, Mycobacterium bovis subsp bovis AF2122/97
cggcgccgccgg

SEQ ID NO: 3187222 - RNA, 13 nt, Mycobacterium bovis subsp bovis AF2122/97
cggcgccgccggc

SEQ ID NO: 3187223 - RNA, 17 nt, Mycobacterium bovis subsp bovis AF2122/97
cggcgccgccggcaccg

SEQ ID NO: 3187224 - RNA, 14 nt, Mycobacterium bovis subsp bovis AF2122/97
cggcgccgccggcg

SEQ ID NO: 3187225 - RNA, 20 nt, Mycobacterium bovis subsp bovis AF2122/97
cggcgccgccggcgccgccc

SEQ ID NO: 3187226 - RNA, 13 nt, Mycobacterium bovis subsp bovis AF2122/97
cggcgccgccggu

SEQ ID NO: 3187227 - RNA, 23 nt, Mycobacterium bovis subsp bovis AF2122/97
cggcgccgccggugccaccggcu

SEQ ID NO: 3187228 - RNA, 12 nt, Mycobacterium bovis subsp bovis AF2122/97
cggcgccgccgu

SEQ ID NO: 3187229 - RNA, 22 nt, Mycobacterium bovis subsp bovis AF2122/97
cggcgccgccguccagcgccgc

SEQ ID NO: 3187230 - RNA, 15 nt, Mycobacterium bovis subsp bovis AF2122/97
cggcgccgccgucgu

SEQ ID NO: 3187231 - RNA, 15 nt, Mycobacterium bovis subsp bovis AF2122/97
cggcgccgccgugcg

SEQ ID NO: 3187232 - RNA, 19 nt, Mycobacterium bovis subsp bovis AF2122/97
cggcgccgccgugcggguu

SEQ ID NO: 3187233 - RNA, 13 nt, Mycobacterium bovis subsp bovis AF2122/97
cggcgccgccguu

SEQ ID NO: 3187234 - RNA, 14 nt, Mycobacterium bovis subsp bovis AF2122/97
cggcgccgccguua

SEQ ID NO: 3187235 - RNA, 22 nt, Mycobacterium bovis subsp bovis AF2122/97
cggcgccgccguuaccgccggc

SEQ ID NO: 3187236 - RNA, 14 nt, Mycobacterium bovis subsp bovis AF2122/97
cggcgccgccguug

SEQ ID NO: 3187237 - RNA, 23 nt, Mycobacterium bovis subsp bovis AF2122/97
cggcgccgccuggacgccgccgg

SEQ ID NO: 3187238 - RNA, 11 nt, Mycobacterium bovis subsp bovis AF2122/97
cggcgccgcgc

SEQ ID NO: 3187239 - RNA, 14 nt, Mycobacterium bovis subsp bovis AF2122/97
cggcgccgcgccgu

SEQ ID NO: 3187240 - RNA, 19 nt, Mycobacterium bovis subsp bovis AF2122/97
cggcgccgcgccgucccga

SEQ ID NO: 3187241 - RNA, 14 nt, Mycobacterium bovis subsp bovis AF2122/97
cggcgccgcgggug

SEQ ID NO: 3187242 - RNA, 18 nt, Mycobacterium bovis subsp bovis AF2122/97
cggcgccgcgggugcggc

SEQ ID NO: 3187243 - RNA, 16 nt, Mycobacterium bovis subsp bovis AF2122/97
cggcgccggagccgcc

SEQ ID NO: 3187244 - RNA, 17 nt, Mycobacterium bovis subsp bovis AF2122/97
cggcgccggagccgccc

SEQ ID NO: 3187245 - RNA, 18 nt, Mycobacterium bovis subsp bovis AF2122/97
cggcgccggagccgccca

SEQ ID NO: 3187246 - RNA, 23 nt, Mycobacterium bovis subsp bovis AF2122/97
cggcgccggaggcggcgcuuucg

SEQ ID NO: 3187247 - RNA, 14 nt, Mycobacterium bovis subsp bovis AF2122/97
cggcgccggaguug

SEQ ID NO: 3187248 - RNA, 16 nt, Mycobacterium bovis subsp bovis AF2122/97
cggcgccggaguugaa

SEQ ID NO: 3187249 - RNA, 23 nt, Mycobacterium bovis subsp bovis AF2122/97
cggcgccggaguugaagaagccc

SEQ ID NO: 3187250 - RNA, 14 nt, Mycobacterium bovis subsp bovis AF2122/97
cggcgccggcaucg

SEQ ID NO: 3187251 - RNA, 21 nt, Mycobacterium bovis subsp bovis AF2122/97
cggcgccggcaucuccaccgu

SEQ ID NO: 3187252 - RNA, 14 nt, Mycobacterium bovis subsp bovis AF2122/97
cggcgccggcgccu

SEQ ID NO: 3187253 - RNA, 15 nt, Mycobacterium bovis subsp bovis AF2122/97
cggcgccggcgccuc

SEQ ID NO: 3187254 - RNA, 13 nt, Mycobacterium bovis subsp bovis AF2122/97
cggcgccggcggc

SEQ ID NO: 3187255 - RNA, 15 nt, Mycobacterium bovis subsp bovis AF2122/97
cggcgccggcggccg

SEQ ID NO: 3187256 - RNA, 16 nt, Mycobacterium bovis subsp bovis AF2122/97
cggcgccggcggccgc

SEQ ID NO: 3187257 - RNA, 12 nt, Mycobacterium bovis subsp bovis AF2122/97
cggcgccggcgu

SEQ ID NO: 3187258 - RNA, 15 nt, Mycobacterium bovis subsp bovis AF2122/97
cggcgccggcgucgg

SEQ ID NO: 3187259 - RNA, 20 nt, Mycobacterium bovis subsp bovis AF2122/97
cggcgccggcgucggcgccc

SEQ ID NO: 3187260 - RNA, 23 nt, Mycobacterium bovis subsp bovis AF2122/97
cggcgccggcgucggcgcccagc

SEQ ID NO: 3187261 - RNA, 14 nt, Mycobacterium bovis subsp bovis AF2122/97
cggcgccggggggc

SEQ ID NO: 3187262 - RNA, 15 nt, Mycobacterium bovis subsp bovis AF2122/97
cggcgccggugccgc

SEQ ID NO: 3187263 - RNA, 18 nt, Mycobacterium bovis subsp bovis AF2122/97
cggcgccggugccgccuc

SEQ ID NO: 3187264 - RNA, 13 nt, Mycobacterium bovis subsp bovis AF2122/97
cggcgccgguggg

SEQ ID NO: 3187265 - RNA, 16 nt, Mycobacterium bovis subsp bovis AF2122/97
cggcgccggugggcgg

SEQ ID NO: 3187266 - RNA, 17 nt, Mycobacterium bovis subsp bovis AF2122/97
cggcgccggugguaacg

SEQ ID NO: 3187267 - RNA, 23 nt, Mycobacterium bovis subsp bovis AF2122/97
cggcgccggugguaacggcggcc

SEQ ID NO: 3187268 - RNA, 21 nt, Mycobacterium bovis subsp bovis AF2122/97
cggcgccggugguaccggcgg

SEQ ID NO: 3187269 - RNA, 19 nt, Mycobacterium bovis subsp bovis AF2122/97
cggcgccguagccgaucaa

SEQ ID NO: 3187270 - RNA, 23 nt, Mycobacterium bovis subsp bovis AF2122/97
cggcgccguagugcgcaucgccg

SEQ ID NO: 3187271 - RNA, 15 nt, Mycobacterium bovis subsp bovis AF2122/97
cggcgccgucgauga

SEQ ID NO: 3187272 - RNA, 17 nt, Mycobacterium bovis subsp bovis AF2122/97
cggcgccgucgcccagc

SEQ ID NO: 3187273 - RNA, 14 nt, Mycobacterium bovis subsp bovis AF2122/97
cggcgccgucguca

SEQ ID NO: 3187274 - RNA, 21 nt, Mycobacterium bovis subsp bovis AF2122/97
cggcgccgucguugugccggu

SEQ ID NO: 3187275 - RNA, 21 nt, Mycobacterium bovis subsp bovis AF2122/97
cggcgccgugaucagcucgcg

SEQ ID NO: 3187276 - RNA, 15 nt, Mycobacterium bovis subsp bovis AF2122/97
cggcgccgugucacc

SEQ ID NO: 3187277 - RNA, 17 nt, Mycobacterium bovis subsp bovis AF2122/97
cggcgccgugucaccgg

SEQ ID NO: 3187278 - RNA, 13 nt, Mycobacterium bovis subsp bovis AF2122/97
cggcgccguugcc

SEQ ID NO: 3187279 - RNA, 23 nt, Mycobacterium bovis subsp bovis AF2122/97
cggcgccguugccaccguugccg

SEQ ID NO: 3187280 - RNA, 19 nt, Mycobacterium bovis subsp bovis AF2122/97
cggcgccuacaccggcgcu

SEQ ID NO: 3187281 - RNA, 21 nt, Mycobacterium bovis subsp bovis AF2122/97
cggcgccuagcacgaagcugg

SEQ ID NO: 3187282 - RNA, 20 nt, Mycobacterium bovis subsp bovis AF2122/97
cggcgccucaucggacagcg

SEQ ID NO: 3187283 - RNA, 23 nt, Mycobacterium bovis subsp bovis AF2122/97
cggcgccucaucggacagcgccu

SEQ ID NO: 3187284 - RNA, 13 nt, Mycobacterium bovis subsp bovis AF2122/97
cggcgccuccgcu

SEQ ID NO: 3187285 - RNA, 17 nt, Mycobacterium bovis subsp bovis AF2122/97
cggcgccuccgcucggu

SEQ ID NO: 3187286 - RNA, 15 nt, Mycobacterium bovis subsp bovis AF2122/97
cggcgccuccggcac

SEQ ID NO: 3187287 - RNA, 17 nt, Mycobacterium bovis subsp bovis AF2122/97
cggcgccucggaccaga

SEQ ID NO: 3187288 - RNA, 21 nt, Mycobacterium bovis subsp bovis AF2122/97
cggcgccucggaccagaccca

SEQ ID NO: 3187289 - RNA, 18 nt, Mycobacterium bovis subsp bovis AF2122/97
cggcgccucgugcguggg

SEQ ID NO: 3187290 - RNA, 13 nt, Mycobacterium bovis subsp bovis AF2122/97
cggcgccucguug

SEQ ID NO: 3187291 - RNA, 15 nt, Mycobacterium bovis subsp bovis AF2122/97
cggcgccucguugcc

SEQ ID NO: 3187292 - RNA, 16 nt, Mycobacterium bovis subsp bovis AF2122/97
cggcgccucguugccg

SEQ ID NO: 3187293 - RNA, 21 nt, Mycobacterium bovis subsp bovis AF2122/97
cggcgccucguugccguagcu

SEQ ID NO: 3187294 - RNA, 19 nt, Mycobacterium bovis subsp bovis AF2122/97
cggcgccugacucaucacc

SEQ ID NO: 3187295 - RNA, 22 nt, Mycobacterium bovis subsp bovis AF2122/97
cggcgccugacucaucaccgau

SEQ ID NO: 3187296 - RNA, 16 nt, Mycobacterium bovis subsp bovis AF2122/97
cggcgccuggcggcgc

SEQ ID NO: 3187297 - RNA, 19 nt, Mycobacterium bovis subsp bovis AF2122/97
cggcgccuguucgggagcu

SEQ ID NO: 3187298 - RNA, 21 nt, Mycobacterium bovis subsp bovis AF2122/97
cggcgccuuggucgccgccuu

SEQ ID NO: 3187299 - RNA, 22 nt, Mycobacterium bovis subsp bovis AF2122/97
cggcgccuuguggaaccauccc

SEQ ID NO: 3187300 - RNA, 15 nt, Mycobacterium bovis subsp bovis AF2122/97
cggcgcgaaucacgu

SEQ ID NO: 3187301 - RNA, 23 nt, Mycobacterium bovis subsp bovis AF2122/97
cggcgcgacagacagcaccgccg

SEQ ID NO: 3187302 - RNA, 17 nt, Mycobacterium bovis subsp bovis AF2122/97
cggcgcgacagccgugg

SEQ ID NO: 3187303 - RNA, 13 nt, Mycobacterium bovis subsp bovis AF2122/97
cggcgcgacaggu

SEQ ID NO: 3187304 - RNA, 22 nt, Mycobacterium bovis subsp bovis AF2122/97
cggcgcgaccagaaucgggccg

SEQ ID NO: 3187305 - RNA, 14 nt, Mycobacterium bovis subsp bovis AF2122/97
cggcgcgaccgcgg

SEQ ID NO: 3187306 - RNA, 16 nt, Mycobacterium bovis subsp bovis AF2122/97
cggcgcgaccgcggcg

SEQ ID NO: 3187307 - RNA, 17 nt, Mycobacterium bovis subsp bovis AF2122/97
cggcgcgaccgcggcga

SEQ ID NO: 3187308 - RNA, 15 nt, Mycobacterium bovis subsp bovis AF2122/97
cggcgcgagcagaca

SEQ ID NO: 3187309 - RNA, 16 nt, Mycobacterium bovis subsp bovis AF2122/97
cggcgcgagcagacac

SEQ ID NO: 3187310 - RNA, 16 nt, Mycobacterium bovis subsp bovis AF2122/97
cggcgcgagcagacgc

SEQ ID NO: 3187311 - RNA, 14 nt, Mycobacterium bovis subsp bovis AF2122/97
cggcgcgagccgca

SEQ ID NO: 3187312 - RNA, 16 nt, Mycobacterium bovis subsp bovis AF2122/97
cggcgcgagccgcacg

SEQ ID NO: 3187313 - RNA, 24 nt, Mycobacterium bovis subsp bovis AF2122/97
cggcgcgagccgcacgaugccggg

SEQ ID NO: 3187314 - RNA, 12 nt, Mycobacterium bovis subsp bovis AF2122/97
cggcgcgagccu

SEQ ID NO: 3187315 - RNA, 16 nt, Mycobacterium bovis subsp bovis AF2122/97
cggcgcgagccugcuc

SEQ ID NO: 3187316 - RNA, 19 nt, Mycobacterium bovis subsp bovis AF2122/97
cggcgcgagccugcucuuc

SEQ ID NO: 3187317 - RNA, 19 nt, Mycobacterium bovis subsp bovis AF2122/97
cggcgcgaggaggcuuaca

SEQ ID NO: 3187318 - RNA, 18 nt, Mycobacterium bovis subsp bovis AF2122/97
cggcgcgauagauacccg

SEQ ID NO: 3187319 - RNA, 22 nt, Mycobacterium bovis subsp bovis AF2122/97
cggcgcgaucagguaccggcgg

SEQ ID NO: 3187320 - RNA, 19 nt, Mycobacterium bovis subsp bovis AF2122/97
cggcgcgaucgacgcucgg

SEQ ID NO: 3187321 - RNA, 11 nt, Mycobacterium bovis subsp bovis AF2122/97
cggcgcgcacc

SEQ ID NO: 3187322 - RNA, 16 nt, Mycobacterium bovis subsp bovis AF2122/97
cggcgcgcaccccggc

SEQ ID NO: 3187323 - RNA, 21 nt, Mycobacterium bovis subsp bovis AF2122/97
cggcgcgcagcgauucgccua

SEQ ID NO: 3187324 - RNA, 13 nt, Mycobacterium bovis subsp bovis AF2122/97
cggcgcgcagcuu

SEQ ID NO: 3187325 - RNA, 23 nt, Mycobacterium bovis subsp bovis AF2122/97
cggcgcgcaggaccugcgucauc

SEQ ID NO: 3187326 - RNA, 20 nt, Mycobacterium bovis subsp bovis AF2122/97
cggcgcgccaaacaccccgg

SEQ ID NO: 3187327 - RNA, 20 nt, Mycobacterium bovis subsp bovis AF2122/97
cggcgcgccccaccgcgccg

SEQ ID NO: 3187328 - RNA, 13 nt, Mycobacterium bovis subsp bovis AF2122/97
cggcgcgccccgc

SEQ ID NO: 3187329 - RNA, 15 nt, Mycobacterium bovis subsp bovis AF2122/97
cggcgcgccccgccg

SEQ ID NO: 3187330 - RNA, 17 nt, Mycobacterium bovis subsp bovis AF2122/97
cggcgcgccccgccgca

SEQ ID NO: 3187331 - RNA, 12 nt, Mycobacterium bovis subsp bovis AF2122/97
cggcgcgccgac

SEQ ID NO: 3187332 - RNA, 18 nt, Mycobacterium bovis subsp bovis AF2122/97
cggcgcgccgaccaccgc

SEQ ID NO: 3187333 - RNA, 21 nt, Mycobacterium bovis subsp bovis AF2122/97
cggcgcgccgaucggcaccgu

SEQ ID NO: 3187334 - RNA, 14 nt, Mycobacterium bovis subsp bovis AF2122/97
cggcgcgccgggcg

SEQ ID NO: 3187335 - RNA, 15 nt, Mycobacterium bovis subsp bovis AF2122/97
cggcgcgccgggcgg

SEQ ID NO: 3187336 - RNA, 18 nt, Mycobacterium bovis subsp bovis AF2122/97
cggcgcgccggucgccga

SEQ ID NO: 3187337 - RNA, 20 nt, Mycobacterium bovis subsp bovis AF2122/97
cggcgcgccguugccggcca

SEQ ID NO: 3187338 - RNA, 15 nt, Mycobacterium bovis subsp bovis AF2122/97
cggcgcgcgcgccgg

SEQ ID NO: 3187339 - RNA, 15 nt, Mycobacterium bovis subsp bovis AF2122/97
cggcgcgcgcugcgc

SEQ ID NO: 3187340 - RNA, 14 nt, Mycobacterium bovis subsp bovis AF2122/97
cggcgcgcggguug

SEQ ID NO: 3187341 - RNA, 18 nt, Mycobacterium bovis subsp bovis AF2122/97
cggcgcgcggguugucgg

SEQ ID NO: 3187342 - RNA, 21 nt, Mycobacterium bovis subsp bovis AF2122/97
cggcgcgcggguugucggcga

SEQ ID NO: 3187343 - RNA, 14 nt, Mycobacterium bovis subsp bovis AF2122/97
cggcgcgcugcacg

SEQ ID NO: 3187344 - RNA, 13 nt, Mycobacterium bovis subsp bovis AF2122/97
cggcgcggaacgc

SEQ ID NO: 3187345 - RNA, 18 nt, Mycobacterium bovis subsp bovis AF2122/97
cggcgcggaacgcgucgc

SEQ ID NO: 3187346 - RNA, 21 nt, Mycobacterium bovis subsp bovis AF2122/97
cggcgcggaacgcgucgccga

SEQ ID NO: 3187347 - RNA, 13 nt, Mycobacterium bovis subsp bovis AF2122/97
cggcgcggagagc

SEQ ID NO: 3187348 - RNA, 22 nt, Mycobacterium bovis subsp bovis AF2122/97
cggcgcggagugcccagggccg

SEQ ID NO: 3187349 - RNA, 15 nt, Mycobacterium bovis subsp bovis AF2122/97
cggcgcggccagcuc

SEQ ID NO: 3187350 - RNA, 13 nt, Mycobacterium bovis subsp bovis AF2122/97
cggcgcggccgca

SEQ ID NO: 3187351 - RNA, 16 nt, Mycobacterium bovis subsp bovis AF2122/97
cggcgcggccgcaagc

SEQ ID NO: 3187352 - RNA, 14 nt, Mycobacterium bovis subsp bovis AF2122/97
cggcgcggccgcag

SEQ ID NO: 3187353 - RNA, 15 nt, Mycobacterium bovis subsp bovis AF2122/97
cggcgcggccgcagc

SEQ ID NO: 3187354 - RNA, 17 nt, Mycobacterium bovis subsp bovis AF2122/97
cggcgcggccgcagcca

SEQ ID NO: 3187355 - RNA, 12 nt, Mycobacterium bovis subsp bovis AF2122/97
cggcgcggccgg

SEQ ID NO: 3187356 - RNA, 15 nt, Mycobacterium bovis subsp bovis AF2122/97
cggcgcggccggccg

SEQ ID NO: 3187357 - RNA, 16 nt, Mycobacterium bovis subsp bovis AF2122/97
cggcgcggccggccgc

SEQ ID NO: 3187358 - RNA, 15 nt, Mycobacterium bovis subsp bovis AF2122/97
cggcgcggcggaccg

SEQ ID NO: 3187359 - RNA, 12 nt, Mycobacterium bovis subsp bovis AF2122/97
cggcgcggcggc

SEQ ID NO: 3187360 - RNA, 16 nt, Mycobacterium bovis subsp bovis AF2122/97
cggcgcggcggcgucg

SEQ ID NO: 3187361 - RNA, 17 nt, Mycobacterium bovis subsp bovis AF2122/97
cggcgcggcggcgucga

SEQ ID NO: 3187362 - RNA, 23 nt, Mycobacterium bovis subsp bovis AF2122/97
cggcgcgggcacgcccucgucga

SEQ ID NO: 3187363 - RNA, 17 nt, Mycobacterium bovis subsp bovis AF2122/97
cggcgcgggccaccacg

SEQ ID NO: 3187364 - RNA, 23 nt, Mycobacterium bovis subsp bovis AF2122/97
cggcgcgggccaccacgcgccgc

SEQ ID NO: 3187365 - RNA, 13 nt, Mycobacterium bovis subsp bovis AF2122/97
cggcgcgggucgg

SEQ ID NO: 3187366 - RNA, 16 nt, Mycobacterium bovis subsp bovis AF2122/97
cggcgcgggucggcga

SEQ ID NO: 3187367 - RNA, 14 nt, Mycobacterium bovis subsp bovis AF2122/97
cggcgcggucucgg

SEQ ID NO: 3187368 - RNA, 19 nt, Mycobacterium bovis subsp bovis AF2122/97
cggcgcgguggggcgcgcc

SEQ ID NO: 3187369 - RNA, 20 nt, Mycobacterium bovis subsp bovis AF2122/97
cggcgcgguggggcgcgccg

SEQ ID NO: 3187370 - RNA, 22 nt, Mycobacterium bovis subsp bovis AF2122/97
cggcgcgguggggcgcgccggc

SEQ ID NO: 3187371 - RNA, 23 nt, Mycobacterium bovis subsp bovis AF2122/97
cggcgcgguggggcgcgccggcu

SEQ ID NO: 3187372 - RNA, 21 nt, Mycobacterium bovis subsp bovis AF2122/97
cggcgcgguuuccagacgacc

SEQ ID NO: 3187373 - RNA, 22 nt, Mycobacterium bovis subsp bovis AF2122/97
cggcgcgguuucggcgucaccg

SEQ ID NO: 3187374 - RNA, 22 nt, Mycobacterium bovis subsp bovis AF2122/97
cggcgcguaguaaugcucgacg

SEQ ID NO: 3187375 - RNA, 12 nt, Mycobacterium bovis subsp bovis AF2122/97
cggcgcguccgc

SEQ ID NO: 3187376 - RNA, 21 nt, Mycobacterium bovis subsp bovis AF2122/97
cggcgcgucggcaccgauccu

SEQ ID NO: 3187377 - RNA, 14 nt, Mycobacterium bovis subsp bovis AF2122/97
cggcgcgucguugc

SEQ ID NO: 3187378 - RNA, 21 nt, Mycobacterium bovis subsp bovis AF2122/97
cggcgcgugcgguggcgcgca

SEQ ID NO: 3187379 - RNA, 23 nt, Mycobacterium bovis subsp bovis AF2122/97
cggcgcgugcgguggcgcgcagc

SEQ ID NO: 3187380 - RNA, 21 nt, Mycobacterium bovis subsp bovis AF2122/97
cggcgcguggcaccaccaagg

SEQ ID NO: 3187381 - RNA, 14 nt, Mycobacterium bovis subsp bovis AF2122/97
cggcgcuagcgccg

SEQ ID NO: 3187382 - RNA, 18 nt, Mycobacterium bovis subsp bovis AF2122/97
cggcgcuagcgccgcgcu

SEQ ID NO: 3187383 - RNA, 19 nt, Mycobacterium bovis subsp bovis AF2122/97
cggcgcuagcgccgcgcuu

SEQ ID NO: 3187384 - RNA, 20 nt, Mycobacterium bovis subsp bovis AF2122/97
cggcgcucaaugcggucaac

SEQ ID NO: 3187385 - RNA, 21 nt, Mycobacterium bovis subsp bovis AF2122/97
cggcgcucaaugcggucaacg

SEQ ID NO: 3187386 - RNA, 14 nt, Mycobacterium bovis subsp bovis AF2122/97
cggcgcuccaacgc

SEQ ID NO: 3187387 - RNA, 14 nt, Mycobacterium bovis subsp bovis AF2122/97
cggcgcuccgccag

SEQ ID NO: 3187388 - RNA, 16 nt, Mycobacterium bovis subsp bovis AF2122/97
cggcgcucgcggcggc

SEQ ID NO: 3187389 - RNA, 17 nt, Mycobacterium bovis subsp bovis AF2122/97
cggcgcucgcggcggcg

SEQ ID NO: 3187390 - RNA, 14 nt, Mycobacterium bovis subsp bovis AF2122/97
cggcgcucggccau

SEQ ID NO: 3187391 - RNA, 22 nt, Mycobacterium bovis subsp bovis AF2122/97
cggcgcucggccauagcgccgc

SEQ ID NO: 3187392 - RNA, 16 nt, Mycobacterium bovis subsp bovis AF2122/97
cggcgcucggcgagcu

SEQ ID NO: 3187393 - RNA, 14 nt, Mycobacterium bovis subsp bovis AF2122/97
cggcgcucggcgcc

SEQ ID NO: 3187394 - RNA, 17 nt, Mycobacterium bovis subsp bovis AF2122/97
cggcgcugacgaacgcu

SEQ ID NO: 3187395 - RNA, 13 nt, Mycobacterium bovis subsp bovis AF2122/97
cggcgcugacgac

SEQ ID NO: 3187396 - RNA, 15 nt, Mycobacterium bovis subsp bovis AF2122/97
cggcgcugaucgcga

SEQ ID NO: 3187397 - RNA, 17 nt, Mycobacterium bovis subsp bovis AF2122/97
cggcgcugaucgcgcgc

SEQ ID NO: 3187398 - RNA, 19 nt, Mycobacterium bovis subsp bovis AF2122/97
cggcgcugaucgcgcgcac

SEQ ID NO: 3187399 - RNA, 21 nt, Mycobacterium bovis subsp bovis AF2122/97
cggcgcugcagcugcucgucg

SEQ ID NO: 3187400 - RNA, 14 nt, Mycobacterium bovis subsp bovis AF2122/97
cggcgcugcccggg

SEQ ID NO: 3187401 - RNA, 15 nt, Mycobacterium bovis subsp bovis AF2122/97
cggcgcugcccgggc

SEQ ID NO: 3187402 - RNA, 12 nt, Mycobacterium bovis subsp bovis AF2122/97
cggcgcugccgg

SEQ ID NO: 3187403 - RNA, 14 nt, Mycobacterium bovis subsp bovis AF2122/97
cggcgcugcgcacc

SEQ ID NO: 3187404 - RNA, 15 nt, Mycobacterium bovis subsp bovis AF2122/97
cggcgcugcgcaccg

SEQ ID NO: 3187405 - RNA, 19 nt, Mycobacterium bovis subsp bovis AF2122/97
cggcgcugcgcaccgccgc

SEQ ID NO: 3187406 - RNA, 20 nt, Mycobacterium bovis subsp bovis AF2122/97
cggcgcugcgcaccgccgcg

SEQ ID NO: 3187407 - RNA, 13 nt, Mycobacterium bovis subsp bovis AF2122/97
cggcgcugcgcga

SEQ ID NO: 3187408 - RNA, 15 nt, Mycobacterium bovis subsp bovis AF2122/97
cggcgcugcgcgcga

SEQ ID NO: 3187409 - RNA, 19 nt, Mycobacterium bovis subsp bovis AF2122/97
cggcgcugcggcgugccgg

SEQ ID NO: 3187410 - RNA, 14 nt, Mycobacterium bovis subsp bovis AF2122/97
cggcgcugcugcca

SEQ ID NO: 3187411 - RNA, 12 nt, Mycobacterium bovis subsp bovis AF2122/97
cggcgcuggccg

SEQ ID NO: 3187412 - RNA, 16 nt, Mycobacterium bovis subsp bovis AF2122/97
cggcgcuggccgucga

SEQ ID NO: 3187413 - RNA, 14 nt, Mycobacterium bovis subsp bovis AF2122/97
cggcgcuggcgggc

SEQ ID NO: 3187414 - RNA, 19 nt, Mycobacterium bovis subsp bovis AF2122/97
cggcgcuggcgggcgaucg

SEQ ID NO: 3187415 - RNA, 20 nt, Mycobacterium bovis subsp bovis AF2122/97
cggcgcuggcgggcgaucgc

SEQ ID NO: 3187416 - RNA, 23 nt, Mycobacterium bovis subsp bovis AF2122/97
cggcgcuggcgggcgaucgcggc

SEQ ID NO: 3187417 - RNA, 14 nt, Mycobacterium bovis subsp bovis AF2122/97
cggcgcugggacgg

SEQ ID NO: 3187418 - RNA, 19 nt, Mycobacterium bovis subsp bovis AF2122/97
cggcgcuggucgcgguggc

SEQ ID NO: 3187419 - RNA, 13 nt, Mycobacterium bovis subsp bovis AF2122/97
cggcgcuguggcg

SEQ ID NO: 3187420 - RNA, 21 nt, Mycobacterium bovis subsp bovis AF2122/97
cggcggaaauggcgucgccgg

SEQ ID NO: 3187421 - RNA, 19 nt, Mycobacterium bovis subsp bovis AF2122/97
cggcggaacaccgacgaca

SEQ ID NO: 3187422 - RNA, 22 nt, Mycobacterium bovis subsp bovis AF2122/97
cggcggaagaagugcacugcga

SEQ ID NO: 3187423 - RNA, 16 nt, Mycobacterium bovis subsp bovis AF2122/97
cggcggaagaccggau

SEQ ID NO: 3187424 - RNA, 18 nt, Mycobacterium bovis subsp bovis AF2122/97
cggcggacaccucgggcg

SEQ ID NO: 3187425 - RNA, 20 nt, Mycobacterium bovis subsp bovis AF2122/97
cggcggacaccucgggcgcc

SEQ ID NO: 3187426 - RNA, 19 nt, Mycobacterium bovis subsp bovis AF2122/97
cggcggacaggcccggugg

SEQ ID NO: 3187427 - RNA, 20 nt, Mycobacterium bovis subsp bovis AF2122/97
cggcggacaggcccgguggc

SEQ ID NO: 3187428 - RNA, 21 nt, Mycobacterium bovis subsp bovis AF2122/97
cggcggacccgcucgcggcga

SEQ ID NO: 3187429 - RNA, 12 nt, Mycobacterium bovis subsp bovis AF2122/97
cggcggacccgg

SEQ ID NO: 3187430 - RNA, 19 nt, Mycobacterium bovis subsp bovis AF2122/97
cggcggacccggugacccg

SEQ ID NO: 3187431 - RNA, 20 nt, Mycobacterium bovis subsp bovis AF2122/97
cggcggacccggugacccgc

SEQ ID NO: 3187432 - RNA, 23 nt, Mycobacterium bovis subsp bovis AF2122/97
cggcggacccggugacccgcugg

SEQ ID NO: 3187433 - RNA, 12 nt, Mycobacterium bovis subsp bovis AF2122/97
cggcggaccgca

SEQ ID NO: 3187434 - RNA, 18 nt, Mycobacterium bovis subsp bovis AF2122/97
cggcggaccgcagcguga

SEQ ID NO: 3187435 - RNA, 20 nt, Mycobacterium bovis subsp bovis AF2122/97
cggcggacgcccggcgcacc

SEQ ID NO: 3187436 - RNA, 22 nt, Mycobacterium bovis subsp bovis AF2122/97
cggcggacugagagauggucgg

SEQ ID NO: 3187437 - RNA, 24 nt, Mycobacterium bovis subsp bovis AF2122/97
cggcggacugagagauggucgggc

SEQ ID NO: 3187438 - RNA, 17 nt, Mycobacterium bovis subsp bovis AF2122/97
cggcggagcgggccagc

SEQ ID NO: 3187439 - RNA, 20 nt, Mycobacterium bovis subsp bovis AF2122/97
cggcggagcgggccagcacc

SEQ ID NO: 3187440 - RNA, 17 nt, Mycobacterium bovis subsp bovis AF2122/97
cggcggaggcugggcug

SEQ ID NO: 3187441 - RNA, 14 nt, Mycobacterium bovis subsp bovis AF2122/97
cggcggagucgcgc

SEQ ID NO: 3187442 - RNA, 13 nt, Mycobacterium bovis subsp bovis AF2122/97
cggcggagugcau

SEQ ID NO: 3187443 - RNA, 16 nt, Mycobacterium bovis subsp bovis AF2122/97
cggcggauagucgcgg

SEQ ID NO: 3187444 - RNA, 20 nt, Mycobacterium bovis subsp bovis AF2122/97
cggcggaucccgaggcgccc

SEQ ID NO: 3187445 - RNA, 21 nt, Mycobacterium bovis subsp bovis AF2122/97
cggcggaucccgaggcgccca

SEQ ID NO: 3187446 - RNA, 17 nt, Mycobacterium bovis subsp bovis AF2122/97
cggcggaucggcggccg

SEQ ID NO: 3187447 - RNA, 18 nt, Mycobacterium bovis subsp bovis AF2122/97
cggcggaucggcggccgg

SEQ ID NO: 3187448 - RNA, 19 nt, Mycobacterium bovis subsp bovis AF2122/97
cggcggaucggcggccggc

SEQ ID NO: 3187449 - RNA, 20 nt, Mycobacterium bovis subsp bovis AF2122/97
cggcggaucggcggccggca

SEQ ID NO: 3187450 - RNA, 13 nt, Mycobacterium bovis subsp bovis AF2122/97
cggcggaucugau

SEQ ID NO: 3187451 - RNA, 16 nt, Mycobacterium bovis subsp bovis AF2122/97
cggcggauuccggcau

SEQ ID NO: 3187452 - RNA, 17 nt, Mycobacterium bovis subsp bovis AF2122/97
cggcggauucgcgcugg

SEQ ID NO: 3187453 - RNA, 22 nt, Mycobacterium bovis subsp bovis AF2122/97
cggcggauucgguaucagggga

SEQ ID NO: 3187454 - RNA, 20 nt, Mycobacterium bovis subsp bovis AF2122/97
cggcggcaaagaacagccgg

SEQ ID NO: 3187455 - RNA, 22 nt, Mycobacterium bovis subsp bovis AF2122/97
cggcggcaaagaacagccggcc

SEQ ID NO: 3187456 - RNA, 23 nt, Mycobacterium bovis subsp bovis AF2122/97
cggcggcaaagaacagccggcca

SEQ ID NO: 3187457 - RNA, 16 nt, Mycobacterium bovis subsp bovis AF2122/97
cggcggcaaccccgag

SEQ ID NO: 3187458 - RNA, 23 nt, Mycobacterium bovis subsp bovis AF2122/97
cggcggcaaccccgagcggagcc

SEQ ID NO: 3187459 - RNA, 18 nt, Mycobacterium bovis subsp bovis AF2122/97
cggcggcaacccugcccg

SEQ ID NO: 3187460 - RNA, 20 nt, Mycobacterium bovis subsp bovis AF2122/97
cggcggcaacccugcccggc

SEQ ID NO: 3187461 - RNA, 16 nt, Mycobacterium bovis subsp bovis AF2122/97
cggcggcaaccgccgc

SEQ ID NO: 3187462 - RNA, 17 nt, Mycobacterium bovis subsp bovis AF2122/97
cggcggcaaccgccgcc

SEQ ID NO: 3187463 - RNA, 18 nt, Mycobacterium bovis subsp bovis AF2122/97
cggcggcaaccgccgcca

SEQ ID NO: 3187464 - RNA, 19 nt, Mycobacterium bovis subsp bovis AF2122/97
cggcggcaaccgccgccac

SEQ ID NO: 3187465 - RNA, 15 nt, Mycobacterium bovis subsp bovis AF2122/97
cggcggcaacggcgg

SEQ ID NO: 3187466 - RNA, 17 nt, Mycobacterium bovis subsp bovis AF2122/97
cggcggcaacggcggca

SEQ ID NO: 3187467 - RNA, 20 nt, Mycobacterium bovis subsp bovis AF2122/97
cggcggcaacggcggcaucg

SEQ ID NO: 3187468 - RNA, 23 nt, Mycobacterium bovis subsp bovis AF2122/97
cggcggcaacggcggcaucggcg

SEQ ID NO: 3187469 - RNA, 17 nt, Mycobacterium bovis subsp bovis AF2122/97
cggcggcaacgguggca

SEQ ID NO: 3187470 - RNA, 16 nt, Mycobacterium bovis subsp bovis AF2122/97
cggcggcaagggcggc

SEQ ID NO: 3187471 - RNA, 18 nt, Mycobacterium bovis subsp bovis AF2122/97
cggcggcaagggugguga

SEQ ID NO: 3187472 - RNA, 19 nt, Mycobacterium bovis subsp bovis AF2122/97
cggcggcaaggguggugac

SEQ ID NO: 3187473 - RNA, 13 nt, Mycobacterium bovis subsp bovis AF2122/97
cggcggcacccgg

SEQ ID NO: 3187474 - RNA, 15 nt, Mycobacterium bovis subsp bovis AF2122/97
cggcggcacccgggu

SEQ ID NO: 3187475 - RNA, 18 nt, Mycobacterium bovis subsp bovis AF2122/97
cggcggcacccggguggc

SEQ ID NO: 3187476 - RNA, 18 nt, Mycobacterium bovis subsp bovis AF2122/97
cggcggcacgcucgcgca

SEQ ID NO: 3187477 - RNA, 13 nt, Mycobacterium bovis subsp bovis AF2122/97
cggcggcacgggc

SEQ ID NO: 3187478 - RNA, 14 nt, Mycobacterium bovis subsp bovis AF2122/97
cggcggcacgggcg

SEQ ID NO: 3187479 - RNA, 16 nt, Mycobacterium bovis subsp bovis AF2122/97
cggcggcacgggcggc

SEQ ID NO: 3187480 - RNA, 19 nt, Mycobacterium bovis subsp bovis AF2122/97
cggcggcacuacgcagccg

SEQ ID NO: 3187481 - RNA, 20 nt, Mycobacterium bovis subsp bovis AF2122/97
cggcggcacuacgcagccgu

SEQ ID NO: 3187482 - RNA, 16 nt, Mycobacterium bovis subsp bovis AF2122/97
cggcggcacuggugcc

SEQ ID NO: 3187483 - RNA, 18 nt, Mycobacterium bovis subsp bovis AF2122/97
cggcggcacuggugcccg

SEQ ID NO: 3187484 - RNA, 14 nt, Mycobacterium bovis subsp bovis AF2122/97
cggcggcagcaccc

SEQ ID NO: 3187485 - RNA, 13 nt, Mycobacterium bovis subsp bovis AF2122/97
cggcggcagcggc

SEQ ID NO: 3187486 - RNA, 14 nt, Mycobacterium bovis subsp bovis AF2122/97
cggcggcagcggcg

SEQ ID NO: 3187487 - RNA, 15 nt, Mycobacterium bovis subsp bovis AF2122/97
cggcggcagcggcga

SEQ ID NO: 3187488 - RNA, 18 nt, Mycobacterium bovis subsp bovis AF2122/97
cggcggcagcggcgccgc

SEQ ID NO: 3187489 - RNA, 19 nt, Mycobacterium bovis subsp bovis AF2122/97
cggcggcagcggcgccgcc

SEQ ID NO: 3187490 - RNA, 16 nt, Mycobacterium bovis subsp bovis AF2122/97
cggcggcagcggcgua

SEQ ID NO: 3187491 - RNA, 14 nt, Mycobacterium bovis subsp bovis AF2122/97
cggcggcaggccgg

SEQ ID NO: 3187492 - RNA, 16 nt, Mycobacterium bovis subsp bovis AF2122/97
cggcggcaggccggcc

SEQ ID NO: 3187493 - RNA, 17 nt, Mycobacterium bovis subsp bovis AF2122/97
cggcggcaggccggcca

SEQ ID NO: 3187494 - RNA, 19 nt, Mycobacterium bovis subsp bovis AF2122/97
cggcggcaggccggccacc

SEQ ID NO: 3187495 - RNA, 22 nt, Mycobacterium bovis subsp bovis AF2122/97
cggcggcaggccggccaccgag

SEQ ID NO: 3187496 - RNA, 21 nt, Mycobacterium bovis subsp bovis AF2122/97
cggcggcagguagaucagcau

SEQ ID NO: 3187497 - RNA, 15 nt, Mycobacterium bovis subsp bovis AF2122/97
cggcggcagucgcgg

SEQ ID NO: 3187498 - RNA, 23 nt, Mycobacterium bovis subsp bovis AF2122/97
cggcggcauaaacaucgguggcg

SEQ ID NO: 3187499 - RNA, 20 nt, Mycobacterium bovis subsp bovis AF2122/97
cggcggcauagugcgacugc

SEQ ID NO: 3187500 - RNA, 15 nt, Mycobacterium bovis subsp bovis AF2122/97
cggcggcaucgaguu

SEQ ID NO: 3187501 - RNA, 24 nt, Mycobacterium bovis subsp bovis AF2122/97
cggcggcaucgaguucggcccgca

SEQ ID NO: 3187502 - RNA, 17 nt, Mycobacterium bovis subsp bovis AF2122/97
cggcggcaucggcggca

SEQ ID NO: 3187503 - RNA, 18 nt, Mycobacterium bovis subsp bovis AF2122/97
cggcggcaucggcggcaa

SEQ ID NO: 3187504 - RNA, 16 nt, Mycobacterium bovis subsp bovis AF2122/97
cggcggcaucgguggu

SEQ ID NO: 3187505 - RNA, 20 nt, Mycobacterium bovis subsp bovis AF2122/97
cggcggcaucucgcaccgcg

SEQ ID NO: 3187506 - RNA, 21 nt, Mycobacterium bovis subsp bovis AF2122/97
cggcggcaucucgcaccgcgc

SEQ ID NO: 3187507 - RNA, 19 nt, Mycobacterium bovis subsp bovis AF2122/97
cggcggcaugaagcaguug

SEQ ID NO: 3187508 - RNA, 16 nt, Mycobacterium bovis subsp bovis AF2122/97
cggcggcaugggucgu

SEQ ID NO: 3187509 - RNA, 20 nt, Mycobacterium bovis subsp bovis AF2122/97
cggcggcauguucaucgcag

SEQ ID NO: 3187510 - RNA, 20 nt, Mycobacterium bovis subsp bovis AF2122/97
cggcggccaacagcacccgg

SEQ ID NO: 3187511 - RNA, 22 nt, Mycobacterium bovis subsp bovis AF2122/97
cggcggccaacagcacccgggc

SEQ ID NO: 3187512 - RNA, 20 nt, Mycobacterium bovis subsp bovis AF2122/97
cggcggccaaggucgaccca

SEQ ID NO: 3187513 - RNA, 15 nt, Mycobacterium bovis subsp bovis AF2122/97
cggcggccaccaugu

SEQ ID NO: 3187514 - RNA, 17 nt, Mycobacterium bovis subsp bovis AF2122/97
cggcggccaccugcugg

SEQ ID NO: 3187515 - RNA, 14 nt, Mycobacterium bovis subsp bovis AF2122/97
cggcggccacgccg

SEQ ID NO: 3187516 - RNA, 16 nt, Mycobacterium bovis subsp bovis AF2122/97
cggcggccacggccau

SEQ ID NO: 3187517 - RNA, 18 nt, Mycobacterium bovis subsp bovis AF2122/97
cggcggccacguggucgg

SEQ ID NO: 3187518 - RNA, 13 nt, Mycobacterium bovis subsp bovis AF2122/97
cggcggccagcga

SEQ ID NO: 3187519 - RNA, 14 nt, Mycobacterium bovis subsp bovis AF2122/97
cggcggccagcucg

SEQ ID NO: 3187520 - RNA, 18 nt, Mycobacterium bovis subsp bovis AF2122/97
cggcggccagcucggcca

SEQ ID NO: 3187521 - RNA, 19 nt, Mycobacterium bovis subsp bovis AF2122/97
cggcggccaguacgaucuc

SEQ ID NO: 3187522 - RNA, 22 nt, Mycobacterium bovis subsp bovis AF2122/97
cggcggccauucggucagccag

SEQ ID NO: 3187523 - RNA, 16 nt, Mycobacterium bovis subsp bovis AF2122/97
cggcggcccaucgacc

SEQ ID NO: 3187524 - RNA, 13 nt, Mycobacterium bovis subsp bovis AF2122/97
cggcggccccagg

SEQ ID NO: 3187525 - RNA, 16 nt, Mycobacterium bovis subsp bovis AF2122/97
cggcggccccgcgcca

SEQ ID NO: 3187526 - RNA, 17 nt, Mycobacterium bovis subsp bovis AF2122/97
cggcggccccggcauug

SEQ ID NO: 3187527 - RNA, 14 nt, Mycobacterium bovis subsp bovis AF2122/97
cggcggcccgcagc

SEQ ID NO: 3187528 - RNA, 15 nt, Mycobacterium bovis subsp bovis AF2122/97
cggcggcccgcagcc

SEQ ID NO: 3187529 - RNA, 16 nt, Mycobacterium bovis subsp bovis AF2122/97
cggcggcccgcagccc

SEQ ID NO: 3187530 - RNA, 21 nt, Mycobacterium bovis subsp bovis AF2122/97
cggcggcccgcagcccgccgg

SEQ ID NO: 3187531 - RNA, 17 nt, Mycobacterium bovis subsp bovis AF2122/97
cggcggcccguuugccg

SEQ ID NO: 3187532 - RNA, 19 nt, Mycobacterium bovis subsp bovis AF2122/97
cggcggcccguuugccggu

SEQ ID NO: 3187533 - RNA, 20 nt, Mycobacterium bovis subsp bovis AF2122/97
cggcggcccguuugccgguu

SEQ ID NO: 3187534 - RNA, 20 nt, Mycobacterium bovis subsp bovis AF2122/97
cggcggcccuaaacaccgcg

SEQ ID NO: 3187535 - RNA, 15 nt, Mycobacterium bovis subsp bovis AF2122/97
cggcggcccuuucca

SEQ ID NO: 3187536 - RNA, 12 nt, Mycobacterium bovis subsp bovis AF2122/97
cggcggccgcag

SEQ ID NO: 3187537 - RNA, 14 nt, Mycobacterium bovis subsp bovis AF2122/97
cggcggccgcagcg

SEQ ID NO: 3187538 - RNA, 18 nt, Mycobacterium bovis subsp bovis AF2122/97
cggcggccgcagcggcca

SEQ ID NO: 3187539 - RNA, 12 nt, Mycobacterium bovis subsp bovis AF2122/97
cggcggccgccc

SEQ ID NO: 3187540 - RNA, 14 nt, Mycobacterium bovis subsp bovis AF2122/97
cggcggccgcccag

SEQ ID NO: 3187541 - RNA, 17 nt, Mycobacterium bovis subsp bovis AF2122/97
cggcggccgcccagaug

SEQ ID NO: 3187542 - RNA, 13 nt, Mycobacterium bovis subsp bovis AF2122/97
cggcggccgccgc

SEQ ID NO: 3187543 - RNA, 15 nt, Mycobacterium bovis subsp bovis AF2122/97
cggcggccgcgacca

SEQ ID NO: 3187544 - RNA, 17 nt, Mycobacterium bovis subsp bovis AF2122/97
cggcggccgcgaccagc

SEQ ID NO: 3187545 - RNA, 21 nt, Mycobacterium bovis subsp bovis AF2122/97
cggcggccgcgaccagcgccg

SEQ ID NO: 3187546 - RNA, 16 nt, Mycobacterium bovis subsp bovis AF2122/97
cggcggccgcgauggc

SEQ ID NO: 3187547 - RNA, 21 nt, Mycobacterium bovis subsp bovis AF2122/97
cggcggccgcggugcccgucg

SEQ ID NO: 3187548 - RNA, 14 nt, Mycobacterium bovis subsp bovis AF2122/97
cggcggccgcgugc

SEQ ID NO: 3187549 - RNA, 13 nt, Mycobacterium bovis subsp bovis AF2122/97
cggcggccggcac

SEQ ID NO: 3187550 - RNA, 14 nt, Mycobacterium bovis subsp bovis AF2122/97
cggcggccggcacg

SEQ ID NO: 3187551 - RNA, 18 nt, Mycobacterium bovis subsp bovis AF2122/97
cggcggccggcacgggcg

SEQ ID NO: 3187552 - RNA, 16 nt, Mycobacterium bovis subsp bovis AF2122/97
cggcggccggcgccgg

SEQ ID NO: 3187553 - RNA, 20 nt, Mycobacterium bovis subsp bovis AF2122/97
cggcggccggcgccggcgcg

SEQ ID NO: 3187554 - RNA, 19 nt, Mycobacterium bovis subsp bovis AF2122/97
cggcggccguggcuggacc

SEQ ID NO: 3187555 - RNA, 15 nt, Mycobacterium bovis subsp bovis AF2122/97
cggcggccgugucgg

SEQ ID NO: 3187556 - RNA, 16 nt, Mycobacterium bovis subsp bovis AF2122/97
cggcggccgugucggg

SEQ ID NO: 3187557 - RNA, 17 nt, Mycobacterium bovis subsp bovis AF2122/97
cggcggccgugucgggc

SEQ ID NO: 3187558 - RNA, 16 nt, Mycobacterium bovis subsp bovis AF2122/97
cggcggccuccaccac

SEQ ID NO: 3187559 - RNA, 20 nt, Mycobacterium bovis subsp bovis AF2122/97
cggcggccuccaccacgucg

SEQ ID NO: 3187560 - RNA, 21 nt, Mycobacterium bovis subsp bovis AF2122/97
cggcggccuccaccacgucgg

SEQ ID NO: 3187561 - RNA, 19 nt, Mycobacterium bovis subsp bovis AF2122/97
cggcggccuggcacccggg

SEQ ID NO: 3187562 - RNA, 20 nt, Mycobacterium bovis subsp bovis AF2122/97
cggcggccuggcacccgggg

SEQ ID NO: 3187563 - RNA, 14 nt, Mycobacterium bovis subsp bovis AF2122/97
cggcggccugggcc

SEQ ID NO: 3187564 - RNA, 15 nt, Mycobacterium bovis subsp bovis AF2122/97
cggcggccugggcca

SEQ ID NO: 3187565 - RNA, 17 nt, Mycobacterium bovis subsp bovis AF2122/97
cggcggccuucggccgg

SEQ ID NO: 3187566 - RNA, 18 nt, Mycobacterium bovis subsp bovis AF2122/97
cggcggccuucggccggc

SEQ ID NO: 3187567 - RNA, 18 nt, Mycobacterium bovis subsp bovis AF2122/97
cggcggccuucuccccga

SEQ ID NO: 3187568 - RNA, 16 nt, Mycobacterium bovis subsp bovis AF2122/97
cggcggccuugcgggc

SEQ ID NO: 3187569 - RNA, 12 nt, Mycobacterium bovis subsp bovis AF2122/97
cggcggcgacca

SEQ ID NO: 3187570 - RNA, 15 nt, Mycobacterium bovis subsp bovis AF2122/97
cggcggcgaccgcca

SEQ ID NO: 3187571 - RNA, 12 nt, Mycobacterium bovis subsp bovis AF2122/97
cggcggcgacgg

SEQ ID NO: 3187572 - RNA, 16 nt, Mycobacterium bovis subsp bovis AF2122/97
cggcggcgacggcggc

SEQ ID NO: 3187573 - RNA, 19 nt, Mycobacterium bovis subsp bovis AF2122/97
cggcggcgacggugccacc

SEQ ID NO: 3187574 - RNA, 20 nt, Mycobacterium bovis subsp bovis AF2122/97
cggcggcgacggugccaccg

SEQ ID NO: 3187575 - RNA, 21 nt, Mycobacterium bovis subsp bovis AF2122/97
cggcggcgacggugccaccgc

SEQ ID NO: 3187576 - RNA, 23 nt, Mycobacterium bovis subsp bovis AF2122/97
cggcggcgacggugccaccgcga

SEQ ID NO: 3187577 - RNA, 12 nt, Mycobacterium bovis subsp bovis AF2122/97
cggcggcgacgu

SEQ ID NO: 3187578 - RNA, 16 nt, Mycobacterium bovis subsp bovis AF2122/97
cggcggcgacgucugc

SEQ ID NO: 3187579 - RNA, 15 nt, Mycobacterium bovis subsp bovis AF2122/97
cggcggcgacguggc

SEQ ID NO: 3187580 - RNA, 22 nt, Mycobacterium bovis subsp bovis AF2122/97
cggcggcgaggcgagucaccgg

SEQ ID NO: 3187581 - RNA, 21 nt, Mycobacterium bovis subsp bovis AF2122/97
cggcggcgaggcggucgccga

SEQ ID NO: 3187582 - RNA, 14 nt, Mycobacterium bovis subsp bovis AF2122/97
cggcggcgcaguuc

SEQ ID NO: 3187583 - RNA, 14 nt, Mycobacterium bovis subsp bovis AF2122/97
cggcggcgcccggc

SEQ ID NO: 3187584 - RNA, 17 nt, Mycobacterium bovis subsp bovis AF2122/97
cggcggcgccgcccaac

SEQ ID NO: 3187585 - RNA, 13 nt, Mycobacterium bovis subsp bovis AF2122/97
cggcggcgccgga

SEQ ID NO: 3187586 - RNA, 20 nt, Mycobacterium bovis subsp bovis AF2122/97
cggcggcgccggccucgccg

SEQ ID NO: 3187587 - RNA, 15 nt, Mycobacterium bovis subsp bovis AF2122/97
cggcggcgccggcgc

SEQ ID NO: 3187588 - RNA, 15 nt, Mycobacterium bovis subsp bovis AF2122/97
cggcggcgccggugg

SEQ ID NO: 3187589 - RNA, 15 nt, Mycobacterium bovis subsp bovis AF2122/97
cggcggcgcucuucg

SEQ ID NO: 3187590 - RNA, 16 nt, Mycobacterium bovis subsp bovis AF2122/97
cggcggcgcuggcggg

SEQ ID NO: 3187591 - RNA, 18 nt, Mycobacterium bovis subsp bovis AF2122/97
cggcggcgcuggucgcgg

SEQ ID NO: 3187592 - RNA, 14 nt, Mycobacterium bovis subsp bovis AF2122/97
cggcggcggaggcu

SEQ ID NO: 3187593 - RNA, 15 nt, Mycobacterium bovis subsp bovis AF2122/97
cggcggcggcaacgg

SEQ ID NO: 3187594 - RNA, 14 nt, Mycobacterium bovis subsp bovis AF2122/97
cggcggcggcacgc

SEQ ID NO: 3187595 - RNA, 16 nt, Mycobacterium bovis subsp bovis AF2122/97
cggcggcggccaggau

SEQ ID NO: 3187596 - RNA, 13 nt, Mycobacterium bovis subsp bovis AF2122/97
cggcggcggccgc

SEQ ID NO: 3187597 - RNA, 16 nt, Mycobacterium bovis subsp bovis AF2122/97
cggcggcggccgcagc

SEQ ID NO: 3187598 - RNA, 13 nt, Mycobacterium bovis subsp bovis AF2122/97
cggcggcggcgcu

SEQ ID NO: 3187599 - RNA, 15 nt, Mycobacterium bovis subsp bovis AF2122/97
cggcggcggcggccc

SEQ ID NO: 3187600 - RNA, 14 nt, Mycobacterium bovis subsp bovis AF2122/97
cggcggcggcgucg

SEQ ID NO: 3187601 - RNA, 14 nt, Mycobacterium bovis subsp bovis AF2122/97
cggcggcggcuuca

SEQ ID NO: 3187602 - RNA, 16 nt, Mycobacterium bovis subsp bovis AF2122/97
cggcggcggucugaga

SEQ ID NO: 3187603 - RNA, 14 nt, Mycobacterium bovis subsp bovis AF2122/97
cggcggcggugcgc

SEQ ID NO: 3187604 - RNA, 19 nt, Mycobacterium bovis subsp bovis AF2122/97
cggcggcggugcgccccgc

SEQ ID NO: 3187605 - RNA, 22 nt, Mycobacterium bovis subsp bovis AF2122/97
cggcggcggugcgccccgcguu

SEQ ID NO: 3187606 - RNA, 13 nt, Mycobacterium bovis subsp bovis AF2122/97
cggcggcgguggu

SEQ ID NO: 3187607 - RNA, 13 nt, Mycobacterium bovis subsp bovis AF2122/97
cggcggcguccac

SEQ ID NO: 3187608 - RNA, 17 nt, Mycobacterium bovis subsp bovis AF2122/97
cggcggcguccaccugc

SEQ ID NO: 3187609 - RNA, 19 nt, Mycobacterium bovis subsp bovis AF2122/97
cggcggcguccaucgcgcg

SEQ ID NO: 3187610 - RNA, 21 nt, Mycobacterium bovis subsp bovis AF2122/97
cggcggcguccaucgcgcgcc

SEQ ID NO: 3187611 - RNA, 16 nt, Mycobacterium bovis subsp bovis AF2122/97
cggcggcgucgacggc

SEQ ID NO: 3187612 - RNA, 15 nt, Mycobacterium bovis subsp bovis AF2122/97
cggcggcgucgaggg

SEQ ID NO: 3187613 - RNA, 14 nt, Mycobacterium bovis subsp bovis AF2122/97
cggcggcgucgcgg

SEQ ID NO: 3187614 - RNA, 15 nt, Mycobacterium bovis subsp bovis AF2122/97
cggcggcgucgcggu

SEQ ID NO: 3187615 - RNA, 14 nt, Mycobacterium bovis subsp bovis AF2122/97
cggcggcgucuucg

SEQ ID NO: 3187616 - RNA, 16 nt, Mycobacterium bovis subsp bovis AF2122/97
cggcggcgucuucguc

SEQ ID NO: 3187617 - RNA, 19 nt, Mycobacterium bovis subsp bovis AF2122/97
cggcggcgugcuccugccc

SEQ ID NO: 3187618 - RNA, 20 nt, Mycobacterium bovis subsp bovis AF2122/97
cggcggcuacuagcgguguc

SEQ ID NO: 3187619 - RNA, 22 nt, Mycobacterium bovis subsp bovis AF2122/97
cggcggcucgggugcgcccggc

SEQ ID NO: 3187620 - RNA, 17 nt, Mycobacterium bovis subsp bovis AF2122/97
cggcggcugaaccgcug

SEQ ID NO: 3187621 - RNA, 18 nt, Mycobacterium bovis subsp bovis AF2122/97
cggcggcugaaccgcugg

SEQ ID NO: 3187622 - RNA, 12 nt, Mycobacterium bovis subsp bovis AF2122/97
cggcggcugcca

SEQ ID NO: 3187623 - RNA, 12 nt, Mycobacterium bovis subsp bovis AF2122/97
cggcggcugccg

SEQ ID NO: 3187624 - RNA, 14 nt, Mycobacterium bovis subsp bovis AF2122/97
cggcggcugccggu

SEQ ID NO: 3187625 - RNA, 17 nt, Mycobacterium bovis subsp bovis AF2122/97
cggcggcugucggccgg

SEQ ID NO: 3187626 - RNA, 18 nt, Mycobacterium bovis subsp bovis AF2122/97
cggcggcugucggccggg

SEQ ID NO: 3187627 - RNA, 16 nt, Mycobacterium bovis subsp bovis AF2122/97
cggcggcuguggucgc

SEQ ID NO: 3187628 - RNA, 18 nt, Mycobacterium bovis subsp bovis AF2122/97
cggcggcuguugcggcgg

SEQ ID NO: 3187629 - RNA, 16 nt, Mycobacterium bovis subsp bovis AF2122/97
cggcggcuucgauugc

SEQ ID NO: 3187630 - RNA, 18 nt, Mycobacterium bovis subsp bovis AF2122/97
cggcggcuucguggcggc

SEQ ID NO: 3187631 - RNA, 22 nt, Mycobacterium bovis subsp bovis AF2122/97
cggcggcuucguggcggcgcgc

SEQ ID NO: 3187632 - RNA, 23 nt, Mycobacterium bovis subsp bovis AF2122/97
cggcggcuucguggcggcgcgcg

SEQ ID NO: 3187633 - RNA, 14 nt, Mycobacterium bovis subsp bovis AF2122/97
cggcggcuuggccg

SEQ ID NO: 3187634 - RNA, 15 nt, Mycobacterium bovis subsp bovis AF2122/97
cggcggcuuggccgc

SEQ ID NO: 3187635 - RNA, 21 nt, Mycobacterium bovis subsp bovis AF2122/97
cggcggcuuggccgccccggc

SEQ ID NO: 3187636 - RNA, 22 nt, Mycobacterium bovis subsp bovis AF2122/97
cggcggcuuggccgccccggcc

SEQ ID NO: 3187637 - RNA, 23 nt, Mycobacterium bovis subsp bovis AF2122/97
cggcggcuuggccgccccggccg

SEQ ID NO: 3187638 - RNA, 16 nt, Mycobacterium bovis subsp bovis AF2122/97
cggcggcuuuggccgc

SEQ ID NO: 3187639 - RNA, 18 nt, Mycobacterium bovis subsp bovis AF2122/97
cggcggcuuuggccgccg

SEQ ID NO: 3187640 - RNA, 17 nt, Mycobacterium bovis subsp bovis AF2122/97
cggcgggaugcgcgccc

SEQ ID NO: 3187641 - RNA, 17 nt, Mycobacterium bovis subsp bovis AF2122/97
cggcgggcacaccgcac

SEQ ID NO: 3187642 - RNA, 22 nt, Mycobacterium bovis subsp bovis AF2122/97
cggcgggcacgcacaaguucuu

SEQ ID NO: 3187643 - RNA, 12 nt, Mycobacterium bovis subsp bovis AF2122/97
cggcgggccacc

SEQ ID NO: 3187644 - RNA, 14 nt, Mycobacterium bovis subsp bovis AF2122/97
cggcgggcccgccg

SEQ ID NO: 3187645 - RNA, 15 nt, Mycobacterium bovis subsp bovis AF2122/97
cggcgggcccgccgg

SEQ ID NO: 3187646 - RNA, 19 nt, Mycobacterium bovis subsp bovis AF2122/97
cggcgggcccgccggcccc

SEQ ID NO: 3187647 - RNA, 14 nt, Mycobacterium bovis subsp bovis AF2122/97
cggcgggccgcgcg

SEQ ID NO: 3187648 - RNA, 13 nt, Mycobacterium bovis subsp bovis AF2122/97
cggcgggccugcc

SEQ ID NO: 3187649 - RNA, 15 nt, Mycobacterium bovis subsp bovis AF2122/97
cggcgggccugcccg

SEQ ID NO: 3187650 - RNA, 14 nt, Mycobacterium bovis subsp bovis AF2122/97
cggcgggcgagcca

SEQ ID NO: 3187651 - RNA, 12 nt, Mycobacterium bovis subsp bovis AF2122/97
cggcgggcgagu

SEQ ID NO: 3187652 - RNA, 24 nt, Mycobacterium bovis subsp bovis AF2122/97
cggcgggcgaucuuggcgacaugc

SEQ ID NO: 3187653 - RNA, 15 nt, Mycobacterium bovis subsp bovis AF2122/97
cggcgggcgcgggcg

SEQ ID NO: 3187654 - RNA, 13 nt, Mycobacterium bovis subsp bovis AF2122/97
cggcgggcggccg

SEQ ID NO: 3187655 - RNA, 14 nt, Mycobacterium bovis subsp bovis AF2122/97
cggcgggcggccgc

SEQ ID NO: 3187656 - RNA, 19 nt, Mycobacterium bovis subsp bovis AF2122/97
cggcgggcggugggcagca

SEQ ID NO: 3187657 - RNA, 18 nt, Mycobacterium bovis subsp bovis AF2122/97
cggcgggcguaccuucga

SEQ ID NO: 3187658 - RNA, 14 nt, Mycobacterium bovis subsp bovis AF2122/97
cggcgggcucgccc

SEQ ID NO: 3187659 - RNA, 21 nt, Mycobacterium bovis subsp bovis AF2122/97
cggcgggcucuacucgcggcc

SEQ ID NO: 3187660 - RNA, 22 nt, Mycobacterium bovis subsp bovis AF2122/97
cggcgggcucuacucgcggccg

SEQ ID NO: 3187661 - RNA, 16 nt, Mycobacterium bovis subsp bovis AF2122/97
cggcggggaccgcggu

SEQ ID NO: 3187662 - RNA, 19 nt, Mycobacterium bovis subsp bovis AF2122/97
cggcggggacucugccacc

SEQ ID NO: 3187663 - RNA, 24 nt, Mycobacterium bovis subsp bovis AF2122/97
cggcggggacucugccacccagca

SEQ ID NO: 3187664 - RNA, 13 nt, Mycobacterium bovis subsp bovis AF2122/97
cggcggggccggc

SEQ ID NO: 3187665 - RNA, 15 nt, Mycobacterium bovis subsp bovis AF2122/97
cggcggggccggcgg

SEQ ID NO: 3187666 - RNA, 16 nt, Mycobacterium bovis subsp bovis AF2122/97
cggcggggccggcggc

SEQ ID NO: 3187667 - RNA, 19 nt, Mycobacterium bovis subsp bovis AF2122/97
cggcggggcggacucacga

SEQ ID NO: 3187668 - RNA, 20 nt, Mycobacterium bovis subsp bovis AF2122/97
cggcggggcggacucacgag

SEQ ID NO: 3187669 - RNA, 14 nt, Mycobacterium bovis subsp bovis AF2122/97
cggcggggcggcgg

SEQ ID NO: 3187670 - RNA, 16 nt, Mycobacterium bovis subsp bovis AF2122/97
cggcgggggaccccgc

SEQ ID NO: 3187671 - RNA, 22 nt, Mycobacterium bovis subsp bovis AF2122/97
cggcgggggaccccgccagccg

SEQ ID NO: 3187672 - RNA, 23 nt, Mycobacterium bovis subsp bovis AF2122/97
cggcgggggaccccgccagccgg

SEQ ID NO: 3187673 - RNA, 17 nt, Mycobacterium bovis subsp bovis AF2122/97
cggcgggggcggcggcu

SEQ ID NO: 3187674 - RNA, 20 nt, Mycobacterium bovis subsp bovis AF2122/97
cggcgggggcgucgccgccg

SEQ ID NO: 3187675 - RNA, 21 nt, Mycobacterium bovis subsp bovis AF2122/97
cggcgggggcgucgccgccgg

SEQ ID NO: 3187676 - RNA, 22 nt, Mycobacterium bovis subsp bovis AF2122/97
cggcgggggcgucgccgccggg

SEQ ID NO: 3187677 - RNA, 21 nt, Mycobacterium bovis subsp bovis AF2122/97
cggcggggggugaucgccacc

SEQ ID NO: 3187678 - RNA, 13 nt, Mycobacterium bovis subsp bovis AF2122/97
cggcggggugagg

SEQ ID NO: 3187679 - RNA, 20 nt, Mycobacterium bovis subsp bovis AF2122/97
cggcggguagaaccagcccg

SEQ ID NO: 3187680 - RNA, 14 nt, Mycobacterium bovis subsp bovis AF2122/97
cggcggguagaucc

SEQ ID NO: 3187681 - RNA, 15 nt, Mycobacterium bovis subsp bovis AF2122/97
cggcgggucaggcca

SEQ ID NO: 3187682 - RNA, 14 nt, Mycobacterium bovis subsp bovis AF2122/97
cggcgggucccgcc

SEQ ID NO: 3187683 - RNA, 16 nt, Mycobacterium bovis subsp bovis AF2122/97
cggcgggucccgccac

SEQ ID NO: 3187684 - RNA, 18 nt, Mycobacterium bovis subsp bovis AF2122/97
cggcgggucccgccacca

SEQ ID NO: 3187685 - RNA, 21 nt, Mycobacterium bovis subsp bovis AF2122/97
cggcgggucugggucaggcga

SEQ ID NO: 3187686 - RNA, 14 nt, Mycobacterium bovis subsp bovis AF2122/97
cggcgggugccgag

SEQ ID NO: 3187687 - RNA, 15 nt, Mycobacterium bovis subsp bovis AF2122/97
cggcgggugccgagc

SEQ ID NO: 3187688 - RNA, 21 nt, Mycobacterium bovis subsp bovis AF2122/97
cggcgggugccgagcuggcga

SEQ ID NO: 3187689 - RNA, 20 nt, Mycobacterium bovis subsp bovis AF2122/97
cggcgguaaagcucaccaca

SEQ ID NO: 3187690 - RNA, 20 nt, Mycobacterium bovis subsp bovis AF2122/97
cggcgguaaaugccugccca

SEQ ID NO: 3187691 - RNA, 18 nt, Mycobacterium bovis subsp bovis AF2122/97
cggcgguaagggcgggcu

SEQ ID NO: 3187692 - RNA, 14 nt, Mycobacterium bovis subsp bovis AF2122/97
cggcgguaccgccg

SEQ ID NO: 3187693 - RNA, 21 nt, Mycobacterium bovis subsp bovis AF2122/97
cggcgguaccgccgcugccgg

SEQ ID NO: 3187694 - RNA, 23 nt, Mycobacterium bovis subsp bovis AF2122/97
cggcgguaccgccgcugccggug

SEQ ID NO: 3187695 - RNA, 21 nt, Mycobacterium bovis subsp bovis AF2122/97
cggcgguaccggaaucggcgg

SEQ ID NO: 3187696 - RNA, 20 nt, Mycobacterium bovis subsp bovis AF2122/97
cggcgguagccgaccagcgc

SEQ ID NO: 3187697 - RNA, 22 nt, Mycobacterium bovis subsp bovis AF2122/97
cggcgguagccgaccagcgcua

SEQ ID NO: 3187698 - RNA, 15 nt, Mycobacterium bovis subsp bovis AF2122/97
cggcgguagucggcc

SEQ ID NO: 3187699 - RNA, 16 nt, Mycobacterium bovis subsp bovis AF2122/97
cggcgguagucggcca

SEQ ID NO: 3187700 - RNA, 18 nt, Mycobacterium bovis subsp bovis AF2122/97
cggcgguagucggccagc

SEQ ID NO: 3187701 - RNA, 16 nt, Mycobacterium bovis subsp bovis AF2122/97
cggcgguaugcucgcu

SEQ ID NO: 3187702 - RNA, 22 nt, Mycobacterium bovis subsp bovis AF2122/97
cggcgguauuuugccggauucu

SEQ ID NO: 3187703 - RNA, 15 nt, Mycobacterium bovis subsp bovis AF2122/97
cggcggucaccaccg

SEQ ID NO: 3187704 - RNA, 16 nt, Mycobacterium bovis subsp bovis AF2122/97
cggcggucaccaccga

SEQ ID NO: 3187705 - RNA, 15 nt, Mycobacterium bovis subsp bovis AF2122/97
cggcggucagcggcu

SEQ ID NO: 3187706 - RNA, 21 nt, Mycobacterium bovis subsp bovis AF2122/97
cggcggucagcggcucggcgg

SEQ ID NO: 3187707 - RNA, 17 nt, Mycobacterium bovis subsp bovis AF2122/97
cggcggucagcggcugg

SEQ ID NO: 3187708 - RNA, 18 nt, Mycobacterium bovis subsp bovis AF2122/97
cggcggucagcggcuggg

SEQ ID NO: 3187709 - RNA, 21 nt, Mycobacterium bovis subsp bovis AF2122/97
cggcggucccugaagccagcg

SEQ ID NO: 3187710 - RNA, 22 nt, Mycobacterium bovis subsp bovis AF2122/97
cggcggucccugaagccagcgc

SEQ ID NO: 3187711 - RNA, 17 nt, Mycobacterium bovis subsp bovis AF2122/97
cggcgguccggaugcgc

SEQ ID NO: 3187712 - RNA, 14 nt, Mycobacterium bovis subsp bovis AF2122/97
cggcggucgagcga

SEQ ID NO: 3187713 - RNA, 15 nt, Mycobacterium bovis subsp bovis AF2122/97
cggcggucgagcucg

SEQ ID NO: 3187714 - RNA, 19 nt, Mycobacterium bovis subsp bovis AF2122/97
cggcggucgagcucguagg

SEQ ID NO: 3187715 - RNA, 16 nt, Mycobacterium bovis subsp bovis AF2122/97
cggcggucgccagucg

SEQ ID NO: 3187716 - RNA, 21 nt, Mycobacterium bovis subsp bovis AF2122/97
cggcggucgccagucgauucg

SEQ ID NO: 3187717 - RNA, 13 nt, Mycobacterium bovis subsp bovis AF2122/97
cggcggucgccgc

SEQ ID NO: 3187718 - RNA, 14 nt, Mycobacterium bovis subsp bovis AF2122/97
cggcggucgccucc

SEQ ID NO: 3187719 - RNA, 22 nt, Mycobacterium bovis subsp bovis AF2122/97
cggcggucgccuccggggugaa

SEQ ID NO: 3187720 - RNA, 14 nt, Mycobacterium bovis subsp bovis AF2122/97
cggcggucgcuauc

SEQ ID NO: 3187721 - RNA, 20 nt, Mycobacterium bovis subsp bovis AF2122/97
cggcggucgcuauccggcgg

SEQ ID NO: 3187722 - RNA, 18 nt, Mycobacterium bovis subsp bovis AF2122/97
cggcggucggcugggcga

SEQ ID NO: 3187723 - RNA, 12 nt, Mycobacterium bovis subsp bovis AF2122/97
cggcggucgggc

SEQ ID NO: 3187724 - RNA, 14 nt, Mycobacterium bovis subsp bovis AF2122/97
cggcggucgggccc

SEQ ID NO: 3187725 - RNA, 15 nt, Mycobacterium bovis subsp bovis AF2122/97
cggcggucgggcccg

SEQ ID NO: 3187726 - RNA, 22 nt, Mycobacterium bovis subsp bovis AF2122/97
cggcggucgggcccggcgagcu

SEQ ID NO: 3187727 - RNA, 14 nt, Mycobacterium bovis subsp bovis AF2122/97
cggcggucguugcc

SEQ ID NO: 3187728 - RNA, 15 nt, Mycobacterium bovis subsp bovis AF2122/97
cggcggucucggcgu

SEQ ID NO: 3187729 - RNA, 17 nt, Mycobacterium bovis subsp bovis AF2122/97
cggcggucucggcgucg

SEQ ID NO: 3187730 - RNA, 18 nt, Mycobacterium bovis subsp bovis AF2122/97
cggcggucucggcgucga

SEQ ID NO: 3187731 - RNA, 15 nt, Mycobacterium bovis subsp bovis AF2122/97
cggcggucugcagug

SEQ ID NO: 3187732 - RNA, 17 nt, Mycobacterium bovis subsp bovis AF2122/97
cggcggucugcagugca

SEQ ID NO: 3187733 - RNA, 12 nt, Mycobacterium bovis subsp bovis AF2122/97
cggcggucuggg

SEQ ID NO: 3187734 - RNA, 23 nt, Mycobacterium bovis subsp bovis AF2122/97
cggcggugaacuucuccaccagc

SEQ ID NO: 3187735 - RNA, 22 nt, Mycobacterium bovis subsp bovis AF2122/97
cggcggugaagugggcguuggc

SEQ ID NO: 3187736 - RNA, 16 nt, Mycobacterium bovis subsp bovis AF2122/97
cggcggugacggcggc

SEQ ID NO: 3187737 - RNA, 18 nt, Mycobacterium bovis subsp bovis AF2122/97
cggcggugacggcggcaa

SEQ ID NO: 3187738 - RNA, 20 nt, Mycobacterium bovis subsp bovis AF2122/97
cggcggugacggcggcaacg

SEQ ID NO: 3187739 - RNA, 14 nt, Mycobacterium bovis subsp bovis AF2122/97
cggcggugacggug

SEQ ID NO: 3187740 - RNA, 15 nt, Mycobacterium bovis subsp bovis AF2122/97
cggcggugacggugc

SEQ ID NO: 3187741 - RNA, 22 nt, Mycobacterium bovis subsp bovis AF2122/97
cggcggugcagaucggcucacc

SEQ ID NO: 3187742 - RNA, 22 nt, Mycobacterium bovis subsp bovis AF2122/97
cggcggugccacgaucggcggg

SEQ ID NO: 3187743 - RNA, 18 nt, Mycobacterium bovis subsp bovis AF2122/97
cggcggugcccagcagcg

SEQ ID NO: 3187744 - RNA, 19 nt, Mycobacterium bovis subsp bovis AF2122/97
cggcggugcccagcagcgc

SEQ ID NO: 3187745 - RNA, 20 nt, Mycobacterium bovis subsp bovis AF2122/97
cggcggugcccagcagcgcg

SEQ ID NO: 3187746 - RNA, 15 nt, Mycobacterium bovis subsp bovis AF2122/97
cggcggugccgcggc

SEQ ID NO: 3187747 - RNA, 17 nt, Mycobacterium bovis subsp bovis AF2122/97
cggcggugccgcggcua

SEQ ID NO: 3187748 - RNA, 21 nt, Mycobacterium bovis subsp bovis AF2122/97
cggcggugccgcggcuaggcc

SEQ ID NO: 3187749 - RNA, 18 nt, Mycobacterium bovis subsp bovis AF2122/97
cggcggugccggugguga

SEQ ID NO: 3187750 - RNA, 21 nt, Mycobacterium bovis subsp bovis AF2122/97
cggcggugccgucagcggcgg

SEQ ID NO: 3187751 - RNA, 14 nt, Mycobacterium bovis subsp bovis AF2122/97
cggcggugccgucg

SEQ ID NO: 3187752 - RNA, 15 nt, Mycobacterium bovis subsp bovis AF2122/97
cggcggugccgucgc

SEQ ID NO: 3187753 - RNA, 18 nt, Mycobacterium bovis subsp bovis AF2122/97
cggcggugcgccccgcgu

SEQ ID NO: 3187754 - RNA, 16 nt, Mycobacterium bovis subsp bovis AF2122/97
cggcggugcggguggu

SEQ ID NO: 3187755 - RNA, 21 nt, Mycobacterium bovis subsp bovis AF2122/97
cggcgguggccagcgucgcga

SEQ ID NO: 3187756 - RNA, 19 nt, Mycobacterium bovis subsp bovis AF2122/97
cggcgguggccguuuaggc

SEQ ID NO: 3187757 - RNA, 12 nt, Mycobacterium bovis subsp bovis AF2122/97
cggcgguggcga

SEQ ID NO: 3187758 - RNA, 12 nt, Mycobacterium bovis subsp bovis AF2122/97
cggcgguggggc

SEQ ID NO: 3187759 - RNA, 15 nt, Mycobacterium bovis subsp bovis AF2122/97
cggcgguggggccgg

SEQ ID NO: 3187760 - RNA, 14 nt, Mycobacterium bovis subsp bovis AF2122/97
cggcggugggucgu

SEQ ID NO: 3187761 - RNA, 14 nt, Mycobacterium bovis subsp bovis AF2122/97
cggcggugguaccg

SEQ ID NO: 3187762 - RNA, 18 nt, Mycobacterium bovis subsp bovis AF2122/97
cggcggugguaccggcgc

SEQ ID NO: 3187763 - RNA, 19 nt, Mycobacterium bovis subsp bovis AF2122/97
cggcggugguaccggcgcc

SEQ ID NO: 3187764 - RNA, 20 nt, Mycobacterium bovis subsp bovis AF2122/97
cggcggugguaccggcgcca

SEQ ID NO: 3187765 - RNA, 22 nt, Mycobacterium bovis subsp bovis AF2122/97
cggcgguggugucgcucgcgag

SEQ ID NO: 3187766 - RNA, 14 nt, Mycobacterium bovis subsp bovis AF2122/97
cggcggugugcgca

SEQ ID NO: 3187767 - RNA, 16 nt, Mycobacterium bovis subsp bovis AF2122/97
cggcgguuaucgucgg

SEQ ID NO: 3187768 - RNA, 18 nt, Mycobacterium bovis subsp bovis AF2122/97
cggcgguucgaucccguc

SEQ ID NO: 3187769 - RNA, 18 nt, Mycobacterium bovis subsp bovis AF2122/97
cggcgguucugcggccgc

SEQ ID NO: 3187770 - RNA, 21 nt, Mycobacterium bovis subsp bovis AF2122/97
cggcgguugccccgaccgccg

SEQ ID NO: 3187771 - RNA, 23 nt, Mycobacterium bovis subsp bovis AF2122/97
cggcgguuggugcagcgugcagc

SEQ ID NO: 3187772 - RNA, 24 nt, Mycobacterium bovis subsp bovis AF2122/97
cggcgguuggugcagcgugcagcg

SEQ ID NO: 3187773 - RNA, 16 nt, Mycobacterium bovis subsp bovis AF2122/97
cggcgguuucgguggu

SEQ ID NO: 3187774 - RNA, 16 nt, Mycobacterium bovis subsp bovis AF2122/97
cggcguaaccggcagc

SEQ ID NO: 3187775 - RNA, 17 nt, Mycobacterium bovis subsp bovis AF2122/97
cggcguaaccggcagcg

SEQ ID NO: 3187776 - RNA, 18 nt, Mycobacterium bovis subsp bovis AF2122/97
cggcguacaaaccgucgg

SEQ ID NO: 3187777 - RNA, 20 nt, Mycobacterium bovis subsp bovis AF2122/97
cggcguacaaaccgucgggg

SEQ ID NO: 3187778 - RNA, 21 nt, Mycobacterium bovis subsp bovis AF2122/97
cggcguacaaaccgucgggga

SEQ ID NO: 3187779 - RNA, 15 nt, Mycobacterium bovis subsp bovis AF2122/97
cggcguacagcgccu

SEQ ID NO: 3187780 - RNA, 16 nt, Mycobacterium bovis subsp bovis AF2122/97
cggcguacagcgccug

SEQ ID NO: 3187781 - RNA, 24 nt, Mycobacterium bovis subsp bovis AF2122/97
cggcguacccguuaugcgccgccc

SEQ ID NO: 3187782 - RNA, 15 nt, Mycobacterium bovis subsp bovis AF2122/97
cggcguacgccggac

SEQ ID NO: 3187783 - RNA, 17 nt, Mycobacterium bovis subsp bovis AF2122/97
cggcguacucggcaucc

SEQ ID NO: 3187784 - RNA, 22 nt, Mycobacterium bovis subsp bovis AF2122/97
cggcguacucggugaucgcggu

SEQ ID NO: 3187785 - RNA, 23 nt, Mycobacterium bovis subsp bovis AF2122/97
cggcguacucgugcaccgucggg

SEQ ID NO: 3187786 - RNA, 15 nt, Mycobacterium bovis subsp bovis AF2122/97
cggcguagacguccg

SEQ ID NO: 3187787 - RNA, 16 nt, Mycobacterium bovis subsp bovis AF2122/97
cggcguagacguccgc

SEQ ID NO: 3187788 - RNA, 21 nt, Mycobacterium bovis subsp bovis AF2122/97
cggcguagaucaucagcgacu

SEQ ID NO: 3187789 - RNA, 18 nt, Mycobacterium bovis subsp bovis AF2122/97
cggcguagaugcgcccgg

SEQ ID NO: 3187790 - RNA, 20 nt, Mycobacterium bovis subsp bovis AF2122/97
cggcguagaugcgcccggcg

SEQ ID NO: 3187791 - RNA, 22 nt, Mycobacterium bovis subsp bovis AF2122/97
cggcguagcagaaggccgcggu

SEQ ID NO: 3187792 - RNA, 15 nt, Mycobacterium bovis subsp bovis AF2122/97
cggcguaggcgaugg

SEQ ID NO: 3187793 - RNA, 21 nt, Mycobacterium bovis subsp bovis AF2122/97
cggcguaggcgauggcggcgc

SEQ ID NO: 3187794 - RNA, 19 nt, Mycobacterium bovis subsp bovis AF2122/97
cggcguauugcaccgccag

SEQ ID NO: 3187795 - RNA, 20 nt, Mycobacterium bovis subsp bovis AF2122/97
cggcguauugcaccgccagg

SEQ ID NO: 3187796 - RNA, 16 nt, Mycobacterium bovis subsp bovis AF2122/97
cggcguauugcggccu

SEQ ID NO: 3187797 - RNA, 18 nt, Mycobacterium bovis subsp bovis AF2122/97
cggcguauugcggccugu

SEQ ID NO: 3187798 - RNA, 22 nt, Mycobacterium bovis subsp bovis AF2122/97
cggcgucaaaggccuugacgua

SEQ ID NO: 3187799 - RNA, 17 nt, Mycobacterium bovis subsp bovis AF2122/97
cggcgucacccgcaacg

SEQ ID NO: 3187800 - RNA, 21 nt, Mycobacterium bovis subsp bovis AF2122/97
cggcgucacccgcaacgacug

SEQ ID NO: 3187801 - RNA, 17 nt, Mycobacterium bovis subsp bovis AF2122/97
cggcgucaccguguugc

SEQ ID NO: 3187802 - RNA, 12 nt, Mycobacterium bovis subsp bovis AF2122/97
cggcgucacgag

SEQ ID NO: 3187803 - RNA, 13 nt, Mycobacterium bovis subsp bovis AF2122/97
cggcgucacggcg

SEQ ID NO: 3187804 - RNA, 19 nt, Mycobacterium bovis subsp bovis AF2122/97
cggcgucacggcgugacca

SEQ ID NO: 3187805 - RNA, 20 nt, Mycobacterium bovis subsp bovis AF2122/97
cggcgucacggcgugaccac

SEQ ID NO: 3187806 - RNA, 21 nt, Mycobacterium bovis subsp bovis AF2122/97
cggcgucagccccgacugcgc

SEQ ID NO: 3187807 - RNA, 18 nt, Mycobacterium bovis subsp bovis AF2122/97
cggcgucaggcacaacgc

SEQ ID NO: 3187808 - RNA, 21 nt, Mycobacterium bovis subsp bovis AF2122/97
cggcgucaggcacaacgcgac

SEQ ID NO: 3187809 - RNA, 23 nt, Mycobacterium bovis subsp bovis AF2122/97
cggcgucaggcacaacgcgacgc

SEQ ID NO: 3187810 - RNA, 15 nt, Mycobacterium bovis subsp bovis AF2122/97
cggcgucauccaccg

SEQ ID NO: 3187811 - RNA, 16 nt, Mycobacterium bovis subsp bovis AF2122/97
cggcgucauccaccgc

SEQ ID NO: 3187812 - RNA, 13 nt, Mycobacterium bovis subsp bovis AF2122/97
cggcguccaagaa

SEQ ID NO: 3187813 - RNA, 15 nt, Mycobacterium bovis subsp bovis AF2122/97
cggcguccaccugcu

SEQ ID NO: 3187814 - RNA, 15 nt, Mycobacterium bovis subsp bovis AF2122/97
cggcguccagcagcg

SEQ ID NO: 3187815 - RNA, 15 nt, Mycobacterium bovis subsp bovis AF2122/97
cggcguccagggcgc

SEQ ID NO: 3187816 - RNA, 13 nt, Mycobacterium bovis subsp bovis AF2122/97
cggcguccaucac

SEQ ID NO: 3187817 - RNA, 14 nt, Mycobacterium bovis subsp bovis AF2122/97
cggcguccaucacc

SEQ ID NO: 3187818 - RNA, 21 nt, Mycobacterium bovis subsp bovis AF2122/97
cggcguccaucaccagcagug

SEQ ID NO: 3187819 - RNA, 13 nt, Mycobacterium bovis subsp bovis AF2122/97
cggcguccaucgc

SEQ ID NO: 3187820 - RNA, 18 nt, Mycobacterium bovis subsp bovis AF2122/97
cggcguccaucgcgcgcc

SEQ ID NO: 3187821 - RNA, 15 nt, Mycobacterium bovis subsp bovis AF2122/97
cggcguccgcccagc

SEQ ID NO: 3187822 - RNA, 22 nt, Mycobacterium bovis subsp bovis AF2122/97
cggcguccgcccagcacccuca

SEQ ID NO: 3187823 - RNA, 16 nt, Mycobacterium bovis subsp bovis AF2122/97
cggcguccuugcgcag

SEQ ID NO: 3187824 - RNA, 17 nt, Mycobacterium bovis subsp bovis AF2122/97
cggcguccuugcgcagc

SEQ ID NO: 3187825 - RNA, 19 nt, Mycobacterium bovis subsp bovis AF2122/97
cggcguccuugcgcagcac

SEQ ID NO: 3187826 - RNA, 13 nt, Mycobacterium bovis subsp bovis AF2122/97
cggcgucgaccag

SEQ ID NO: 3187827 - RNA, 15 nt, Mycobacterium bovis subsp bovis AF2122/97
cggcgucgaccaguu

SEQ ID NO: 3187828 - RNA, 15 nt, Mycobacterium bovis subsp bovis AF2122/97
cggcgucgaccucgc

SEQ ID NO: 3187829 - RNA, 17 nt, Mycobacterium bovis subsp bovis AF2122/97
cggcgucgaccucgcgg

SEQ ID NO: 3187830 - RNA, 13 nt, Mycobacterium bovis subsp bovis AF2122/97
cggcgucgacgau

SEQ ID NO: 3187831 - RNA, 13 nt, Mycobacterium bovis subsp bovis AF2122/97
cggcgucgacggc

SEQ ID NO: 3187832 - RNA, 22 nt, Mycobacterium bovis subsp bovis AF2122/97
cggcgucgacguccaguccguc

SEQ ID NO: 3187833 - RNA, 20 nt, Mycobacterium bovis subsp bovis AF2122/97
cggcgucgacugcgugccgc

SEQ ID NO: 3187834 - RNA, 17 nt, Mycobacterium bovis subsp bovis AF2122/97
cggcgucgacuggccgu

SEQ ID NO: 3187835 - RNA, 18 nt, Mycobacterium bovis subsp bovis AF2122/97
cggcgucgacuggccguu

SEQ ID NO: 3187836 - RNA, 20 nt, Mycobacterium bovis subsp bovis AF2122/97
cggcgucgacuggccguuuc

SEQ ID NO: 3187837 - RNA, 22 nt, Mycobacterium bovis subsp bovis AF2122/97
cggcgucgagauagucggccgg

SEQ ID NO: 3187838 - RNA, 23 nt, Mycobacterium bovis subsp bovis AF2122/97
cggcgucgagauagucggccggc

SEQ ID NO: 3187839 - RNA, 14 nt, Mycobacterium bovis subsp bovis AF2122/97
cggcgucgagccgg

SEQ ID NO: 3187840 - RNA, 21 nt, Mycobacterium bovis subsp bovis AF2122/97
cggcgucgagggagcgccgca

SEQ ID NO: 3187841 - RNA, 24 nt, Mycobacterium bovis subsp bovis AF2122/97
cggcgucgagggagcgccgcaggg

SEQ ID NO: 3187842 - RNA, 21 nt, Mycobacterium bovis subsp bovis AF2122/97
cggcgucgaguaguucgucga

SEQ ID NO: 3187843 - RNA, 19 nt, Mycobacterium bovis subsp bovis AF2122/97
cggcgucgaguucgguugc

SEQ ID NO: 3187844 - RNA, 21 nt, Mycobacterium bovis subsp bovis AF2122/97
cggcgucgauaaccuggcggu

SEQ ID NO: 3187845 - RNA, 19 nt, Mycobacterium bovis subsp bovis AF2122/97
cggcgucgaugaccuuggg

SEQ ID NO: 3187846 - RNA, 16 nt, Mycobacterium bovis subsp bovis AF2122/97
cggcgucgaugacgac

SEQ ID NO: 3187847 - RNA, 17 nt, Mycobacterium bovis subsp bovis AF2122/97
cggcgucgaugacgacg

SEQ ID NO: 3187848 - RNA, 21 nt, Mycobacterium bovis subsp bovis AF2122/97
cggcgucgaugucauccgaca

SEQ ID NO: 3187849 - RNA, 19 nt, Mycobacterium bovis subsp bovis AF2122/97
cggcgucgccgccauugcc

SEQ ID NO: 3187850 - RNA, 18 nt, Mycobacterium bovis subsp bovis AF2122/97
cggcgucgccuuggaacu

SEQ ID NO: 3187851 - RNA, 14 nt, Mycobacterium bovis subsp bovis AF2122/97
cggcgucgcgguug

SEQ ID NO: 3187852 - RNA, 16 nt, Mycobacterium bovis subsp bovis AF2122/97
cggcgucgcucguugc

SEQ ID NO: 3187853 - RNA, 13 nt, Mycobacterium bovis subsp bovis AF2122/97
cggcgucgcugcc

SEQ ID NO: 3187854 - RNA, 17 nt, Mycobacterium bovis subsp bovis AF2122/97
cggcgucgcuggccagg

SEQ ID NO: 3187855 - RNA, 18 nt, Mycobacterium bovis subsp bovis AF2122/97
cggcgucgcuggccaggc

SEQ ID NO: 3187856 - RNA, 20 nt, Mycobacterium bovis subsp bovis AF2122/97
cggcgucgcuggccaggccg

SEQ ID NO: 3187857 - RNA, 22 nt, Mycobacterium bovis subsp bovis AF2122/97
cggcgucgcuggccaggccggc

SEQ ID NO: 3187858 - RNA, 12 nt, Mycobacterium bovis subsp bovis AF2122/97
cggcgucggcca

SEQ ID NO: 3187859 - RNA, 14 nt, Mycobacterium bovis subsp bovis AF2122/97
cggcgucggccacc

SEQ ID NO: 3187860 - RNA, 15 nt, Mycobacterium bovis subsp bovis AF2122/97
cggcgucggccaccg

SEQ ID NO: 3187861 - RNA, 16 nt, Mycobacterium bovis subsp bovis AF2122/97
cggcgucggccaccgc

SEQ ID NO: 3187862 - RNA, 18 nt, Mycobacterium bovis subsp bovis AF2122/97
cggcgucggccaccgccu

SEQ ID NO: 3187863 - RNA, 13 nt, Mycobacterium bovis subsp bovis AF2122/97
cggcgucggcgcc

SEQ ID NO: 3187864 - RNA, 14 nt, Mycobacterium bovis subsp bovis AF2122/97
cggcgucggcgccc

SEQ ID NO: 3187865 - RNA, 13 nt, Mycobacterium bovis subsp bovis AF2122/97
cggcgucggcgcg

SEQ ID NO: 3187866 - RNA, 17 nt, Mycobacterium bovis subsp bovis AF2122/97
cggcgucggcgcggccg

SEQ ID NO: 3187867 - RNA, 12 nt, Mycobacterium bovis subsp bovis AF2122/97
cggcgucgggcc

SEQ ID NO: 3187868 - RNA, 16 nt, Mycobacterium bovis subsp bovis AF2122/97
cggcgucggucgucgg

SEQ ID NO: 3187869 - RNA, 18 nt, Mycobacterium bovis subsp bovis AF2122/97
cggcgucggucgucgggu

SEQ ID NO: 3187870 - RNA, 23 nt, Mycobacterium bovis subsp bovis AF2122/97
cggcgucgguggaggcguagucg

SEQ ID NO: 3187871 - RNA, 13 nt, Mycobacterium bovis subsp bovis AF2122/97
cggcgucguccgc

SEQ ID NO: 3187872 - RNA, 17 nt, Mycobacterium bovis subsp bovis AF2122/97
cggcgucguccgcgcca

SEQ ID NO: 3187873 - RNA, 19 nt, Mycobacterium bovis subsp bovis AF2122/97
cggcgucguccgcgccagu

SEQ ID NO: 3187874 - RNA, 17 nt, Mycobacterium bovis subsp bovis AF2122/97
cggcgucgucgacggcu

SEQ ID NO: 3187875 - RNA, 20 nt, Mycobacterium bovis subsp bovis AF2122/97
cggcgucgucgacggcugcg

SEQ ID NO: 3187876 - RNA, 21 nt, Mycobacterium bovis subsp bovis AF2122/97
cggcgucgucgaugaugccgg

SEQ ID NO: 3187877 - RNA, 23 nt, Mycobacterium bovis subsp bovis AF2122/97
cggcgucgucgaugaugccggac

SEQ ID NO: 3187878 - RNA, 15 nt, Mycobacterium bovis subsp bovis AF2122/97
cggcgucgugguggc

SEQ ID NO: 3187879 - RNA, 19 nt, Mycobacterium bovis subsp bovis AF2122/97
cggcgucgugguggccacg

SEQ ID NO: 3187880 - RNA, 21 nt, Mycobacterium bovis subsp bovis AF2122/97
cggcgucguugaggaagcccg

SEQ ID NO: 3187881 - RNA, 23 nt, Mycobacterium bovis subsp bovis AF2122/97
cggcgucguugaggaagcccgau

SEQ ID NO: 3187882 - RNA, 23 nt, Mycobacterium bovis subsp bovis AF2122/97
cggcgucuccgccggcucgucga

SEQ ID NO: 3187883 - RNA, 15 nt, Mycobacterium bovis subsp bovis AF2122/97
cggcgucucgcagca

SEQ ID NO: 3187884 - RNA, 16 nt, Mycobacterium bovis subsp bovis AF2122/97
cggcgucucgcagcaa

SEQ ID NO: 3187885 - RNA, 13 nt, Mycobacterium bovis subsp bovis AF2122/97
cggcgucugcccg

SEQ ID NO: 3187886 - RNA, 14 nt, Mycobacterium bovis subsp bovis AF2122/97
cggcgucugcccgc

SEQ ID NO: 3187887 - RNA, 19 nt, Mycobacterium bovis subsp bovis AF2122/97
cggcgucugcccgcccagc

SEQ ID NO: 3187888 - RNA, 16 nt, Mycobacterium bovis subsp bovis AF2122/97
cggcgucugcgccaga

SEQ ID NO: 3187889 - RNA, 19 nt, Mycobacterium bovis subsp bovis AF2122/97
cggcgucuguaccacgggc

SEQ ID NO: 3187890 - RNA, 18 nt, Mycobacterium bovis subsp bovis AF2122/97
cggcgucuuccucggcca

SEQ ID NO: 3187891 - RNA, 21 nt, Mycobacterium bovis subsp bovis AF2122/97
cggcgucuuccucggccaccc

SEQ ID NO: 3187892 - RNA, 22 nt, Mycobacterium bovis subsp bovis AF2122/97
cggcgucuuccucggccacccg

SEQ ID NO: 3187893 - RNA, 24 nt, Mycobacterium bovis subsp bovis AF2122/97
cggcgucuuccucggccacccgca

SEQ ID NO: 3187894 - RNA, 20 nt, Mycobacterium bovis subsp bovis AF2122/97
cggcgucuugcaucagcggc

SEQ ID NO: 3187895 - RNA, 21 nt, Mycobacterium bovis subsp bovis AF2122/97
cggcgucuugcaucagcggcg

SEQ ID NO: 3187896 - RNA, 22 nt, Mycobacterium bovis subsp bovis AF2122/97
cggcgucuugcaucagcggcgc

SEQ ID NO: 3187897 - RNA, 19 nt, Mycobacterium bovis subsp bovis AF2122/97
cggcgugaaaaacgcccgc

SEQ ID NO: 3187898 - RNA, 21 nt, Mycobacterium bovis subsp bovis AF2122/97
cggcgugaaaaacgcccgcgc

SEQ ID NO: 3187899 - RNA, 14 nt, Mycobacterium bovis subsp bovis AF2122/97
cggcgugaucaccg

SEQ ID NO: 3187900 - RNA, 22 nt, Mycobacterium bovis subsp bovis AF2122/97
cggcgugaugucuaccaacacc

SEQ ID NO: 3187901 - RNA, 15 nt, Mycobacterium bovis subsp bovis AF2122/97
cggcgugcagaaucc

SEQ ID NO: 3187902 - RNA, 15 nt, Mycobacterium bovis subsp bovis AF2122/97
cggcgugcagcaccc

SEQ ID NO: 3187903 - RNA, 15 nt, Mycobacterium bovis subsp bovis AF2122/97
cggcgugcaggguca

SEQ ID NO: 3187904 - RNA, 17 nt, Mycobacterium bovis subsp bovis AF2122/97
cggcgugcaguacaccc

SEQ ID NO: 3187905 - RNA, 23 nt, Mycobacterium bovis subsp bovis AF2122/97
cggcgugcaugagccgggugcga

SEQ ID NO: 3187906 - RNA, 16 nt, Mycobacterium bovis subsp bovis AF2122/97
cggcgugcggacugac

SEQ ID NO: 3187907 - RNA, 21 nt, Mycobacterium bovis subsp bovis AF2122/97
cggcgugcuuaacacaugcaa

SEQ ID NO: 3187908 - RNA, 14 nt, Mycobacterium bovis subsp bovis AF2122/97
cggcguggauccgu

SEQ ID NO: 3187909 - RNA, 14 nt, Mycobacterium bovis subsp bovis AF2122/97
cggcguggcgccgg

SEQ ID NO: 3187910 - RNA, 24 nt, Mycobacterium bovis subsp bovis AF2122/97
cggcguggcugccuucggcgagcg

SEQ ID NO: 3187911 - RNA, 22 nt, Mycobacterium bovis subsp bovis AF2122/97
cggcguggcuucacccaacccc

SEQ ID NO: 3187912 - RNA, 20 nt, Mycobacterium bovis subsp bovis AF2122/97
cggcguggcuuguucggacu

SEQ ID NO: 3187913 - RNA, 18 nt, Mycobacterium bovis subsp bovis AF2122/97
cggcgugggagguggcgc

SEQ ID NO: 3187914 - RNA, 20 nt, Mycobacterium bovis subsp bovis AF2122/97
cggcgugggagguggcgcgg

SEQ ID NO: 3187915 - RNA, 22 nt, Mycobacterium bovis subsp bovis AF2122/97
cggcgugggagguggcgcgggg

SEQ ID NO: 3187916 - RNA, 23 nt, Mycobacterium bovis subsp bovis AF2122/97
cggcgugggagguggcgcggggc

SEQ ID NO: 3187917 - RNA, 14 nt, Mycobacterium bovis subsp bovis AF2122/97
cggcgugggcaccu

SEQ ID NO: 3187918 - RNA, 21 nt, Mycobacterium bovis subsp bovis AF2122/97
cggcguggucgcgcggcaccg

SEQ ID NO: 3187919 - RNA, 22 nt, Mycobacterium bovis subsp bovis AF2122/97
cggcguggucgcgcggcaccga

SEQ ID NO: 3187920 - RNA, 14 nt, Mycobacterium bovis subsp bovis AF2122/97
cggcguggucggca

SEQ ID NO: 3187921 - RNA, 14 nt, Mycobacterium bovis subsp bovis AF2122/97
cggcguguacgucg

SEQ ID NO: 3187922 - RNA, 15 nt, Mycobacterium bovis subsp bovis AF2122/97
cggcguguccgccga

SEQ ID NO: 3187923 - RNA, 17 nt, Mycobacterium bovis subsp bovis AF2122/97
cggcguguccgccgaac

SEQ ID NO: 3187924 - RNA, 17 nt, Mycobacterium bovis subsp bovis AF2122/97
cggcgugucgccgccac

SEQ ID NO: 3187925 - RNA, 19 nt, Mycobacterium bovis subsp bovis AF2122/97
cggcgugucgccgccacca

SEQ ID NO: 3187926 - RNA, 20 nt, Mycobacterium bovis subsp bovis AF2122/97
cggcgugucgccgccaccag

SEQ ID NO: 3187927 - RNA, 16 nt, Mycobacterium bovis subsp bovis AF2122/97
cggcgugucgcgucgc

SEQ ID NO: 3187928 - RNA, 15 nt, Mycobacterium bovis subsp bovis AF2122/97
cggcgugucgggggc

SEQ ID NO: 3187929 - RNA, 20 nt, Mycobacterium bovis subsp bovis AF2122/97
cggcgugucguugccagggc

SEQ ID NO: 3187930 - RNA, 16 nt, Mycobacterium bovis subsp bovis AF2122/97
cggcgugucucgucgc

SEQ ID NO: 3187931 - RNA, 19 nt, Mycobacterium bovis subsp bovis AF2122/97
cggcgugucucgucgcccc

SEQ ID NO: 3187932 - RNA, 17 nt, Mycobacterium bovis subsp bovis AF2122/97
cggcgugucugcccgag

SEQ ID NO: 3187933 - RNA, 22 nt, Mycobacterium bovis subsp bovis AF2122/97
cggcguuaaugcuucgcgucga

SEQ ID NO: 3187934 - RNA, 14 nt, Mycobacterium bovis subsp bovis AF2122/97
cggcguuaccaccg

SEQ ID NO: 3187935 - RNA, 20 nt, Mycobacterium bovis subsp bovis AF2122/97
cggcguuaccaccgucaccg

SEQ ID NO: 3187936 - RNA, 22 nt, Mycobacterium bovis subsp bovis AF2122/97
cggcguuaccaccgucaccgcc

SEQ ID NO: 3187937 - RNA, 23 nt, Mycobacterium bovis subsp bovis AF2122/97
cggcguuaccaccgucaccgccg

SEQ ID NO: 3187938 - RNA, 16 nt, Mycobacterium bovis subsp bovis AF2122/97
cggcguuacguggugg

SEQ ID NO: 3187939 - RNA, 16 nt, Mycobacterium bovis subsp bovis AF2122/97
cggcguuagcguagcc

SEQ ID NO: 3187940 - RNA, 21 nt, Mycobacterium bovis subsp bovis AF2122/97
cggcguuagcguagcccgagu

SEQ ID NO: 3187941 - RNA, 19 nt, Mycobacterium bovis subsp bovis AF2122/97
cggcguuagucgaucacgu

SEQ ID NO: 3187942 - RNA, 15 nt, Mycobacterium bovis subsp bovis AF2122/97
cggcguuaucgucgg

SEQ ID NO: 3187943 - RNA, 23 nt, Mycobacterium bovis subsp bovis AF2122/97
cggcguuccccgagaacggcggg

SEQ ID NO: 3187944 - RNA, 23 nt, Mycobacterium bovis subsp bovis AF2122/97
cggcguucccgccauugccgccg

SEQ ID NO: 3187945 - RNA, 16 nt, Mycobacterium bovis subsp bovis AF2122/97
cggcguuccggacggg

SEQ ID NO: 3187946 - RNA, 16 nt, Mycobacterium bovis subsp bovis AF2122/97
cggcguuccgggccga

SEQ ID NO: 3187947 - RNA, 20 nt, Mycobacterium bovis subsp bovis AF2122/97
cggcguuccgggccgaucac

SEQ ID NO: 3187948 - RNA, 14 nt, Mycobacterium bovis subsp bovis AF2122/97
cggcguucgaugcc

SEQ ID NO: 3187949 - RNA, 15 nt, Mycobacterium bovis subsp bovis AF2122/97
cggcguucgaugcca

SEQ ID NO: 3187950 - RNA, 18 nt, Mycobacterium bovis subsp bovis AF2122/97
cggcguugagcuggcggu

SEQ ID NO: 3187951 - RNA, 20 nt, Mycobacterium bovis subsp bovis AF2122/97
cggcguugaucgacaucacc

SEQ ID NO: 3187952 - RNA, 14 nt, Mycobacterium bovis subsp bovis AF2122/97
cggcguugccgaaa

SEQ ID NO: 3187953 - RNA, 18 nt, Mycobacterium bovis subsp bovis AF2122/97
cggcguugccgaaacccg

SEQ ID NO: 3187954 - RNA, 20 nt, Mycobacterium bovis subsp bovis AF2122/97
cggcguugccgaaacccgag

SEQ ID NO: 3187955 - RNA, 21 nt, Mycobacterium bovis subsp bovis AF2122/97
cggcguugccgaaacccgagu

SEQ ID NO: 3187956 - RNA, 13 nt, Mycobacterium bovis subsp bovis AF2122/97
cggcguugccgcc

SEQ ID NO: 3187957 - RNA, 14 nt, Mycobacterium bovis subsp bovis AF2122/97
cggcguugccgccg

SEQ ID NO: 3187958 - RNA, 17 nt, Mycobacterium bovis subsp bovis AF2122/97
cggcguugccgccggcu

SEQ ID NO: 3187959 - RNA, 15 nt, Mycobacterium bovis subsp bovis AF2122/97
cggcguugccgccgu

SEQ ID NO: 3187960 - RNA, 19 nt, Mycobacterium bovis subsp bovis AF2122/97
cggcguugccgccgucccc

SEQ ID NO: 3187961 - RNA, 23 nt, Mycobacterium bovis subsp bovis AF2122/97
cggcguugccgccguuaccgccg

SEQ ID NO: 3187962 - RNA, 20 nt, Mycobacterium bovis subsp bovis AF2122/97
cggcguugccgccguugccg

SEQ ID NO: 3187963 - RNA, 23 nt, Mycobacterium bovis subsp bovis AF2122/97
cggcguugccggagaaguucgug

SEQ ID NO: 3187964 - RNA, 19 nt, Mycobacterium bovis subsp bovis AF2122/97
cggcguugcggaaucagca

SEQ ID NO: 3187965 - RNA, 23 nt, Mycobacterium bovis subsp bovis AF2122/97
cggcguuggaaaagucgggcacu

SEQ ID NO: 3187966 - RNA, 13 nt, Mycobacterium bovis subsp bovis AF2122/97
cggcguuggcgcc

SEQ ID NO: 3187967 - RNA, 14 nt, Mycobacterium bovis subsp bovis AF2122/97
cggcguuggcgccg

SEQ ID NO: 3187968 - RNA, 19 nt, Mycobacterium bovis subsp bovis AF2122/97
cggcguuggcgccguuacc

SEQ ID NO: 3187969 - RNA, 21 nt, Mycobacterium bovis subsp bovis AF2122/97
cggcguuggugcagucggugc

SEQ ID NO: 3187970 - RNA, 16 nt, Mycobacterium bovis subsp bovis AF2122/97
cggcguugucccccag

SEQ ID NO: 3187971 - RNA, 15 nt, Mycobacterium bovis subsp bovis AF2122/97
cggcguugucgacga

SEQ ID NO: 3187972 - RNA, 18 nt, Mycobacterium bovis subsp bovis AF2122/97
cggcguugugaccgccga

SEQ ID NO: 3187973 - RNA, 22 nt, Mycobacterium bovis subsp bovis AF2122/97
cggcguugugcaaugugggcgc

SEQ ID NO: 3187974 - RNA, 23 nt, Mycobacterium bovis subsp bovis AF2122/97
cggcguuuagggcgauuuccauc

SEQ ID NO: 3187975 - RNA, 18 nt, Mycobacterium bovis subsp bovis AF2122/97
cggcguuuuccgggcugu

SEQ ID NO: 3187976 - RNA, 19 nt, Mycobacterium bovis subsp bovis AF2122/97
cggcuaagccuucgguguc

SEQ ID NO: 3187977 - RNA, 22 nt, Mycobacterium bovis subsp bovis AF2122/97
cggcuaagccuucggugucgcc

SEQ ID NO: 3187978 - RNA, 14 nt, Mycobacterium bovis subsp bovis AF2122/97
cggcuacaucggcg

SEQ ID NO: 3187979 - RNA, 15 nt, Mycobacterium bovis subsp bovis AF2122/97
cggcuacaucggcgg

SEQ ID NO: 3187980 - RNA, 17 nt, Mycobacterium bovis subsp bovis AF2122/97
cggcuacaucggcggcg

SEQ ID NO: 3187981 - RNA, 21 nt, Mycobacterium bovis subsp bovis AF2122/97
cggcuacaucggcggcgucga

SEQ ID NO: 3187982 - RNA, 15 nt, Mycobacterium bovis subsp bovis AF2122/97
cggcuaccaccgcac

SEQ ID NO: 3187983 - RNA, 21 nt, Mycobacterium bovis subsp bovis AF2122/97
cggcuaccaccgcaccugcga

SEQ ID NO: 3187984 - RNA, 17 nt, Mycobacterium bovis subsp bovis AF2122/97
cggcuaccccgcagaau

SEQ ID NO: 3187985 - RNA, 13 nt, Mycobacterium bovis subsp bovis AF2122/97
cggcuaccgccga

SEQ ID NO: 3187986 - RNA, 17 nt, Mycobacterium bovis subsp bovis AF2122/97
cggcuaccgccgaccgg

SEQ ID NO: 3187987 - RNA, 21 nt, Mycobacterium bovis subsp bovis AF2122/97
cggcuaccgccuugucggcga

SEQ ID NO: 3187988 - RNA, 14 nt, Mycobacterium bovis subsp bovis AF2122/97
cggcuaccgcgcuc

SEQ ID NO: 3187989 - RNA, 16 nt, Mycobacterium bovis subsp bovis AF2122/97
cggcuaccgcgcuccc

SEQ ID NO: 3187990 - RNA, 17 nt, Mycobacterium bovis subsp bovis AF2122/97
cggcuaccgcgcucccg

SEQ ID NO: 3187991 - RNA, 19 nt, Mycobacterium bovis subsp bovis AF2122/97
cggcuaccgcgcucccggc

SEQ ID NO: 3187992 - RNA, 20 nt, Mycobacterium bovis subsp bovis AF2122/97
cggcuaccgcgcucccggcg

SEQ ID NO: 3187993 - RNA, 21 nt, Mycobacterium bovis subsp bovis AF2122/97
cggcuaccgcgcucccggcgu

SEQ ID NO: 3187994 - RNA, 22 nt, Mycobacterium bovis subsp bovis AF2122/97
cggcuaccgcgcucccggcguc

SEQ ID NO: 3187995 - RNA, 13 nt, Mycobacterium bovis subsp bovis AF2122/97
cggcuaccggcgu

SEQ ID NO: 3187996 - RNA, 18 nt, Mycobacterium bovis subsp bovis AF2122/97
cggcuaccuaacccgcac

SEQ ID NO: 3187997 - RNA, 19 nt, Mycobacterium bovis subsp bovis AF2122/97
cggcuaccuaacccgcacc

SEQ ID NO: 3187998 - RNA, 19 nt, Mycobacterium bovis subsp bovis AF2122/97
cggcuaccuaacccgcgcc

SEQ ID NO: 3187999 - RNA, 15 nt, Mycobacterium bovis subsp bovis AF2122/97
cggcuacgacggcgc

SEQ ID NO: 3188000 - RNA, 17 nt, Mycobacterium bovis subsp bovis AF2122/97
cggcuacgccucggcgu

SEQ ID NO: 3188001 - RNA, 18 nt, Mycobacterium bovis subsp bovis AF2122/97
cggcuacgccucggcgug

SEQ ID NO: 3188002 - RNA, 15 nt, Mycobacterium bovis subsp bovis AF2122/97
cggcuacggcgacac

SEQ ID NO: 3188003 - RNA, 17 nt, Mycobacterium bovis subsp bovis AF2122/97
cggcuagauaacccaac

SEQ ID NO: 3188004 - RNA, 19 nt, Mycobacterium bovis subsp bovis AF2122/97
cggcuagcaguuagccggg

SEQ ID NO: 3188005 - RNA, 20 nt, Mycobacterium bovis subsp bovis AF2122/97
cggcuagcugaugccugguc

SEQ ID NO: 3188006 - RNA, 20 nt, Mycobacterium bovis subsp bovis AF2122/97
cggcuaggagaucagcaccg

SEQ ID NO: 3188007 - RNA, 17 nt, Mycobacterium bovis subsp bovis AF2122/97
cggcuaggccagcacgg

SEQ ID NO: 3188008 - RNA, 23 nt, Mycobacterium bovis subsp bovis AF2122/97
cggcuaggccagcacggcgacga

SEQ ID NO: 3188009 - RNA, 19 nt, Mycobacterium bovis subsp bovis AF2122/97
cggcuaggccggccggagu

SEQ ID NO: 3188010 - RNA, 18 nt, Mycobacterium bovis subsp bovis AF2122/97
cggcuagggcagcagccc

SEQ ID NO: 3188011 - RNA, 21 nt, Mycobacterium bovis subsp bovis AF2122/97
cggcuagggcagcagcccggg

SEQ ID NO: 3188012 - RNA, 19 nt, Mycobacterium bovis subsp bovis AF2122/97
cggcuagggcccuggcggc

SEQ ID NO: 3188013 - RNA, 21 nt, Mycobacterium bovis subsp bovis AF2122/97
cggcuagggcccuggcggccc

SEQ ID NO: 3188014 - RNA, 23 nt, Mycobacterium bovis subsp bovis AF2122/97
cggcuaggucagcgggcuugccg

SEQ ID NO: 3188015 - RNA, 19 nt, Mycobacterium bovis subsp bovis AF2122/97
cggcuauaucccgccccgg

SEQ ID NO: 3188016 - RNA, 13 nt, Mycobacterium bovis subsp bovis AF2122/97
cggcuaugcuggc

SEQ ID NO: 3188017 - RNA, 14 nt, Mycobacterium bovis subsp bovis AF2122/97
cggcuaugcuggcg

SEQ ID NO: 3188018 - RNA, 16 nt, Mycobacterium bovis subsp bovis AF2122/97
cggcuaugcuggcgca

SEQ ID NO: 3188019 - RNA, 19 nt, Mycobacterium bovis subsp bovis AF2122/97
cggcuaugcuggcgcagcg

SEQ ID NO: 3188020 - RNA, 20 nt, Mycobacterium bovis subsp bovis AF2122/97
cggcuaugcuggcgcagcgc

SEQ ID NO: 3188021 - RNA, 22 nt, Mycobacterium bovis subsp bovis AF2122/97
cggcuaugcuggcgcagcgcca

SEQ ID NO: 3188022 - RNA, 15 nt, Mycobacterium bovis subsp bovis AF2122/97
cggcuauggcgccgc

SEQ ID NO: 3188023 - RNA, 21 nt, Mycobacterium bovis subsp bovis AF2122/97
cggcuauggguucgcgguugu

SEQ ID NO: 3188024 - RNA, 21 nt, Mycobacterium bovis subsp bovis AF2122/97
cggcucaacaccgaguuccuc

SEQ ID NO: 3188025 - RNA, 18 nt, Mycobacterium bovis subsp bovis AF2122/97
cggcucaaccucuggcgg

SEQ ID NO: 3188026 - RNA, 19 nt, Mycobacterium bovis subsp bovis AF2122/97
cggcucaaccucuggcggc

SEQ ID NO: 3188027 - RNA, 20 nt, Mycobacterium bovis subsp bovis AF2122/97
cggcucaaccucuggcggcg

SEQ ID NO: 3188028 - RNA, 21 nt, Mycobacterium bovis subsp bovis AF2122/97
cggcucaaccucuggcggcgg

SEQ ID NO: 3188029 - RNA, 21 nt, Mycobacterium bovis subsp bovis AF2122/97
cggcucaaggacgcaccgcca

SEQ ID NO: 3188030 - RNA, 18 nt, Mycobacterium bovis subsp bovis AF2122/97
cggcucaaucuccuccgc

SEQ ID NO: 3188031 - RNA, 13 nt, Mycobacterium bovis subsp bovis AF2122/97
cggcucacagcac

SEQ ID NO: 3188032 - RNA, 14 nt, Mycobacterium bovis subsp bovis AF2122/97
cggcucacagcaca

SEQ ID NO: 3188033 - RNA, 15 nt, Mycobacterium bovis subsp bovis AF2122/97
cggcucacagcacag

SEQ ID NO: 3188034 - RNA, 16 nt, Mycobacterium bovis subsp bovis AF2122/97
cggcucacagcacagc

SEQ ID NO: 3188035 - RNA, 22 nt, Mycobacterium bovis subsp bovis AF2122/97
cggcucacagcacagcgcagcc

SEQ ID NO: 3188036 - RNA, 17 nt, Mycobacterium bovis subsp bovis AF2122/97
cggcucaccgaucccgc

SEQ ID NO: 3188037 - RNA, 23 nt, Mycobacterium bovis subsp bovis AF2122/97
cggcucaccgaucccgcggccgg

SEQ ID NO: 3188038 - RNA, 12 nt, Mycobacterium bovis subsp bovis AF2122/97
cggcucaccgcg

SEQ ID NO: 3188039 - RNA, 16 nt, Mycobacterium bovis subsp bovis AF2122/97
cggcucaccgcgcauc

SEQ ID NO: 3188040 - RNA, 19 nt, Mycobacterium bovis subsp bovis AF2122/97
cggcucacgaccggccaac

SEQ ID NO: 3188041 - RNA, 22 nt, Mycobacterium bovis subsp bovis AF2122/97
cggcucacgaccggccaacgcc

SEQ ID NO: 3188042 - RNA, 16 nt, Mycobacterium bovis subsp bovis AF2122/97
cggcucacgacugcgu

SEQ ID NO: 3188043 - RNA, 21 nt, Mycobacterium bovis subsp bovis AF2122/97
cggcucacguaaccagugacc

SEQ ID NO: 3188044 - RNA, 13 nt, Mycobacterium bovis subsp bovis AF2122/97
cggcucagcgugc

SEQ ID NO: 3188045 - RNA, 13 nt, Mycobacterium bovis subsp bovis AF2122/97
cggcucagucacg

SEQ ID NO: 3188046 - RNA, 21 nt, Mycobacterium bovis subsp bovis AF2122/97
cggcucagucacgcacucccg

SEQ ID NO: 3188047 - RNA, 13 nt, Mycobacterium bovis subsp bovis AF2122/97
cggcucaucccga

SEQ ID NO: 3188048 - RNA, 15 nt, Mycobacterium bovis subsp bovis AF2122/97
cggcuccaccgggcc

SEQ ID NO: 3188049 - RNA, 17 nt, Mycobacterium bovis subsp bovis AF2122/97
cggcuccaccgggcccg

SEQ ID NO: 3188050 - RNA, 18 nt, Mycobacterium bovis subsp bovis AF2122/97
cggcuccaccgggcccgc

SEQ ID NO: 3188051 - RNA, 20 nt, Mycobacterium bovis subsp bovis AF2122/97
cggcuccaccgggcccgccg

SEQ ID NO: 3188052 - RNA, 21 nt, Mycobacterium bovis subsp bovis AF2122/97
cggcuccaccgggcccgccgg

SEQ ID NO: 3188053 - RNA, 22 nt, Mycobacterium bovis subsp bovis AF2122/97
cggcuccaccgggcccgccggc

SEQ ID NO: 3188054 - RNA, 16 nt, Mycobacterium bovis subsp bovis AF2122/97
cggcuccagcaugggc

SEQ ID NO: 3188055 - RNA, 11 nt, Mycobacterium bovis subsp bovis AF2122/97
cggcucccggg

SEQ ID NO: 3188056 - RNA, 20 nt, Mycobacterium bovis subsp bovis AF2122/97
cggcuccgaaggccgccagu

SEQ ID NO: 3188057 - RNA, 17 nt, Mycobacterium bovis subsp bovis AF2122/97
cggcuccgauuccgaac

SEQ ID NO: 3188058 - RNA, 13 nt, Mycobacterium bovis subsp bovis AF2122/97
cggcuccgcagcg

SEQ ID NO: 3188059 - RNA, 14 nt, Mycobacterium bovis subsp bovis AF2122/97
cggcuccgccacug

SEQ ID NO: 3188060 - RNA, 20 nt, Mycobacterium bovis subsp bovis AF2122/97
cggcuccgccacuggcgccg

SEQ ID NO: 3188061 - RNA, 12 nt, Mycobacterium bovis subsp bovis AF2122/97
cggcuccgccgc

SEQ ID NO: 3188062 - RNA, 21 nt, Mycobacterium bovis subsp bovis AF2122/97
cggcuccgccgcgggcucccc

SEQ ID NO: 3188063 - RNA, 14 nt, Mycobacterium bovis subsp bovis AF2122/97
cggcuccgccguug

SEQ ID NO: 3188064 - RNA, 22 nt, Mycobacterium bovis subsp bovis AF2122/97
cggcuccggacaccccgcacgg

SEQ ID NO: 3188065 - RNA, 19 nt, Mycobacterium bovis subsp bovis AF2122/97
cggcuccggcggugccguc

SEQ ID NO: 3188066 - RNA, 13 nt, Mycobacterium bovis subsp bovis AF2122/97
cggcuccgggacg

SEQ ID NO: 3188067 - RNA, 19 nt, Mycobacterium bovis subsp bovis AF2122/97
cggcuccgggcgcucgguc

SEQ ID NO: 3188068 - RNA, 14 nt, Mycobacterium bovis subsp bovis AF2122/97
cggcuccuccccgg

SEQ ID NO: 3188069 - RNA, 18 nt, Mycobacterium bovis subsp bovis AF2122/97
cggcuccuccccggcccg

SEQ ID NO: 3188070 - RNA, 20 nt, Mycobacterium bovis subsp bovis AF2122/97
cggcuccuccccggcccgcu

SEQ ID NO: 3188071 - RNA, 21 nt, Mycobacterium bovis subsp bovis AF2122/97
cggcuccuccgguaucggcga

SEQ ID NO: 3188072 - RNA, 17 nt, Mycobacterium bovis subsp bovis AF2122/97
cggcucgaauacggugc

SEQ ID NO: 3188073 - RNA, 19 nt, Mycobacterium bovis subsp bovis AF2122/97
cggcucgaauacggugcca

SEQ ID NO: 3188074 - RNA, 17 nt, Mycobacterium bovis subsp bovis AF2122/97
cggcucgagcucggcga

SEQ ID NO: 3188075 - RNA, 13 nt, Mycobacterium bovis subsp bovis AF2122/97
cggcucgagucgc

SEQ ID NO: 3188076 - RNA, 21 nt, Mycobacterium bovis subsp bovis AF2122/97
cggcucgagucgcagcacggg

SEQ ID NO: 3188077 - RNA, 22 nt, Mycobacterium bovis subsp bovis AF2122/97
cggcucgagucgcagcacgggu

SEQ ID NO: 3188078 - RNA, 19 nt, Mycobacterium bovis subsp bovis AF2122/97
cggcucgaucucguuuucg

SEQ ID NO: 3188079 - RNA, 15 nt, Mycobacterium bovis subsp bovis AF2122/97
cggcucgccaccucg

SEQ ID NO: 3188080 - RNA, 13 nt, Mycobacterium bovis subsp bovis AF2122/97
cggcucgccgacc

SEQ ID NO: 3188081 - RNA, 19 nt, Mycobacterium bovis subsp bovis AF2122/97
cggcucgccgacccgccgc

SEQ ID NO: 3188082 - RNA, 20 nt, Mycobacterium bovis subsp bovis AF2122/97
cggcucgccgacccgccgcg

SEQ ID NO: 3188083 - RNA, 17 nt, Mycobacterium bovis subsp bovis AF2122/97
cggcucgccggcgaccg

SEQ ID NO: 3188084 - RNA, 20 nt, Mycobacterium bovis subsp bovis AF2122/97
cggcucgccggcgaccggga

SEQ ID NO: 3188085 - RNA, 15 nt, Mycobacterium bovis subsp bovis AF2122/97
cggcucgccggcgcg

SEQ ID NO: 3188086 - RNA, 17 nt, Mycobacterium bovis subsp bovis AF2122/97
cggcucgccggcgcgca

SEQ ID NO: 3188087 - RNA, 15 nt, Mycobacterium bovis subsp bovis AF2122/97
cggcucgccggcggc

SEQ ID NO: 3188088 - RNA, 19 nt, Mycobacterium bovis subsp bovis AF2122/97
cggcucgccggcggcccgc

SEQ ID NO: 3188089 - RNA, 20 nt, Mycobacterium bovis subsp bovis AF2122/97
cggcucgccggcggcccgcu

SEQ ID NO: 3188090 - RNA, 21 nt, Mycobacterium bovis subsp bovis AF2122/97
cggcucgccggcggcccgcuc

SEQ ID NO: 3188091 - RNA, 23 nt, Mycobacterium bovis subsp bovis AF2122/97
cggcucgccggcggcccgcucga

SEQ ID NO: 3188092 - RNA, 18 nt, Mycobacterium bovis subsp bovis AF2122/97
cggcucggaaaccgcccc

SEQ ID NO: 3188093 - RNA, 19 nt, Mycobacterium bovis subsp bovis AF2122/97
cggcucggaaaccgccccg

SEQ ID NO: 3188094 - RNA, 18 nt, Mycobacterium bovis subsp bovis AF2122/97
cggcucggcaggugacca

SEQ ID NO: 3188095 - RNA, 14 nt, Mycobacterium bovis subsp bovis AF2122/97
cggcucggccaccg

SEQ ID NO: 3188096 - RNA, 14 nt, Mycobacterium bovis subsp bovis AF2122/97
cggcucggccagcc

SEQ ID NO: 3188097 - RNA, 15 nt, Mycobacterium bovis subsp bovis AF2122/97
cggcucggccagcca

SEQ ID NO: 3188098 - RNA, 13 nt, Mycobacterium bovis subsp bovis AF2122/97
cggcucggccccc

SEQ ID NO: 3188099 - RNA, 13 nt, Mycobacterium bovis subsp bovis AF2122/97
cggcucggccgga

SEQ ID NO: 3188100 - RNA, 22 nt, Mycobacterium bovis subsp bovis AF2122/97
cggcucggcgggggaccccgcc

SEQ ID NO: 3188101 - RNA, 14 nt, Mycobacterium bovis subsp bovis AF2122/97
cggcucgggcagcg

SEQ ID NO: 3188102 - RNA, 15 nt, Mycobacterium bovis subsp bovis AF2122/97
cggcucgggugcgcc

SEQ ID NO: 3188103 - RNA, 17 nt, Mycobacterium bovis subsp bovis AF2122/97
cggcucgggugcgcccg

SEQ ID NO: 3188104 - RNA, 19 nt, Mycobacterium bovis subsp bovis AF2122/97
cggcucgggugcgcccggc

SEQ ID NO: 3188105 - RNA, 21 nt, Mycobacterium bovis subsp bovis AF2122/97
cggcucgggugcgcccggcca

SEQ ID NO: 3188106 - RNA, 12 nt, Mycobacterium bovis subsp bovis AF2122/97
cggcucggugcg

SEQ ID NO: 3188107 - RNA, 19 nt, Mycobacterium bovis subsp bovis AF2122/97
cggcucgguggcguauucg

SEQ ID NO: 3188108 - RNA, 15 nt, Mycobacterium bovis subsp bovis AF2122/97
cggcucgucagguuc

SEQ ID NO: 3188109 - RNA, 19 nt, Mycobacterium bovis subsp bovis AF2122/97
cggcucguccgggcagaug

SEQ ID NO: 3188110 - RNA, 13 nt, Mycobacterium bovis subsp bovis AF2122/97
cggcucgucgcuc

SEQ ID NO: 3188111 - RNA, 15 nt, Mycobacterium bovis subsp bovis AF2122/97
cggcucguugcgggc

SEQ ID NO: 3188112 - RNA, 16 nt, Mycobacterium bovis subsp bovis AF2122/97
cggcucguuggcaaag

SEQ ID NO: 3188113 - RNA, 17 nt, Mycobacterium bovis subsp bovis AF2122/97
cggcucuauccggcgca

SEQ ID NO: 3188114 - RNA, 17 nt, Mycobacterium bovis subsp bovis AF2122/97
cggcucucuucgcgcgc

SEQ ID NO: 3188115 - RNA, 22 nt, Mycobacterium bovis subsp bovis AF2122/97
cggcucucuucgcgcgcugggc

SEQ ID NO: 3188116 - RNA, 23 nt, Mycobacterium bovis subsp bovis AF2122/97
cggcucucuucgcgcgcugggcg

SEQ ID NO: 3188117 - RNA, 17 nt, Mycobacterium bovis subsp bovis AF2122/97
cggcugaaccgcuggga

SEQ ID NO: 3188118 - RNA, 16 nt, Mycobacterium bovis subsp bovis AF2122/97
cggcugaacggcagcc

SEQ ID NO: 3188119 - RNA, 17 nt, Mycobacterium bovis subsp bovis AF2122/97
cggcugaauucggcgag

SEQ ID NO: 3188120 - RNA, 13 nt, Mycobacterium bovis subsp bovis AF2122/97
cggcugaccgacc

SEQ ID NO: 3188121 - RNA, 14 nt, Mycobacterium bovis subsp bovis AF2122/97
cggcugaccgaccc

SEQ ID NO: 3188122 - RNA, 18 nt, Mycobacterium bovis subsp bovis AF2122/97
cggcugaccgacccggac

SEQ ID NO: 3188123 - RNA, 17 nt, Mycobacterium bovis subsp bovis AF2122/97
cggcugaccggggcgcc

SEQ ID NO: 3188124 - RNA, 19 nt, Mycobacterium bovis subsp bovis AF2122/97
cggcugaccggggcgcccg

SEQ ID NO: 3188125 - RNA, 20 nt, Mycobacterium bovis subsp bovis AF2122/97
cggcugaccggggcgcccgg

SEQ ID NO: 3188126 - RNA, 20 nt, Mycobacterium bovis subsp bovis AF2122/97
cggcugaccggggucggccu

SEQ ID NO: 3188127 - RNA, 13 nt, Mycobacterium bovis subsp bovis AF2122/97
cggcugaccuccc

SEQ ID NO: 3188128 - RNA, 18 nt, Mycobacterium bovis subsp bovis AF2122/97
cggcugaccucccacccc

SEQ ID NO: 3188129 - RNA, 19 nt, Mycobacterium bovis subsp bovis AF2122/97
cggcugaccucccaccccc

SEQ ID NO: 3188130 - RNA, 20 nt, Mycobacterium bovis subsp bovis AF2122/97
cggcugaccucccacccccg

SEQ ID NO: 3188131 - RNA, 22 nt, Mycobacterium bovis subsp bovis AF2122/97
cggcugaccucccacccccggu

SEQ ID NO: 3188132 - RNA, 21 nt, Mycobacterium bovis subsp bovis AF2122/97
cggcugaccuucucacgcacc

SEQ ID NO: 3188133 - RNA, 18 nt, Mycobacterium bovis subsp bovis AF2122/97
cggcugacgaccaaccac

SEQ ID NO: 3188134 - RNA, 21 nt, Mycobacterium bovis subsp bovis AF2122/97
cggcugacgaccaaccaccga

SEQ ID NO: 3188135 - RNA, 16 nt, Mycobacterium bovis subsp bovis AF2122/97
cggcugagacagaccg

SEQ ID NO: 3188136 - RNA, 20 nt, Mycobacterium bovis subsp bovis AF2122/97
cggcugagacagaccgggcc

SEQ ID NO: 3188137 - RNA, 21 nt, Mycobacterium bovis subsp bovis AF2122/97
cggcugagacagaccgggccc

SEQ ID NO: 3188138 - RNA, 16 nt, Mycobacterium bovis subsp bovis AF2122/97
cggcugagacgguguu

SEQ ID NO: 3188139 - RNA, 20 nt, Mycobacterium bovis subsp bovis AF2122/97
cggcugagacgguguugcuc

SEQ ID NO: 3188140 - RNA, 12 nt, Mycobacterium bovis subsp bovis AF2122/97
cggcugagccgc

SEQ ID NO: 3188141 - RNA, 13 nt, Mycobacterium bovis subsp bovis AF2122/97
cggcugagccgca

SEQ ID NO: 3188142 - RNA, 23 nt, Mycobacterium bovis subsp bovis AF2122/97
cggcugagccgcaucuggccggc

SEQ ID NO: 3188143 - RNA, 19 nt, Mycobacterium bovis subsp bovis AF2122/97
cggcugagcgugcggugau

SEQ ID NO: 3188144 - RNA, 22 nt, Mycobacterium bovis subsp bovis AF2122/97
cggcugagcgugcggugaucga

SEQ ID NO: 3188145 - RNA, 18 nt, Mycobacterium bovis subsp bovis AF2122/97
cggcugauucgagccaca

SEQ ID NO: 3188146 - RNA, 15 nt, Mycobacterium bovis subsp bovis AF2122/97
cggcugauuggccca

SEQ ID NO: 3188147 - RNA, 18 nt, Mycobacterium bovis subsp bovis AF2122/97
cggcugauuggcccaccg

SEQ ID NO: 3188148 - RNA, 22 nt, Mycobacterium bovis subsp bovis AF2122/97
cggcugauuggcccaccgccgu

SEQ ID NO: 3188149 - RNA, 17 nt, Mycobacterium bovis subsp bovis AF2122/97
cggcugcaaccagcggc

SEQ ID NO: 3188150 - RNA, 18 nt, Mycobacterium bovis subsp bovis AF2122/97
cggcugcaaccagcggca

SEQ ID NO: 3188151 - RNA, 23 nt, Mycobacterium bovis subsp bovis AF2122/97
cggcugcaaccagcggcacauca

SEQ ID NO: 3188152 - RNA, 14 nt, Mycobacterium bovis subsp bovis AF2122/97
cggcugcaccggcu

SEQ ID NO: 3188153 - RNA, 19 nt, Mycobacterium bovis subsp bovis AF2122/97
cggcugcacgcugcggguc

SEQ ID NO: 3188154 - RNA, 17 nt, Mycobacterium bovis subsp bovis AF2122/97
cggcugcagccgaccga

SEQ ID NO: 3188155 - RNA, 20 nt, Mycobacterium bovis subsp bovis AF2122/97
cggcugcauccuccucgucg

SEQ ID NO: 3188156 - RNA, 14 nt, Mycobacterium bovis subsp bovis AF2122/97
cggcugccacacag

SEQ ID NO: 3188157 - RNA, 21 nt, Mycobacterium bovis subsp bovis AF2122/97
cggcugccacacaggcgucca

SEQ ID NO: 3188158 - RNA, 12 nt, Mycobacterium bovis subsp bovis AF2122/97
cggcugccacgc

SEQ ID NO: 3188159 - RNA, 15 nt, Mycobacterium bovis subsp bovis AF2122/97
cggcugccacgcguc

SEQ ID NO: 3188160 - RNA, 17 nt, Mycobacterium bovis subsp bovis AF2122/97
cggcugccacgcgucgg

SEQ ID NO: 3188161 - RNA, 17 nt, Mycobacterium bovis subsp bovis AF2122/97
cggcugccagcgccgcc

SEQ ID NO: 3188162 - RNA, 18 nt, Mycobacterium bovis subsp bovis AF2122/97
cggcugccagcgccgccg

SEQ ID NO: 3188163 - RNA, 16 nt, Mycobacterium bovis subsp bovis AF2122/97
cggcugccagugccgc

SEQ ID NO: 3188164 - RNA, 17 nt, Mycobacterium bovis subsp bovis AF2122/97
cggcugccagugccgcc

SEQ ID NO: 3188165 - RNA, 23 nt, Mycobacterium bovis subsp bovis AF2122/97
cggcugccaucccgaucccggcc

SEQ ID NO: 3188166 - RNA, 19 nt, Mycobacterium bovis subsp bovis AF2122/97
cggcugcccguucugccca

SEQ ID NO: 3188167 - RNA, 17 nt, Mycobacterium bovis subsp bovis AF2122/97
cggcugccgcaccaagg

SEQ ID NO: 3188168 - RNA, 22 nt, Mycobacterium bovis subsp bovis AF2122/97
cggcugccgcaccaaggccgcc

SEQ ID NO: 3188169 - RNA, 13 nt, Mycobacterium bovis subsp bovis AF2122/97
cggcugccgcgcg

SEQ ID NO: 3188170 - RNA, 14 nt, Mycobacterium bovis subsp bovis AF2122/97
cggcugccgcgcgc

SEQ ID NO: 3188171 - RNA, 15 nt, Mycobacterium bovis subsp bovis AF2122/97
cggcugccgcgcgcu

SEQ ID NO: 3188172 - RNA, 19 nt, Mycobacterium bovis subsp bovis AF2122/97
cggcugccgcgcgcugccg

SEQ ID NO: 3188173 - RNA, 20 nt, Mycobacterium bovis subsp bovis AF2122/97
cggcugccgcgcgcugccgc

SEQ ID NO: 3188174 - RNA, 14 nt, Mycobacterium bovis subsp bovis AF2122/97
cggcugccgcucga

SEQ ID NO: 3188175 - RNA, 14 nt, Mycobacterium bovis subsp bovis AF2122/97
cggcugccgucagc

SEQ ID NO: 3188176 - RNA, 24 nt, Mycobacterium bovis subsp bovis AF2122/97
cggcugccgucuccuggucaaccg

SEQ ID NO: 3188177 - RNA, 15 nt, Mycobacterium bovis subsp bovis AF2122/97
cggcugccuccauga

SEQ ID NO: 3188178 - RNA, 20 nt, Mycobacterium bovis subsp bovis AF2122/97
cggcugcgaaagccacucgc

SEQ ID NO: 3188179 - RNA, 20 nt, Mycobacterium bovis subsp bovis AF2122/97
cggcugcgacaggacgucgg

SEQ ID NO: 3188180 - RNA, 22 nt, Mycobacterium bovis subsp bovis AF2122/97
cggcugcgccgaacaccacacc

SEQ ID NO: 3188181 - RNA, 23 nt, Mycobacterium bovis subsp bovis AF2122/97
cggcugcgccgaacaccacaccg

SEQ ID NO: 3188182 - RNA, 16 nt, Mycobacterium bovis subsp bovis AF2122/97
cggcugcggaggcggg

SEQ ID NO: 3188183 - RNA, 17 nt, Mycobacterium bovis subsp bovis AF2122/97
cggcugcggaggcgggu

SEQ ID NO: 3188184 - RNA, 22 nt, Mycobacterium bovis subsp bovis AF2122/97
cggcugcggcgucguugaggaa

SEQ ID NO: 3188185 - RNA, 16 nt, Mycobacterium bovis subsp bovis AF2122/97
cggcugcguuggcugg

SEQ ID NO: 3188186 - RNA, 23 nt, Mycobacterium bovis subsp bovis AF2122/97
cggcugcguuguguuccguugcg

SEQ ID NO: 3188187 - RNA, 16 nt, Mycobacterium bovis subsp bovis AF2122/97
cggcugcucgacggcu

SEQ ID NO: 3188188 - RNA, 20 nt, Mycobacterium bovis subsp bovis AF2122/97
cggcugcucgacggcuccga

SEQ ID NO: 3188189 - RNA, 15 nt, Mycobacterium bovis subsp bovis AF2122/97
cggcugcugcgcggu

SEQ ID NO: 3188190 - RNA, 17 nt, Mycobacterium bovis subsp bovis AF2122/97
cggcugcugcgcggugc

SEQ ID NO: 3188191 - RNA, 21 nt, Mycobacterium bovis subsp bovis AF2122/97
cggcugcugcgcggugccggc

SEQ ID NO: 3188192 - RNA, 19 nt, Mycobacterium bovis subsp bovis AF2122/97
cggcugcuuggucgcccag

SEQ ID NO: 3188193 - RNA, 18 nt, Mycobacterium bovis subsp bovis AF2122/97
cggcuggacggcgccggu

SEQ ID NO: 3188194 - RNA, 14 nt, Mycobacterium bovis subsp bovis AF2122/97
cggcuggcccaccu

SEQ ID NO: 3188195 - RNA, 18 nt, Mycobacterium bovis subsp bovis AF2122/97
cggcuggcccagcgacca

SEQ ID NO: 3188196 - RNA, 20 nt, Mycobacterium bovis subsp bovis AF2122/97
cggcuggcccgcaugccggc

SEQ ID NO: 3188197 - RNA, 16 nt, Mycobacterium bovis subsp bovis AF2122/97
cggcuggccgcgccuc

SEQ ID NO: 3188198 - RNA, 18 nt, Mycobacterium bovis subsp bovis AF2122/97
cggcuggccgcgccucgg

SEQ ID NO: 3188199 - RNA, 13 nt, Mycobacterium bovis subsp bovis AF2122/97
cggcuggcggccu

SEQ ID NO: 3188200 - RNA, 16 nt, Mycobacterium bovis subsp bovis AF2122/97
cggcugggcgccacca

SEQ ID NO: 3188201 - RNA, 15 nt, Mycobacterium bovis subsp bovis AF2122/97
cggcugggcggucgg

SEQ ID NO: 3188202 - RNA, 20 nt, Mycobacterium bovis subsp bovis AF2122/97
cggcuggggccccgcgccgg

SEQ ID NO: 3188203 - RNA, 14 nt, Mycobacterium bovis subsp bovis AF2122/97
cggcuggggccgcu

SEQ ID NO: 3188204 - RNA, 15 nt, Mycobacterium bovis subsp bovis AF2122/97
cggcuggucacccgu

SEQ ID NO: 3188205 - RNA, 20 nt, Mycobacterium bovis subsp bovis AF2122/97
cggcugguccuccuucggug

SEQ ID NO: 3188206 - RNA, 19 nt, Mycobacterium bovis subsp bovis AF2122/97
cggcuggucgcugcugcga

SEQ ID NO: 3188207 - RNA, 20 nt, Mycobacterium bovis subsp bovis AF2122/97
cggcuggugccuuaccaccg

SEQ ID NO: 3188208 - RNA, 23 nt, Mycobacterium bovis subsp bovis AF2122/97
cggcuggugggacgcggccgagg

SEQ ID NO: 3188209 - RNA, 14 nt, Mycobacterium bovis subsp bovis AF2122/97
cggcugguggggga

SEQ ID NO: 3188210 - RNA, 23 nt, Mycobacterium bovis subsp bovis AF2122/97
cggcuggugggggagcggccgcc

SEQ ID NO: 3188211 - RNA, 19 nt, Mycobacterium bovis subsp bovis AF2122/97
cggcugguguccagccagg

SEQ ID NO: 3188212 - RNA, 22 nt, Mycobacterium bovis subsp bovis AF2122/97
cggcugguguccagccaggcga

SEQ ID NO: 3188213 - RNA, 13 nt, Mycobacterium bovis subsp bovis AF2122/97
cggcuggugucgg

SEQ ID NO: 3188214 - RNA, 15 nt, Mycobacterium bovis subsp bovis AF2122/97
cggcuggugucgggc

SEQ ID NO: 3188215 - RNA, 20 nt, Mycobacterium bovis subsp bovis AF2122/97
cggcugucacaagccugccg

SEQ ID NO: 3188216 - RNA, 20 nt, Mycobacterium bovis subsp bovis AF2122/97
cggcugucacgccugccacc

SEQ ID NO: 3188217 - RNA, 12 nt, Mycobacterium bovis subsp bovis AF2122/97
cggcugucggcc

SEQ ID NO: 3188218 - RNA, 12 nt, Mycobacterium bovis subsp bovis AF2122/97
cggcugucgguc

SEQ ID NO: 3188219 - RNA, 20 nt, Mycobacterium bovis subsp bovis AF2122/97
cggcuguggucgcugcugcc

SEQ ID NO: 3188220 - RNA, 21 nt, Mycobacterium bovis subsp bovis AF2122/97
cggcuguuaggcgauaucgca

SEQ ID NO: 3188221 - RNA, 14 nt, Mycobacterium bovis subsp bovis AF2122/97
cggcuguucucgcc

SEQ ID NO: 3188222 - RNA, 15 nt, Mycobacterium bovis subsp bovis AF2122/97
cggcuguucucgccg

SEQ ID NO: 3188223 - RNA, 16 nt, Mycobacterium bovis subsp bovis AF2122/97
cggcuguucucgccga

SEQ ID NO: 3188224 - RNA, 17 nt, Mycobacterium bovis subsp bovis AF2122/97
cggcuguugcggcggcg

SEQ ID NO: 3188225 - RNA, 18 nt, Mycobacterium bovis subsp bovis AF2122/97
cggcuguugcggcggcgc

SEQ ID NO: 3188226 - RNA, 19 nt, Mycobacterium bovis subsp bovis AF2122/97
cggcuuaaggcccuggccg

SEQ ID NO: 3188227 - RNA, 14 nt, Mycobacterium bovis subsp bovis AF2122/97
cggcuuaccggcgg

SEQ ID NO: 3188228 - RNA, 19 nt, Mycobacterium bovis subsp bovis AF2122/97
cggcuuagaacgugcuggu

SEQ ID NO: 3188229 - RNA, 18 nt, Mycobacterium bovis subsp bovis AF2122/97
cggcuucacugagaucca

SEQ ID NO: 3188230 - RNA, 18 nt, Mycobacterium bovis subsp bovis AF2122/97
cggcuucaguccggcccc

SEQ ID NO: 3188231 - RNA, 23 nt, Mycobacterium bovis subsp bovis AF2122/97
cggcuuccaacucggcggccagc

SEQ ID NO: 3188232 - RNA, 14 nt, Mycobacterium bovis subsp bovis AF2122/97
cggcuuccccagca

SEQ ID NO: 3188233 - RNA, 23 nt, Mycobacterium bovis subsp bovis AF2122/97
cggcuuccccagcaguucgccgc

SEQ ID NO: 3188234 - RNA, 15 nt, Mycobacterium bovis subsp bovis AF2122/97
cggcuucgacgucgg

SEQ ID NO: 3188235 - RNA, 18 nt, Mycobacterium bovis subsp bovis AF2122/97
cggcuucgacgucggcga

SEQ ID NO: 3188236 - RNA, 14 nt, Mycobacterium bovis subsp bovis AF2122/97
cggcuucgccccga

SEQ ID NO: 3188237 - RNA, 15 nt, Mycobacterium bovis subsp bovis AF2122/97
cggcuucgccgcgcu

SEQ ID NO: 3188238 - RNA, 20 nt, Mycobacterium bovis subsp bovis AF2122/97
cggcuucgcgguuggcggcg

SEQ ID NO: 3188239 - RNA, 21 nt, Mycobacterium bovis subsp bovis AF2122/97
cggcuucgcgguuggcggcga

SEQ ID NO: 3188240 - RNA, 22 nt, Mycobacterium bovis subsp bovis AF2122/97
cggcuucggcagaccggcaucg

SEQ ID NO: 3188241 - RNA, 14 nt, Mycobacterium bovis subsp bovis AF2122/97
cggcuucggcagcc

SEQ ID NO: 3188242 - RNA, 15 nt, Mycobacterium bovis subsp bovis AF2122/97
cggcuucggcagccg

SEQ ID NO: 3188243 - RNA, 16 nt, Mycobacterium bovis subsp bovis AF2122/97
cggcuucggcagccgc

SEQ ID NO: 3188244 - RNA, 19 nt, Mycobacterium bovis subsp bovis AF2122/97
cggcuucggcagccgcaua

SEQ ID NO: 3188245 - RNA, 12 nt, Mycobacterium bovis subsp bovis AF2122/97
cggcuucggcga

SEQ ID NO: 3188246 - RNA, 15 nt, Mycobacterium bovis subsp bovis AF2122/97
cggcuucggcgagcg

SEQ ID NO: 3188247 - RNA, 21 nt, Mycobacterium bovis subsp bovis AF2122/97
cggcuucggguguucgcgcgc

SEQ ID NO: 3188248 - RNA, 16 nt, Mycobacterium bovis subsp bovis AF2122/97
cggcuucguccaccgc

SEQ ID NO: 3188249 - RNA, 18 nt, Mycobacterium bovis subsp bovis AF2122/97
cggcuucgucgacaucgc

SEQ ID NO: 3188250 - RNA, 22 nt, Mycobacterium bovis subsp bovis AF2122/97
cggcuucgucgacaucgccaua

SEQ ID NO: 3188251 - RNA, 15 nt, Mycobacterium bovis subsp bovis AF2122/97
cggcuucgucggcca

SEQ ID NO: 3188252 - RNA, 18 nt, Mycobacterium bovis subsp bovis AF2122/97
cggcuucguggcggcgcg

SEQ ID NO: 3188253 - RNA, 21 nt, Mycobacterium bovis subsp bovis AF2122/97
cggcuucuucuucuugaccgc

SEQ ID NO: 3188254 - RNA, 18 nt, Mycobacterium bovis subsp bovis AF2122/97
cggcuucuugaccacgaa

SEQ ID NO: 3188255 - RNA, 17 nt, Mycobacterium bovis subsp bovis AF2122/97
cggcuugaucagccgcc

SEQ ID NO: 3188256 - RNA, 17 nt, Mycobacterium bovis subsp bovis AF2122/97
cggcuugcccuccgggu

SEQ ID NO: 3188257 - RNA, 12 nt, Mycobacterium bovis subsp bovis AF2122/97
cggcuugccgcc

SEQ ID NO: 3188258 - RNA, 13 nt, Mycobacterium bovis subsp bovis AF2122/97
cggcuugcugccc

SEQ ID NO: 3188259 - RNA, 20 nt, Mycobacterium bovis subsp bovis AF2122/97
cggcuuggccuagccgcggc

SEQ ID NO: 3188260 - RNA, 21 nt, Mycobacterium bovis subsp bovis AF2122/97
cggcuuggccuagccgcggca

SEQ ID NO: 3188261 - RNA, 21 nt, Mycobacterium bovis subsp bovis AF2122/97
cggcuuggccuuugccgucga

SEQ ID NO: 3188262 - RNA, 23 nt, Mycobacterium bovis subsp bovis AF2122/97
cggcuuggccuuugccgucgagg

SEQ ID NO: 3188263 - RNA, 14 nt, Mycobacterium bovis subsp bovis AF2122/97
cggcuuggcggcga

SEQ ID NO: 3188264 - RNA, 24 nt, Mycobacterium bovis subsp bovis AF2122/97
cggcuuggcggcgaucaacucggg

SEQ ID NO: 3188265 - RNA, 19 nt, Mycobacterium bovis subsp bovis AF2122/97
cggcuugggaaacccggcc

SEQ ID NO: 3188266 - RNA, 13 nt, Mycobacterium bovis subsp bovis AF2122/97
cggcuugggccag

SEQ ID NO: 3188267 - RNA, 15 nt, Mycobacterium bovis subsp bovis AF2122/97
cggcuugggcuugcg

SEQ ID NO: 3188268 - RNA, 19 nt, Mycobacterium bovis subsp bovis AF2122/97
cggcuugggcuugcgccgg

SEQ ID NO: 3188269 - RNA, 18 nt, Mycobacterium bovis subsp bovis AF2122/97
cggcuuggugaaccgcgc

SEQ ID NO: 3188270 - RNA, 19 nt, Mycobacterium bovis subsp bovis AF2122/97
cggcuuggugaaccgcgcg

SEQ ID NO: 3188271 - RNA, 23 nt, Mycobacterium bovis subsp bovis AF2122/97
cggcuuggugaaccgcgcggcga

SEQ ID NO: 3188272 - RNA, 23 nt, Mycobacterium bovis subsp bovis AF2122/97
cggcuuguccucacaugcccgga

SEQ ID NO: 3188273 - RNA, 20 nt, Mycobacterium bovis subsp bovis AF2122/97
cggcuugucgaccacgaccg

SEQ ID NO: 3188274 - RNA, 14 nt, Mycobacterium bovis subsp bovis AF2122/97
cggcuuucccaccg

SEQ ID NO: 3188275 - RNA, 19 nt, Mycobacterium bovis subsp bovis AF2122/97
cggcuuucccaccgcuucc

SEQ ID NO: 3188276 - RNA, 18 nt, Mycobacterium bovis subsp bovis AF2122/97
cggcuuugacgcccggca

SEQ ID NO: 3188277 - RNA, 16 nt, Mycobacterium bovis subsp bovis AF2122/97
cggcuuugagccgcuc

SEQ ID NO: 3188278 - RNA, 19 nt, Mycobacterium bovis subsp bovis AF2122/97
cggcuuugcggcgcgacca

SEQ ID NO: 3188279 - RNA, 15 nt, Mycobacterium bovis subsp bovis AF2122/97
cggcuuugcuugccg

SEQ ID NO: 3188280 - RNA, 22 nt, Mycobacterium bovis subsp bovis AF2122/97
cggcuuuuccggcauugccgcc

SEQ ID NO: 3188281 - RNA, 16 nt, Mycobacterium bovis subsp bovis AF2122/97
cggcuuuucgacgcug

SEQ ID NO: 3188282 - RNA, 11 nt, Mycobacterium bovis subsp bovis AF2122/97
cggcuuuugcg

SEQ ID NO: 3188283 - RNA, 16 nt, Mycobacterium bovis subsp bovis AF2122/97
cgggaaaccgaggaug

SEQ ID NO: 3188284 - RNA, 16 nt, Mycobacterium bovis subsp bovis AF2122/97
cgggaaaguagcgugc

SEQ ID NO: 3188285 - RNA, 19 nt, Mycobacterium bovis subsp bovis AF2122/97
cgggaaaguuguaucgcag

SEQ ID NO: 3188286 - RNA, 20 nt, Mycobacterium bovis subsp bovis AF2122/97
cgggaacaacggcguaaucg

SEQ ID NO: 3188287 - RNA, 21 nt, Mycobacterium bovis subsp bovis AF2122/97
cgggaacaacggcguaaucgg

SEQ ID NO: 3188288 - RNA, 15 nt, Mycobacterium bovis subsp bovis AF2122/97
cgggaaccaacacca

SEQ ID NO: 3188289 - RNA, 18 nt, Mycobacterium bovis subsp bovis AF2122/97
cgggaaccaacaccaggu

SEQ ID NO: 3188290 - RNA, 16 nt, Mycobacterium bovis subsp bovis AF2122/97
cgggaaccacggucag

SEQ ID NO: 3188291 - RNA, 22 nt, Mycobacterium bovis subsp bovis AF2122/97
cgggaacgagccacgccagcgu

SEQ ID NO: 3188292 - RNA, 21 nt, Mycobacterium bovis subsp bovis AF2122/97
cgggaacgaguacgggcaggc

SEQ ID NO: 3188293 - RNA, 13 nt, Mycobacterium bovis subsp bovis AF2122/97
cgggaacgaugcc

SEQ ID NO: 3188294 - RNA, 15 nt, Mycobacterium bovis subsp bovis AF2122/97
cgggaacgaugccgc

SEQ ID NO: 3188295 - RNA, 18 nt, Mycobacterium bovis subsp bovis AF2122/97
cgggaacgaugccgccgg

SEQ ID NO: 3188296 - RNA, 19 nt, Mycobacterium bovis subsp bovis AF2122/97
cgggaacgaugccgccggc

SEQ ID NO: 3188297 - RNA, 21 nt, Mycobacterium bovis subsp bovis AF2122/97
cgggaacgaugccgccggcgg

SEQ ID NO: 3188298 - RNA, 14 nt, Mycobacterium bovis subsp bovis AF2122/97
cgggaacgccgaac

SEQ ID NO: 3188299 - RNA, 14 nt, Mycobacterium bovis subsp bovis AF2122/97
cgggaacgccucag

SEQ ID NO: 3188300 - RNA, 14 nt, Mycobacterium bovis subsp bovis AF2122/97
cgggaacgcggcgg

SEQ ID NO: 3188301 - RNA, 21 nt, Mycobacterium bovis subsp bovis AF2122/97
cgggaacggugccgaucgggg

SEQ ID NO: 3188302 - RNA, 23 nt, Mycobacterium bovis subsp bovis AF2122/97
cgggaacggugccgaucggggug

SEQ ID NO: 3188303 - RNA, 22 nt, Mycobacterium bovis subsp bovis AF2122/97
cgggaacguccagccguggcgg

SEQ ID NO: 3188304 - RNA, 22 nt, Mycobacterium bovis subsp bovis AF2122/97
cgggaacuucgccgaagcgccg

SEQ ID NO: 3188305 - RNA, 16 nt, Mycobacterium bovis subsp bovis AF2122/97
cgggaagaacaucacc

SEQ ID NO: 3188306 - RNA, 16 nt, Mycobacterium bovis subsp bovis AF2122/97
cgggaagacgucggga

SEQ ID NO: 3188307 - RNA, 21 nt, Mycobacterium bovis subsp bovis AF2122/97
cgggaagccgcaucuggcugu

SEQ ID NO: 3188308 - RNA, 14 nt, Mycobacterium bovis subsp bovis AF2122/97
cgggaagccgcgcc

SEQ ID NO: 3188309 - RNA, 12 nt, Mycobacterium bovis subsp bovis AF2122/97
cgggaaggaacc

SEQ ID NO: 3188310 - RNA, 19 nt, Mycobacterium bovis subsp bovis AF2122/97
cgggaaggaaccgggcaaa

SEQ ID NO: 3188311 - RNA, 13 nt, Mycobacterium bovis subsp bovis AF2122/97
cgggaaggugacg

SEQ ID NO: 3188312 - RNA, 12 nt, Mycobacterium bovis subsp bovis AF2122/97
cgggaagucggg

SEQ ID NO: 3188313 - RNA, 18 nt, Mycobacterium bovis subsp bovis AF2122/97
cgggaagucgggccggua

SEQ ID NO: 3188314 - RNA, 14 nt, Mycobacterium bovis subsp bovis AF2122/97
cgggaagugcaccc

SEQ ID NO: 3188315 - RNA, 17 nt, Mycobacterium bovis subsp bovis AF2122/97
cgggaagugcacccggu

SEQ ID NO: 3188316 - RNA, 15 nt, Mycobacterium bovis subsp bovis AF2122/97
cgggaaguucgucgg

SEQ ID NO: 3188317 - RNA, 17 nt, Mycobacterium bovis subsp bovis AF2122/97
cgggaaguugcccaggu

SEQ ID NO: 3188318 - RNA, 15 nt, Mycobacterium bovis subsp bovis AF2122/97
cgggaauccggugau

SEQ ID NO: 3188319 - RNA, 14 nt, Mycobacterium bovis subsp bovis AF2122/97
cgggaaucgcucgc

SEQ ID NO: 3188320 - RNA, 21 nt, Mycobacterium bovis subsp bovis AF2122/97
cgggaaucgcucgcgccaggu

SEQ ID NO: 3188321 - RNA, 15 nt, Mycobacterium bovis subsp bovis AF2122/97
cgggaauggcgacca

SEQ ID NO: 3188322 - RNA, 22 nt, Mycobacterium bovis subsp bovis AF2122/97
cgggaaugucuuuggucgccgg

SEQ ID NO: 3188323 - RNA, 19 nt, Mycobacterium bovis subsp bovis AF2122/97
cgggaauuucgucggccau

SEQ ID NO: 3188324 - RNA, 21 nt, Mycobacterium bovis subsp bovis AF2122/97
cgggaauuucgucggccaugg

SEQ ID NO: 3188325 - RNA, 18 nt, Mycobacterium bovis subsp bovis AF2122/97
cgggacaaagccgaacga

SEQ ID NO: 3188326 - RNA, 24 nt, Mycobacterium bovis subsp bovis AF2122/97
cgggacaaagccgaacgacagcag

SEQ ID NO: 3188327 - RNA, 19 nt, Mycobacterium bovis subsp bovis AF2122/97
cgggacaaguucgguagcg

SEQ ID NO: 3188328 - RNA, 17 nt, Mycobacterium bovis subsp bovis AF2122/97
cgggacaccaccgcccg

SEQ ID NO: 3188329 - RNA, 20 nt, Mycobacterium bovis subsp bovis AF2122/97
cgggacacgucgcgccaggc

SEQ ID NO: 3188330 - RNA, 22 nt, Mycobacterium bovis subsp bovis AF2122/97
cgggacacgucgcgccaggcgc

SEQ ID NO: 3188331 - RNA, 15 nt, Mycobacterium bovis subsp bovis AF2122/97
cgggacagcgccggg

SEQ ID NO: 3188332 - RNA, 18 nt, Mycobacterium bovis subsp bovis AF2122/97
cgggaccaggccaacggc

SEQ ID NO: 3188333 - RNA, 15 nt, Mycobacterium bovis subsp bovis AF2122/97
cgggaccauagucgc

SEQ ID NO: 3188334 - RNA, 17 nt, Mycobacterium bovis subsp bovis AF2122/97
cgggaccauagucgccg

SEQ ID NO: 3188335 - RNA, 22 nt, Mycobacterium bovis subsp bovis AF2122/97
cgggaccgaucuuggccaccgc

SEQ ID NO: 3188336 - RNA, 14 nt, Mycobacterium bovis subsp bovis AF2122/97
cgggaccgccccgg

SEQ ID NO: 3188337 - RNA, 15 nt, Mycobacterium bovis subsp bovis AF2122/97
cgggaccgccccggc

SEQ ID NO: 3188338 - RNA, 14 nt, Mycobacterium bovis subsp bovis AF2122/97
cgggaccggcuugc

SEQ ID NO: 3188339 - RNA, 17 nt, Mycobacterium bovis subsp bovis AF2122/97
cgggaccggggacgcgc

SEQ ID NO: 3188340 - RNA, 19 nt, Mycobacterium bovis subsp bovis AF2122/97
cgggaccggggacgcgccc

SEQ ID NO: 3188341 - RNA, 18 nt, Mycobacterium bovis subsp bovis AF2122/97
cgggaccgugacguaucg

SEQ ID NO: 3188342 - RNA, 17 nt, Mycobacterium bovis subsp bovis AF2122/97
cgggaccuucgagccgc

SEQ ID NO: 3188343 - RNA, 18 nt, Mycobacterium bovis subsp bovis AF2122/97
cgggaccuucgagccgca

SEQ ID NO: 3188344 - RNA, 17 nt, Mycobacterium bovis subsp bovis AF2122/97
cgggacgaaaaaaucgu

SEQ ID NO: 3188345 - RNA, 20 nt, Mycobacterium bovis subsp bovis AF2122/97
cgggacgaaaaaaucgugcg

SEQ ID NO: 3188346 - RNA, 20 nt, Mycobacterium bovis subsp bovis AF2122/97
cgggacgaaccggccgacgc

SEQ ID NO: 3188347 - RNA, 23 nt, Mycobacterium bovis subsp bovis AF2122/97
cgggacgaaccggccgacgcugg

SEQ ID NO: 3188348 - RNA, 20 nt, Mycobacterium bovis subsp bovis AF2122/97
cgggacgaaucccgcgcccg

SEQ ID NO: 3188349 - RNA, 21 nt, Mycobacterium bovis subsp bovis AF2122/97
cgggacgcaugcgugacccga

SEQ ID NO: 3188350 - RNA, 22 nt, Mycobacterium bovis subsp bovis AF2122/97
cgggacgcaugcgugacccgac

SEQ ID NO: 3188351 - RNA, 13 nt, Mycobacterium bovis subsp bovis AF2122/97
cgggacgccccgu

SEQ ID NO: 3188352 - RNA, 13 nt, Mycobacterium bovis subsp bovis AF2122/97
cgggacgccgaau

SEQ ID NO: 3188353 - RNA, 23 nt, Mycobacterium bovis subsp bovis AF2122/97
cgggacgccgcccccguggggug

SEQ ID NO: 3188354 - RNA, 11 nt, Mycobacterium bovis subsp bovis AF2122/97
cgggacgccgu

SEQ ID NO: 3188355 - RNA, 21 nt, Mycobacterium bovis subsp bovis AF2122/97
cgggacgccuugaucggcgag

SEQ ID NO: 3188356 - RNA, 18 nt, Mycobacterium bovis subsp bovis AF2122/97
cgggacgcgacucggcgg

SEQ ID NO: 3188357 - RNA, 15 nt, Mycobacterium bovis subsp bovis AF2122/97
cgggacgcugccggu

SEQ ID NO: 3188358 - RNA, 13 nt, Mycobacterium bovis subsp bovis AF2122/97
cgggacgucaccg

SEQ ID NO: 3188359 - RNA, 15 nt, Mycobacterium bovis subsp bovis AF2122/97
cgggacgucaccguu

SEQ ID NO: 3188360 - RNA, 17 nt, Mycobacterium bovis subsp bovis AF2122/97
cgggacguuguccaccg

SEQ ID NO: 3188361 - RNA, 18 nt, Mycobacterium bovis subsp bovis AF2122/97
cgggacguuguccaccgc

SEQ ID NO: 3188362 - RNA, 23 nt, Mycobacterium bovis subsp bovis AF2122/97
cgggacguuguccaccgccacca

SEQ ID NO: 3188363 - RNA, 16 nt, Mycobacterium bovis subsp bovis AF2122/97
cgggacuaccacccgc

SEQ ID NO: 3188364 - RNA, 17 nt, Mycobacterium bovis subsp bovis AF2122/97
cgggacuaccacccgca

SEQ ID NO: 3188365 - RNA, 22 nt, Mycobacterium bovis subsp bovis AF2122/97
cgggacuaccacccgcaggucg

SEQ ID NO: 3188366 - RNA, 16 nt, Mycobacterium bovis subsp bovis AF2122/97
cgggacuagguccgau

SEQ ID NO: 3188367 - RNA, 19 nt, Mycobacterium bovis subsp bovis AF2122/97
cgggacucccgcgcgggcg

SEQ ID NO: 3188368 - RNA, 16 nt, Mycobacterium bovis subsp bovis AF2122/97
cgggacugacccugau

SEQ ID NO: 3188369 - RNA, 17 nt, Mycobacterium bovis subsp bovis AF2122/97
cgggacugacccugauc

SEQ ID NO: 3188370 - RNA, 16 nt, Mycobacterium bovis subsp bovis AF2122/97
cgggacugcagcgcgg

SEQ ID NO: 3188371 - RNA, 15 nt, Mycobacterium bovis subsp bovis AF2122/97
cgggacuucccgcga

SEQ ID NO: 3188372 - RNA, 21 nt, Mycobacterium bovis subsp bovis AF2122/97
cgggacuuccggggagcagag

SEQ ID NO: 3188373 - RNA, 17 nt, Mycobacterium bovis subsp bovis AF2122/97
cgggacuugucggggug

SEQ ID NO: 3188374 - RNA, 22 nt, Mycobacterium bovis subsp bovis AF2122/97
cgggagaaaacggcggcgccgg

SEQ ID NO: 3188375 - RNA, 23 nt, Mycobacterium bovis subsp bovis AF2122/97
cgggagaaaacggcggcgccggu

SEQ ID NO: 3188376 - RNA, 16 nt, Mycobacterium bovis subsp bovis AF2122/97
cgggagaacgugccga

SEQ ID NO: 3188377 - RNA, 19 nt, Mycobacterium bovis subsp bovis AF2122/97
cgggagacguaaccgcugg

SEQ ID NO: 3188378 - RNA, 20 nt, Mycobacterium bovis subsp bovis AF2122/97
cgggagaugccguauagcgc

SEQ ID NO: 3188379 - RNA, 15 nt, Mycobacterium bovis subsp bovis AF2122/97
cgggagcaccgacca

SEQ ID NO: 3188380 - RNA, 20 nt, Mycobacterium bovis subsp bovis AF2122/97
cgggagcccgagcucaccgc

SEQ ID NO: 3188381 - RNA, 15 nt, Mycobacterium bovis subsp bovis AF2122/97
cgggagccgcacccg

SEQ ID NO: 3188382 - RNA, 13 nt, Mycobacterium bovis subsp bovis AF2122/97
cgggagccggcug

SEQ ID NO: 3188383 - RNA, 18 nt, Mycobacterium bovis subsp bovis AF2122/97
cgggagcggaauggcgcc

SEQ ID NO: 3188384 - RNA, 12 nt, Mycobacterium bovis subsp bovis AF2122/97
cgggagcggcug

SEQ ID NO: 3188385 - RNA, 14 nt, Mycobacterium bovis subsp bovis AF2122/97
cgggagcggcugcg

SEQ ID NO: 3188386 - RNA, 18 nt, Mycobacterium bovis subsp bovis AF2122/97
cgggagcggcugcggcaa

SEQ ID NO: 3188387 - RNA, 14 nt, Mycobacterium bovis subsp bovis AF2122/97
cgggagcugaucac

SEQ ID NO: 3188388 - RNA, 15 nt, Mycobacterium bovis subsp bovis AF2122/97
cgggaggacaccagc

SEQ ID NO: 3188389 - RNA, 22 nt, Mycobacterium bovis subsp bovis AF2122/97
cgggaggacaccagcuggaaga

SEQ ID NO: 3188390 - RNA, 15 nt, Mycobacterium bovis subsp bovis AF2122/97
cgggaggcagcgcga

SEQ ID NO: 3188391 - RNA, 13 nt, Mycobacterium bovis subsp bovis AF2122/97
cgggaggccaccg

SEQ ID NO: 3188392 - RNA, 14 nt, Mycobacterium bovis subsp bovis AF2122/97
cgggaggccaccgc

SEQ ID NO: 3188393 - RNA, 16 nt, Mycobacterium bovis subsp bovis AF2122/97
cgggaggccaccgcga

SEQ ID NO: 3188394 - RNA, 21 nt, Mycobacterium bovis subsp bovis AF2122/97
cgggaggccggcuaccgcgcu

SEQ ID NO: 3188395 - RNA, 16 nt, Mycobacterium bovis subsp bovis AF2122/97
cgggaggcggcgccgc

SEQ ID NO: 3188396 - RNA, 22 nt, Mycobacterium bovis subsp bovis AF2122/97
cgggagucaccgccgucggguu

SEQ ID NO: 3188397 - RNA, 19 nt, Mycobacterium bovis subsp bovis AF2122/97
cgggagucgguaucggcag

SEQ ID NO: 3188398 - RNA, 12 nt, Mycobacterium bovis subsp bovis AF2122/97
cgggagucgucg

SEQ ID NO: 3188399 - RNA, 17 nt, Mycobacterium bovis subsp bovis AF2122/97
cgggagucgucgagcug

SEQ ID NO: 3188400 - RNA, 15 nt, Mycobacterium bovis subsp bovis AF2122/97
cgggagucuucggcg

SEQ ID NO: 3188401 - RNA, 16 nt, Mycobacterium bovis subsp bovis AF2122/97
cgggagucuucggcga

SEQ ID NO: 3188402 - RNA, 13 nt, Mycobacterium bovis subsp bovis AF2122/97
cgggagugcgccg

SEQ ID NO: 3188403 - RNA, 15 nt, Mycobacterium bovis subsp bovis AF2122/97
cgggaguguguccga

SEQ ID NO: 3188404 - RNA, 23 nt, Mycobacterium bovis subsp bovis AF2122/97
cgggaguucggggugcgcccagg

SEQ ID NO: 3188405 - RNA, 14 nt, Mycobacterium bovis subsp bovis AF2122/97
cgggauaacccagc

SEQ ID NO: 3188406 - RNA, 23 nt, Mycobacterium bovis subsp bovis AF2122/97
cgggauaacccagcaccacaacg

SEQ ID NO: 3188407 - RNA, 19 nt, Mycobacterium bovis subsp bovis AF2122/97
cgggauaccgcucagggug

SEQ ID NO: 3188408 - RNA, 19 nt, Mycobacterium bovis subsp bovis AF2122/97
cgggauagacgaccccggu

SEQ ID NO: 3188409 - RNA, 16 nt, Mycobacterium bovis subsp bovis AF2122/97
cgggauagccguucgg

SEQ ID NO: 3188410 - RNA, 19 nt, Mycobacterium bovis subsp bovis AF2122/97
cgggauaggacaccgucau

SEQ ID NO: 3188411 - RNA, 20 nt, Mycobacterium bovis subsp bovis AF2122/97
cgggauaguuuucggccgcc

SEQ ID NO: 3188412 - RNA, 22 nt, Mycobacterium bovis subsp bovis AF2122/97
cgggauaguuuucggccgccag

SEQ ID NO: 3188413 - RNA, 16 nt, Mycobacterium bovis subsp bovis AF2122/97
cgggauauccggucgc

SEQ ID NO: 3188414 - RNA, 14 nt, Mycobacterium bovis subsp bovis AF2122/97
cgggauaucgucga

SEQ ID NO: 3188415 - RNA, 19 nt, Mycobacterium bovis subsp bovis AF2122/97
cgggauaucgucgacgccc

SEQ ID NO: 3188416 - RNA, 21 nt, Mycobacterium bovis subsp bovis AF2122/97
cgggauaucgucgacgcccau

SEQ ID NO: 3188417 - RNA, 15 nt, Mycobacterium bovis subsp bovis AF2122/97
cgggaucaccgauca

SEQ ID NO: 3188418 - RNA, 13 nt, Mycobacterium bovis subsp bovis AF2122/97
cgggaucagcgua

SEQ ID NO: 3188419 - RNA, 20 nt, Mycobacterium bovis subsp bovis AF2122/97
cgggaucaugaccaucgagg

SEQ ID NO: 3188420 - RNA, 19 nt, Mycobacterium bovis subsp bovis AF2122/97
cgggauccacccagugcca

SEQ ID NO: 3188421 - RNA, 21 nt, Mycobacterium bovis subsp bovis AF2122/97
cgggauccacccagugccacg

SEQ ID NO: 3188422 - RNA, 17 nt, Mycobacterium bovis subsp bovis AF2122/97
cgggauccaggcccagc

SEQ ID NO: 3188423 - RNA, 21 nt, Mycobacterium bovis subsp bovis AF2122/97
cgggaucccacggcgggcgag

SEQ ID NO: 3188424 - RNA, 13 nt, Mycobacterium bovis subsp bovis AF2122/97
cgggauccgcgcg

SEQ ID NO: 3188425 - RNA, 15 nt, Mycobacterium bovis subsp bovis AF2122/97
cgggaucgacccgcc

SEQ ID NO: 3188426 - RNA, 17 nt, Mycobacterium bovis subsp bovis AF2122/97
cgggaucgacccgccca

SEQ ID NO: 3188427 - RNA, 16 nt, Mycobacterium bovis subsp bovis AF2122/97
cgggaucgaucugcgg

SEQ ID NO: 3188428 - RNA, 13 nt, Mycobacterium bovis subsp bovis AF2122/97
cgggaucgccaug

SEQ ID NO: 3188429 - RNA, 14 nt, Mycobacterium bovis subsp bovis AF2122/97
cgggaucgccaugu

SEQ ID NO: 3188430 - RNA, 22 nt, Mycobacterium bovis subsp bovis AF2122/97
cgggaucgcccaggcgcgacgu

SEQ ID NO: 3188431 - RNA, 21 nt, Mycobacterium bovis subsp bovis AF2122/97
cgggaucgccguccagcaaua

SEQ ID NO: 3188432 - RNA, 23 nt, Mycobacterium bovis subsp bovis AF2122/97
cgggaucgcugccagcggccggg

SEQ ID NO: 3188433 - RNA, 12 nt, Mycobacterium bovis subsp bovis AF2122/97
cgggaucggcgu

SEQ ID NO: 3188434 - RNA, 13 nt, Mycobacterium bovis subsp bovis AF2122/97
cgggaucggcguc

SEQ ID NO: 3188435 - RNA, 19 nt, Mycobacterium bovis subsp bovis AF2122/97
cgggaucggcguccaucac

SEQ ID NO: 3188436 - RNA, 21 nt, Mycobacterium bovis subsp bovis AF2122/97
cgggaucgggcccuccggcgc

SEQ ID NO: 3188437 - RNA, 19 nt, Mycobacterium bovis subsp bovis AF2122/97
cgggaucgguggcggcacg

SEQ ID NO: 3188438 - RNA, 21 nt, Mycobacterium bovis subsp bovis AF2122/97
cgggaucgguggcggcacgca

SEQ ID NO: 3188439 - RNA, 16 nt, Mycobacterium bovis subsp bovis AF2122/97
cgggaucgucaggccc

SEQ ID NO: 3188440 - RNA, 21 nt, Mycobacterium bovis subsp bovis AF2122/97
cgggaucgucaggcccauggc

SEQ ID NO: 3188441 - RNA, 19 nt, Mycobacterium bovis subsp bovis AF2122/97
cgggaucucgaaggccgcc

SEQ ID NO: 3188442 - RNA, 20 nt, Mycobacterium bovis subsp bovis AF2122/97
cgggaucugagggcucggug

SEQ ID NO: 3188443 - RNA, 15 nt, Mycobacterium bovis subsp bovis AF2122/97
cgggaucugcgccgc

SEQ ID NO: 3188444 - RNA, 17 nt, Mycobacterium bovis subsp bovis AF2122/97
cgggaucugcgccgcgc

SEQ ID NO: 3188445 - RNA, 18 nt, Mycobacterium bovis subsp bovis AF2122/97
cgggaucugcgccgcgcg

SEQ ID NO: 3188446 - RNA, 14 nt, Mycobacterium bovis subsp bovis AF2122/97
cgggaucugcuccg

SEQ ID NO: 3188447 - RNA, 15 nt, Mycobacterium bovis subsp bovis AF2122/97
cgggaucugcuccgc

SEQ ID NO: 3188448 - RNA, 19 nt, Mycobacterium bovis subsp bovis AF2122/97
cgggaucugcuccgcagca

SEQ ID NO: 3188449 - RNA, 18 nt, Mycobacterium bovis subsp bovis AF2122/97
cgggaugaauacgcguug

SEQ ID NO: 3188450 - RNA, 16 nt, Mycobacterium bovis subsp bovis AF2122/97
cgggaugacugggcaa

SEQ ID NO: 3188451 - RNA, 13 nt, Mycobacterium bovis subsp bovis AF2122/97
cgggaugagauca

SEQ ID NO: 3188452 - RNA, 19 nt, Mycobacterium bovis subsp bovis AF2122/97
cgggaugcagcugcccggc

SEQ ID NO: 3188453 - RNA, 14 nt, Mycobacterium bovis subsp bovis AF2122/97
cgggaugccgccgc

SEQ ID NO: 3188454 - RNA, 14 nt, Mycobacterium bovis subsp bovis AF2122/97
cgggaugccggcga

SEQ ID NO: 3188455 - RNA, 15 nt, Mycobacterium bovis subsp bovis AF2122/97
cgggaugcgcgcccg

SEQ ID NO: 3188456 - RNA, 21 nt, Mycobacterium bovis subsp bovis AF2122/97
cgggaugcgcguuacccaucg

SEQ ID NO: 3188457 - RNA, 17 nt, Mycobacterium bovis subsp bovis AF2122/97
cgggaugcggucgauca

SEQ ID NO: 3188458 - RNA, 15 nt, Mycobacterium bovis subsp bovis AF2122/97
cgggaugcucgaucc

SEQ ID NO: 3188459 - RNA, 14 nt, Mycobacterium bovis subsp bovis AF2122/97
cgggauggacacca

SEQ ID NO: 3188460 - RNA, 17 nt, Mycobacterium bovis subsp bovis AF2122/97
cgggauggacaccaccu

SEQ ID NO: 3188461 - RNA, 19 nt, Mycobacterium bovis subsp bovis AF2122/97
cgggauggacaccaccucg

SEQ ID NO: 3188462 - RNA, 13 nt, Mycobacterium bovis subsp bovis AF2122/97
cgggauggacagc

SEQ ID NO: 3188463 - RNA, 17 nt, Mycobacterium bovis subsp bovis AF2122/97
cgggauggacagcuguu

SEQ ID NO: 3188464 - RNA, 17 nt, Mycobacterium bovis subsp bovis AF2122/97
cgggauggauaccgggg

SEQ ID NO: 3188465 - RNA, 13 nt, Mycobacterium bovis subsp bovis AF2122/97
cgggauggccgcc

SEQ ID NO: 3188466 - RNA, 12 nt, Mycobacterium bovis subsp bovis AF2122/97
cgggaugugcgg

SEQ ID NO: 3188467 - RNA, 17 nt, Mycobacterium bovis subsp bovis AF2122/97
cgggaugugcggcugca

SEQ ID NO: 3188468 - RNA, 19 nt, Mycobacterium bovis subsp bovis AF2122/97
cgggaugugcggcugcacc

SEQ ID NO: 3188469 - RNA, 17 nt, Mycobacterium bovis subsp bovis AF2122/97
cgggauuaugccggcaa

SEQ ID NO: 3188470 - RNA, 21 nt, Mycobacterium bovis subsp bovis AF2122/97
cgggauuaugccggcaaccug

SEQ ID NO: 3188471 - RNA, 15 nt, Mycobacterium bovis subsp bovis AF2122/97
cgggauucgggcgcc

SEQ ID NO: 3188472 - RNA, 16 nt, Mycobacterium bovis subsp bovis AF2122/97
cgggauugccgccacc

SEQ ID NO: 3188473 - RNA, 21 nt, Mycobacterium bovis subsp bovis AF2122/97
cgggauugccgccaccuuggc

SEQ ID NO: 3188474 - RNA, 15 nt, Mycobacterium bovis subsp bovis AF2122/97
cgggcaaaucaagca

SEQ ID NO: 3188475 - RNA, 13 nt, Mycobacterium bovis subsp bovis AF2122/97
cgggcaacacgau

SEQ ID NO: 3188476 - RNA, 20 nt, Mycobacterium bovis subsp bovis AF2122/97
cgggcaacacgauaucgggc

SEQ ID NO: 3188477 - RNA, 14 nt, Mycobacterium bovis subsp bovis AF2122/97
cgggcaaccgauga

SEQ ID NO: 3188478 - RNA, 18 nt, Mycobacterium bovis subsp bovis AF2122/97
cgggcaaccgaugacgcg

SEQ ID NO: 3188479 - RNA, 13 nt, Mycobacterium bovis subsp bovis AF2122/97
cgggcaaccugcc

SEQ ID NO: 3188480 - RNA, 23 nt, Mycobacterium bovis subsp bovis AF2122/97
cgggcaaccugccgggccacggc

SEQ ID NO: 3188481 - RNA, 15 nt, Mycobacterium bovis subsp bovis AF2122/97
cgggcaacgccucga

SEQ ID NO: 3188482 - RNA, 18 nt, Mycobacterium bovis subsp bovis AF2122/97
cgggcaacgcgaaccggc

SEQ ID NO: 3188483 - RNA, 15 nt, Mycobacterium bovis subsp bovis AF2122/97
cgggcaacggcagcc

SEQ ID NO: 3188484 - RNA, 19 nt, Mycobacterium bovis subsp bovis AF2122/97
cgggcaacggcggggccgg

SEQ ID NO: 3188485 - RNA, 21 nt, Mycobacterium bovis subsp bovis AF2122/97
cgggcaacggcggggccggcg

SEQ ID NO: 3188486 - RNA, 17 nt, Mycobacterium bovis subsp bovis AF2122/97
cgggcaacucggugacg

SEQ ID NO: 3188487 - RNA, 15 nt, Mycobacterium bovis subsp bovis AF2122/97
cgggcaacugcagca

SEQ ID NO: 3188488 - RNA, 19 nt, Mycobacterium bovis subsp bovis AF2122/97
cgggcaagccggacagauc

SEQ ID NO: 3188489 - RNA, 22 nt, Mycobacterium bovis subsp bovis AF2122/97
cgggcaagccggacagaucaac

SEQ ID NO: 3188490 - RNA, 16 nt, Mycobacterium bovis subsp bovis AF2122/97
cgggcaaggccaccgg

SEQ ID NO: 3188491 - RNA, 21 nt, Mycobacterium bovis subsp bovis AF2122/97
cgggcaaggccaccgucgcgg

SEQ ID NO: 3188492 - RNA, 14 nt, Mycobacterium bovis subsp bovis AF2122/97
cgggcaaggcggcg

SEQ ID NO: 3188493 - RNA, 16 nt, Mycobacterium bovis subsp bovis AF2122/97
cgggcaagucgcccag

SEQ ID NO: 3188494 - RNA, 17 nt, Mycobacterium bovis subsp bovis AF2122/97
cgggcaagucgcccagc

SEQ ID NO: 3188495 - RNA, 19 nt, Mycobacterium bovis subsp bovis AF2122/97
cgggcaagucgcccagccg

SEQ ID NO: 3188496 - RNA, 17 nt, Mycobacterium bovis subsp bovis AF2122/97
cgggcaauacguagucg

SEQ ID NO: 3188497 - RNA, 21 nt, Mycobacterium bovis subsp bovis AF2122/97
cgggcaauacguagucgccga

SEQ ID NO: 3188498 - RNA, 14 nt, Mycobacterium bovis subsp bovis AF2122/97
cgggcaaucaccgc

SEQ ID NO: 3188499 - RNA, 15 nt, Mycobacterium bovis subsp bovis AF2122/97
cgggcaaucaccgcc

SEQ ID NO: 3188500 - RNA, 16 nt, Mycobacterium bovis subsp bovis AF2122/97
cgggcaaucaccgccg

SEQ ID NO: 3188501 - RNA, 20 nt, Mycobacterium bovis subsp bovis AF2122/97
cgggcaaucaccgccggcgg

SEQ ID NO: 3188502 - RNA, 22 nt, Mycobacterium bovis subsp bovis AF2122/97
cgggcaaugucgacaccggcgc

SEQ ID NO: 3188503 - RNA, 21 nt, Mycobacterium bovis subsp bovis AF2122/97
cgggcacaauaggcuccagcg

SEQ ID NO: 3188504 - RNA, 12 nt, Mycobacterium bovis subsp bovis AF2122/97
cgggcacaccga

SEQ ID NO: 3188505 - RNA, 20 nt, Mycobacterium bovis subsp bovis AF2122/97
cgggcacaccgacgccgcca

SEQ ID NO: 3188506 - RNA, 13 nt, Mycobacterium bovis subsp bovis AF2122/97
cgggcaccaaccu

SEQ ID NO: 3188507 - RNA, 17 nt, Mycobacterium bovis subsp bovis AF2122/97
cgggcaccaaccugagc

SEQ ID NO: 3188508 - RNA, 21 nt, Mycobacterium bovis subsp bovis AF2122/97
cgggcaccaauaccgcacccg

SEQ ID NO: 3188509 - RNA, 20 nt, Mycobacterium bovis subsp bovis AF2122/97
cgggcaccaccacaccggag

SEQ ID NO: 3188510 - RNA, 12 nt, Mycobacterium bovis subsp bovis AF2122/97
cgggcaccaccc

SEQ ID NO: 3188511 - RNA, 19 nt, Mycobacterium bovis subsp bovis AF2122/97
cgggcaccacccuugccga

SEQ ID NO: 3188512 - RNA, 20 nt, Mycobacterium bovis subsp bovis AF2122/97
cgggcacccgagccgcacag

SEQ ID NO: 3188513 - RNA, 16 nt, Mycobacterium bovis subsp bovis AF2122/97
cgggcacccuugccga

SEQ ID NO: 3188514 - RNA, 15 nt, Mycobacterium bovis subsp bovis AF2122/97
cgggcaccggccggu

SEQ ID NO: 3188515 - RNA, 20 nt, Mycobacterium bovis subsp bovis AF2122/97
cgggcaccgucggaacugac

SEQ ID NO: 3188516 - RNA, 15 nt, Mycobacterium bovis subsp bovis AF2122/97
cgggcaccuggucgg

SEQ ID NO: 3188517 - RNA, 18 nt, Mycobacterium bovis subsp bovis AF2122/97
cgggcaccuggucggccg

SEQ ID NO: 3188518 - RNA, 19 nt, Mycobacterium bovis subsp bovis AF2122/97
cgggcaccuggucggccgc

SEQ ID NO: 3188519 - RNA, 16 nt, Mycobacterium bovis subsp bovis AF2122/97
cgggcacgaucgucgc

SEQ ID NO: 3188520 - RNA, 21 nt, Mycobacterium bovis subsp bovis AF2122/97
cgggcacgaucgucgcggcca

SEQ ID NO: 3188521 - RNA, 17 nt, Mycobacterium bovis subsp bovis AF2122/97
cgggcacgcccucgucg

SEQ ID NO: 3188522 - RNA, 14 nt, Mycobacterium bovis subsp bovis AF2122/97
cgggcacgccgccg

SEQ ID NO: 3188523 - RNA, 17 nt, Mycobacterium bovis subsp bovis AF2122/97
cgggcacgccgccgacg

SEQ ID NO: 3188524 - RNA, 22 nt, Mycobacterium bovis subsp bovis AF2122/97
cgggcacggugaugaggaucgc

SEQ ID NO: 3188525 - RNA, 23 nt, Mycobacterium bovis subsp bovis AF2122/97
cgggcacguuuacauagaccacc

SEQ ID NO: 3188526 - RNA, 23 nt, Mycobacterium bovis subsp bovis AF2122/97
cgggcacugugaggucauuggcg

SEQ ID NO: 3188527 - RNA, 21 nt, Mycobacterium bovis subsp bovis AF2122/97
cgggcagauaugacggcagac

SEQ ID NO: 3188528 - RNA, 21 nt, Mycobacterium bovis subsp bovis AF2122/97
cgggcagaugaugccguucgg

SEQ ID NO: 3188529 - RNA, 16 nt, Mycobacterium bovis subsp bovis AF2122/97
cgggcagauucuucac

SEQ ID NO: 3188530 - RNA, 18 nt, Mycobacterium bovis subsp bovis AF2122/97
cgggcagcaaaaaccagc

SEQ ID NO: 3188531 - RNA, 22 nt, Mycobacterium bovis subsp bovis AF2122/97
cgggcagcaaaaaccagcgucc

SEQ ID NO: 3188532 - RNA, 19 nt, Mycobacterium bovis subsp bovis AF2122/97
cgggcagcaacaggcccac

SEQ ID NO: 3188533 - RNA, 15 nt, Mycobacterium bovis subsp bovis AF2122/97
cgggcagcacccgcg

SEQ ID NO: 3188534 - RNA, 16 nt, Mycobacterium bovis subsp bovis AF2122/97
cgggcagcacccgcgc

SEQ ID NO: 3188535 - RNA, 18 nt, Mycobacterium bovis subsp bovis AF2122/97
cgggcagcacccgcgcca

SEQ ID NO: 3188536 - RNA, 20 nt, Mycobacterium bovis subsp bovis AF2122/97
cgggcagcacccgcgccagu

SEQ ID NO: 3188537 - RNA, 15 nt, Mycobacterium bovis subsp bovis AF2122/97
cgggcagcacgccag

SEQ ID NO: 3188538 - RNA, 20 nt, Mycobacterium bovis subsp bovis AF2122/97
cgggcagcacgccagcccca

SEQ ID NO: 3188539 - RNA, 20 nt, Mycobacterium bovis subsp bovis AF2122/97
cgggcagcacuuggacccgg

SEQ ID NO: 3188540 - RNA, 18 nt, Mycobacterium bovis subsp bovis AF2122/97
cgggcagcaucaacaccg

SEQ ID NO: 3188541 - RNA, 19 nt, Mycobacterium bovis subsp bovis AF2122/97
cgggcagcaucaacaccgg

SEQ ID NO: 3188542 - RNA, 21 nt, Mycobacterium bovis subsp bovis AF2122/97
cgggcagcaucaacaccggcu

SEQ ID NO: 3188543 - RNA, 13 nt, Mycobacterium bovis subsp bovis AF2122/97
cgggcagccccuc

SEQ ID NO: 3188544 - RNA, 21 nt, Mycobacterium bovis subsp bovis AF2122/97
cgggcagccccuccgcgccga

SEQ ID NO: 3188545 - RNA, 13 nt, Mycobacterium bovis subsp bovis AF2122/97
cgggcagccgccc

SEQ ID NO: 3188546 - RNA, 14 nt, Mycobacterium bovis subsp bovis AF2122/97
cgggcagccgcccg

SEQ ID NO: 3188547 - RNA, 17 nt, Mycobacterium bovis subsp bovis AF2122/97
cgggcagccgcccgcca

SEQ ID NO: 3188548 - RNA, 14 nt, Mycobacterium bovis subsp bovis AF2122/97
cgggcagccgcgcc

SEQ ID NO: 3188549 - RNA, 21 nt, Mycobacterium bovis subsp bovis AF2122/97
cgggcagcgaucuugguggcc

SEQ ID NO: 3188550 - RNA, 11 nt, Mycobacterium bovis subsp bovis AF2122/97
cgggcagcgcg

SEQ ID NO: 3188551 - RNA, 16 nt, Mycobacterium bovis subsp bovis AF2122/97
cgggcagcgcggccag

SEQ ID NO: 3188552 - RNA, 16 nt, Mycobacterium bovis subsp bovis AF2122/97
cgggcagcgcgugcug

SEQ ID NO: 3188553 - RNA, 12 nt, Mycobacterium bovis subsp bovis AF2122/97
cgggcagcgcuc

SEQ ID NO: 3188554 - RNA, 14 nt, Mycobacterium bovis subsp bovis AF2122/97
cgggcagcuacggg

SEQ ID NO: 3188555 - RNA, 14 nt, Mycobacterium bovis subsp bovis AF2122/97
cgggcagcugggca

SEQ ID NO: 3188556 - RNA, 18 nt, Mycobacterium bovis subsp bovis AF2122/97
cgggcagcuguucggcca

SEQ ID NO: 3188557 - RNA, 22 nt, Mycobacterium bovis subsp bovis AF2122/97
cgggcagcuguucggccaaccc

SEQ ID NO: 3188558 - RNA, 18 nt, Mycobacterium bovis subsp bovis AF2122/97
cgggcagcuucaacaccg

SEQ ID NO: 3188559 - RNA, 19 nt, Mycobacterium bovis subsp bovis AF2122/97
cgggcagcuucaacaccgg

SEQ ID NO: 3188560 - RNA, 20 nt, Mycobacterium bovis subsp bovis AF2122/97
cgggcagcuucaacaccggc

SEQ ID NO: 3188561 - RNA, 21 nt, Mycobacterium bovis subsp bovis AF2122/97
cgggcagcuucaacaccggca

SEQ ID NO: 3188562 - RNA, 20 nt, Mycobacterium bovis subsp bovis AF2122/97
cgggcaggagcagcacgucg

SEQ ID NO: 3188563 - RNA, 14 nt, Mycobacterium bovis subsp bovis AF2122/97
cgggcaggccccac

SEQ ID NO: 3188564 - RNA, 15 nt, Mycobacterium bovis subsp bovis AF2122/97
cgggcaggccccacu

SEQ ID NO: 3188565 - RNA, 13 nt, Mycobacterium bovis subsp bovis AF2122/97
cgggcaggccgcu

SEQ ID NO: 3188566 - RNA, 17 nt, Mycobacterium bovis subsp bovis AF2122/97
cgggcaggccgcugggc

SEQ ID NO: 3188567 - RNA, 12 nt, Mycobacterium bovis subsp bovis AF2122/97
cgggcaggccgu

SEQ ID NO: 3188568 - RNA, 15 nt, Mycobacterium bovis subsp bovis AF2122/97
cgggcaggccgucga

SEQ ID NO: 3188569 - RNA, 13 nt, Mycobacterium bovis subsp bovis AF2122/97
cgggcaggcggcc

SEQ ID NO: 3188570 - RNA, 17 nt, Mycobacterium bovis subsp bovis AF2122/97
cgggcaggcggccagcg

SEQ ID NO: 3188571 - RNA, 15 nt, Mycobacterium bovis subsp bovis AF2122/97
cgggcagggaccgca

SEQ ID NO: 3188572 - RNA, 18 nt, Mycobacterium bovis subsp bovis AF2122/97
cgggcagggaccgcaucg

SEQ ID NO: 3188573 - RNA, 18 nt, Mycobacterium bovis subsp bovis AF2122/97
cgggcaguagcuguggcc

SEQ ID NO: 3188574 - RNA, 15 nt, Mycobacterium bovis subsp bovis AF2122/97
cgggcaguccaggca

SEQ ID NO: 3188575 - RNA, 17 nt, Mycobacterium bovis subsp bovis AF2122/97
cgggcaguggcagcccg

SEQ ID NO: 3188576 - RNA, 21 nt, Mycobacterium bovis subsp bovis AF2122/97
cgggcaguggcagcccgucgg

SEQ ID NO: 3188577 - RNA, 14 nt, Mycobacterium bovis subsp bovis AF2122/97
cgggcagugugguc

SEQ ID NO: 3188578 - RNA, 23 nt, Mycobacterium bovis subsp bovis AF2122/97
cgggcaguucaacgaggccgacg

SEQ ID NO: 3188579 - RNA, 22 nt, Mycobacterium bovis subsp bovis AF2122/97
cgggcaguucacgguugaugau

SEQ ID NO: 3188580 - RNA, 15 nt, Mycobacterium bovis subsp bovis AF2122/97
cgggcaguugaccca

SEQ ID NO: 3188581 - RNA, 23 nt, Mycobacterium bovis subsp bovis AF2122/97
cgggcaguuguugacagacacag

SEQ ID NO: 3188582 - RNA, 18 nt, Mycobacterium bovis subsp bovis AF2122/97
cgggcaguuuguucgcga

SEQ ID NO: 3188583 - RNA, 21 nt, Mycobacterium bovis subsp bovis AF2122/97
cgggcaguuuguucgcgaagc

SEQ ID NO: 3188584 - RNA, 16 nt, Mycobacterium bovis subsp bovis AF2122/97
cgggcauccuucacca

SEQ ID NO: 3188585 - RNA, 18 nt, Mycobacterium bovis subsp bovis AF2122/97
cgggcauccuucaccagc

SEQ ID NO: 3188586 - RNA, 20 nt, Mycobacterium bovis subsp bovis AF2122/97
cgggcauccuucaccagcug

SEQ ID NO: 3188587 - RNA, 14 nt, Mycobacterium bovis subsp bovis AF2122/97
cgggcaucggcggu

SEQ ID NO: 3188588 - RNA, 16 nt, Mycobacterium bovis subsp bovis AF2122/97
cgggcaucggcgguuc

SEQ ID NO: 3188589 - RNA, 19 nt, Mycobacterium bovis subsp bovis AF2122/97
cgggcaucggugccacggc

SEQ ID NO: 3188590 - RNA, 16 nt, Mycobacterium bovis subsp bovis AF2122/97
cgggcaucgucgucgc

SEQ ID NO: 3188591 - RNA, 23 nt, Mycobacterium bovis subsp bovis AF2122/97
cgggcaugauccccguugaccca

SEQ ID NO: 3188592 - RNA, 22 nt, Mycobacterium bovis subsp bovis AF2122/97
cgggcaugauguugaaacaccg

SEQ ID NO: 3188593 - RNA, 14 nt, Mycobacterium bovis subsp bovis AF2122/97
cgggcaugccggcg

SEQ ID NO: 3188594 - RNA, 15 nt, Mycobacterium bovis subsp bovis AF2122/97
cgggcaugccggcga

SEQ ID NO: 3188595 - RNA, 17 nt, Mycobacterium bovis subsp bovis AF2122/97
cgggcaugcucuggcaa

SEQ ID NO: 3188596 - RNA, 14 nt, Mycobacterium bovis subsp bovis AF2122/97
cgggcauggcggcg

SEQ ID NO: 3188597 - RNA, 16 nt, Mycobacterium bovis subsp bovis AF2122/97
cgggcauggucgccgg

SEQ ID NO: 3188598 - RNA, 22 nt, Mycobacterium bovis subsp bovis AF2122/97
cgggcauuucguggcacggguc

SEQ ID NO: 3188599 - RNA, 23 nt, Mycobacterium bovis subsp bovis AF2122/97
cgggcauuucguggcacgggucg

SEQ ID NO: 3188600 - RNA, 16 nt, Mycobacterium bovis subsp bovis AF2122/97
cgggccaacucggcga

SEQ ID NO: 3188601 - RNA, 20 nt, Mycobacterium bovis subsp bovis AF2122/97
cgggccaacucggcgaugac

SEQ ID NO: 3188602 - RNA, 20 nt, Mycobacterium bovis subsp bovis AF2122/97
cgggccaaugccguugaucg

SEQ ID NO: 3188603 - RNA, 14 nt, Mycobacterium bovis subsp bovis AF2122/97
cgggccacagcaac

SEQ ID NO: 3188604 - RNA, 18 nt, Mycobacterium bovis subsp bovis AF2122/97
cgggccaccacgcgccgc

SEQ ID NO: 3188605 - RNA, 16 nt, Mycobacterium bovis subsp bovis AF2122/97
cgggccaccagcgucg

SEQ ID NO: 3188606 - RNA, 18 nt, Mycobacterium bovis subsp bovis AF2122/97
cgggccaccagcgucgca

SEQ ID NO: 3188607 - RNA, 15 nt, Mycobacterium bovis subsp bovis AF2122/97
cgggccaccgcuguc

SEQ ID NO: 3188608 - RNA, 22 nt, Mycobacterium bovis subsp bovis AF2122/97
cgggccaccggaauccuggccg

SEQ ID NO: 3188609 - RNA, 22 nt, Mycobacterium bovis subsp bovis AF2122/97
cgggccaccguaaacagcgcgc

SEQ ID NO: 3188610 - RNA, 23 nt, Mycobacterium bovis subsp bovis AF2122/97
cgggccaccgucccugugucgcc

SEQ ID NO: 3188611 - RNA, 15 nt, Mycobacterium bovis subsp bovis AF2122/97
cgggccacgaugcgc

SEQ ID NO: 3188612 - RNA, 19 nt, Mycobacterium bovis subsp bovis AF2122/97
cgggccacguccugcccgu

SEQ ID NO: 3188613 - RNA, 21 nt, Mycobacterium bovis subsp bovis AF2122/97
cgggccacguccugcccgucg

SEQ ID NO: 3188614 - RNA, 13 nt, Mycobacterium bovis subsp bovis AF2122/97
cgggccacgucga

SEQ ID NO: 3188615 - RNA, 20 nt, Mycobacterium bovis subsp bovis AF2122/97
cgggccacgucgagcacccg

SEQ ID NO: 3188616 - RNA, 15 nt, Mycobacterium bovis subsp bovis AF2122/97
cgggccagcacccgc

SEQ ID NO: 3188617 - RNA, 21 nt, Mycobacterium bovis subsp bovis AF2122/97
cgggccagcacccgcuccagc

SEQ ID NO: 3188618 - RNA, 20 nt, Mycobacterium bovis subsp bovis AF2122/97
cgggccagcaccucgaccgc

SEQ ID NO: 3188619 - RNA, 18 nt, Mycobacterium bovis subsp bovis AF2122/97
cgggccaggcccucgacg

SEQ ID NO: 3188620 - RNA, 19 nt, Mycobacterium bovis subsp bovis AF2122/97
cgggccagucgaaucguca

SEQ ID NO: 3188621 - RNA, 16 nt, Mycobacterium bovis subsp bovis AF2122/97
cgggccaucaagcgau

SEQ ID NO: 3188622 - RNA, 23 nt, Mycobacterium bovis subsp bovis AF2122/97
cgggccaucgcauccccagcaca

SEQ ID NO: 3188623 - RNA, 22 nt, Mycobacterium bovis subsp bovis AF2122/97
cgggccauggguagccgcccag

SEQ ID NO: 3188624 - RNA, 23 nt, Mycobacterium bovis subsp bovis AF2122/97
cgggccauggguagccgcccagc

SEQ ID NO: 3188625 - RNA, 15 nt, Mycobacterium bovis subsp bovis AF2122/97
cgggccaugugggga

SEQ ID NO: 3188626 - RNA, 12 nt, Mycobacterium bovis subsp bovis AF2122/97
cgggcccaccgc

SEQ ID NO: 3188627 - RNA, 13 nt, Mycobacterium bovis subsp bovis AF2122/97
cgggcccacguug

SEQ ID NO: 3188628 - RNA, 13 nt, Mycobacterium bovis subsp bovis AF2122/97
cgggcccagcagg

SEQ ID NO: 3188629 - RNA, 20 nt, Mycobacterium bovis subsp bovis AF2122/97
cgggcccagcaggucgucgg

SEQ ID NO: 3188630 - RNA, 17 nt, Mycobacterium bovis subsp bovis AF2122/97
cgggcccagccggaccg

SEQ ID NO: 3188631 - RNA, 13 nt, Mycobacterium bovis subsp bovis AF2122/97
cgggcccaucgcc

SEQ ID NO: 3188632 - RNA, 14 nt, Mycobacterium bovis subsp bovis AF2122/97
cgggccccacggcg

SEQ ID NO: 3188633 - RNA, 19 nt, Mycobacterium bovis subsp bovis AF2122/97
cgggcccccagguagugca

SEQ ID NO: 3188634 - RNA, 21 nt, Mycobacterium bovis subsp bovis AF2122/97
cgggcccccagguagugcaca

SEQ ID NO: 3188635 - RNA, 17 nt, Mycobacterium bovis subsp bovis AF2122/97
cgggcccccggcagcau

SEQ ID NO: 3188636 - RNA, 19 nt, Mycobacterium bovis subsp bovis AF2122/97
cgggcccccuggaucgcgc

SEQ ID NO: 3188637 - RNA, 19 nt, Mycobacterium bovis subsp bovis AF2122/97
cgggccccggggugccccc

SEQ ID NO: 3188638 - RNA, 20 nt, Mycobacterium bovis subsp bovis AF2122/97
cgggccccggggugcccccg

SEQ ID NO: 3188639 - RNA, 24 nt, Mycobacterium bovis subsp bovis AF2122/97
cgggcccgaugaggacauccggcg

SEQ ID NO: 3188640 - RNA, 12 nt, Mycobacterium bovis subsp bovis AF2122/97
cgggcccgaugu

SEQ ID NO: 3188641 - RNA, 18 nt, Mycobacterium bovis subsp bovis AF2122/97
cgggcccgaugucgucga

SEQ ID NO: 3188642 - RNA, 17 nt, Mycobacterium bovis subsp bovis AF2122/97
cgggcccgcaggucggc

SEQ ID NO: 3188643 - RNA, 15 nt, Mycobacterium bovis subsp bovis AF2122/97
cgggcccgccggccc

SEQ ID NO: 3188644 - RNA, 18 nt, Mycobacterium bovis subsp bovis AF2122/97
cgggcccgccggccccgc

SEQ ID NO: 3188645 - RNA, 16 nt, Mycobacterium bovis subsp bovis AF2122/97
cgggcccgcguucucg

SEQ ID NO: 3188646 - RNA, 21 nt, Mycobacterium bovis subsp bovis AF2122/97
cgggcccgcugggcuuggggc

SEQ ID NO: 3188647 - RNA, 13 nt, Mycobacterium bovis subsp bovis AF2122/97
cgggcccggcgaa

SEQ ID NO: 3188648 - RNA, 15 nt, Mycobacterium bovis subsp bovis AF2122/97
cgggcccguagccga

SEQ ID NO: 3188649 - RNA, 20 nt, Mycobacterium bovis subsp bovis AF2122/97
cgggcccguagccgagcuug

SEQ ID NO: 3188650 - RNA, 18 nt, Mycobacterium bovis subsp bovis AF2122/97
cgggcccgucgucgucga

SEQ ID NO: 3188651 - RNA, 17 nt, Mycobacterium bovis subsp bovis AF2122/97
cgggcccuccacugcga

SEQ ID NO: 3188652 - RNA, 22 nt, Mycobacterium bovis subsp bovis AF2122/97
cgggcccuccacugcgagcgcc

SEQ ID NO: 3188653 - RNA, 16 nt, Mycobacterium bovis subsp bovis AF2122/97
cgggcccuccggcgca

SEQ ID NO: 3188654 - RNA, 18 nt, Mycobacterium bovis subsp bovis AF2122/97
cgggcccuccggcgcagc

SEQ ID NO: 3188655 - RNA, 20 nt, Mycobacterium bovis subsp bovis AF2122/97
cgggcccuccggcgcagcga

SEQ ID NO: 3188656 - RNA, 18 nt, Mycobacterium bovis subsp bovis AF2122/97
cgggcccucgccauggcg

SEQ ID NO: 3188657 - RNA, 24 nt, Mycobacterium bovis subsp bovis AF2122/97
cgggcccucgccauggcguucugc

SEQ ID NO: 3188658 - RNA, 18 nt, Mycobacterium bovis subsp bovis AF2122/97
cgggcccuuccuggccga

SEQ ID NO: 3188659 - RNA, 20 nt, Mycobacterium bovis subsp bovis AF2122/97
cgggccgaacacaccgggcg

SEQ ID NO: 3188660 - RNA, 23 nt, Mycobacterium bovis subsp bovis AF2122/97
cgggccgaacacaccgggcgggc

SEQ ID NO: 3188661 - RNA, 17 nt, Mycobacterium bovis subsp bovis AF2122/97
cgggccgaagccccgau

SEQ ID NO: 3188662 - RNA, 17 nt, Mycobacterium bovis subsp bovis AF2122/97
cgggccgaagcgcgcgc

SEQ ID NO: 3188663 - RNA, 18 nt, Mycobacterium bovis subsp bovis AF2122/97
cgggccgaauaccacacc

SEQ ID NO: 3188664 - RNA, 19 nt, Mycobacterium bovis subsp bovis AF2122/97
cgggccgaauaccacaccg

SEQ ID NO: 3188665 - RNA, 23 nt, Mycobacterium bovis subsp bovis AF2122/97
cgggccgaccagagcuucgccgc

SEQ ID NO: 3188666 - RNA, 20 nt, Mycobacterium bovis subsp bovis AF2122/97
cgggccgagcgcaccacggc

SEQ ID NO: 3188667 - RNA, 18 nt, Mycobacterium bovis subsp bovis AF2122/97
cgggccgaucucuccggc

SEQ ID NO: 3188668 - RNA, 20 nt, Mycobacterium bovis subsp bovis AF2122/97
cgggccgaucucuccggcgg

SEQ ID NO: 3188669 - RNA, 16 nt, Mycobacterium bovis subsp bovis AF2122/97
cgggccgcaucgucgc

SEQ ID NO: 3188670 - RNA, 19 nt, Mycobacterium bovis subsp bovis AF2122/97
cgggccgcaucgucgccgc

SEQ ID NO: 3188671 - RNA, 20 nt, Mycobacterium bovis subsp bovis AF2122/97
cgggccgcaucgucgccgcg

SEQ ID NO: 3188672 - RNA, 21 nt, Mycobacterium bovis subsp bovis AF2122/97
cgggccgcaucgucgccgcgc

SEQ ID NO: 3188673 - RNA, 17 nt, Mycobacterium bovis subsp bovis AF2122/97
cgggccgccaggcggcc

SEQ ID NO: 3188674 - RNA, 19 nt, Mycobacterium bovis subsp bovis AF2122/97
cgggccgccaggcggccgg

SEQ ID NO: 3188675 - RNA, 20 nt, Mycobacterium bovis subsp bovis AF2122/97
cgggccgccaggcggccggg

SEQ ID NO: 3188676 - RNA, 16 nt, Mycobacterium bovis subsp bovis AF2122/97
cgggccgccagggccc

SEQ ID NO: 3188677 - RNA, 13 nt, Mycobacterium bovis subsp bovis AF2122/97
cgggccgccgagc

SEQ ID NO: 3188678 - RNA, 15 nt, Mycobacterium bovis subsp bovis AF2122/97
cgggccgccgagcgg

SEQ ID NO: 3188679 - RNA, 14 nt, Mycobacterium bovis subsp bovis AF2122/97
cgggccgccgagcu

SEQ ID NO: 3188680 - RNA, 21 nt, Mycobacterium bovis subsp bovis AF2122/97
cgggccgccucgaucgacucg

SEQ ID NO: 3188681 - RNA, 14 nt, Mycobacterium bovis subsp bovis AF2122/97
cgggccgcgcgcag

SEQ ID NO: 3188682 - RNA, 13 nt, Mycobacterium bovis subsp bovis AF2122/97
cgggccgcgcggg

SEQ ID NO: 3188683 - RNA, 16 nt, Mycobacterium bovis subsp bovis AF2122/97
cgggccgcgcgggccg

SEQ ID NO: 3188684 - RNA, 21 nt, Mycobacterium bovis subsp bovis AF2122/97
cgggccgcgcgggccgccgca

SEQ ID NO: 3188685 - RNA, 18 nt, Mycobacterium bovis subsp bovis AF2122/97
cgggccgcggccacaucg

SEQ ID NO: 3188686 - RNA, 13 nt, Mycobacterium bovis subsp bovis AF2122/97
cgggccgcggcgg

SEQ ID NO: 3188687 - RNA, 15 nt, Mycobacterium bovis subsp bovis AF2122/97
cgggccgcggcggcc

SEQ ID NO: 3188688 - RNA, 15 nt, Mycobacterium bovis subsp bovis AF2122/97
cgggccgcguccaga

SEQ ID NO: 3188689 - RNA, 18 nt, Mycobacterium bovis subsp bovis AF2122/97
cgggccgcguccagaccg

SEQ ID NO: 3188690 - RNA, 19 nt, Mycobacterium bovis subsp bovis AF2122/97
cgggccgcgucgaacuggg

SEQ ID NO: 3188691 - RNA, 17 nt, Mycobacterium bovis subsp bovis AF2122/97
cgggccggaccaucagc

SEQ ID NO: 3188692 - RNA, 17 nt, Mycobacterium bovis subsp bovis AF2122/97
cgggccggagccggugc

SEQ ID NO: 3188693 - RNA, 23 nt, Mycobacterium bovis subsp bovis AF2122/97
cgggccggagccggugccgacgg

SEQ ID NO: 3188694 - RNA, 23 nt, Mycobacterium bovis subsp bovis AF2122/97
cgggccggaugacgcccagggcg

SEQ ID NO: 3188695 - RNA, 17 nt, Mycobacterium bovis subsp bovis AF2122/97
cgggccggcaucgucgg

SEQ ID NO: 3188696 - RNA, 13 nt, Mycobacterium bovis subsp bovis AF2122/97
cgggccggccgcc

SEQ ID NO: 3188697 - RNA, 14 nt, Mycobacterium bovis subsp bovis AF2122/97
cgggccggccgccg

SEQ ID NO: 3188698 - RNA, 19 nt, Mycobacterium bovis subsp bovis AF2122/97
cgggccggcgacuguccca

SEQ ID NO: 3188699 - RNA, 14 nt, Mycobacterium bovis subsp bovis AF2122/97
cgggccggucggug

SEQ ID NO: 3188700 - RNA, 17 nt, Mycobacterium bovis subsp bovis AF2122/97
cgggccggucggugagc

SEQ ID NO: 3188701 - RNA, 17 nt, Mycobacterium bovis subsp bovis AF2122/97
cgggccggucgugccgg

SEQ ID NO: 3188702 - RNA, 18 nt, Mycobacterium bovis subsp bovis AF2122/97
cgggccggugcgcaccag

SEQ ID NO: 3188703 - RNA, 22 nt, Mycobacterium bovis subsp bovis AF2122/97
cgggccgguggaaaagccacgg

SEQ ID NO: 3188704 - RNA, 23 nt, Mycobacterium bovis subsp bovis AF2122/97
cgggccgguggaaaagccacggc

SEQ ID NO: 3188705 - RNA, 16 nt, Mycobacterium bovis subsp bovis AF2122/97
cgggccguacggcgcg

SEQ ID NO: 3188706 - RNA, 15 nt, Mycobacterium bovis subsp bovis AF2122/97
cgggccgucaaucgc

SEQ ID NO: 3188707 - RNA, 13 nt, Mycobacterium bovis subsp bovis AF2122/97
cgggccgugaccc

SEQ ID NO: 3188708 - RNA, 14 nt, Mycobacterium bovis subsp bovis AF2122/97
cgggccgugacccu

SEQ ID NO: 3188709 - RNA, 22 nt, Mycobacterium bovis subsp bovis AF2122/97
cgggccgugacccucagcaccg

SEQ ID NO: 3188710 - RNA, 23 nt, Mycobacterium bovis subsp bovis AF2122/97
cgggccuagccgaagcgcccgga

SEQ ID NO: 3188711 - RNA, 23 nt, Mycobacterium bovis subsp bovis AF2122/97
cgggccucaugcuaggccaccgg

SEQ ID NO: 3188712 - RNA, 24 nt, Mycobacterium bovis subsp bovis AF2122/97
cgggccucaugcuaggccaccggc

SEQ ID NO: 3188713 - RNA, 15 nt, Mycobacterium bovis subsp bovis AF2122/97
cgggccucccccaaa

SEQ ID NO: 3188714 - RNA, 14 nt, Mycobacterium bovis subsp bovis AF2122/97
cgggccuccugcug

SEQ ID NO: 3188715 - RNA, 13 nt, Mycobacterium bovis subsp bovis AF2122/97
cgggccucggcga

SEQ ID NO: 3188716 - RNA, 14 nt, Mycobacterium bovis subsp bovis AF2122/97
cgggccucggcgcc

SEQ ID NO: 3188717 - RNA, 18 nt, Mycobacterium bovis subsp bovis AF2122/97
cgggccucggcgccgucg

SEQ ID NO: 3188718 - RNA, 13 nt, Mycobacterium bovis subsp bovis AF2122/97
cgggccugaacca

SEQ ID NO: 3188719 - RNA, 15 nt, Mycobacterium bovis subsp bovis AF2122/97
cgggccugcaccacg

SEQ ID NO: 3188720 - RNA, 18 nt, Mycobacterium bovis subsp bovis AF2122/97
cgggccugcaccacggcg

SEQ ID NO: 3188721 - RNA, 22 nt, Mycobacterium bovis subsp bovis AF2122/97
cgggccugcaccacggcggcca

SEQ ID NO: 3188722 - RNA, 18 nt, Mycobacterium bovis subsp bovis AF2122/97
cgggccugcacgccggcg

SEQ ID NO: 3188723 - RNA, 14 nt, Mycobacterium bovis subsp bovis AF2122/97
cgggccuggcccac

SEQ ID NO: 3188724 - RNA, 16 nt, Mycobacterium bovis subsp bovis AF2122/97
cgggccuggcccacgc

SEQ ID NO: 3188725 - RNA, 23 nt, Mycobacterium bovis subsp bovis AF2122/97
cgggccuggcccacgccgcaucg

SEQ ID NO: 3188726 - RNA, 15 nt, Mycobacterium bovis subsp bovis AF2122/97
cgggccuggccugcc

SEQ ID NO: 3188727 - RNA, 19 nt, Mycobacterium bovis subsp bovis AF2122/97
cgggccuggccugcccagc

SEQ ID NO: 3188728 - RNA, 18 nt, Mycobacterium bovis subsp bovis AF2122/97
cgggccugggacggcggc

SEQ ID NO: 3188729 - RNA, 16 nt, Mycobacterium bovis subsp bovis AF2122/97
cgggccugguggauga

SEQ ID NO: 3188730 - RNA, 16 nt, Mycobacterium bovis subsp bovis AF2122/97
cgggccuucagcucac

SEQ ID NO: 3188731 - RNA, 17 nt, Mycobacterium bovis subsp bovis AF2122/97
cgggccuucagcucacc

SEQ ID NO: 3188732 - RNA, 18 nt, Mycobacterium bovis subsp bovis AF2122/97
cgggccuucagcucacca

SEQ ID NO: 3188733 - RNA, 15 nt, Mycobacterium bovis subsp bovis AF2122/97
cgggccuugcgcgcg

SEQ ID NO: 3188734 - RNA, 16 nt, Mycobacterium bovis subsp bovis AF2122/97
cgggccuugcgcgcgc

SEQ ID NO: 3188735 - RNA, 18 nt, Mycobacterium bovis subsp bovis AF2122/97
cgggccuugcgcgcgcag

SEQ ID NO: 3188736 - RNA, 17 nt, Mycobacterium bovis subsp bovis AF2122/97
cgggcgaaacgcccggg

SEQ ID NO: 3188737 - RNA, 18 nt, Mycobacterium bovis subsp bovis AF2122/97
cgggcgaaacgcccgggc

SEQ ID NO: 3188738 - RNA, 17 nt, Mycobacterium bovis subsp bovis AF2122/97
cgggcgaaauuccgggc

SEQ ID NO: 3188739 - RNA, 23 nt, Mycobacterium bovis subsp bovis AF2122/97
cgggcgaacgcuucaccucgucg

SEQ ID NO: 3188740 - RNA, 18 nt, Mycobacterium bovis subsp bovis AF2122/97
cgggcgaauccggcgggu

SEQ ID NO: 3188741 - RNA, 16 nt, Mycobacterium bovis subsp bovis AF2122/97
cgggcgacaucgagau

SEQ ID NO: 3188742 - RNA, 15 nt, Mycobacterium bovis subsp bovis AF2122/97
cgggcgaccaccacc

SEQ ID NO: 3188743 - RNA, 16 nt, Mycobacterium bovis subsp bovis AF2122/97
cgggcgaccaccaccg

SEQ ID NO: 3188744 - RNA, 19 nt, Mycobacterium bovis subsp bovis AF2122/97
cgggcgaccaccaccgccg

SEQ ID NO: 3188745 - RNA, 21 nt, Mycobacterium bovis subsp bovis AF2122/97
cgggcgaccaccaccgccgcc

SEQ ID NO: 3188746 - RNA, 22 nt, Mycobacterium bovis subsp bovis AF2122/97
cgggcgaccaccaccgccgccg

SEQ ID NO: 3188747 - RNA, 14 nt, Mycobacterium bovis subsp bovis AF2122/97
cgggcgacgguuuc

SEQ ID NO: 3188748 - RNA, 15 nt, Mycobacterium bovis subsp bovis AF2122/97
cgggcgagaacccac

SEQ ID NO: 3188749 - RNA, 21 nt, Mycobacterium bovis subsp bovis AF2122/97
cgggcgagaucuuuucaccac

SEQ ID NO: 3188750 - RNA, 19 nt, Mycobacterium bovis subsp bovis AF2122/97
cgggcgagccgugccagca

SEQ ID NO: 3188751 - RNA, 22 nt, Mycobacterium bovis subsp bovis AF2122/97
cgggcgagcgcaucgauggccg

SEQ ID NO: 3188752 - RNA, 22 nt, Mycobacterium bovis subsp bovis AF2122/97
cgggcgagcgcggccugcacca

SEQ ID NO: 3188753 - RNA, 14 nt, Mycobacterium bovis subsp bovis AF2122/97
cgggcgagcucguc

SEQ ID NO: 3188754 - RNA, 15 nt, Mycobacterium bovis subsp bovis AF2122/97
cgggcgagcucgucg

SEQ ID NO: 3188755 - RNA, 20 nt, Mycobacterium bovis subsp bovis AF2122/97
cgggcgagcucgucgagcgc

SEQ ID NO: 3188756 - RNA, 20 nt, Mycobacterium bovis subsp bovis AF2122/97
cgggcgaguacaggcgcagc

SEQ ID NO: 3188757 - RNA, 21 nt, Mycobacterium bovis subsp bovis AF2122/97
cgggcgaguacaggcgcagcg

SEQ ID NO: 3188758 - RNA, 22 nt, Mycobacterium bovis subsp bovis AF2122/97
cgggcgaguacaggcgcagcgu

SEQ ID NO: 3188759 - RNA, 15 nt, Mycobacterium bovis subsp bovis AF2122/97
cgggcgagucccggc

SEQ ID NO: 3188760 - RNA, 18 nt, Mycobacterium bovis subsp bovis AF2122/97
cgggcgagucccggcggu

SEQ ID NO: 3188761 - RNA, 15 nt, Mycobacterium bovis subsp bovis AF2122/97
cgggcgagugucagc

SEQ ID NO: 3188762 - RNA, 20 nt, Mycobacterium bovis subsp bovis AF2122/97
cgggcgaucaaagccagcac

SEQ ID NO: 3188763 - RNA, 21 nt, Mycobacterium bovis subsp bovis AF2122/97
cgggcgaucaacccuagggcg

SEQ ID NO: 3188764 - RNA, 14 nt, Mycobacterium bovis subsp bovis AF2122/97
cgggcgaucgccug

SEQ ID NO: 3188765 - RNA, 17 nt, Mycobacterium bovis subsp bovis AF2122/97
cgggcgaucgccugggc

SEQ ID NO: 3188766 - RNA, 18 nt, Mycobacterium bovis subsp bovis AF2122/97
cgggcgaucgccugggcu

SEQ ID NO: 3188767 - RNA, 12 nt, Mycobacterium bovis subsp bovis AF2122/97
cgggcgaugacc

SEQ ID NO: 3188768 - RNA, 16 nt, Mycobacterium bovis subsp bovis AF2122/97
cgggcgaugacccgga

SEQ ID NO: 3188769 - RNA, 17 nt, Mycobacterium bovis subsp bovis AF2122/97
cgggcgaugacccggaa

SEQ ID NO: 3188770 - RNA, 16 nt, Mycobacterium bovis subsp bovis AF2122/97
cgggcgaugagcgcga

SEQ ID NO: 3188771 - RNA, 21 nt, Mycobacterium bovis subsp bovis AF2122/97
cgggcgaugccgaugucgggc

SEQ ID NO: 3188772 - RNA, 17 nt, Mycobacterium bovis subsp bovis AF2122/97
cgggcgaugcgggccgc

SEQ ID NO: 3188773 - RNA, 13 nt, Mycobacterium bovis subsp bovis AF2122/97
cgggcgaugcugg

SEQ ID NO: 3188774 - RNA, 14 nt, Mycobacterium bovis subsp bovis AF2122/97
cgggcgaugcuggg

SEQ ID NO: 3188775 - RNA, 14 nt, Mycobacterium bovis subsp bovis AF2122/97
cgggcgauggccag

SEQ ID NO: 3188776 - RNA, 16 nt, Mycobacterium bovis subsp bovis AF2122/97
cgggcgauggccaguu

SEQ ID NO: 3188777 - RNA, 22 nt, Mycobacterium bovis subsp bovis AF2122/97
cgggcgauucgcaaucagcugg

SEQ ID NO: 3188778 - RNA, 20 nt, Mycobacterium bovis subsp bovis AF2122/97
cgggcgauuucggcgccggc

SEQ ID NO: 3188779 - RNA, 21 nt, Mycobacterium bovis subsp bovis AF2122/97
cgggcgauuucggcgccggcg

SEQ ID NO: 3188780 - RNA, 20 nt, Mycobacterium bovis subsp bovis AF2122/97
cgggcgcaagcagcccgggu

SEQ ID NO: 3188781 - RNA, 20 nt, Mycobacterium bovis subsp bovis AF2122/97
cgggcgcaccaagacgccac

SEQ ID NO: 3188782 - RNA, 14 nt, Mycobacterium bovis subsp bovis AF2122/97
cgggcgcaccaggg

SEQ ID NO: 3188783 - RNA, 15 nt, Mycobacterium bovis subsp bovis AF2122/97
cgggcgcaccaggga

SEQ ID NO: 3188784 - RNA, 23 nt, Mycobacterium bovis subsp bovis AF2122/97
cgggcgcaccagggagccguuca

SEQ ID NO: 3188785 - RNA, 15 nt, Mycobacterium bovis subsp bovis AF2122/97
cgggcgcacgcccgc

SEQ ID NO: 3188786 - RNA, 22 nt, Mycobacterium bovis subsp bovis AF2122/97
cgggcgcacgguccacgguggc

SEQ ID NO: 3188787 - RNA, 17 nt, Mycobacterium bovis subsp bovis AF2122/97
cgggcgccaacgggcug

SEQ ID NO: 3188788 - RNA, 22 nt, Mycobacterium bovis subsp bovis AF2122/97
cgggcgccaacgggcugccccu

SEQ ID NO: 3188789 - RNA, 19 nt, Mycobacterium bovis subsp bovis AF2122/97
cgggcgcccaugcugacac

SEQ ID NO: 3188790 - RNA, 13 nt, Mycobacterium bovis subsp bovis AF2122/97
cgggcgccccacc

SEQ ID NO: 3188791 - RNA, 20 nt, Mycobacterium bovis subsp bovis AF2122/97
cgggcgcccuugagccgccg

SEQ ID NO: 3188792 - RNA, 12 nt, Mycobacterium bovis subsp bovis AF2122/97
cgggcgccgcua

SEQ ID NO: 3188793 - RNA, 23 nt, Mycobacterium bovis subsp bovis AF2122/97
cgggcgccgugccccgggcccag

SEQ ID NO: 3188794 - RNA, 19 nt, Mycobacterium bovis subsp bovis AF2122/97
cgggcgccuuccaggcggg

SEQ ID NO: 3188795 - RNA, 22 nt, Mycobacterium bovis subsp bovis AF2122/97
cgggcgccuuccaggcgggcgg

SEQ ID NO: 3188796 - RNA, 18 nt, Mycobacterium bovis subsp bovis AF2122/97
cgggcgccuuggucgccg

SEQ ID NO: 3188797 - RNA, 20 nt, Mycobacterium bovis subsp bovis AF2122/97
cgggcgccuuggucgccgcc

SEQ ID NO: 3188798 - RNA, 20 nt, Mycobacterium bovis subsp bovis AF2122/97
cgggcgccuuggucgccgcu

SEQ ID NO: 3188799 - RNA, 15 nt, Mycobacterium bovis subsp bovis AF2122/97
cgggcgcgccggcca

SEQ ID NO: 3188800 - RNA, 20 nt, Mycobacterium bovis subsp bovis AF2122/97
cgggcgcgccggccaugccu

SEQ ID NO: 3188801 - RNA, 15 nt, Mycobacterium bovis subsp bovis AF2122/97
cgggcgcgcucgugg

SEQ ID NO: 3188802 - RNA, 12 nt, Mycobacterium bovis subsp bovis AF2122/97
cgggcgcgcugc

SEQ ID NO: 3188803 - RNA, 15 nt, Mycobacterium bovis subsp bovis AF2122/97
cgggcgcgcugccca

SEQ ID NO: 3188804 - RNA, 12 nt, Mycobacterium bovis subsp bovis AF2122/97
cgggcgcggggc

SEQ ID NO: 3188805 - RNA, 16 nt, Mycobacterium bovis subsp bovis AF2122/97
cgggcgcggggcggcc

SEQ ID NO: 3188806 - RNA, 22 nt, Mycobacterium bovis subsp bovis AF2122/97
cgggcgcgggugaccaggcggc

SEQ ID NO: 3188807 - RNA, 19 nt, Mycobacterium bovis subsp bovis AF2122/97
cgggcgcgguaaccacgcg

SEQ ID NO: 3188808 - RNA, 20 nt, Mycobacterium bovis subsp bovis AF2122/97
cgggcgcgguaaccacgcgg

SEQ ID NO: 3188809 - RNA, 22 nt, Mycobacterium bovis subsp bovis AF2122/97
cgggcgcgguaaccacgcggau

SEQ ID NO: 3188810 - RNA, 20 nt, Mycobacterium bovis subsp bovis AF2122/97
cgggcgcguccucgccgcac

SEQ ID NO: 3188811 - RNA, 21 nt, Mycobacterium bovis subsp bovis AF2122/97
cgggcgcguccucgccgcacg

SEQ ID NO: 3188812 - RNA, 15 nt, Mycobacterium bovis subsp bovis AF2122/97
cgggcgcgucggcgu

SEQ ID NO: 3188813 - RNA, 16 nt, Mycobacterium bovis subsp bovis AF2122/97
cgggcgcuggacggcg

SEQ ID NO: 3188814 - RNA, 17 nt, Mycobacterium bovis subsp bovis AF2122/97
cgggcgcuggacggcgg

SEQ ID NO: 3188815 - RNA, 18 nt, Mycobacterium bovis subsp bovis AF2122/97
cgggcgcuggacggcggg

SEQ ID NO: 3188816 - RNA, 18 nt, Mycobacterium bovis subsp bovis AF2122/97
cgggcgcuguagucgcgc

SEQ ID NO: 3188817 - RNA, 20 nt, Mycobacterium bovis subsp bovis AF2122/97
cgggcgcuguagucgcgccu

SEQ ID NO: 3188818 - RNA, 21 nt, Mycobacterium bovis subsp bovis AF2122/97
cgggcgcuugcaccaggggcg

SEQ ID NO: 3188819 - RNA, 17 nt, Mycobacterium bovis subsp bovis AF2122/97
cgggcggaaacaagcaa

SEQ ID NO: 3188820 - RNA, 18 nt, Mycobacterium bovis subsp bovis AF2122/97
cgggcggaaagcccgucg

SEQ ID NO: 3188821 - RNA, 19 nt, Mycobacterium bovis subsp bovis AF2122/97
cgggcggaaagcccgucgg

SEQ ID NO: 3188822 - RNA, 15 nt, Mycobacterium bovis subsp bovis AF2122/97
cgggcggaacgccgg

SEQ ID NO: 3188823 - RNA, 18 nt, Mycobacterium bovis subsp bovis AF2122/97
cgggcggaacgccggcac

SEQ ID NO: 3188824 - RNA, 14 nt, Mycobacterium bovis subsp bovis AF2122/97
cgggcggaucgccg

SEQ ID NO: 3188825 - RNA, 15 nt, Mycobacterium bovis subsp bovis AF2122/97
cgggcggaucgccgg

SEQ ID NO: 3188826 - RNA, 22 nt, Mycobacterium bovis subsp bovis AF2122/97
cgggcggaucgccggggacgcc

SEQ ID NO: 3188827 - RNA, 17 nt, Mycobacterium bovis subsp bovis AF2122/97
cgggcggccaggcgcga

SEQ ID NO: 3188828 - RNA, 15 nt, Mycobacterium bovis subsp bovis AF2122/97
cgggcggccauggca

SEQ ID NO: 3188829 - RNA, 21 nt, Mycobacterium bovis subsp bovis AF2122/97
cgggcggccucguugaccggg

SEQ ID NO: 3188830 - RNA, 20 nt, Mycobacterium bovis subsp bovis AF2122/97
cgggcggcgcgauagauacc

SEQ ID NO: 3188831 - RNA, 15 nt, Mycobacterium bovis subsp bovis AF2122/97
cgggcggcggcgacu

SEQ ID NO: 3188832 - RNA, 11 nt, Mycobacterium bovis subsp bovis AF2122/97
cgggcggcguc

SEQ ID NO: 3188833 - RNA, 16 nt, Mycobacterium bovis subsp bovis AF2122/97
cgggcggcgucgguga

SEQ ID NO: 3188834 - RNA, 16 nt, Mycobacterium bovis subsp bovis AF2122/97
cgggcggcgucugcgc

SEQ ID NO: 3188835 - RNA, 14 nt, Mycobacterium bovis subsp bovis AF2122/97
cgggcggcgugguu

SEQ ID NO: 3188836 - RNA, 17 nt, Mycobacterium bovis subsp bovis AF2122/97
cgggcgggauccaccca

SEQ ID NO: 3188837 - RNA, 18 nt, Mycobacterium bovis subsp bovis AF2122/97
cgggcgggauccacccag

SEQ ID NO: 3188838 - RNA, 16 nt, Mycobacterium bovis subsp bovis AF2122/97
cgggcgggccugcgcg

SEQ ID NO: 3188839 - RNA, 22 nt, Mycobacterium bovis subsp bovis AF2122/97
cgggcgggcguccacgcugacc

SEQ ID NO: 3188840 - RNA, 23 nt, Mycobacterium bovis subsp bovis AF2122/97
cgggcgggcuggugucagcugau

SEQ ID NO: 3188841 - RNA, 17 nt, Mycobacterium bovis subsp bovis AF2122/97
cgggcggggacggcggc

SEQ ID NO: 3188842 - RNA, 19 nt, Mycobacterium bovis subsp bovis AF2122/97
cgggcggggacggcggcaa

SEQ ID NO: 3188843 - RNA, 16 nt, Mycobacterium bovis subsp bovis AF2122/97
cgggcgguaaucgcga

SEQ ID NO: 3188844 - RNA, 17 nt, Mycobacterium bovis subsp bovis AF2122/97
cgggcgguaaucgcgag

SEQ ID NO: 3188845 - RNA, 22 nt, Mycobacterium bovis subsp bovis AF2122/97
cgggcgguccaaaacaccgcca

SEQ ID NO: 3188846 - RNA, 16 nt, Mycobacterium bovis subsp bovis AF2122/97
cgggcggucgagaugu

SEQ ID NO: 3188847 - RNA, 13 nt, Mycobacterium bovis subsp bovis AF2122/97
cgggcggugcaca

SEQ ID NO: 3188848 - RNA, 16 nt, Mycobacterium bovis subsp bovis AF2122/97
cgggcggugggcagca

SEQ ID NO: 3188849 - RNA, 17 nt, Mycobacterium bovis subsp bovis AF2122/97
cgggcggugggcagcag

SEQ ID NO: 3188850 - RNA, 18 nt, Mycobacterium bovis subsp bovis AF2122/97
cgggcggugggcagcagc

SEQ ID NO: 3188851 - RNA, 19 nt, Mycobacterium bovis subsp bovis AF2122/97
cgggcguacauucgggcgu

SEQ ID NO: 3188852 - RNA, 12 nt, Mycobacterium bovis subsp bovis AF2122/97
cgggcgucacgg

SEQ ID NO: 3188853 - RNA, 20 nt, Mycobacterium bovis subsp bovis AF2122/97
cgggcgucacggugcguucg

SEQ ID NO: 3188854 - RNA, 21 nt, Mycobacterium bovis subsp bovis AF2122/97
cgggcgucagcaguucggcga

SEQ ID NO: 3188855 - RNA, 15 nt, Mycobacterium bovis subsp bovis AF2122/97
cgggcgucccaaucg

SEQ ID NO: 3188856 - RNA, 19 nt, Mycobacterium bovis subsp bovis AF2122/97
cgggcgucccaaucgggau

SEQ ID NO: 3188857 - RNA, 14 nt, Mycobacterium bovis subsp bovis AF2122/97
cgggcgucccggcg

SEQ ID NO: 3188858 - RNA, 15 nt, Mycobacterium bovis subsp bovis AF2122/97
cgggcgucccggcgg

SEQ ID NO: 3188859 - RNA, 16 nt, Mycobacterium bovis subsp bovis AF2122/97
cgggcgucccggcggu

SEQ ID NO: 3188860 - RNA, 21 nt, Mycobacterium bovis subsp bovis AF2122/97
cgggcgucccggcggucagcg

SEQ ID NO: 3188861 - RNA, 16 nt, Mycobacterium bovis subsp bovis AF2122/97
cgggcguccgccggcg

SEQ ID NO: 3188862 - RNA, 17 nt, Mycobacterium bovis subsp bovis AF2122/97
cgggcguccgccggcga

SEQ ID NO: 3188863 - RNA, 13 nt, Mycobacterium bovis subsp bovis AF2122/97
cgggcgucgucgg

SEQ ID NO: 3188864 - RNA, 15 nt, Mycobacterium bovis subsp bovis AF2122/97
cgggcgucgucggug

SEQ ID NO: 3188865 - RNA, 19 nt, Mycobacterium bovis subsp bovis AF2122/97
cgggcgugaucccgcccaa

SEQ ID NO: 3188866 - RNA, 14 nt, Mycobacterium bovis subsp bovis AF2122/97
cgggcgugccgacc

SEQ ID NO: 3188867 - RNA, 15 nt, Mycobacterium bovis subsp bovis AF2122/97
cgggcgugccgacca

SEQ ID NO: 3188868 - RNA, 17 nt, Mycobacterium bovis subsp bovis AF2122/97
cgggcgugccgaccagc

SEQ ID NO: 3188869 - RNA, 15 nt, Mycobacterium bovis subsp bovis AF2122/97
cgggcgugcggcggc

SEQ ID NO: 3188870 - RNA, 15 nt, Mycobacterium bovis subsp bovis AF2122/97
cgggcgugcucgccg

SEQ ID NO: 3188871 - RNA, 16 nt, Mycobacterium bovis subsp bovis AF2122/97
cgggcgugcucgccgg

SEQ ID NO: 3188872 - RNA, 22 nt, Mycobacterium bovis subsp bovis AF2122/97
cgggcgugcucggaggcgauca

SEQ ID NO: 3188873 - RNA, 14 nt, Mycobacterium bovis subsp bovis AF2122/97
cgggcgugcugccg

SEQ ID NO: 3188874 - RNA, 15 nt, Mycobacterium bovis subsp bovis AF2122/97
cgggcgugcugccga

SEQ ID NO: 3188875 - RNA, 18 nt, Mycobacterium bovis subsp bovis AF2122/97
cgggcgugggcaccccgc

SEQ ID NO: 3188876 - RNA, 23 nt, Mycobacterium bovis subsp bovis AF2122/97
cgggcgugguaaccagggcagcc

SEQ ID NO: 3188877 - RNA, 14 nt, Mycobacterium bovis subsp bovis AF2122/97
cgggcgugucggga

SEQ ID NO: 3188878 - RNA, 23 nt, Mycobacterium bovis subsp bovis AF2122/97
cgggcguucucgauugucgccgc

SEQ ID NO: 3188879 - RNA, 14 nt, Mycobacterium bovis subsp bovis AF2122/97
cgggcguuggccag

SEQ ID NO: 3188880 - RNA, 17 nt, Mycobacterium bovis subsp bovis AF2122/97
cgggcguuggccagcag

SEQ ID NO: 3188881 - RNA, 20 nt, Mycobacterium bovis subsp bovis AF2122/97
cgggcguugggaucgcgcag

SEQ ID NO: 3188882 - RNA, 21 nt, Mycobacterium bovis subsp bovis AF2122/97
cgggcguugggaucgcgcagc

SEQ ID NO: 3188883 - RNA, 19 nt, Mycobacterium bovis subsp bovis AF2122/97
cgggcguuguuaucgaagc

SEQ ID NO: 3188884 - RNA, 22 nt, Mycobacterium bovis subsp bovis AF2122/97
cgggcguuguuaucgaagcccg

SEQ ID NO: 3188885 - RNA, 17 nt, Mycobacterium bovis subsp bovis AF2122/97
cgggcguuuggacgggc

SEQ ID NO: 3188886 - RNA, 23 nt, Mycobacterium bovis subsp bovis AF2122/97
cgggcguuuggacgggcgugcug

SEQ ID NO: 3188887 - RNA, 16 nt, Mycobacterium bovis subsp bovis AF2122/97
cgggcuaccggcagcu

SEQ ID NO: 3188888 - RNA, 16 nt, Mycobacterium bovis subsp bovis AF2122/97
cgggcuaggcggcguu

SEQ ID NO: 3188889 - RNA, 17 nt, Mycobacterium bovis subsp bovis AF2122/97
cgggcuauccgcgggaa

SEQ ID NO: 3188890 - RNA, 20 nt, Mycobacterium bovis subsp bovis AF2122/97
cgggcuaucgguucagcugc

SEQ ID NO: 3188891 - RNA, 15 nt, Mycobacterium bovis subsp bovis AF2122/97
cgggcucaacaccag

SEQ ID NO: 3188892 - RNA, 19 nt, Mycobacterium bovis subsp bovis AF2122/97
cgggcucaacaccagccgg

SEQ ID NO: 3188893 - RNA, 22 nt, Mycobacterium bovis subsp bovis AF2122/97
cgggcucaacaccagccggucg

SEQ ID NO: 3188894 - RNA, 17 nt, Mycobacterium bovis subsp bovis AF2122/97
cgggcucacaugugcgc

SEQ ID NO: 3188895 - RNA, 21 nt, Mycobacterium bovis subsp bovis AF2122/97
cgggcucagacuuucgcccag

SEQ ID NO: 3188896 - RNA, 15 nt, Mycobacterium bovis subsp bovis AF2122/97
cgggcucagcggcga

SEQ ID NO: 3188897 - RNA, 18 nt, Mycobacterium bovis subsp bovis AF2122/97
cgggcucagcggcgaccg

SEQ ID NO: 3188898 - RNA, 14 nt, Mycobacterium bovis subsp bovis AF2122/97
cgggcuccaacagg

SEQ ID NO: 3188899 - RNA, 20 nt, Mycobacterium bovis subsp bovis AF2122/97
cgggcuccaauugcggccgc

SEQ ID NO: 3188900 - RNA, 13 nt, Mycobacterium bovis subsp bovis AF2122/97
cgggcuccccggc

SEQ ID NO: 3188901 - RNA, 20 nt, Mycobacterium bovis subsp bovis AF2122/97
cgggcuccccggcaaccggg

SEQ ID NO: 3188902 - RNA, 19 nt, Mycobacterium bovis subsp bovis AF2122/97
cgggcuccgugguugccga

SEQ ID NO: 3188903 - RNA, 17 nt, Mycobacterium bovis subsp bovis AF2122/97
cgggcucgcauguucuc

SEQ ID NO: 3188904 - RNA, 22 nt, Mycobacterium bovis subsp bovis AF2122/97
cgggcucgcauguucuccacgc

SEQ ID NO: 3188905 - RNA, 20 nt, Mycobacterium bovis subsp bovis AF2122/97
cgggcucgcuucaggcaccg

SEQ ID NO: 3188906 - RNA, 23 nt, Mycobacterium bovis subsp bovis AF2122/97
cgggcucgcuucaggcaccggau

SEQ ID NO: 3188907 - RNA, 15 nt, Mycobacterium bovis subsp bovis AF2122/97
cgggcucggagauga

SEQ ID NO: 3188908 - RNA, 16 nt, Mycobacterium bovis subsp bovis AF2122/97
cgggcucggcaggccc

SEQ ID NO: 3188909 - RNA, 21 nt, Mycobacterium bovis subsp bovis AF2122/97
cgggcucggcgaaacccggga

SEQ ID NO: 3188910 - RNA, 15 nt, Mycobacterium bovis subsp bovis AF2122/97
cgggcucggcgaagg

SEQ ID NO: 3188911 - RNA, 18 nt, Mycobacterium bovis subsp bovis AF2122/97
cgggcucggcgucgccgc

SEQ ID NO: 3188912 - RNA, 20 nt, Mycobacterium bovis subsp bovis AF2122/97
cgggcucggcgucgccgcca

SEQ ID NO: 3188913 - RNA, 15 nt, Mycobacterium bovis subsp bovis AF2122/97
cgggcucguguccgc

SEQ ID NO: 3188914 - RNA, 16 nt, Mycobacterium bovis subsp bovis AF2122/97
cgggcucguguccgcc

SEQ ID NO: 3188915 - RNA, 18 nt, Mycobacterium bovis subsp bovis AF2122/97
cgggcucguguccgccgu

SEQ ID NO: 3188916 - RNA, 22 nt, Mycobacterium bovis subsp bovis AF2122/97
cgggcucguguccgccgucacc

SEQ ID NO: 3188917 - RNA, 11 nt, Mycobacterium bovis subsp bovis AF2122/97
cgggcucuacu

SEQ ID NO: 3188918 - RNA, 20 nt, Mycobacterium bovis subsp bovis AF2122/97
cgggcugacgaucuccaccc

SEQ ID NO: 3188919 - RNA, 16 nt, Mycobacterium bovis subsp bovis AF2122/97
cgggcugaggcggcga

SEQ ID NO: 3188920 - RNA, 21 nt, Mycobacterium bovis subsp bovis AF2122/97
cgggcugaggcggcgacgacc

SEQ ID NO: 3188921 - RNA, 12 nt, Mycobacterium bovis subsp bovis AF2122/97
cgggcugcagcc

SEQ ID NO: 3188922 - RNA, 18 nt, Mycobacterium bovis subsp bovis AF2122/97
cgggcugcagugacucga

SEQ ID NO: 3188923 - RNA, 23 nt, Mycobacterium bovis subsp bovis AF2122/97
cgggcugcagugacucgaucacc

SEQ ID NO: 3188924 - RNA, 17 nt, Mycobacterium bovis subsp bovis AF2122/97
cgggcugccaaggccuu

SEQ ID NO: 3188925 - RNA, 21 nt, Mycobacterium bovis subsp bovis AF2122/97
cgggcugccccuccgggcgca

SEQ ID NO: 3188926 - RNA, 22 nt, Mycobacterium bovis subsp bovis AF2122/97
cgggcugccgcccaugccggga

SEQ ID NO: 3188927 - RNA, 15 nt, Mycobacterium bovis subsp bovis AF2122/97
cgggcugcggcagua

SEQ ID NO: 3188928 - RNA, 19 nt, Mycobacterium bovis subsp bovis AF2122/97
cgggcugcuugcgcccggc

SEQ ID NO: 3188929 - RNA, 14 nt, Mycobacterium bovis subsp bovis AF2122/97
cgggcuggccgacu

SEQ ID NO: 3188930 - RNA, 17 nt, Mycobacterium bovis subsp bovis AF2122/97
cgggcuguaggcgauca

SEQ ID NO: 3188931 - RNA, 13 nt, Mycobacterium bovis subsp bovis AF2122/97
cgggcugucaggc

SEQ ID NO: 3188932 - RNA, 20 nt, Mycobacterium bovis subsp bovis AF2122/97
cgggcugugaacagcgcguc

SEQ ID NO: 3188933 - RNA, 22 nt, Mycobacterium bovis subsp bovis AF2122/97
cgggcugugaacagcgcgucgg

SEQ ID NO: 3188934 - RNA, 16 nt, Mycobacterium bovis subsp bovis AF2122/97
cgggcuuaggccgcgg

SEQ ID NO: 3188935 - RNA, 16 nt, Mycobacterium bovis subsp bovis AF2122/97
cgggcuucagcacgcg

SEQ ID NO: 3188936 - RNA, 21 nt, Mycobacterium bovis subsp bovis AF2122/97
cgggcuugccgucuucgccgc

SEQ ID NO: 3188937 - RNA, 15 nt, Mycobacterium bovis subsp bovis AF2122/97
cgggcuugccguugg

SEQ ID NO: 3188938 - RNA, 15 nt, Mycobacterium bovis subsp bovis AF2122/97
cgggcuugcgcagca

SEQ ID NO: 3188939 - RNA, 17 nt, Mycobacterium bovis subsp bovis AF2122/97
cgggcuuggccgcgccg

SEQ ID NO: 3188940 - RNA, 20 nt, Mycobacterium bovis subsp bovis AF2122/97
cgggcuuggggucccgccgg

SEQ ID NO: 3188941 - RNA, 11 nt, Mycobacterium bovis subsp bovis AF2122/97
cggggaacacc

SEQ ID NO: 3188942 - RNA, 13 nt, Mycobacterium bovis subsp bovis AF2122/97
cggggaacaccgc

SEQ ID NO: 3188943 - RNA, 18 nt, Mycobacterium bovis subsp bovis AF2122/97
cggggaacaccgcgguga

SEQ ID NO: 3188944 - RNA, 21 nt, Mycobacterium bovis subsp bovis AF2122/97
cggggaacguccgcgccgagc

SEQ ID NO: 3188945 - RNA, 14 nt, Mycobacterium bovis subsp bovis AF2122/97
cggggaagcccggc

SEQ ID NO: 3188946 - RNA, 20 nt, Mycobacterium bovis subsp bovis AF2122/97
cggggaagcccggcagaugc

SEQ ID NO: 3188947 - RNA, 16 nt, Mycobacterium bovis subsp bovis AF2122/97
cggggaagccugcggg

SEQ ID NO: 3188948 - RNA, 17 nt, Mycobacterium bovis subsp bovis AF2122/97
cggggaagccugcgggc

SEQ ID NO: 3188949 - RNA, 19 nt, Mycobacterium bovis subsp bovis AF2122/97
cggggaagccugcgggccg

SEQ ID NO: 3188950 - RNA, 18 nt, Mycobacterium bovis subsp bovis AF2122/97
cggggaaggggcucagcg

SEQ ID NO: 3188951 - RNA, 18 nt, Mycobacterium bovis subsp bovis AF2122/97
cggggaaucacccacucg

SEQ ID NO: 3188952 - RNA, 17 nt, Mycobacterium bovis subsp bovis AF2122/97
cggggacaacucgcgug

SEQ ID NO: 3188953 - RNA, 18 nt, Mycobacterium bovis subsp bovis AF2122/97
cggggacagcccggcaga

SEQ ID NO: 3188954 - RNA, 18 nt, Mycobacterium bovis subsp bovis AF2122/97
cggggaccacgccgacgu

SEQ ID NO: 3188955 - RNA, 20 nt, Mycobacterium bovis subsp bovis AF2122/97
cggggaccgcggucauggcg

SEQ ID NO: 3188956 - RNA, 14 nt, Mycobacterium bovis subsp bovis AF2122/97
cggggaccucggcg

SEQ ID NO: 3188957 - RNA, 16 nt, Mycobacterium bovis subsp bovis AF2122/97
cggggacgcccucggg

SEQ ID NO: 3188958 - RNA, 16 nt, Mycobacterium bovis subsp bovis AF2122/97
cggggacgccgcggcg

SEQ ID NO: 3188959 - RNA, 16 nt, Mycobacterium bovis subsp bovis AF2122/97
cggggacgcgccccag

SEQ ID NO: 3188960 - RNA, 14 nt, Mycobacterium bovis subsp bovis AF2122/97
cggggacggcggca

SEQ ID NO: 3188961 - RNA, 18 nt, Mycobacterium bovis subsp bovis AF2122/97
cggggacggcggcaaggg

SEQ ID NO: 3188962 - RNA, 15 nt, Mycobacterium bovis subsp bovis AF2122/97
cggggacgggucggc

SEQ ID NO: 3188963 - RNA, 23 nt, Mycobacterium bovis subsp bovis AF2122/97
cggggacgucgacuucgcccggg

SEQ ID NO: 3188964 - RNA, 15 nt, Mycobacterium bovis subsp bovis AF2122/97
cggggagcugcggcg

SEQ ID NO: 3188965 - RNA, 19 nt, Mycobacterium bovis subsp bovis AF2122/97
cggggagcugcggcggcca

SEQ ID NO: 3188966 - RNA, 15 nt, Mycobacterium bovis subsp bovis AF2122/97
cggggaggucgagcu

SEQ ID NO: 3188967 - RNA, 21 nt, Mycobacterium bovis subsp bovis AF2122/97
cggggaguggaaacccgccga

SEQ ID NO: 3188968 - RNA, 18 nt, Mycobacterium bovis subsp bovis AF2122/97
cggggaguucgcgcagca

SEQ ID NO: 3188969 - RNA, 18 nt, Mycobacterium bovis subsp bovis AF2122/97
cggggauaccggucagca

SEQ ID NO: 3188970 - RNA, 17 nt, Mycobacterium bovis subsp bovis AF2122/97
cggggauaucacgacgc

SEQ ID NO: 3188971 - RNA, 20 nt, Mycobacterium bovis subsp bovis AF2122/97
cggggauaucacgacgccga

SEQ ID NO: 3188972 - RNA, 21 nt, Mycobacterium bovis subsp bovis AF2122/97
cggggaucgcaagccguugca

SEQ ID NO: 3188973 - RNA, 19 nt, Mycobacterium bovis subsp bovis AF2122/97
cggggaucgcuggccgcga

SEQ ID NO: 3188974 - RNA, 15 nt, Mycobacterium bovis subsp bovis AF2122/97
cggggaugcgaccgc

SEQ ID NO: 3188975 - RNA, 16 nt, Mycobacterium bovis subsp bovis AF2122/97
cggggauggagccggu

SEQ ID NO: 3188976 - RNA, 19 nt, Mycobacterium bovis subsp bovis AF2122/97
cggggauggagccggugac

SEQ ID NO: 3188977 - RNA, 21 nt, Mycobacterium bovis subsp bovis AF2122/97
cggggauggagccggugacgg

SEQ ID NO: 3188978 - RNA, 23 nt, Mycobacterium bovis subsp bovis AF2122/97
cggggauggagccggugacggug

SEQ ID NO: 3188979 - RNA, 19 nt, Mycobacterium bovis subsp bovis AF2122/97
cggggaugggggagccggu

SEQ ID NO: 3188980 - RNA, 17 nt, Mycobacterium bovis subsp bovis AF2122/97
cggggauuggcgacguc

SEQ ID NO: 3188981 - RNA, 20 nt, Mycobacterium bovis subsp bovis AF2122/97
cggggauuggugcccagcgc

SEQ ID NO: 3188982 - RNA, 16 nt, Mycobacterium bovis subsp bovis AF2122/97
cggggcacaaggguca

SEQ ID NO: 3188983 - RNA, 18 nt, Mycobacterium bovis subsp bovis AF2122/97
cggggcaccacgccagcc

SEQ ID NO: 3188984 - RNA, 24 nt, Mycobacterium bovis subsp bovis AF2122/97
cggggcaccacgccagcccguccg

SEQ ID NO: 3188985 - RNA, 18 nt, Mycobacterium bovis subsp bovis AF2122/97
cggggcagcgggccgccc

SEQ ID NO: 3188986 - RNA, 23 nt, Mycobacterium bovis subsp bovis AF2122/97
cggggcagcucaccuuccucgaa

SEQ ID NO: 3188987 - RNA, 15 nt, Mycobacterium bovis subsp bovis AF2122/97
cggggccacccgcag

SEQ ID NO: 3188988 - RNA, 15 nt, Mycobacterium bovis subsp bovis AF2122/97
cggggccccaugccg

SEQ ID NO: 3188989 - RNA, 17 nt, Mycobacterium bovis subsp bovis AF2122/97
cggggccccaugccgac

SEQ ID NO: 3188990 - RNA, 19 nt, Mycobacterium bovis subsp bovis AF2122/97
cggggccccaugccgaccg

SEQ ID NO: 3188991 - RNA, 22 nt, Mycobacterium bovis subsp bovis AF2122/97
cggggcccccgccggacacgau

SEQ ID NO: 3188992 - RNA, 19 nt, Mycobacterium bovis subsp bovis AF2122/97
cggggccccgcggcgccgc

SEQ ID NO: 3188993 - RNA, 20 nt, Mycobacterium bovis subsp bovis AF2122/97
cggggccccgcggcgccgcc

SEQ ID NO: 3188994 - RNA, 17 nt, Mycobacterium bovis subsp bovis AF2122/97
cggggccgaauccgucc

SEQ ID NO: 3188995 - RNA, 15 nt, Mycobacterium bovis subsp bovis AF2122/97
cggggccgcaaccau

SEQ ID NO: 3188996 - RNA, 22 nt, Mycobacterium bovis subsp bovis AF2122/97
cggggccgcacuguugcguagc

SEQ ID NO: 3188997 - RNA, 16 nt, Mycobacterium bovis subsp bovis AF2122/97
cggggccgccagcugc

SEQ ID NO: 3188998 - RNA, 18 nt, Mycobacterium bovis subsp bovis AF2122/97
cggggccgccagcugcgc

SEQ ID NO: 3188999 - RNA, 16 nt, Mycobacterium bovis subsp bovis AF2122/97
cggggccgccgaugcc

SEQ ID NO: 3189000 - RNA, 15 nt, Mycobacterium bovis subsp bovis AF2122/97
cggggccgccgcggc

SEQ ID NO: 3189001 - RNA, 17 nt, Mycobacterium bovis subsp bovis AF2122/97
cggggccgccgcggccg

SEQ ID NO: 3189002 - RNA, 19 nt, Mycobacterium bovis subsp bovis AF2122/97
cggggccgccgcggccggc

SEQ ID NO: 3189003 - RNA, 20 nt, Mycobacterium bovis subsp bovis AF2122/97
cggggccgccgcggccggcg

SEQ ID NO: 3189004 - RNA, 21 nt, Mycobacterium bovis subsp bovis AF2122/97
cggggccgccgcggccggcgc

SEQ ID NO: 3189005 - RNA, 22 nt, Mycobacterium bovis subsp bovis AF2122/97
cggggccgccgcggccggcgcu

SEQ ID NO: 3189006 - RNA, 21 nt, Mycobacterium bovis subsp bovis AF2122/97
cggggccgcgccuugcuuccg

SEQ ID NO: 3189007 - RNA, 15 nt, Mycobacterium bovis subsp bovis AF2122/97
cggggccggaugacg

SEQ ID NO: 3189008 - RNA, 15 nt, Mycobacterium bovis subsp bovis AF2122/97
cggggccggccggca

SEQ ID NO: 3189009 - RNA, 13 nt, Mycobacterium bovis subsp bovis AF2122/97
cggggccggcggc

SEQ ID NO: 3189010 - RNA, 15 nt, Mycobacterium bovis subsp bovis AF2122/97
cggggccggcggcuc

SEQ ID NO: 3189011 - RNA, 19 nt, Mycobacterium bovis subsp bovis AF2122/97
cggggccggcggcucgggu

SEQ ID NO: 3189012 - RNA, 10 nt, Mycobacterium bovis subsp bovis AF2122/97
cggggccggu

SEQ ID NO: 3189013 - RNA, 12 nt, Mycobacterium bovis subsp bovis AF2122/97
cggggccgucgg

SEQ ID NO: 3189014 - RNA, 14 nt, Mycobacterium bovis subsp bovis AF2122/97
cggggccgucggca

SEQ ID NO: 3189015 - RNA, 12 nt, Mycobacterium bovis subsp bovis AF2122/97
cggggccgucgu

SEQ ID NO: 3189016 - RNA, 21 nt, Mycobacterium bovis subsp bovis AF2122/97
cggggccgucgucggucaccg

SEQ ID NO: 3189017 - RNA, 18 nt, Mycobacterium bovis subsp bovis AF2122/97
cggggccgucucgccgug

SEQ ID NO: 3189018 - RNA, 16 nt, Mycobacterium bovis subsp bovis AF2122/97
cggggccucgcgagaa

SEQ ID NO: 3189019 - RNA, 18 nt, Mycobacterium bovis subsp bovis AF2122/97
cggggccugcguccgacg

SEQ ID NO: 3189020 - RNA, 17 nt, Mycobacterium bovis subsp bovis AF2122/97
cggggccuucggcccgg

SEQ ID NO: 3189021 - RNA, 20 nt, Mycobacterium bovis subsp bovis AF2122/97
cggggccuucggcccggugg

SEQ ID NO: 3189022 - RNA, 19 nt, Mycobacterium bovis subsp bovis AF2122/97
cggggcgaacggcaccgcg

SEQ ID NO: 3189023 - RNA, 12 nt, Mycobacterium bovis subsp bovis AF2122/97
cggggcgacgau

SEQ ID NO: 3189024 - RNA, 17 nt, Mycobacterium bovis subsp bovis AF2122/97
cggggcgauccccagca

SEQ ID NO: 3189025 - RNA, 13 nt, Mycobacterium bovis subsp bovis AF2122/97
cggggcgcccggc

SEQ ID NO: 3189026 - RNA, 20 nt, Mycobacterium bovis subsp bovis AF2122/97
cggggcgccugaugcggccg

SEQ ID NO: 3189027 - RNA, 19 nt, Mycobacterium bovis subsp bovis AF2122/97
cggggcgcgguaccggugu

SEQ ID NO: 3189028 - RNA, 20 nt, Mycobacterium bovis subsp bovis AF2122/97
cggggcgcucgcgcgcuggg

SEQ ID NO: 3189029 - RNA, 18 nt, Mycobacterium bovis subsp bovis AF2122/97
cggggcggcauuggcggu

SEQ ID NO: 3189030 - RNA, 19 nt, Mycobacterium bovis subsp bovis AF2122/97
cggggcggcauuggcggug

SEQ ID NO: 3189031 - RNA, 16 nt, Mycobacterium bovis subsp bovis AF2122/97
cggggcggucggccgg

SEQ ID NO: 3189032 - RNA, 13 nt, Mycobacterium bovis subsp bovis AF2122/97
cggggcuagucgg

SEQ ID NO: 3189033 - RNA, 23 nt, Mycobacterium bovis subsp bovis AF2122/97
cggggcucaagucucccggccgc

SEQ ID NO: 3189034 - RNA, 16 nt, Mycobacterium bovis subsp bovis AF2122/97
cggggcucucgagucc

SEQ ID NO: 3189035 - RNA, 22 nt, Mycobacterium bovis subsp bovis AF2122/97
cggggcucucgaguccaggcag

SEQ ID NO: 3189036 - RNA, 22 nt, Mycobacterium bovis subsp bovis AF2122/97
cggggcucucggaucuugacgu

SEQ ID NO: 3189037 - RNA, 15 nt, Mycobacterium bovis subsp bovis AF2122/97
cggggcugaccgcca

SEQ ID NO: 3189038 - RNA, 14 nt, Mycobacterium bovis subsp bovis AF2122/97
cggggcugcccgcg

SEQ ID NO: 3189039 - RNA, 11 nt, Mycobacterium bovis subsp bovis AF2122/97
cggggcugccg

SEQ ID NO: 3189040 - RNA, 14 nt, Mycobacterium bovis subsp bovis AF2122/97
cggggcugccgccg

SEQ ID NO: 3189041 - RNA, 13 nt, Mycobacterium bovis subsp bovis AF2122/97
cggggcugccggu

SEQ ID NO: 3189042 - RNA, 23 nt, Mycobacterium bovis subsp bovis AF2122/97
cggggcugggcgccaugcgccaa

SEQ ID NO: 3189043 - RNA, 21 nt, Mycobacterium bovis subsp bovis AF2122/97
cggggcuguacucgcggcgcg

SEQ ID NO: 3189044 - RNA, 21 nt, Mycobacterium bovis subsp bovis AF2122/97
cggggcuucaucuggcgccgu

SEQ ID NO: 3189045 - RNA, 17 nt, Mycobacterium bovis subsp bovis AF2122/97
cgggggaagcgccaaac

SEQ ID NO: 3189046 - RNA, 16 nt, Mycobacterium bovis subsp bovis AF2122/97
cgggggaagcgcgucc

SEQ ID NO: 3189047 - RNA, 17 nt, Mycobacterium bovis subsp bovis AF2122/97
cgggggaccccgccagc

SEQ ID NO: 3189048 - RNA, 12 nt, Mycobacterium bovis subsp bovis AF2122/97
cgggggacgggu

SEQ ID NO: 3189049 - RNA, 16 nt, Mycobacterium bovis subsp bovis AF2122/97
cgggggagcgaacggc

SEQ ID NO: 3189050 - RNA, 22 nt, Mycobacterium bovis subsp bovis AF2122/97
cgggggagcgaacggcgcaguu

SEQ ID NO: 3189051 - RNA, 18 nt, Mycobacterium bovis subsp bovis AF2122/97
cgggggaguagugguggg

SEQ ID NO: 3189052 - RNA, 19 nt, Mycobacterium bovis subsp bovis AF2122/97
cgggggaguaguggugggc

SEQ ID NO: 3189053 - RNA, 14 nt, Mycobacterium bovis subsp bovis AF2122/97
cgggggcagcgcga

SEQ ID NO: 3189054 - RNA, 15 nt, Mycobacterium bovis subsp bovis AF2122/97
cgggggccagcguca

SEQ ID NO: 3189055 - RNA, 22 nt, Mycobacterium bovis subsp bovis AF2122/97
cgggggccagcgucaccucacc

SEQ ID NO: 3189056 - RNA, 17 nt, Mycobacterium bovis subsp bovis AF2122/97
cgggggccgaccagucg

SEQ ID NO: 3189057 - RNA, 21 nt, Mycobacterium bovis subsp bovis AF2122/97
cgggggccgaccagucgacgu

SEQ ID NO: 3189058 - RNA, 16 nt, Mycobacterium bovis subsp bovis AF2122/97
cgggggccgagccgac

SEQ ID NO: 3189059 - RNA, 23 nt, Mycobacterium bovis subsp bovis AF2122/97
cgggggccgcgucucggugcagc

SEQ ID NO: 3189060 - RNA, 20 nt, Mycobacterium bovis subsp bovis AF2122/97
cgggggcgccgccguugccg

SEQ ID NO: 3189061 - RNA, 21 nt, Mycobacterium bovis subsp bovis AF2122/97
cgggggcgccgccguugccgc

SEQ ID NO: 3189062 - RNA, 13 nt, Mycobacterium bovis subsp bovis AF2122/97
cgggggcgccgga

SEQ ID NO: 3189063 - RNA, 22 nt, Mycobacterium bovis subsp bovis AF2122/97
cgggggcgccggagccaacggc

SEQ ID NO: 3189064 - RNA, 14 nt, Mycobacterium bovis subsp bovis AF2122/97
cgggggcgccggcg

SEQ ID NO: 3189065 - RNA, 17 nt, Mycobacterium bovis subsp bovis AF2122/97
cgggggcgccggcgccc

SEQ ID NO: 3189066 - RNA, 14 nt, Mycobacterium bovis subsp bovis AF2122/97
cgggggcggccggc

SEQ ID NO: 3189067 - RNA, 15 nt, Mycobacterium bovis subsp bovis AF2122/97
cgggggcggccggcg

SEQ ID NO: 3189068 - RNA, 13 nt, Mycobacterium bovis subsp bovis AF2122/97
cgggggcggcggc

SEQ ID NO: 3189069 - RNA, 17 nt, Mycobacterium bovis subsp bovis AF2122/97
cgggggcgucgccgccg

SEQ ID NO: 3189070 - RNA, 20 nt, Mycobacterium bovis subsp bovis AF2122/97
cgggggcgucgccgccgggc

SEQ ID NO: 3189071 - RNA, 19 nt, Mycobacterium bovis subsp bovis AF2122/97
cgggggcugcacgcucguu

SEQ ID NO: 3189072 - RNA, 16 nt, Mycobacterium bovis subsp bovis AF2122/97
cgggggcuguccaccg

SEQ ID NO: 3189073 - RNA, 21 nt, Mycobacterium bovis subsp bovis AF2122/97
cgggggcuuauguguccgcuc

SEQ ID NO: 3189074 - RNA, 20 nt, Mycobacterium bovis subsp bovis AF2122/97
cgggggcuuuugcgucugcu

SEQ ID NO: 3189075 - RNA, 20 nt, Mycobacterium bovis subsp bovis AF2122/97
cggggggauccagcaggccg

SEQ ID NO: 3189076 - RNA, 23 nt, Mycobacterium bovis subsp bovis AF2122/97
cggggggauccagcaggccggga

SEQ ID NO: 3189077 - RNA, 21 nt, Mycobacterium bovis subsp bovis AF2122/97
cggggggaucucggucgacgg

SEQ ID NO: 3189078 - RNA, 17 nt, Mycobacterium bovis subsp bovis AF2122/97
cggggggucagacaaca

SEQ ID NO: 3189079 - RNA, 16 nt, Mycobacterium bovis subsp bovis AF2122/97
cggggguacgucaccg

SEQ ID NO: 3189080 - RNA, 19 nt, Mycobacterium bovis subsp bovis AF2122/97
cggggguacgucaccgggu

SEQ ID NO: 3189081 - RNA, 12 nt, Mycobacterium bovis subsp bovis AF2122/97
cgggggugcucg

SEQ ID NO: 3189082 - RNA, 17 nt, Mycobacterium bovis subsp bovis AF2122/97
cgggggugggcgugacg

SEQ ID NO: 3189083 - RNA, 20 nt, Mycobacterium bovis subsp bovis AF2122/97
cgggggugggcgugacgggc

SEQ ID NO: 3189084 - RNA, 20 nt, Mycobacterium bovis subsp bovis AF2122/97
cggggguuccacuccccagc

SEQ ID NO: 3189085 - RNA, 20 nt, Mycobacterium bovis subsp bovis AF2122/97
cgggguaucgacccuccagc

SEQ ID NO: 3189086 - RNA, 19 nt, Mycobacterium bovis subsp bovis AF2122/97
cggggucaaucccacgccc

SEQ ID NO: 3189087 - RNA, 22 nt, Mycobacterium bovis subsp bovis AF2122/97
cggggucaaucccacgcccggc

SEQ ID NO: 3189088 - RNA, 13 nt, Mycobacterium bovis subsp bovis AF2122/97
cggggucaccggc

SEQ ID NO: 3189089 - RNA, 17 nt, Mycobacterium bovis subsp bovis AF2122/97
cggggucaccuuggccg

SEQ ID NO: 3189090 - RNA, 18 nt, Mycobacterium bovis subsp bovis AF2122/97
cggggucagauccaggac

SEQ ID NO: 3189091 - RNA, 18 nt, Mycobacterium bovis subsp bovis AF2122/97
cgggguccaucggggccg

SEQ ID NO: 3189092 - RNA, 20 nt, Mycobacterium bovis subsp bovis AF2122/97
cgggguccaucggggccguc

SEQ ID NO: 3189093 - RNA, 22 nt, Mycobacterium bovis subsp bovis AF2122/97
cgggguccaucggggccgucgg

SEQ ID NO: 3189094 - RNA, 18 nt, Mycobacterium bovis subsp bovis AF2122/97
cggggucgaacagcucga

SEQ ID NO: 3189095 - RNA, 21 nt, Mycobacterium bovis subsp bovis AF2122/97
cggggucgaacaugauccgcc

SEQ ID NO: 3189096 - RNA, 13 nt, Mycobacterium bovis subsp bovis AF2122/97
cggggucgccggc

SEQ ID NO: 3189097 - RNA, 21 nt, Mycobacterium bovis subsp bovis AF2122/97
cggggucgcggaucucaucgg

SEQ ID NO: 3189098 - RNA, 16 nt, Mycobacterium bovis subsp bovis AF2122/97
cggggucggcccgcca

SEQ ID NO: 3189099 - RNA, 13 nt, Mycobacterium bovis subsp bovis AF2122/97
cggggucggccug

SEQ ID NO: 3189100 - RNA, 21 nt, Mycobacterium bovis subsp bovis AF2122/97
cggggucggccugcggcaccg

SEQ ID NO: 3189101 - RNA, 23 nt, Mycobacterium bovis subsp bovis AF2122/97
cggggucggccugcggcaccggc

SEQ ID NO: 3189102 - RNA, 22 nt, Mycobacterium bovis subsp bovis AF2122/97
cggggucggggaagacgaccgu

SEQ ID NO: 3189103 - RNA, 16 nt, Mycobacterium bovis subsp bovis AF2122/97
cggggucguugaggcc

SEQ ID NO: 3189104 - RNA, 18 nt, Mycobacterium bovis subsp bovis AF2122/97
cggggucguugaggccgg

SEQ ID NO: 3189105 - RNA, 22 nt, Mycobacterium bovis subsp bovis AF2122/97
cggggucguugaggccggugaa

SEQ ID NO: 3189106 - RNA, 19 nt, Mycobacterium bovis subsp bovis AF2122/97
cggggucuugacggcgcca

SEQ ID NO: 3189107 - RNA, 22 nt, Mycobacterium bovis subsp bovis AF2122/97
cggggucuugacggcgccaggc

SEQ ID NO: 3189108 - RNA, 14 nt, Mycobacterium bovis subsp bovis AF2122/97
cggggugcacaccg

SEQ ID NO: 3189109 - RNA, 21 nt, Mycobacterium bovis subsp bovis AF2122/97
cggggugcacaccgucgcgcu

SEQ ID NO: 3189110 - RNA, 15 nt, Mycobacterium bovis subsp bovis AF2122/97
cggggugcagagcca

SEQ ID NO: 3189111 - RNA, 13 nt, Mycobacterium bovis subsp bovis AF2122/97
cggggugcccggc

SEQ ID NO: 3189112 - RNA, 15 nt, Mycobacterium bovis subsp bovis AF2122/97
cggggugcccggccg

SEQ ID NO: 3189113 - RNA, 16 nt, Mycobacterium bovis subsp bovis AF2122/97
cggggugcccggccgc

SEQ ID NO: 3189114 - RNA, 17 nt, Mycobacterium bovis subsp bovis AF2122/97
cggggugcccggccgcc

SEQ ID NO: 3189115 - RNA, 18 nt, Mycobacterium bovis subsp bovis AF2122/97
cggggugcccggccgcca

SEQ ID NO: 3189116 - RNA, 20 nt, Mycobacterium bovis subsp bovis AF2122/97
cggggugcccggccgccagc

SEQ ID NO: 3189117 - RNA, 16 nt, Mycobacterium bovis subsp bovis AF2122/97
cggggugcgcgcgacc

SEQ ID NO: 3189118 - RNA, 17 nt, Mycobacterium bovis subsp bovis AF2122/97
cgggguggccaccagcg

SEQ ID NO: 3189119 - RNA, 18 nt, Mycobacterium bovis subsp bovis AF2122/97
cgggguggccaccagcgg

SEQ ID NO: 3189120 - RNA, 13 nt, Mycobacterium bovis subsp bovis AF2122/97
cgggguggcggca

SEQ ID NO: 3189121 - RNA, 15 nt, Mycobacterium bovis subsp bovis AF2122/97
cgggguggcggcgcu

SEQ ID NO: 3189122 - RNA, 20 nt, Mycobacterium bovis subsp bovis AF2122/97
cggggugggaaguagugcau

SEQ ID NO: 3189123 - RNA, 14 nt, Mycobacterium bovis subsp bovis AF2122/97
cggggugggugaca

SEQ ID NO: 3189124 - RNA, 18 nt, Mycobacterium bovis subsp bovis AF2122/97
cgggguggucgcaccgcc

SEQ ID NO: 3189125 - RNA, 19 nt, Mycobacterium bovis subsp bovis AF2122/97
cgggguggucgcaccgccg

SEQ ID NO: 3189126 - RNA, 21 nt, Mycobacterium bovis subsp bovis AF2122/97
cgggguggucgcaccgccggc

SEQ ID NO: 3189127 - RNA, 12 nt, Mycobacterium bovis subsp bovis AF2122/97
cggggugguggu

SEQ ID NO: 3189128 - RNA, 14 nt, Mycobacterium bovis subsp bovis AF2122/97
cggggugugcgggc

SEQ ID NO: 3189129 - RNA, 23 nt, Mycobacterium bovis subsp bovis AF2122/97
cggggugugcgggcggugcacac

SEQ ID NO: 3189130 - RNA, 17 nt, Mycobacterium bovis subsp bovis AF2122/97
cgggguguucgucgacc

SEQ ID NO: 3189131 - RNA, 22 nt, Mycobacterium bovis subsp bovis AF2122/97
cgggguuacucgcagcgccguc

SEQ ID NO: 3189132 - RNA, 15 nt, Mycobacterium bovis subsp bovis AF2122/97
cgggguucaccgucg

SEQ ID NO: 3189133 - RNA, 16 nt, Mycobacterium bovis subsp bovis AF2122/97
cgggguucaccgucga

SEQ ID NO: 3189134 - RNA, 17 nt, Mycobacterium bovis subsp bovis AF2122/97
cgggguugaccgccacc

SEQ ID NO: 3189135 - RNA, 20 nt, Mycobacterium bovis subsp bovis AF2122/97
cgggguugaccgccaccccg

SEQ ID NO: 3189136 - RNA, 23 nt, Mycobacterium bovis subsp bovis AF2122/97
cgggguugaccguggucggaggu

SEQ ID NO: 3189137 - RNA, 15 nt, Mycobacterium bovis subsp bovis AF2122/97
cgggguugacuggcc

SEQ ID NO: 3189138 - RNA, 19 nt, Mycobacterium bovis subsp bovis AF2122/97
cgggguugacuggccgccc

SEQ ID NO: 3189139 - RNA, 17 nt, Mycobacterium bovis subsp bovis AF2122/97
cgggguugaucaccgac

SEQ ID NO: 3189140 - RNA, 18 nt, Mycobacterium bovis subsp bovis AF2122/97
cgggguugaucaccgaca

SEQ ID NO: 3189141 - RNA, 23 nt, Mycobacterium bovis subsp bovis AF2122/97
cgggguugaucaccgacaccgug

SEQ ID NO: 3189142 - RNA, 16 nt, Mycobacterium bovis subsp bovis AF2122/97
cgggguuggccguggu

SEQ ID NO: 3189143 - RNA, 18 nt, Mycobacterium bovis subsp bovis AF2122/97
cgggguuguccucggcga

SEQ ID NO: 3189144 - RNA, 15 nt, Mycobacterium bovis subsp bovis AF2122/97
cgggguuucaggcgg

SEQ ID NO: 3189145 - RNA, 20 nt, Mycobacterium bovis subsp bovis AF2122/97
cgggguuucaggcggcaggu

SEQ ID NO: 3189146 - RNA, 17 nt, Mycobacterium bovis subsp bovis AF2122/97
cggguaaccggcuccgg

SEQ ID NO: 3189147 - RNA, 19 nt, Mycobacterium bovis subsp bovis AF2122/97
cggguaacgauugucgaug

SEQ ID NO: 3189148 - RNA, 19 nt, Mycobacterium bovis subsp bovis AF2122/97
cggguaacgcacccaccga

SEQ ID NO: 3189149 - RNA, 15 nt, Mycobacterium bovis subsp bovis AF2122/97
cggguaagacgucgg

SEQ ID NO: 3189150 - RNA, 20 nt, Mycobacterium bovis subsp bovis AF2122/97
cggguaagcgaccgacgcca

SEQ ID NO: 3189151 - RNA, 16 nt, Mycobacterium bovis subsp bovis AF2122/97
cggguacaccacgguu

SEQ ID NO: 3189152 - RNA, 15 nt, Mycobacterium bovis subsp bovis AF2122/97
cggguacacccgcuc

SEQ ID NO: 3189153 - RNA, 19 nt, Mycobacterium bovis subsp bovis AF2122/97
cggguacacccgcucgccc

SEQ ID NO: 3189154 - RNA, 13 nt, Mycobacterium bovis subsp bovis AF2122/97
cggguaccacgcu

SEQ ID NO: 3189155 - RNA, 18 nt, Mycobacterium bovis subsp bovis AF2122/97
cggguaccacgcuggcgc

SEQ ID NO: 3189156 - RNA, 15 nt, Mycobacterium bovis subsp bovis AF2122/97
cggguaccagcaccg

SEQ ID NO: 3189157 - RNA, 16 nt, Mycobacterium bovis subsp bovis AF2122/97
cggguaccagcaccga

SEQ ID NO: 3189158 - RNA, 17 nt, Mycobacterium bovis subsp bovis AF2122/97
cggguacccaucugcuc

SEQ ID NO: 3189159 - RNA, 15 nt, Mycobacterium bovis subsp bovis AF2122/97
cggguacgccgggca

SEQ ID NO: 3189160 - RNA, 20 nt, Mycobacterium bovis subsp bovis AF2122/97
cggguacggcguacgccgga

SEQ ID NO: 3189161 - RNA, 21 nt, Mycobacterium bovis subsp bovis AF2122/97
cggguacggucucacggcgcg

SEQ ID NO: 3189162 - RNA, 16 nt, Mycobacterium bovis subsp bovis AF2122/97
cggguacuuacggguc

SEQ ID NO: 3189163 - RNA, 19 nt, Mycobacterium bovis subsp bovis AF2122/97
cggguagaaccagcccggc

SEQ ID NO: 3189164 - RNA, 17 nt, Mycobacterium bovis subsp bovis AF2122/97
cggguagacaccgcgau

SEQ ID NO: 3189165 - RNA, 18 nt, Mycobacterium bovis subsp bovis AF2122/97
cggguagacaugggugaa

SEQ ID NO: 3189166 - RNA, 17 nt, Mycobacterium bovis subsp bovis AF2122/97
cggguagacccacauca

SEQ ID NO: 3189167 - RNA, 21 nt, Mycobacterium bovis subsp bovis AF2122/97
cggguagacccacaucagguc

SEQ ID NO: 3189168 - RNA, 20 nt, Mycobacterium bovis subsp bovis AF2122/97
cggguagauguucacgccgc

SEQ ID NO: 3189169 - RNA, 22 nt, Mycobacterium bovis subsp bovis AF2122/97
cggguagauguucacgccgccg

SEQ ID NO: 3189170 - RNA, 23 nt, Mycobacterium bovis subsp bovis AF2122/97
cggguagauguucacgccgccgg

SEQ ID NO: 3189171 - RNA, 13 nt, Mycobacterium bovis subsp bovis AF2122/97
cggguagccggcg

SEQ ID NO: 3189172 - RNA, 19 nt, Mycobacterium bovis subsp bovis AF2122/97
cggguagccggcgugcacu

SEQ ID NO: 3189173 - RNA, 22 nt, Mycobacterium bovis subsp bovis AF2122/97
cggguagccgucgaucccgguc

SEQ ID NO: 3189174 - RNA, 17 nt, Mycobacterium bovis subsp bovis AF2122/97
cggguagcggcgccgcc

SEQ ID NO: 3189175 - RNA, 20 nt, Mycobacterium bovis subsp bovis AF2122/97
cggguagcgguucaucaccg

SEQ ID NO: 3189176 - RNA, 16 nt, Mycobacterium bovis subsp bovis AF2122/97
cggguagcugccgcgg

SEQ ID NO: 3189177 - RNA, 17 nt, Mycobacterium bovis subsp bovis AF2122/97
cggguagcugccgcggc

SEQ ID NO: 3189178 - RNA, 13 nt, Mycobacterium bovis subsp bovis AF2122/97
cggguaggugacg

SEQ ID NO: 3189179 - RNA, 17 nt, Mycobacterium bovis subsp bovis AF2122/97
cggguaggugacgacgu

SEQ ID NO: 3189180 - RNA, 18 nt, Mycobacterium bovis subsp bovis AF2122/97
cggguagugcacggacag

SEQ ID NO: 3189181 - RNA, 21 nt, Mycobacterium bovis subsp bovis AF2122/97
cgggucaacgccaucaccccg

SEQ ID NO: 3189182 - RNA, 22 nt, Mycobacterium bovis subsp bovis AF2122/97
cgggucaacgccaucaccccgg

SEQ ID NO: 3189183 - RNA, 23 nt, Mycobacterium bovis subsp bovis AF2122/97
cgggucaccagcgcaucggccag

SEQ ID NO: 3189184 - RNA, 14 nt, Mycobacterium bovis subsp bovis AF2122/97
cgggucacccagau

SEQ ID NO: 3189185 - RNA, 13 nt, Mycobacterium bovis subsp bovis AF2122/97
cgggucacccccg

SEQ ID NO: 3189186 - RNA, 16 nt, Mycobacterium bovis subsp bovis AF2122/97
cgggucacccccggcc

SEQ ID NO: 3189187 - RNA, 19 nt, Mycobacterium bovis subsp bovis AF2122/97
cgggucacccccggccagc

SEQ ID NO: 3189188 - RNA, 20 nt, Mycobacterium bovis subsp bovis AF2122/97
cgggucacccccggccagcg

SEQ ID NO: 3189189 - RNA, 22 nt, Mycobacterium bovis subsp bovis AF2122/97
cgggucaccgauucggccagcg

SEQ ID NO: 3189190 - RNA, 14 nt, Mycobacterium bovis subsp bovis AF2122/97
cgggucacuccggc

SEQ ID NO: 3189191 - RNA, 16 nt, Mycobacterium bovis subsp bovis AF2122/97
cgggucacuccggcgg

SEQ ID NO: 3189192 - RNA, 17 nt, Mycobacterium bovis subsp bovis AF2122/97
cgggucacuccggcggc

SEQ ID NO: 3189193 - RNA, 21 nt, Mycobacterium bovis subsp bovis AF2122/97
cgggucacuccggcggcuucg

SEQ ID NO: 3189194 - RNA, 15 nt, Mycobacterium bovis subsp bovis AF2122/97
cgggucagcaccacc

SEQ ID NO: 3189195 - RNA, 20 nt, Mycobacterium bovis subsp bovis AF2122/97
cgggucagcaccaccagcag

SEQ ID NO: 3189196 - RNA, 21 nt, Mycobacterium bovis subsp bovis AF2122/97
cgggucagcaccaccagcagc

SEQ ID NO: 3189197 - RNA, 15 nt, Mycobacterium bovis subsp bovis AF2122/97
cgggucagcccagcc

SEQ ID NO: 3189198 - RNA, 16 nt, Mycobacterium bovis subsp bovis AF2122/97
cgggucagcgccgaga

SEQ ID NO: 3189199 - RNA, 21 nt, Mycobacterium bovis subsp bovis AF2122/97
cgggucagcgccgagagcacc

SEQ ID NO: 3189200 - RNA, 23 nt, Mycobacterium bovis subsp bovis AF2122/97
cgggucagcgccgagagcaccgc

SEQ ID NO: 3189201 - RNA, 20 nt, Mycobacterium bovis subsp bovis AF2122/97
cgggucagcugacgggccgc

SEQ ID NO: 3189202 - RNA, 17 nt, Mycobacterium bovis subsp bovis AF2122/97
cgggucaucuugccacc

SEQ ID NO: 3189203 - RNA, 19 nt, Mycobacterium bovis subsp bovis AF2122/97
cgggucaucuugccaccgc

SEQ ID NO: 3189204 - RNA, 19 nt, Mycobacterium bovis subsp bovis AF2122/97
cggguccaagaaccacgac

SEQ ID NO: 3189205 - RNA, 24 nt, Mycobacterium bovis subsp bovis AF2122/97
cggguccaagaaccacgacguugc

SEQ ID NO: 3189206 - RNA, 12 nt, Mycobacterium bovis subsp bovis AF2122/97
cggguccaccgc

SEQ ID NO: 3189207 - RNA, 15 nt, Mycobacterium bovis subsp bovis AF2122/97
cggguccagccaccg

SEQ ID NO: 3189208 - RNA, 21 nt, Mycobacterium bovis subsp bovis AF2122/97
cggguccagccaccgaccccg

SEQ ID NO: 3189209 - RNA, 21 nt, Mycobacterium bovis subsp bovis AF2122/97
cggguccagcccggaacccga

SEQ ID NO: 3189210 - RNA, 15 nt, Mycobacterium bovis subsp bovis AF2122/97
cggguccaggcguug

SEQ ID NO: 3189211 - RNA, 22 nt, Mycobacterium bovis subsp bovis AF2122/97
cgggucccaaucgucggccagc

SEQ ID NO: 3189212 - RNA, 15 nt, Mycobacterium bovis subsp bovis AF2122/97
cgggucccggcagcu

SEQ ID NO: 3189213 - RNA, 14 nt, Mycobacterium bovis subsp bovis AF2122/97
cggguccgccgggc

SEQ ID NO: 3189214 - RNA, 19 nt, Mycobacterium bovis subsp bovis AF2122/97
cggguccggugaacccgau

SEQ ID NO: 3189215 - RNA, 13 nt, Mycobacterium bovis subsp bovis AF2122/97
cggguccucgcgg

SEQ ID NO: 3189216 - RNA, 16 nt, Mycobacterium bovis subsp bovis AF2122/97
cggguccucgcggagc

SEQ ID NO: 3189217 - RNA, 17 nt, Mycobacterium bovis subsp bovis AF2122/97
cggguccucgcggagcc

SEQ ID NO: 3189218 - RNA, 18 nt, Mycobacterium bovis subsp bovis AF2122/97
cggguccuucugccggga

SEQ ID NO: 3189219 - RNA, 19 nt, Mycobacterium bovis subsp bovis AF2122/97
cgggucgaacaggccggcc

SEQ ID NO: 3189220 - RNA, 19 nt, Mycobacterium bovis subsp bovis AF2122/97
cgggucgaacuugaucacc

SEQ ID NO: 3189221 - RNA, 19 nt, Mycobacterium bovis subsp bovis AF2122/97
cgggucgaagcgauccggc

SEQ ID NO: 3189222 - RNA, 19 nt, Mycobacterium bovis subsp bovis AF2122/97
cgggucgaaucgugucgcc

SEQ ID NO: 3189223 - RNA, 15 nt, Mycobacterium bovis subsp bovis AF2122/97
cgggucgaccccggc

SEQ ID NO: 3189224 - RNA, 17 nt, Mycobacterium bovis subsp bovis AF2122/97
cgggucgagccggaccc

SEQ ID NO: 3189225 - RNA, 20 nt, Mycobacterium bovis subsp bovis AF2122/97
cgggucgagccggacccggu

SEQ ID NO: 3189226 - RNA, 19 nt, Mycobacterium bovis subsp bovis AF2122/97
cgggucgaguccgacgggg

SEQ ID NO: 3189227 - RNA, 14 nt, Mycobacterium bovis subsp bovis AF2122/97
cgggucgagugcgg

SEQ ID NO: 3189228 - RNA, 13 nt, Mycobacterium bovis subsp bovis AF2122/97
cgggucgaucacc

SEQ ID NO: 3189229 - RNA, 16 nt, Mycobacterium bovis subsp bovis AF2122/97
cgggucgaucaccgac

SEQ ID NO: 3189230 - RNA, 20 nt, Mycobacterium bovis subsp bovis AF2122/97
cgggucgaucaccgacaccg

SEQ ID NO: 3189231 - RNA, 13 nt, Mycobacterium bovis subsp bovis AF2122/97
cgggucgaugacg

SEQ ID NO: 3189232 - RNA, 15 nt, Mycobacterium bovis subsp bovis AF2122/97
cgggucgaugacgcc

SEQ ID NO: 3189233 - RNA, 14 nt, Mycobacterium bovis subsp bovis AF2122/97
cgggucgaugucgg

SEQ ID NO: 3189234 - RNA, 19 nt, Mycobacterium bovis subsp bovis AF2122/97
cgggucgcaaccgccgcca

SEQ ID NO: 3189235 - RNA, 14 nt, Mycobacterium bovis subsp bovis AF2122/97
cgggucgcaccccg

SEQ ID NO: 3189236 - RNA, 19 nt, Mycobacterium bovis subsp bovis AF2122/97
cgggucgcaccccggcggc

SEQ ID NO: 3189237 - RNA, 20 nt, Mycobacterium bovis subsp bovis AF2122/97
cgggucgccggacugcggcc

SEQ ID NO: 3189238 - RNA, 16 nt, Mycobacterium bovis subsp bovis AF2122/97
cgggucgccgggcccg

SEQ ID NO: 3189239 - RNA, 20 nt, Mycobacterium bovis subsp bovis AF2122/97
cgggucgccgggcccgucgg

SEQ ID NO: 3189240 - RNA, 14 nt, Mycobacterium bovis subsp bovis AF2122/97
cgggucgcgcuggc

SEQ ID NO: 3189241 - RNA, 16 nt, Mycobacterium bovis subsp bovis AF2122/97
cgggucgcgcuggcgc

SEQ ID NO: 3189242 - RNA, 22 nt, Mycobacterium bovis subsp bovis AF2122/97
cgggucgcggcuauggcgccgc

SEQ ID NO: 3189243 - RNA, 23 nt, Mycobacterium bovis subsp bovis AF2122/97
cgggucgcggcuauggcgccgcg

SEQ ID NO: 3189244 - RNA, 14 nt, Mycobacterium bovis subsp bovis AF2122/97
cgggucgcgggaug

SEQ ID NO: 3189245 - RNA, 22 nt, Mycobacterium bovis subsp bovis AF2122/97
cgggucgcgggguaggcccagc

SEQ ID NO: 3189246 - RNA, 14 nt, Mycobacterium bovis subsp bovis AF2122/97
cgggucgcgggugc

SEQ ID NO: 3189247 - RNA, 14 nt, Mycobacterium bovis subsp bovis AF2122/97
cgggucgcugccgg

SEQ ID NO: 3189248 - RNA, 17 nt, Mycobacterium bovis subsp bovis AF2122/97
cgggucgcugccggcug

SEQ ID NO: 3189249 - RNA, 20 nt, Mycobacterium bovis subsp bovis AF2122/97
cgggucgcugccggcugacg

SEQ ID NO: 3189250 - RNA, 12 nt, Mycobacterium bovis subsp bovis AF2122/97
cgggucggcacg

SEQ ID NO: 3189251 - RNA, 12 nt, Mycobacterium bovis subsp bovis AF2122/97
cgggucggcaga

SEQ ID NO: 3189252 - RNA, 13 nt, Mycobacterium bovis subsp bovis AF2122/97
cgggucggcaucg

SEQ ID NO: 3189253 - RNA, 19 nt, Mycobacterium bovis subsp bovis AF2122/97
cgggucggcauugaucggu

SEQ ID NO: 3189254 - RNA, 13 nt, Mycobacterium bovis subsp bovis AF2122/97
cgggucggccgcu

SEQ ID NO: 3189255 - RNA, 13 nt, Mycobacterium bovis subsp bovis AF2122/97
cgggucggccggg

SEQ ID NO: 3189256 - RNA, 17 nt, Mycobacterium bovis subsp bovis AF2122/97
cgggucggcgaccgcgc

SEQ ID NO: 3189257 - RNA, 17 nt, Mycobacterium bovis subsp bovis AF2122/97
cgggucggcgccgagca

SEQ ID NO: 3189258 - RNA, 20 nt, Mycobacterium bovis subsp bovis AF2122/97
cgggucggcggugccgugug

SEQ ID NO: 3189259 - RNA, 15 nt, Mycobacterium bovis subsp bovis AF2122/97
cgggucgggcaccgc

SEQ ID NO: 3189260 - RNA, 18 nt, Mycobacterium bovis subsp bovis AF2122/97
cgggucgggcaccgcgcg

SEQ ID NO: 3189261 - RNA, 20 nt, Mycobacterium bovis subsp bovis AF2122/97
cgggucgggcaccgcgcgcu

SEQ ID NO: 3189262 - RNA, 22 nt, Mycobacterium bovis subsp bovis AF2122/97
cgggucgguuuccuccggcagc

SEQ ID NO: 3189263 - RNA, 20 nt, Mycobacterium bovis subsp bovis AF2122/97
cgggucguacaacacgggca

SEQ ID NO: 3189264 - RNA, 16 nt, Mycobacterium bovis subsp bovis AF2122/97
cgggucgucauacagc

SEQ ID NO: 3189265 - RNA, 21 nt, Mycobacterium bovis subsp bovis AF2122/97
cgggucgucauacagcgcccu

SEQ ID NO: 3189266 - RNA, 21 nt, Mycobacterium bovis subsp bovis AF2122/97
cgggucgucaugccagucgcc

SEQ ID NO: 3189267 - RNA, 15 nt, Mycobacterium bovis subsp bovis AF2122/97
cgggucguccggcgg

SEQ ID NO: 3189268 - RNA, 17 nt, Mycobacterium bovis subsp bovis AF2122/97
cgggucguccggcggca

SEQ ID NO: 3189269 - RNA, 14 nt, Mycobacterium bovis subsp bovis AF2122/97
cgggucgucggcgu

SEQ ID NO: 3189270 - RNA, 20 nt, Mycobacterium bovis subsp bovis AF2122/97
cgggucgucggcgucggugg

SEQ ID NO: 3189271 - RNA, 16 nt, Mycobacterium bovis subsp bovis AF2122/97
cgggucgugccagcag

SEQ ID NO: 3189272 - RNA, 18 nt, Mycobacterium bovis subsp bovis AF2122/97
cgggucgugccagcagca

SEQ ID NO: 3189273 - RNA, 16 nt, Mycobacterium bovis subsp bovis AF2122/97
cgggucgugccccggc

SEQ ID NO: 3189274 - RNA, 17 nt, Mycobacterium bovis subsp bovis AF2122/97
cgggucuacagcguugc

SEQ ID NO: 3189275 - RNA, 15 nt, Mycobacterium bovis subsp bovis AF2122/97
cgggucucgccgacc

SEQ ID NO: 3189276 - RNA, 14 nt, Mycobacterium bovis subsp bovis AF2122/97
cgggucucgcgagc

SEQ ID NO: 3189277 - RNA, 14 nt, Mycobacterium bovis subsp bovis AF2122/97
cgggucucggugcg

SEQ ID NO: 3189278 - RNA, 16 nt, Mycobacterium bovis subsp bovis AF2122/97
cgggucucggugcggc

SEQ ID NO: 3189279 - RNA, 16 nt, Mycobacterium bovis subsp bovis AF2122/97
cgggucugcggucauc

SEQ ID NO: 3189280 - RNA, 20 nt, Mycobacterium bovis subsp bovis AF2122/97
cgggucuggccaacgccggg

SEQ ID NO: 3189281 - RNA, 22 nt, Mycobacterium bovis subsp bovis AF2122/97
cgggucuguccaaugcuguggc

SEQ ID NO: 3189282 - RNA, 21 nt, Mycobacterium bovis subsp bovis AF2122/97
cgggugaaacgauggcgauga

SEQ ID NO: 3189283 - RNA, 19 nt, Mycobacterium bovis subsp bovis AF2122/97
cgggugaaucgacaccgcc

SEQ ID NO: 3189284 - RNA, 22 nt, Mycobacterium bovis subsp bovis AF2122/97
cgggugaaucgacaccgcccga

SEQ ID NO: 3189285 - RNA, 19 nt, Mycobacterium bovis subsp bovis AF2122/97
cgggugaccaggcggcgcg

SEQ ID NO: 3189286 - RNA, 15 nt, Mycobacterium bovis subsp bovis AF2122/97
cgggugacucgggca

SEQ ID NO: 3189287 - RNA, 18 nt, Mycobacterium bovis subsp bovis AF2122/97
cgggugacucgggcacgg

SEQ ID NO: 3189288 - RNA, 19 nt, Mycobacterium bovis subsp bovis AF2122/97
cgggugacucgggcacggg

SEQ ID NO: 3189289 - RNA, 20 nt, Mycobacterium bovis subsp bovis AF2122/97
cgggugagacaaaggugccg

SEQ ID NO: 3189290 - RNA, 21 nt, Mycobacterium bovis subsp bovis AF2122/97
cgggugaguaacacgugggug

SEQ ID NO: 3189291 - RNA, 16 nt, Mycobacterium bovis subsp bovis AF2122/97
cgggugaguucggcgu

SEQ ID NO: 3189292 - RNA, 16 nt, Mycobacterium bovis subsp bovis AF2122/97
cgggugaucuccaccg

SEQ ID NO: 3189293 - RNA, 18 nt, Mycobacterium bovis subsp bovis AF2122/97
cgggugaucuccaccggc

SEQ ID NO: 3189294 - RNA, 17 nt, Mycobacterium bovis subsp bovis AF2122/97
cgggugaucuuggcgcc

SEQ ID NO: 3189295 - RNA, 23 nt, Mycobacterium bovis subsp bovis AF2122/97
cgggugaucuuggcgcccgccgg

SEQ ID NO: 3189296 - RNA, 15 nt, Mycobacterium bovis subsp bovis AF2122/97
cgggugaugacgccg

SEQ ID NO: 3189297 - RNA, 19 nt, Mycobacterium bovis subsp bovis AF2122/97
cgggugaugacgccgucgg

SEQ ID NO: 3189298 - RNA, 22 nt, Mycobacterium bovis subsp bovis AF2122/97
cgggugaugacgccgucggcgc

SEQ ID NO: 3189299 - RNA, 23 nt, Mycobacterium bovis subsp bovis AF2122/97
cgggugaugacgccgucggcgcg

SEQ ID NO: 3189300 - RNA, 15 nt, Mycobacterium bovis subsp bovis AF2122/97
cgggugaugcaguga

SEQ ID NO: 3189301 - RNA, 22 nt, Mycobacterium bovis subsp bovis AF2122/97
cgggugauggaugggucgaccg

SEQ ID NO: 3189302 - RNA, 19 nt, Mycobacterium bovis subsp bovis AF2122/97
cgggugcagcacggcgccg

SEQ ID NO: 3189303 - RNA, 20 nt, Mycobacterium bovis subsp bovis AF2122/97
cgggugcagcacggcgccgc

SEQ ID NO: 3189304 - RNA, 23 nt, Mycobacterium bovis subsp bovis AF2122/97
cgggugcagcacggcgccgccac

SEQ ID NO: 3189305 - RNA, 15 nt, Mycobacterium bovis subsp bovis AF2122/97
cgggugcagccagau

SEQ ID NO: 3189306 - RNA, 13 nt, Mycobacterium bovis subsp bovis AF2122/97
cgggugcagcgca

SEQ ID NO: 3189307 - RNA, 16 nt, Mycobacterium bovis subsp bovis AF2122/97
cgggugcagcgcaacc

SEQ ID NO: 3189308 - RNA, 16 nt, Mycobacterium bovis subsp bovis AF2122/97
cgggugcauucugcgg

SEQ ID NO: 3189309 - RNA, 12 nt, Mycobacterium bovis subsp bovis AF2122/97
cgggugccagcc

SEQ ID NO: 3189310 - RNA, 14 nt, Mycobacterium bovis subsp bovis AF2122/97
cgggugccagcccg

SEQ ID NO: 3189311 - RNA, 15 nt, Mycobacterium bovis subsp bovis AF2122/97
cgggugccagcccgu

SEQ ID NO: 3189312 - RNA, 16 nt, Mycobacterium bovis subsp bovis AF2122/97
cgggugccaucggugg

SEQ ID NO: 3189313 - RNA, 17 nt, Mycobacterium bovis subsp bovis AF2122/97
cgggugccaucgguggu

SEQ ID NO: 3189314 - RNA, 20 nt, Mycobacterium bovis subsp bovis AF2122/97
cgggugccaucggugguggc

SEQ ID NO: 3189315 - RNA, 16 nt, Mycobacterium bovis subsp bovis AF2122/97
cgggugccgacgucgg

SEQ ID NO: 3189316 - RNA, 13 nt, Mycobacterium bovis subsp bovis AF2122/97
cgggugccgagcu

SEQ ID NO: 3189317 - RNA, 14 nt, Mycobacterium bovis subsp bovis AF2122/97
cgggugccgagcug

SEQ ID NO: 3189318 - RNA, 18 nt, Mycobacterium bovis subsp bovis AF2122/97
cgggugccgagcuggcga

SEQ ID NO: 3189319 - RNA, 12 nt, Mycobacterium bovis subsp bovis AF2122/97
cgggugcgaucg

SEQ ID NO: 3189320 - RNA, 14 nt, Mycobacterium bovis subsp bovis AF2122/97
cgggugcgcccggc

SEQ ID NO: 3189321 - RNA, 15 nt, Mycobacterium bovis subsp bovis AF2122/97
cgggugcgcccggcc

SEQ ID NO: 3189322 - RNA, 15 nt, Mycobacterium bovis subsp bovis AF2122/97
cgggugcgccggcgu

SEQ ID NO: 3189323 - RNA, 14 nt, Mycobacterium bovis subsp bovis AF2122/97
cgggugcgccguug

SEQ ID NO: 3189324 - RNA, 17 nt, Mycobacterium bovis subsp bovis AF2122/97
cgggugcgccguugccg

SEQ ID NO: 3189325 - RNA, 22 nt, Mycobacterium bovis subsp bovis AF2122/97
cgggugcgccguugccgccguc

SEQ ID NO: 3189326 - RNA, 14 nt, Mycobacterium bovis subsp bovis AF2122/97
cgggugcgcgaggu

SEQ ID NO: 3189327 - RNA, 17 nt, Mycobacterium bovis subsp bovis AF2122/97
cgggugcgcugcgauca

SEQ ID NO: 3189328 - RNA, 15 nt, Mycobacterium bovis subsp bovis AF2122/97
cgggugcggacaccg

SEQ ID NO: 3189329 - RNA, 16 nt, Mycobacterium bovis subsp bovis AF2122/97
cgggugcggacaccga

SEQ ID NO: 3189330 - RNA, 22 nt, Mycobacterium bovis subsp bovis AF2122/97
cgggugcggcgauucccgcgaa

SEQ ID NO: 3189331 - RNA, 13 nt, Mycobacterium bovis subsp bovis AF2122/97
cgggugcgggccg

SEQ ID NO: 3189332 - RNA, 14 nt, Mycobacterium bovis subsp bovis AF2122/97
cgggugcgucgaug

SEQ ID NO: 3189333 - RNA, 20 nt, Mycobacterium bovis subsp bovis AF2122/97
cgggugcgugcgcgucggug

SEQ ID NO: 3189334 - RNA, 23 nt, Mycobacterium bovis subsp bovis AF2122/97
cgggugcgugcgcgucggugucg

SEQ ID NO: 3189335 - RNA, 17 nt, Mycobacterium bovis subsp bovis AF2122/97
cgggugcuggucaacag

SEQ ID NO: 3189336 - RNA, 19 nt, Mycobacterium bovis subsp bovis AF2122/97
cgggugcuggucaacagcg

SEQ ID NO: 3189337 - RNA, 22 nt, Mycobacterium bovis subsp bovis AF2122/97
cggguggaucuucaccucgaug

SEQ ID NO: 3189338 - RNA, 13 nt, Mycobacterium bovis subsp bovis AF2122/97
cggguggcacacc

SEQ ID NO: 3189339 - RNA, 16 nt, Mycobacterium bovis subsp bovis AF2122/97
cggguggcccggcgaa

SEQ ID NO: 3189340 - RNA, 12 nt, Mycobacterium bovis subsp bovis AF2122/97
cggguggccggg

SEQ ID NO: 3189341 - RNA, 17 nt, Mycobacterium bovis subsp bovis AF2122/97
cggguggcgaggcagca

SEQ ID NO: 3189342 - RNA, 21 nt, Mycobacterium bovis subsp bovis AF2122/97
cggguggcgaggcagcacccg

SEQ ID NO: 3189343 - RNA, 14 nt, Mycobacterium bovis subsp bovis AF2122/97
cggguggcgccggu

SEQ ID NO: 3189344 - RNA, 12 nt, Mycobacterium bovis subsp bovis AF2122/97
cggguggcgucg

SEQ ID NO: 3189345 - RNA, 17 nt, Mycobacterium bovis subsp bovis AF2122/97
cggguggcuuccggggu

SEQ ID NO: 3189346 - RNA, 21 nt, Mycobacterium bovis subsp bovis AF2122/97
cgggugggagcagccgaaccg

SEQ ID NO: 3189347 - RNA, 18 nt, Mycobacterium bovis subsp bovis AF2122/97
cgggugggcaagcugacc

SEQ ID NO: 3189348 - RNA, 17 nt, Mycobacterium bovis subsp bovis AF2122/97
cgggugggcacaccggu

SEQ ID NO: 3189349 - RNA, 19 nt, Mycobacterium bovis subsp bovis AF2122/97
cggguggggaucacgauca

SEQ ID NO: 3189350 - RNA, 18 nt, Mycobacterium bovis subsp bovis AF2122/97
cgggugggucguucaccg

SEQ ID NO: 3189351 - RNA, 13 nt, Mycobacterium bovis subsp bovis AF2122/97
cgggugguccagc

SEQ ID NO: 3189352 - RNA, 14 nt, Mycobacterium bovis subsp bovis AF2122/97
cgggugguccagcc

SEQ ID NO: 3189353 - RNA, 22 nt, Mycobacterium bovis subsp bovis AF2122/97
cggguggugaaguagucggcgc

SEQ ID NO: 3189354 - RNA, 23 nt, Mycobacterium bovis subsp bovis AF2122/97
cggguggugaaguagucggcgcc

SEQ ID NO: 3189355 - RNA, 15 nt, Mycobacterium bovis subsp bovis AF2122/97
cggguggugccggcg

SEQ ID NO: 3189356 - RNA, 16 nt, Mycobacterium bovis subsp bovis AF2122/97
cggguggugccggcgg

SEQ ID NO: 3189357 - RNA, 16 nt, Mycobacterium bovis subsp bovis AF2122/97
cggguggugcgcuggc

SEQ ID NO: 3189358 - RNA, 13 nt, Mycobacterium bovis subsp bovis AF2122/97
cggguggugcggc

SEQ ID NO: 3189359 - RNA, 18 nt, Mycobacterium bovis subsp bovis AF2122/97
cggguggugcggccgugg

SEQ ID NO: 3189360 - RNA, 24 nt, Mycobacterium bovis subsp bovis AF2122/97
cggguggugcggccguggcguggc

SEQ ID NO: 3189361 - RNA, 20 nt, Mycobacterium bovis subsp bovis AF2122/97
cgggugguucaccucggcga

SEQ ID NO: 3189362 - RNA, 14 nt, Mycobacterium bovis subsp bovis AF2122/97
cgggugucggcgug

SEQ ID NO: 3189363 - RNA, 16 nt, Mycobacterium bovis subsp bovis AF2122/97
cgggugucgggcagca

SEQ ID NO: 3189364 - RNA, 18 nt, Mycobacterium bovis subsp bovis AF2122/97
cgggugucgggcagcaac

SEQ ID NO: 3189365 - RNA, 15 nt, Mycobacterium bovis subsp bovis AF2122/97
cgggugucgggcgcg

SEQ ID NO: 3189366 - RNA, 19 nt, Mycobacterium bovis subsp bovis AF2122/97
cgggugucgggcgcgcugc

SEQ ID NO: 3189367 - RNA, 13 nt, Mycobacterium bovis subsp bovis AF2122/97
cgggugugcaggc

SEQ ID NO: 3189368 - RNA, 15 nt, Mycobacterium bovis subsp bovis AF2122/97
cgggugugcaggccg

SEQ ID NO: 3189369 - RNA, 18 nt, Mycobacterium bovis subsp bovis AF2122/97
cgggugugcaggccgcgg

SEQ ID NO: 3189370 - RNA, 22 nt, Mycobacterium bovis subsp bovis AF2122/97
cggguguggcuugacgcccggg

SEQ ID NO: 3189371 - RNA, 17 nt, Mycobacterium bovis subsp bovis AF2122/97
cggguguggucaccagg

SEQ ID NO: 3189372 - RNA, 18 nt, Mycobacterium bovis subsp bovis AF2122/97
cggguguggucaccaggc

SEQ ID NO: 3189373 - RNA, 16 nt, Mycobacterium bovis subsp bovis AF2122/97
cggguguggucggugg

SEQ ID NO: 3189374 - RNA, 17 nt, Mycobacterium bovis subsp bovis AF2122/97
cggguguggucgguggc

SEQ ID NO: 3189375 - RNA, 16 nt, Mycobacterium bovis subsp bovis AF2122/97
cggguguuaucggucg

SEQ ID NO: 3189376 - RNA, 21 nt, Mycobacterium bovis subsp bovis AF2122/97
cggguguuccacaccaggccg

SEQ ID NO: 3189377 - RNA, 22 nt, Mycobacterium bovis subsp bovis AF2122/97
cggguguuccacaccaggccga

SEQ ID NO: 3189378 - RNA, 13 nt, Mycobacterium bovis subsp bovis AF2122/97
cggguguucgcgc

SEQ ID NO: 3189379 - RNA, 20 nt, Mycobacterium bovis subsp bovis AF2122/97
cggguguucucgcgcgucgc

SEQ ID NO: 3189380 - RNA, 22 nt, Mycobacterium bovis subsp bovis AF2122/97
cggguucaacgcgcgcacgcca

SEQ ID NO: 3189381 - RNA, 18 nt, Mycobacterium bovis subsp bovis AF2122/97
cggguucacugccggcca

SEQ ID NO: 3189382 - RNA, 14 nt, Mycobacterium bovis subsp bovis AF2122/97
cggguuccagcggc

SEQ ID NO: 3189383 - RNA, 18 nt, Mycobacterium bovis subsp bovis AF2122/97
cggguuccagcggcaccg

SEQ ID NO: 3189384 - RNA, 20 nt, Mycobacterium bovis subsp bovis AF2122/97
cggguuccgaucucaagggc

SEQ ID NO: 3189385 - RNA, 20 nt, Mycobacterium bovis subsp bovis AF2122/97
cggguucgacguugaucgcc

SEQ ID NO: 3189386 - RNA, 23 nt, Mycobacterium bovis subsp bovis AF2122/97
cggguucgacguugaucgccaug

SEQ ID NO: 3189387 - RNA, 15 nt, Mycobacterium bovis subsp bovis AF2122/97
cggguucgucgucgu

SEQ ID NO: 3189388 - RNA, 19 nt, Mycobacterium bovis subsp bovis AF2122/97
cggguucuucaacuccggg

SEQ ID NO: 3189389 - RNA, 20 nt, Mycobacterium bovis subsp bovis AF2122/97
cggguucuucaacuccggga

SEQ ID NO: 3189390 - RNA, 23 nt, Mycobacterium bovis subsp bovis AF2122/97
cggguucuucaacuccgggaccg

SEQ ID NO: 3189391 - RNA, 18 nt, Mycobacterium bovis subsp bovis AF2122/97
cggguugagccgccgcga

SEQ ID NO: 3189392 - RNA, 14 nt, Mycobacterium bovis subsp bovis AF2122/97
cggguugcccuggu

SEQ ID NO: 3189393 - RNA, 21 nt, Mycobacterium bovis subsp bovis AF2122/97
cggguugcccuggugugccgc

SEQ ID NO: 3189394 - RNA, 14 nt, Mycobacterium bovis subsp bovis AF2122/97
cggguugcgacgaa

SEQ ID NO: 3189395 - RNA, 12 nt, Mycobacterium bovis subsp bovis AF2122/97
cggguugcgcgg

SEQ ID NO: 3189396 - RNA, 17 nt, Mycobacterium bovis subsp bovis AF2122/97
cggguuggaagccgcac

SEQ ID NO: 3189397 - RNA, 18 nt, Mycobacterium bovis subsp bovis AF2122/97
cggguuggaagccgcacc

SEQ ID NO: 3189398 - RNA, 14 nt, Mycobacterium bovis subsp bovis AF2122/97
cggguuggccaccu

SEQ ID NO: 3189399 - RNA, 22 nt, Mycobacterium bovis subsp bovis AF2122/97
cggguuggccggguuggccggc

SEQ ID NO: 3189400 - RNA, 14 nt, Mycobacterium bovis subsp bovis AF2122/97
cggguuggcgccgg

SEQ ID NO: 3189401 - RNA, 17 nt, Mycobacterium bovis subsp bovis AF2122/97
cggguuggcgccggcca

SEQ ID NO: 3189402 - RNA, 19 nt, Mycobacterium bovis subsp bovis AF2122/97
cggguuggcgccggccagu

SEQ ID NO: 3189403 - RNA, 14 nt, Mycobacterium bovis subsp bovis AF2122/97
cggguuggcgucgc

SEQ ID NO: 3189404 - RNA, 13 nt, Mycobacterium bovis subsp bovis AF2122/97
cggguugggaccg

SEQ ID NO: 3189405 - RNA, 19 nt, Mycobacterium bovis subsp bovis AF2122/97
cggguuggucccgaugacc

SEQ ID NO: 3189406 - RNA, 20 nt, Mycobacterium bovis subsp bovis AF2122/97
cggguuggugggucggggcg

SEQ ID NO: 3189407 - RNA, 19 nt, Mycobacterium bovis subsp bovis AF2122/97
cggguugguuggcucgcug

SEQ ID NO: 3189408 - RNA, 17 nt, Mycobacterium bovis subsp bovis AF2122/97
cggguuguggcacccgg

SEQ ID NO: 3189409 - RNA, 17 nt, Mycobacterium bovis subsp bovis AF2122/97
cggguuuauccagucga

SEQ ID NO: 3189410 - RNA, 19 nt, Mycobacterium bovis subsp bovis AF2122/97
cggguuucgcucgcaccgc

SEQ ID NO: 3189411 - RNA, 21 nt, Mycobacterium bovis subsp bovis AF2122/97
cggguuucgcucgcaccgccc

SEQ ID NO: 3189412 - RNA, 18 nt, Mycobacterium bovis subsp bovis AF2122/97
cggguuugaucuccaccu

SEQ ID NO: 3189413 - RNA, 16 nt, Mycobacterium bovis subsp bovis AF2122/97
cggguuuggccgacag

SEQ ID NO: 3189414 - RNA, 22 nt, Mycobacterium bovis subsp bovis AF2122/97
cggguuuggccgacagccaccg

SEQ ID NO: 3189415 - RNA, 20 nt, Mycobacterium bovis subsp bovis AF2122/97
cggguuuucucgccguuggc

SEQ ID NO: 3189416 - RNA, 19 nt, Mycobacterium bovis subsp bovis AF2122/97
cggguuuugauagacgacc

SEQ ID NO: 3189417 - RNA, 22 nt, Mycobacterium bovis subsp bovis AF2122/97
cggguuuugauagacgacccgg

SEQ ID NO: 3189418 - RNA, 16 nt, Mycobacterium bovis subsp bovis AF2122/97
cggguuuugcgcggcc

SEQ ID NO: 3189419 - RNA, 19 nt, Mycobacterium bovis subsp bovis AF2122/97
cggguuuugcgcggccacc

SEQ ID NO: 3189420 - RNA, 20 nt, Mycobacterium bovis subsp bovis AF2122/97
cgguaaagaucuugucgcgu

SEQ ID NO: 3189421 - RNA, 14 nt, Mycobacterium bovis subsp bovis AF2122/97
cgguaaccacgcgg

SEQ ID NO: 3189422 - RNA, 15 nt, Mycobacterium bovis subsp bovis AF2122/97
cgguaaccacgcgga

SEQ ID NO: 3189423 - RNA, 20 nt, Mycobacterium bovis subsp bovis AF2122/97
cgguaaccggcccgaugacc

SEQ ID NO: 3189424 - RNA, 14 nt, Mycobacterium bovis subsp bovis AF2122/97
cgguaacgaacagc

SEQ ID NO: 3189425 - RNA, 18 nt, Mycobacterium bovis subsp bovis AF2122/97
cgguaacgccaacaccgg

SEQ ID NO: 3189426 - RNA, 18 nt, Mycobacterium bovis subsp bovis AF2122/97
cgguaacgccaucgucgg

SEQ ID NO: 3189427 - RNA, 19 nt, Mycobacterium bovis subsp bovis AF2122/97
cgguaacggcgguaagggc

SEQ ID NO: 3189428 - RNA, 17 nt, Mycobacterium bovis subsp bovis AF2122/97
cgguaacggcggugcgg

SEQ ID NO: 3189429 - RNA, 17 nt, Mycobacterium bovis subsp bovis AF2122/97
cgguaacuguccgcccg

SEQ ID NO: 3189430 - RNA, 19 nt, Mycobacterium bovis subsp bovis AF2122/97
cgguaacuguccgcccgga

SEQ ID NO: 3189431 - RNA, 13 nt, Mycobacterium bovis subsp bovis AF2122/97
cgguaagcgaaac

SEQ ID NO: 3189432 - RNA, 14 nt, Mycobacterium bovis subsp bovis AF2122/97
cgguaagcgccaag

SEQ ID NO: 3189433 - RNA, 19 nt, Mycobacterium bovis subsp bovis AF2122/97
cgguacaacccccaggcgc

SEQ ID NO: 3189434 - RNA, 15 nt, Mycobacterium bovis subsp bovis AF2122/97
cgguaccaccggcac

SEQ ID NO: 3189435 - RNA, 14 nt, Mycobacterium bovis subsp bovis AF2122/97
cgguaccaucaccg

SEQ ID NO: 3189436 - RNA, 16 nt, Mycobacterium bovis subsp bovis AF2122/97
cgguaccaucaccgcg

SEQ ID NO: 3189437 - RNA, 17 nt, Mycobacterium bovis subsp bovis AF2122/97
cgguaccaucaccgcgc

SEQ ID NO: 3189438 - RNA, 20 nt, Mycobacterium bovis subsp bovis AF2122/97
cgguaccaucaccgcgccag

SEQ ID NO: 3189439 - RNA, 20 nt, Mycobacterium bovis subsp bovis AF2122/97
cgguacccaccucccgcagc

SEQ ID NO: 3189440 - RNA, 21 nt, Mycobacterium bovis subsp bovis AF2122/97
cgguacccaccucccgcagcc

SEQ ID NO: 3189441 - RNA, 23 nt, Mycobacterium bovis subsp bovis AF2122/97
cgguacccaccucccgcagccgg

SEQ ID NO: 3189442 - RNA, 17 nt, Mycobacterium bovis subsp bovis AF2122/97
cgguaccccagcgcugu

SEQ ID NO: 3189443 - RNA, 19 nt, Mycobacterium bovis subsp bovis AF2122/97
cgguaccccagcgcugucg

SEQ ID NO: 3189444 - RNA, 16 nt, Mycobacterium bovis subsp bovis AF2122/97
cgguacccguagcacc

SEQ ID NO: 3189445 - RNA, 17 nt, Mycobacterium bovis subsp bovis AF2122/97
cgguacccguagcacca

SEQ ID NO: 3189446 - RNA, 20 nt, Mycobacterium bovis subsp bovis AF2122/97
cgguacccguagcaccacau

SEQ ID NO: 3189447 - RNA, 19 nt, Mycobacterium bovis subsp bovis AF2122/97
cgguaccgacggggaugga

SEQ ID NO: 3189448 - RNA, 18 nt, Mycobacterium bovis subsp bovis AF2122/97
cgguaccgaucagcaggg

SEQ ID NO: 3189449 - RNA, 14 nt, Mycobacterium bovis subsp bovis AF2122/97
cgguaccgcccagu

SEQ ID NO: 3189450 - RNA, 15 nt, Mycobacterium bovis subsp bovis AF2122/97
cgguaccgccgcggu

SEQ ID NO: 3189451 - RNA, 15 nt, Mycobacterium bovis subsp bovis AF2122/97
cgguaccgccgcugc

SEQ ID NO: 3189452 - RNA, 17 nt, Mycobacterium bovis subsp bovis AF2122/97
cgguaccgccgcugccg

SEQ ID NO: 3189453 - RNA, 15 nt, Mycobacterium bovis subsp bovis AF2122/97
cgguaccgccggcuc

SEQ ID NO: 3189454 - RNA, 18 nt, Mycobacterium bovis subsp bovis AF2122/97
cgguaccgccggcuccgc

SEQ ID NO: 3189455 - RNA, 13 nt, Mycobacterium bovis subsp bovis AF2122/97
cgguaccgggauc

SEQ ID NO: 3189456 - RNA, 17 nt, Mycobacterium bovis subsp bovis AF2122/97
cgguaccuagccgcaga

SEQ ID NO: 3189457 - RNA, 16 nt, Mycobacterium bovis subsp bovis AF2122/97
cgguaccucaacacca

SEQ ID NO: 3189458 - RNA, 14 nt, Mycobacterium bovis subsp bovis AF2122/97
cgguaccucgucga

SEQ ID NO: 3189459 - RNA, 18 nt, Mycobacterium bovis subsp bovis AF2122/97
cgguacgcaaccaaccgu

SEQ ID NO: 3189460 - RNA, 12 nt, Mycobacterium bovis subsp bovis AF2122/97
cgguacgccggu

SEQ ID NO: 3189461 - RNA, 20 nt, Mycobacterium bovis subsp bovis AF2122/97
cgguacgccggucggugcgg

SEQ ID NO: 3189462 - RNA, 21 nt, Mycobacterium bovis subsp bovis AF2122/97
cgguacggaccguggcagcug

SEQ ID NO: 3189463 - RNA, 21 nt, Mycobacterium bovis subsp bovis AF2122/97
cgguacgggucgccggacugc

SEQ ID NO: 3189464 - RNA, 17 nt, Mycobacterium bovis subsp bovis AF2122/97
cgguacugcgcagcgcc

SEQ ID NO: 3189465 - RNA, 18 nt, Mycobacterium bovis subsp bovis AF2122/97
cgguacugcgcagcgccu

SEQ ID NO: 3189466 - RNA, 18 nt, Mycobacterium bovis subsp bovis AF2122/97
cgguagacaagucggcgc

SEQ ID NO: 3189467 - RNA, 22 nt, Mycobacterium bovis subsp bovis AF2122/97
cgguagacaagucggcgcuggc

SEQ ID NO: 3189468 - RNA, 16 nt, Mycobacterium bovis subsp bovis AF2122/97
cgguagacgccgccgu

SEQ ID NO: 3189469 - RNA, 15 nt, Mycobacterium bovis subsp bovis AF2122/97
cgguagaucagcgcc

SEQ ID NO: 3189470 - RNA, 21 nt, Mycobacterium bovis subsp bovis AF2122/97
cgguagaucuucggccgcacu

SEQ ID NO: 3189471 - RNA, 16 nt, Mycobacterium bovis subsp bovis AF2122/97
cgguagcacagcagca

SEQ ID NO: 3189472 - RNA, 14 nt, Mycobacterium bovis subsp bovis AF2122/97
cgguagcauccagc

SEQ ID NO: 3189473 - RNA, 15 nt, Mycobacterium bovis subsp bovis AF2122/97
cgguagccaggcgcg

SEQ ID NO: 3189474 - RNA, 23 nt, Mycobacterium bovis subsp bovis AF2122/97
cgguagccaggcgcgcuaccagc

SEQ ID NO: 3189475 - RNA, 18 nt, Mycobacterium bovis subsp bovis AF2122/97
cgguagccccgucgaccu

SEQ ID NO: 3189476 - RNA, 16 nt, Mycobacterium bovis subsp bovis AF2122/97
cgguagccgaccagcg

SEQ ID NO: 3189477 - RNA, 17 nt, Mycobacterium bovis subsp bovis AF2122/97
cgguagccgaccagcgc

SEQ ID NO: 3189478 - RNA, 18 nt, Mycobacterium bovis subsp bovis AF2122/97
cgguagccgaccagcgcu

SEQ ID NO: 3189479 - RNA, 16 nt, Mycobacterium bovis subsp bovis AF2122/97
cgguagccgaccgacc

SEQ ID NO: 3189480 - RNA, 18 nt, Mycobacterium bovis subsp bovis AF2122/97
cgguagccgacgacacgg

SEQ ID NO: 3189481 - RNA, 18 nt, Mycobacterium bovis subsp bovis AF2122/97
cgguagccuggcuguccg

SEQ ID NO: 3189482 - RNA, 18 nt, Mycobacterium bovis subsp bovis AF2122/97
cgguagcgcggguggcuc

SEQ ID NO: 3189483 - RNA, 18 nt, Mycobacterium bovis subsp bovis AF2122/97
cgguagcucauugccgau

SEQ ID NO: 3189484 - RNA, 17 nt, Mycobacterium bovis subsp bovis AF2122/97
cgguagcucgucgagga

SEQ ID NO: 3189485 - RNA, 21 nt, Mycobacterium bovis subsp bovis AF2122/97
cgguagcugaccgugcugaau

SEQ ID NO: 3189486 - RNA, 18 nt, Mycobacterium bovis subsp bovis AF2122/97
cgguagcugcccagcguc

SEQ ID NO: 3189487 - RNA, 13 nt, Mycobacterium bovis subsp bovis AF2122/97
cgguagcuuccgc

SEQ ID NO: 3189488 - RNA, 14 nt, Mycobacterium bovis subsp bovis AF2122/97
cgguaggcaccgau

SEQ ID NO: 3189489 - RNA, 18 nt, Mycobacterium bovis subsp bovis AF2122/97
cgguaggcaccgaucggu

SEQ ID NO: 3189490 - RNA, 21 nt, Mycobacterium bovis subsp bovis AF2122/97
cgguaggcaccgaucggugcc

SEQ ID NO: 3189491 - RNA, 14 nt, Mycobacterium bovis subsp bovis AF2122/97
cgguaggccggcaa

SEQ ID NO: 3189492 - RNA, 15 nt, Mycobacterium bovis subsp bovis AF2122/97
cgguaggggugaucc

SEQ ID NO: 3189493 - RNA, 20 nt, Mycobacterium bovis subsp bovis AF2122/97
cgguaggugcaugucgauga

SEQ ID NO: 3189494 - RNA, 16 nt, Mycobacterium bovis subsp bovis AF2122/97
cgguaguacuagcacg

SEQ ID NO: 3189495 - RNA, 18 nt, Mycobacterium bovis subsp bovis AF2122/97
cgguaguccggcuuaccg

SEQ ID NO: 3189496 - RNA, 14 nt, Mycobacterium bovis subsp bovis AF2122/97
cgguagucgaugcu

SEQ ID NO: 3189497 - RNA, 23 nt, Mycobacterium bovis subsp bovis AF2122/97
cgguagucgaugcugacgguggg

SEQ ID NO: 3189498 - RNA, 14 nt, Mycobacterium bovis subsp bovis AF2122/97
cgguagucggccag

SEQ ID NO: 3189499 - RNA, 12 nt, Mycobacterium bovis subsp bovis AF2122/97
cgguagucgucg

SEQ ID NO: 3189500 - RNA, 17 nt, Mycobacterium bovis subsp bovis AF2122/97
cgguaguuaacccaggg

SEQ ID NO: 3189501 - RNA, 20 nt, Mycobacterium bovis subsp bovis AF2122/97
cgguaguugucccgccgcgc

SEQ ID NO: 3189502 - RNA, 17 nt, Mycobacterium bovis subsp bovis AF2122/97
cgguauacccggccccg

SEQ ID NO: 3189503 - RNA, 19 nt, Mycobacterium bovis subsp bovis AF2122/97
cgguaucccccagccgcgg

SEQ ID NO: 3189504 - RNA, 22 nt, Mycobacterium bovis subsp bovis AF2122/97
cgguaucccccagccgcggcgc

SEQ ID NO: 3189505 - RNA, 18 nt, Mycobacterium bovis subsp bovis AF2122/97
cgguaucgaaagccaacu

SEQ ID NO: 3189506 - RNA, 12 nt, Mycobacterium bovis subsp bovis AF2122/97
cgguaucgccaa

SEQ ID NO: 3189507 - RNA, 17 nt, Mycobacterium bovis subsp bovis AF2122/97
cgguaucggcagauggu

SEQ ID NO: 3189508 - RNA, 20 nt, Mycobacterium bovis subsp bovis AF2122/97
cgguaucgucccggcgaccg

SEQ ID NO: 3189509 - RNA, 22 nt, Mycobacterium bovis subsp bovis AF2122/97
cgguaugcgcguccccagcgcc

SEQ ID NO: 3189510 - RNA, 16 nt, Mycobacterium bovis subsp bovis AF2122/97
cgguaugcucgcuggc

SEQ ID NO: 3189511 - RNA, 14 nt, Mycobacterium bovis subsp bovis AF2122/97
cgguauuaccgccg

SEQ ID NO: 3189512 - RNA, 13 nt, Mycobacterium bovis subsp bovis AF2122/97
cgguauugcccgg

SEQ ID NO: 3189513 - RNA, 23 nt, Mycobacterium bovis subsp bovis AF2122/97
cgguauugccuagguucgcccag

SEQ ID NO: 3189514 - RNA, 22 nt, Mycobacterium bovis subsp bovis AF2122/97
cgguauuugaacgcccgcuuca

SEQ ID NO: 3189515 - RNA, 15 nt, Mycobacterium bovis subsp bovis AF2122/97
cggucaaacgcgcgc

SEQ ID NO: 3189516 - RNA, 17 nt, Mycobacterium bovis subsp bovis AF2122/97
cggucaaacgcgcgcgc

SEQ ID NO: 3189517 - RNA, 20 nt, Mycobacterium bovis subsp bovis AF2122/97
cggucaacacccgcccgggc

SEQ ID NO: 3189518 - RNA, 18 nt, Mycobacterium bovis subsp bovis AF2122/97
cggucaacgacagccuca

SEQ ID NO: 3189519 - RNA, 13 nt, Mycobacterium bovis subsp bovis AF2122/97
cggucaacgaucc

SEQ ID NO: 3189520 - RNA, 16 nt, Mycobacterium bovis subsp bovis AF2122/97
cggucaacgcugacgu

SEQ ID NO: 3189521 - RNA, 17 nt, Mycobacterium bovis subsp bovis AF2122/97
cggucaagccggcgccc

SEQ ID NO: 3189522 - RNA, 24 nt, Mycobacterium bovis subsp bovis AF2122/97
cggucaagccggcgcccgccgcga

SEQ ID NO: 3189523 - RNA, 17 nt, Mycobacterium bovis subsp bovis AF2122/97
cggucaaggugcgccgc

SEQ ID NO: 3189524 - RNA, 18 nt, Mycobacterium bovis subsp bovis AF2122/97
cggucaaggugcgccgcc

SEQ ID NO: 3189525 - RNA, 19 nt, Mycobacterium bovis subsp bovis AF2122/97
cggucaaggugcgccgcca

SEQ ID NO: 3189526 - RNA, 20 nt, Mycobacterium bovis subsp bovis AF2122/97
cggucaaggugcgccgccau

SEQ ID NO: 3189527 - RNA, 20 nt, Mycobacterium bovis subsp bovis AF2122/97
cggucaaucccggccagggg

SEQ ID NO: 3189528 - RNA, 22 nt, Mycobacterium bovis subsp bovis AF2122/97
cggucaauucggugcgcuggcg

SEQ ID NO: 3189529 - RNA, 15 nt, Mycobacterium bovis subsp bovis AF2122/97
cggucacacgccagc

SEQ ID NO: 3189530 - RNA, 17 nt, Mycobacterium bovis subsp bovis AF2122/97
cggucacacgccagccg

SEQ ID NO: 3189531 - RNA, 21 nt, Mycobacterium bovis subsp bovis AF2122/97
cggucaccaccguggcgcccg

SEQ ID NO: 3189532 - RNA, 16 nt, Mycobacterium bovis subsp bovis AF2122/97
cggucaccacgcggcg

SEQ ID NO: 3189533 - RNA, 23 nt, Mycobacterium bovis subsp bovis AF2122/97
cggucaccacggcggcggcguag

SEQ ID NO: 3189534 - RNA, 22 nt, Mycobacterium bovis subsp bovis AF2122/97
cggucaccauggcgccgcgccg

SEQ ID NO: 3189535 - RNA, 16 nt, Mycobacterium bovis subsp bovis AF2122/97
cggucaccccggcucg

SEQ ID NO: 3189536 - RNA, 22 nt, Mycobacterium bovis subsp bovis AF2122/97
cggucaccccggcucggccacc

SEQ ID NO: 3189537 - RNA, 21 nt, Mycobacterium bovis subsp bovis AF2122/97
cggucaccgacaauucaacac

SEQ ID NO: 3189538 - RNA, 18 nt, Mycobacterium bovis subsp bovis AF2122/97
cggucaccgacgcagaac

SEQ ID NO: 3189539 - RNA, 14 nt, Mycobacterium bovis subsp bovis AF2122/97
cggucaccgcgcag

SEQ ID NO: 3189540 - RNA, 13 nt, Mycobacterium bovis subsp bovis AF2122/97
cggucaccgcggc

SEQ ID NO: 3189541 - RNA, 15 nt, Mycobacterium bovis subsp bovis AF2122/97
cggucaccgcggcau

SEQ ID NO: 3189542 - RNA, 12 nt, Mycobacterium bovis subsp bovis AF2122/97
cggucaccgcgu

SEQ ID NO: 3189543 - RNA, 14 nt, Mycobacterium bovis subsp bovis AF2122/97
cggucaccgcguca

SEQ ID NO: 3189544 - RNA, 13 nt, Mycobacterium bovis subsp bovis AF2122/97
cggucaccggcgc

SEQ ID NO: 3189545 - RNA, 15 nt, Mycobacterium bovis subsp bovis AF2122/97
cggucaccggcgcac

SEQ ID NO: 3189546 - RNA, 14 nt, Mycobacterium bovis subsp bovis AF2122/97
cggucaccucgaug

SEQ ID NO: 3189547 - RNA, 15 nt, Mycobacterium bovis subsp bovis AF2122/97
cggucaccucgaugc

SEQ ID NO: 3189548 - RNA, 16 nt, Mycobacterium bovis subsp bovis AF2122/97
cggucaccucgaugcg

SEQ ID NO: 3189549 - RNA, 17 nt, Mycobacterium bovis subsp bovis AF2122/97
cggucacgacggcacgc

SEQ ID NO: 3189550 - RNA, 18 nt, Mycobacterium bovis subsp bovis AF2122/97
cggucacgacggcacgcc

SEQ ID NO: 3189551 - RNA, 12 nt, Mycobacterium bovis subsp bovis AF2122/97
cggucacgacgu

SEQ ID NO: 3189552 - RNA, 16 nt, Mycobacterium bovis subsp bovis AF2122/97
cggucacgaucacgau

SEQ ID NO: 3189553 - RNA, 14 nt, Mycobacterium bovis subsp bovis AF2122/97
cggucacgguggug

SEQ ID NO: 3189554 - RNA, 15 nt, Mycobacterium bovis subsp bovis AF2122/97
cggucacgucgauga

SEQ ID NO: 3189555 - RNA, 15 nt, Mycobacterium bovis subsp bovis AF2122/97
cggucacucuggcga

SEQ ID NO: 3189556 - RNA, 16 nt, Mycobacterium bovis subsp bovis AF2122/97
cggucagauucggcga

SEQ ID NO: 3189557 - RNA, 16 nt, Mycobacterium bovis subsp bovis AF2122/97
cggucagcaccuccac

SEQ ID NO: 3189558 - RNA, 19 nt, Mycobacterium bovis subsp bovis AF2122/97
cggucagccagcccagggu

SEQ ID NO: 3189559 - RNA, 13 nt, Mycobacterium bovis subsp bovis AF2122/97
cggucagccgcgg

SEQ ID NO: 3189560 - RNA, 15 nt, Mycobacterium bovis subsp bovis AF2122/97
cggucagcgcggcga

SEQ ID NO: 3189561 - RNA, 17 nt, Mycobacterium bovis subsp bovis AF2122/97
cggucagcgcggcgcac

SEQ ID NO: 3189562 - RNA, 18 nt, Mycobacterium bovis subsp bovis AF2122/97
cggucagcggauccaggc

SEQ ID NO: 3189563 - RNA, 19 nt, Mycobacterium bovis subsp bovis AF2122/97
cggucagcggauccaggcc

SEQ ID NO: 3189564 - RNA, 19 nt, Mycobacterium bovis subsp bovis AF2122/97
cggucagcggccaacccau

SEQ ID NO: 3189565 - RNA, 22 nt, Mycobacterium bovis subsp bovis AF2122/97
cggucagcgggcacgccgccga

SEQ ID NO: 3189566 - RNA, 17 nt, Mycobacterium bovis subsp bovis AF2122/97
cggucagcucgcugacg

SEQ ID NO: 3189567 - RNA, 19 nt, Mycobacterium bovis subsp bovis AF2122/97
cggucagcucgcugacggc

SEQ ID NO: 3189568 - RNA, 22 nt, Mycobacterium bovis subsp bovis AF2122/97
cggucagcucggcagcaucucc

SEQ ID NO: 3189569 - RNA, 18 nt, Mycobacterium bovis subsp bovis AF2122/97
cggucaggcaguccaccg

SEQ ID NO: 3189570 - RNA, 13 nt, Mycobacterium bovis subsp bovis AF2122/97
cggucaggccgcc

SEQ ID NO: 3189571 - RNA, 14 nt, Mycobacterium bovis subsp bovis AF2122/97
cggucaggccgccg

SEQ ID NO: 3189572 - RNA, 15 nt, Mycobacterium bovis subsp bovis AF2122/97
cggucaggccgccgc

SEQ ID NO: 3189573 - RNA, 17 nt, Mycobacterium bovis subsp bovis AF2122/97
cggucaggccgccgcgg

SEQ ID NO: 3189574 - RNA, 19 nt, Mycobacterium bovis subsp bovis AF2122/97
cggucaggcucauccgccg

SEQ ID NO: 3189575 - RNA, 21 nt, Mycobacterium bovis subsp bovis AF2122/97
cggucaggcucauccgccggg

SEQ ID NO: 3189576 - RNA, 19 nt, Mycobacterium bovis subsp bovis AF2122/97
cggucagguacaucccggu

SEQ ID NO: 3189577 - RNA, 16 nt, Mycobacterium bovis subsp bovis AF2122/97
cggucaggucgagguc

SEQ ID NO: 3189578 - RNA, 22 nt, Mycobacterium bovis subsp bovis AF2122/97
cggucaggucugacagaccggg

SEQ ID NO: 3189579 - RNA, 17 nt, Mycobacterium bovis subsp bovis AF2122/97
cggucaguauggcgacg

SEQ ID NO: 3189580 - RNA, 18 nt, Mycobacterium bovis subsp bovis AF2122/97
cggucaguauggcgacga

SEQ ID NO: 3189581 - RNA, 20 nt, Mycobacterium bovis subsp bovis AF2122/97
cggucagugggacgggcgcg

SEQ ID NO: 3189582 - RNA, 23 nt, Mycobacterium bovis subsp bovis AF2122/97
cggucaucccuuucgcgccgcga

SEQ ID NO: 3189583 - RNA, 14 nt, Mycobacterium bovis subsp bovis AF2122/97
cggucauccggccg

SEQ ID NO: 3189584 - RNA, 17 nt, Mycobacterium bovis subsp bovis AF2122/97
cggucauccggccgucg

SEQ ID NO: 3189585 - RNA, 22 nt, Mycobacterium bovis subsp bovis AF2122/97
cggucauccgggcgaccaccac

SEQ ID NO: 3189586 - RNA, 13 nt, Mycobacterium bovis subsp bovis AF2122/97
cggucaucgccga

SEQ ID NO: 3189587 - RNA, 15 nt, Mycobacterium bovis subsp bovis AF2122/97
cggucaucggcgcca

SEQ ID NO: 3189588 - RNA, 14 nt, Mycobacterium bovis subsp bovis AF2122/97
cggucaugccgccg

SEQ ID NO: 3189589 - RNA, 16 nt, Mycobacterium bovis subsp bovis AF2122/97
cggucaugccgccgcc

SEQ ID NO: 3189590 - RNA, 16 nt, Mycobacterium bovis subsp bovis AF2122/97
cggucauggcgacggu

SEQ ID NO: 3189591 - RNA, 17 nt, Mycobacterium bovis subsp bovis AF2122/97
cggucauggcgacgguc

SEQ ID NO: 3189592 - RNA, 19 nt, Mycobacterium bovis subsp bovis AF2122/97
cggucauguccguccgcga

SEQ ID NO: 3189593 - RNA, 17 nt, Mycobacterium bovis subsp bovis AF2122/97
cggucaugucggccacc

SEQ ID NO: 3189594 - RNA, 18 nt, Mycobacterium bovis subsp bovis AF2122/97
cgguccaaaacaccgcca

SEQ ID NO: 3189595 - RNA, 16 nt, Mycobacterium bovis subsp bovis AF2122/97
cgguccaaagcacguc

SEQ ID NO: 3189596 - RNA, 17 nt, Mycobacterium bovis subsp bovis AF2122/97
cgguccaacagcgccag

SEQ ID NO: 3189597 - RNA, 17 nt, Mycobacterium bovis subsp bovis AF2122/97
cgguccaaucgccgggu

SEQ ID NO: 3189598 - RNA, 19 nt, Mycobacterium bovis subsp bovis AF2122/97
cgguccaaucgccgggugc

SEQ ID NO: 3189599 - RNA, 16 nt, Mycobacterium bovis subsp bovis AF2122/97
cgguccacccaagcuc

SEQ ID NO: 3189600 - RNA, 20 nt, Mycobacterium bovis subsp bovis AF2122/97
cgguccaccggcccucgcca

SEQ ID NO: 3189601 - RNA, 16 nt, Mycobacterium bovis subsp bovis AF2122/97
cgguccacgacgucga

SEQ ID NO: 3189602 - RNA, 13 nt, Mycobacterium bovis subsp bovis AF2122/97
cgguccagcagcu

SEQ ID NO: 3189603 - RNA, 23 nt, Mycobacterium bovis subsp bovis AF2122/97
cgguccagcagcucggccgaggc

SEQ ID NO: 3189604 - RNA, 21 nt, Mycobacterium bovis subsp bovis AF2122/97
cgguccagccaacgggaacaa

SEQ ID NO: 3189605 - RNA, 14 nt, Mycobacterium bovis subsp bovis AF2122/97
cgguccagccaccg

SEQ ID NO: 3189606 - RNA, 20 nt, Mycobacterium bovis subsp bovis AF2122/97
cgguccagccgguccagacc

SEQ ID NO: 3189607 - RNA, 15 nt, Mycobacterium bovis subsp bovis AF2122/97
cgguccagcgccgga

SEQ ID NO: 3189608 - RNA, 16 nt, Mycobacterium bovis subsp bovis AF2122/97
cgguccagcggccgcc

SEQ ID NO: 3189609 - RNA, 18 nt, Mycobacterium bovis subsp bovis AF2122/97
cgguccagcggccgccgc

SEQ ID NO: 3189610 - RNA, 20 nt, Mycobacterium bovis subsp bovis AF2122/97
cgguccagcggccgccgcgg

SEQ ID NO: 3189611 - RNA, 19 nt, Mycobacterium bovis subsp bovis AF2122/97
cgguccagcgucgccgcca

SEQ ID NO: 3189612 - RNA, 20 nt, Mycobacterium bovis subsp bovis AF2122/97
cgguccagcgucgccgccag

SEQ ID NO: 3189613 - RNA, 18 nt, Mycobacterium bovis subsp bovis AF2122/97
cgguccaggccggcaccc

SEQ ID NO: 3189614 - RNA, 13 nt, Mycobacterium bovis subsp bovis AF2122/97
cgguccaucccga

SEQ ID NO: 3189615 - RNA, 16 nt, Mycobacterium bovis subsp bovis AF2122/97
cgguccaucccgagcu

SEQ ID NO: 3189616 - RNA, 19 nt, Mycobacterium bovis subsp bovis AF2122/97
cgguccauggacggccagg

SEQ ID NO: 3189617 - RNA, 20 nt, Mycobacterium bovis subsp bovis AF2122/97
cgguccauggacggccaggu

SEQ ID NO: 3189618 - RNA, 13 nt, Mycobacterium bovis subsp bovis AF2122/97
cgguccauucguc

SEQ ID NO: 3189619 - RNA, 19 nt, Mycobacterium bovis subsp bovis AF2122/97
cgguccauucguccgcggu

SEQ ID NO: 3189620 - RNA, 16 nt, Mycobacterium bovis subsp bovis AF2122/97
cggucccaaggcguug

SEQ ID NO: 3189621 - RNA, 16 nt, Mycobacterium bovis subsp bovis AF2122/97
cggucccacggccggc

SEQ ID NO: 3189622 - RNA, 19 nt, Mycobacterium bovis subsp bovis AF2122/97
cggucccacggccggccgc

SEQ ID NO: 3189623 - RNA, 19 nt, Mycobacterium bovis subsp bovis AF2122/97
cggucccacugccggugcu

SEQ ID NO: 3189624 - RNA, 22 nt, Mycobacterium bovis subsp bovis AF2122/97
cggucccacugccggugcugag

SEQ ID NO: 3189625 - RNA, 14 nt, Mycobacterium bovis subsp bovis AF2122/97
cggucccagguugg

SEQ ID NO: 3189626 - RNA, 21 nt, Mycobacterium bovis subsp bovis AF2122/97
cggucccagguuggagcccga

SEQ ID NO: 3189627 - RNA, 21 nt, Mycobacterium bovis subsp bovis AF2122/97
cgguccccccguugccgccgu

SEQ ID NO: 3189628 - RNA, 19 nt, Mycobacterium bovis subsp bovis AF2122/97
cggucccccgcccacauac

SEQ ID NO: 3189629 - RNA, 20 nt, Mycobacterium bovis subsp bovis AF2122/97
cgguccccgcagcucgacca

SEQ ID NO: 3189630 - RNA, 15 nt, Mycobacterium bovis subsp bovis AF2122/97
cgguccccgccggcg

SEQ ID NO: 3189631 - RNA, 16 nt, Mycobacterium bovis subsp bovis AF2122/97
cgguccccgccggcgg

SEQ ID NO: 3189632 - RNA, 13 nt, Mycobacterium bovis subsp bovis AF2122/97
cggucccgccgac

SEQ ID NO: 3189633 - RNA, 14 nt, Mycobacterium bovis subsp bovis AF2122/97
cggucccgccgacc

SEQ ID NO: 3189634 - RNA, 15 nt, Mycobacterium bovis subsp bovis AF2122/97
cggucccgccgaccg

SEQ ID NO: 3189635 - RNA, 13 nt, Mycobacterium bovis subsp bovis AF2122/97
cggucccgccgug

SEQ ID NO: 3189636 - RNA, 19 nt, Mycobacterium bovis subsp bovis AF2122/97
cggucccgccgugccgcgg

SEQ ID NO: 3189637 - RNA, 16 nt, Mycobacterium bovis subsp bovis AF2122/97
cggucccgcggaccgc

SEQ ID NO: 3189638 - RNA, 15 nt, Mycobacterium bovis subsp bovis AF2122/97
cggucccguugccgc

SEQ ID NO: 3189639 - RNA, 14 nt, Mycobacterium bovis subsp bovis AF2122/97
cggucccucaugcu

SEQ ID NO: 3189640 - RNA, 15 nt, Mycobacterium bovis subsp bovis AF2122/97
cggucccugcgccgu

SEQ ID NO: 3189641 - RNA, 20 nt, Mycobacterium bovis subsp bovis AF2122/97
cggucccuuuguggggccgg

SEQ ID NO: 3189642 - RNA, 21 nt, Mycobacterium bovis subsp bovis AF2122/97
cggucccuuuguggggccggg

SEQ ID NO: 3189643 - RNA, 22 nt, Mycobacterium bovis subsp bovis AF2122/97
cggucccuuuguggggccgggc

SEQ ID NO: 3189644 - RNA, 20 nt, Mycobacterium bovis subsp bovis AF2122/97
cgguccgauugaguucuggg

SEQ ID NO: 3189645 - RNA, 13 nt, Mycobacterium bovis subsp bovis AF2122/97
cgguccgccacgg

SEQ ID NO: 3189646 - RNA, 18 nt, Mycobacterium bovis subsp bovis AF2122/97
cgguccgccacggcgggc

SEQ ID NO: 3189647 - RNA, 14 nt, Mycobacterium bovis subsp bovis AF2122/97
cgguccgccagcgc

SEQ ID NO: 3189648 - RNA, 15 nt, Mycobacterium bovis subsp bovis AF2122/97
cgguccgccagcgcg

SEQ ID NO: 3189649 - RNA, 16 nt, Mycobacterium bovis subsp bovis AF2122/97
cgguccgccgcagacc

SEQ ID NO: 3189650 - RNA, 22 nt, Mycobacterium bovis subsp bovis AF2122/97
cgguccgcugccaucggcacca

SEQ ID NO: 3189651 - RNA, 21 nt, Mycobacterium bovis subsp bovis AF2122/97
cgguccggaaauuccggcgcg

SEQ ID NO: 3189652 - RNA, 22 nt, Mycobacterium bovis subsp bovis AF2122/97
cgguccggauugaagucgucgg

SEQ ID NO: 3189653 - RNA, 17 nt, Mycobacterium bovis subsp bovis AF2122/97
cgguccggcccaccagc

SEQ ID NO: 3189654 - RNA, 19 nt, Mycobacterium bovis subsp bovis AF2122/97
cgguccggcccaccagcgc

SEQ ID NO: 3189655 - RNA, 15 nt, Mycobacterium bovis subsp bovis AF2122/97
cgguccggcccgggg

SEQ ID NO: 3189656 - RNA, 23 nt, Mycobacterium bovis subsp bovis AF2122/97
cgguccggcgaaaagacugcgcc

SEQ ID NO: 3189657 - RNA, 16 nt, Mycobacterium bovis subsp bovis AF2122/97
cgguccggggcaacga

SEQ ID NO: 3189658 - RNA, 21 nt, Mycobacterium bovis subsp bovis AF2122/97
cgguccgucaccaccgccgcc

SEQ ID NO: 3189659 - RNA, 15 nt, Mycobacterium bovis subsp bovis AF2122/97
cgguccguucgcgcc

SEQ ID NO: 3189660 - RNA, 17 nt, Mycobacterium bovis subsp bovis AF2122/97
cgguccguucgcgccgu

SEQ ID NO: 3189661 - RNA, 19 nt, Mycobacterium bovis subsp bovis AF2122/97
cgguccguucgcgccguug

SEQ ID NO: 3189662 - RNA, 15 nt, Mycobacterium bovis subsp bovis AF2122/97
cgguccucgaucggu

SEQ ID NO: 3189663 - RNA, 13 nt, Mycobacterium bovis subsp bovis AF2122/97
cgguccucgucgg

SEQ ID NO: 3189664 - RNA, 13 nt, Mycobacterium bovis subsp bovis AF2122/97
cgguccugcucgc

SEQ ID NO: 3189665 - RNA, 14 nt, Mycobacterium bovis subsp bovis AF2122/97
cgguccugcucgca

SEQ ID NO: 3189666 - RNA, 18 nt, Mycobacterium bovis subsp bovis AF2122/97
cgguccugcucgcacagc

SEQ ID NO: 3189667 - RNA, 18 nt, Mycobacterium bovis subsp bovis AF2122/97
cgguccugggauccggcg

SEQ ID NO: 3189668 - RNA, 16 nt, Mycobacterium bovis subsp bovis AF2122/97
cggucgaagagguggg

SEQ ID NO: 3189669 - RNA, 23 nt, Mycobacterium bovis subsp bovis AF2122/97
cggucgaauucuguugugccgca

SEQ ID NO: 3189670 - RNA, 18 nt, Mycobacterium bovis subsp bovis AF2122/97
cggucgacagcgaaggcg

SEQ ID NO: 3189671 - RNA, 22 nt, Mycobacterium bovis subsp bovis AF2122/97
cggucgacagcgaaggcgccga

SEQ ID NO: 3189672 - RNA, 20 nt, Mycobacterium bovis subsp bovis AF2122/97
cggucgacagcgcaguaacg

SEQ ID NO: 3189673 - RNA, 21 nt, Mycobacterium bovis subsp bovis AF2122/97
cggucgaccaauuggucgagu

SEQ ID NO: 3189674 - RNA, 23 nt, Mycobacterium bovis subsp bovis AF2122/97
cggucgacccacucaucagagcg

SEQ ID NO: 3189675 - RNA, 15 nt, Mycobacterium bovis subsp bovis AF2122/97
cggucgaccugagcc

SEQ ID NO: 3189676 - RNA, 16 nt, Mycobacterium bovis subsp bovis AF2122/97
cggucgaccugagccc

SEQ ID NO: 3189677 - RNA, 22 nt, Mycobacterium bovis subsp bovis AF2122/97
cggucgacgaucucgccggcga

SEQ ID NO: 3189678 - RNA, 17 nt, Mycobacterium bovis subsp bovis AF2122/97
cggucgacgaugacggu

SEQ ID NO: 3189679 - RNA, 15 nt, Mycobacterium bovis subsp bovis AF2122/97
cggucgacgggucgg

SEQ ID NO: 3189680 - RNA, 16 nt, Mycobacterium bovis subsp bovis AF2122/97
cggucgacgggucggc

SEQ ID NO: 3189681 - RNA, 19 nt, Mycobacterium bovis subsp bovis AF2122/97
cggucgacgggucggcgcc

SEQ ID NO: 3189682 - RNA, 14 nt, Mycobacterium bovis subsp bovis AF2122/97
cggucgacuccagc

SEQ ID NO: 3189683 - RNA, 15 nt, Mycobacterium bovis subsp bovis AF2122/97
cggucgacuccagca

SEQ ID NO: 3189684 - RNA, 19 nt, Mycobacterium bovis subsp bovis AF2122/97
cggucgacuccagcaccag

SEQ ID NO: 3189685 - RNA, 22 nt, Mycobacterium bovis subsp bovis AF2122/97
cggucgacuccagcaccagcac

SEQ ID NO: 3189686 - RNA, 19 nt, Mycobacterium bovis subsp bovis AF2122/97
cggucgacugggacgacgc

SEQ ID NO: 3189687 - RNA, 18 nt, Mycobacterium bovis subsp bovis AF2122/97
cggucgagccacccaccg

SEQ ID NO: 3189688 - RNA, 20 nt, Mycobacterium bovis subsp bovis AF2122/97
cggucgagccagcggagcag

SEQ ID NO: 3189689 - RNA, 14 nt, Mycobacterium bovis subsp bovis AF2122/97
cggucgagcucgua

SEQ ID NO: 3189690 - RNA, 21 nt, Mycobacterium bovis subsp bovis AF2122/97
cggucgagcuucaucccggag

SEQ ID NO: 3189691 - RNA, 16 nt, Mycobacterium bovis subsp bovis AF2122/97
cggucgaggucggcga

SEQ ID NO: 3189692 - RNA, 17 nt, Mycobacterium bovis subsp bovis AF2122/97
cggucgagguggcgggc

SEQ ID NO: 3189693 - RNA, 21 nt, Mycobacterium bovis subsp bovis AF2122/97
cggucgagguggcgggcgaug

SEQ ID NO: 3189694 - RNA, 22 nt, Mycobacterium bovis subsp bovis AF2122/97
cggucgaguagccguagccgcc

SEQ ID NO: 3189695 - RNA, 12 nt, Mycobacterium bovis subsp bovis AF2122/97
cggucgauagcg

SEQ ID NO: 3189696 - RNA, 16 nt, Mycobacterium bovis subsp bovis AF2122/97
cggucgaucaacacca

SEQ ID NO: 3189697 - RNA, 21 nt, Mycobacterium bovis subsp bovis AF2122/97
cggucgaucacacgguccgcc

SEQ ID NO: 3189698 - RNA, 12 nt, Mycobacterium bovis subsp bovis AF2122/97
cggucgaugacc

SEQ ID NO: 3189699 - RNA, 18 nt, Mycobacterium bovis subsp bovis AF2122/97
cggucgaugaccucguca

SEQ ID NO: 3189700 - RNA, 21 nt, Mycobacterium bovis subsp bovis AF2122/97
cggucgaugaucucgccccag

SEQ ID NO: 3189701 - RNA, 22 nt, Mycobacterium bovis subsp bovis AF2122/97
cggucgaugcucagugccaaag

SEQ ID NO: 3189702 - RNA, 19 nt, Mycobacterium bovis subsp bovis AF2122/97
cggucgauguccgcagcac

SEQ ID NO: 3189703 - RNA, 21 nt, Mycobacterium bovis subsp bovis AF2122/97
cggucgauguccgcagcaccg

SEQ ID NO: 3189704 - RNA, 20 nt, Mycobacterium bovis subsp bovis AF2122/97
cggucgaugucggcgaacca

SEQ ID NO: 3189705 - RNA, 19 nt, Mycobacterium bovis subsp bovis AF2122/97
cggucgcacuuggcccccg

SEQ ID NO: 3189706 - RNA, 19 nt, Mycobacterium bovis subsp bovis AF2122/97
cggucgcagcagaccacaa

SEQ ID NO: 3189707 - RNA, 21 nt, Mycobacterium bovis subsp bovis AF2122/97
cggucgcagcagaccacaacg

SEQ ID NO: 3189708 - RNA, 15 nt, Mycobacterium bovis subsp bovis AF2122/97
cggucgcauggucga

SEQ ID NO: 3189709 - RNA, 17 nt, Mycobacterium bovis subsp bovis AF2122/97
cggucgccaaauccgac

SEQ ID NO: 3189710 - RNA, 17 nt, Mycobacterium bovis subsp bovis AF2122/97
cggucgccaagaucggg

SEQ ID NO: 3189711 - RNA, 20 nt, Mycobacterium bovis subsp bovis AF2122/97
cggucgccaagaucgggugg

SEQ ID NO: 3189712 - RNA, 13 nt, Mycobacterium bovis subsp bovis AF2122/97
cggucgccacacc

SEQ ID NO: 3189713 - RNA, 16 nt, Mycobacterium bovis subsp bovis AF2122/97
cggucgccaccgccgg

SEQ ID NO: 3189714 - RNA, 17 nt, Mycobacterium bovis subsp bovis AF2122/97
cggucgccaccgccggc

SEQ ID NO: 3189715 - RNA, 20 nt, Mycobacterium bovis subsp bovis AF2122/97
cggucgccaccgccggcagc

SEQ ID NO: 3189716 - RNA, 22 nt, Mycobacterium bovis subsp bovis AF2122/97
cggucgccaccgugucacgcga

SEQ ID NO: 3189717 - RNA, 20 nt, Mycobacterium bovis subsp bovis AF2122/97
cggucgccgaauggcugggc

SEQ ID NO: 3189718 - RNA, 12 nt, Mycobacterium bovis subsp bovis AF2122/97
cggucgccgacc

SEQ ID NO: 3189719 - RNA, 13 nt, Mycobacterium bovis subsp bovis AF2122/97
cggucgccgacca

SEQ ID NO: 3189720 - RNA, 17 nt, Mycobacterium bovis subsp bovis AF2122/97
cggucgccgaccacucg

SEQ ID NO: 3189721 - RNA, 13 nt, Mycobacterium bovis subsp bovis AF2122/97
cggucgccgacgg

SEQ ID NO: 3189722 - RNA, 22 nt, Mycobacterium bovis subsp bovis AF2122/97
cggucgccgacggcgaccaccg

SEQ ID NO: 3189723 - RNA, 12 nt, Mycobacterium bovis subsp bovis AF2122/97
cggucgccgcga

SEQ ID NO: 3189724 - RNA, 12 nt, Mycobacterium bovis subsp bovis AF2122/97
cggucgccgcgc

SEQ ID NO: 3189725 - RNA, 13 nt, Mycobacterium bovis subsp bovis AF2122/97
cggucgccgcgcg

SEQ ID NO: 3189726 - RNA, 14 nt, Mycobacterium bovis subsp bovis AF2122/97
cggucgccgcgcgu

SEQ ID NO: 3189727 - RNA, 15 nt, Mycobacterium bovis subsp bovis AF2122/97
cggucgccgcgucua

SEQ ID NO: 3189728 - RNA, 13 nt, Mycobacterium bovis subsp bovis AF2122/97
cggucgccggcug

SEQ ID NO: 3189729 - RNA, 16 nt, Mycobacterium bovis subsp bovis AF2122/97
cggucgccucaccggc

SEQ ID NO: 3189730 - RNA, 19 nt, Mycobacterium bovis subsp bovis AF2122/97
cggucgccucaccggcgcg

SEQ ID NO: 3189731 - RNA, 22 nt, Mycobacterium bovis subsp bovis AF2122/97
cggucgccucaccggcgcgagc

SEQ ID NO: 3189732 - RNA, 22 nt, Mycobacterium bovis subsp bovis AF2122/97
cggucgccuggaagaucacgcg

SEQ ID NO: 3189733 - RNA, 23 nt, Mycobacterium bovis subsp bovis AF2122/97
cggucgccuggaagaucacgcgu

SEQ ID NO: 3189734 - RNA, 20 nt, Mycobacterium bovis subsp bovis AF2122/97
cggucgcgacuaccaucgcc

SEQ ID NO: 3189735 - RNA, 20 nt, Mycobacterium bovis subsp bovis AF2122/97
cggucgcgcccucagccgcg

SEQ ID NO: 3189736 - RNA, 19 nt, Mycobacterium bovis subsp bovis AF2122/97
cggucgcgcgacggccggg

SEQ ID NO: 3189737 - RNA, 22 nt, Mycobacterium bovis subsp bovis AF2122/97
cggucgcggacagguagucgcc

SEQ ID NO: 3189738 - RNA, 20 nt, Mycobacterium bovis subsp bovis AF2122/97
cggucgcggagcgugagcca

SEQ ID NO: 3189739 - RNA, 13 nt, Mycobacterium bovis subsp bovis AF2122/97
cggucgcggcggu

SEQ ID NO: 3189740 - RNA, 15 nt, Mycobacterium bovis subsp bovis AF2122/97
cggucgcggcugaca

SEQ ID NO: 3189741 - RNA, 19 nt, Mycobacterium bovis subsp bovis AF2122/97
cggucgcgguagcagccgc

SEQ ID NO: 3189742 - RNA, 17 nt, Mycobacterium bovis subsp bovis AF2122/97
cggucgcguaccggugg

SEQ ID NO: 3189743 - RNA, 21 nt, Mycobacterium bovis subsp bovis AF2122/97
cggucgcguugcagaccacca

SEQ ID NO: 3189744 - RNA, 20 nt, Mycobacterium bovis subsp bovis AF2122/97
cggucgcuauccggcggcca

SEQ ID NO: 3189745 - RNA, 22 nt, Mycobacterium bovis subsp bovis AF2122/97
cggucgcuccggguagcggaua

SEQ ID NO: 3189746 - RNA, 20 nt, Mycobacterium bovis subsp bovis AF2122/97
cggucgcugauccgggcgcc

SEQ ID NO: 3189747 - RNA, 20 nt, Mycobacterium bovis subsp bovis AF2122/97
cggucgcugcgaugcugauc

SEQ ID NO: 3189748 - RNA, 22 nt, Mycobacterium bovis subsp bovis AF2122/97
cggucggaaugccgucgccggu

SEQ ID NO: 3189749 - RNA, 17 nt, Mycobacterium bovis subsp bovis AF2122/97
cggucggaccacccggc

SEQ ID NO: 3189750 - RNA, 20 nt, Mycobacterium bovis subsp bovis AF2122/97
cggucggaccacccggcgcg

SEQ ID NO: 3189751 - RNA, 15 nt, Mycobacterium bovis subsp bovis AF2122/97
cggucggacggccau

SEQ ID NO: 3189752 - RNA, 23 nt, Mycobacterium bovis subsp bovis AF2122/97
cggucggacggccaucgccagcc

SEQ ID NO: 3189753 - RNA, 22 nt, Mycobacterium bovis subsp bovis AF2122/97
cggucggagcggugccgacggu

SEQ ID NO: 3189754 - RNA, 21 nt, Mycobacterium bovis subsp bovis AF2122/97
cggucggagucgagcacaccg

SEQ ID NO: 3189755 - RNA, 23 nt, Mycobacterium bovis subsp bovis AF2122/97
cggucggagucgagcacaccgag

SEQ ID NO: 3189756 - RNA, 21 nt, Mycobacterium bovis subsp bovis AF2122/97
cggucggaucgauuccgccgc

SEQ ID NO: 3189757 - RNA, 16 nt, Mycobacterium bovis subsp bovis AF2122/97
cggucggaucggcgcc

SEQ ID NO: 3189758 - RNA, 17 nt, Mycobacterium bovis subsp bovis AF2122/97
cggucggaucggcgccg

SEQ ID NO: 3189759 - RNA, 12 nt, Mycobacterium bovis subsp bovis AF2122/97
cggucggcacca

SEQ ID NO: 3189760 - RNA, 13 nt, Mycobacterium bovis subsp bovis AF2122/97
cggucggcaccac

SEQ ID NO: 3189761 - RNA, 15 nt, Mycobacterium bovis subsp bovis AF2122/97
cggucggcaccacca

SEQ ID NO: 3189762 - RNA, 20 nt, Mycobacterium bovis subsp bovis AF2122/97
cggucggcaccaccacgccg

SEQ ID NO: 3189763 - RNA, 15 nt, Mycobacterium bovis subsp bovis AF2122/97
cggucggcagcgacg

SEQ ID NO: 3189764 - RNA, 12 nt, Mycobacterium bovis subsp bovis AF2122/97
cggucggcagcu

SEQ ID NO: 3189765 - RNA, 22 nt, Mycobacterium bovis subsp bovis AF2122/97
cggucggcagcuucucgccgac

SEQ ID NO: 3189766 - RNA, 23 nt, Mycobacterium bovis subsp bovis AF2122/97
cggucggcagcuucucgccgacg

SEQ ID NO: 3189767 - RNA, 24 nt, Mycobacterium bovis subsp bovis AF2122/97
cggucggcagcuucucgccgacga

SEQ ID NO: 3189768 - RNA, 15 nt, Mycobacterium bovis subsp bovis AF2122/97
cggucggccaccaac

SEQ ID NO: 3189769 - RNA, 19 nt, Mycobacterium bovis subsp bovis AF2122/97
cggucggccaccaacucgg

SEQ ID NO: 3189770 - RNA, 16 nt, Mycobacterium bovis subsp bovis AF2122/97
cggucggccaggccgu

SEQ ID NO: 3189771 - RNA, 16 nt, Mycobacterium bovis subsp bovis AF2122/97
cggucggccauccacc

SEQ ID NO: 3189772 - RNA, 18 nt, Mycobacterium bovis subsp bovis AF2122/97
cggucggccauccaccgc

SEQ ID NO: 3189773 - RNA, 23 nt, Mycobacterium bovis subsp bovis AF2122/97
cggucggccauugcccgggcggg

SEQ ID NO: 3189774 - RNA, 15 nt, Mycobacterium bovis subsp bovis AF2122/97
cggucggccggcucg

SEQ ID NO: 3189775 - RNA, 21 nt, Mycobacterium bovis subsp bovis AF2122/97
cggucggccugcggcaacggc

SEQ ID NO: 3189776 - RNA, 16 nt, Mycobacterium bovis subsp bovis AF2122/97
cggucggcgaccacca

SEQ ID NO: 3189777 - RNA, 18 nt, Mycobacterium bovis subsp bovis AF2122/97
cggucggcgaccaccagc

SEQ ID NO: 3189778 - RNA, 19 nt, Mycobacterium bovis subsp bovis AF2122/97
cggucggcgaccaccagcg

SEQ ID NO: 3189779 - RNA, 23 nt, Mycobacterium bovis subsp bovis AF2122/97
cggucggcgaccaccagcgccga

SEQ ID NO: 3189780 - RNA, 13 nt, Mycobacterium bovis subsp bovis AF2122/97
cggucggcgacgu

SEQ ID NO: 3189781 - RNA, 18 nt, Mycobacterium bovis subsp bovis AF2122/97
cggucggcgacguagacg

SEQ ID NO: 3189782 - RNA, 22 nt, Mycobacterium bovis subsp bovis AF2122/97
cggucggcgacguauaccgcac

SEQ ID NO: 3189783 - RNA, 16 nt, Mycobacterium bovis subsp bovis AF2122/97
cggucggcggaaacaa

SEQ ID NO: 3189784 - RNA, 12 nt, Mycobacterium bovis subsp bovis AF2122/97
cggucggcggca

SEQ ID NO: 3189785 - RNA, 18 nt, Mycobacterium bovis subsp bovis AF2122/97
cggucggcggccgccagg

SEQ ID NO: 3189786 - RNA, 13 nt, Mycobacterium bovis subsp bovis AF2122/97
cggucggcgggca

SEQ ID NO: 3189787 - RNA, 22 nt, Mycobacterium bovis subsp bovis AF2122/97
cggucggcgguagccgaccagc

SEQ ID NO: 3189788 - RNA, 14 nt, Mycobacterium bovis subsp bovis AF2122/97
cggucgggcccggc

SEQ ID NO: 3189789 - RNA, 15 nt, Mycobacterium bovis subsp bovis AF2122/97
cggucgggcccggcg

SEQ ID NO: 3189790 - RNA, 20 nt, Mycobacterium bovis subsp bovis AF2122/97
cggucgggcccggcgagcua

SEQ ID NO: 3189791 - RNA, 20 nt, Mycobacterium bovis subsp bovis AF2122/97
cggucggggauccgaccugc

SEQ ID NO: 3189792 - RNA, 17 nt, Mycobacterium bovis subsp bovis AF2122/97
cggucgggggcagcgcc

SEQ ID NO: 3189793 - RNA, 18 nt, Mycobacterium bovis subsp bovis AF2122/97
cggucgggggcagcgccu

SEQ ID NO: 3189794 - RNA, 23 nt, Mycobacterium bovis subsp bovis AF2122/97
cggucgguaacggcggugcgggu

SEQ ID NO: 3189795 - RNA, 23 nt, Mycobacterium bovis subsp bovis AF2122/97
cggucggucaccauggcgccgcg

SEQ ID NO: 3189796 - RNA, 13 nt, Mycobacterium bovis subsp bovis AF2122/97
cggucggucucgg

SEQ ID NO: 3189797 - RNA, 16 nt, Mycobacterium bovis subsp bovis AF2122/97
cggucggucucggcga

SEQ ID NO: 3189798 - RNA, 16 nt, Mycobacterium bovis subsp bovis AF2122/97
cggucggugaacccgc

SEQ ID NO: 3189799 - RNA, 14 nt, Mycobacterium bovis subsp bovis AF2122/97
cggucggugagccg

SEQ ID NO: 3189800 - RNA, 20 nt, Mycobacterium bovis subsp bovis AF2122/97
cggucgguguggacugggcc

SEQ ID NO: 3189801 - RNA, 20 nt, Mycobacterium bovis subsp bovis AF2122/97
cggucgucacggaccgccac

SEQ ID NO: 3189802 - RNA, 21 nt, Mycobacterium bovis subsp bovis AF2122/97
cggucgucacggaccgccacc

SEQ ID NO: 3189803 - RNA, 22 nt, Mycobacterium bovis subsp bovis AF2122/97
cggucguccccgucgcuggccg

SEQ ID NO: 3189804 - RNA, 16 nt, Mycobacterium bovis subsp bovis AF2122/97
cggucgugaucagcag

SEQ ID NO: 3189805 - RNA, 13 nt, Mycobacterium bovis subsp bovis AF2122/97
cggucgugccccg

SEQ ID NO: 3189806 - RNA, 17 nt, Mycobacterium bovis subsp bovis AF2122/97
cggucguugccgaccga

SEQ ID NO: 3189807 - RNA, 15 nt, Mycobacterium bovis subsp bovis AF2122/97
cggucguuggucggg

SEQ ID NO: 3189808 - RNA, 16 nt, Mycobacterium bovis subsp bovis AF2122/97
cggucuacgccaccga

SEQ ID NO: 3189809 - RNA, 15 nt, Mycobacterium bovis subsp bovis AF2122/97
cggucucacggcgcg

SEQ ID NO: 3189810 - RNA, 16 nt, Mycobacterium bovis subsp bovis AF2122/97
cggucucacggcgcga

SEQ ID NO: 3189811 - RNA, 17 nt, Mycobacterium bovis subsp bovis AF2122/97
cggucucacggcgcgag

SEQ ID NO: 3189812 - RNA, 17 nt, Mycobacterium bovis subsp bovis AF2122/97
cggucucagugcucgcc

SEQ ID NO: 3189813 - RNA, 18 nt, Mycobacterium bovis subsp bovis AF2122/97
cggucucaugcacccggu

SEQ ID NO: 3189814 - RNA, 18 nt, Mycobacterium bovis subsp bovis AF2122/97
cggucuccgcccgcgggc

SEQ ID NO: 3189815 - RNA, 21 nt, Mycobacterium bovis subsp bovis AF2122/97
cggucuccgcccgcgggcccc

SEQ ID NO: 3189816 - RNA, 15 nt, Mycobacterium bovis subsp bovis AF2122/97
cggucucgaccgcgc

SEQ ID NO: 3189817 - RNA, 16 nt, Mycobacterium bovis subsp bovis AF2122/97
cggucucgaccgcgcc

SEQ ID NO: 3189818 - RNA, 15 nt, Mycobacterium bovis subsp bovis AF2122/97
cggucucgacggcgg

SEQ ID NO: 3189819 - RNA, 17 nt, Mycobacterium bovis subsp bovis AF2122/97
cggucucgacggcggcc

SEQ ID NO: 3189820 - RNA, 16 nt, Mycobacterium bovis subsp bovis AF2122/97
cggucucgagucgguu

SEQ ID NO: 3189821 - RNA, 15 nt, Mycobacterium bovis subsp bovis AF2122/97
cggucucgcaccagu

SEQ ID NO: 3189822 - RNA, 17 nt, Mycobacterium bovis subsp bovis AF2122/97
cggucucgcaccagucg

SEQ ID NO: 3189823 - RNA, 23 nt, Mycobacterium bovis subsp bovis AF2122/97
cggucucggaaacggaccuccuc

SEQ ID NO: 3189824 - RNA, 18 nt, Mycobacterium bovis subsp bovis AF2122/97
cggucucggcgucgacca

SEQ ID NO: 3189825 - RNA, 14 nt, Mycobacterium bovis subsp bovis AF2122/97
cggucucguaacca

SEQ ID NO: 3189826 - RNA, 22 nt, Mycobacterium bovis subsp bovis AF2122/97
cggucucgucgcggguccaggc

SEQ ID NO: 3189827 - RNA, 23 nt, Mycobacterium bovis subsp bovis AF2122/97
cggucugagacucgucgaugcgg

SEQ ID NO: 3189828 - RNA, 23 nt, Mycobacterium bovis subsp bovis AF2122/97
cggucugcgccaaaauccgccca

SEQ ID NO: 3189829 - RNA, 23 nt, Mycobacterium bovis subsp bovis AF2122/97
cggucugcgccuucgccagcggc

SEQ ID NO: 3189830 - RNA, 12 nt, Mycobacterium bovis subsp bovis AF2122/97
cggucugcucca

SEQ ID NO: 3189831 - RNA, 18 nt, Mycobacterium bovis subsp bovis AF2122/97
cggucugcuccaggcgcg

SEQ ID NO: 3189832 - RNA, 19 nt, Mycobacterium bovis subsp bovis AF2122/97
cggucugcuccaggcgcgc

SEQ ID NO: 3189833 - RNA, 21 nt, Mycobacterium bovis subsp bovis AF2122/97
cggucuggacaucggccggcg

SEQ ID NO: 3189834 - RNA, 20 nt, Mycobacterium bovis subsp bovis AF2122/97
cggucuggcccgcgacaucg

SEQ ID NO: 3189835 - RNA, 13 nt, Mycobacterium bovis subsp bovis AF2122/97
cggucuggugguc

SEQ ID NO: 3189836 - RNA, 20 nt, Mycobacterium bovis subsp bovis AF2122/97
cggucugguugucgaucucg

SEQ ID NO: 3189837 - RNA, 15 nt, Mycobacterium bovis subsp bovis AF2122/97
cggucugugcugcgc

SEQ ID NO: 3189838 - RNA, 18 nt, Mycobacterium bovis subsp bovis AF2122/97
cggucuuacggucggcuc

SEQ ID NO: 3189839 - RNA, 17 nt, Mycobacterium bovis subsp bovis AF2122/97
cggucuugcaucgccaa

SEQ ID NO: 3189840 - RNA, 22 nt, Mycobacterium bovis subsp bovis AF2122/97
cggucuugcaucgccaaugcgg

SEQ ID NO: 3189841 - RNA, 17 nt, Mycobacterium bovis subsp bovis AF2122/97
cggucuuggcgcgccca

SEQ ID NO: 3189842 - RNA, 18 nt, Mycobacterium bovis subsp bovis AF2122/97
cggucuuggcgcgcccau

SEQ ID NO: 3189843 - RNA, 19 nt, Mycobacterium bovis subsp bovis AF2122/97
cggucuugggcgcgggugc

SEQ ID NO: 3189844 - RNA, 19 nt, Mycobacterium bovis subsp bovis AF2122/97
cggucuuuaauccagcgcc

SEQ ID NO: 3189845 - RNA, 22 nt, Mycobacterium bovis subsp bovis AF2122/97
cggucuuuaauccagcgccgac

SEQ ID NO: 3189846 - RNA, 17 nt, Mycobacterium bovis subsp bovis AF2122/97
cggucuuugagccggua

SEQ ID NO: 3189847 - RNA, 17 nt, Mycobacterium bovis subsp bovis AF2122/97
cggugaaaaaggcgacu

SEQ ID NO: 3189848 - RNA, 18 nt, Mycobacterium bovis subsp bovis AF2122/97
cggugaaaaaggcgacuc

SEQ ID NO: 3189849 - RNA, 21 nt, Mycobacterium bovis subsp bovis AF2122/97
cggugaaaccggccuucucgc

SEQ ID NO: 3189850 - RNA, 19 nt, Mycobacterium bovis subsp bovis AF2122/97
cggugaaacgaucgugcga

SEQ ID NO: 3189851 - RNA, 22 nt, Mycobacterium bovis subsp bovis AF2122/97
cggugaaacgaucgugcgaucg

SEQ ID NO: 3189852 - RNA, 16 nt, Mycobacterium bovis subsp bovis AF2122/97
cggugaaaucgcacag

SEQ ID NO: 3189853 - RNA, 18 nt, Mycobacterium bovis subsp bovis AF2122/97
cggugaaauucgcggcgg

SEQ ID NO: 3189854 - RNA, 14 nt, Mycobacterium bovis subsp bovis AF2122/97
cggugaacaccagc

SEQ ID NO: 3189855 - RNA, 18 nt, Mycobacterium bovis subsp bovis AF2122/97
cggugaacaccagcagga

SEQ ID NO: 3189856 - RNA, 15 nt, Mycobacterium bovis subsp bovis AF2122/97
cggugaacaccgccu

SEQ ID NO: 3189857 - RNA, 14 nt, Mycobacterium bovis subsp bovis AF2122/97
cggugaacgccgcc

SEQ ID NO: 3189858 - RNA, 16 nt, Mycobacterium bovis subsp bovis AF2122/97
cggugaacggcaaggu

SEQ ID NO: 3189859 - RNA, 21 nt, Mycobacterium bovis subsp bovis AF2122/97
cggugaacggcaaggucgcgg

SEQ ID NO: 3189860 - RNA, 17 nt, Mycobacterium bovis subsp bovis AF2122/97
cggugaacggcagcacg

SEQ ID NO: 3189861 - RNA, 19 nt, Mycobacterium bovis subsp bovis AF2122/97
cggugaacggcagcacggu

SEQ ID NO: 3189862 - RNA, 15 nt, Mycobacterium bovis subsp bovis AF2122/97
cggugaacugcuggc

SEQ ID NO: 3189863 - RNA, 21 nt, Mycobacterium bovis subsp bovis AF2122/97
cggugaacuucuccaccagcg

SEQ ID NO: 3189864 - RNA, 22 nt, Mycobacterium bovis subsp bovis AF2122/97
cggugaacuucuccaccagcgu

SEQ ID NO: 3189865 - RNA, 19 nt, Mycobacterium bovis subsp bovis AF2122/97
cggugaagccgagcgcccg

SEQ ID NO: 3189866 - RNA, 22 nt, Mycobacterium bovis subsp bovis AF2122/97
cggugaagccguuugcgcuggc

SEQ ID NO: 3189867 - RNA, 19 nt, Mycobacterium bovis subsp bovis AF2122/97
cggugaaguagugcucgca

SEQ ID NO: 3189868 - RNA, 15 nt, Mycobacterium bovis subsp bovis AF2122/97
cggugaaguccucca

SEQ ID NO: 3189869 - RNA, 22 nt, Mycobacterium bovis subsp bovis AF2122/97
cggugaaguccuccacgcuggc

SEQ ID NO: 3189870 - RNA, 21 nt, Mycobacterium bovis subsp bovis AF2122/97
cggugaaguggcgcaccaccu

SEQ ID NO: 3189871 - RNA, 19 nt, Mycobacterium bovis subsp bovis AF2122/97
cggugaaugccgucgccgg

SEQ ID NO: 3189872 - RNA, 20 nt, Mycobacterium bovis subsp bovis AF2122/97
cggugaaugccgucgccgga

SEQ ID NO: 3189873 - RNA, 21 nt, Mycobacterium bovis subsp bovis AF2122/97
cggugaauguugccgccgcgg

SEQ ID NO: 3189874 - RNA, 18 nt, Mycobacterium bovis subsp bovis AF2122/97
cggugaauucacgaugcu

SEQ ID NO: 3189875 - RNA, 17 nt, Mycobacterium bovis subsp bovis AF2122/97
cggugacaagcggcccg

SEQ ID NO: 3189876 - RNA, 21 nt, Mycobacterium bovis subsp bovis AF2122/97
cggugacaagcggcccgcugu

SEQ ID NO: 3189877 - RNA, 17 nt, Mycobacterium bovis subsp bovis AF2122/97
cggugacaccaacaccg

SEQ ID NO: 3189878 - RNA, 19 nt, Mycobacterium bovis subsp bovis AF2122/97
cggugacaccaacaccggu

SEQ ID NO: 3189879 - RNA, 14 nt, Mycobacterium bovis subsp bovis AF2122/97
cggugaccaccccg

SEQ ID NO: 3189880 - RNA, 16 nt, Mycobacterium bovis subsp bovis AF2122/97
cggugaccaccccggc

SEQ ID NO: 3189881 - RNA, 19 nt, Mycobacterium bovis subsp bovis AF2122/97
cggugaccaccccggccaa

SEQ ID NO: 3189882 - RNA, 20 nt, Mycobacterium bovis subsp bovis AF2122/97
cggugaccacuugcagcaca

SEQ ID NO: 3189883 - RNA, 19 nt, Mycobacterium bovis subsp bovis AF2122/97
cggugaccaggccggcccg

SEQ ID NO: 3189884 - RNA, 20 nt, Mycobacterium bovis subsp bovis AF2122/97
cggugaccaggccggcccgc

SEQ ID NO: 3189885 - RNA, 15 nt, Mycobacterium bovis subsp bovis AF2122/97
cggugacccccgaga

SEQ ID NO: 3189886 - RNA, 16 nt, Mycobacterium bovis subsp bovis AF2122/97
cggugacccgcugggc

SEQ ID NO: 3189887 - RNA, 21 nt, Mycobacterium bovis subsp bovis AF2122/97
cggugacccugguggugcgga

SEQ ID NO: 3189888 - RNA, 12 nt, Mycobacterium bovis subsp bovis AF2122/97
cggugaccgcga

SEQ ID NO: 3189889 - RNA, 15 nt, Mycobacterium bovis subsp bovis AF2122/97
cggugaccgcgaugu

SEQ ID NO: 3189890 - RNA, 12 nt, Mycobacterium bovis subsp bovis AF2122/97
cggugaccgggu

SEQ ID NO: 3189891 - RNA, 22 nt, Mycobacterium bovis subsp bovis AF2122/97
cggugaccgugaacggcucggg

SEQ ID NO: 3189892 - RNA, 16 nt, Mycobacterium bovis subsp bovis AF2122/97
cggugaccguggcggg

SEQ ID NO: 3189893 - RNA, 14 nt, Mycobacterium bovis subsp bovis AF2122/97
cggugaccguucgg

SEQ ID NO: 3189894 - RNA, 22 nt, Mycobacterium bovis subsp bovis AF2122/97
cggugaccuucgcuauggcggc

SEQ ID NO: 3189895 - RNA, 19 nt, Mycobacterium bovis subsp bovis AF2122/97
cggugacgaaacagagcgu

SEQ ID NO: 3189896 - RNA, 14 nt, Mycobacterium bovis subsp bovis AF2122/97
cggugacgaagagc

SEQ ID NO: 3189897 - RNA, 20 nt, Mycobacterium bovis subsp bovis AF2122/97
cggugacgacgucgccgccg

SEQ ID NO: 3189898 - RNA, 22 nt, Mycobacterium bovis subsp bovis AF2122/97
cggugacgacgucgccgccgcg

SEQ ID NO: 3189899 - RNA, 23 nt, Mycobacterium bovis subsp bovis AF2122/97
cggugacgacgucgccgccgcgg

SEQ ID NO: 3189900 - RNA, 18 nt, Mycobacterium bovis subsp bovis AF2122/97
cggugacgagcacaugcu

SEQ ID NO: 3189901 - RNA, 19 nt, Mycobacterium bovis subsp bovis AF2122/97
cggugacgagccaccaccg

SEQ ID NO: 3189902 - RNA, 21 nt, Mycobacterium bovis subsp bovis AF2122/97
cggugacgagccaccaccgcc

SEQ ID NO: 3189903 - RNA, 22 nt, Mycobacterium bovis subsp bovis AF2122/97
cggugacgagccaccaccgccg

SEQ ID NO: 3189904 - RNA, 16 nt, Mycobacterium bovis subsp bovis AF2122/97
cggugacgaugaccgc

SEQ ID NO: 3189905 - RNA, 17 nt, Mycobacterium bovis subsp bovis AF2122/97
cggugacgaugaccgcg

SEQ ID NO: 3189906 - RNA, 17 nt, Mycobacterium bovis subsp bovis AF2122/97
cggugacgcacagcagc

SEQ ID NO: 3189907 - RNA, 22 nt, Mycobacterium bovis subsp bovis AF2122/97
cggugacgcacagcagcaccgc

SEQ ID NO: 3189908 - RNA, 23 nt, Mycobacterium bovis subsp bovis AF2122/97
cggugacgcacagcagcaccgcg

SEQ ID NO: 3189909 - RNA, 17 nt, Mycobacterium bovis subsp bovis AF2122/97
cggugacgccagccugg

SEQ ID NO: 3189910 - RNA, 23 nt, Mycobacterium bovis subsp bovis AF2122/97
cggugacgccagccuggccaucg

SEQ ID NO: 3189911 - RNA, 15 nt, Mycobacterium bovis subsp bovis AF2122/97
cggugacgccgucga

SEQ ID NO: 3189912 - RNA, 17 nt, Mycobacterium bovis subsp bovis AF2122/97
cggugacggcggcaacg

SEQ ID NO: 3189913 - RNA, 22 nt, Mycobacterium bovis subsp bovis AF2122/97
cggugacggcggcugucggccg

SEQ ID NO: 3189914 - RNA, 17 nt, Mycobacterium bovis subsp bovis AF2122/97
cggugacggggcugacc

SEQ ID NO: 3189915 - RNA, 20 nt, Mycobacterium bovis subsp bovis AF2122/97
cggugacggggcugaccgcc

SEQ ID NO: 3189916 - RNA, 20 nt, Mycobacterium bovis subsp bovis AF2122/97
cggugacgggguugaccgcc

SEQ ID NO: 3189917 - RNA, 21 nt, Mycobacterium bovis subsp bovis AF2122/97
cggugacgggguugaccgcca

SEQ ID NO: 3189918 - RNA, 23 nt, Mycobacterium bovis subsp bovis AF2122/97
cggugacgggguugaccgccacc

SEQ ID NO: 3189919 - RNA, 15 nt, Mycobacterium bovis subsp bovis AF2122/97
cggugacggugccgg

SEQ ID NO: 3189920 - RNA, 12 nt, Mycobacterium bovis subsp bovis AF2122/97
cggugacguaga

SEQ ID NO: 3189921 - RNA, 16 nt, Mycobacterium bovis subsp bovis AF2122/97
cggugacguggugggc

SEQ ID NO: 3189922 - RNA, 19 nt, Mycobacterium bovis subsp bovis AF2122/97
cggugacguuggcaggcag

SEQ ID NO: 3189923 - RNA, 21 nt, Mycobacterium bovis subsp bovis AF2122/97
cggugacucggccuccgccga

SEQ ID NO: 3189924 - RNA, 24 nt, Mycobacterium bovis subsp bovis AF2122/97
cggugacucggccuccgccgagga

SEQ ID NO: 3189925 - RNA, 17 nt, Mycobacterium bovis subsp bovis AF2122/97
cggugacuucacucguu

SEQ ID NO: 3189926 - RNA, 17 nt, Mycobacterium bovis subsp bovis AF2122/97
cggugagaagaagccca

SEQ ID NO: 3189927 - RNA, 15 nt, Mycobacterium bovis subsp bovis AF2122/97
cggugagauggcggu

SEQ ID NO: 3189928 - RNA, 12 nt, Mycobacterium bovis subsp bovis AF2122/97
cggugagcaccg

SEQ ID NO: 3189929 - RNA, 15 nt, Mycobacterium bovis subsp bovis AF2122/97
cggugagcagggcgg

SEQ ID NO: 3189930 - RNA, 22 nt, Mycobacterium bovis subsp bovis AF2122/97
cggugagccggaugaugucggu

SEQ ID NO: 3189931 - RNA, 23 nt, Mycobacterium bovis subsp bovis AF2122/97
cggugagccggaugaugucgguc

SEQ ID NO: 3189932 - RNA, 15 nt, Mycobacterium bovis subsp bovis AF2122/97
cggugagccgggcgg

SEQ ID NO: 3189933 - RNA, 23 nt, Mycobacterium bovis subsp bovis AF2122/97
cggugagccgguggcccgccggc

SEQ ID NO: 3189934 - RNA, 16 nt, Mycobacterium bovis subsp bovis AF2122/97
cggugagccgugccgc

SEQ ID NO: 3189935 - RNA, 18 nt, Mycobacterium bovis subsp bovis AF2122/97
cggugagccgugccgcca

SEQ ID NO: 3189936 - RNA, 13 nt, Mycobacterium bovis subsp bovis AF2122/97
cggugagcgagcg

SEQ ID NO: 3189937 - RNA, 16 nt, Mycobacterium bovis subsp bovis AF2122/97
cggugagcgagcgcgc

SEQ ID NO: 3189938 - RNA, 20 nt, Mycobacterium bovis subsp bovis AF2122/97
cggugagcgagcgcgcguag

SEQ ID NO: 3189939 - RNA, 17 nt, Mycobacterium bovis subsp bovis AF2122/97
cggugagcgcgucgcgg

SEQ ID NO: 3189940 - RNA, 15 nt, Mycobacterium bovis subsp bovis AF2122/97
cggugaggaagcggc

SEQ ID NO: 3189941 - RNA, 17 nt, Mycobacterium bovis subsp bovis AF2122/97
cggugaggaagcggccg

SEQ ID NO: 3189942 - RNA, 17 nt, Mycobacterium bovis subsp bovis AF2122/97
cggugagggcgucgucg

SEQ ID NO: 3189943 - RNA, 23 nt, Mycobacterium bovis subsp bovis AF2122/97
cggugagggguugcggucgacgu

SEQ ID NO: 3189944 - RNA, 21 nt, Mycobacterium bovis subsp bovis AF2122/97
cggugagguauucguggucgg

SEQ ID NO: 3189945 - RNA, 22 nt, Mycobacterium bovis subsp bovis AF2122/97
cggugagguauucguggucggc

SEQ ID NO: 3189946 - RNA, 16 nt, Mycobacterium bovis subsp bovis AF2122/97
cggugaggucgaugcc

SEQ ID NO: 3189947 - RNA, 14 nt, Mycobacterium bovis subsp bovis AF2122/97
cggugaggucggug

SEQ ID NO: 3189948 - RNA, 19 nt, Mycobacterium bovis subsp bovis AF2122/97
cggugaucaaaccggcggc

SEQ ID NO: 3189949 - RNA, 16 nt, Mycobacterium bovis subsp bovis AF2122/97
cggugaucaccaugau

SEQ ID NO: 3189950 - RNA, 21 nt, Mycobacterium bovis subsp bovis AF2122/97
cggugaucacggucggcgggu

SEQ ID NO: 3189951 - RNA, 15 nt, Mycobacterium bovis subsp bovis AF2122/97
cggugaucagcagca

SEQ ID NO: 3189952 - RNA, 14 nt, Mycobacterium bovis subsp bovis AF2122/97
cggugaucagccac

SEQ ID NO: 3189953 - RNA, 17 nt, Mycobacterium bovis subsp bovis AF2122/97
cggugauccaacuggcc

SEQ ID NO: 3189954 - RNA, 18 nt, Mycobacterium bovis subsp bovis AF2122/97
cggugauccaacuggccg

SEQ ID NO: 3189955 - RNA, 20 nt, Mycobacterium bovis subsp bovis AF2122/97
cggugauccaacuggccgcg

SEQ ID NO: 3189956 - RNA, 22 nt, Mycobacterium bovis subsp bovis AF2122/97
cggugaucgaacugggggccgg

SEQ ID NO: 3189957 - RNA, 13 nt, Mycobacterium bovis subsp bovis AF2122/97
cggugaucgaggu

SEQ ID NO: 3189958 - RNA, 18 nt, Mycobacterium bovis subsp bovis AF2122/97
cggugaucgagguugacg

SEQ ID NO: 3189959 - RNA, 19 nt, Mycobacterium bovis subsp bovis AF2122/97
cggugaucgccggcuucgc

SEQ ID NO: 3189960 - RNA, 20 nt, Mycobacterium bovis subsp bovis AF2122/97
cggugaucgcgguggcggug

SEQ ID NO: 3189961 - RNA, 15 nt, Mycobacterium bovis subsp bovis AF2122/97
cggugaucggcggca

SEQ ID NO: 3189962 - RNA, 20 nt, Mycobacterium bovis subsp bovis AF2122/97
cggugaucggcggcaaccgc

SEQ ID NO: 3189963 - RNA, 13 nt, Mycobacterium bovis subsp bovis AF2122/97
cggugaucgggca

SEQ ID NO: 3189964 - RNA, 15 nt, Mycobacterium bovis subsp bovis AF2122/97
cggugaucgggcagc

SEQ ID NO: 3189965 - RNA, 23 nt, Mycobacterium bovis subsp bovis AF2122/97
cggugaucucguacuccccgcgc

SEQ ID NO: 3189966 - RNA, 19 nt, Mycobacterium bovis subsp bovis AF2122/97
cggugaucuuguccgggcc

SEQ ID NO: 3189967 - RNA, 22 nt, Mycobacterium bovis subsp bovis AF2122/97
cggugaugaacgacauccggcc

SEQ ID NO: 3189968 - RNA, 18 nt, Mycobacterium bovis subsp bovis AF2122/97
cggugaugaggaucgcgu

SEQ ID NO: 3189969 - RNA, 17 nt, Mycobacterium bovis subsp bovis AF2122/97
cggugaugcccagcgcc

SEQ ID NO: 3189970 - RNA, 18 nt, Mycobacterium bovis subsp bovis AF2122/97
cggugaugcccagcgccg

SEQ ID NO: 3189971 - RNA, 21 nt, Mycobacterium bovis subsp bovis AF2122/97
cggugaugcccagcgccgaau

SEQ ID NO: 3189972 - RNA, 20 nt, Mycobacterium bovis subsp bovis AF2122/97
cggugauggacugaucgcga

SEQ ID NO: 3189973 - RNA, 17 nt, Mycobacterium bovis subsp bovis AF2122/97
cggugauggagccggug

SEQ ID NO: 3189974 - RNA, 19 nt, Mycobacterium bovis subsp bovis AF2122/97
cggugauggagccggugac

SEQ ID NO: 3189975 - RNA, 21 nt, Mycobacterium bovis subsp bovis AF2122/97
cggugauggagccggugacgg

SEQ ID NO: 3189976 - RNA, 16 nt, Mycobacterium bovis subsp bovis AF2122/97
cggugauggccgacca

SEQ ID NO: 3189977 - RNA, 21 nt, Mycobacterium bovis subsp bovis AF2122/97
cggugauggccgaccagccga

SEQ ID NO: 3189978 - RNA, 24 nt, Mycobacterium bovis subsp bovis AF2122/97
cggugauggccgaccagccgauca

SEQ ID NO: 3189979 - RNA, 16 nt, Mycobacterium bovis subsp bovis AF2122/97
cggugaugggggagcc

SEQ ID NO: 3189980 - RNA, 18 nt, Mycobacterium bovis subsp bovis AF2122/97
cggugaugggggagccgg

SEQ ID NO: 3189981 - RNA, 19 nt, Mycobacterium bovis subsp bovis AF2122/97
cggugaugggggagccggu

SEQ ID NO: 3189982 - RNA, 22 nt, Mycobacterium bovis subsp bovis AF2122/97
cggugaugggggagccggugac

SEQ ID NO: 3189983 - RNA, 15 nt, Mycobacterium bovis subsp bovis AF2122/97
cggugauggugacca

SEQ ID NO: 3189984 - RNA, 13 nt, Mycobacterium bovis subsp bovis AF2122/97
cggugaugguggc

SEQ ID NO: 3189985 - RNA, 20 nt, Mycobacterium bovis subsp bovis AF2122/97
cggugaugguggcaacgggu

SEQ ID NO: 3189986 - RNA, 23 nt, Mycobacterium bovis subsp bovis AF2122/97
cggugaugguggcaacggguccg

SEQ ID NO: 3189987 - RNA, 20 nt, Mycobacterium bovis subsp bovis AF2122/97
cggugauggugugcagcagc

SEQ ID NO: 3189988 - RNA, 21 nt, Mycobacterium bovis subsp bovis AF2122/97
cggugauguccgcacaacgau

SEQ ID NO: 3189989 - RNA, 14 nt, Mycobacterium bovis subsp bovis AF2122/97
cggugaugucggug

SEQ ID NO: 3189990 - RNA, 13 nt, Mycobacterium bovis subsp bovis AF2122/97
cggugcacaacgc

SEQ ID NO: 3189991 - RNA, 19 nt, Mycobacterium bovis subsp bovis AF2122/97
cggugcacaacgcccacca

SEQ ID NO: 3189992 - RNA, 20 nt, Mycobacterium bovis subsp bovis AF2122/97
cggugcacaacgcccaccac

SEQ ID NO: 3189993 - RNA, 13 nt, Mycobacterium bovis subsp bovis AF2122/97
cggugcacaccgu

SEQ ID NO: 3189994 - RNA, 16 nt, Mycobacterium bovis subsp bovis AF2122/97
cggugcacaccgucgc

SEQ ID NO: 3189995 - RNA, 20 nt, Mycobacterium bovis subsp bovis AF2122/97
cggugcacacugaccccgcc

SEQ ID NO: 3189996 - RNA, 12 nt, Mycobacterium bovis subsp bovis AF2122/97
cggugcaccagg

SEQ ID NO: 3189997 - RNA, 17 nt, Mycobacterium bovis subsp bovis AF2122/97
cggugcacgagcggaca

SEQ ID NO: 3189998 - RNA, 17 nt, Mycobacterium bovis subsp bovis AF2122/97
cggugcagaucggcuca

SEQ ID NO: 3189999 - RNA, 22 nt, Mycobacterium bovis subsp bovis AF2122/97
cggugcagcacgugugcgggca

SEQ ID NO: 3190000 - RNA, 18 nt, Mycobacterium bovis subsp bovis AF2122/97
cggugcagcagggcgcgc

SEQ ID NO: 3190001 - RNA, 21 nt, Mycobacterium bovis subsp bovis AF2122/97
cggugcagcagggcgcgcauc

SEQ ID NO: 3190002 - RNA, 13 nt, Mycobacterium bovis subsp bovis AF2122/97
cggugcagcccgc

SEQ ID NO: 3190003 - RNA, 19 nt, Mycobacterium bovis subsp bovis AF2122/97
cggugcagcccgccgcuga

SEQ ID NO: 3190004 - RNA, 19 nt, Mycobacterium bovis subsp bovis AF2122/97
cggugcagcgcacgcagcc

SEQ ID NO: 3190005 - RNA, 17 nt, Mycobacterium bovis subsp bovis AF2122/97
cggugcagcuccccgcc

SEQ ID NO: 3190006 - RNA, 21 nt, Mycobacterium bovis subsp bovis AF2122/97
cggugcaggaccagaacucgu

SEQ ID NO: 3190007 - RNA, 12 nt, Mycobacterium bovis subsp bovis AF2122/97
cggugcaggauu

SEQ ID NO: 3190008 - RNA, 19 nt, Mycobacterium bovis subsp bovis AF2122/97
cggugcaggauucggcggu

SEQ ID NO: 3190009 - RNA, 21 nt, Mycobacterium bovis subsp bovis AF2122/97
cggugcagugccucggcggcg

SEQ ID NO: 3190010 - RNA, 14 nt, Mycobacterium bovis subsp bovis AF2122/97
cggugcaguggcua

SEQ ID NO: 3190011 - RNA, 21 nt, Mycobacterium bovis subsp bovis AF2122/97
cggugcauauuggaucgucgg

SEQ ID NO: 3190012 - RNA, 16 nt, Mycobacterium bovis subsp bovis AF2122/97
cggugcaucgccacca

SEQ ID NO: 3190013 - RNA, 18 nt, Mycobacterium bovis subsp bovis AF2122/97
cggugccaaaggacgaca

SEQ ID NO: 3190014 - RNA, 22 nt, Mycobacterium bovis subsp bovis AF2122/97
cggugccaccacgcuccccagc

SEQ ID NO: 3190015 - RNA, 16 nt, Mycobacterium bovis subsp bovis AF2122/97
cggugccacggcaccg

SEQ ID NO: 3190016 - RNA, 19 nt, Mycobacterium bovis subsp bovis AF2122/97
cggugccacguucgcgggc

SEQ ID NO: 3190017 - RNA, 18 nt, Mycobacterium bovis subsp bovis AF2122/97
cggugccacugccggugg

SEQ ID NO: 3190018 - RNA, 14 nt, Mycobacterium bovis subsp bovis AF2122/97
cggugccagcacca

SEQ ID NO: 3190019 - RNA, 17 nt, Mycobacterium bovis subsp bovis AF2122/97
cggugccagcacuccac

SEQ ID NO: 3190020 - RNA, 16 nt, Mycobacterium bovis subsp bovis AF2122/97
cggugccagcaggccg

SEQ ID NO: 3190021 - RNA, 17 nt, Mycobacterium bovis subsp bovis AF2122/97
cggugccaucgggcgcg

SEQ ID NO: 3190022 - RNA, 22 nt, Mycobacterium bovis subsp bovis AF2122/97
cggugcccaacccacucgcagc

SEQ ID NO: 3190023 - RNA, 12 nt, Mycobacterium bovis subsp bovis AF2122/97
cggugcccacca

SEQ ID NO: 3190024 - RNA, 16 nt, Mycobacterium bovis subsp bovis AF2122/97
cggugcccaccaccga

SEQ ID NO: 3190025 - RNA, 15 nt, Mycobacterium bovis subsp bovis AF2122/97
cggugcccagcagcg

SEQ ID NO: 3190026 - RNA, 22 nt, Mycobacterium bovis subsp bovis AF2122/97
cggugcccagcagcgcgacggu

SEQ ID NO: 3190027 - RNA, 15 nt, Mycobacterium bovis subsp bovis AF2122/97
cggugcccagggcga

SEQ ID NO: 3190028 - RNA, 14 nt, Mycobacterium bovis subsp bovis AF2122/97
cggugcccgcacca

SEQ ID NO: 3190029 - RNA, 18 nt, Mycobacterium bovis subsp bovis AF2122/97
cggugcccgcaccacacc

SEQ ID NO: 3190030 - RNA, 20 nt, Mycobacterium bovis subsp bovis AF2122/97
cggugcccgggcgucaagcc

SEQ ID NO: 3190031 - RNA, 16 nt, Mycobacterium bovis subsp bovis AF2122/97
cggugcccugccggca

SEQ ID NO: 3190032 - RNA, 17 nt, Mycobacterium bovis subsp bovis AF2122/97
cggugcccugccggcag

SEQ ID NO: 3190033 - RNA, 18 nt, Mycobacterium bovis subsp bovis AF2122/97
cggugcccugccggcagc

SEQ ID NO: 3190034 - RNA, 19 nt, Mycobacterium bovis subsp bovis AF2122/97
cggugcccugccggcagcg

SEQ ID NO: 3190035 - RNA, 21 nt, Mycobacterium bovis subsp bovis AF2122/97
cggugcccugccggcagcggc

SEQ ID NO: 3190036 - RNA, 14 nt, Mycobacterium bovis subsp bovis AF2122/97
cggugccgaacagc

SEQ ID NO: 3190037 - RNA, 13 nt, Mycobacterium bovis subsp bovis AF2122/97
cggugccgaccgg

SEQ ID NO: 3190038 - RNA, 15 nt, Mycobacterium bovis subsp bovis AF2122/97
cggugccgacggcgc

SEQ ID NO: 3190039 - RNA, 13 nt, Mycobacterium bovis subsp bovis AF2122/97
cggugccgacggu

SEQ ID NO: 3190040 - RNA, 15 nt, Mycobacterium bovis subsp bovis AF2122/97
cggugccgacgguga

SEQ ID NO: 3190041 - RNA, 22 nt, Mycobacterium bovis subsp bovis AF2122/97
cggugccgacggugauggggga

SEQ ID NO: 3190042 - RNA, 17 nt, Mycobacterium bovis subsp bovis AF2122/97
cggugccgacggugggc

SEQ ID NO: 3190043 - RNA, 21 nt, Mycobacterium bovis subsp bovis AF2122/97
cggugccgacggugggcgagg

SEQ ID NO: 3190044 - RNA, 12 nt, Mycobacterium bovis subsp bovis AF2122/97
cggugccgagcg

SEQ ID NO: 3190045 - RNA, 23 nt, Mycobacterium bovis subsp bovis AF2122/97
cggugccgcagcaggggacgacc

SEQ ID NO: 3190046 - RNA, 15 nt, Mycobacterium bovis subsp bovis AF2122/97
cggugccgccaccgg

SEQ ID NO: 3190047 - RNA, 13 nt, Mycobacterium bovis subsp bovis AF2122/97
cggugccgccauc

SEQ ID NO: 3190048 - RNA, 16 nt, Mycobacterium bovis subsp bovis AF2122/97
cggugccgccaucgcc

SEQ ID NO: 3190049 - RNA, 20 nt, Mycobacterium bovis subsp bovis AF2122/97
cggugccgccaucgccgccg

SEQ ID NO: 3190050 - RNA, 22 nt, Mycobacterium bovis subsp bovis AF2122/97
cggugccgccaucgccgccggu

SEQ ID NO: 3190051 - RNA, 21 nt, Mycobacterium bovis subsp bovis AF2122/97
cggugccgccauugacgccgu

SEQ ID NO: 3190052 - RNA, 23 nt, Mycobacterium bovis subsp bovis AF2122/97
cggugccgccauugacgccguug

SEQ ID NO: 3190053 - RNA, 20 nt, Mycobacterium bovis subsp bovis AF2122/97
cggugccgcccgagccggug

SEQ ID NO: 3190054 - RNA, 13 nt, Mycobacterium bovis subsp bovis AF2122/97
cggugccgcccgc

SEQ ID NO: 3190055 - RNA, 18 nt, Mycobacterium bovis subsp bovis AF2122/97
cggugccgcccgcgccgc

SEQ ID NO: 3190056 - RNA, 20 nt, Mycobacterium bovis subsp bovis AF2122/97
cggugccgcccgcgccgccg

SEQ ID NO: 3190057 - RNA, 22 nt, Mycobacterium bovis subsp bovis AF2122/97
cggugccgcccgcgccuccguu

SEQ ID NO: 3190058 - RNA, 12 nt, Mycobacterium bovis subsp bovis AF2122/97
cggugccgccga

SEQ ID NO: 3190059 - RNA, 22 nt, Mycobacterium bovis subsp bovis AF2122/97
cggugccgccgauaccgccggc

SEQ ID NO: 3190060 - RNA, 12 nt, Mycobacterium bovis subsp bovis AF2122/97
cggugccgccgc

SEQ ID NO: 3190061 - RNA, 13 nt, Mycobacterium bovis subsp bovis AF2122/97
cggugccgccgcc

SEQ ID NO: 3190062 - RNA, 15 nt, Mycobacterium bovis subsp bovis AF2122/97
cggugccgccgccgg

SEQ ID NO: 3190063 - RNA, 16 nt, Mycobacterium bovis subsp bovis AF2122/97
cggugccgccgccggc

SEQ ID NO: 3190064 - RNA, 22 nt, Mycobacterium bovis subsp bovis AF2122/97
cggugccgccgccggcgccgga

SEQ ID NO: 3190065 - RNA, 18 nt, Mycobacterium bovis subsp bovis AF2122/97
cggugccgccgccugcuc

SEQ ID NO: 3190066 - RNA, 16 nt, Mycobacterium bovis subsp bovis AF2122/97
cggugccgccgcggcc

SEQ ID NO: 3190067 - RNA, 17 nt, Mycobacterium bovis subsp bovis AF2122/97
cggugccgccgcggcca

SEQ ID NO: 3190068 - RNA, 19 nt, Mycobacterium bovis subsp bovis AF2122/97
cggugccgccgcggccacc

SEQ ID NO: 3190069 - RNA, 23 nt, Mycobacterium bovis subsp bovis AF2122/97
cggugccgccgcggccaccaccg

SEQ ID NO: 3190070 - RNA, 12 nt, Mycobacterium bovis subsp bovis AF2122/97
cggugccgccgg

SEQ ID NO: 3190071 - RNA, 18 nt, Mycobacterium bovis subsp bovis AF2122/97
cggugccgccggugccgc

SEQ ID NO: 3190072 - RNA, 20 nt, Mycobacterium bovis subsp bovis AF2122/97
cggugccgccggugccgcca

SEQ ID NO: 3190073 - RNA, 20 nt, Mycobacterium bovis subsp bovis AF2122/97
cggugccgccggugccgccu

SEQ ID NO: 3190074 - RNA, 21 nt, Mycobacterium bovis subsp bovis AF2122/97
cggugccgccggugccgccug

SEQ ID NO: 3190075 - RNA, 22 nt, Mycobacterium bovis subsp bovis AF2122/97
cggugccgccggugccgccugc

SEQ ID NO: 3190076 - RNA, 15 nt, Mycobacterium bovis subsp bovis AF2122/97
cggugccgccgucgc

SEQ ID NO: 3190077 - RNA, 23 nt, Mycobacterium bovis subsp bovis AF2122/97
cggugccgccguucccaccacca

SEQ ID NO: 3190078 - RNA, 17 nt, Mycobacterium bovis subsp bovis AF2122/97
cggugccgccuccgccu

SEQ ID NO: 3190079 - RNA, 18 nt, Mycobacterium bovis subsp bovis AF2122/97
cggugccgccuccgccug

SEQ ID NO: 3190080 - RNA, 23 nt, Mycobacterium bovis subsp bovis AF2122/97
cggugccgccuccgccugcccca

SEQ ID NO: 3190081 - RNA, 16 nt, Mycobacterium bovis subsp bovis AF2122/97
cggugccgccugcgcc

SEQ ID NO: 3190082 - RNA, 15 nt, Mycobacterium bovis subsp bovis AF2122/97
cggugccgcggacgu

SEQ ID NO: 3190083 - RNA, 13 nt, Mycobacterium bovis subsp bovis AF2122/97
cggugccgcggcu

SEQ ID NO: 3190084 - RNA, 15 nt, Mycobacterium bovis subsp bovis AF2122/97
cggugccggaaacgc

SEQ ID NO: 3190085 - RNA, 18 nt, Mycobacterium bovis subsp bovis AF2122/97
cggugccggaaacgccag

SEQ ID NO: 3190086 - RNA, 18 nt, Mycobacterium bovis subsp bovis AF2122/97
cggugccggcacccgagu

SEQ ID NO: 3190087 - RNA, 12 nt, Mycobacterium bovis subsp bovis AF2122/97
cggugccggcca

SEQ ID NO: 3190088 - RNA, 20 nt, Mycobacterium bovis subsp bovis AF2122/97
cggugccggcccugcucggc

SEQ ID NO: 3190089 - RNA, 12 nt, Mycobacterium bovis subsp bovis AF2122/97
cggugccggccg

SEQ ID NO: 3190090 - RNA, 14 nt, Mycobacterium bovis subsp bovis AF2122/97
cggugccggccgca

SEQ ID NO: 3190091 - RNA, 14 nt, Mycobacterium bovis subsp bovis AF2122/97
cggugccggccugu

SEQ ID NO: 3190092 - RNA, 14 nt, Mycobacterium bovis subsp bovis AF2122/97
cggugccggcgacg

SEQ ID NO: 3190093 - RNA, 21 nt, Mycobacterium bovis subsp bovis AF2122/97
cggugccggcgacgcuaccgc

SEQ ID NO: 3190094 - RNA, 14 nt, Mycobacterium bovis subsp bovis AF2122/97
cggugccggcguag

SEQ ID NO: 3190095 - RNA, 18 nt, Mycobacterium bovis subsp bovis AF2122/97
cggugccggcguugccgc

SEQ ID NO: 3190096 - RNA, 20 nt, Mycobacterium bovis subsp bovis AF2122/97
cggugccggcguugccgccg

SEQ ID NO: 3190097 - RNA, 17 nt, Mycobacterium bovis subsp bovis AF2122/97
cggugccgggaugccgc

SEQ ID NO: 3190098 - RNA, 17 nt, Mycobacterium bovis subsp bovis AF2122/97
cggugccgggcaccacc

SEQ ID NO: 3190099 - RNA, 19 nt, Mycobacterium bovis subsp bovis AF2122/97
cggugccgguggugacggc

SEQ ID NO: 3190100 - RNA, 16 nt, Mycobacterium bovis subsp bovis AF2122/97
cggugccgucagcggc

SEQ ID NO: 3190101 - RNA, 18 nt, Mycobacterium bovis subsp bovis AF2122/97
cggugccgucagcggcgg

SEQ ID NO: 3190102 - RNA, 19 nt, Mycobacterium bovis subsp bovis AF2122/97
cggugccgucagcggcggc

SEQ ID NO: 3190103 - RNA, 16 nt, Mycobacterium bovis subsp bovis AF2122/97
cggugccgucgagucc

SEQ ID NO: 3190104 - RNA, 20 nt, Mycobacterium bovis subsp bovis AF2122/97
cggugccgucgaguccaggc

SEQ ID NO: 3190105 - RNA, 17 nt, Mycobacterium bovis subsp bovis AF2122/97
cggugccgucgccgccc

SEQ ID NO: 3190106 - RNA, 16 nt, Mycobacterium bovis subsp bovis AF2122/97
cggugccgucggugcc

SEQ ID NO: 3190107 - RNA, 21 nt, Mycobacterium bovis subsp bovis AF2122/97
cggugccgugaucggcgcccg

SEQ ID NO: 3190108 - RNA, 15 nt, Mycobacterium bovis subsp bovis AF2122/97
cggugccguggugga

SEQ ID NO: 3190109 - RNA, 21 nt, Mycobacterium bovis subsp bovis AF2122/97
cggugccgugguggacgaugc

SEQ ID NO: 3190110 - RNA, 21 nt, Mycobacterium bovis subsp bovis AF2122/97
cggugccguuggagccgccac

SEQ ID NO: 3190111 - RNA, 16 nt, Mycobacterium bovis subsp bovis AF2122/97
cggugccucgcagcca

SEQ ID NO: 3190112 - RNA, 15 nt, Mycobacterium bovis subsp bovis AF2122/97
cggugccugcaacgc

SEQ ID NO: 3190113 - RNA, 13 nt, Mycobacterium bovis subsp bovis AF2122/97
cggugccugcagc

SEQ ID NO: 3190114 - RNA, 14 nt, Mycobacterium bovis subsp bovis AF2122/97
cggugccugcagcu

SEQ ID NO: 3190115 - RNA, 16 nt, Mycobacterium bovis subsp bovis AF2122/97
cggugccugcagcuug

SEQ ID NO: 3190116 - RNA, 18 nt, Mycobacterium bovis subsp bovis AF2122/97
cggugcgaccaacacggu

SEQ ID NO: 3190117 - RNA, 13 nt, Mycobacterium bovis subsp bovis AF2122/97
cggugcgaucagg

SEQ ID NO: 3190118 - RNA, 20 nt, Mycobacterium bovis subsp bovis AF2122/97
cggugcgaucaggcugccgc

SEQ ID NO: 3190119 - RNA, 23 nt, Mycobacterium bovis subsp bovis AF2122/97
cggugcgauccugaccagccagg

SEQ ID NO: 3190120 - RNA, 12 nt, Mycobacterium bovis subsp bovis AF2122/97
cggugcgcacca

SEQ ID NO: 3190121 - RNA, 16 nt, Mycobacterium bovis subsp bovis AF2122/97
cggugcgcaccaccga

SEQ ID NO: 3190122 - RNA, 18 nt, Mycobacterium bovis subsp bovis AF2122/97
cggugcgcaccaccgagc

SEQ ID NO: 3190123 - RNA, 15 nt, Mycobacterium bovis subsp bovis AF2122/97
cggugcgcaccagag

SEQ ID NO: 3190124 - RNA, 22 nt, Mycobacterium bovis subsp bovis AF2122/97
cggugcgcaccagcacacccgu

SEQ ID NO: 3190125 - RNA, 16 nt, Mycobacterium bovis subsp bovis AF2122/97
cggugcgcacggcggc

SEQ ID NO: 3190126 - RNA, 19 nt, Mycobacterium bovis subsp bovis AF2122/97
cggugcgcagccagguguc

SEQ ID NO: 3190127 - RNA, 22 nt, Mycobacterium bovis subsp bovis AF2122/97
cggugcgccagaucaccgucga

SEQ ID NO: 3190128 - RNA, 14 nt, Mycobacterium bovis subsp bovis AF2122/97
cggugcgcgcagac

SEQ ID NO: 3190129 - RNA, 15 nt, Mycobacterium bovis subsp bovis AF2122/97
cggugcgcgcggcga

SEQ ID NO: 3190130 - RNA, 18 nt, Mycobacterium bovis subsp bovis AF2122/97
cggugcgcgcggcgacca

SEQ ID NO: 3190131 - RNA, 14 nt, Mycobacterium bovis subsp bovis AF2122/97
cggugcgcggcaau

SEQ ID NO: 3190132 - RNA, 15 nt, Mycobacterium bovis subsp bovis AF2122/97
cggugcgcgugacga

SEQ ID NO: 3190133 - RNA, 12 nt, Mycobacterium bovis subsp bovis AF2122/97
cggugcgcugga

SEQ ID NO: 3190134 - RNA, 21 nt, Mycobacterium bovis subsp bovis AF2122/97
cggugcgcuggaggcuccugg

SEQ ID NO: 3190135 - RNA, 23 nt, Mycobacterium bovis subsp bovis AF2122/97
cggugcgcuggaggcuccugguc

SEQ ID NO: 3190136 - RNA, 15 nt, Mycobacterium bovis subsp bovis AF2122/97
cggugcgcuggaugu

SEQ ID NO: 3190137 - RNA, 15 nt, Mycobacterium bovis subsp bovis AF2122/97
cggugcgcuggcggc

SEQ ID NO: 3190138 - RNA, 18 nt, Mycobacterium bovis subsp bovis AF2122/97
cggugcgcuggcggcgca

SEQ ID NO: 3190139 - RNA, 14 nt, Mycobacterium bovis subsp bovis AF2122/97
cggugcggaacacc

SEQ ID NO: 3190140 - RNA, 17 nt, Mycobacterium bovis subsp bovis AF2122/97
cggugcggaacaccgcc

SEQ ID NO: 3190141 - RNA, 16 nt, Mycobacterium bovis subsp bovis AF2122/97
cggugcggaacacgau

SEQ ID NO: 3190142 - RNA, 15 nt, Mycobacterium bovis subsp bovis AF2122/97
cggugcggacuucga

SEQ ID NO: 3190143 - RNA, 19 nt, Mycobacterium bovis subsp bovis AF2122/97
cggugcggacuucgauguc

SEQ ID NO: 3190144 - RNA, 18 nt, Mycobacterium bovis subsp bovis AF2122/97
cggugcggcagauacucg

SEQ ID NO: 3190145 - RNA, 21 nt, Mycobacterium bovis subsp bovis AF2122/97
cggugcggccaaugacgucgg

SEQ ID NO: 3190146 - RNA, 13 nt, Mycobacterium bovis subsp bovis AF2122/97
cggugcggcgagg

SEQ ID NO: 3190147 - RNA, 14 nt, Mycobacterium bovis subsp bovis AF2122/97
cggugcggcgggcu

SEQ ID NO: 3190148 - RNA, 13 nt, Mycobacterium bovis subsp bovis AF2122/97
cggugcgggcgcc

SEQ ID NO: 3190149 - RNA, 15 nt, Mycobacterium bovis subsp bovis AF2122/97
cggugcgggcgccgc

SEQ ID NO: 3190150 - RNA, 14 nt, Mycobacterium bovis subsp bovis AF2122/97
cggugcgggcuagg

SEQ ID NO: 3190151 - RNA, 17 nt, Mycobacterium bovis subsp bovis AF2122/97
cggugcggguggugccg

SEQ ID NO: 3190152 - RNA, 17 nt, Mycobacterium bovis subsp bovis AF2122/97
cggugcgguggugcgca

SEQ ID NO: 3190153 - RNA, 18 nt, Mycobacterium bovis subsp bovis AF2122/97
cggugcgguggugcgcaa

SEQ ID NO: 3190154 - RNA, 19 nt, Mycobacterium bovis subsp bovis AF2122/97
cggugcgguucgcugcggc

SEQ ID NO: 3190155 - RNA, 14 nt, Mycobacterium bovis subsp bovis AF2122/97
cggugcuaaccgac

SEQ ID NO: 3190156 - RNA, 17 nt, Mycobacterium bovis subsp bovis AF2122/97
cggugcuaaccgacgcu

SEQ ID NO: 3190157 - RNA, 16 nt, Mycobacterium bovis subsp bovis AF2122/97
cggugcuaccggcuug

SEQ ID NO: 3190158 - RNA, 22 nt, Mycobacterium bovis subsp bovis AF2122/97
cggugcucaccaaucugcgggc

SEQ ID NO: 3190159 - RNA, 13 nt, Mycobacterium bovis subsp bovis AF2122/97
cggugcucgucga

SEQ ID NO: 3190160 - RNA, 17 nt, Mycobacterium bovis subsp bovis AF2122/97
cggugcugaccccgccg

SEQ ID NO: 3190161 - RNA, 18 nt, Mycobacterium bovis subsp bovis AF2122/97
cggugcugaccccgccgg

SEQ ID NO: 3190162 - RNA, 20 nt, Mycobacterium bovis subsp bovis AF2122/97
cggugcugaccccgccggcu

SEQ ID NO: 3190163 - RNA, 21 nt, Mycobacterium bovis subsp bovis AF2122/97
cggugcugaccccgccggcug

SEQ ID NO: 3190164 - RNA, 23 nt, Mycobacterium bovis subsp bovis AF2122/97
cggugcugaccccgccggcugcg

SEQ ID NO: 3190165 - RNA, 18 nt, Mycobacterium bovis subsp bovis AF2122/97
cggugcugacgacgaggg

SEQ ID NO: 3190166 - RNA, 19 nt, Mycobacterium bovis subsp bovis AF2122/97
cggugcugacgacgagggc

SEQ ID NO: 3190167 - RNA, 15 nt, Mycobacterium bovis subsp bovis AF2122/97
cggugcugguccagc

SEQ ID NO: 3190168 - RNA, 16 nt, Mycobacterium bovis subsp bovis AF2122/97
cggugcugguccagcc

SEQ ID NO: 3190169 - RNA, 18 nt, Mycobacterium bovis subsp bovis AF2122/97
cggugcugguccagccgg

SEQ ID NO: 3190170 - RNA, 18 nt, Mycobacterium bovis subsp bovis AF2122/97
cggugcuggucgccgcgg

SEQ ID NO: 3190171 - RNA, 22 nt, Mycobacterium bovis subsp bovis AF2122/97
cggugcugguggcggcacuggc

SEQ ID NO: 3190172 - RNA, 18 nt, Mycobacterium bovis subsp bovis AF2122/97
cggugcugucgacgucgg

SEQ ID NO: 3190173 - RNA, 21 nt, Mycobacterium bovis subsp bovis AF2122/97
cggugcugucgacgucggcaa

SEQ ID NO: 3190174 - RNA, 20 nt, Mycobacterium bovis subsp bovis AF2122/97
cggugcuguugucgaacaac

SEQ ID NO: 3190175 - RNA, 16 nt, Mycobacterium bovis subsp bovis AF2122/97
cgguggaaaccgggcg

SEQ ID NO: 3190176 - RNA, 17 nt, Mycobacterium bovis subsp bovis AF2122/97
cgguggaauccaccagc

SEQ ID NO: 3190177 - RNA, 22 nt, Mycobacterium bovis subsp bovis AF2122/97
cgguggacagaaucgaccgccg

SEQ ID NO: 3190178 - RNA, 17 nt, Mycobacterium bovis subsp bovis AF2122/97
cgguggacgauacgcgc

SEQ ID NO: 3190179 - RNA, 21 nt, Mycobacterium bovis subsp bovis AF2122/97
cgguggacggcaggcggccgc

SEQ ID NO: 3190180 - RNA, 13 nt, Mycobacterium bovis subsp bovis AF2122/97
cgguggagcgcgc

SEQ ID NO: 3190181 - RNA, 22 nt, Mycobacterium bovis subsp bovis AF2122/97
cgguggagcgcgccucgcccag

SEQ ID NO: 3190182 - RNA, 23 nt, Mycobacterium bovis subsp bovis AF2122/97
cgguggagcgcgccucgcccagc

SEQ ID NO: 3190183 - RNA, 18 nt, Mycobacterium bovis subsp bovis AF2122/97
cgguggaggcguagucgg

SEQ ID NO: 3190184 - RNA, 22 nt, Mycobacterium bovis subsp bovis AF2122/97
cgguggaugcgaugcgcgccga

SEQ ID NO: 3190185 - RNA, 20 nt, Mycobacterium bovis subsp bovis AF2122/97
cgguggcaacggaggugccg

SEQ ID NO: 3190186 - RNA, 14 nt, Mycobacterium bovis subsp bovis AF2122/97
cgguggcaacgggu

SEQ ID NO: 3190187 - RNA, 17 nt, Mycobacterium bovis subsp bovis AF2122/97
cgguggcaacgggucgg

SEQ ID NO: 3190188 - RNA, 19 nt, Mycobacterium bovis subsp bovis AF2122/97
cgguggcaacgggucggca

SEQ ID NO: 3190189 - RNA, 18 nt, Mycobacterium bovis subsp bovis AF2122/97
cgguggcacccgcgucga

SEQ ID NO: 3190190 - RNA, 13 nt, Mycobacterium bovis subsp bovis AF2122/97
cgguggcaccggc

SEQ ID NO: 3190191 - RNA, 14 nt, Mycobacterium bovis subsp bovis AF2122/97
cgguggcacgcuga

SEQ ID NO: 3190192 - RNA, 20 nt, Mycobacterium bovis subsp bovis AF2122/97
cgguggcacggccccugcca

SEQ ID NO: 3190193 - RNA, 21 nt, Mycobacterium bovis subsp bovis AF2122/97
cgguggcacggccccugccac

SEQ ID NO: 3190194 - RNA, 16 nt, Mycobacterium bovis subsp bovis AF2122/97
cgguggcagagccgcc

SEQ ID NO: 3190195 - RNA, 20 nt, Mycobacterium bovis subsp bovis AF2122/97
cgguggcagagccgccguug

SEQ ID NO: 3190196 - RNA, 13 nt, Mycobacterium bovis subsp bovis AF2122/97
cgguggcagcaca

SEQ ID NO: 3190197 - RNA, 17 nt, Mycobacterium bovis subsp bovis AF2122/97
cgguggcagccugcugc

SEQ ID NO: 3190198 - RNA, 21 nt, Mycobacterium bovis subsp bovis AF2122/97
cgguggcauccuugccaaucg

SEQ ID NO: 3190199 - RNA, 16 nt, Mycobacterium bovis subsp bovis AF2122/97
cgguggccaacaccgc

SEQ ID NO: 3190200 - RNA, 17 nt, Mycobacterium bovis subsp bovis AF2122/97
cgguggccaacaccgcc

SEQ ID NO: 3190201 - RNA, 20 nt, Mycobacterium bovis subsp bovis AF2122/97
cgguggccaacaccgccagc

SEQ ID NO: 3190202 - RNA, 16 nt, Mycobacterium bovis subsp bovis AF2122/97
cgguggccacccggcc

SEQ ID NO: 3190203 - RNA, 17 nt, Mycobacterium bovis subsp bovis AF2122/97
cgguggccacccggccg

SEQ ID NO: 3190204 - RNA, 22 nt, Mycobacterium bovis subsp bovis AF2122/97
cgguggccacccggccgcgcgg

SEQ ID NO: 3190205 - RNA, 14 nt, Mycobacterium bovis subsp bovis AF2122/97
cgguggccagaucg

SEQ ID NO: 3190206 - RNA, 17 nt, Mycobacterium bovis subsp bovis AF2122/97
cgguggccagcacgugc

SEQ ID NO: 3190207 - RNA, 16 nt, Mycobacterium bovis subsp bovis AF2122/97
cgguggccaucgcgcg

SEQ ID NO: 3190208 - RNA, 20 nt, Mycobacterium bovis subsp bovis AF2122/97
cgguggccaucgcgcggacc

SEQ ID NO: 3190209 - RNA, 21 nt, Mycobacterium bovis subsp bovis AF2122/97
cgguggccaucgcgcggacca

SEQ ID NO: 3190210 - RNA, 23 nt, Mycobacterium bovis subsp bovis AF2122/97
cgguggccaucgcgcggaccaga

SEQ ID NO: 3190211 - RNA, 14 nt, Mycobacterium bovis subsp bovis AF2122/97
cgguggcccgccgg

SEQ ID NO: 3190212 - RNA, 16 nt, Mycobacterium bovis subsp bovis AF2122/97
cgguggcccggugcaa

SEQ ID NO: 3190213 - RNA, 12 nt, Mycobacterium bovis subsp bovis AF2122/97
cgguggccgaca

SEQ ID NO: 3190214 - RNA, 14 nt, Mycobacterium bovis subsp bovis AF2122/97
cgguggccgcacga

SEQ ID NO: 3190215 - RNA, 15 nt, Mycobacterium bovis subsp bovis AF2122/97
cgguggccgcaucga

SEQ ID NO: 3190216 - RNA, 19 nt, Mycobacterium bovis subsp bovis AF2122/97
cgguggccgcaucgacgcu

SEQ ID NO: 3190217 - RNA, 17 nt, Mycobacterium bovis subsp bovis AF2122/97
cgguggccgcgcugguc

SEQ ID NO: 3190218 - RNA, 12 nt, Mycobacterium bovis subsp bovis AF2122/97
cgguggccgcgg

SEQ ID NO: 3190219 - RNA, 15 nt, Mycobacterium bovis subsp bovis AF2122/97
cgguggccgcggcgg

SEQ ID NO: 3190220 - RNA, 16 nt, Mycobacterium bovis subsp bovis AF2122/97
cgguggccgcggcggu

SEQ ID NO: 3190221 - RNA, 19 nt, Mycobacterium bovis subsp bovis AF2122/97
cgguggccgcugccagccg

SEQ ID NO: 3190222 - RNA, 17 nt, Mycobacterium bovis subsp bovis AF2122/97
cgguggccggcaacggc

SEQ ID NO: 3190223 - RNA, 22 nt, Mycobacterium bovis subsp bovis AF2122/97
cgguggccggcagccagacugc

SEQ ID NO: 3190224 - RNA, 13 nt, Mycobacterium bovis subsp bovis AF2122/97
cgguggccggcga

SEQ ID NO: 3190225 - RNA, 13 nt, Mycobacterium bovis subsp bovis AF2122/97
cgguggccgucgg

SEQ ID NO: 3190226 - RNA, 20 nt, Mycobacterium bovis subsp bovis AF2122/97
cgguggccgucgggugcagc

SEQ ID NO: 3190227 - RNA, 21 nt, Mycobacterium bovis subsp bovis AF2122/97
cgguggccgucgggugcagca

SEQ ID NO: 3190228 - RNA, 18 nt, Mycobacterium bovis subsp bovis AF2122/97
cgguggccucccacggcg

SEQ ID NO: 3190229 - RNA, 20 nt, Mycobacterium bovis subsp bovis AF2122/97
cgguggccucccacggcgcg

SEQ ID NO: 3190230 - RNA, 17 nt, Mycobacterium bovis subsp bovis AF2122/97
cgguggcgccggggccg

SEQ ID NO: 3190231 - RNA, 16 nt, Mycobacterium bovis subsp bovis AF2122/97
cgguggcgccggggcg

SEQ ID NO: 3190232 - RNA, 17 nt, Mycobacterium bovis subsp bovis AF2122/97
cgguggcgccggggcgc

SEQ ID NO: 3190233 - RNA, 15 nt, Mycobacterium bovis subsp bovis AF2122/97
cgguggcgccgucgg

SEQ ID NO: 3190234 - RNA, 18 nt, Mycobacterium bovis subsp bovis AF2122/97
cgguggcgccgucggccg

SEQ ID NO: 3190235 - RNA, 14 nt, Mycobacterium bovis subsp bovis AF2122/97
cgguggcgcggugc

SEQ ID NO: 3190236 - RNA, 15 nt, Mycobacterium bovis subsp bovis AF2122/97
cgguggcgcggugcc

SEQ ID NO: 3190237 - RNA, 16 nt, Mycobacterium bovis subsp bovis AF2122/97
cgguggcgcggugccg

SEQ ID NO: 3190238 - RNA, 18 nt, Mycobacterium bovis subsp bovis AF2122/97
cgguggcgcggugccggc

SEQ ID NO: 3190239 - RNA, 13 nt, Mycobacterium bovis subsp bovis AF2122/97
cgguggcggcacg

SEQ ID NO: 3190240 - RNA, 14 nt, Mycobacterium bovis subsp bovis AF2122/97
cgguggcggcacgc

SEQ ID NO: 3190241 - RNA, 15 nt, Mycobacterium bovis subsp bovis AF2122/97
cgguggcggcacgca

SEQ ID NO: 3190242 - RNA, 17 nt, Mycobacterium bovis subsp bovis AF2122/97
cgguggcggcagcagcg

SEQ ID NO: 3190243 - RNA, 16 nt, Mycobacterium bovis subsp bovis AF2122/97
cgguggcggccuccga

SEQ ID NO: 3190244 - RNA, 17 nt, Mycobacterium bovis subsp bovis AF2122/97
cgguggcggcgagcagc

SEQ ID NO: 3190245 - RNA, 18 nt, Mycobacterium bovis subsp bovis AF2122/97
cgguggcggcgagcagca

SEQ ID NO: 3190246 - RNA, 16 nt, Mycobacterium bovis subsp bovis AF2122/97
cgguggcggcucacga

SEQ ID NO: 3190247 - RNA, 20 nt, Mycobacterium bovis subsp bovis AF2122/97
cgguggcggcucacgaccgg

SEQ ID NO: 3190248 - RNA, 21 nt, Mycobacterium bovis subsp bovis AF2122/97
cgguggcggucuugccgcagg

SEQ ID NO: 3190249 - RNA, 15 nt, Mycobacterium bovis subsp bovis AF2122/97
cgguggcggugucgg

SEQ ID NO: 3190250 - RNA, 19 nt, Mycobacterium bovis subsp bovis AF2122/97
cgguggcggugucggcgcc

SEQ ID NO: 3190251 - RNA, 19 nt, Mycobacterium bovis subsp bovis AF2122/97
cgguggcguauucggugca

SEQ ID NO: 3190252 - RNA, 15 nt, Mycobacterium bovis subsp bovis AF2122/97
cgguggcgucgucgg

SEQ ID NO: 3190253 - RNA, 23 nt, Mycobacterium bovis subsp bovis AF2122/97
cgguggcgucgucggcgggcugc

SEQ ID NO: 3190254 - RNA, 15 nt, Mycobacterium bovis subsp bovis AF2122/97
cgguggcguggucuc

SEQ ID NO: 3190255 - RNA, 19 nt, Mycobacterium bovis subsp bovis AF2122/97
cgguggcguuugaugcggg

SEQ ID NO: 3190256 - RNA, 16 nt, Mycobacterium bovis subsp bovis AF2122/97
cgguggcugaucaccg

SEQ ID NO: 3190257 - RNA, 19 nt, Mycobacterium bovis subsp bovis AF2122/97
cgguggcugccacuuggac

SEQ ID NO: 3190258 - RNA, 12 nt, Mycobacterium bovis subsp bovis AF2122/97
cgguggcugcgc

SEQ ID NO: 3190259 - RNA, 20 nt, Mycobacterium bovis subsp bovis AF2122/97
cgguggcuggccgccaccgc

SEQ ID NO: 3190260 - RNA, 22 nt, Mycobacterium bovis subsp bovis AF2122/97
cgguggcuggccgccaccgcac

SEQ ID NO: 3190261 - RNA, 19 nt, Mycobacterium bovis subsp bovis AF2122/97
cgguggcuucaacccgggc

SEQ ID NO: 3190262 - RNA, 17 nt, Mycobacterium bovis subsp bovis AF2122/97
cgguggcuugccccgcc

SEQ ID NO: 3190263 - RNA, 18 nt, Mycobacterium bovis subsp bovis AF2122/97
cgguggcuugccccgccg

SEQ ID NO: 3190264 - RNA, 20 nt, Mycobacterium bovis subsp bovis AF2122/97
cgguggcuuuugcgucugcu

SEQ ID NO: 3190265 - RNA, 12 nt, Mycobacterium bovis subsp bovis AF2122/97
cggugggcagca

SEQ ID NO: 3190266 - RNA, 13 nt, Mycobacterium bovis subsp bovis AF2122/97
cggugggcgccga

SEQ ID NO: 3190267 - RNA, 20 nt, Mycobacterium bovis subsp bovis AF2122/97
cggugggcgccgacaccggc

SEQ ID NO: 3190268 - RNA, 19 nt, Mycobacterium bovis subsp bovis AF2122/97
cggugggcggcgagcgcga

SEQ ID NO: 3190269 - RNA, 22 nt, Mycobacterium bovis subsp bovis AF2122/97
cggugggcgggcaaucaccgcc

SEQ ID NO: 3190270 - RNA, 21 nt, Mycobacterium bovis subsp bovis AF2122/97
cggugggcgggugcgcgaggu

SEQ ID NO: 3190271 - RNA, 15 nt, Mycobacterium bovis subsp bovis AF2122/97
cggugggcgguccgc

SEQ ID NO: 3190272 - RNA, 19 nt, Mycobacterium bovis subsp bovis AF2122/97
cggugggcguucccccggc

SEQ ID NO: 3190273 - RNA, 22 nt, Mycobacterium bovis subsp bovis AF2122/97
cggugggcuuggcgccgaugcc

SEQ ID NO: 3190274 - RNA, 18 nt, Mycobacterium bovis subsp bovis AF2122/97
cgguggggacccgcucca

SEQ ID NO: 3190275 - RNA, 18 nt, Mycobacterium bovis subsp bovis AF2122/97
cgguggggauggcgccca

SEQ ID NO: 3190276 - RNA, 19 nt, Mycobacterium bovis subsp bovis AF2122/97
cgguggggauggcgcccag

SEQ ID NO: 3190277 - RNA, 21 nt, Mycobacterium bovis subsp bovis AF2122/97
cgguggggauggcgcccagau

SEQ ID NO: 3190278 - RNA, 14 nt, Mycobacterium bovis subsp bovis AF2122/97
cgguggggcgccgg

SEQ ID NO: 3190279 - RNA, 16 nt, Mycobacterium bovis subsp bovis AF2122/97
cgguggggcgcgccgg

SEQ ID NO: 3190280 - RNA, 16 nt, Mycobacterium bovis subsp bovis AF2122/97
cgguggggucgccguc

SEQ ID NO: 3190281 - RNA, 16 nt, Mycobacterium bovis subsp bovis AF2122/97
cgguggggucgcugcc

SEQ ID NO: 3190282 - RNA, 17 nt, Mycobacterium bovis subsp bovis AF2122/97
cgguggggucgcugccg

SEQ ID NO: 3190283 - RNA, 18 nt, Mycobacterium bovis subsp bovis AF2122/97
cgguggggucgcugccgc

SEQ ID NO: 3190284 - RNA, 20 nt, Mycobacterium bovis subsp bovis AF2122/97
cgguggggucgcugccgccg

SEQ ID NO: 3190285 - RNA, 20 nt, Mycobacterium bovis subsp bovis AF2122/97
cgguggggucggucuggcug

SEQ ID NO: 3190286 - RNA, 13 nt, Mycobacterium bovis subsp bovis AF2122/97
cggugggugacgu

SEQ ID NO: 3190287 - RNA, 15 nt, Mycobacterium bovis subsp bovis AF2122/97
cggugggugccagcc

SEQ ID NO: 3190288 - RNA, 21 nt, Mycobacterium bovis subsp bovis AF2122/97
cggugggugccagccggucga

SEQ ID NO: 3190289 - RNA, 16 nt, Mycobacterium bovis subsp bovis AF2122/97
cggugguaacaccggc

SEQ ID NO: 3190290 - RNA, 18 nt, Mycobacterium bovis subsp bovis AF2122/97
cggugguaacaccggcga

SEQ ID NO: 3190291 - RNA, 19 nt, Mycobacterium bovis subsp bovis AF2122/97
cggugguaacaccggcgag

SEQ ID NO: 3190292 - RNA, 14 nt, Mycobacterium bovis subsp bovis AF2122/97
cggugguaacgggg

SEQ ID NO: 3190293 - RNA, 20 nt, Mycobacterium bovis subsp bovis AF2122/97
cggugguaauacgucccgag

SEQ ID NO: 3190294 - RNA, 16 nt, Mycobacterium bovis subsp bovis AF2122/97
cggugguaccggcggc

SEQ ID NO: 3190295 - RNA, 19 nt, Mycobacterium bovis subsp bovis AF2122/97
cggugguacgugcgagccc

SEQ ID NO: 3190296 - RNA, 16 nt, Mycobacterium bovis subsp bovis AF2122/97
cggugguagcgacgau

SEQ ID NO: 3190297 - RNA, 13 nt, Mycobacterium bovis subsp bovis AF2122/97
cggugguagcggc

SEQ ID NO: 3190298 - RNA, 23 nt, Mycobacterium bovis subsp bovis AF2122/97
cggugguagcggcgguuucggug

SEQ ID NO: 3190299 - RNA, 17 nt, Mycobacterium bovis subsp bovis AF2122/97
cgguggucagcaccggc

SEQ ID NO: 3190300 - RNA, 20 nt, Mycobacterium bovis subsp bovis AF2122/97
cgguggucagcaccggcgcg

SEQ ID NO: 3190301 - RNA, 20 nt, Mycobacterium bovis subsp bovis AF2122/97
cgguggucaggaacacucgc

SEQ ID NO: 3190302 - RNA, 14 nt, Mycobacterium bovis subsp bovis AF2122/97
cggugguccagcgc

SEQ ID NO: 3190303 - RNA, 17 nt, Mycobacterium bovis subsp bovis AF2122/97
cgguggucccccgcagc

SEQ ID NO: 3190304 - RNA, 17 nt, Mycobacterium bovis subsp bovis AF2122/97
cgguggucccgauggcg

SEQ ID NO: 3190305 - RNA, 23 nt, Mycobacterium bovis subsp bovis AF2122/97
cgguggucccgauggcgaugcgc

SEQ ID NO: 3190306 - RNA, 13 nt, Mycobacterium bovis subsp bovis AF2122/97
cggugguccuggc

SEQ ID NO: 3190307 - RNA, 16 nt, Mycobacterium bovis subsp bovis AF2122/97
cgguggucgcgcccau

SEQ ID NO: 3190308 - RNA, 14 nt, Mycobacterium bovis subsp bovis AF2122/97
cgguggucggcgcg

SEQ ID NO: 3190309 - RNA, 18 nt, Mycobacterium bovis subsp bovis AF2122/97
cgguggucggcgcgccgu

SEQ ID NO: 3190310 - RNA, 14 nt, Mycobacterium bovis subsp bovis AF2122/97
cgguggucguaggu

SEQ ID NO: 3190311 - RNA, 19 nt, Mycobacterium bovis subsp bovis AF2122/97
cgguggucguaggugacga

SEQ ID NO: 3190312 - RNA, 20 nt, Mycobacterium bovis subsp bovis AF2122/97
cgguggucguaggugacgaa

SEQ ID NO: 3190313 - RNA, 21 nt, Mycobacterium bovis subsp bovis AF2122/97
cgguggucguaggugacgaag

SEQ ID NO: 3190314 - RNA, 22 nt, Mycobacterium bovis subsp bovis AF2122/97
cgguggucgucccgcccauccc

SEQ ID NO: 3190315 - RNA, 23 nt, Mycobacterium bovis subsp bovis AF2122/97
cgguggucucgacggcgccgccc

SEQ ID NO: 3190316 - RNA, 18 nt, Mycobacterium bovis subsp bovis AF2122/97
cgguggucuuggcccggc

SEQ ID NO: 3190317 - RNA, 19 nt, Mycobacterium bovis subsp bovis AF2122/97
cgguggucuuggcccggcg

SEQ ID NO: 3190318 - RNA, 20 nt, Mycobacterium bovis subsp bovis AF2122/97
cgguggugaccaaguagucg

SEQ ID NO: 3190319 - RNA, 21 nt, Mycobacterium bovis subsp bovis AF2122/97
cgguggugaccaaguagucgg

SEQ ID NO: 3190320 - RNA, 16 nt, Mycobacterium bovis subsp bovis AF2122/97
cgguggugaccgcggg

SEQ ID NO: 3190321 - RNA, 17 nt, Mycobacterium bovis subsp bovis AF2122/97
cgguggugaccgcgggc

SEQ ID NO: 3190322 - RNA, 19 nt, Mycobacterium bovis subsp bovis AF2122/97
cgguggugaccgcgggcgc

SEQ ID NO: 3190323 - RNA, 15 nt, Mycobacterium bovis subsp bovis AF2122/97
cgguggugacggcgg

SEQ ID NO: 3190324 - RNA, 20 nt, Mycobacterium bovis subsp bovis AF2122/97
cgguggugacggcgguaccg

SEQ ID NO: 3190325 - RNA, 15 nt, Mycobacterium bovis subsp bovis AF2122/97
cgguggugacgucga

SEQ ID NO: 3190326 - RNA, 17 nt, Mycobacterium bovis subsp bovis AF2122/97
cgguggugagugcgucu

SEQ ID NO: 3190327 - RNA, 18 nt, Mycobacterium bovis subsp bovis AF2122/97
cgguggugaucacgucgg

SEQ ID NO: 3190328 - RNA, 13 nt, Mycobacterium bovis subsp bovis AF2122/97
cgguggugccgcg

SEQ ID NO: 3190329 - RNA, 16 nt, Mycobacterium bovis subsp bovis AF2122/97
cgguggugccggcgcc

SEQ ID NO: 3190330 - RNA, 18 nt, Mycobacterium bovis subsp bovis AF2122/97
cgguggugccggcgccgc

SEQ ID NO: 3190331 - RNA, 19 nt, Mycobacterium bovis subsp bovis AF2122/97
cgguggugccggcgccgcc

SEQ ID NO: 3190332 - RNA, 23 nt, Mycobacterium bovis subsp bovis AF2122/97
cgguggugccggcgccgccagca

SEQ ID NO: 3190333 - RNA, 21 nt, Mycobacterium bovis subsp bovis AF2122/97
cgguggugcgcucgcgguagc

SEQ ID NO: 3190334 - RNA, 12 nt, Mycobacterium bovis subsp bovis AF2122/97
cgguggugcggu

SEQ ID NO: 3190335 - RNA, 15 nt, Mycobacterium bovis subsp bovis AF2122/97
cgguggugcggucuc

SEQ ID NO: 3190336 - RNA, 17 nt, Mycobacterium bovis subsp bovis AF2122/97
cgguggugcggucuccg

SEQ ID NO: 3190337 - RNA, 13 nt, Mycobacterium bovis subsp bovis AF2122/97
cgguggugcugcc

SEQ ID NO: 3190338 - RNA, 14 nt, Mycobacterium bovis subsp bovis AF2122/97
cgguggugcugccg

SEQ ID NO: 3190339 - RNA, 15 nt, Mycobacterium bovis subsp bovis AF2122/97
cgguggugcugccga

SEQ ID NO: 3190340 - RNA, 14 nt, Mycobacterium bovis subsp bovis AF2122/97
cggugguggccaug

SEQ ID NO: 3190341 - RNA, 14 nt, Mycobacterium bovis subsp bovis AF2122/97
cgguggugucagcc

SEQ ID NO: 3190342 - RNA, 15 nt, Mycobacterium bovis subsp bovis AF2122/97
cgguggugucagcca

SEQ ID NO: 3190343 - RNA, 13 nt, Mycobacterium bovis subsp bovis AF2122/97
cgguggugucggu

SEQ ID NO: 3190344 - RNA, 22 nt, Mycobacterium bovis subsp bovis AF2122/97
cgguggugucgguucgucgggc

SEQ ID NO: 3190345 - RNA, 17 nt, Mycobacterium bovis subsp bovis AF2122/97
cggugguguuccagguc

SEQ ID NO: 3190346 - RNA, 19 nt, Mycobacterium bovis subsp bovis AF2122/97
cggugguuagguggcuggc

SEQ ID NO: 3190347 - RNA, 20 nt, Mycobacterium bovis subsp bovis AF2122/97
cggugguuagguggcuggcu

SEQ ID NO: 3190348 - RNA, 21 nt, Mycobacterium bovis subsp bovis AF2122/97
cggugguugugcuguggucgg

SEQ ID NO: 3190349 - RNA, 23 nt, Mycobacterium bovis subsp bovis AF2122/97
cggugguuguggcgggucagcgc

SEQ ID NO: 3190350 - RNA, 16 nt, Mycobacterium bovis subsp bovis AF2122/97
cggugguuuggcgcgc

SEQ ID NO: 3190351 - RNA, 21 nt, Mycobacterium bovis subsp bovis AF2122/97
cggugguuuucccgucgccgc

SEQ ID NO: 3190352 - RNA, 17 nt, Mycobacterium bovis subsp bovis AF2122/97
cgguguaacccuggcgg

SEQ ID NO: 3190353 - RNA, 19 nt, Mycobacterium bovis subsp bovis AF2122/97
cgguguaauugccgacgcu

SEQ ID NO: 3190354 - RNA, 18 nt, Mycobacterium bovis subsp bovis AF2122/97
cgguguacaggucgccgg

SEQ ID NO: 3190355 - RNA, 23 nt, Mycobacterium bovis subsp bovis AF2122/97
cgguguacaggucgccggggccg

SEQ ID NO: 3190356 - RNA, 18 nt, Mycobacterium bovis subsp bovis AF2122/97
cgguguacagucgcgcgc

SEQ ID NO: 3190357 - RNA, 19 nt, Mycobacterium bovis subsp bovis AF2122/97
cgguguacagucgcgcgcu

SEQ ID NO: 3190358 - RNA, 21 nt, Mycobacterium bovis subsp bovis AF2122/97
cgguguaccagguggaccggc

SEQ ID NO: 3190359 - RNA, 14 nt, Mycobacterium bovis subsp bovis AF2122/97
cgguguacgcccgc

SEQ ID NO: 3190360 - RNA, 15 nt, Mycobacterium bovis subsp bovis AF2122/97
cgguguacgcccgcu

SEQ ID NO: 3190361 - RNA, 18 nt, Mycobacterium bovis subsp bovis AF2122/97
cgguguacucgaagcggg

SEQ ID NO: 3190362 - RNA, 19 nt, Mycobacterium bovis subsp bovis AF2122/97
cgguguagagcgcaccgcg

SEQ ID NO: 3190363 - RNA, 20 nt, Mycobacterium bovis subsp bovis AF2122/97
cgguguagagcgcaccgcga

SEQ ID NO: 3190364 - RNA, 15 nt, Mycobacterium bovis subsp bovis AF2122/97
cgguguagcccagcc

SEQ ID NO: 3190365 - RNA, 17 nt, Mycobacterium bovis subsp bovis AF2122/97
cgguguagcccagccgg

SEQ ID NO: 3190366 - RNA, 14 nt, Mycobacterium bovis subsp bovis AF2122/97
cgguguagccggcg

SEQ ID NO: 3190367 - RNA, 20 nt, Mycobacterium bovis subsp bovis AF2122/97
cgguguagccggcgccgccg

SEQ ID NO: 3190368 - RNA, 19 nt, Mycobacterium bovis subsp bovis AF2122/97
cgguguaggccugcccccg

SEQ ID NO: 3190369 - RNA, 14 nt, Mycobacterium bovis subsp bovis AF2122/97
cgguguagggcggc

SEQ ID NO: 3190370 - RNA, 21 nt, Mycobacterium bovis subsp bovis AF2122/97
cgguguauccgacuggccccg

SEQ ID NO: 3190371 - RNA, 22 nt, Mycobacterium bovis subsp bovis AF2122/97
cgguguauccgacuggccccgc

SEQ ID NO: 3190372 - RNA, 16 nt, Mycobacterium bovis subsp bovis AF2122/97
cggugucaugaacgac

SEQ ID NO: 3190373 - RNA, 20 nt, Mycobacterium bovis subsp bovis AF2122/97
cggugucaugaacgaccgga

SEQ ID NO: 3190374 - RNA, 12 nt, Mycobacterium bovis subsp bovis AF2122/97
cgguguccagcc

SEQ ID NO: 3190375 - RNA, 15 nt, Mycobacterium bovis subsp bovis AF2122/97
cgguguccagugcau

SEQ ID NO: 3190376 - RNA, 21 nt, Mycobacterium bovis subsp bovis AF2122/97
cgguguccucgaccgucacgc

SEQ ID NO: 3190377 - RNA, 13 nt, Mycobacterium bovis subsp bovis AF2122/97
cgguguccuggcc

SEQ ID NO: 3190378 - RNA, 21 nt, Mycobacterium bovis subsp bovis AF2122/97
cgguguccuuggccgccacuc

SEQ ID NO: 3190379 - RNA, 14 nt, Mycobacterium bovis subsp bovis AF2122/97
cggugucgacgggg

SEQ ID NO: 3190380 - RNA, 16 nt, Mycobacterium bovis subsp bovis AF2122/97
cggugucgacggggaa

SEQ ID NO: 3190381 - RNA, 22 nt, Mycobacterium bovis subsp bovis AF2122/97
cggugucgacguucaucuucac

SEQ ID NO: 3190382 - RNA, 13 nt, Mycobacterium bovis subsp bovis AF2122/97
cggugucgaugcg

SEQ ID NO: 3190383 - RNA, 21 nt, Mycobacterium bovis subsp bovis AF2122/97
cggugucgaugcgcagcccgu

SEQ ID NO: 3190384 - RNA, 13 nt, Mycobacterium bovis subsp bovis AF2122/97
cggugucgaugcu

SEQ ID NO: 3190385 - RNA, 17 nt, Mycobacterium bovis subsp bovis AF2122/97
cggugucgccgaacacc

SEQ ID NO: 3190386 - RNA, 15 nt, Mycobacterium bovis subsp bovis AF2122/97
cggugucgcgaugcu

SEQ ID NO: 3190387 - RNA, 15 nt, Mycobacterium bovis subsp bovis AF2122/97
cggugucggcugguc

SEQ ID NO: 3190388 - RNA, 17 nt, Mycobacterium bovis subsp bovis AF2122/97
cggugucgggcugucag

SEQ ID NO: 3190389 - RNA, 11 nt, Mycobacterium bovis subsp bovis AF2122/97
cggugucggug

SEQ ID NO: 3190390 - RNA, 14 nt, Mycobacterium bovis subsp bovis AF2122/97
cggugucggugaca

SEQ ID NO: 3190391 - RNA, 17 nt, Mycobacterium bovis subsp bovis AF2122/97
cggugucggugcgcggc

SEQ ID NO: 3190392 - RNA, 18 nt, Mycobacterium bovis subsp bovis AF2122/97
cggugucggugcgcggca

SEQ ID NO: 3190393 - RNA, 20 nt, Mycobacterium bovis subsp bovis AF2122/97
cggugucgguucggucggcc

SEQ ID NO: 3190394 - RNA, 15 nt, Mycobacterium bovis subsp bovis AF2122/97
cggugucgucgaggu

SEQ ID NO: 3190395 - RNA, 17 nt, Mycobacterium bovis subsp bovis AF2122/97
cggugucuucugccauc

SEQ ID NO: 3190396 - RNA, 20 nt, Mycobacterium bovis subsp bovis AF2122/97
cggugucuucugccaucaac

SEQ ID NO: 3190397 - RNA, 15 nt, Mycobacterium bovis subsp bovis AF2122/97
cggugugcacgcggg

SEQ ID NO: 3190398 - RNA, 22 nt, Mycobacterium bovis subsp bovis AF2122/97
cggugugcagggacccggcgcc

SEQ ID NO: 3190399 - RNA, 17 nt, Mycobacterium bovis subsp bovis AF2122/97
cggugugcaucgccggc

SEQ ID NO: 3190400 - RNA, 18 nt, Mycobacterium bovis subsp bovis AF2122/97
cggugugcaucgccggca

SEQ ID NO: 3190401 - RNA, 20 nt, Mycobacterium bovis subsp bovis AF2122/97
cggugugcaucgccggcacg

SEQ ID NO: 3190402 - RNA, 14 nt, Mycobacterium bovis subsp bovis AF2122/97
cggugugcccgccu

SEQ ID NO: 3190403 - RNA, 22 nt, Mycobacterium bovis subsp bovis AF2122/97
cggugugcgcaccccgcuugcg

SEQ ID NO: 3190404 - RNA, 14 nt, Mycobacterium bovis subsp bovis AF2122/97
cggugugcgcgcca

SEQ ID NO: 3190405 - RNA, 20 nt, Mycobacterium bovis subsp bovis AF2122/97
cggugugcggcagcccgcug

SEQ ID NO: 3190406 - RNA, 15 nt, Mycobacterium bovis subsp bovis AF2122/97
cggugugcggcauug

SEQ ID NO: 3190407 - RNA, 14 nt, Mycobacterium bovis subsp bovis AF2122/97
cggugugcggcgca

SEQ ID NO: 3190408 - RNA, 14 nt, Mycobacterium bovis subsp bovis AF2122/97
cggugugcgugcgg

SEQ ID NO: 3190409 - RNA, 16 nt, Mycobacterium bovis subsp bovis AF2122/97
cggugugcgugcgguc

SEQ ID NO: 3190410 - RNA, 13 nt, Mycobacterium bovis subsp bovis AF2122/97
cggugugcucgau

SEQ ID NO: 3190411 - RNA, 16 nt, Mycobacterium bovis subsp bovis AF2122/97
cggugugcucgccgac

SEQ ID NO: 3190412 - RNA, 18 nt, Mycobacterium bovis subsp bovis AF2122/97
cggugugcucgccgacca

SEQ ID NO: 3190413 - RNA, 16 nt, Mycobacterium bovis subsp bovis AF2122/97
cggugugcuugcucgg

SEQ ID NO: 3190414 - RNA, 19 nt, Mycobacterium bovis subsp bovis AF2122/97
cgguguggacuucagcagg

SEQ ID NO: 3190415 - RNA, 22 nt, Mycobacterium bovis subsp bovis AF2122/97
cgguguggacuucagcaggccc

SEQ ID NO: 3190416 - RNA, 23 nt, Mycobacterium bovis subsp bovis AF2122/97
cgguguggacuucagcaggccca

SEQ ID NO: 3190417 - RNA, 14 nt, Mycobacterium bovis subsp bovis AF2122/97
cgguguggcccaac

SEQ ID NO: 3190418 - RNA, 17 nt, Mycobacterium bovis subsp bovis AF2122/97
cgguguggcccaacacc

SEQ ID NO: 3190419 - RNA, 18 nt, Mycobacterium bovis subsp bovis AF2122/97
cgguguggcccaacaccg

SEQ ID NO: 3190420 - RNA, 23 nt, Mycobacterium bovis subsp bovis AF2122/97
cgguguggcccaacaccgccaga

SEQ ID NO: 3190421 - RNA, 14 nt, Mycobacterium bovis subsp bovis AF2122/97
cggugugguggggc

SEQ ID NO: 3190422 - RNA, 18 nt, Mycobacterium bovis subsp bovis AF2122/97
cgguguguauucgccgac

SEQ ID NO: 3190423 - RNA, 22 nt, Mycobacterium bovis subsp bovis AF2122/97
cggugugugcaagccgaacacc

SEQ ID NO: 3190424 - RNA, 17 nt, Mycobacterium bovis subsp bovis AF2122/97
cgguguguucggcccgc

SEQ ID NO: 3190425 - RNA, 21 nt, Mycobacterium bovis subsp bovis AF2122/97
cgguguuagccccgaagccgg

SEQ ID NO: 3190426 - RNA, 21 nt, Mycobacterium bovis subsp bovis AF2122/97
cgguguuagcgcgaacccggc

SEQ ID NO: 3190427 - RNA, 16 nt, Mycobacterium bovis subsp bovis AF2122/97
cgguguuccgcccagc

SEQ ID NO: 3190428 - RNA, 21 nt, Mycobacterium bovis subsp bovis AF2122/97
cgguguugagaucgcccgagu

SEQ ID NO: 3190429 - RNA, 19 nt, Mycobacterium bovis subsp bovis AF2122/97
cgguguugagcgaacccgc

SEQ ID NO: 3190430 - RNA, 19 nt, Mycobacterium bovis subsp bovis AF2122/97
cgguguugauuccggcgug

SEQ ID NO: 3190431 - RNA, 13 nt, Mycobacterium bovis subsp bovis AF2122/97
cgguguugcccga

SEQ ID NO: 3190432 - RNA, 13 nt, Mycobacterium bovis subsp bovis AF2122/97
cgguguugcuccc

SEQ ID NO: 3190433 - RNA, 22 nt, Mycobacterium bovis subsp bovis AF2122/97
cgguguugcucccggccgccga

SEQ ID NO: 3190434 - RNA, 15 nt, Mycobacterium bovis subsp bovis AF2122/97
cgguguugguggccg

SEQ ID NO: 3190435 - RNA, 22 nt, Mycobacterium bovis subsp bovis AF2122/97
cgguguuucgacguaaugcgcu

SEQ ID NO: 3190436 - RNA, 19 nt, Mycobacterium bovis subsp bovis AF2122/97
cgguguuucgugccauggu

SEQ ID NO: 3190437 - RNA, 16 nt, Mycobacterium bovis subsp bovis AF2122/97
cgguuacccggaccgu

SEQ ID NO: 3190438 - RNA, 13 nt, Mycobacterium bovis subsp bovis AF2122/97
cgguuagcgcggc

SEQ ID NO: 3190439 - RNA, 21 nt, Mycobacterium bovis subsp bovis AF2122/97
cgguuagggcacgucgagcgu

SEQ ID NO: 3190440 - RNA, 14 nt, Mycobacterium bovis subsp bovis AF2122/97
cgguuaucgccgag

SEQ ID NO: 3190441 - RNA, 20 nt, Mycobacterium bovis subsp bovis AF2122/97
cgguuauguauccgcgccgc

SEQ ID NO: 3190442 - RNA, 22 nt, Mycobacterium bovis subsp bovis AF2122/97
cgguucaccaugucggccaccc

SEQ ID NO: 3190443 - RNA, 21 nt, Mycobacterium bovis subsp bovis AF2122/97
cgguucagcgcuggcaggccg

SEQ ID NO: 3190444 - RNA, 20 nt, Mycobacterium bovis subsp bovis AF2122/97
cgguucagggguggcgcggg

SEQ ID NO: 3190445 - RNA, 21 nt, Mycobacterium bovis subsp bovis AF2122/97
cgguucagggguggcgcgggc

SEQ ID NO: 3190446 - RNA, 14 nt, Mycobacterium bovis subsp bovis AF2122/97
cgguuccacgcugc

SEQ ID NO: 3190447 - RNA, 19 nt, Mycobacterium bovis subsp bovis AF2122/97
cgguuccauugcgaacucg

SEQ ID NO: 3190448 - RNA, 17 nt, Mycobacterium bovis subsp bovis AF2122/97
cgguucccagcuuccgc

SEQ ID NO: 3190449 - RNA, 22 nt, Mycobacterium bovis subsp bovis AF2122/97
cgguuccgccaccggacaucug

SEQ ID NO: 3190450 - RNA, 23 nt, Mycobacterium bovis subsp bovis AF2122/97
cgguuccgccaggccgaccgcgc

SEQ ID NO: 3190451 - RNA, 15 nt, Mycobacterium bovis subsp bovis AF2122/97
cgguuccgccggccc

SEQ ID NO: 3190452 - RNA, 17 nt, Mycobacterium bovis subsp bovis AF2122/97
cgguuccgccggcccca

SEQ ID NO: 3190453 - RNA, 23 nt, Mycobacterium bovis subsp bovis AF2122/97
cgguuccgccggccccaccggua

SEQ ID NO: 3190454 - RNA, 14 nt, Mycobacterium bovis subsp bovis AF2122/97
cgguuccgggcgcg

SEQ ID NO: 3190455 - RNA, 21 nt, Mycobacterium bovis subsp bovis AF2122/97
cgguucgacccccgcaucggc

SEQ ID NO: 3190456 - RNA, 17 nt, Mycobacterium bovis subsp bovis AF2122/97
cgguucgaggaucccgc

SEQ ID NO: 3190457 - RNA, 17 nt, Mycobacterium bovis subsp bovis AF2122/97
cgguucgauggcaucgg

SEQ ID NO: 3190458 - RNA, 23 nt, Mycobacterium bovis subsp bovis AF2122/97
cgguucgccccugcacagcaggc

SEQ ID NO: 3190459 - RNA, 14 nt, Mycobacterium bovis subsp bovis AF2122/97
cgguucgccgccgu

SEQ ID NO: 3190460 - RNA, 22 nt, Mycobacterium bovis subsp bovis AF2122/97
cgguucgccgccguuggcucga

SEQ ID NO: 3190461 - RNA, 17 nt, Mycobacterium bovis subsp bovis AF2122/97
cgguucgcugcggcggu

SEQ ID NO: 3190462 - RNA, 22 nt, Mycobacterium bovis subsp bovis AF2122/97
cgguucggagucacgcagccgc

SEQ ID NO: 3190463 - RNA, 15 nt, Mycobacterium bovis subsp bovis AF2122/97
cgguucggucgggga

SEQ ID NO: 3190464 - RNA, 22 nt, Mycobacterium bovis subsp bovis AF2122/97
cgguucggugagcgggaggaug

SEQ ID NO: 3190465 - RNA, 23 nt, Mycobacterium bovis subsp bovis AF2122/97
cgguucgucgaacggaucucggu

SEQ ID NO: 3190466 - RNA, 23 nt, Mycobacterium bovis subsp bovis AF2122/97
cgguucguugccaaugacgucgc

SEQ ID NO: 3190467 - RNA, 16 nt, Mycobacterium bovis subsp bovis AF2122/97
cgguucugcggccgcg

SEQ ID NO: 3190468 - RNA, 15 nt, Mycobacterium bovis subsp bovis AF2122/97
cgguucugggccugc

SEQ ID NO: 3190469 - RNA, 14 nt, Mycobacterium bovis subsp bovis AF2122/97
cgguugaacgaccu

SEQ ID NO: 3190470 - RNA, 20 nt, Mycobacterium bovis subsp bovis AF2122/97
cgguugacacccgggccacc

SEQ ID NO: 3190471 - RNA, 13 nt, Mycobacterium bovis subsp bovis AF2122/97
cgguugacccaca

SEQ ID NO: 3190472 - RNA, 17 nt, Mycobacterium bovis subsp bovis AF2122/97
cgguugaccggucgacc

SEQ ID NO: 3190473 - RNA, 23 nt, Mycobacterium bovis subsp bovis AF2122/97
cgguugacgccgguccccgccgg

SEQ ID NO: 3190474 - RNA, 16 nt, Mycobacterium bovis subsp bovis AF2122/97
cgguugacgggcucgg

SEQ ID NO: 3190475 - RNA, 24 nt, Mycobacterium bovis subsp bovis AF2122/97
cgguugacgggcucggcaggcccg

SEQ ID NO: 3190476 - RNA, 19 nt, Mycobacterium bovis subsp bovis AF2122/97
cgguugaucgccggccugc

SEQ ID NO: 3190477 - RNA, 15 nt, Mycobacterium bovis subsp bovis AF2122/97
cgguugaucggccac

SEQ ID NO: 3190478 - RNA, 18 nt, Mycobacterium bovis subsp bovis AF2122/97
cgguugaugguccgccag

SEQ ID NO: 3190479 - RNA, 19 nt, Mycobacterium bovis subsp bovis AF2122/97
cgguugcaaaccgcugcgc

SEQ ID NO: 3190480 - RNA, 16 nt, Mycobacterium bovis subsp bovis AF2122/97
cgguugcacccgcgcg

SEQ ID NO: 3190481 - RNA, 17 nt, Mycobacterium bovis subsp bovis AF2122/97
cgguugcauaccgccgg

SEQ ID NO: 3190482 - RNA, 22 nt, Mycobacterium bovis subsp bovis AF2122/97
cgguugcauccauccugccuua

SEQ ID NO: 3190483 - RNA, 17 nt, Mycobacterium bovis subsp bovis AF2122/97
cgguugccacgccgccg

SEQ ID NO: 3190484 - RNA, 18 nt, Mycobacterium bovis subsp bovis AF2122/97
cgguugccacgccgccgg

SEQ ID NO: 3190485 - RNA, 15 nt, Mycobacterium bovis subsp bovis AF2122/97
cgguugccauccguc

SEQ ID NO: 3190486 - RNA, 14 nt, Mycobacterium bovis subsp bovis AF2122/97
cgguugccccgacc

SEQ ID NO: 3190487 - RNA, 17 nt, Mycobacterium bovis subsp bovis AF2122/97
cgguugccccgaccgcc

SEQ ID NO: 3190488 - RNA, 13 nt, Mycobacterium bovis subsp bovis AF2122/97
cgguugccccggc

SEQ ID NO: 3190489 - RNA, 16 nt, Mycobacterium bovis subsp bovis AF2122/97
cgguugccccggcgac

SEQ ID NO: 3190490 - RNA, 20 nt, Mycobacterium bovis subsp bovis AF2122/97
cgguugccccggcgacccgg

SEQ ID NO: 3190491 - RNA, 23 nt, Mycobacterium bovis subsp bovis AF2122/97
cgguugcccgagcggcugagccg

SEQ ID NO: 3190492 - RNA, 14 nt, Mycobacterium bovis subsp bovis AF2122/97
cgguugccggcggc

SEQ ID NO: 3190493 - RNA, 18 nt, Mycobacterium bovis subsp bovis AF2122/97
cgguugccggcggcgacg

SEQ ID NO: 3190494 - RNA, 17 nt, Mycobacterium bovis subsp bovis AF2122/97
cgguugcggcugcguug

SEQ ID NO: 3190495 - RNA, 20 nt, Mycobacterium bovis subsp bovis AF2122/97
cgguugcggucaucggcgcc

SEQ ID NO: 3190496 - RNA, 22 nt, Mycobacterium bovis subsp bovis AF2122/97
cgguugcggucaucggcgccaa

SEQ ID NO: 3190497 - RNA, 17 nt, Mycobacterium bovis subsp bovis AF2122/97
cgguugcugugucgugg

SEQ ID NO: 3190498 - RNA, 23 nt, Mycobacterium bovis subsp bovis AF2122/97
cgguuggaccacgugaucgacga

SEQ ID NO: 3190499 - RNA, 18 nt, Mycobacterium bovis subsp bovis AF2122/97
cgguuggaucggcggccg

SEQ ID NO: 3190500 - RNA, 17 nt, Mycobacterium bovis subsp bovis AF2122/97
cgguuggcagccacggg

SEQ ID NO: 3190501 - RNA, 13 nt, Mycobacterium bovis subsp bovis AF2122/97
cgguuggcagugg

SEQ ID NO: 3190502 - RNA, 15 nt, Mycobacterium bovis subsp bovis AF2122/97
cgguuggccagccac

SEQ ID NO: 3190503 - RNA, 22 nt, Mycobacterium bovis subsp bovis AF2122/97
cgguuggccagccacagccgac

SEQ ID NO: 3190504 - RNA, 23 nt, Mycobacterium bovis subsp bovis AF2122/97
cgguuggccagccacagccgacc

SEQ ID NO: 3190505 - RNA, 16 nt, Mycobacterium bovis subsp bovis AF2122/97
cgguuggcggcgaugg

SEQ ID NO: 3190506 - RNA, 14 nt, Mycobacterium bovis subsp bovis AF2122/97
cgguuggcucgggc

SEQ ID NO: 3190507 - RNA, 19 nt, Mycobacterium bovis subsp bovis AF2122/97
cgguuggcucgggccagau

SEQ ID NO: 3190508 - RNA, 17 nt, Mycobacterium bovis subsp bovis AF2122/97
cgguuggcugccggcaa

SEQ ID NO: 3190509 - RNA, 18 nt, Mycobacterium bovis subsp bovis AF2122/97
cgguugggguggcggugc

SEQ ID NO: 3190510 - RNA, 15 nt, Mycobacterium bovis subsp bovis AF2122/97
cgguuggguagcacc

SEQ ID NO: 3190511 - RNA, 18 nt, Mycobacterium bovis subsp bovis AF2122/97
cgguuggguagcaccgau

SEQ ID NO: 3190512 - RNA, 15 nt, Mycobacterium bovis subsp bovis AF2122/97
cgguugguccgccgu

SEQ ID NO: 3190513 - RNA, 18 nt, Mycobacterium bovis subsp bovis AF2122/97
cgguuggugcagcgugca

SEQ ID NO: 3190514 - RNA, 13 nt, Mycobacterium bovis subsp bovis AF2122/97
cgguugugcgcgc

SEQ ID NO: 3190515 - RNA, 19 nt, Mycobacterium bovis subsp bovis AF2122/97
cgguugugcugggugccgc

SEQ ID NO: 3190516 - RNA, 13 nt, Mycobacterium bovis subsp bovis AF2122/97
cgguuguggcuga

SEQ ID NO: 3190517 - RNA, 23 nt, Mycobacterium bovis subsp bovis AF2122/97
cgguuguggcugaucccggccag

SEQ ID NO: 3190518 - RNA, 22 nt, Mycobacterium bovis subsp bovis AF2122/97
cgguuguguugggagccaccgg

SEQ ID NO: 3190519 - RNA, 22 nt, Mycobacterium bovis subsp bovis AF2122/97
cgguuguuguagaucugcgcca

SEQ ID NO: 3190520 - RNA, 14 nt, Mycobacterium bovis subsp bovis AF2122/97
cgguuucaccgacg

SEQ ID NO: 3190521 - RNA, 13 nt, Mycobacterium bovis subsp bovis AF2122/97
cgguuucgaucac

SEQ ID NO: 3190522 - RNA, 14 nt, Mycobacterium bovis subsp bovis AF2122/97
cgguuucgggugcg

SEQ ID NO: 3190523 - RNA, 16 nt, Mycobacterium bovis subsp bovis AF2122/97
cgguuucggugguaac

SEQ ID NO: 3190524 - RNA, 15 nt, Mycobacterium bovis subsp bovis AF2122/97
cgguuugcaccgcgg

SEQ ID NO: 3190525 - RNA, 13 nt, Mycobacterium bovis subsp bovis AF2122/97
cgguuugcagcgg

SEQ ID NO: 3190526 - RNA, 13 nt, Mycobacterium bovis subsp bovis AF2122/97
cgguuugcccggu

SEQ ID NO: 3190527 - RNA, 14 nt, Mycobacterium bovis subsp bovis AF2122/97
cgguuugcccgguc

SEQ ID NO: 3190528 - RNA, 17 nt, Mycobacterium bovis subsp bovis AF2122/97
cgguuugccggugcggu

SEQ ID NO: 3190529 - RNA, 16 nt, Mycobacterium bovis subsp bovis AF2122/97
cgguuugcguccuggu

SEQ ID NO: 3190530 - RNA, 12 nt, Mycobacterium bovis subsp bovis AF2122/97
cgguuuggccga

SEQ ID NO: 3190531 - RNA, 18 nt, Mycobacterium bovis subsp bovis AF2122/97
cgguuuggcgacgucgac

SEQ ID NO: 3190532 - RNA, 16 nt, Mycobacterium bovis subsp bovis AF2122/97
cgguuuucggcugccg

SEQ ID NO: 3190533 - RNA, 17 nt, Mycobacterium bovis subsp bovis AF2122/97
cgguuuucggcugccgc

SEQ ID NO: 3190534 - RNA, 17 nt, Mycobacterium bovis subsp bovis AF2122/97
cguaaaagccgaugacg

SEQ ID NO: 3190535 - RNA, 20 nt, Mycobacterium bovis subsp bovis AF2122/97
cguaaacagcgcgccggcgu

SEQ ID NO: 3190536 - RNA, 18 nt, Mycobacterium bovis subsp bovis AF2122/97
cguaaaccguggccgcga

SEQ ID NO: 3190537 - RNA, 12 nt, Mycobacterium bovis subsp bovis AF2122/97
cguaaacgucgg

SEQ ID NO: 3190538 - RNA, 23 nt, Mycobacterium bovis subsp bovis AF2122/97
cguaaauagcgcccugccauggg

SEQ ID NO: 3190539 - RNA, 15 nt, Mycobacterium bovis subsp bovis AF2122/97
cguaacagccggccg

SEQ ID NO: 3190540 - RNA, 14 nt, Mycobacterium bovis subsp bovis AF2122/97
cguaaccacgacga

SEQ ID NO: 3190541 - RNA, 16 nt, Mycobacterium bovis subsp bovis AF2122/97
cguaaccgucgccugc

SEQ ID NO: 3190542 - RNA, 23 nt, Mycobacterium bovis subsp bovis AF2122/97
cguaacgccaagcucggcccagc

SEQ ID NO: 3190543 - RNA, 15 nt, Mycobacterium bovis subsp bovis AF2122/97
cguaacgccgcucau

SEQ ID NO: 3190544 - RNA, 15 nt, Mycobacterium bovis subsp bovis AF2122/97
cguaacggucgguga

SEQ ID NO: 3190545 - RNA, 17 nt, Mycobacterium bovis subsp bovis AF2122/97
cguaacugcccgcggcg

SEQ ID NO: 3190546 - RNA, 18 nt, Mycobacterium bovis subsp bovis AF2122/97
cguaacugcccgcggcgg

SEQ ID NO: 3190547 - RNA, 13 nt, Mycobacterium bovis subsp bovis AF2122/97
cguaagcaccagc

SEQ ID NO: 3190548 - RNA, 14 nt, Mycobacterium bovis subsp bovis AF2122/97
cguaagcaccagcc

SEQ ID NO: 3190549 - RNA, 12 nt, Mycobacterium bovis subsp bovis AF2122/97
cguaaggccgga

SEQ ID NO: 3190550 - RNA, 21 nt, Mycobacterium bovis subsp bovis AF2122/97
cguaaggccggagucgacgac

SEQ ID NO: 3190551 - RNA, 19 nt, Mycobacterium bovis subsp bovis AF2122/97
cguaaggcugugccggcca

SEQ ID NO: 3190552 - RNA, 12 nt, Mycobacterium bovis subsp bovis AF2122/97
cguaauccacgc

SEQ ID NO: 3190553 - RNA, 18 nt, Mycobacterium bovis subsp bovis AF2122/97
cguaauccacgccgaccu

SEQ ID NO: 3190554 - RNA, 17 nt, Mycobacterium bovis subsp bovis AF2122/97
cguaauccgagcgcggc

SEQ ID NO: 3190555 - RNA, 15 nt, Mycobacterium bovis subsp bovis AF2122/97
cguaaugcgcugccg

SEQ ID NO: 3190556 - RNA, 19 nt, Mycobacterium bovis subsp bovis AF2122/97
cguaaugcgcugccgccgu

SEQ ID NO: 3190557 - RNA, 19 nt, Mycobacterium bovis subsp bovis AF2122/97
cguaaugcugcugcagcaa

SEQ ID NO: 3190558 - RNA, 19 nt, Mycobacterium bovis subsp bovis AF2122/97
cguacaacacgggcagcuu

SEQ ID NO: 3190559 - RNA, 20 nt, Mycobacterium bovis subsp bovis AF2122/97
cguacaacaugauucgcugc

SEQ ID NO: 3190560 - RNA, 17 nt, Mycobacterium bovis subsp bovis AF2122/97
cguacaaccacccaccc

SEQ ID NO: 3190561 - RNA, 20 nt, Mycobacterium bovis subsp bovis AF2122/97
cguacaccagggugccgggc

SEQ ID NO: 3190562 - RNA, 15 nt, Mycobacterium bovis subsp bovis AF2122/97
cguacaccucgagcg

SEQ ID NO: 3190563 - RNA, 12 nt, Mycobacterium bovis subsp bovis AF2122/97
cguacagcgccu

SEQ ID NO: 3190564 - RNA, 14 nt, Mycobacterium bovis subsp bovis AF2122/97
cguacagcgccugg

SEQ ID NO: 3190565 - RNA, 15 nt, Mycobacterium bovis subsp bovis AF2122/97
cguacagcggcggcg

SEQ ID NO: 3190566 - RNA, 21 nt, Mycobacterium bovis subsp bovis AF2122/97
cguacaggacgguugagaugg

SEQ ID NO: 3190567 - RNA, 16 nt, Mycobacterium bovis subsp bovis AF2122/97
cguacaggccggccac

SEQ ID NO: 3190568 - RNA, 17 nt, Mycobacterium bovis subsp bovis AF2122/97
cguacaggccggccacc

SEQ ID NO: 3190569 - RNA, 16 nt, Mycobacterium bovis subsp bovis AF2122/97
cguaccaauucccgcg

SEQ ID NO: 3190570 - RNA, 17 nt, Mycobacterium bovis subsp bovis AF2122/97
cguacccacgacgggcc

SEQ ID NO: 3190571 - RNA, 14 nt, Mycobacterium bovis subsp bovis AF2122/97
cguacccgaucagc

SEQ ID NO: 3190572 - RNA, 15 nt, Mycobacterium bovis subsp bovis AF2122/97
cguacccggcaacgg

SEQ ID NO: 3190573 - RNA, 19 nt, Mycobacterium bovis subsp bovis AF2122/97
cguacccguuaugcgccgc

SEQ ID NO: 3190574 - RNA, 13 nt, Mycobacterium bovis subsp bovis AF2122/97
cguaccgauucca

SEQ ID NO: 3190575 - RNA, 14 nt, Mycobacterium bovis subsp bovis AF2122/97
cguaccggccuuca

SEQ ID NO: 3190576 - RNA, 13 nt, Mycobacterium bovis subsp bovis AF2122/97
cguaccgggcgag

SEQ ID NO: 3190577 - RNA, 15 nt, Mycobacterium bovis subsp bovis AF2122/97
cguaccguucgggcc

SEQ ID NO: 3190578 - RNA, 20 nt, Mycobacterium bovis subsp bovis AF2122/97
cguaccguucgggccguccu

SEQ ID NO: 3190579 - RNA, 21 nt, Mycobacterium bovis subsp bovis AF2122/97
cguaccguucgggccguccuc

SEQ ID NO: 3190580 - RNA, 20 nt, Mycobacterium bovis subsp bovis AF2122/97
cguaccuaaggcucaccagg

SEQ ID NO: 3190581 - RNA, 16 nt, Mycobacterium bovis subsp bovis AF2122/97
cguacgacagucgcag

SEQ ID NO: 3190582 - RNA, 16 nt, Mycobacterium bovis subsp bovis AF2122/97
cguacgcacgcagccc

SEQ ID NO: 3190583 - RNA, 20 nt, Mycobacterium bovis subsp bovis AF2122/97
cguacgccgccgaucaccag

SEQ ID NO: 3190584 - RNA, 22 nt, Mycobacterium bovis subsp bovis AF2122/97
cguacgccgccgaucaccaggg

SEQ ID NO: 3190585 - RNA, 14 nt, Mycobacterium bovis subsp bovis AF2122/97
cguacgccggcggu

SEQ ID NO: 3190586 - RNA, 11 nt, Mycobacterium bovis subsp bovis AF2122/97
cguacgccgua

SEQ ID NO: 3190587 - RNA, 15 nt, Mycobacterium bovis subsp bovis AF2122/97
cguacggggucgccg

SEQ ID NO: 3190588 - RNA, 21 nt, Mycobacterium bovis subsp bovis AF2122/97
cguacggggucgccggcaccg

SEQ ID NO: 3190589 - RNA, 17 nt, Mycobacterium bovis subsp bovis AF2122/97
cguacgucggaucuucg

SEQ ID NO: 3190590 - RNA, 19 nt, Mycobacterium bovis subsp bovis AF2122/97
cguacgucgguccacccaa

SEQ ID NO: 3190591 - RNA, 16 nt, Mycobacterium bovis subsp bovis AF2122/97
cguacguucaccaccg

SEQ ID NO: 3190592 - RNA, 15 nt, Mycobacterium bovis subsp bovis AF2122/97
cguacuccaccgcgc

SEQ ID NO: 3190593 - RNA, 13 nt, Mycobacterium bovis subsp bovis AF2122/97
cguacuccccgcg

SEQ ID NO: 3190594 - RNA, 18 nt, Mycobacterium bovis subsp bovis AF2122/97
cguacucggcgcgcagcg

SEQ ID NO: 3190595 - RNA, 18 nt, Mycobacterium bovis subsp bovis AF2122/97
cguacucggcggccacca

SEQ ID NO: 3190596 - RNA, 19 nt, Mycobacterium bovis subsp bovis AF2122/97
cguacuucgacagcggcga

SEQ ID NO: 3190597 - RNA, 16 nt, Mycobacterium bovis subsp bovis AF2122/97
cguagaagcgcuccag

SEQ ID NO: 3190598 - RNA, 18 nt, Mycobacterium bovis subsp bovis AF2122/97
cguagaaggaccgcucgu

SEQ ID NO: 3190599 - RNA, 18 nt, Mycobacterium bovis subsp bovis AF2122/97
cguagaaggcgauuugcu

SEQ ID NO: 3190600 - RNA, 18 nt, Mycobacterium bovis subsp bovis AF2122/97
cguagaaguaggcggcga

SEQ ID NO: 3190601 - RNA, 16 nt, Mycobacterium bovis subsp bovis AF2122/97
cguagaaucggcucag

SEQ ID NO: 3190602 - RNA, 21 nt, Mycobacterium bovis subsp bovis AF2122/97
cguagaaucggcucagcaacg

SEQ ID NO: 3190603 - RNA, 18 nt, Mycobacterium bovis subsp bovis AF2122/97
cguagaaugcgccgucgg

SEQ ID NO: 3190604 - RNA, 22 nt, Mycobacterium bovis subsp bovis AF2122/97
cguagaaugcgccgucgguggg

SEQ ID NO: 3190605 - RNA, 17 nt, Mycobacterium bovis subsp bovis AF2122/97
cguagaccacgccggug

SEQ ID NO: 3190606 - RNA, 19 nt, Mycobacterium bovis subsp bovis AF2122/97
cguagaccacgccggugac

SEQ ID NO: 3190607 - RNA, 13 nt, Mycobacterium bovis subsp bovis AF2122/97
cguagaccagcag

SEQ ID NO: 3190608 - RNA, 19 nt, Mycobacterium bovis subsp bovis AF2122/97
cguagaccagcaggcccug

SEQ ID NO: 3190609 - RNA, 16 nt, Mycobacterium bovis subsp bovis AF2122/97
cguagacccacagucg

SEQ ID NO: 3190610 - RNA, 20 nt, Mycobacterium bovis subsp bovis AF2122/97
cguagacccacagucgccgg

SEQ ID NO: 3190611 - RNA, 23 nt, Mycobacterium bovis subsp bovis AF2122/97
cguagaccgucgauccgucggcg

SEQ ID NO: 3190612 - RNA, 15 nt, Mycobacterium bovis subsp bovis AF2122/97
cguagaccuucuuga

SEQ ID NO: 3190613 - RNA, 23 nt, Mycobacterium bovis subsp bovis AF2122/97
cguagaccuucuugacacccacc

SEQ ID NO: 3190614 - RNA, 23 nt, Mycobacterium bovis subsp bovis AF2122/97
cguagacgacaucgucaucagcg

SEQ ID NO: 3190615 - RNA, 18 nt, Mycobacterium bovis subsp bovis AF2122/97
cguagacgacgucggccg

SEQ ID NO: 3190616 - RNA, 14 nt, Mycobacterium bovis subsp bovis AF2122/97
cguagacgccgagc

SEQ ID NO: 3190617 - RNA, 15 nt, Mycobacterium bovis subsp bovis AF2122/97
cguagacgccgagca

SEQ ID NO: 3190618 - RNA, 16 nt, Mycobacterium bovis subsp bovis AF2122/97
cguagacggggugagc

SEQ ID NO: 3190619 - RNA, 23 nt, Mycobacterium bovis subsp bovis AF2122/97
cguagacgguuaccgcgaagcug

SEQ ID NO: 3190620 - RNA, 20 nt, Mycobacterium bovis subsp bovis AF2122/97
cguagacguagaaugcgccg

SEQ ID NO: 3190621 - RNA, 20 nt, Mycobacterium bovis subsp bovis AF2122/97
cguagacguccgcggucgca

SEQ ID NO: 3190622 - RNA, 21 nt, Mycobacterium bovis subsp bovis AF2122/97
cguagacuuccucggauugca

SEQ ID NO: 3190623 - RNA, 14 nt, Mycobacterium bovis subsp bovis AF2122/97
cguagacuugcugc

SEQ ID NO: 3190624 - RNA, 17 nt, Mycobacterium bovis subsp bovis AF2122/97
cguagagcaugccgccc

SEQ ID NO: 3190625 - RNA, 19 nt, Mycobacterium bovis subsp bovis AF2122/97
cguagagcaugccgcccgc

SEQ ID NO: 3190626 - RNA, 16 nt, Mycobacterium bovis subsp bovis AF2122/97
cguagagccgaucacc

SEQ ID NO: 3190627 - RNA, 17 nt, Mycobacterium bovis subsp bovis AF2122/97
cguagagcuggugcggg

SEQ ID NO: 3190628 - RNA, 22 nt, Mycobacterium bovis subsp bovis AF2122/97
cguagagcuggugcgggacgcc

SEQ ID NO: 3190629 - RNA, 15 nt, Mycobacterium bovis subsp bovis AF2122/97
cguagaggacugcgg

SEQ ID NO: 3190630 - RNA, 15 nt, Mycobacterium bovis subsp bovis AF2122/97
cguagaucaucagcg

SEQ ID NO: 3190631 - RNA, 17 nt, Mycobacterium bovis subsp bovis AF2122/97
cguagaugguggucacc

SEQ ID NO: 3190632 - RNA, 18 nt, Mycobacterium bovis subsp bovis AF2122/97
cguagaugguggucacca

SEQ ID NO: 3190633 - RNA, 23 nt, Mycobacterium bovis subsp bovis AF2122/97
cguagaugguggucaccaccauc

SEQ ID NO: 3190634 - RNA, 23 nt, Mycobacterium bovis subsp bovis AF2122/97
cguagauggugguggcccggcug

SEQ ID NO: 3190635 - RNA, 13 nt, Mycobacterium bovis subsp bovis AF2122/97
cguagauguugcc

SEQ ID NO: 3190636 - RNA, 15 nt, Mycobacterium bovis subsp bovis AF2122/97
cguagcaacccagga

SEQ ID NO: 3190637 - RNA, 15 nt, Mycobacterium bovis subsp bovis AF2122/97
cguagcacaccggug

SEQ ID NO: 3190638 - RNA, 22 nt, Mycobacterium bovis subsp bovis AF2122/97
cguagcacaccgguggacccgg

SEQ ID NO: 3190639 - RNA, 15 nt, Mycobacterium bovis subsp bovis AF2122/97
cguagcagcgccggc

SEQ ID NO: 3190640 - RNA, 15 nt, Mycobacterium bovis subsp bovis AF2122/97
cguagcaggucgacg

SEQ ID NO: 3190641 - RNA, 16 nt, Mycobacterium bovis subsp bovis AF2122/97
cguagcaggucgacgg

SEQ ID NO: 3190642 - RNA, 17 nt, Mycobacterium bovis subsp bovis AF2122/97
cguagcagguguaggug

SEQ ID NO: 3190643 - RNA, 23 nt, Mycobacterium bovis subsp bovis AF2122/97
cguagcaucgggcgagcucgucg

SEQ ID NO: 3190644 - RNA, 14 nt, Mycobacterium bovis subsp bovis AF2122/97
cguagccagcagcg

SEQ ID NO: 3190645 - RNA, 16 nt, Mycobacterium bovis subsp bovis AF2122/97
cguagccagcagcggc

SEQ ID NO: 3190646 - RNA, 13 nt, Mycobacterium bovis subsp bovis AF2122/97
cguagccagcagg

SEQ ID NO: 3190647 - RNA, 14 nt, Mycobacterium bovis subsp bovis AF2122/97
cguagcccacccgg

SEQ ID NO: 3190648 - RNA, 15 nt, Mycobacterium bovis subsp bovis AF2122/97
cguagcccacgacga

SEQ ID NO: 3190649 - RNA, 18 nt, Mycobacterium bovis subsp bovis AF2122/97
cguagcccaggucgaugc

SEQ ID NO: 3190650 - RNA, 22 nt, Mycobacterium bovis subsp bovis AF2122/97
cguagccgagcuugagcgugag

SEQ ID NO: 3190651 - RNA, 15 nt, Mycobacterium bovis subsp bovis AF2122/97
cguagccgccgucgc

SEQ ID NO: 3190652 - RNA, 13 nt, Mycobacterium bovis subsp bovis AF2122/97
cguagccguacgg

SEQ ID NO: 3190653 - RNA, 20 nt, Mycobacterium bovis subsp bovis AF2122/97
cguagcgaagugcgcgcugg

SEQ ID NO: 3190654 - RNA, 17 nt, Mycobacterium bovis subsp bovis AF2122/97
cguagcgaccucgccgc

SEQ ID NO: 3190655 - RNA, 18 nt, Mycobacterium bovis subsp bovis AF2122/97
cguagcgaccucgccgcg

SEQ ID NO: 3190656 - RNA, 12 nt, Mycobacterium bovis subsp bovis AF2122/97
cguagcgcagcg

SEQ ID NO: 3190657 - RNA, 20 nt, Mycobacterium bovis subsp bovis AF2122/97
cguagcgcccaccguagacg

SEQ ID NO: 3190658 - RNA, 23 nt, Mycobacterium bovis subsp bovis AF2122/97
cguagcggcuccgggaugaagcu

SEQ ID NO: 3190659 - RNA, 15 nt, Mycobacterium bovis subsp bovis AF2122/97
cguagcgggggagcg

SEQ ID NO: 3190660 - RNA, 22 nt, Mycobacterium bovis subsp bovis AF2122/97
cguagcgggggagcgaacggcg

SEQ ID NO: 3190661 - RNA, 20 nt, Mycobacterium bovis subsp bovis AF2122/97
cguagcgggucagcucgacc

SEQ ID NO: 3190662 - RNA, 17 nt, Mycobacterium bovis subsp bovis AF2122/97
cguagcggucuccccag

SEQ ID NO: 3190663 - RNA, 14 nt, Mycobacterium bovis subsp bovis AF2122/97
cguagcguccgcgc

SEQ ID NO: 3190664 - RNA, 15 nt, Mycobacterium bovis subsp bovis AF2122/97
cguagcguccgcgcc

SEQ ID NO: 3190665 - RNA, 17 nt, Mycobacterium bovis subsp bovis AF2122/97
cguagcugacggccugc

SEQ ID NO: 3190666 - RNA, 14 nt, Mycobacterium bovis subsp bovis AF2122/97
cguagcugcgcagc

SEQ ID NO: 3190667 - RNA, 15 nt, Mycobacterium bovis subsp bovis AF2122/97
cguagcuggcgaucu

SEQ ID NO: 3190668 - RNA, 17 nt, Mycobacterium bovis subsp bovis AF2122/97
cguagcugggcaccccg

SEQ ID NO: 3190669 - RNA, 17 nt, Mycobacterium bovis subsp bovis AF2122/97
cguagcuucccuccaga

SEQ ID NO: 3190670 - RNA, 18 nt, Mycobacterium bovis subsp bovis AF2122/97
cguagcuucccuccagau

SEQ ID NO: 3190671 - RNA, 14 nt, Mycobacterium bovis subsp bovis AF2122/97
cguagcuuccgguc

SEQ ID NO: 3190672 - RNA, 21 nt, Mycobacterium bovis subsp bovis AF2122/97
cguagcuuccgguccagcggc

SEQ ID NO: 3190673 - RNA, 12 nt, Mycobacterium bovis subsp bovis AF2122/97
cguaggcacccc

SEQ ID NO: 3190674 - RNA, 21 nt, Mycobacterium bovis subsp bovis AF2122/97
cguaggcaccccggugcccgc

SEQ ID NO: 3190675 - RNA, 18 nt, Mycobacterium bovis subsp bovis AF2122/97
cguaggcccaacgacggc

SEQ ID NO: 3190676 - RNA, 23 nt, Mycobacterium bovis subsp bovis AF2122/97
cguaggccuugcucagccggccc

SEQ ID NO: 3190677 - RNA, 14 nt, Mycobacterium bovis subsp bovis AF2122/97
cguaggcgaugagc

SEQ ID NO: 3190678 - RNA, 16 nt, Mycobacterium bovis subsp bovis AF2122/97
cguaggcgauggcggc

SEQ ID NO: 3190679 - RNA, 14 nt, Mycobacterium bovis subsp bovis AF2122/97
cguaggcgccgaac

SEQ ID NO: 3190680 - RNA, 14 nt, Mycobacterium bovis subsp bovis AF2122/97
cguaggcgccguug

SEQ ID NO: 3190681 - RNA, 17 nt, Mycobacterium bovis subsp bovis AF2122/97
cguaggcggcgacccgc

SEQ ID NO: 3190682 - RNA, 13 nt, Mycobacterium bovis subsp bovis AF2122/97
cguaggcggcggc

SEQ ID NO: 3190683 - RNA, 14 nt, Mycobacterium bovis subsp bovis AF2122/97
cguaggcggcggcc

SEQ ID NO: 3190684 - RNA, 14 nt, Mycobacterium bovis subsp bovis AF2122/97
cguagggacgccga

SEQ ID NO: 3190685 - RNA, 18 nt, Mycobacterium bovis subsp bovis AF2122/97
cguagggauagcagugca

SEQ ID NO: 3190686 - RNA, 19 nt, Mycobacterium bovis subsp bovis AF2122/97
cguagggauagcagugcag

SEQ ID NO: 3190687 - RNA, 21 nt, Mycobacterium bovis subsp bovis AF2122/97
cguagggauagcagugcagca

SEQ ID NO: 3190688 - RNA, 22 nt, Mycobacterium bovis subsp bovis AF2122/97
cguagggauagcagugcagcaa

SEQ ID NO: 3190689 - RNA, 14 nt, Mycobacterium bovis subsp bovis AF2122/97
cguagggcagcgcc

SEQ ID NO: 3190690 - RNA, 23 nt, Mycobacterium bovis subsp bovis AF2122/97
cguagggcuguccgaccucgccg

SEQ ID NO: 3190691 - RNA, 15 nt, Mycobacterium bovis subsp bovis AF2122/97
cguaggguggccgac

SEQ ID NO: 3190692 - RNA, 15 nt, Mycobacterium bovis subsp bovis AF2122/97
cguaggguggccggu

SEQ ID NO: 3190693 - RNA, 12 nt, Mycobacterium bovis subsp bovis AF2122/97
cguagggugggu

SEQ ID NO: 3190694 - RNA, 18 nt, Mycobacterium bovis subsp bovis AF2122/97
cguagguccuugucggcc

SEQ ID NO: 3190695 - RNA, 16 nt, Mycobacterium bovis subsp bovis AF2122/97
cguagguggccagcgc

SEQ ID NO: 3190696 - RNA, 16 nt, Mycobacterium bovis subsp bovis AF2122/97
cguagguggccggcuu

SEQ ID NO: 3190697 - RNA, 16 nt, Mycobacterium bovis subsp bovis AF2122/97
cguagguugcgccccg

SEQ ID NO: 3190698 - RNA, 20 nt, Mycobacterium bovis subsp bovis AF2122/97
cguaguaaggagccgggccg

SEQ ID NO: 3190699 - RNA, 17 nt, Mycobacterium bovis subsp bovis AF2122/97
cguaguaaugcucgacg

SEQ ID NO: 3190700 - RNA, 15 nt, Mycobacterium bovis subsp bovis AF2122/97
cguaguaggcgccgc

SEQ ID NO: 3190701 - RNA, 17 nt, Mycobacterium bovis subsp bovis AF2122/97
cguaguaggcgccgcga

SEQ ID NO: 3190702 - RNA, 17 nt, Mycobacterium bovis subsp bovis AF2122/97
cguaguaguggccgcca

SEQ ID NO: 3190703 - RNA, 23 nt, Mycobacterium bovis subsp bovis AF2122/97
cguaguaguggccgccacccgca

SEQ ID NO: 3190704 - RNA, 21 nt, Mycobacterium bovis subsp bovis AF2122/97
cguaguaguucagccaggccg

SEQ ID NO: 3190705 - RNA, 13 nt, Mycobacterium bovis subsp bovis AF2122/97
cguaguccaggcc

SEQ ID NO: 3190706 - RNA, 20 nt, Mycobacterium bovis subsp bovis AF2122/97
cguaguccaggccgucguug

SEQ ID NO: 3190707 - RNA, 15 nt, Mycobacterium bovis subsp bovis AF2122/97
cguagucgcugucgg

SEQ ID NO: 3190708 - RNA, 14 nt, Mycobacterium bovis subsp bovis AF2122/97
cguagucggcaucg

SEQ ID NO: 3190709 - RNA, 21 nt, Mycobacterium bovis subsp bovis AF2122/97
cguagucggcgaugcgcacca

SEQ ID NO: 3190710 - RNA, 12 nt, Mycobacterium bovis subsp bovis AF2122/97
cguagucggcgg

SEQ ID NO: 3190711 - RNA, 19 nt, Mycobacterium bovis subsp bovis AF2122/97
cguagugaacggcucgggc

SEQ ID NO: 3190712 - RNA, 20 nt, Mycobacterium bovis subsp bovis AF2122/97
cguagugcacgucggcgggc

SEQ ID NO: 3190713 - RNA, 13 nt, Mycobacterium bovis subsp bovis AF2122/97
cguagugcgcgcc

SEQ ID NO: 3190714 - RNA, 14 nt, Mycobacterium bovis subsp bovis AF2122/97
cguagugcgcgcca

SEQ ID NO: 3190715 - RNA, 16 nt, Mycobacterium bovis subsp bovis AF2122/97
cguagugcucgccggc

SEQ ID NO: 3190716 - RNA, 17 nt, Mycobacterium bovis subsp bovis AF2122/97
cguagugcucgccggca

SEQ ID NO: 3190717 - RNA, 14 nt, Mycobacterium bovis subsp bovis AF2122/97
cguaguggccggcu

SEQ ID NO: 3190718 - RNA, 15 nt, Mycobacterium bovis subsp bovis AF2122/97
cguaguggccggcuu

SEQ ID NO: 3190719 - RNA, 14 nt, Mycobacterium bovis subsp bovis AF2122/97
cguagugucggcgu

SEQ ID NO: 3190720 - RNA, 19 nt, Mycobacterium bovis subsp bovis AF2122/97
cguauagcaugccgcggcg

SEQ ID NO: 3190721 - RNA, 17 nt, Mycobacterium bovis subsp bovis AF2122/97
cguauaggcccgggcgg

SEQ ID NO: 3190722 - RNA, 17 nt, Mycobacterium bovis subsp bovis AF2122/97
cguauaggucagaauug

SEQ ID NO: 3190723 - RNA, 23 nt, Mycobacterium bovis subsp bovis AF2122/97
cguauaggucagaauugugugca

SEQ ID NO: 3190724 - RNA, 19 nt, Mycobacterium bovis subsp bovis AF2122/97
cguaucacgguugccgcga

SEQ ID NO: 3190725 - RNA, 20 nt, Mycobacterium bovis subsp bovis AF2122/97
cguaucacgguugccgcgau

SEQ ID NO: 3190726 - RNA, 23 nt, Mycobacterium bovis subsp bovis AF2122/97
cguaucacgguugccgcgaucgg

SEQ ID NO: 3190727 - RNA, 14 nt, Mycobacterium bovis subsp bovis AF2122/97
cguauccacggucg

SEQ ID NO: 3190728 - RNA, 13 nt, Mycobacterium bovis subsp bovis AF2122/97
cguaucccagaua

SEQ ID NO: 3190729 - RNA, 16 nt, Mycobacterium bovis subsp bovis AF2122/97
cguaucccgugugcgg

SEQ ID NO: 3190730 - RNA, 19 nt, Mycobacterium bovis subsp bovis AF2122/97
cguaucggggcaccacgcc

SEQ ID NO: 3190731 - RNA, 18 nt, Mycobacterium bovis subsp bovis AF2122/97
cguaucgucgagcaccuu

SEQ ID NO: 3190732 - RNA, 16 nt, Mycobacterium bovis subsp bovis AF2122/97
cguaugacgcccaccg

SEQ ID NO: 3190733 - RNA, 18 nt, Mycobacterium bovis subsp bovis AF2122/97
cguaugauucacgcucgg

SEQ ID NO: 3190734 - RNA, 22 nt, Mycobacterium bovis subsp bovis AF2122/97
cguaugccaggacuggcaccgc

SEQ ID NO: 3190735 - RNA, 17 nt, Mycobacterium bovis subsp bovis AF2122/97
cguaugccgccaaccgc

SEQ ID NO: 3190736 - RNA, 17 nt, Mycobacterium bovis subsp bovis AF2122/97
cguaugccguggccgcc

SEQ ID NO: 3190737 - RNA, 20 nt, Mycobacterium bovis subsp bovis AF2122/97
cguauggcggcuccaacgau

SEQ ID NO: 3190738 - RNA, 14 nt, Mycobacterium bovis subsp bovis AF2122/97
cguauggcggucgg

SEQ ID NO: 3190739 - RNA, 15 nt, Mycobacterium bovis subsp bovis AF2122/97
cguauucggccgcga

SEQ ID NO: 3190740 - RNA, 16 nt, Mycobacterium bovis subsp bovis AF2122/97
cguauucggccgcgag

SEQ ID NO: 3190741 - RNA, 17 nt, Mycobacterium bovis subsp bovis AF2122/97
cguauugauacugcccg

SEQ ID NO: 3190742 - RNA, 15 nt, Mycobacterium bovis subsp bovis AF2122/97
cguauugccaaagcc

SEQ ID NO: 3190743 - RNA, 15 nt, Mycobacterium bovis subsp bovis AF2122/97
cguauugcggccugu

SEQ ID NO: 3190744 - RNA, 17 nt, Mycobacterium bovis subsp bovis AF2122/97
cguauuggacgcugccg

SEQ ID NO: 3190745 - RNA, 22 nt, Mycobacterium bovis subsp bovis AF2122/97
cgucaaacgcaaagacagcgcg

SEQ ID NO: 3190746 - RNA, 23 nt, Mycobacterium bovis subsp bovis AF2122/97
cgucaaacgcaaagacagcgcgg

SEQ ID NO: 3190747 - RNA, 17 nt, Mycobacterium bovis subsp bovis AF2122/97
cgucaaccacggccgcc

SEQ ID NO: 3190748 - RNA, 19 nt, Mycobacterium bovis subsp bovis AF2122/97
cgucaaccagggugccggc

SEQ ID NO: 3190749 - RNA, 15 nt, Mycobacterium bovis subsp bovis AF2122/97
cgucaacccgguguc

SEQ ID NO: 3190750 - RNA, 19 nt, Mycobacterium bovis subsp bovis AF2122/97
cgucaaccgaucggucguc

SEQ ID NO: 3190751 - RNA, 15 nt, Mycobacterium bovis subsp bovis AF2122/97
cgucaaccugcugca

SEQ ID NO: 3190752 - RNA, 14 nt, Mycobacterium bovis subsp bovis AF2122/97
cgucaacgauggug

SEQ ID NO: 3190753 - RNA, 20 nt, Mycobacterium bovis subsp bovis AF2122/97
cgucaacgccucugcucagc

SEQ ID NO: 3190754 - RNA, 19 nt, Mycobacterium bovis subsp bovis AF2122/97
cgucaacuugggcccgcug

SEQ ID NO: 3190755 - RNA, 17 nt, Mycobacterium bovis subsp bovis AF2122/97
cgucaagaacgccacga

SEQ ID NO: 3190756 - RNA, 20 nt, Mycobacterium bovis subsp bovis AF2122/97
cgucaagagugcucagcgcg

SEQ ID NO: 3190757 - RNA, 24 nt, Mycobacterium bovis subsp bovis AF2122/97
cgucaagcacacuggccacaaucg

SEQ ID NO: 3190758 - RNA, 19 nt, Mycobacterium bovis subsp bovis AF2122/97
cgucaagccacacccggcg

SEQ ID NO: 3190759 - RNA, 15 nt, Mycobacterium bovis subsp bovis AF2122/97
cgucaagccgggcac

SEQ ID NO: 3190760 - RNA, 15 nt, Mycobacterium bovis subsp bovis AF2122/97
cgucaaggaaggcgu

SEQ ID NO: 3190761 - RNA, 23 nt, Mycobacterium bovis subsp bovis AF2122/97
cgucaaguccuucacugcgaccg

SEQ ID NO: 3190762 - RNA, 19 nt, Mycobacterium bovis subsp bovis AF2122/97
cgucaagucugugcucacg

SEQ ID NO: 3190763 - RNA, 15 nt, Mycobacterium bovis subsp bovis AF2122/97
cgucaaucaccaccg

SEQ ID NO: 3190764 - RNA, 17 nt, Mycobacterium bovis subsp bovis AF2122/97
cgucaaucaccaccgcc

SEQ ID NO: 3190765 - RNA, 18 nt, Mycobacterium bovis subsp bovis AF2122/97
cgucaaucaccaccgcca

SEQ ID NO: 3190766 - RNA, 19 nt, Mycobacterium bovis subsp bovis AF2122/97
cgucaaucaccaccgccag

SEQ ID NO: 3190767 - RNA, 20 nt, Mycobacterium bovis subsp bovis AF2122/97
cgucaaucaccaccgccagc

SEQ ID NO: 3190768 - RNA, 16 nt, Mycobacterium bovis subsp bovis AF2122/97
cgucacaagcugacac

SEQ ID NO: 3190769 - RNA, 20 nt, Mycobacterium bovis subsp bovis AF2122/97
cgucacaagucgacacgccg

SEQ ID NO: 3190770 - RNA, 22 nt, Mycobacterium bovis subsp bovis AF2122/97
cgucacaaugcccaggcucgca

SEQ ID NO: 3190771 - RNA, 15 nt, Mycobacterium bovis subsp bovis AF2122/97
cgucacaccagcggg

SEQ ID NO: 3190772 - RNA, 19 nt, Mycobacterium bovis subsp bovis AF2122/97
cgucacagccggguuuggu

SEQ ID NO: 3190773 - RNA, 16 nt, Mycobacterium bovis subsp bovis AF2122/97
cgucacauccgacagc

SEQ ID NO: 3190774 - RNA, 17 nt, Mycobacterium bovis subsp bovis AF2122/97
cgucacauugccaccgu

SEQ ID NO: 3190775 - RNA, 18 nt, Mycobacterium bovis subsp bovis AF2122/97
cgucaccaaguucagcac

SEQ ID NO: 3190776 - RNA, 13 nt, Mycobacterium bovis subsp bovis AF2122/97
cgucaccaccgcc

SEQ ID NO: 3190777 - RNA, 14 nt, Mycobacterium bovis subsp bovis AF2122/97
cgucaccaccgccg

SEQ ID NO: 3190778 - RNA, 14 nt, Mycobacterium bovis subsp bovis AF2122/97
cgucaccacgaucg

SEQ ID NO: 3190779 - RNA, 20 nt, Mycobacterium bovis subsp bovis AF2122/97
cgucaccaucgggucgucgg

SEQ ID NO: 3190780 - RNA, 13 nt, Mycobacterium bovis subsp bovis AF2122/97
cgucacccggggc

SEQ ID NO: 3190781 - RNA, 18 nt, Mycobacterium bovis subsp bovis AF2122/97
cgucacccugucgcgcac

SEQ ID NO: 3190782 - RNA, 13 nt, Mycobacterium bovis subsp bovis AF2122/97
cgucaccgaucga

SEQ ID NO: 3190783 - RNA, 18 nt, Mycobacterium bovis subsp bovis AF2122/97
cgucaccgaugcgccgga

SEQ ID NO: 3190784 - RNA, 13 nt, Mycobacterium bovis subsp bovis AF2122/97
cgucaccgccgac

SEQ ID NO: 3190785 - RNA, 13 nt, Mycobacterium bovis subsp bovis AF2122/97
cgucaccgccggc

SEQ ID NO: 3190786 - RNA, 18 nt, Mycobacterium bovis subsp bovis AF2122/97
cgucaccgccggcaccgc

SEQ ID NO: 3190787 - RNA, 13 nt, Mycobacterium bovis subsp bovis AF2122/97
cgucaccgccguc

SEQ ID NO: 3190788 - RNA, 13 nt, Mycobacterium bovis subsp bovis AF2122/97
cgucaccgccguu

SEQ ID NO: 3190789 - RNA, 19 nt, Mycobacterium bovis subsp bovis AF2122/97
cgucaccgccguugccgcc

SEQ ID NO: 3190790 - RNA, 21 nt, Mycobacterium bovis subsp bovis AF2122/97
cgucaccgccguugccgccgg

SEQ ID NO: 3190791 - RNA, 24 nt, Mycobacterium bovis subsp bovis AF2122/97
cgucaccgccguugccgccggcgc

SEQ ID NO: 3190792 - RNA, 20 nt, Mycobacterium bovis subsp bovis AF2122/97
cgucaccgcgaccagccagc

SEQ ID NO: 3190793 - RNA, 15 nt, Mycobacterium bovis subsp bovis AF2122/97
cgucaccgcgacccc

SEQ ID NO: 3190794 - RNA, 17 nt, Mycobacterium bovis subsp bovis AF2122/97
cgucaccgcgacggaac

SEQ ID NO: 3190795 - RNA, 16 nt, Mycobacterium bovis subsp bovis AF2122/97
cgucaccggaaucccc

SEQ ID NO: 3190796 - RNA, 16 nt, Mycobacterium bovis subsp bovis AF2122/97
cgucaccggaggccgc

SEQ ID NO: 3190797 - RNA, 17 nt, Mycobacterium bovis subsp bovis AF2122/97
cgucaccggaggccgcc

SEQ ID NO: 3190798 - RNA, 23 nt, Mycobacterium bovis subsp bovis AF2122/97
cgucaccggguccggugaacccg

SEQ ID NO: 3190799 - RNA, 15 nt, Mycobacterium bovis subsp bovis AF2122/97
cgucaccggucagcg

SEQ ID NO: 3190800 - RNA, 23 nt, Mycobacterium bovis subsp bovis AF2122/97
cgucaccggucagcgacgcacgc

SEQ ID NO: 3190801 - RNA, 17 nt, Mycobacterium bovis subsp bovis AF2122/97
cgucaccgucuugcacg

SEQ ID NO: 3190802 - RNA, 21 nt, Mycobacterium bovis subsp bovis AF2122/97
cgucaccgugggccugcccgg

SEQ ID NO: 3190803 - RNA, 22 nt, Mycobacterium bovis subsp bovis AF2122/97
cgucaccguuguucccauagcc

SEQ ID NO: 3190804 - RNA, 15 nt, Mycobacterium bovis subsp bovis AF2122/97
cgucaccuugacgcc

SEQ ID NO: 3190805 - RNA, 18 nt, Mycobacterium bovis subsp bovis AF2122/97
cgucacgaucgugccggg

SEQ ID NO: 3190806 - RNA, 12 nt, Mycobacterium bovis subsp bovis AF2122/97
cgucacgcaacc

SEQ ID NO: 3190807 - RNA, 14 nt, Mycobacterium bovis subsp bovis AF2122/97
cgucacgcaaccgg

SEQ ID NO: 3190808 - RNA, 16 nt, Mycobacterium bovis subsp bovis AF2122/97
cgucacgcaaccggcg

SEQ ID NO: 3190809 - RNA, 17 nt, Mycobacterium bovis subsp bovis AF2122/97
cgucacgcaaccggcgg

SEQ ID NO: 3190810 - RNA, 18 nt, Mycobacterium bovis subsp bovis AF2122/97
cgucacgcaaccggcgga

SEQ ID NO: 3190811 - RNA, 20 nt, Mycobacterium bovis subsp bovis AF2122/97
cgucacgcaaccggcggaca

SEQ ID NO: 3190812 - RNA, 14 nt, Mycobacterium bovis subsp bovis AF2122/97
cgucacgccaccgc

SEQ ID NO: 3190813 - RNA, 15 nt, Mycobacterium bovis subsp bovis AF2122/97
cgucacgccaccgca

SEQ ID NO: 3190814 - RNA, 22 nt, Mycobacterium bovis subsp bovis AF2122/97
cgucacgccggauggucggcca

SEQ ID NO: 3190815 - RNA, 14 nt, Mycobacterium bovis subsp bovis AF2122/97
cgucacgcgcggcg

SEQ ID NO: 3190816 - RNA, 17 nt, Mycobacterium bovis subsp bovis AF2122/97
cgucacgcgcggcggcg

SEQ ID NO: 3190817 - RNA, 14 nt, Mycobacterium bovis subsp bovis AF2122/97
cgucacgcguacgu

SEQ ID NO: 3190818 - RNA, 16 nt, Mycobacterium bovis subsp bovis AF2122/97
cgucacggaccgccac

SEQ ID NO: 3190819 - RNA, 21 nt, Mycobacterium bovis subsp bovis AF2122/97
cgucacggaccgccaccuugg

SEQ ID NO: 3190820 - RNA, 14 nt, Mycobacterium bovis subsp bovis AF2122/97
cgucacgggcguug

SEQ ID NO: 3190821 - RNA, 22 nt, Mycobacterium bovis subsp bovis AF2122/97
cgucacgucgacggcggccgcc

SEQ ID NO: 3190822 - RNA, 17 nt, Mycobacterium bovis subsp bovis AF2122/97
cgucacguggucggcca

SEQ ID NO: 3190823 - RNA, 20 nt, Mycobacterium bovis subsp bovis AF2122/97
cgucacguggucggccaccc

SEQ ID NO: 3190824 - RNA, 15 nt, Mycobacterium bovis subsp bovis AF2122/97
cgucacucaccccaa

SEQ ID NO: 3190825 - RNA, 13 nt, Mycobacterium bovis subsp bovis AF2122/97
cgucacucccgac

SEQ ID NO: 3190826 - RNA, 17 nt, Mycobacterium bovis subsp bovis AF2122/97
cgucacucccuggccgc

SEQ ID NO: 3190827 - RNA, 14 nt, Mycobacterium bovis subsp bovis AF2122/97
cgucacugccaccu

SEQ ID NO: 3190828 - RNA, 14 nt, Mycobacterium bovis subsp bovis AF2122/97
cgucagaacaccgg

SEQ ID NO: 3190829 - RNA, 20 nt, Mycobacterium bovis subsp bovis AF2122/97
cgucagaccauccagguuga

SEQ ID NO: 3190830 - RNA, 14 nt, Mycobacterium bovis subsp bovis AF2122/97
cgucagcaccaucc

SEQ ID NO: 3190831 - RNA, 14 nt, Mycobacterium bovis subsp bovis AF2122/97
cgucagcaccgcua

SEQ ID NO: 3190832 - RNA, 14 nt, Mycobacterium bovis subsp bovis AF2122/97
cgucagcagcaacg

SEQ ID NO: 3190833 - RNA, 22 nt, Mycobacterium bovis subsp bovis AF2122/97
cgucagcaugggaauccgcugu

SEQ ID NO: 3190834 - RNA, 13 nt, Mycobacterium bovis subsp bovis AF2122/97
cgucagcccaggu

SEQ ID NO: 3190835 - RNA, 12 nt, Mycobacterium bovis subsp bovis AF2122/97
cgucagccccga

SEQ ID NO: 3190836 - RNA, 21 nt, Mycobacterium bovis subsp bovis AF2122/97
cgucagccccgacugcgccca

SEQ ID NO: 3190837 - RNA, 20 nt, Mycobacterium bovis subsp bovis AF2122/97
cgucagcccgauacgggugu

SEQ ID NO: 3190838 - RNA, 16 nt, Mycobacterium bovis subsp bovis AF2122/97
cgucagccgcaccccg

SEQ ID NO: 3190839 - RNA, 14 nt, Mycobacterium bovis subsp bovis AF2122/97
cgucagccguucgg

SEQ ID NO: 3190840 - RNA, 17 nt, Mycobacterium bovis subsp bovis AF2122/97
cgucagccguucggcua

SEQ ID NO: 3190841 - RNA, 22 nt, Mycobacterium bovis subsp bovis AF2122/97
cgucagccguucggcuaagccu

SEQ ID NO: 3190842 - RNA, 12 nt, Mycobacterium bovis subsp bovis AF2122/97
cgucagcgccgc

SEQ ID NO: 3190843 - RNA, 13 nt, Mycobacterium bovis subsp bovis AF2122/97
cgucagcgccgcc

SEQ ID NO: 3190844 - RNA, 14 nt, Mycobacterium bovis subsp bovis AF2122/97
cgucagcgccgccg

SEQ ID NO: 3190845 - RNA, 23 nt, Mycobacterium bovis subsp bovis AF2122/97
cgucagcgccgccggaagcgccg

SEQ ID NO: 3190846 - RNA, 14 nt, Mycobacterium bovis subsp bovis AF2122/97
cgucagcgccgcgc

SEQ ID NO: 3190847 - RNA, 16 nt, Mycobacterium bovis subsp bovis AF2122/97
cgucagcgccgcgcgc

SEQ ID NO: 3190848 - RNA, 18 nt, Mycobacterium bovis subsp bovis AF2122/97
cgucagcgccgcgcgcgc

SEQ ID NO: 3190849 - RNA, 14 nt, Mycobacterium bovis subsp bovis AF2122/97
cgucagcgccgcug

SEQ ID NO: 3190850 - RNA, 15 nt, Mycobacterium bovis subsp bovis AF2122/97
cgucagcgccgcuga

SEQ ID NO: 3190851 - RNA, 17 nt, Mycobacterium bovis subsp bovis AF2122/97
cgucagcgcgccgucgg

SEQ ID NO: 3190852 - RNA, 18 nt, Mycobacterium bovis subsp bovis AF2122/97
cgucagcggcgagcagag

SEQ ID NO: 3190853 - RNA, 14 nt, Mycobacterium bovis subsp bovis AF2122/97
cgucagcggcggcc

SEQ ID NO: 3190854 - RNA, 17 nt, Mycobacterium bovis subsp bovis AF2122/97
cgucagcggcggccacg

SEQ ID NO: 3190855 - RNA, 17 nt, Mycobacterium bovis subsp bovis AF2122/97
cgucagcgggcagcagg

SEQ ID NO: 3190856 - RNA, 22 nt, Mycobacterium bovis subsp bovis AF2122/97
cgucagcgucggcgcaucacca

SEQ ID NO: 3190857 - RNA, 18 nt, Mycobacterium bovis subsp bovis AF2122/97
cgucagcgucucucgcag

SEQ ID NO: 3190858 - RNA, 21 nt, Mycobacterium bovis subsp bovis AF2122/97
cgucagcgucucucgcagcuc

SEQ ID NO: 3190859 - RNA, 13 nt, Mycobacterium bovis subsp bovis AF2122/97
cgucagcgucuga

SEQ ID NO: 3190860 - RNA, 18 nt, Mycobacterium bovis subsp bovis AF2122/97
cgucagcgucugagcgcc

SEQ ID NO: 3190861 - RNA, 16 nt, Mycobacterium bovis subsp bovis AF2122/97
cgucagcuccccgucg

SEQ ID NO: 3190862 - RNA, 20 nt, Mycobacterium bovis subsp bovis AF2122/97
cgucagcuccccgucgggga

SEQ ID NO: 3190863 - RNA, 21 nt, Mycobacterium bovis subsp bovis AF2122/97
cgucagcuuggacccugcgcc

SEQ ID NO: 3190864 - RNA, 22 nt, Mycobacterium bovis subsp bovis AF2122/97
cgucagcuuggacccugcgccg

SEQ ID NO: 3190865 - RNA, 23 nt, Mycobacterium bovis subsp bovis AF2122/97
cgucagcuuggacccugcgccgc

SEQ ID NO: 3190866 - RNA, 15 nt, Mycobacterium bovis subsp bovis AF2122/97
cgucaggaaccaccc

SEQ ID NO: 3190867 - RNA, 16 nt, Mycobacterium bovis subsp bovis AF2122/97
cgucaggaaccaccca

SEQ ID NO: 3190868 - RNA, 18 nt, Mycobacterium bovis subsp bovis AF2122/97
cgucaggaaccacccacc

SEQ ID NO: 3190869 - RNA, 21 nt, Mycobacterium bovis subsp bovis AF2122/97
cgucaggaaccacccaccggc

SEQ ID NO: 3190870 - RNA, 22 nt, Mycobacterium bovis subsp bovis AF2122/97
cgucaggaaccacccaccggcc

SEQ ID NO: 3190871 - RNA, 20 nt, Mycobacterium bovis subsp bovis AF2122/97
cgucaggcacaacgcgacgc

SEQ ID NO: 3190872 - RNA, 20 nt, Mycobacterium bovis subsp bovis AF2122/97
cgucaggcagcuccgccgcc

SEQ ID NO: 3190873 - RNA, 22 nt, Mycobacterium bovis subsp bovis AF2122/97
cgucaggcagcuccgccgccga

SEQ ID NO: 3190874 - RNA, 17 nt, Mycobacterium bovis subsp bovis AF2122/97
cgucaggccagagucgc

SEQ ID NO: 3190875 - RNA, 19 nt, Mycobacterium bovis subsp bovis AF2122/97
cgucaggccagagucgccc

SEQ ID NO: 3190876 - RNA, 14 nt, Mycobacterium bovis subsp bovis AF2122/97
cgucaggccagcgc

SEQ ID NO: 3190877 - RNA, 19 nt, Mycobacterium bovis subsp bovis AF2122/97
cgucaggcccauggcagcc

SEQ ID NO: 3190878 - RNA, 18 nt, Mycobacterium bovis subsp bovis AF2122/97
cgucaggcccucgggugu

SEQ ID NO: 3190879 - RNA, 20 nt, Mycobacterium bovis subsp bovis AF2122/97
cgucaggguauccacgccgg

SEQ ID NO: 3190880 - RNA, 23 nt, Mycobacterium bovis subsp bovis AF2122/97
cgucaggguauccacgccgggca

SEQ ID NO: 3190881 - RNA, 15 nt, Mycobacterium bovis subsp bovis AF2122/97
cgucaggugcgcgac

SEQ ID NO: 3190882 - RNA, 17 nt, Mycobacterium bovis subsp bovis AF2122/97
cgucagguggccaaugc

SEQ ID NO: 3190883 - RNA, 19 nt, Mycobacterium bovis subsp bovis AF2122/97
cgucagguggccaaugccu

SEQ ID NO: 3190884 - RNA, 18 nt, Mycobacterium bovis subsp bovis AF2122/97
cgucagguuccgcgacaa

SEQ ID NO: 3190885 - RNA, 20 nt, Mycobacterium bovis subsp bovis AF2122/97
cgucagguucuaccaaaucg

SEQ ID NO: 3190886 - RNA, 23 nt, Mycobacterium bovis subsp bovis AF2122/97
cgucagguucuaccaaaucgaca

SEQ ID NO: 3190887 - RNA, 15 nt, Mycobacterium bovis subsp bovis AF2122/97
cgucaguagccacgc

SEQ ID NO: 3190888 - RNA, 16 nt, Mycobacterium bovis subsp bovis AF2122/97
cgucaguagccacgcc

SEQ ID NO: 3190889 - RNA, 14 nt, Mycobacterium bovis subsp bovis AF2122/97
cgucagugccccgc

SEQ ID NO: 3190890 - RNA, 15 nt, Mycobacterium bovis subsp bovis AF2122/97
cgucagugccccgca

SEQ ID NO: 3190891 - RNA, 17 nt, Mycobacterium bovis subsp bovis AF2122/97
cgucagugccccgcagc

SEQ ID NO: 3190892 - RNA, 18 nt, Mycobacterium bovis subsp bovis AF2122/97
cgucagugccccgcagca

SEQ ID NO: 3190893 - RNA, 19 nt, Mycobacterium bovis subsp bovis AF2122/97
cgucagugccccgcagcac

SEQ ID NO: 3190894 - RNA, 16 nt, Mycobacterium bovis subsp bovis AF2122/97
cgucaguucggugugc

SEQ ID NO: 3190895 - RNA, 19 nt, Mycobacterium bovis subsp bovis AF2122/97
cgucaguucggugugcggc

SEQ ID NO: 3190896 - RNA, 21 nt, Mycobacterium bovis subsp bovis AF2122/97
cgucaguucggugugcggcgc

SEQ ID NO: 3190897 - RNA, 22 nt, Mycobacterium bovis subsp bovis AF2122/97
cgucaguucggugugcggcgca

SEQ ID NO: 3190898 - RNA, 13 nt, Mycobacterium bovis subsp bovis AF2122/97
cgucaguugagaa

SEQ ID NO: 3190899 - RNA, 13 nt, Mycobacterium bovis subsp bovis AF2122/97
cgucauacccagc

SEQ ID NO: 3190900 - RNA, 18 nt, Mycobacterium bovis subsp bovis AF2122/97
cgucauacucgacaccga

SEQ ID NO: 3190901 - RNA, 16 nt, Mycobacterium bovis subsp bovis AF2122/97
cgucaucaggucgucg

SEQ ID NO: 3190902 - RNA, 15 nt, Mycobacterium bovis subsp bovis AF2122/97
cgucauccaaccgug

SEQ ID NO: 3190903 - RNA, 14 nt, Mycobacterium bovis subsp bovis AF2122/97
cgucauccauccgg

SEQ ID NO: 3190904 - RNA, 20 nt, Mycobacterium bovis subsp bovis AF2122/97
cgucauccauccgggccgcg

SEQ ID NO: 3190905 - RNA, 23 nt, Mycobacterium bovis subsp bovis AF2122/97
cgucauccauccgggccgcggcc

SEQ ID NO: 3190906 - RNA, 22 nt, Mycobacterium bovis subsp bovis AF2122/97
cgucaucccgauguaccccagc

SEQ ID NO: 3190907 - RNA, 15 nt, Mycobacterium bovis subsp bovis AF2122/97
cgucaucgacgagcg

SEQ ID NO: 3190908 - RNA, 17 nt, Mycobacterium bovis subsp bovis AF2122/97
cgucaucgacgagcgau

SEQ ID NO: 3190909 - RNA, 15 nt, Mycobacterium bovis subsp bovis AF2122/97
cgucaucgcagcaca

SEQ ID NO: 3190910 - RNA, 17 nt, Mycobacterium bovis subsp bovis AF2122/97
cgucaucgccggguagc

SEQ ID NO: 3190911 - RNA, 16 nt, Mycobacterium bovis subsp bovis AF2122/97
cgucaucgcggugugc

SEQ ID NO: 3190912 - RNA, 19 nt, Mycobacterium bovis subsp bovis AF2122/97
cgucaucgcguagugaugg

SEQ ID NO: 3190913 - RNA, 20 nt, Mycobacterium bovis subsp bovis AF2122/97
cgucaucgcguagugauggc

SEQ ID NO: 3190914 - RNA, 16 nt, Mycobacterium bovis subsp bovis AF2122/97
cgucaucggcuggccg

SEQ ID NO: 3190915 - RNA, 20 nt, Mycobacterium bovis subsp bovis AF2122/97
cgucaucggcuggccgcgcc

SEQ ID NO: 3190916 - RNA, 16 nt, Mycobacterium bovis subsp bovis AF2122/97
cgucaugaacgaucgg

SEQ ID NO: 3190917 - RNA, 20 nt, Mycobacterium bovis subsp bovis AF2122/97
cgucaugaacgaucggacca

SEQ ID NO: 3190918 - RNA, 23 nt, Mycobacterium bovis subsp bovis AF2122/97
cgucaugcagggaauagcggcgc

SEQ ID NO: 3190919 - RNA, 20 nt, Mycobacterium bovis subsp bovis AF2122/97
cgucaugccagucgccgaaa

SEQ ID NO: 3190920 - RNA, 13 nt, Mycobacterium bovis subsp bovis AF2122/97
cgucaugcccacc

SEQ ID NO: 3190921 - RNA, 15 nt, Mycobacterium bovis subsp bovis AF2122/97
cgucaugcccaccgc

SEQ ID NO: 3190922 - RNA, 16 nt, Mycobacterium bovis subsp bovis AF2122/97
cgucaugcccaccgcc

SEQ ID NO: 3190923 - RNA, 14 nt, Mycobacterium bovis subsp bovis AF2122/97
cgucaugcccaggu

SEQ ID NO: 3190924 - RNA, 22 nt, Mycobacterium bovis subsp bovis AF2122/97
cgucaugcccaggugcguccag

SEQ ID NO: 3190925 - RNA, 18 nt, Mycobacterium bovis subsp bovis AF2122/97
cgucaugcccaucuccaa

SEQ ID NO: 3190926 - RNA, 22 nt, Mycobacterium bovis subsp bovis AF2122/97
cgucaugcccaucuccaacagg

SEQ ID NO: 3190927 - RNA, 22 nt, Mycobacterium bovis subsp bovis AF2122/97
cgucaugcccugcccgaaggug

SEQ ID NO: 3190928 - RNA, 20 nt, Mycobacterium bovis subsp bovis AF2122/97
cgucauggcccgaucgaccg

SEQ ID NO: 3190929 - RNA, 21 nt, Mycobacterium bovis subsp bovis AF2122/97
cgucauggcccgaucgaccgc

SEQ ID NO: 3190930 - RNA, 13 nt, Mycobacterium bovis subsp bovis AF2122/97
cgucauggccggc

SEQ ID NO: 3190931 - RNA, 14 nt, Mycobacterium bovis subsp bovis AF2122/97
cgucauggccggcc

SEQ ID NO: 3190932 - RNA, 21 nt, Mycobacterium bovis subsp bovis AF2122/97
cgucauggcgaaccgucagcg

SEQ ID NO: 3190933 - RNA, 20 nt, Mycobacterium bovis subsp bovis AF2122/97
cguccaaaccuucaacaacg

SEQ ID NO: 3190934 - RNA, 16 nt, Mycobacterium bovis subsp bovis AF2122/97
cguccaacagcgcucg

SEQ ID NO: 3190935 - RNA, 23 nt, Mycobacterium bovis subsp bovis AF2122/97
cguccaaccaaggacgaacgcgc

SEQ ID NO: 3190936 - RNA, 11 nt, Mycobacterium bovis subsp bovis AF2122/97
cguccaaccca

SEQ ID NO: 3190937 - RNA, 18 nt, Mycobacterium bovis subsp bovis AF2122/97
cguccaacuacgccagcc

SEQ ID NO: 3190938 - RNA, 21 nt, Mycobacterium bovis subsp bovis AF2122/97
cguccaacuacgccagccgcg

SEQ ID NO: 3190939 - RNA, 17 nt, Mycobacterium bovis subsp bovis AF2122/97
cguccaacucggcccgg

SEQ ID NO: 3190940 - RNA, 20 nt, Mycobacterium bovis subsp bovis AF2122/97
cguccaagaacggaugccgg

SEQ ID NO: 3190941 - RNA, 15 nt, Mycobacterium bovis subsp bovis AF2122/97
cguccaagccggcca

SEQ ID NO: 3190942 - RNA, 21 nt, Mycobacterium bovis subsp bovis AF2122/97
cguccaagccguagaccaggc

SEQ ID NO: 3190943 - RNA, 16 nt, Mycobacterium bovis subsp bovis AF2122/97
cguccaauuggcgucg

SEQ ID NO: 3190944 - RNA, 23 nt, Mycobacterium bovis subsp bovis AF2122/97
cguccaauuggcgucgucggcgg

SEQ ID NO: 3190945 - RNA, 20 nt, Mycobacterium bovis subsp bovis AF2122/97
cguccaccacaccugcggcu

SEQ ID NO: 3190946 - RNA, 15 nt, Mycobacterium bovis subsp bovis AF2122/97
cguccaccagccggu

SEQ ID NO: 3190947 - RNA, 22 nt, Mycobacterium bovis subsp bovis AF2122/97
cguccacccacgaucagcagcg

SEQ ID NO: 3190948 - RNA, 21 nt, Mycobacterium bovis subsp bovis AF2122/97
cguccaccccgauccgccacg

SEQ ID NO: 3190949 - RNA, 22 nt, Mycobacterium bovis subsp bovis AF2122/97
cguccaccccgauccgccacga

SEQ ID NO: 3190950 - RNA, 24 nt, Mycobacterium bovis subsp bovis AF2122/97
cguccaccgacguggccagcccgc

SEQ ID NO: 3190951 - RNA, 15 nt, Mycobacterium bovis subsp bovis AF2122/97
cguccaccgccgaca

SEQ ID NO: 3190952 - RNA, 17 nt, Mycobacterium bovis subsp bovis AF2122/97
cguccaccgucacgguc

SEQ ID NO: 3190953 - RNA, 15 nt, Mycobacterium bovis subsp bovis AF2122/97
cguccacgaccccgg

SEQ ID NO: 3190954 - RNA, 18 nt, Mycobacterium bovis subsp bovis AF2122/97
cguccacgcagaggcggc

SEQ ID NO: 3190955 - RNA, 14 nt, Mycobacterium bovis subsp bovis AF2122/97
cguccacgcugacc

SEQ ID NO: 3190956 - RNA, 18 nt, Mycobacterium bovis subsp bovis AF2122/97
cguccacgcugaccaacg

SEQ ID NO: 3190957 - RNA, 23 nt, Mycobacterium bovis subsp bovis AF2122/97
cguccacgggaucugcggaggcg

SEQ ID NO: 3190958 - RNA, 21 nt, Mycobacterium bovis subsp bovis AF2122/97
cguccagacgccacugccagc

SEQ ID NO: 3190959 - RNA, 17 nt, Mycobacterium bovis subsp bovis AF2122/97
cguccagauaguagucg

SEQ ID NO: 3190960 - RNA, 20 nt, Mycobacterium bovis subsp bovis AF2122/97
cguccagauagugcuccacg

SEQ ID NO: 3190961 - RNA, 18 nt, Mycobacterium bovis subsp bovis AF2122/97
cguccagcaaaugcggcg

SEQ ID NO: 3190962 - RNA, 12 nt, Mycobacterium bovis subsp bovis AF2122/97
cguccagcaaca

SEQ ID NO: 3190963 - RNA, 18 nt, Mycobacterium bovis subsp bovis AF2122/97
cguccagcagcucggggc

SEQ ID NO: 3190964 - RNA, 22 nt, Mycobacterium bovis subsp bovis AF2122/97
cguccagcaggacggugaagca

SEQ ID NO: 3190965 - RNA, 23 nt, Mycobacterium bovis subsp bovis AF2122/97
cguccagcccagauccagcaacg

SEQ ID NO: 3190966 - RNA, 16 nt, Mycobacterium bovis subsp bovis AF2122/97
cguccagccguggcgg

SEQ ID NO: 3190967 - RNA, 17 nt, Mycobacterium bovis subsp bovis AF2122/97
cguccagccguggcggc

SEQ ID NO: 3190968 - RNA, 14 nt, Mycobacterium bovis subsp bovis AF2122/97
cguccagcgccugc

SEQ ID NO: 3190969 - RNA, 19 nt, Mycobacterium bovis subsp bovis AF2122/97
cguccagcgccugcgccca

SEQ ID NO: 3190970 - RNA, 18 nt, Mycobacterium bovis subsp bovis AF2122/97
cguccagcgcggccuugg

SEQ ID NO: 3190971 - RNA, 12 nt, Mycobacterium bovis subsp bovis AF2122/97
cguccagcucgg

SEQ ID NO: 3190972 - RNA, 13 nt, Mycobacterium bovis subsp bovis AF2122/97
cguccagcuggca

SEQ ID NO: 3190973 - RNA, 12 nt, Mycobacterium bovis subsp bovis AF2122/97
cguccaggcgcu

SEQ ID NO: 3190974 - RNA, 18 nt, Mycobacterium bovis subsp bovis AF2122/97
cguccaggcgcugcagca

SEQ ID NO: 3190975 - RNA, 22 nt, Mycobacterium bovis subsp bovis AF2122/97
cguccagggcgacgagaucugc

SEQ ID NO: 3190976 - RNA, 13 nt, Mycobacterium bovis subsp bovis AF2122/97
cguccagggcgcc

SEQ ID NO: 3190977 - RNA, 21 nt, Mycobacterium bovis subsp bovis AF2122/97
cguccagggcgccgaucgugc

SEQ ID NO: 3190978 - RNA, 23 nt, Mycobacterium bovis subsp bovis AF2122/97
cguccagguccaaguccuccacg

SEQ ID NO: 3190979 - RNA, 15 nt, Mycobacterium bovis subsp bovis AF2122/97
cguccaggucggccg

SEQ ID NO: 3190980 - RNA, 16 nt, Mycobacterium bovis subsp bovis AF2122/97
cguccaggucggccgc

SEQ ID NO: 3190981 - RNA, 17 nt, Mycobacterium bovis subsp bovis AF2122/97
cguccaggucggccgcc

SEQ ID NO: 3190982 - RNA, 15 nt, Mycobacterium bovis subsp bovis AF2122/97
cguccaggugcgccg

SEQ ID NO: 3190983 - RNA, 14 nt, Mycobacterium bovis subsp bovis AF2122/97
cguccagucggucg

SEQ ID NO: 3190984 - RNA, 23 nt, Mycobacterium bovis subsp bovis AF2122/97
cguccagucggucgguaccggua

SEQ ID NO: 3190985 - RNA, 15 nt, Mycobacterium bovis subsp bovis AF2122/97
cguccaguggcagcc

SEQ ID NO: 3190986 - RNA, 14 nt, Mycobacterium bovis subsp bovis AF2122/97
cguccaucaccggc

SEQ ID NO: 3190987 - RNA, 18 nt, Mycobacterium bovis subsp bovis AF2122/97
cguccaucaccggcggcc

SEQ ID NO: 3190988 - RNA, 19 nt, Mycobacterium bovis subsp bovis AF2122/97
cguccaucaccggcggccc

SEQ ID NO: 3190989 - RNA, 20 nt, Mycobacterium bovis subsp bovis AF2122/97
cguccaucccggcgccgcgg

SEQ ID NO: 3190990 - RNA, 13 nt, Mycobacterium bovis subsp bovis AF2122/97
cguccaucgccac

SEQ ID NO: 3190991 - RNA, 15 nt, Mycobacterium bovis subsp bovis AF2122/97
cguccaucgccaccg

SEQ ID NO: 3190992 - RNA, 16 nt, Mycobacterium bovis subsp bovis AF2122/97
cguccaucgccaccgc

SEQ ID NO: 3190993 - RNA, 18 nt, Mycobacterium bovis subsp bovis AF2122/97
cguccaucgccaccgcgu

SEQ ID NO: 3190994 - RNA, 19 nt, Mycobacterium bovis subsp bovis AF2122/97
cguccaucgccaccgcguc

SEQ ID NO: 3190995 - RNA, 17 nt, Mycobacterium bovis subsp bovis AF2122/97
cguccaucgcgcgccga

SEQ ID NO: 3190996 - RNA, 19 nt, Mycobacterium bovis subsp bovis AF2122/97
cguccaucgcgcgccgacc

SEQ ID NO: 3190997 - RNA, 22 nt, Mycobacterium bovis subsp bovis AF2122/97
cguccaucgcgucgucuucuuc

SEQ ID NO: 3190998 - RNA, 21 nt, Mycobacterium bovis subsp bovis AF2122/97
cgucccacagguuugcgccgc

SEQ ID NO: 3190999 - RNA, 13 nt, Mycobacterium bovis subsp bovis AF2122/97
cgucccaccagcc

SEQ ID NO: 3191000 - RNA, 15 nt, Mycobacterium bovis subsp bovis AF2122/97
cgucccaccagccga

SEQ ID NO: 3191001 - RNA, 19 nt, Mycobacterium bovis subsp bovis AF2122/97
cgucccagagaaucagcgu

SEQ ID NO: 3191002 - RNA, 13 nt, Mycobacterium bovis subsp bovis AF2122/97
cgucccagcgccg

SEQ ID NO: 3191003 - RNA, 13 nt, Mycobacterium bovis subsp bovis AF2122/97
cgucccagcgcgg

SEQ ID NO: 3191004 - RNA, 20 nt, Mycobacterium bovis subsp bovis AF2122/97
cgucccagcgguagccgagc

SEQ ID NO: 3191005 - RNA, 21 nt, Mycobacterium bovis subsp bovis AF2122/97
cgucccaggacuccggccgca

SEQ ID NO: 3191006 - RNA, 16 nt, Mycobacterium bovis subsp bovis AF2122/97
cgucccagggcugccg

SEQ ID NO: 3191007 - RNA, 17 nt, Mycobacterium bovis subsp bovis AF2122/97
cgucccagggcugccgg

SEQ ID NO: 3191008 - RNA, 13 nt, Mycobacterium bovis subsp bovis AF2122/97
cguccccagaccg

SEQ ID NO: 3191009 - RNA, 15 nt, Mycobacterium bovis subsp bovis AF2122/97
cguccccagaccggc

SEQ ID NO: 3191010 - RNA, 11 nt, Mycobacterium bovis subsp bovis AF2122/97
cguccccgacg

SEQ ID NO: 3191011 - RNA, 12 nt, Mycobacterium bovis subsp bovis AF2122/97
cguccccgccga

SEQ ID NO: 3191012 - RNA, 14 nt, Mycobacterium bovis subsp bovis AF2122/97
cguccccgccgacg

SEQ ID NO: 3191013 - RNA, 18 nt, Mycobacterium bovis subsp bovis AF2122/97
cguccccgccgacgccga

SEQ ID NO: 3191014 - RNA, 23 nt, Mycobacterium bovis subsp bovis AF2122/97
cguccccgccgucgccaccaucg

SEQ ID NO: 3191015 - RNA, 15 nt, Mycobacterium bovis subsp bovis AF2122/97
cguccccgucgcugg

SEQ ID NO: 3191016 - RNA, 19 nt, Mycobacterium bovis subsp bovis AF2122/97
cguccccgucgcuggccgg

SEQ ID NO: 3191017 - RNA, 22 nt, Mycobacterium bovis subsp bovis AF2122/97
cguccccgucgcuggccggcac

SEQ ID NO: 3191018 - RNA, 18 nt, Mycobacterium bovis subsp bovis AF2122/97
cgucccgaaacgccgggu

SEQ ID NO: 3191019 - RNA, 14 nt, Mycobacterium bovis subsp bovis AF2122/97
cgucccgagcccgu

SEQ ID NO: 3191020 - RNA, 18 nt, Mycobacterium bovis subsp bovis AF2122/97
cgucccgauacggccggc

SEQ ID NO: 3191021 - RNA, 19 nt, Mycobacterium bovis subsp bovis AF2122/97
cgucccgauacggccggcc

SEQ ID NO: 3191022 - RNA, 22 nt, Mycobacterium bovis subsp bovis AF2122/97
cgucccgauggcgguggggcug

SEQ ID NO: 3191023 - RNA, 17 nt, Mycobacterium bovis subsp bovis AF2122/97
cgucccgcccaucccgg

SEQ ID NO: 3191024 - RNA, 12 nt, Mycobacterium bovis subsp bovis AF2122/97
cgucccgcccgg

SEQ ID NO: 3191025 - RNA, 17 nt, Mycobacterium bovis subsp bovis AF2122/97
cgucccgcccggaugcg

SEQ ID NO: 3191026 - RNA, 19 nt, Mycobacterium bovis subsp bovis AF2122/97
cgucccgcgagcagcccgg

SEQ ID NO: 3191027 - RNA, 15 nt, Mycobacterium bovis subsp bovis AF2122/97
cgucccgcggcgcgg

SEQ ID NO: 3191028 - RNA, 12 nt, Mycobacterium bovis subsp bovis AF2122/97
cgucccgcucga

SEQ ID NO: 3191029 - RNA, 22 nt, Mycobacterium bovis subsp bovis AF2122/97
cgucccgcucgagcagcgcgcc

SEQ ID NO: 3191030 - RNA, 12 nt, Mycobacterium bovis subsp bovis AF2122/97
cgucccggccuc

SEQ ID NO: 3191031 - RNA, 15 nt, Mycobacterium bovis subsp bovis AF2122/97
cgucccggcgaccgg

SEQ ID NO: 3191032 - RNA, 17 nt, Mycobacterium bovis subsp bovis AF2122/97
cgucccggcgaccgggu

SEQ ID NO: 3191033 - RNA, 14 nt, Mycobacterium bovis subsp bovis AF2122/97
cgucccggcucgag

SEQ ID NO: 3191034 - RNA, 16 nt, Mycobacterium bovis subsp bovis AF2122/97
cgucccggcucgagcu

SEQ ID NO: 3191035 - RNA, 16 nt, Mycobacterium bovis subsp bovis AF2122/97
cgucccggucgccaaa

SEQ ID NO: 3191036 - RNA, 15 nt, Mycobacterium bovis subsp bovis AF2122/97
cgucccgguugacgc

SEQ ID NO: 3191037 - RNA, 16 nt, Mycobacterium bovis subsp bovis AF2122/97
cgucccugugucgccg

SEQ ID NO: 3191038 - RNA, 20 nt, Mycobacterium bovis subsp bovis AF2122/97
cgucccugugucgccgucgc

SEQ ID NO: 3191039 - RNA, 22 nt, Mycobacterium bovis subsp bovis AF2122/97
cguccgaaccaccuguccggug

SEQ ID NO: 3191040 - RNA, 15 nt, Mycobacterium bovis subsp bovis AF2122/97
cguccgacaacgacu

SEQ ID NO: 3191041 - RNA, 20 nt, Mycobacterium bovis subsp bovis AF2122/97
cguccgaccgauaacacccg

SEQ ID NO: 3191042 - RNA, 14 nt, Mycobacterium bovis subsp bovis AF2122/97
cguccgacggcgga

SEQ ID NO: 3191043 - RNA, 14 nt, Mycobacterium bovis subsp bovis AF2122/97
cguccgacgggccg

SEQ ID NO: 3191044 - RNA, 22 nt, Mycobacterium bovis subsp bovis AF2122/97
cguccgacgggccgucgccguc

SEQ ID NO: 3191045 - RNA, 18 nt, Mycobacterium bovis subsp bovis AF2122/97
cguccgauuucccagcgc

SEQ ID NO: 3191046 - RNA, 13 nt, Mycobacterium bovis subsp bovis AF2122/97
cguccgcaacagg

SEQ ID NO: 3191047 - RNA, 12 nt, Mycobacterium bovis subsp bovis AF2122/97
cguccgcccagc

SEQ ID NO: 3191048 - RNA, 14 nt, Mycobacterium bovis subsp bovis AF2122/97
cguccgcccagcac

SEQ ID NO: 3191049 - RNA, 15 nt, Mycobacterium bovis subsp bovis AF2122/97
cguccgcccagccgc

SEQ ID NO: 3191050 - RNA, 17 nt, Mycobacterium bovis subsp bovis AF2122/97
cguccgcccagccgcag

SEQ ID NO: 3191051 - RNA, 21 nt, Mycobacterium bovis subsp bovis AF2122/97
cguccgcccagccgcagcacc

SEQ ID NO: 3191052 - RNA, 13 nt, Mycobacterium bovis subsp bovis AF2122/97
cguccgccggcga

SEQ ID NO: 3191053 - RNA, 19 nt, Mycobacterium bovis subsp bovis AF2122/97
cguccgccggcgagugguc

SEQ ID NO: 3191054 - RNA, 24 nt, Mycobacterium bovis subsp bovis AF2122/97
cguccgccguaugccgccaaccgc

SEQ ID NO: 3191055 - RNA, 16 nt, Mycobacterium bovis subsp bovis AF2122/97
cguccgccugcaccgc

SEQ ID NO: 3191056 - RNA, 14 nt, Mycobacterium bovis subsp bovis AF2122/97
cguccgcgcaccgc

SEQ ID NO: 3191057 - RNA, 17 nt, Mycobacterium bovis subsp bovis AF2122/97
cguccgcgcaccgcagg

SEQ ID NO: 3191058 - RNA, 21 nt, Mycobacterium bovis subsp bovis AF2122/97
cguccgcgccaguggccacca

SEQ ID NO: 3191059 - RNA, 23 nt, Mycobacterium bovis subsp bovis AF2122/97
cguccgcgcccaccggcuagcug

SEQ ID NO: 3191060 - RNA, 16 nt, Mycobacterium bovis subsp bovis AF2122/97
cguccgcgccgagccc

SEQ ID NO: 3191061 - RNA, 20 nt, Mycobacterium bovis subsp bovis AF2122/97
cguccgcgcguugcuggucg

SEQ ID NO: 3191062 - RNA, 12 nt, Mycobacterium bovis subsp bovis AF2122/97
cguccgcggacu

SEQ ID NO: 3191063 - RNA, 22 nt, Mycobacterium bovis subsp bovis AF2122/97
cguccgcggacuuggcggucgg

SEQ ID NO: 3191064 - RNA, 23 nt, Mycobacterium bovis subsp bovis AF2122/97
cguccgcggacuuggcggucggu

SEQ ID NO: 3191065 - RNA, 16 nt, Mycobacterium bovis subsp bovis AF2122/97
cguccgcggagcucaa

SEQ ID NO: 3191066 - RNA, 18 nt, Mycobacterium bovis subsp bovis AF2122/97
cguccgcgggggaccgcc

SEQ ID NO: 3191067 - RNA, 17 nt, Mycobacterium bovis subsp bovis AF2122/97
cguccgcggucgcagca

SEQ ID NO: 3191068 - RNA, 18 nt, Mycobacterium bovis subsp bovis AF2122/97
cguccgcggucgcagcag

SEQ ID NO: 3191069 - RNA, 22 nt, Mycobacterium bovis subsp bovis AF2122/97
cguccgcugguggucagcaccc

SEQ ID NO: 3191070 - RNA, 24 nt, Mycobacterium bovis subsp bovis AF2122/97
cguccggagaauuccgcuagguca

SEQ ID NO: 3191071 - RNA, 18 nt, Mycobacterium bovis subsp bovis AF2122/97
cguccggaucggucggca

SEQ ID NO: 3191072 - RNA, 22 nt, Mycobacterium bovis subsp bovis AF2122/97
cguccggccacgguccggccca

SEQ ID NO: 3191073 - RNA, 18 nt, Mycobacterium bovis subsp bovis AF2122/97
cguccggcgcccacaucg

SEQ ID NO: 3191074 - RNA, 20 nt, Mycobacterium bovis subsp bovis AF2122/97
cguccggcggcaggaaucgg

SEQ ID NO: 3191075 - RNA, 16 nt, Mycobacterium bovis subsp bovis AF2122/97
cguccgggaucucccc

SEQ ID NO: 3191076 - RNA, 22 nt, Mycobacterium bovis subsp bovis AF2122/97
cguccgggcagccgcgccgcgg

SEQ ID NO: 3191077 - RNA, 18 nt, Mycobacterium bovis subsp bovis AF2122/97
cguccgggcggccucccg

SEQ ID NO: 3191078 - RNA, 20 nt, Mycobacterium bovis subsp bovis AF2122/97
cguccgggcggccucccggg

SEQ ID NO: 3191079 - RNA, 14 nt, Mycobacterium bovis subsp bovis AF2122/97
cguccggggccgcg

SEQ ID NO: 3191080 - RNA, 18 nt, Mycobacterium bovis subsp bovis AF2122/97
cguccggggccgcggccc

SEQ ID NO: 3191081 - RNA, 17 nt, Mycobacterium bovis subsp bovis AF2122/97
cguccggguagacaugg

SEQ ID NO: 3191082 - RNA, 14 nt, Mycobacterium bovis subsp bovis AF2122/97
cguccgggucacca

SEQ ID NO: 3191083 - RNA, 16 nt, Mycobacterium bovis subsp bovis AF2122/97
cguccgggucaccagc

SEQ ID NO: 3191084 - RNA, 17 nt, Mycobacterium bovis subsp bovis AF2122/97
cguccgggucaccagcg

SEQ ID NO: 3191085 - RNA, 19 nt, Mycobacterium bovis subsp bovis AF2122/97
cguccgggucaccagcgca

SEQ ID NO: 3191086 - RNA, 15 nt, Mycobacterium bovis subsp bovis AF2122/97
cguccggguggcaca

SEQ ID NO: 3191087 - RNA, 17 nt, Mycobacterium bovis subsp bovis AF2122/97
cguccggucgccucacc

SEQ ID NO: 3191088 - RNA, 18 nt, Mycobacterium bovis subsp bovis AF2122/97
cguccggucgccucaccg

SEQ ID NO: 3191089 - RNA, 20 nt, Mycobacterium bovis subsp bovis AF2122/97
cguccggucgccucaccggc

SEQ ID NO: 3191090 - RNA, 21 nt, Mycobacterium bovis subsp bovis AF2122/97
cguccggucgccucaccggcg

SEQ ID NO: 3191091 - RNA, 23 nt, Mycobacterium bovis subsp bovis AF2122/97
cguccggucgccucaccggcgcg

SEQ ID NO: 3191092 - RNA, 16 nt, Mycobacterium bovis subsp bovis AF2122/97
cguccgguggaccgcc

SEQ ID NO: 3191093 - RNA, 16 nt, Mycobacterium bovis subsp bovis AF2122/97
cguccgucgucggcgu

SEQ ID NO: 3191094 - RNA, 16 nt, Mycobacterium bovis subsp bovis AF2122/97
cguccgucucgcaggc

SEQ ID NO: 3191095 - RNA, 23 nt, Mycobacterium bovis subsp bovis AF2122/97
cguccucaucguuccacgagucg

SEQ ID NO: 3191096 - RNA, 24 nt, Mycobacterium bovis subsp bovis AF2122/97
cguccucaucguuccacgagucgu

SEQ ID NO: 3191097 - RNA, 13 nt, Mycobacterium bovis subsp bovis AF2122/97
cguccucgccgca

SEQ ID NO: 3191098 - RNA, 16 nt, Mycobacterium bovis subsp bovis AF2122/97
cguccucgccgcacgc

SEQ ID NO: 3191099 - RNA, 16 nt, Mycobacterium bovis subsp bovis AF2122/97
cguccucgcuggauca

SEQ ID NO: 3191100 - RNA, 16 nt, Mycobacterium bovis subsp bovis AF2122/97
cguccucgucuucguc

SEQ ID NO: 3191101 - RNA, 18 nt, Mycobacterium bovis subsp bovis AF2122/97
cguccugaaucgguucgg

SEQ ID NO: 3191102 - RNA, 19 nt, Mycobacterium bovis subsp bovis AF2122/97
cguccugaaucgguucggc

SEQ ID NO: 3191103 - RNA, 21 nt, Mycobacterium bovis subsp bovis AF2122/97
cguccugaaucgguucggcca

SEQ ID NO: 3191104 - RNA, 23 nt, Mycobacterium bovis subsp bovis AF2122/97
cguccugaaucgguucggccaga

SEQ ID NO: 3191105 - RNA, 21 nt, Mycobacterium bovis subsp bovis AF2122/97
cguccugcaggaaguacgcga

SEQ ID NO: 3191106 - RNA, 20 nt, Mycobacterium bovis subsp bovis AF2122/97
cguccugcccgucgucggca

SEQ ID NO: 3191107 - RNA, 11 nt, Mycobacterium bovis subsp bovis AF2122/97
cguccugcgag

SEQ ID NO: 3191108 - RNA, 23 nt, Mycobacterium bovis subsp bovis AF2122/97
cguccuggauaugcuccggccgc

SEQ ID NO: 3191109 - RNA, 14 nt, Mycobacterium bovis subsp bovis AF2122/97
cguccugguggcgg

SEQ ID NO: 3191110 - RNA, 22 nt, Mycobacterium bovis subsp bovis AF2122/97
cguccugguggcgggaucacca

SEQ ID NO: 3191111 - RNA, 17 nt, Mycobacterium bovis subsp bovis AF2122/97
cguccuguccgggcugc

SEQ ID NO: 3191112 - RNA, 15 nt, Mycobacterium bovis subsp bovis AF2122/97
cguccuucgcuggua

SEQ ID NO: 3191113 - RNA, 17 nt, Mycobacterium bovis subsp bovis AF2122/97
cguccuucuuguugguc

SEQ ID NO: 3191114 - RNA, 14 nt, Mycobacterium bovis subsp bovis AF2122/97
cguccuugcgcagc

SEQ ID NO: 3191115 - RNA, 17 nt, Mycobacterium bovis subsp bovis AF2122/97
cguccuugcgcagcacc

SEQ ID NO: 3191116 - RNA, 20 nt, Mycobacterium bovis subsp bovis AF2122/97
cgucgaaagagaaggcggcg

SEQ ID NO: 3191117 - RNA, 23 nt, Mycobacterium bovis subsp bovis AF2122/97
cgucgaaagagaaggcggcgucg

SEQ ID NO: 3191118 - RNA, 16 nt, Mycobacterium bovis subsp bovis AF2122/97
cgucgaaauacccggu

SEQ ID NO: 3191119 - RNA, 19 nt, Mycobacterium bovis subsp bovis AF2122/97
cgucgaaauacccggucca

SEQ ID NO: 3191120 - RNA, 15 nt, Mycobacterium bovis subsp bovis AF2122/97
cgucgaaauccacaa

SEQ ID NO: 3191121 - RNA, 15 nt, Mycobacterium bovis subsp bovis AF2122/97
cgucgaacagcaccg

SEQ ID NO: 3191122 - RNA, 19 nt, Mycobacterium bovis subsp bovis AF2122/97
cgucgaacagugccucgcg

SEQ ID NO: 3191123 - RNA, 17 nt, Mycobacterium bovis subsp bovis AF2122/97
cgucgaaccagucgaag

SEQ ID NO: 3191124 - RNA, 21 nt, Mycobacterium bovis subsp bovis AF2122/97
cgucgaaccugucgaucacgg

SEQ ID NO: 3191125 - RNA, 20 nt, Mycobacterium bovis subsp bovis AF2122/97
cgucgaacgcgcgcgugguc

SEQ ID NO: 3191126 - RNA, 20 nt, Mycobacterium bovis subsp bovis AF2122/97
cgucgaacggaucucggugg

SEQ ID NO: 3191127 - RNA, 21 nt, Mycobacterium bovis subsp bovis AF2122/97
cgucgaacggaucucgguggu

SEQ ID NO: 3191128 - RNA, 14 nt, Mycobacterium bovis subsp bovis AF2122/97
cgucgaacggcagc

SEQ ID NO: 3191129 - RNA, 19 nt, Mycobacterium bovis subsp bovis AF2122/97
cgucgaacgguagcacggu

SEQ ID NO: 3191130 - RNA, 17 nt, Mycobacterium bovis subsp bovis AF2122/97
cgucgaacugggcgccc

SEQ ID NO: 3191131 - RNA, 21 nt, Mycobacterium bovis subsp bovis AF2122/97
cgucgaagaccgccuccaccg

SEQ ID NO: 3191132 - RNA, 20 nt, Mycobacterium bovis subsp bovis AF2122/97
cgucgaagaugaccugaucg

SEQ ID NO: 3191133 - RNA, 14 nt, Mycobacterium bovis subsp bovis AF2122/97
cgucgaagcggacc

SEQ ID NO: 3191134 - RNA, 20 nt, Mycobacterium bovis subsp bovis AF2122/97
cgucgaaguagccgacgucg

SEQ ID NO: 3191135 - RNA, 21 nt, Mycobacterium bovis subsp bovis AF2122/97
cgucgaaguuggcgaagcccg

SEQ ID NO: 3191136 - RNA, 15 nt, Mycobacterium bovis subsp bovis AF2122/97
cgucgaauccucgcg

SEQ ID NO: 3191137 - RNA, 24 nt, Mycobacterium bovis subsp bovis AF2122/97
cgucgaaucuucugagacugccgc

SEQ ID NO: 3191138 - RNA, 23 nt, Mycobacterium bovis subsp bovis AF2122/97
cgucgacaaacagcgccaucgau

SEQ ID NO: 3191139 - RNA, 19 nt, Mycobacterium bovis subsp bovis AF2122/97
cgucgacaacaaacccggc

SEQ ID NO: 3191140 - RNA, 16 nt, Mycobacterium bovis subsp bovis AF2122/97
cgucgacaacgaucgc

SEQ ID NO: 3191141 - RNA, 19 nt, Mycobacterium bovis subsp bovis AF2122/97
cgucgacaacgaucgcgcg

SEQ ID NO: 3191142 - RNA, 22 nt, Mycobacterium bovis subsp bovis AF2122/97
cgucgacaacgaucgcgcgagc

SEQ ID NO: 3191143 - RNA, 14 nt, Mycobacterium bovis subsp bovis AF2122/97
cgucgacacaccca

SEQ ID NO: 3191144 - RNA, 19 nt, Mycobacterium bovis subsp bovis AF2122/97
cgucgacacacccaccgga

SEQ ID NO: 3191145 - RNA, 22 nt, Mycobacterium bovis subsp bovis AF2122/97
cgucgacacacccaccggacca

SEQ ID NO: 3191146 - RNA, 15 nt, Mycobacterium bovis subsp bovis AF2122/97
cgucgacaccgcgga

SEQ ID NO: 3191147 - RNA, 14 nt, Mycobacterium bovis subsp bovis AF2122/97
cgucgacacgguga

SEQ ID NO: 3191148 - RNA, 18 nt, Mycobacterium bovis subsp bovis AF2122/97
cgucgacagucaacaggg

SEQ ID NO: 3191149 - RNA, 21 nt, Mycobacterium bovis subsp bovis AF2122/97
cgucgacaguucaacgggccu

SEQ ID NO: 3191150 - RNA, 20 nt, Mycobacterium bovis subsp bovis AF2122/97
cgucgacaguuuucaccgcg

SEQ ID NO: 3191151 - RNA, 21 nt, Mycobacterium bovis subsp bovis AF2122/97
cgucgacaguuuucaccgcga

SEQ ID NO: 3191152 - RNA, 21 nt, Mycobacterium bovis subsp bovis AF2122/97
cgucgaccaagguguccagca

SEQ ID NO: 3191153 - RNA, 15 nt, Mycobacterium bovis subsp bovis AF2122/97
cgucgaccacgacgu

SEQ ID NO: 3191154 - RNA, 21 nt, Mycobacterium bovis subsp bovis AF2122/97
cgucgaccacgacguucgacg

SEQ ID NO: 3191155 - RNA, 13 nt, Mycobacterium bovis subsp bovis AF2122/97
cgucgaccaggcc

SEQ ID NO: 3191156 - RNA, 14 nt, Mycobacterium bovis subsp bovis AF2122/97
cgucgaccaggcca

SEQ ID NO: 3191157 - RNA, 19 nt, Mycobacterium bovis subsp bovis AF2122/97
cgucgaccaugcgaccggc

SEQ ID NO: 3191158 - RNA, 23 nt, Mycobacterium bovis subsp bovis AF2122/97
cgucgaccaugcgaccggcaacg

SEQ ID NO: 3191159 - RNA, 20 nt, Mycobacterium bovis subsp bovis AF2122/97
cgucgacccccugccacagc

SEQ ID NO: 3191160 - RNA, 21 nt, Mycobacterium bovis subsp bovis AF2122/97
cgucgacccccugccacagcg

SEQ ID NO: 3191161 - RNA, 23 nt, Mycobacterium bovis subsp bovis AF2122/97
cgucgacccgaacugggcgaucg

SEQ ID NO: 3191162 - RNA, 24 nt, Mycobacterium bovis subsp bovis AF2122/97
cgucgacccgaacugggcgaucga

SEQ ID NO: 3191163 - RNA, 16 nt, Mycobacterium bovis subsp bovis AF2122/97
cgucgaccgaacccga

SEQ ID NO: 3191164 - RNA, 22 nt, Mycobacterium bovis subsp bovis AF2122/97
cgucgaccgaacccgacgucgc

SEQ ID NO: 3191165 - RNA, 13 nt, Mycobacterium bovis subsp bovis AF2122/97
cgucgaccgacgg

SEQ ID NO: 3191166 - RNA, 15 nt, Mycobacterium bovis subsp bovis AF2122/97
cgucgaccgacgggu

SEQ ID NO: 3191167 - RNA, 16 nt, Mycobacterium bovis subsp bovis AF2122/97
cgucgaccgacggguc

SEQ ID NO: 3191168 - RNA, 13 nt, Mycobacterium bovis subsp bovis AF2122/97
cgucgaccgcgcc

SEQ ID NO: 3191169 - RNA, 13 nt, Mycobacterium bovis subsp bovis AF2122/97
cgucgaccgcggc

SEQ ID NO: 3191170 - RNA, 17 nt, Mycobacterium bovis subsp bovis AF2122/97
cgucgaccgcggcccgg

SEQ ID NO: 3191171 - RNA, 15 nt, Mycobacterium bovis subsp bovis AF2122/97
cgucgaccggaacca

SEQ ID NO: 3191172 - RNA, 15 nt, Mycobacterium bovis subsp bovis AF2122/97
cgucgaccggcggga

SEQ ID NO: 3191173 - RNA, 17 nt, Mycobacterium bovis subsp bovis AF2122/97
cgucgaccgugucaccg

SEQ ID NO: 3191174 - RNA, 19 nt, Mycobacterium bovis subsp bovis AF2122/97
cgucgaccgugucaccgcc

SEQ ID NO: 3191175 - RNA, 16 nt, Mycobacterium bovis subsp bovis AF2122/97
cgucgaccuccaccaa

SEQ ID NO: 3191176 - RNA, 16 nt, Mycobacterium bovis subsp bovis AF2122/97
cgucgaccucggcaac

SEQ ID NO: 3191177 - RNA, 22 nt, Mycobacterium bovis subsp bovis AF2122/97
cgucgacgaauaacgcggucgg

SEQ ID NO: 3191178 - RNA, 14 nt, Mycobacterium bovis subsp bovis AF2122/97
cgucgacgagcgcc

SEQ ID NO: 3191179 - RNA, 19 nt, Mycobacterium bovis subsp bovis AF2122/97
cgucgacgaggucagcggu

SEQ ID NO: 3191180 - RNA, 17 nt, Mycobacterium bovis subsp bovis AF2122/97
cgucgacgauucccgcg

SEQ ID NO: 3191181 - RNA, 18 nt, Mycobacterium bovis subsp bovis AF2122/97
cgucgacgauucccgcgg

SEQ ID NO: 3191182 - RNA, 12 nt, Mycobacterium bovis subsp bovis AF2122/97
cgucgacgccga

SEQ ID NO: 3191183 - RNA, 18 nt, Mycobacterium bovis subsp bovis AF2122/97
cgucgacgccgaucgcgg

SEQ ID NO: 3191184 - RNA, 14 nt, Mycobacterium bovis subsp bovis AF2122/97
cgucgacgcggccg

SEQ ID NO: 3191185 - RNA, 14 nt, Mycobacterium bovis subsp bovis AF2122/97
cgucgacgcgucgu

SEQ ID NO: 3191186 - RNA, 15 nt, Mycobacterium bovis subsp bovis AF2122/97
cgucgacgcgucgug

SEQ ID NO: 3191187 - RNA, 13 nt, Mycobacterium bovis subsp bovis AF2122/97
cgucgacgcguug

SEQ ID NO: 3191188 - RNA, 14 nt, Mycobacterium bovis subsp bovis AF2122/97
cgucgacggccugg

SEQ ID NO: 3191189 - RNA, 22 nt, Mycobacterium bovis subsp bovis AF2122/97
cgucgacggccuggggcagccg

SEQ ID NO: 3191190 - RNA, 14 nt, Mycobacterium bovis subsp bovis AF2122/97
cgucgacggcgaug

SEQ ID NO: 3191191 - RNA, 21 nt, Mycobacterium bovis subsp bovis AF2122/97
cgucgacggcgauggcgcgca

SEQ ID NO: 3191192 - RNA, 16 nt, Mycobacterium bovis subsp bovis AF2122/97
cgucgacggucuggcc

SEQ ID NO: 3191193 - RNA, 16 nt, Mycobacterium bovis subsp bovis AF2122/97
cgucgacgucgacggc

SEQ ID NO: 3191194 - RNA, 15 nt, Mycobacterium bovis subsp bovis AF2122/97
cgucgacgucgaugg

SEQ ID NO: 3191195 - RNA, 16 nt, Mycobacterium bovis subsp bovis AF2122/97
cgucgacgucgauggu

SEQ ID NO: 3191196 - RNA, 17 nt, Mycobacterium bovis subsp bovis AF2122/97
cgucgacgucgauggug

SEQ ID NO: 3191197 - RNA, 12 nt, Mycobacterium bovis subsp bovis AF2122/97
cgucgacgucgg

SEQ ID NO: 3191198 - RNA, 21 nt, Mycobacterium bovis subsp bovis AF2122/97
cgucgacgucggcaucggcgg

SEQ ID NO: 3191199 - RNA, 16 nt, Mycobacterium bovis subsp bovis AF2122/97
cgucgacgucggcccc

SEQ ID NO: 3191200 - RNA, 15 nt, Mycobacterium bovis subsp bovis AF2122/97
cgucgacgucggcga

SEQ ID NO: 3191201 - RNA, 16 nt, Mycobacterium bovis subsp bovis AF2122/97
cgucgacgucggcgag

SEQ ID NO: 3191202 - RNA, 13 nt, Mycobacterium bovis subsp bovis AF2122/97
cgucgacucggcg

SEQ ID NO: 3191203 - RNA, 20 nt, Mycobacterium bovis subsp bovis AF2122/97
cgucgacugcgugccgcacc

SEQ ID NO: 3191204 - RNA, 23 nt, Mycobacterium bovis subsp bovis AF2122/97
cgucgacuggccguuucggcgcc

SEQ ID NO: 3191205 - RNA, 16 nt, Mycobacterium bovis subsp bovis AF2122/97
cgucgacuucagcggc

SEQ ID NO: 3191206 - RNA, 18 nt, Mycobacterium bovis subsp bovis AF2122/97
cgucgacuucagcggccg

SEQ ID NO: 3191207 - RNA, 19 nt, Mycobacterium bovis subsp bovis AF2122/97
cgucgacuucgcccgggga

SEQ ID NO: 3191208 - RNA, 19 nt, Mycobacterium bovis subsp bovis AF2122/97
cgucgacuugcaggcgucc

SEQ ID NO: 3191209 - RNA, 21 nt, Mycobacterium bovis subsp bovis AF2122/97
cgucgacuugcaggcguccca

SEQ ID NO: 3191210 - RNA, 18 nt, Mycobacterium bovis subsp bovis AF2122/97
cgucgagagguucgccgu

SEQ ID NO: 3191211 - RNA, 18 nt, Mycobacterium bovis subsp bovis AF2122/97
cgucgagauagccgacgu

SEQ ID NO: 3191212 - RNA, 15 nt, Mycobacterium bovis subsp bovis AF2122/97
cgucgagauccucgu

SEQ ID NO: 3191213 - RNA, 17 nt, Mycobacterium bovis subsp bovis AF2122/97
cgucgagauccucgucg

SEQ ID NO: 3191214 - RNA, 22 nt, Mycobacterium bovis subsp bovis AF2122/97
cgucgagcaacgugacccggau

SEQ ID NO: 3191215 - RNA, 17 nt, Mycobacterium bovis subsp bovis AF2122/97
cgucgagcaccacccgg

SEQ ID NO: 3191216 - RNA, 14 nt, Mycobacterium bovis subsp bovis AF2122/97
cgucgagcaccuug

SEQ ID NO: 3191217 - RNA, 15 nt, Mycobacterium bovis subsp bovis AF2122/97
cgucgagcaccuugg

SEQ ID NO: 3191218 - RNA, 15 nt, Mycobacterium bovis subsp bovis AF2122/97
cgucgagcagcacca

SEQ ID NO: 3191219 - RNA, 14 nt, Mycobacterium bovis subsp bovis AF2122/97
cgucgagcagcgcc

SEQ ID NO: 3191220 - RNA, 15 nt, Mycobacterium bovis subsp bovis AF2122/97
cgucgagcagcgcca

SEQ ID NO: 3191221 - RNA, 17 nt, Mycobacterium bovis subsp bovis AF2122/97
cgucgagcagcgccacc

SEQ ID NO: 3191222 - RNA, 18 nt, Mycobacterium bovis subsp bovis AF2122/97
cgucgagcauccacccau

SEQ ID NO: 3191223 - RNA, 14 nt, Mycobacterium bovis subsp bovis AF2122/97
cgucgagccacagc

SEQ ID NO: 3191224 - RNA, 20 nt, Mycobacterium bovis subsp bovis AF2122/97
cgucgagccacagcgucgaa

SEQ ID NO: 3191225 - RNA, 15 nt, Mycobacterium bovis subsp bovis AF2122/97
cgucgagccgaccgc

SEQ ID NO: 3191226 - RNA, 16 nt, Mycobacterium bovis subsp bovis AF2122/97
cgucgagccgaccgcg

SEQ ID NO: 3191227 - RNA, 14 nt, Mycobacterium bovis subsp bovis AF2122/97
cgucgagccgaucg

SEQ ID NO: 3191228 - RNA, 19 nt, Mycobacterium bovis subsp bovis AF2122/97
cgucgagccgaucgcccgc

SEQ ID NO: 3191229 - RNA, 14 nt, Mycobacterium bovis subsp bovis AF2122/97
cgucgagccgccag

SEQ ID NO: 3191230 - RNA, 14 nt, Mycobacterium bovis subsp bovis AF2122/97
cgucgagccgugcc

SEQ ID NO: 3191231 - RNA, 20 nt, Mycobacterium bovis subsp bovis AF2122/97
cgucgagcgacccccagcgc

SEQ ID NO: 3191232 - RNA, 22 nt, Mycobacterium bovis subsp bovis AF2122/97
cgucgagcgacccccagcgccc

SEQ ID NO: 3191233 - RNA, 16 nt, Mycobacterium bovis subsp bovis AF2122/97
cgucgagcgccggccg

SEQ ID NO: 3191234 - RNA, 17 nt, Mycobacterium bovis subsp bovis AF2122/97
cgucgagcgccggccgc

SEQ ID NO: 3191235 - RNA, 18 nt, Mycobacterium bovis subsp bovis AF2122/97
cgucgagcgccggccgcg

SEQ ID NO: 3191236 - RNA, 21 nt, Mycobacterium bovis subsp bovis AF2122/97
cgucgagcgccuugucgaucu

SEQ ID NO: 3191237 - RNA, 12 nt, Mycobacterium bovis subsp bovis AF2122/97
cgucgagcgcgc

SEQ ID NO: 3191238 - RNA, 13 nt, Mycobacterium bovis subsp bovis AF2122/97
cgucgagcgcgcc

SEQ ID NO: 3191239 - RNA, 14 nt, Mycobacterium bovis subsp bovis AF2122/97
cgucgagcgcgcca

SEQ ID NO: 3191240 - RNA, 15 nt, Mycobacterium bovis subsp bovis AF2122/97
cgucgagcgcggugc

SEQ ID NO: 3191241 - RNA, 19 nt, Mycobacterium bovis subsp bovis AF2122/97
cgucgagcgcggugccgcc

SEQ ID NO: 3191242 - RNA, 22 nt, Mycobacterium bovis subsp bovis AF2122/97
cgucgagcgcggugccgccacc

SEQ ID NO: 3191243 - RNA, 12 nt, Mycobacterium bovis subsp bovis AF2122/97
cgucgagcgcgu

SEQ ID NO: 3191244 - RNA, 14 nt, Mycobacterium bovis subsp bovis AF2122/97
cgucgagcgcgucg

SEQ ID NO: 3191245 - RNA, 19 nt, Mycobacterium bovis subsp bovis AF2122/97
cgucgagcgcgucggucac

SEQ ID NO: 3191246 - RNA, 20 nt, Mycobacterium bovis subsp bovis AF2122/97
cgucgagcgugcgcacggcg

SEQ ID NO: 3191247 - RNA, 23 nt, Mycobacterium bovis subsp bovis AF2122/97
cgucgagcgugcgcacggcgccg

SEQ ID NO: 3191248 - RNA, 20 nt, Mycobacterium bovis subsp bovis AF2122/97
cgucgagcucguccucgucu

SEQ ID NO: 3191249 - RNA, 15 nt, Mycobacterium bovis subsp bovis AF2122/97
cgucgagcugauacg

SEQ ID NO: 3191250 - RNA, 20 nt, Mycobacterium bovis subsp bovis AF2122/97
cgucgaggaagaucaccucc

SEQ ID NO: 3191251 - RNA, 21 nt, Mycobacterium bovis subsp bovis AF2122/97
cgucgaggaagaucaccuccc

SEQ ID NO: 3191252 - RNA, 14 nt, Mycobacterium bovis subsp bovis AF2122/97
cgucgaggcggcag

SEQ ID NO: 3191253 - RNA, 17 nt, Mycobacterium bovis subsp bovis AF2122/97
cgucgaggcggcagucg

SEQ ID NO: 3191254 - RNA, 15 nt, Mycobacterium bovis subsp bovis AF2122/97
cgucgaggcugaccg

SEQ ID NO: 3191255 - RNA, 19 nt, Mycobacterium bovis subsp bovis AF2122/97
cgucgaggcugaccguggc

SEQ ID NO: 3191256 - RNA, 21 nt, Mycobacterium bovis subsp bovis AF2122/97
cgucgaggcugaccguggcgc

SEQ ID NO: 3191257 - RNA, 17 nt, Mycobacterium bovis subsp bovis AF2122/97
cgucgagggagcgccgc

SEQ ID NO: 3191258 - RNA, 18 nt, Mycobacterium bovis subsp bovis AF2122/97
cgucgagggagcgccgca

SEQ ID NO: 3191259 - RNA, 16 nt, Mycobacterium bovis subsp bovis AF2122/97
cgucgagggugaccaa

SEQ ID NO: 3191260 - RNA, 15 nt, Mycobacterium bovis subsp bovis AF2122/97
cgucgagguccacca

SEQ ID NO: 3191261 - RNA, 16 nt, Mycobacterium bovis subsp bovis AF2122/97
cgucgagguccaccac

SEQ ID NO: 3191262 - RNA, 14 nt, Mycobacterium bovis subsp bovis AF2122/97
cgucgagguggcgc

SEQ ID NO: 3191263 - RNA, 16 nt, Mycobacterium bovis subsp bovis AF2122/97
cgucgaguagugcagg

SEQ ID NO: 3191264 - RNA, 22 nt, Mycobacterium bovis subsp bovis AF2122/97
cgucgaguagugcaggugcccg

SEQ ID NO: 3191265 - RNA, 21 nt, Mycobacterium bovis subsp bovis AF2122/97
cgucgaguaguucgucgacgu

SEQ ID NO: 3191266 - RNA, 22 nt, Mycobacterium bovis subsp bovis AF2122/97
cgucgaguccaggccggcagcu

SEQ ID NO: 3191267 - RNA, 23 nt, Mycobacterium bovis subsp bovis AF2122/97
cgucgagucgccgaggacgccgg

SEQ ID NO: 3191268 - RNA, 14 nt, Mycobacterium bovis subsp bovis AF2122/97
cgucgagugccgcc

SEQ ID NO: 3191269 - RNA, 18 nt, Mycobacterium bovis subsp bovis AF2122/97
cgucgagugccgccaccg

SEQ ID NO: 3191270 - RNA, 19 nt, Mycobacterium bovis subsp bovis AF2122/97
cgucgagugccgccaccgc

SEQ ID NO: 3191271 - RNA, 19 nt, Mycobacterium bovis subsp bovis AF2122/97
cgucgaguuccggccggua

SEQ ID NO: 3191272 - RNA, 22 nt, Mycobacterium bovis subsp bovis AF2122/97
cgucgaguucgguugcccccag

SEQ ID NO: 3191273 - RNA, 14 nt, Mycobacterium bovis subsp bovis AF2122/97
cgucgauaucgcga

SEQ ID NO: 3191274 - RNA, 13 nt, Mycobacterium bovis subsp bovis AF2122/97
cgucgaucaccug

SEQ ID NO: 3191275 - RNA, 18 nt, Mycobacterium bovis subsp bovis AF2122/97
cgucgaucacgucgucag

SEQ ID NO: 3191276 - RNA, 23 nt, Mycobacterium bovis subsp bovis AF2122/97
cgucgaucacgugguccaaccgg

SEQ ID NO: 3191277 - RNA, 14 nt, Mycobacterium bovis subsp bovis AF2122/97
cgucgaucagcggc

SEQ ID NO: 3191278 - RNA, 18 nt, Mycobacterium bovis subsp bovis AF2122/97
cgucgaucagcggcagca

SEQ ID NO: 3191279 - RNA, 19 nt, Mycobacterium bovis subsp bovis AF2122/97
cgucgaucagugcaagacc

SEQ ID NO: 3191280 - RNA, 16 nt, Mycobacterium bovis subsp bovis AF2122/97
cgucgaucccggucgg

SEQ ID NO: 3191281 - RNA, 18 nt, Mycobacterium bovis subsp bovis AF2122/97
cgucgauccgucggcgga

SEQ ID NO: 3191282 - RNA, 15 nt, Mycobacterium bovis subsp bovis AF2122/97
cgucgaucgccgcga

SEQ ID NO: 3191283 - RNA, 19 nt, Mycobacterium bovis subsp bovis AF2122/97
cgucgaucgccgcgauggc

SEQ ID NO: 3191284 - RNA, 16 nt, Mycobacterium bovis subsp bovis AF2122/97
cgucgaucgccgcgcc

SEQ ID NO: 3191285 - RNA, 12 nt, Mycobacterium bovis subsp bovis AF2122/97
cgucgaucgcgg

SEQ ID NO: 3191286 - RNA, 15 nt, Mycobacterium bovis subsp bovis AF2122/97
cgucgaucgcggacc

SEQ ID NO: 3191287 - RNA, 14 nt, Mycobacterium bovis subsp bovis AF2122/97
cgucgaucggcuug

SEQ ID NO: 3191288 - RNA, 12 nt, Mycobacterium bovis subsp bovis AF2122/97
cgucgaucucga

SEQ ID NO: 3191289 - RNA, 22 nt, Mycobacterium bovis subsp bovis AF2122/97
cgucgaucucgaucgacccggu

SEQ ID NO: 3191290 - RNA, 14 nt, Mycobacterium bovis subsp bovis AF2122/97
cgucgaucucggcg

SEQ ID NO: 3191291 - RNA, 20 nt, Mycobacterium bovis subsp bovis AF2122/97
cgucgaugaccagcacaccg

SEQ ID NO: 3191292 - RNA, 17 nt, Mycobacterium bovis subsp bovis AF2122/97
cgucgaugagcgguacc

SEQ ID NO: 3191293 - RNA, 14 nt, Mycobacterium bovis subsp bovis AF2122/97
cgucgaugaucugc

SEQ ID NO: 3191294 - RNA, 20 nt, Mycobacterium bovis subsp bovis AF2122/97
cgucgaugaucugcuugcca

SEQ ID NO: 3191295 - RNA, 18 nt, Mycobacterium bovis subsp bovis AF2122/97
cgucgaugccggcugccg

SEQ ID NO: 3191296 - RNA, 22 nt, Mycobacterium bovis subsp bovis AF2122/97
cgucgaugccggcugccgcacc

SEQ ID NO: 3191297 - RNA, 15 nt, Mycobacterium bovis subsp bovis AF2122/97
cgucgaugcgcugcu

SEQ ID NO: 3191298 - RNA, 21 nt, Mycobacterium bovis subsp bovis AF2122/97
cgucgaugcgcugcucacgca

SEQ ID NO: 3191299 - RNA, 18 nt, Mycobacterium bovis subsp bovis AF2122/97
cgucgauggccacccggu

SEQ ID NO: 3191300 - RNA, 19 nt, Mycobacterium bovis subsp bovis AF2122/97
cgucgauguauccgaugcg

SEQ ID NO: 3191301 - RNA, 15 nt, Mycobacterium bovis subsp bovis AF2122/97
cgucgaugucauccg

SEQ ID NO: 3191302 - RNA, 19 nt, Mycobacterium bovis subsp bovis AF2122/97
cgucgauguccccggcggc

SEQ ID NO: 3191303 - RNA, 14 nt, Mycobacterium bovis subsp bovis AF2122/97
cgucgaugucgucg

SEQ ID NO: 3191304 - RNA, 19 nt, Mycobacterium bovis subsp bovis AF2122/97
cgucgaugucguuggccac

SEQ ID NO: 3191305 - RNA, 16 nt, Mycobacterium bovis subsp bovis AF2122/97
cgucgaugugcgccca

SEQ ID NO: 3191306 - RNA, 15 nt, Mycobacterium bovis subsp bovis AF2122/97
cgucgauguggcgcu

SEQ ID NO: 3191307 - RNA, 21 nt, Mycobacterium bovis subsp bovis AF2122/97
cgucgauguggcgcuccggcg

SEQ ID NO: 3191308 - RNA, 20 nt, Mycobacterium bovis subsp bovis AF2122/97
cgucgauuagcccacccaug

SEQ ID NO: 3191309 - RNA, 22 nt, Mycobacterium bovis subsp bovis AF2122/97
cgucgauugcaggucggcccag

SEQ ID NO: 3191310 - RNA, 16 nt, Mycobacterium bovis subsp bovis AF2122/97
cgucgauuucgacgac

SEQ ID NO: 3191311 - RNA, 18 nt, Mycobacterium bovis subsp bovis AF2122/97
cgucgauuucgacgacca

SEQ ID NO: 3191312 - RNA, 20 nt, Mycobacterium bovis subsp bovis AF2122/97
cgucgauuucgacgaccacc

SEQ ID NO: 3191313 - RNA, 21 nt, Mycobacterium bovis subsp bovis AF2122/97
cgucgauuucgacgaccaccu

SEQ ID NO: 3191314 - RNA, 15 nt, Mycobacterium bovis subsp bovis AF2122/97
cgucgauuucggcga

SEQ ID NO: 3191315 - RNA, 13 nt, Mycobacterium bovis subsp bovis AF2122/97
cgucgcaaacaga

SEQ ID NO: 3191316 - RNA, 19 nt, Mycobacterium bovis subsp bovis AF2122/97
cgucgcaaacuucgcgcac

SEQ ID NO: 3191317 - RNA, 22 nt, Mycobacterium bovis subsp bovis AF2122/97
cgucgcaaacuucgcgcacgcc

SEQ ID NO: 3191318 - RNA, 15 nt, Mycobacterium bovis subsp bovis AF2122/97
cgucgcaacccggcc

SEQ ID NO: 3191319 - RNA, 18 nt, Mycobacterium bovis subsp bovis AF2122/97
cgucgcaacgcgaucacc

SEQ ID NO: 3191320 - RNA, 14 nt, Mycobacterium bovis subsp bovis AF2122/97
cgucgcaacggccc

SEQ ID NO: 3191321 - RNA, 23 nt, Mycobacterium bovis subsp bovis AF2122/97
cgucgcaacggccccccccaggu

SEQ ID NO: 3191322 - RNA, 18 nt, Mycobacterium bovis subsp bovis AF2122/97
cgucgcaaggcccgcacc

SEQ ID NO: 3191323 - RNA, 23 nt, Mycobacterium bovis subsp bovis AF2122/97
cgucgcaaggcccgcaccgcuga

SEQ ID NO: 3191324 - RNA, 23 nt, Mycobacterium bovis subsp bovis AF2122/97
cgucgcacccaacuccaucagcg

SEQ ID NO: 3191325 - RNA, 20 nt, Mycobacterium bovis subsp bovis AF2122/97
cgucgcacccagggcguugg

SEQ ID NO: 3191326 - RNA, 15 nt, Mycobacterium bovis subsp bovis AF2122/97
cgucgcacgcgcgca

SEQ ID NO: 3191327 - RNA, 13 nt, Mycobacterium bovis subsp bovis AF2122/97
cgucgcagugcaa

SEQ ID NO: 3191328 - RNA, 23 nt, Mycobacterium bovis subsp bovis AF2122/97
cgucgcauacgcccacuccagca

SEQ ID NO: 3191329 - RNA, 16 nt, Mycobacterium bovis subsp bovis AF2122/97
cgucgcaucaccaggg

SEQ ID NO: 3191330 - RNA, 22 nt, Mycobacterium bovis subsp bovis AF2122/97
cgucgccaagcccaggcgaucg

SEQ ID NO: 3191331 - RNA, 19 nt, Mycobacterium bovis subsp bovis AF2122/97
cgucgccaaucugcgcgag

SEQ ID NO: 3191332 - RNA, 14 nt, Mycobacterium bovis subsp bovis AF2122/97
cgucgccaccaucg

SEQ ID NO: 3191333 - RNA, 12 nt, Mycobacterium bovis subsp bovis AF2122/97
cgucgccaccga

SEQ ID NO: 3191334 - RNA, 19 nt, Mycobacterium bovis subsp bovis AF2122/97
cgucgccaccgauggcggu

SEQ ID NO: 3191335 - RNA, 22 nt, Mycobacterium bovis subsp bovis AF2122/97
cgucgccaccgauggcgguggu

SEQ ID NO: 3191336 - RNA, 14 nt, Mycobacterium bovis subsp bovis AF2122/97
cgucgccaccggua

SEQ ID NO: 3191337 - RNA, 21 nt, Mycobacterium bovis subsp bovis AF2122/97
cgucgccaccgguaccgauca

SEQ ID NO: 3191338 - RNA, 16 nt, Mycobacterium bovis subsp bovis AF2122/97
cgucgccacgaugccg

SEQ ID NO: 3191339 - RNA, 18 nt, Mycobacterium bovis subsp bovis AF2122/97
cgucgccacgaugccggc

SEQ ID NO: 3191340 - RNA, 21 nt, Mycobacterium bovis subsp bovis AF2122/97
cgucgccacgcccagcgcccg

SEQ ID NO: 3191341 - RNA, 20 nt, Mycobacterium bovis subsp bovis AF2122/97
cgucgccagauagguccgau

SEQ ID NO: 3191342 - RNA, 12 nt, Mycobacterium bovis subsp bovis AF2122/97
cgucgccaggcc

SEQ ID NO: 3191343 - RNA, 13 nt, Mycobacterium bovis subsp bovis AF2122/97
cgucgccagggcc

SEQ ID NO: 3191344 - RNA, 17 nt, Mycobacterium bovis subsp bovis AF2122/97
cgucgccagggccgccg

SEQ ID NO: 3191345 - RNA, 22 nt, Mycobacterium bovis subsp bovis AF2122/97
cgucgccagggccgccgaagcu

SEQ ID NO: 3191346 - RNA, 23 nt, Mycobacterium bovis subsp bovis AF2122/97
cgucgccauuccaucgcgcaccg

SEQ ID NO: 3191347 - RNA, 15 nt, Mycobacterium bovis subsp bovis AF2122/97
cgucgcccagggugu

SEQ ID NO: 3191348 - RNA, 15 nt, Mycobacterium bovis subsp bovis AF2122/97
cgucgcccagugcgc

SEQ ID NO: 3191349 - RNA, 19 nt, Mycobacterium bovis subsp bovis AF2122/97
cgucgcccagugcgcaacc

SEQ ID NO: 3191350 - RNA, 21 nt, Mycobacterium bovis subsp bovis AF2122/97
cgucgcccagugcgcaaccca

SEQ ID NO: 3191351 - RNA, 14 nt, Mycobacterium bovis subsp bovis AF2122/97
cgucgcccccggcc

SEQ ID NO: 3191352 - RNA, 22 nt, Mycobacterium bovis subsp bovis AF2122/97
cgucgcccugacacaacaccgg

SEQ ID NO: 3191353 - RNA, 18 nt, Mycobacterium bovis subsp bovis AF2122/97
cgucgccgaacagcgacg

SEQ ID NO: 3191354 - RNA, 12 nt, Mycobacterium bovis subsp bovis AF2122/97
cgucgccgaccc

SEQ ID NO: 3191355 - RNA, 14 nt, Mycobacterium bovis subsp bovis AF2122/97
cgucgccgacccgg

SEQ ID NO: 3191356 - RNA, 18 nt, Mycobacterium bovis subsp bovis AF2122/97
cgucgccgacccgggggc

SEQ ID NO: 3191357 - RNA, 14 nt, Mycobacterium bovis subsp bovis AF2122/97
cgucgccgacgccg

SEQ ID NO: 3191358 - RNA, 15 nt, Mycobacterium bovis subsp bovis AF2122/97
cgucgccgacgccgg

SEQ ID NO: 3191359 - RNA, 13 nt, Mycobacterium bovis subsp bovis AF2122/97
cgucgccgacggu

SEQ ID NO: 3191360 - RNA, 19 nt, Mycobacterium bovis subsp bovis AF2122/97
cgucgccgacgguuaccca

SEQ ID NO: 3191361 - RNA, 19 nt, Mycobacterium bovis subsp bovis AF2122/97
cgucgccgaucagcugcgc

SEQ ID NO: 3191362 - RNA, 13 nt, Mycobacterium bovis subsp bovis AF2122/97
cgucgccgccauu

SEQ ID NO: 3191363 - RNA, 16 nt, Mycobacterium bovis subsp bovis AF2122/97
cgucgccgccauugcc

SEQ ID NO: 3191364 - RNA, 15 nt, Mycobacterium bovis subsp bovis AF2122/97
cgucgccgcccgugc

SEQ ID NO: 3191365 - RNA, 20 nt, Mycobacterium bovis subsp bovis AF2122/97
cgucgccgcccuggccgccg

SEQ ID NO: 3191366 - RNA, 21 nt, Mycobacterium bovis subsp bovis AF2122/97
cgucgccgcccuggccgccgg

SEQ ID NO: 3191367 - RNA, 22 nt, Mycobacterium bovis subsp bovis AF2122/97
cgucgccgcccuggccgccggc

SEQ ID NO: 3191368 - RNA, 11 nt, Mycobacterium bovis subsp bovis AF2122/97
cgucgccgccg

SEQ ID NO: 3191369 - RNA, 14 nt, Mycobacterium bovis subsp bovis AF2122/97
cgucgccgccgcgg

SEQ ID NO: 3191370 - RNA, 15 nt, Mycobacterium bovis subsp bovis AF2122/97
cgucgccgccgcggg

SEQ ID NO: 3191371 - RNA, 16 nt, Mycobacterium bovis subsp bovis AF2122/97
cgucgccgccgcgggc

SEQ ID NO: 3191372 - RNA, 19 nt, Mycobacterium bovis subsp bovis AF2122/97
cgucgccgccgcgggcgcc

SEQ ID NO: 3191373 - RNA, 17 nt, Mycobacterium bovis subsp bovis AF2122/97
cgucgccgccgcuaccg

SEQ ID NO: 3191374 - RNA, 18 nt, Mycobacterium bovis subsp bovis AF2122/97
cgucgccgccgcuaccgc

SEQ ID NO: 3191375 - RNA, 12 nt, Mycobacterium bovis subsp bovis AF2122/97
cgucgccgccgg

SEQ ID NO: 3191376 - RNA, 13 nt, Mycobacterium bovis subsp bovis AF2122/97
cgucgccgccggc

SEQ ID NO: 3191377 - RNA, 19 nt, Mycobacterium bovis subsp bovis AF2122/97
cgucgccgccggcgccgcc

SEQ ID NO: 3191378 - RNA, 15 nt, Mycobacterium bovis subsp bovis AF2122/97
cgucgccgccggcuc

SEQ ID NO: 3191379 - RNA, 19 nt, Mycobacterium bovis subsp bovis AF2122/97
cgucgccgccggcuccggc

SEQ ID NO: 3191380 - RNA, 23 nt, Mycobacterium bovis subsp bovis AF2122/97
cgucgccgccggcuccggcggug

SEQ ID NO: 3191381 - RNA, 18 nt, Mycobacterium bovis subsp bovis AF2122/97
cgucgccgccgggcagug

SEQ ID NO: 3191382 - RNA, 16 nt, Mycobacterium bovis subsp bovis AF2122/97
cgucgccgccgguccc

SEQ ID NO: 3191383 - RNA, 12 nt, Mycobacterium bovis subsp bovis AF2122/97
cgucgccgccgu

SEQ ID NO: 3191384 - RNA, 16 nt, Mycobacterium bovis subsp bovis AF2122/97
cgucgccgccgucacc

SEQ ID NO: 3191385 - RNA, 14 nt, Mycobacterium bovis subsp bovis AF2122/97
cgucgccgccguua

SEQ ID NO: 3191386 - RNA, 16 nt, Mycobacterium bovis subsp bovis AF2122/97
cgucgccgccguugcc

SEQ ID NO: 3191387 - RNA, 23 nt, Mycobacterium bovis subsp bovis AF2122/97
cgucgccgccguugccgccggcg

SEQ ID NO: 3191388 - RNA, 14 nt, Mycobacterium bovis subsp bovis AF2122/97
cgucgccgcggcgg

SEQ ID NO: 3191389 - RNA, 15 nt, Mycobacterium bovis subsp bovis AF2122/97
cgucgccgcggcggc

SEQ ID NO: 3191390 - RNA, 16 nt, Mycobacterium bovis subsp bovis AF2122/97
cgucgccgcggcggca

SEQ ID NO: 3191391 - RNA, 15 nt, Mycobacterium bovis subsp bovis AF2122/97
cgucgccggacgaca

SEQ ID NO: 3191392 - RNA, 18 nt, Mycobacterium bovis subsp bovis AF2122/97
cgucgccggagucgauca

SEQ ID NO: 3191393 - RNA, 20 nt, Mycobacterium bovis subsp bovis AF2122/97
cgucgccggagucgaucagc

SEQ ID NO: 3191394 - RNA, 19 nt, Mycobacterium bovis subsp bovis AF2122/97
cgucgccggauagcgcagc

SEQ ID NO: 3191395 - RNA, 23 nt, Mycobacterium bovis subsp bovis AF2122/97
cgucgccggauagcgcagcucgc

SEQ ID NO: 3191396 - RNA, 13 nt, Mycobacterium bovis subsp bovis AF2122/97
cgucgccggcacc

SEQ ID NO: 3191397 - RNA, 14 nt, Mycobacterium bovis subsp bovis AF2122/97
cgucgccggcaccg

SEQ ID NO: 3191398 - RNA, 13 nt, Mycobacterium bovis subsp bovis AF2122/97
cgucgccggcccc

SEQ ID NO: 3191399 - RNA, 19 nt, Mycobacterium bovis subsp bovis AF2122/97
cgucgccggccccgccggc

SEQ ID NO: 3191400 - RNA, 13 nt, Mycobacterium bovis subsp bovis AF2122/97
cgucgccggccgu

SEQ ID NO: 3191401 - RNA, 14 nt, Mycobacterium bovis subsp bovis AF2122/97
cgucgccggccuug

SEQ ID NO: 3191402 - RNA, 23 nt, Mycobacterium bovis subsp bovis AF2122/97
cgucgccggccuugagcacccga

SEQ ID NO: 3191403 - RNA, 13 nt, Mycobacterium bovis subsp bovis AF2122/97
cgucgccggcggc

SEQ ID NO: 3191404 - RNA, 14 nt, Mycobacterium bovis subsp bovis AF2122/97
cgucgccggcggcg

SEQ ID NO: 3191405 - RNA, 17 nt, Mycobacterium bovis subsp bovis AF2122/97
cgucgccggcggcggug

SEQ ID NO: 3191406 - RNA, 16 nt, Mycobacterium bovis subsp bovis AF2122/97
cgucgccggcuaccgc

SEQ ID NO: 3191407 - RNA, 20 nt, Mycobacterium bovis subsp bovis AF2122/97
cgucgccggucaggccgccg

SEQ ID NO: 3191408 - RNA, 21 nt, Mycobacterium bovis subsp bovis AF2122/97
cgucgccguacaaccacccac

SEQ ID NO: 3191409 - RNA, 22 nt, Mycobacterium bovis subsp bovis AF2122/97
cgucgccguacaaccacccacc

SEQ ID NO: 3191410 - RNA, 17 nt, Mycobacterium bovis subsp bovis AF2122/97
cgucgccguccagucgg

SEQ ID NO: 3191411 - RNA, 13 nt, Mycobacterium bovis subsp bovis AF2122/97
cgucgccgucggu

SEQ ID NO: 3191412 - RNA, 21 nt, Mycobacterium bovis subsp bovis AF2122/97
cgucgccgucggugccgccgc

SEQ ID NO: 3191413 - RNA, 22 nt, Mycobacterium bovis subsp bovis AF2122/97
cgucgccgucggugccgccgcc

SEQ ID NO: 3191414 - RNA, 15 nt, Mycobacterium bovis subsp bovis AF2122/97
cgucgccugccgacg

SEQ ID NO: 3191415 - RNA, 13 nt, Mycobacterium bovis subsp bovis AF2122/97
cgucgccugcgac

SEQ ID NO: 3191416 - RNA, 14 nt, Mycobacterium bovis subsp bovis AF2122/97
cgucgccugcgacu

SEQ ID NO: 3191417 - RNA, 21 nt, Mycobacterium bovis subsp bovis AF2122/97
cgucgccuucguaaccacgac

SEQ ID NO: 3191418 - RNA, 14 nt, Mycobacterium bovis subsp bovis AF2122/97
cgucgcgacgucgg

SEQ ID NO: 3191419 - RNA, 19 nt, Mycobacterium bovis subsp bovis AF2122/97
cgucgcgauccacuccggc

SEQ ID NO: 3191420 - RNA, 18 nt, Mycobacterium bovis subsp bovis AF2122/97
cgucgcgauugccgcggu

SEQ ID NO: 3191421 - RNA, 19 nt, Mycobacterium bovis subsp bovis AF2122/97
cgucgcgauugccgcgguu

SEQ ID NO: 3191422 - RNA, 13 nt, Mycobacterium bovis subsp bovis AF2122/97
cgucgcgcacggc

SEQ ID NO: 3191423 - RNA, 13 nt, Mycobacterium bovis subsp bovis AF2122/97
cgucgcgcaucgc

SEQ ID NO: 3191424 - RNA, 15 nt, Mycobacterium bovis subsp bovis AF2122/97
cgucgcgccaggcgc

SEQ ID NO: 3191425 - RNA, 17 nt, Mycobacterium bovis subsp bovis AF2122/97
cgucgcgccaggcgcga

SEQ ID NO: 3191426 - RNA, 16 nt, Mycobacterium bovis subsp bovis AF2122/97
cgucgcgccgcguggu

SEQ ID NO: 3191427 - RNA, 22 nt, Mycobacterium bovis subsp bovis AF2122/97
cgucgcgccgcgugguuccggc

SEQ ID NO: 3191428 - RNA, 16 nt, Mycobacterium bovis subsp bovis AF2122/97
cgucgcgccugcccgg

SEQ ID NO: 3191429 - RNA, 14 nt, Mycobacterium bovis subsp bovis AF2122/97
cgucgcgcugccgg

SEQ ID NO: 3191430 - RNA, 17 nt, Mycobacterium bovis subsp bovis AF2122/97
cgucgcgcugccggccg

SEQ ID NO: 3191431 - RNA, 19 nt, Mycobacterium bovis subsp bovis AF2122/97
cgucgcgcugccggccgcg

SEQ ID NO: 3191432 - RNA, 16 nt, Mycobacterium bovis subsp bovis AF2122/97
cgucgcggaaucgcga

SEQ ID NO: 3191433 - RNA, 22 nt, Mycobacterium bovis subsp bovis AF2122/97
cgucgcggaaucgcgacacgcg

SEQ ID NO: 3191434 - RNA, 17 nt, Mycobacterium bovis subsp bovis AF2122/97
cgucgcggacggugcgg

SEQ ID NO: 3191435 - RNA, 16 nt, Mycobacterium bovis subsp bovis AF2122/97
cgucgcggaucagccc

SEQ ID NO: 3191436 - RNA, 18 nt, Mycobacterium bovis subsp bovis AF2122/97
cgucgcggaucagcccgc

SEQ ID NO: 3191437 - RNA, 23 nt, Mycobacterium bovis subsp bovis AF2122/97
cgucgcggaucagcccgcgcagc

SEQ ID NO: 3191438 - RNA, 20 nt, Mycobacterium bovis subsp bovis AF2122/97
cgucgcggauugccgcgcgc

SEQ ID NO: 3191439 - RNA, 16 nt, Mycobacterium bovis subsp bovis AF2122/97
cgucgcggcacgccca

SEQ ID NO: 3191440 - RNA, 21 nt, Mycobacterium bovis subsp bovis AF2122/97
cgucgcggccacggucagcca

SEQ ID NO: 3191441 - RNA, 15 nt, Mycobacterium bovis subsp bovis AF2122/97
cgucgcggccagcag

SEQ ID NO: 3191442 - RNA, 16 nt, Mycobacterium bovis subsp bovis AF2122/97
cgucgcggccagcagg

SEQ ID NO: 3191443 - RNA, 18 nt, Mycobacterium bovis subsp bovis AF2122/97
cgucgcggccgagacggc

SEQ ID NO: 3191444 - RNA, 16 nt, Mycobacterium bovis subsp bovis AF2122/97
cgucgcggccgcggcc

SEQ ID NO: 3191445 - RNA, 17 nt, Mycobacterium bovis subsp bovis AF2122/97
cgucgcggccggcggcc

SEQ ID NO: 3191446 - RNA, 20 nt, Mycobacterium bovis subsp bovis AF2122/97
cgucgcggccggcggccgcc

SEQ ID NO: 3191447 - RNA, 21 nt, Mycobacterium bovis subsp bovis AF2122/97
cgucgcggccggcggccgccc

SEQ ID NO: 3191448 - RNA, 23 nt, Mycobacterium bovis subsp bovis AF2122/97
cgucgcggccggcggccgcccag

SEQ ID NO: 3191449 - RNA, 15 nt, Mycobacterium bovis subsp bovis AF2122/97
cgucgcggccgucgc

SEQ ID NO: 3191450 - RNA, 18 nt, Mycobacterium bovis subsp bovis AF2122/97
cgucgcggccgucgcggg

SEQ ID NO: 3191451 - RNA, 14 nt, Mycobacterium bovis subsp bovis AF2122/97
cgucgcggcggcac

SEQ ID NO: 3191452 - RNA, 13 nt, Mycobacterium bovis subsp bovis AF2122/97
cgucgcgggagaa

SEQ ID NO: 3191453 - RNA, 23 nt, Mycobacterium bovis subsp bovis AF2122/97
cgucgcgggagaaaacggcggcg

SEQ ID NO: 3191454 - RNA, 14 nt, Mycobacterium bovis subsp bovis AF2122/97
cgucgcgggccacc

SEQ ID NO: 3191455 - RNA, 15 nt, Mycobacterium bovis subsp bovis AF2122/97
cgucgcguccgcgau

SEQ ID NO: 3191456 - RNA, 18 nt, Mycobacterium bovis subsp bovis AF2122/97
cgucgcguccgcgaucug

SEQ ID NO: 3191457 - RNA, 12 nt, Mycobacterium bovis subsp bovis AF2122/97
cgucgcgucgac

SEQ ID NO: 3191458 - RNA, 16 nt, Mycobacterium bovis subsp bovis AF2122/97
cgucgcgucgccaggc

SEQ ID NO: 3191459 - RNA, 18 nt, Mycobacterium bovis subsp bovis AF2122/97
cgucgcgucgccaggccc

SEQ ID NO: 3191460 - RNA, 22 nt, Mycobacterium bovis subsp bovis AF2122/97
cgucgcguucuccggcaccggu

SEQ ID NO: 3191461 - RNA, 16 nt, Mycobacterium bovis subsp bovis AF2122/97
cgucgcuagaucccag

SEQ ID NO: 3191462 - RNA, 18 nt, Mycobacterium bovis subsp bovis AF2122/97
cgucgcuaucgugcgccg

SEQ ID NO: 3191463 - RNA, 23 nt, Mycobacterium bovis subsp bovis AF2122/97
cgucgcuaucgugcgccgacggu

SEQ ID NO: 3191464 - RNA, 17 nt, Mycobacterium bovis subsp bovis AF2122/97
cgucgcuaugcgccgca

SEQ ID NO: 3191465 - RNA, 18 nt, Mycobacterium bovis subsp bovis AF2122/97
cgucgcuaugcgccgcau

SEQ ID NO: 3191466 - RNA, 18 nt, Mycobacterium bovis subsp bovis AF2122/97
cgucgcugaaaucggugg

SEQ ID NO: 3191467 - RNA, 18 nt, Mycobacterium bovis subsp bovis AF2122/97
cgucgcugaacagacggc

SEQ ID NO: 3191468 - RNA, 21 nt, Mycobacterium bovis subsp bovis AF2122/97
cgucgcugaauuucgaugagg

SEQ ID NO: 3191469 - RNA, 14 nt, Mycobacterium bovis subsp bovis AF2122/97
cgucgcugaccgcg

SEQ ID NO: 3191470 - RNA, 19 nt, Mycobacterium bovis subsp bovis AF2122/97
cgucgcugacgcccuccug

SEQ ID NO: 3191471 - RNA, 15 nt, Mycobacterium bovis subsp bovis AF2122/97
cgucgcugagcaaaa

SEQ ID NO: 3191472 - RNA, 17 nt, Mycobacterium bovis subsp bovis AF2122/97
cgucgcugagcacggcg

SEQ ID NO: 3191473 - RNA, 15 nt, Mycobacterium bovis subsp bovis AF2122/97
cgucgcugagcagcg

SEQ ID NO: 3191474 - RNA, 16 nt, Mycobacterium bovis subsp bovis AF2122/97
cgucgcugagcagcgc

SEQ ID NO: 3191475 - RNA, 21 nt, Mycobacterium bovis subsp bovis AF2122/97
cgucgcugagcagcgccgcgu

SEQ ID NO: 3191476 - RNA, 22 nt, Mycobacterium bovis subsp bovis AF2122/97
cgucgcugcccaucacacccgg

SEQ ID NO: 3191477 - RNA, 21 nt, Mycobacterium bovis subsp bovis AF2122/97
cgucgcugcccaugcggcagg

SEQ ID NO: 3191478 - RNA, 22 nt, Mycobacterium bovis subsp bovis AF2122/97
cgucgcugccccuugggcucga

SEQ ID NO: 3191479 - RNA, 14 nt, Mycobacterium bovis subsp bovis AF2122/97
cgucgcugcccgcg

SEQ ID NO: 3191480 - RNA, 18 nt, Mycobacterium bovis subsp bovis AF2122/97
cgucgcugcccgcgcggc

SEQ ID NO: 3191481 - RNA, 19 nt, Mycobacterium bovis subsp bovis AF2122/97
cgucgcugcccgcgcggcc

SEQ ID NO: 3191482 - RNA, 16 nt, Mycobacterium bovis subsp bovis AF2122/97
cgucgcugccgccacc

SEQ ID NO: 3191483 - RNA, 15 nt, Mycobacterium bovis subsp bovis AF2122/97
cgucgcuggccggca

SEQ ID NO: 3191484 - RNA, 17 nt, Mycobacterium bovis subsp bovis AF2122/97
cgucgcuggccggcacc

SEQ ID NO: 3191485 - RNA, 18 nt, Mycobacterium bovis subsp bovis AF2122/97
cgucgcuggccggcaccg

SEQ ID NO: 3191486 - RNA, 21 nt, Mycobacterium bovis subsp bovis AF2122/97
cgucgcugggaggcgcggucg

SEQ ID NO: 3191487 - RNA, 22 nt, Mycobacterium bovis subsp bovis AF2122/97
cgucgcugggaggcgcggucga

SEQ ID NO: 3191488 - RNA, 16 nt, Mycobacterium bovis subsp bovis AF2122/97
cgucgcugguggcggu

SEQ ID NO: 3191489 - RNA, 18 nt, Mycobacterium bovis subsp bovis AF2122/97
cgucgcugguggcgguca

SEQ ID NO: 3191490 - RNA, 22 nt, Mycobacterium bovis subsp bovis AF2122/97
cgucgcugguggcggucaccac

SEQ ID NO: 3191491 - RNA, 20 nt, Mycobacterium bovis subsp bovis AF2122/97
cgucgcuguaggccagcccg

SEQ ID NO: 3191492 - RNA, 23 nt, Mycobacterium bovis subsp bovis AF2122/97
cgucgcuguaggccagcccggcg

SEQ ID NO: 3191493 - RNA, 20 nt, Mycobacterium bovis subsp bovis AF2122/97
cgucgcuucggcaccgacug

SEQ ID NO: 3191494 - RNA, 13 nt, Mycobacterium bovis subsp bovis AF2122/97
cgucgcuugcugg

SEQ ID NO: 3191495 - RNA, 22 nt, Mycobacterium bovis subsp bovis AF2122/97
cgucgcuuggaucgucgcugug

SEQ ID NO: 3191496 - RNA, 20 nt, Mycobacterium bovis subsp bovis AF2122/97
cgucggaaauuccaagcggc

SEQ ID NO: 3191497 - RNA, 20 nt, Mycobacterium bovis subsp bovis AF2122/97
cgucggaacugaccacgucg

SEQ ID NO: 3191498 - RNA, 18 nt, Mycobacterium bovis subsp bovis AF2122/97
cgucggaauacaacagcu

SEQ ID NO: 3191499 - RNA, 15 nt, Mycobacterium bovis subsp bovis AF2122/97
cgucggacagcuuuc

SEQ ID NO: 3191500 - RNA, 17 nt, Mycobacterium bovis subsp bovis AF2122/97
cgucggacauaccgcga

SEQ ID NO: 3191501 - RNA, 14 nt, Mycobacterium bovis subsp bovis AF2122/97
cgucggaccagcug

SEQ ID NO: 3191502 - RNA, 15 nt, Mycobacterium bovis subsp bovis AF2122/97
cgucggaccagcugc

SEQ ID NO: 3191503 - RNA, 16 nt, Mycobacterium bovis subsp bovis AF2122/97
cgucggagaccagcuc

SEQ ID NO: 3191504 - RNA, 17 nt, Mycobacterium bovis subsp bovis AF2122/97
cgucggagccggccacc

SEQ ID NO: 3191505 - RNA, 17 nt, Mycobacterium bovis subsp bovis AF2122/97
cgucggaguaccgcgcg

SEQ ID NO: 3191506 - RNA, 20 nt, Mycobacterium bovis subsp bovis AF2122/97
cgucggaguaccgcgcguug

SEQ ID NO: 3191507 - RNA, 16 nt, Mycobacterium bovis subsp bovis AF2122/97
cgucggagucgacggu

SEQ ID NO: 3191508 - RNA, 20 nt, Mycobacterium bovis subsp bovis AF2122/97
cgucggauggaaggcggcca

SEQ ID NO: 3191509 - RNA, 22 nt, Mycobacterium bovis subsp bovis AF2122/97
cgucggauggaaggcggccagg

SEQ ID NO: 3191510 - RNA, 22 nt, Mycobacterium bovis subsp bovis AF2122/97
cgucggcaaagaaggcgacccg

SEQ ID NO: 3191511 - RNA, 21 nt, Mycobacterium bovis subsp bovis AF2122/97
cgucggcaauacuccgcugac

SEQ ID NO: 3191512 - RNA, 22 nt, Mycobacterium bovis subsp bovis AF2122/97
cgucggcaauacuccgcugacg

SEQ ID NO: 3191513 - RNA, 15 nt, Mycobacterium bovis subsp bovis AF2122/97
cgucggcaaucucga

SEQ ID NO: 3191514 - RNA, 17 nt, Mycobacterium bovis subsp bovis AF2122/97
cgucggcaccagcagcc

SEQ ID NO: 3191515 - RNA, 19 nt, Mycobacterium bovis subsp bovis AF2122/97
cgucggcacccucggcguu

SEQ ID NO: 3191516 - RNA, 17 nt, Mycobacterium bovis subsp bovis AF2122/97
cgucggcaccgauccug

SEQ ID NO: 3191517 - RNA, 22 nt, Mycobacterium bovis subsp bovis AF2122/97
cgucggcaccgguuuucgccgg

SEQ ID NO: 3191518 - RNA, 22 nt, Mycobacterium bovis subsp bovis AF2122/97
cgucggcaggcagcucggcaac

SEQ ID NO: 3191519 - RNA, 14 nt, Mycobacterium bovis subsp bovis AF2122/97
cgucggcaucggcg

SEQ ID NO: 3191520 - RNA, 15 nt, Mycobacterium bovis subsp bovis AF2122/97
cgucggcaucggcgg

SEQ ID NO: 3191521 - RNA, 23 nt, Mycobacterium bovis subsp bovis AF2122/97
cgucggcaugacauacagcgggc

SEQ ID NO: 3191522 - RNA, 16 nt, Mycobacterium bovis subsp bovis AF2122/97
cgucggcaugggccgg

SEQ ID NO: 3191523 - RNA, 18 nt, Mycobacterium bovis subsp bovis AF2122/97
cgucggcaugggccggcg

SEQ ID NO: 3191524 - RNA, 21 nt, Mycobacterium bovis subsp bovis AF2122/97
cgucggcaugggccggcgccg

SEQ ID NO: 3191525 - RNA, 23 nt, Mycobacterium bovis subsp bovis AF2122/97
cgucggcaugggccggcgccgca

SEQ ID NO: 3191526 - RNA, 16 nt, Mycobacterium bovis subsp bovis AF2122/97
cgucggcauugcgcag

SEQ ID NO: 3191527 - RNA, 20 nt, Mycobacterium bovis subsp bovis AF2122/97
cgucggcauugcgcaggaug

SEQ ID NO: 3191528 - RNA, 13 nt, Mycobacterium bovis subsp bovis AF2122/97
cgucggccaaaga

SEQ ID NO: 3191529 - RNA, 22 nt, Mycobacterium bovis subsp bovis AF2122/97
cgucggccaaagacccggcacc

SEQ ID NO: 3191530 - RNA, 14 nt, Mycobacterium bovis subsp bovis AF2122/97
cgucggccacccgg

SEQ ID NO: 3191531 - RNA, 16 nt, Mycobacterium bovis subsp bovis AF2122/97
cgucggccaccgccug

SEQ ID NO: 3191532 - RNA, 14 nt, Mycobacterium bovis subsp bovis AF2122/97
cgucggccaccgcg

SEQ ID NO: 3191533 - RNA, 16 nt, Mycobacterium bovis subsp bovis AF2122/97
cgucggccaccgcggc

SEQ ID NO: 3191534 - RNA, 20 nt, Mycobacterium bovis subsp bovis AF2122/97
cgucggccagcagaucaggu

SEQ ID NO: 3191535 - RNA, 14 nt, Mycobacterium bovis subsp bovis AF2122/97
cgucggccagcagc

SEQ ID NO: 3191536 - RNA, 12 nt, Mycobacterium bovis subsp bovis AF2122/97
cgucggccagga

SEQ ID NO: 3191537 - RNA, 13 nt, Mycobacterium bovis subsp bovis AF2122/97
cgucggccaggcc

SEQ ID NO: 3191538 - RNA, 19 nt, Mycobacterium bovis subsp bovis AF2122/97
cgucggccaggccacgggc

SEQ ID NO: 3191539 - RNA, 20 nt, Mycobacterium bovis subsp bovis AF2122/97
cgucggccaggccacgggcg

SEQ ID NO: 3191540 - RNA, 22 nt, Mycobacterium bovis subsp bovis AF2122/97
cgucggccaugguguucggcag

SEQ ID NO: 3191541 - RNA, 17 nt, Mycobacterium bovis subsp bovis AF2122/97
cgucggcccgcggucgc

SEQ ID NO: 3191542 - RNA, 13 nt, Mycobacterium bovis subsp bovis AF2122/97
cgucggcccggug

SEQ ID NO: 3191543 - RNA, 20 nt, Mycobacterium bovis subsp bovis AF2122/97
cgucggccgacaccgccacc

SEQ ID NO: 3191544 - RNA, 22 nt, Mycobacterium bovis subsp bovis AF2122/97
cgucggccgacaccgccaccac

SEQ ID NO: 3191545 - RNA, 23 nt, Mycobacterium bovis subsp bovis AF2122/97
cgucggccgagucgauugccacc

SEQ ID NO: 3191546 - RNA, 15 nt, Mycobacterium bovis subsp bovis AF2122/97
cgucggccgcaucgc

SEQ ID NO: 3191547 - RNA, 12 nt, Mycobacterium bovis subsp bovis AF2122/97
cgucggccggca

SEQ ID NO: 3191548 - RNA, 21 nt, Mycobacterium bovis subsp bovis AF2122/97
cgucggccggcaacgugcggu

SEQ ID NO: 3191549 - RNA, 15 nt, Mycobacterium bovis subsp bovis AF2122/97
cgucggccggcaccc

SEQ ID NO: 3191550 - RNA, 15 nt, Mycobacterium bovis subsp bovis AF2122/97
cgucggccugcgccg

SEQ ID NO: 3191551 - RNA, 17 nt, Mycobacterium bovis subsp bovis AF2122/97
cgucggccugcgccggc

SEQ ID NO: 3191552 - RNA, 18 nt, Mycobacterium bovis subsp bovis AF2122/97
cgucggccugcgccggcg

SEQ ID NO: 3191553 - RNA, 23 nt, Mycobacterium bovis subsp bovis AF2122/97
cgucggccugcgccggcgcugcc

SEQ ID NO: 3191554 - RNA, 12 nt, Mycobacterium bovis subsp bovis AF2122/97
cgucggccugga

SEQ ID NO: 3191555 - RNA, 14 nt, Mycobacterium bovis subsp bovis AF2122/97
cgucggcgaaggug

SEQ ID NO: 3191556 - RNA, 20 nt, Mycobacterium bovis subsp bovis AF2122/97
cgucggcgaauccgccgccu

SEQ ID NO: 3191557 - RNA, 21 nt, Mycobacterium bovis subsp bovis AF2122/97
cgucggcgaauccgccgccua

SEQ ID NO: 3191558 - RNA, 12 nt, Mycobacterium bovis subsp bovis AF2122/97
cgucggcgacca

SEQ ID NO: 3191559 - RNA, 20 nt, Mycobacterium bovis subsp bovis AF2122/97
cgucggcgagcagacgccgc

SEQ ID NO: 3191560 - RNA, 21 nt, Mycobacterium bovis subsp bovis AF2122/97
cgucggcgauaucggagcgca

SEQ ID NO: 3191561 - RNA, 22 nt, Mycobacterium bovis subsp bovis AF2122/97
cgucggcgaugaacagcgacgc

SEQ ID NO: 3191562 - RNA, 13 nt, Mycobacterium bovis subsp bovis AF2122/97
cgucggcgcauca

SEQ ID NO: 3191563 - RNA, 18 nt, Mycobacterium bovis subsp bovis AF2122/97
cgucggcgcccagcucga

SEQ ID NO: 3191564 - RNA, 13 nt, Mycobacterium bovis subsp bovis AF2122/97
cgucggcgccgaa

SEQ ID NO: 3191565 - RNA, 14 nt, Mycobacterium bovis subsp bovis AF2122/97
cgucggcgccgaac

SEQ ID NO: 3191566 - RNA, 16 nt, Mycobacterium bovis subsp bovis AF2122/97
cgucggcgccggcggc

SEQ ID NO: 3191567 - RNA, 17 nt, Mycobacterium bovis subsp bovis AF2122/97
cgucggcgccggcggcc

SEQ ID NO: 3191568 - RNA, 18 nt, Mycobacterium bovis subsp bovis AF2122/97
cgucggcgccucggacca

SEQ ID NO: 3191569 - RNA, 14 nt, Mycobacterium bovis subsp bovis AF2122/97
cgucggcgcggccg

SEQ ID NO: 3191570 - RNA, 13 nt, Mycobacterium bovis subsp bovis AF2122/97
cgucggcgcggcu

SEQ ID NO: 3191571 - RNA, 18 nt, Mycobacterium bovis subsp bovis AF2122/97
cgucggcgcugacgaccc

SEQ ID NO: 3191572 - RNA, 19 nt, Mycobacterium bovis subsp bovis AF2122/97
cgucggcgcugacgacccu

SEQ ID NO: 3191573 - RNA, 16 nt, Mycobacterium bovis subsp bovis AF2122/97
cgucggcgcugcgcgc

SEQ ID NO: 3191574 - RNA, 23 nt, Mycobacterium bovis subsp bovis AF2122/97
cgucggcggccgucaccggucgg

SEQ ID NO: 3191575 - RNA, 14 nt, Mycobacterium bovis subsp bovis AF2122/97
cgucggcggcguug

SEQ ID NO: 3191576 - RNA, 15 nt, Mycobacterium bovis subsp bovis AF2122/97
cgucggcgggcggca

SEQ ID NO: 3191577 - RNA, 18 nt, Mycobacterium bovis subsp bovis AF2122/97
cgucggcgggcggcagcg

SEQ ID NO: 3191578 - RNA, 17 nt, Mycobacterium bovis subsp bovis AF2122/97
cgucggcgggcugcagu

SEQ ID NO: 3191579 - RNA, 19 nt, Mycobacterium bovis subsp bovis AF2122/97
cgucggcgggcugcaguga

SEQ ID NO: 3191580 - RNA, 14 nt, Mycobacterium bovis subsp bovis AF2122/97
cgucggcggugagc

SEQ ID NO: 3191581 - RNA, 21 nt, Mycobacterium bovis subsp bovis AF2122/97
cgucggcggugagcaacuggc

SEQ ID NO: 3191582 - RNA, 17 nt, Mycobacterium bovis subsp bovis AF2122/97
cgucggcguagacguag

SEQ ID NO: 3191583 - RNA, 13 nt, Mycobacterium bovis subsp bovis AF2122/97
cgucggcgucgaa

SEQ ID NO: 3191584 - RNA, 13 nt, Mycobacterium bovis subsp bovis AF2122/97
cgucggcgucgag

SEQ ID NO: 3191585 - RNA, 15 nt, Mycobacterium bovis subsp bovis AF2122/97
cgucggcgucgcgga

SEQ ID NO: 3191586 - RNA, 13 nt, Mycobacterium bovis subsp bovis AF2122/97
cgucggcgucggu

SEQ ID NO: 3191587 - RNA, 21 nt, Mycobacterium bovis subsp bovis AF2122/97
cgucggcguggucgcgcggca

SEQ ID NO: 3191588 - RNA, 23 nt, Mycobacterium bovis subsp bovis AF2122/97
cgucggcguggucgcgcggcacc

SEQ ID NO: 3191589 - RNA, 15 nt, Mycobacterium bovis subsp bovis AF2122/97
cgucggcuccagguc

SEQ ID NO: 3191590 - RNA, 17 nt, Mycobacterium bovis subsp bovis AF2122/97
cgucggcucgucgcucg

SEQ ID NO: 3191591 - RNA, 23 nt, Mycobacterium bovis subsp bovis AF2122/97
cgucggcugccgcaaacgcggcg

SEQ ID NO: 3191592 - RNA, 14 nt, Mycobacterium bovis subsp bovis AF2122/97
cgucggcuucaccu

SEQ ID NO: 3191593 - RNA, 19 nt, Mycobacterium bovis subsp bovis AF2122/97
cgucggcuucucgaucggc

SEQ ID NO: 3191594 - RNA, 16 nt, Mycobacterium bovis subsp bovis AF2122/97
cgucgggaccaccgac

SEQ ID NO: 3191595 - RNA, 19 nt, Mycobacterium bovis subsp bovis AF2122/97
cgucgggaccaccgaccgc

SEQ ID NO: 3191596 - RNA, 18 nt, Mycobacterium bovis subsp bovis AF2122/97
cgucgggacgccgccccc

SEQ ID NO: 3191597 - RNA, 17 nt, Mycobacterium bovis subsp bovis AF2122/97
cgucgggacggccaaca

SEQ ID NO: 3191598 - RNA, 22 nt, Mycobacterium bovis subsp bovis AF2122/97
cgucgggacggccaacagggcg

SEQ ID NO: 3191599 - RNA, 16 nt, Mycobacterium bovis subsp bovis AF2122/97
cgucgggaugcccgcu

SEQ ID NO: 3191600 - RNA, 14 nt, Mycobacterium bovis subsp bovis AF2122/97
cgucgggaugcucg

SEQ ID NO: 3191601 - RNA, 15 nt, Mycobacterium bovis subsp bovis AF2122/97
cgucgggaugcucga

SEQ ID NO: 3191602 - RNA, 17 nt, Mycobacterium bovis subsp bovis AF2122/97
cgucgggauggacggca

SEQ ID NO: 3191603 - RNA, 20 nt, Mycobacterium bovis subsp bovis AF2122/97
cgucgggauggacggcagcc

SEQ ID NO: 3191604 - RNA, 14 nt, Mycobacterium bovis subsp bovis AF2122/97
cgucgggcacaccg

SEQ ID NO: 3191605 - RNA, 17 nt, Mycobacterium bovis subsp bovis AF2122/97
cgucgggcacaccgacg

SEQ ID NO: 3191606 - RNA, 21 nt, Mycobacterium bovis subsp bovis AF2122/97
cgucgggcacaccgacgccgc

SEQ ID NO: 3191607 - RNA, 22 nt, Mycobacterium bovis subsp bovis AF2122/97
cgucgggcacaccgacgccgcc

SEQ ID NO: 3191608 - RNA, 23 nt, Mycobacterium bovis subsp bovis AF2122/97
cgucgggcacaccgacgccgcca

SEQ ID NO: 3191609 - RNA, 12 nt, Mycobacterium bovis subsp bovis AF2122/97
cgucgggcaccg

SEQ ID NO: 3191610 - RNA, 14 nt, Mycobacterium bovis subsp bovis AF2122/97
cgucgggcaccgcc

SEQ ID NO: 3191611 - RNA, 15 nt, Mycobacterium bovis subsp bovis AF2122/97
cgucgggcaccgcca

SEQ ID NO: 3191612 - RNA, 13 nt, Mycobacterium bovis subsp bovis AF2122/97
cgucgggcagcag

SEQ ID NO: 3191613 - RNA, 14 nt, Mycobacterium bovis subsp bovis AF2122/97
cgucgggcccagcc

SEQ ID NO: 3191614 - RNA, 22 nt, Mycobacterium bovis subsp bovis AF2122/97
cgucgggcccagccggaccgcg

SEQ ID NO: 3191615 - RNA, 20 nt, Mycobacterium bovis subsp bovis AF2122/97
cgucgggcccgaugucgucg

SEQ ID NO: 3191616 - RNA, 18 nt, Mycobacterium bovis subsp bovis AF2122/97
cgucgggccgucgggugu

SEQ ID NO: 3191617 - RNA, 20 nt, Mycobacterium bovis subsp bovis AF2122/97
cgucgggcuaauccagcagc

SEQ ID NO: 3191618 - RNA, 14 nt, Mycobacterium bovis subsp bovis AF2122/97
cgucgggcucggcg

SEQ ID NO: 3191619 - RNA, 20 nt, Mycobacterium bovis subsp bovis AF2122/97
cgucggggucguugaggccg

SEQ ID NO: 3191620 - RNA, 14 nt, Mycobacterium bovis subsp bovis AF2122/97
cgucggguaccacg

SEQ ID NO: 3191621 - RNA, 17 nt, Mycobacterium bovis subsp bovis AF2122/97
cgucggguaccacgcug

SEQ ID NO: 3191622 - RNA, 13 nt, Mycobacterium bovis subsp bovis AF2122/97
cgucggguagauc

SEQ ID NO: 3191623 - RNA, 18 nt, Mycobacterium bovis subsp bovis AF2122/97
cgucggguagggcaucgu

SEQ ID NO: 3191624 - RNA, 22 nt, Mycobacterium bovis subsp bovis AF2122/97
cgucggguagggcaucgucgcc

SEQ ID NO: 3191625 - RNA, 17 nt, Mycobacterium bovis subsp bovis AF2122/97
cgucgggucaaugcugg

SEQ ID NO: 3191626 - RNA, 14 nt, Mycobacterium bovis subsp bovis AF2122/97
cgucgggucaccca

SEQ ID NO: 3191627 - RNA, 15 nt, Mycobacterium bovis subsp bovis AF2122/97
cgucgggucacccag

SEQ ID NO: 3191628 - RNA, 20 nt, Mycobacterium bovis subsp bovis AF2122/97
cgucgggucacccagauacc

SEQ ID NO: 3191629 - RNA, 17 nt, Mycobacterium bovis subsp bovis AF2122/97
cgucggguugcacggcg

SEQ ID NO: 3191630 - RNA, 16 nt, Mycobacterium bovis subsp bovis AF2122/97
cgucggguugcgacga

SEQ ID NO: 3191631 - RNA, 18 nt, Mycobacterium bovis subsp bovis AF2122/97
cgucggguugcgacgaac

SEQ ID NO: 3191632 - RNA, 16 nt, Mycobacterium bovis subsp bovis AF2122/97
cgucggguugucgcgg

SEQ ID NO: 3191633 - RNA, 22 nt, Mycobacterium bovis subsp bovis AF2122/97
cgucgguaagcgccaaggcgau

SEQ ID NO: 3191634 - RNA, 18 nt, Mycobacterium bovis subsp bovis AF2122/97
cgucgguaaugccgggcc

SEQ ID NO: 3191635 - RNA, 15 nt, Mycobacterium bovis subsp bovis AF2122/97
cgucggucaccgaca

SEQ ID NO: 3191636 - RNA, 16 nt, Mycobacterium bovis subsp bovis AF2122/97
cgucggucaucgguug

SEQ ID NO: 3191637 - RNA, 23 nt, Mycobacterium bovis subsp bovis AF2122/97
cgucgguccacccaagcucgguc

SEQ ID NO: 3191638 - RNA, 20 nt, Mycobacterium bovis subsp bovis AF2122/97
cgucggugaacgcgucguug

SEQ ID NO: 3191639 - RNA, 15 nt, Mycobacterium bovis subsp bovis AF2122/97
cgucggugaaugccg

SEQ ID NO: 3191640 - RNA, 21 nt, Mycobacterium bovis subsp bovis AF2122/97
cgucggugaccucggcgacca

SEQ ID NO: 3191641 - RNA, 13 nt, Mycobacterium bovis subsp bovis AF2122/97
cgucggugccacc

SEQ ID NO: 3191642 - RNA, 15 nt, Mycobacterium bovis subsp bovis AF2122/97
cgucggugccaccac

SEQ ID NO: 3191643 - RNA, 16 nt, Mycobacterium bovis subsp bovis AF2122/97
cgucggugccaccacg

SEQ ID NO: 3191644 - RNA, 14 nt, Mycobacterium bovis subsp bovis AF2122/97
cgucggugccgccg

SEQ ID NO: 3191645 - RNA, 16 nt, Mycobacterium bovis subsp bovis AF2122/97
cgucggugccgccgcc

SEQ ID NO: 3191646 - RNA, 16 nt, Mycobacterium bovis subsp bovis AF2122/97
cgucggugccggggcu

SEQ ID NO: 3191647 - RNA, 14 nt, Mycobacterium bovis subsp bovis AF2122/97
cgucggugcgcgcg

SEQ ID NO: 3191648 - RNA, 18 nt, Mycobacterium bovis subsp bovis AF2122/97
cgucggugcgcgcggcga

SEQ ID NO: 3191649 - RNA, 21 nt, Mycobacterium bovis subsp bovis AF2122/97
cgucggugcgcgcggcgacca

SEQ ID NO: 3191650 - RNA, 14 nt, Mycobacterium bovis subsp bovis AF2122/97
cgucggugggcgug

SEQ ID NO: 3191651 - RNA, 20 nt, Mycobacterium bovis subsp bovis AF2122/97
cgucggugggcgugacguag

SEQ ID NO: 3191652 - RNA, 22 nt, Mycobacterium bovis subsp bovis AF2122/97
cgucggugggcgugacguagug

SEQ ID NO: 3191653 - RNA, 21 nt, Mycobacterium bovis subsp bovis AF2122/97
cgucggugggucucggcguuc

SEQ ID NO: 3191654 - RNA, 22 nt, Mycobacterium bovis subsp bovis AF2122/97
cgucggugggucucggcguucc

SEQ ID NO: 3191655 - RNA, 18 nt, Mycobacterium bovis subsp bovis AF2122/97
cgucggugggugccagcc

SEQ ID NO: 3191656 - RNA, 14 nt, Mycobacterium bovis subsp bovis AF2122/97
cgucggugucgaug

SEQ ID NO: 3191657 - RNA, 18 nt, Mycobacterium bovis subsp bovis AF2122/97
cgucggugucgaugcuga

SEQ ID NO: 3191658 - RNA, 14 nt, Mycobacterium bovis subsp bovis AF2122/97
cgucggugucgguu

SEQ ID NO: 3191659 - RNA, 19 nt, Mycobacterium bovis subsp bovis AF2122/97
cgucggugugcgcgccagg

SEQ ID NO: 3191660 - RNA, 13 nt, Mycobacterium bovis subsp bovis AF2122/97
cgucggugugguc

SEQ ID NO: 3191661 - RNA, 21 nt, Mycobacterium bovis subsp bovis AF2122/97
cgucgguguuccgccgcgcua

SEQ ID NO: 3191662 - RNA, 22 nt, Mycobacterium bovis subsp bovis AF2122/97
cgucgguguuccgccgcgcuac

SEQ ID NO: 3191663 - RNA, 16 nt, Mycobacterium bovis subsp bovis AF2122/97
cgucgguuccgggcgc

SEQ ID NO: 3191664 - RNA, 21 nt, Mycobacterium bovis subsp bovis AF2122/97
cgucgguuccgggcgcgugga

SEQ ID NO: 3191665 - RNA, 16 nt, Mycobacterium bovis subsp bovis AF2122/97
cgucgguugccacgcc

SEQ ID NO: 3191666 - RNA, 19 nt, Mycobacterium bovis subsp bovis AF2122/97
cgucgguugccacgccgcc

SEQ ID NO: 3191667 - RNA, 20 nt, Mycobacterium bovis subsp bovis AF2122/97
cgucgguugccacgccgccg

SEQ ID NO: 3191668 - RNA, 14 nt, Mycobacterium bovis subsp bovis AF2122/97
cgucguacucggcg

SEQ ID NO: 3191669 - RNA, 20 nt, Mycobacterium bovis subsp bovis AF2122/97
cgucguacucggcggccacc

SEQ ID NO: 3191670 - RNA, 21 nt, Mycobacterium bovis subsp bovis AF2122/97
cgucguacucggcggccacca

SEQ ID NO: 3191671 - RNA, 21 nt, Mycobacterium bovis subsp bovis AF2122/97
cgucguagagauacgggaacg

SEQ ID NO: 3191672 - RNA, 14 nt, Mycobacterium bovis subsp bovis AF2122/97
cgucguagccacgc

SEQ ID NO: 3191673 - RNA, 13 nt, Mycobacterium bovis subsp bovis AF2122/97
cgucguagguggc

SEQ ID NO: 3191674 - RNA, 15 nt, Mycobacterium bovis subsp bovis AF2122/97
cgucguagguggccg

SEQ ID NO: 3191675 - RNA, 23 nt, Mycobacterium bovis subsp bovis AF2122/97
cgucguagguggccggcuugcag

SEQ ID NO: 3191676 - RNA, 15 nt, Mycobacterium bovis subsp bovis AF2122/97
cgucguaugcgguga

SEQ ID NO: 3191677 - RNA, 20 nt, Mycobacterium bovis subsp bovis AF2122/97
cgucguauugccucaccagg

SEQ ID NO: 3191678 - RNA, 21 nt, Mycobacterium bovis subsp bovis AF2122/97
cgucguauugccucaccaggu

SEQ ID NO: 3191679 - RNA, 22 nt, Mycobacterium bovis subsp bovis AF2122/97
cgucgucaaguccuucacugcg

SEQ ID NO: 3191680 - RNA, 19 nt, Mycobacterium bovis subsp bovis AF2122/97
cgucgucaccgaugcgccg

SEQ ID NO: 3191681 - RNA, 20 nt, Mycobacterium bovis subsp bovis AF2122/97
cgucgucaccgcgacggaac

SEQ ID NO: 3191682 - RNA, 17 nt, Mycobacterium bovis subsp bovis AF2122/97
cgucgucacgaucgugc

SEQ ID NO: 3191683 - RNA, 14 nt, Mycobacterium bovis subsp bovis AF2122/97
cgucgucagccacc

SEQ ID NO: 3191684 - RNA, 15 nt, Mycobacterium bovis subsp bovis AF2122/97
cgucgucagccaccg

SEQ ID NO: 3191685 - RNA, 17 nt, Mycobacterium bovis subsp bovis AF2122/97
cgucgucagccaccgca

SEQ ID NO: 3191686 - RNA, 14 nt, Mycobacterium bovis subsp bovis AF2122/97
cgucgucagccagg

SEQ ID NO: 3191687 - RNA, 23 nt, Mycobacterium bovis subsp bovis AF2122/97
cgucgucagccaggaagcggugg

SEQ ID NO: 3191688 - RNA, 16 nt, Mycobacterium bovis subsp bovis AF2122/97
cgucgucagguggcca

SEQ ID NO: 3191689 - RNA, 15 nt, Mycobacterium bovis subsp bovis AF2122/97
cgucgucaucgagcg

SEQ ID NO: 3191690 - RNA, 14 nt, Mycobacterium bovis subsp bovis AF2122/97
cgucguccagacgc

SEQ ID NO: 3191691 - RNA, 15 nt, Mycobacterium bovis subsp bovis AF2122/97
cgucguccagacgcc

SEQ ID NO: 3191692 - RNA, 22 nt, Mycobacterium bovis subsp bovis AF2122/97
cgucguccagacgccacugcca

SEQ ID NO: 3191693 - RNA, 13 nt, Mycobacterium bovis subsp bovis AF2122/97
cgucguccagggc

SEQ ID NO: 3191694 - RNA, 16 nt, Mycobacterium bovis subsp bovis AF2122/97
cgucgucccagggcug

SEQ ID NO: 3191695 - RNA, 18 nt, Mycobacterium bovis subsp bovis AF2122/97
cgucguccgacgggccgu

SEQ ID NO: 3191696 - RNA, 12 nt, Mycobacterium bovis subsp bovis AF2122/97
cgucguccggcc

SEQ ID NO: 3191697 - RNA, 15 nt, Mycobacterium bovis subsp bovis AF2122/97
cgucguccggccacg

SEQ ID NO: 3191698 - RNA, 15 nt, Mycobacterium bovis subsp bovis AF2122/97
cgucguccuguccgg

SEQ ID NO: 3191699 - RNA, 18 nt, Mycobacterium bovis subsp bovis AF2122/97
cgucgucgaauccugccg

SEQ ID NO: 3191700 - RNA, 14 nt, Mycobacterium bovis subsp bovis AF2122/97
cgucgucgacacgg

SEQ ID NO: 3191701 - RNA, 21 nt, Mycobacterium bovis subsp bovis AF2122/97
cgucgucgaccacgacguucg

SEQ ID NO: 3191702 - RNA, 13 nt, Mycobacterium bovis subsp bovis AF2122/97
cgucgucgacggc

SEQ ID NO: 3191703 - RNA, 21 nt, Mycobacterium bovis subsp bovis AF2122/97
cgucgucgacggcugcgccga

SEQ ID NO: 3191704 - RNA, 16 nt, Mycobacterium bovis subsp bovis AF2122/97
cgucgucgagcaccac

SEQ ID NO: 3191705 - RNA, 22 nt, Mycobacterium bovis subsp bovis AF2122/97
cgucgucgagcaccacccgggc

SEQ ID NO: 3191706 - RNA, 13 nt, Mycobacterium bovis subsp bovis AF2122/97
cgucgucgaucca

SEQ ID NO: 3191707 - RNA, 23 nt, Mycobacterium bovis subsp bovis AF2122/97
cgucgucgccgccgaaaaccucg

SEQ ID NO: 3191708 - RNA, 13 nt, Mycobacterium bovis subsp bovis AF2122/97
cgucgucgccguc

SEQ ID NO: 3191709 - RNA, 17 nt, Mycobacterium bovis subsp bovis AF2122/97
cgucgucgccgucggug

SEQ ID NO: 3191710 - RNA, 19 nt, Mycobacterium bovis subsp bovis AF2122/97
cgucgucgccgucggugcc

SEQ ID NO: 3191711 - RNA, 16 nt, Mycobacterium bovis subsp bovis AF2122/97
cgucgucgcggccgcu

SEQ ID NO: 3191712 - RNA, 16 nt, Mycobacterium bovis subsp bovis AF2122/97
cgucgucgcgucgcca

SEQ ID NO: 3191713 - RNA, 14 nt, Mycobacterium bovis subsp bovis AF2122/97
cgucgucgcugaau

SEQ ID NO: 3191714 - RNA, 15 nt, Mycobacterium bovis subsp bovis AF2122/97
cgucgucgcugccgc

SEQ ID NO: 3191715 - RNA, 14 nt, Mycobacterium bovis subsp bovis AF2122/97
cgucgucggcggcg

SEQ ID NO: 3191716 - RNA, 13 nt, Mycobacterium bovis subsp bovis AF2122/97
cgucgucggcgua

SEQ ID NO: 3191717 - RNA, 13 nt, Mycobacterium bovis subsp bovis AF2122/97
cgucgucggcguc

SEQ ID NO: 3191718 - RNA, 13 nt, Mycobacterium bovis subsp bovis AF2122/97
cgucgucgguaau

SEQ ID NO: 3191719 - RNA, 15 nt, Mycobacterium bovis subsp bovis AF2122/97
cgucgucggugauca

SEQ ID NO: 3191720 - RNA, 14 nt, Mycobacterium bovis subsp bovis AF2122/97
cgucgucgucgacg

SEQ ID NO: 3191721 - RNA, 14 nt, Mycobacterium bovis subsp bovis AF2122/97
cgucgucgucgaga

SEQ ID NO: 3191722 - RNA, 13 nt, Mycobacterium bovis subsp bovis AF2122/97
cgucgucgugcac

SEQ ID NO: 3191723 - RNA, 18 nt, Mycobacterium bovis subsp bovis AF2122/97
cgucgucguuucgccagc

SEQ ID NO: 3191724 - RNA, 20 nt, Mycobacterium bovis subsp bovis AF2122/97
cgucgucguuucgccagccg

SEQ ID NO: 3191725 - RNA, 22 nt, Mycobacterium bovis subsp bovis AF2122/97
cgucgucguuucgccagccggc

SEQ ID NO: 3191726 - RNA, 22 nt, Mycobacterium bovis subsp bovis AF2122/97
cgucgucugcagaccuguccgg

SEQ ID NO: 3191727 - RNA, 14 nt, Mycobacterium bovis subsp bovis AF2122/97
cgucgucuugaccg

SEQ ID NO: 3191728 - RNA, 18 nt, Mycobacterium bovis subsp bovis AF2122/97
cgucgugaccgaccgcca

SEQ ID NO: 3191729 - RNA, 14 nt, Mycobacterium bovis subsp bovis AF2122/97
cgucgugaccggcg

SEQ ID NO: 3191730 - RNA, 22 nt, Mycobacterium bovis subsp bovis AF2122/97
cgucgugagaggccaagauggc

SEQ ID NO: 3191731 - RNA, 12 nt, Mycobacterium bovis subsp bovis AF2122/97
cgucgugaggaa

SEQ ID NO: 3191732 - RNA, 15 nt, Mycobacterium bovis subsp bovis AF2122/97
cgucgugagucaccc

SEQ ID NO: 3191733 - RNA, 17 nt, Mycobacterium bovis subsp bovis AF2122/97
cgucgugagucacccgg

SEQ ID NO: 3191734 - RNA, 15 nt, Mycobacterium bovis subsp bovis AF2122/97
cgucgugaucggcga

SEQ ID NO: 3191735 - RNA, 16 nt, Mycobacterium bovis subsp bovis AF2122/97
cgucgugaugggucac

SEQ ID NO: 3191736 - RNA, 13 nt, Mycobacterium bovis subsp bovis AF2122/97
cgucgugauguca

SEQ ID NO: 3191737 - RNA, 15 nt, Mycobacterium bovis subsp bovis AF2122/97
cgucgugcacggcgg

SEQ ID NO: 3191738 - RNA, 17 nt, Mycobacterium bovis subsp bovis AF2122/97
cgucgugcacggcggcc

SEQ ID NO: 3191739 - RNA, 18 nt, Mycobacterium bovis subsp bovis AF2122/97
cgucgugcacggcggcca

SEQ ID NO: 3191740 - RNA, 14 nt, Mycobacterium bovis subsp bovis AF2122/97
cgucgugccaccgu

SEQ ID NO: 3191741 - RNA, 21 nt, Mycobacterium bovis subsp bovis AF2122/97
cgucgugccaccguugggccg

SEQ ID NO: 3191742 - RNA, 12 nt, Mycobacterium bovis subsp bovis AF2122/97
cgucgugccacu

SEQ ID NO: 3191743 - RNA, 18 nt, Mycobacterium bovis subsp bovis AF2122/97
cgucgugcgcggccggca

SEQ ID NO: 3191744 - RNA, 20 nt, Mycobacterium bovis subsp bovis AF2122/97
cgucgugcgcggccggcacg

SEQ ID NO: 3191745 - RNA, 21 nt, Mycobacterium bovis subsp bovis AF2122/97
cgucgugcgcggccggcacga

SEQ ID NO: 3191746 - RNA, 15 nt, Mycobacterium bovis subsp bovis AF2122/97
cgucgugcgggcggg

SEQ ID NO: 3191747 - RNA, 22 nt, Mycobacterium bovis subsp bovis AF2122/97
cgucgugcgugcggcgaaggua

SEQ ID NO: 3191748 - RNA, 15 nt, Mycobacterium bovis subsp bovis AF2122/97
cgucguggagcucac

SEQ ID NO: 3191749 - RNA, 15 nt, Mycobacterium bovis subsp bovis AF2122/97
cgucguggaucuucg

SEQ ID NO: 3191750 - RNA, 21 nt, Mycobacterium bovis subsp bovis AF2122/97
cgucguggaucuucgcgcugu

SEQ ID NO: 3191751 - RNA, 14 nt, Mycobacterium bovis subsp bovis AF2122/97
cgucguggcgcucg

SEQ ID NO: 3191752 - RNA, 18 nt, Mycobacterium bovis subsp bovis AF2122/97
cgucguggcgcucggcga

SEQ ID NO: 3191753 - RNA, 21 nt, Mycobacterium bovis subsp bovis AF2122/97
cgucguggcgcucggcgagca

SEQ ID NO: 3191754 - RNA, 13 nt, Mycobacterium bovis subsp bovis AF2122/97
cgucguggggacc

SEQ ID NO: 3191755 - RNA, 14 nt, Mycobacterium bovis subsp bovis AF2122/97
cgucguggggaccg

SEQ ID NO: 3191756 - RNA, 15 nt, Mycobacterium bovis subsp bovis AF2122/97
cgucguggucggcga

SEQ ID NO: 3191757 - RNA, 18 nt, Mycobacterium bovis subsp bovis AF2122/97
cgucguggucggcgaccc

SEQ ID NO: 3191758 - RNA, 14 nt, Mycobacterium bovis subsp bovis AF2122/97
cgucgugucgccgc

SEQ ID NO: 3191759 - RNA, 15 nt, Mycobacterium bovis subsp bovis AF2122/97
cgucgugucgccgcc

SEQ ID NO: 3191760 - RNA, 19 nt, Mycobacterium bovis subsp bovis AF2122/97
cgucgugugguucacucuc

SEQ ID NO: 3191761 - RNA, 17 nt, Mycobacterium bovis subsp bovis AF2122/97
cgucguuaagacggcga

SEQ ID NO: 3191762 - RNA, 20 nt, Mycobacterium bovis subsp bovis AF2122/97
cgucguuaagacggcgacga

SEQ ID NO: 3191763 - RNA, 23 nt, Mycobacterium bovis subsp bovis AF2122/97
cgucguuaagacggcgacgacau

SEQ ID NO: 3191764 - RNA, 20 nt, Mycobacterium bovis subsp bovis AF2122/97
cgucguucgagaccccgacg

SEQ ID NO: 3191765 - RNA, 15 nt, Mycobacterium bovis subsp bovis AF2122/97
cgucguucgcgggug

SEQ ID NO: 3191766 - RNA, 16 nt, Mycobacterium bovis subsp bovis AF2122/97
cgucguucgcgggugc

SEQ ID NO: 3191767 - RNA, 18 nt, Mycobacterium bovis subsp bovis AF2122/97
cgucguugaggaagcccg

SEQ ID NO: 3191768 - RNA, 16 nt, Mycobacterium bovis subsp bovis AF2122/97
cgucguugcccgaccc

SEQ ID NO: 3191769 - RNA, 18 nt, Mycobacterium bovis subsp bovis AF2122/97
cgucguugcccgacccgc

SEQ ID NO: 3191770 - RNA, 16 nt, Mycobacterium bovis subsp bovis AF2122/97
cgucguugccggcgac

SEQ ID NO: 3191771 - RNA, 18 nt, Mycobacterium bovis subsp bovis AF2122/97
cgucguugccggcgacca

SEQ ID NO: 3191772 - RNA, 22 nt, Mycobacterium bovis subsp bovis AF2122/97
cgucguugucgucgccggcggc

SEQ ID NO: 3191773 - RNA, 19 nt, Mycobacterium bovis subsp bovis AF2122/97
cgucguugugauccggugg

SEQ ID NO: 3191774 - RNA, 15 nt, Mycobacterium bovis subsp bovis AF2122/97
cgucguuucgccagc

SEQ ID NO: 3191775 - RNA, 23 nt, Mycobacterium bovis subsp bovis AF2122/97
cgucguuucgccagccggccgcg

SEQ ID NO: 3191776 - RNA, 21 nt, Mycobacterium bovis subsp bovis AF2122/97
cgucguuugggugcgccguca

SEQ ID NO: 3191777 - RNA, 17 nt, Mycobacterium bovis subsp bovis AF2122/97
cgucuaccccgagccuu

SEQ ID NO: 3191778 - RNA, 18 nt, Mycobacterium bovis subsp bovis AF2122/97
cgucuaccccgagccuug

SEQ ID NO: 3191779 - RNA, 20 nt, Mycobacterium bovis subsp bovis AF2122/97
cgucuccacuuucugcgguc

SEQ ID NO: 3191780 - RNA, 13 nt, Mycobacterium bovis subsp bovis AF2122/97
cgucuccggcgcc

SEQ ID NO: 3191781 - RNA, 20 nt, Mycobacterium bovis subsp bovis AF2122/97
cgucuccggcgccaccgccg

SEQ ID NO: 3191782 - RNA, 23 nt, Mycobacterium bovis subsp bovis AF2122/97
cgucuccuguggggauuccgcac

SEQ ID NO: 3191783 - RNA, 17 nt, Mycobacterium bovis subsp bovis AF2122/97
cgucucgaagcucagcu

SEQ ID NO: 3191784 - RNA, 17 nt, Mycobacterium bovis subsp bovis AF2122/97
cgucucgacaguggcga

SEQ ID NO: 3191785 - RNA, 22 nt, Mycobacterium bovis subsp bovis AF2122/97
cgucucgacaguggcgacggac

SEQ ID NO: 3191786 - RNA, 18 nt, Mycobacterium bovis subsp bovis AF2122/97
cgucucgagcgcgccgcg

SEQ ID NO: 3191787 - RNA, 13 nt, Mycobacterium bovis subsp bovis AF2122/97
cgucucgaucacc

SEQ ID NO: 3191788 - RNA, 11 nt, Mycobacterium bovis subsp bovis AF2122/97
cgucucgauga

SEQ ID NO: 3191789 - RNA, 16 nt, Mycobacterium bovis subsp bovis AF2122/97
cgucucgaugcauggc

SEQ ID NO: 3191790 - RNA, 13 nt, Mycobacterium bovis subsp bovis AF2122/97
cgucucgcaccgc

SEQ ID NO: 3191791 - RNA, 14 nt, Mycobacterium bovis subsp bovis AF2122/97
cgucucgcccccuc

SEQ ID NO: 3191792 - RNA, 18 nt, Mycobacterium bovis subsp bovis AF2122/97
cgucucgcccccucuagc

SEQ ID NO: 3191793 - RNA, 16 nt, Mycobacterium bovis subsp bovis AF2122/97
cgucucgccgcgcacc

SEQ ID NO: 3191794 - RNA, 13 nt, Mycobacterium bovis subsp bovis AF2122/97
cgucucgcgcacc

SEQ ID NO: 3191795 - RNA, 21 nt, Mycobacterium bovis subsp bovis AF2122/97
cgucucgcgcaccugaucggu

SEQ ID NO: 3191796 - RNA, 13 nt, Mycobacterium bovis subsp bovis AF2122/97
cgucucgcggugc

SEQ ID NO: 3191797 - RNA, 22 nt, Mycobacterium bovis subsp bovis AF2122/97
cgucucgcggugcggcaacagc

SEQ ID NO: 3191798 - RNA, 19 nt, Mycobacterium bovis subsp bovis AF2122/97
cgucucggguggggaucac

SEQ ID NO: 3191799 - RNA, 16 nt, Mycobacterium bovis subsp bovis AF2122/97
cgucucggugcagcag

SEQ ID NO: 3191800 - RNA, 18 nt, Mycobacterium bovis subsp bovis AF2122/97
cgucucggugcagcagcg

SEQ ID NO: 3191801 - RNA, 13 nt, Mycobacterium bovis subsp bovis AF2122/97
cgucucgguggcu

SEQ ID NO: 3191802 - RNA, 14 nt, Mycobacterium bovis subsp bovis AF2122/97
cgucucggugguga

SEQ ID NO: 3191803 - RNA, 21 nt, Mycobacterium bovis subsp bovis AF2122/97
cgucucuagauauggaccgcc

SEQ ID NO: 3191804 - RNA, 14 nt, Mycobacterium bovis subsp bovis AF2122/97
cgucucugccacgc

SEQ ID NO: 3191805 - RNA, 16 nt, Mycobacterium bovis subsp bovis AF2122/97
cgucugacaucgucga

SEQ ID NO: 3191806 - RNA, 18 nt, Mycobacterium bovis subsp bovis AF2122/97
cgucugacaucgucgacg

SEQ ID NO: 3191807 - RNA, 15 nt, Mycobacterium bovis subsp bovis AF2122/97
cgucugacccaccgc

SEQ ID NO: 3191808 - RNA, 18 nt, Mycobacterium bovis subsp bovis AF2122/97
cgucugacgaaauccgcc

SEQ ID NO: 3191809 - RNA, 20 nt, Mycobacterium bovis subsp bovis AF2122/97
cgucugcagaccuguccggc

SEQ ID NO: 3191810 - RNA, 21 nt, Mycobacterium bovis subsp bovis AF2122/97
cgucugcagaccuguccggca

SEQ ID NO: 3191811 - RNA, 22 nt, Mycobacterium bovis subsp bovis AF2122/97
cgucugccacgucggcgaacgg

SEQ ID NO: 3191812 - RNA, 17 nt, Mycobacterium bovis subsp bovis AF2122/97
cgucugccaggcgcagc

SEQ ID NO: 3191813 - RNA, 13 nt, Mycobacterium bovis subsp bovis AF2122/97
cgucugcccgccc

SEQ ID NO: 3191814 - RNA, 17 nt, Mycobacterium bovis subsp bovis AF2122/97
cgucugcccgcccagcc

SEQ ID NO: 3191815 - RNA, 18 nt, Mycobacterium bovis subsp bovis AF2122/97
cgucugcccgcccagccc

SEQ ID NO: 3191816 - RNA, 14 nt, Mycobacterium bovis subsp bovis AF2122/97
cgucugcgacccgg

SEQ ID NO: 3191817 - RNA, 18 nt, Mycobacterium bovis subsp bovis AF2122/97
cgucugcgaucccgaucg

SEQ ID NO: 3191818 - RNA, 23 nt, Mycobacterium bovis subsp bovis AF2122/97
cgucugcgaucccgaucgcgcug

SEQ ID NO: 3191819 - RNA, 17 nt, Mycobacterium bovis subsp bovis AF2122/97
cgucugcggaccggcgc

SEQ ID NO: 3191820 - RNA, 20 nt, Mycobacterium bovis subsp bovis AF2122/97
cgucugcggaccggcgcgcu

SEQ ID NO: 3191821 - RNA, 18 nt, Mycobacterium bovis subsp bovis AF2122/97
cgucugcggggugaguga

SEQ ID NO: 3191822 - RNA, 15 nt, Mycobacterium bovis subsp bovis AF2122/97
cgucugcggucgagg

SEQ ID NO: 3191823 - RNA, 15 nt, Mycobacterium bovis subsp bovis AF2122/97
cgucugcucaccagc

SEQ ID NO: 3191824 - RNA, 11 nt, Mycobacterium bovis subsp bovis AF2122/97
cgucugcucgc

SEQ ID NO: 3191825 - RNA, 16 nt, Mycobacterium bovis subsp bovis AF2122/97
cgucugcucgccagcc

SEQ ID NO: 3191826 - RNA, 19 nt, Mycobacterium bovis subsp bovis AF2122/97
cgucugcucgccagccggc

SEQ ID NO: 3191827 - RNA, 13 nt, Mycobacterium bovis subsp bovis AF2122/97
cgucugcucgccg

SEQ ID NO: 3191828 - RNA, 16 nt, Mycobacterium bovis subsp bovis AF2122/97
cgucugcucgccgggc

SEQ ID NO: 3191829 - RNA, 12 nt, Mycobacterium bovis subsp bovis AF2122/97
cgucugcucgcg

SEQ ID NO: 3191830 - RNA, 16 nt, Mycobacterium bovis subsp bovis AF2122/97
cgucugcucgcgcccg

SEQ ID NO: 3191831 - RNA, 15 nt, Mycobacterium bovis subsp bovis AF2122/97
cgucugcucgcgccg

SEQ ID NO: 3191832 - RNA, 16 nt, Mycobacterium bovis subsp bovis AF2122/97
cgucugcucggcaucg

SEQ ID NO: 3191833 - RNA, 15 nt, Mycobacterium bovis subsp bovis AF2122/97
cgucugcucggcgcg

SEQ ID NO: 3191834 - RNA, 15 nt, Mycobacterium bovis subsp bovis AF2122/97
cgucugcucggcgcu

SEQ ID NO: 3191835 - RNA, 15 nt, Mycobacterium bovis subsp bovis AF2122/97
cgucugcucggcgga

SEQ ID NO: 3191836 - RNA, 15 nt, Mycobacterium bovis subsp bovis AF2122/97
cgucugcucggcgua

SEQ ID NO: 3191837 - RNA, 16 nt, Mycobacterium bovis subsp bovis AF2122/97
cgucugcuggccgggu

SEQ ID NO: 3191838 - RNA, 22 nt, Mycobacterium bovis subsp bovis AF2122/97
cgucugcuucacgucagcguug

SEQ ID NO: 3191839 - RNA, 13 nt, Mycobacterium bovis subsp bovis AF2122/97
cgucuggaguucg

SEQ ID NO: 3191840 - RNA, 21 nt, Mycobacterium bovis subsp bovis AF2122/97
cgucuggcaugaccgcugccg

SEQ ID NO: 3191841 - RNA, 22 nt, Mycobacterium bovis subsp bovis AF2122/97
cgucuggcaugaccgcugccga

SEQ ID NO: 3191842 - RNA, 15 nt, Mycobacterium bovis subsp bovis AF2122/97
cgucuggucagccgc

SEQ ID NO: 3191843 - RNA, 19 nt, Mycobacterium bovis subsp bovis AF2122/97
cgucugguggcagcgcacc

SEQ ID NO: 3191844 - RNA, 22 nt, Mycobacterium bovis subsp bovis AF2122/97
cgucugguggcagcgcacccgg

SEQ ID NO: 3191845 - RNA, 16 nt, Mycobacterium bovis subsp bovis AF2122/97
cgucuguaccacgggc

SEQ ID NO: 3191846 - RNA, 20 nt, Mycobacterium bovis subsp bovis AF2122/97
cgucuuaccugaagccgcgc

SEQ ID NO: 3191847 - RNA, 23 nt, Mycobacterium bovis subsp bovis AF2122/97
cgucuuaccugaagccgcgcugc

SEQ ID NO: 3191848 - RNA, 16 nt, Mycobacterium bovis subsp bovis AF2122/97
cgucuuaucggcgucg

SEQ ID NO: 3191849 - RNA, 17 nt, Mycobacterium bovis subsp bovis AF2122/97
cgucuuaucggcgucgu

SEQ ID NO: 3191850 - RNA, 19 nt, Mycobacterium bovis subsp bovis AF2122/97
cgucuuaucggcgucguag

SEQ ID NO: 3191851 - RNA, 17 nt, Mycobacterium bovis subsp bovis AF2122/97
cgucuucacucacgacg

SEQ ID NO: 3191852 - RNA, 17 nt, Mycobacterium bovis subsp bovis AF2122/97
cgucuuccucggccacc

SEQ ID NO: 3191853 - RNA, 18 nt, Mycobacterium bovis subsp bovis AF2122/97
cgucuuccucggccaccc

SEQ ID NO: 3191854 - RNA, 14 nt, Mycobacterium bovis subsp bovis AF2122/97
cgucuucgccgcca

SEQ ID NO: 3191855 - RNA, 16 nt, Mycobacterium bovis subsp bovis AF2122/97
cgucuucgccgccacc

SEQ ID NO: 3191856 - RNA, 22 nt, Mycobacterium bovis subsp bovis AF2122/97
cgucuucgucggagucuucguc

SEQ ID NO: 3191857 - RNA, 22 nt, Mycobacterium bovis subsp bovis AF2122/97
cgucuugaccgcuugcccgcgc

SEQ ID NO: 3191858 - RNA, 20 nt, Mycobacterium bovis subsp bovis AF2122/97
cgucuugauguaaugcgggc

SEQ ID NO: 3191859 - RNA, 23 nt, Mycobacterium bovis subsp bovis AF2122/97
cgucuugauguaaugcgggcgca

SEQ ID NO: 3191860 - RNA, 13 nt, Mycobacterium bovis subsp bovis AF2122/97
cgucuugcagccu

SEQ ID NO: 3191861 - RNA, 20 nt, Mycobacterium bovis subsp bovis AF2122/97
cgucuugcugcacgcucugc

SEQ ID NO: 3191862 - RNA, 15 nt, Mycobacterium bovis subsp bovis AF2122/97
cgucuuggcgaucgg

SEQ ID NO: 3191863 - RNA, 15 nt, Mycobacterium bovis subsp bovis AF2122/97
cgucuugggccggga

SEQ ID NO: 3191864 - RNA, 23 nt, Mycobacterium bovis subsp bovis AF2122/97
cgucuuguaggacaagugccggc

SEQ ID NO: 3191865 - RNA, 18 nt, Mycobacterium bovis subsp bovis AF2122/97
cgucuuuggugccgagca

SEQ ID NO: 3191866 - RNA, 15 nt, Mycobacterium bovis subsp bovis AF2122/97
cgugaaaaacgcccg

SEQ ID NO: 3191867 - RNA, 23 nt, Mycobacterium bovis subsp bovis AF2122/97
cgugaaaaacgcccgcgcugccg

SEQ ID NO: 3191868 - RNA, 16 nt, Mycobacterium bovis subsp bovis AF2122/97
cgugaaccgcccgccc

SEQ ID NO: 3191869 - RNA, 19 nt, Mycobacterium bovis subsp bovis AF2122/97
cgugaaccgcccgcccuug

SEQ ID NO: 3191870 - RNA, 13 nt, Mycobacterium bovis subsp bovis AF2122/97
cgugaaccuggcg

SEQ ID NO: 3191871 - RNA, 19 nt, Mycobacterium bovis subsp bovis AF2122/97
cgugaaccuggcgacgcga

SEQ ID NO: 3191872 - RNA, 13 nt, Mycobacterium bovis subsp bovis AF2122/97
cgugaacggcgcg

SEQ ID NO: 3191873 - RNA, 20 nt, Mycobacterium bovis subsp bovis AF2122/97
cgugaacuguccgggugggc

SEQ ID NO: 3191874 - RNA, 21 nt, Mycobacterium bovis subsp bovis AF2122/97
cgugaagaugcccuucgucgg

SEQ ID NO: 3191875 - RNA, 22 nt, Mycobacterium bovis subsp bovis AF2122/97
cgugaagaugcccuucgucggc

SEQ ID NO: 3191876 - RNA, 19 nt, Mycobacterium bovis subsp bovis AF2122/97
cgugaagcagacgucaugc

SEQ ID NO: 3191877 - RNA, 17 nt, Mycobacterium bovis subsp bovis AF2122/97
cgugaagccaagcgacu

SEQ ID NO: 3191878 - RNA, 22 nt, Mycobacterium bovis subsp bovis AF2122/97
cgugaagcccuggccagcgaaa

SEQ ID NO: 3191879 - RNA, 15 nt, Mycobacterium bovis subsp bovis AF2122/97
cgugaagcgggugcc

SEQ ID NO: 3191880 - RNA, 17 nt, Mycobacterium bovis subsp bovis AF2122/97
cgugaagggauccggaa

SEQ ID NO: 3191881 - RNA, 16 nt, Mycobacterium bovis subsp bovis AF2122/97
cgugaaucgagcaccg

SEQ ID NO: 3191882 - RNA, 22 nt, Mycobacterium bovis subsp bovis AF2122/97
cgugaaugguggugucggcgag

SEQ ID NO: 3191883 - RNA, 23 nt, Mycobacterium bovis subsp bovis AF2122/97
cgugacaaccaucgguggccauc

SEQ ID NO: 3191884 - RNA, 21 nt, Mycobacterium bovis subsp bovis AF2122/97
cgugacaacugcgccggugcc

SEQ ID NO: 3191885 - RNA, 13 nt, Mycobacterium bovis subsp bovis AF2122/97
cgugacaccgggg

SEQ ID NO: 3191886 - RNA, 14 nt, Mycobacterium bovis subsp bovis AF2122/97
cgugacaccgggga

SEQ ID NO: 3191887 - RNA, 20 nt, Mycobacterium bovis subsp bovis AF2122/97
cgugacaccggggacgucga

SEQ ID NO: 3191888 - RNA, 17 nt, Mycobacterium bovis subsp bovis AF2122/97
cgugacauucugcagcg

SEQ ID NO: 3191889 - RNA, 17 nt, Mycobacterium bovis subsp bovis AF2122/97
cgugaccaccgccgaca

SEQ ID NO: 3191890 - RNA, 19 nt, Mycobacterium bovis subsp bovis AF2122/97
cgugaccaccgccgacagg

SEQ ID NO: 3191891 - RNA, 16 nt, Mycobacterium bovis subsp bovis AF2122/97
cgugaccagaucgacg

SEQ ID NO: 3191892 - RNA, 16 nt, Mycobacterium bovis subsp bovis AF2122/97
cgugaccaggugccag

SEQ ID NO: 3191893 - RNA, 23 nt, Mycobacterium bovis subsp bovis AF2122/97
cgugaccagucgcggcguucggc

SEQ ID NO: 3191894 - RNA, 22 nt, Mycobacterium bovis subsp bovis AF2122/97
cgugacccauucucggccggcg

SEQ ID NO: 3191895 - RNA, 23 nt, Mycobacterium bovis subsp bovis AF2122/97
cgugacccauucucggccggcgg

SEQ ID NO: 3191896 - RNA, 14 nt, Mycobacterium bovis subsp bovis AF2122/97
cgugacccgacaug

SEQ ID NO: 3191897 - RNA, 22 nt, Mycobacterium bovis subsp bovis AF2122/97
cgugacccggauaucgaccacc

SEQ ID NO: 3191898 - RNA, 14 nt, Mycobacterium bovis subsp bovis AF2122/97
cgugacccuggggu

SEQ ID NO: 3191899 - RNA, 15 nt, Mycobacterium bovis subsp bovis AF2122/97
cgugaccgacgccgu

SEQ ID NO: 3191900 - RNA, 16 nt, Mycobacterium bovis subsp bovis AF2122/97
cgugaccgacgccguc

SEQ ID NO: 3191901 - RNA, 17 nt, Mycobacterium bovis subsp bovis AF2122/97
cgugaccgacgccgucg

SEQ ID NO: 3191902 - RNA, 14 nt, Mycobacterium bovis subsp bovis AF2122/97
cgugaccgacugcg

SEQ ID NO: 3191903 - RNA, 12 nt, Mycobacterium bovis subsp bovis AF2122/97
cgugaccgagcc

SEQ ID NO: 3191904 - RNA, 14 nt, Mycobacterium bovis subsp bovis AF2122/97
cgugaccgagccgc

SEQ ID NO: 3191905 - RNA, 16 nt, Mycobacterium bovis subsp bovis AF2122/97
cgugaccgagccgcga

SEQ ID NO: 3191906 - RNA, 14 nt, Mycobacterium bovis subsp bovis AF2122/97
cgugaccgccgcgc

SEQ ID NO: 3191907 - RNA, 18 nt, Mycobacterium bovis subsp bovis AF2122/97
cgugaccgccgcgccggc

SEQ ID NO: 3191908 - RNA, 12 nt, Mycobacterium bovis subsp bovis AF2122/97
cgugaccgccgu

SEQ ID NO: 3191909 - RNA, 22 nt, Mycobacterium bovis subsp bovis AF2122/97
cgugaccgccguugucgaccuc

SEQ ID NO: 3191910 - RNA, 16 nt, Mycobacterium bovis subsp bovis AF2122/97
cgugaccggcaaccgc

SEQ ID NO: 3191911 - RNA, 20 nt, Mycobacterium bovis subsp bovis AF2122/97
cgugaccggcaaccgccgug

SEQ ID NO: 3191912 - RNA, 13 nt, Mycobacterium bovis subsp bovis AF2122/97
cgugaccggcaau

SEQ ID NO: 3191913 - RNA, 13 nt, Mycobacterium bovis subsp bovis AF2122/97
cgugacgaccagc

SEQ ID NO: 3191914 - RNA, 24 nt, Mycobacterium bovis subsp bovis AF2122/97
cgugacgaccagccccgcuggucg

SEQ ID NO: 3191915 - RNA, 19 nt, Mycobacterium bovis subsp bovis AF2122/97
cgugacgaguucgcugacc

SEQ ID NO: 3191916 - RNA, 14 nt, Mycobacterium bovis subsp bovis AF2122/97
cgugacgccggcca

SEQ ID NO: 3191917 - RNA, 14 nt, Mycobacterium bovis subsp bovis AF2122/97
cgugacgguccacg

SEQ ID NO: 3191918 - RNA, 16 nt, Mycobacterium bovis subsp bovis AF2122/97
cgugacgguccacgac

SEQ ID NO: 3191919 - RNA, 22 nt, Mycobacterium bovis subsp bovis AF2122/97
cgugacgguccacgacgucgag

SEQ ID NO: 3191920 - RNA, 14 nt, Mycobacterium bovis subsp bovis AF2122/97
cgugacguaccacg

SEQ ID NO: 3191921 - RNA, 17 nt, Mycobacterium bovis subsp bovis AF2122/97
cgugacguaccacggcg

SEQ ID NO: 3191922 - RNA, 19 nt, Mycobacterium bovis subsp bovis AF2122/97
cgugacguaccacggcgau

SEQ ID NO: 3191923 - RNA, 21 nt, Mycobacterium bovis subsp bovis AF2122/97
cgugacguagggcagcgccag

SEQ ID NO: 3191924 - RNA, 18 nt, Mycobacterium bovis subsp bovis AF2122/97
cgugacguagugcaccgc

SEQ ID NO: 3191925 - RNA, 19 nt, Mycobacterium bovis subsp bovis AF2122/97
cgugacguaucgccgcggg

SEQ ID NO: 3191926 - RNA, 21 nt, Mycobacterium bovis subsp bovis AF2122/97
cgugacguaucgccgcgggcg

SEQ ID NO: 3191927 - RNA, 14 nt, Mycobacterium bovis subsp bovis AF2122/97
cgugacgucgucga

SEQ ID NO: 3191928 - RNA, 15 nt, Mycobacterium bovis subsp bovis AF2122/97
cgugacucggccgac

SEQ ID NO: 3191929 - RNA, 16 nt, Mycobacterium bovis subsp bovis AF2122/97
cgugacucggccgacg

SEQ ID NO: 3191930 - RNA, 17 nt, Mycobacterium bovis subsp bovis AF2122/97
cgugacugguggcgcca

SEQ ID NO: 3191931 - RNA, 15 nt, Mycobacterium bovis subsp bovis AF2122/97
cgugagaccuagcag

SEQ ID NO: 3191932 - RNA, 13 nt, Mycobacterium bovis subsp bovis AF2122/97
cgugagacgccgu

SEQ ID NO: 3191933 - RNA, 23 nt, Mycobacterium bovis subsp bovis AF2122/97
cgugagaggccaagauggcgcgc

SEQ ID NO: 3191934 - RNA, 12 nt, Mycobacterium bovis subsp bovis AF2122/97
cgugagcaccag

SEQ ID NO: 3191935 - RNA, 13 nt, Mycobacterium bovis subsp bovis AF2122/97
cgugagcaccagc

SEQ ID NO: 3191936 - RNA, 14 nt, Mycobacterium bovis subsp bovis AF2122/97
cgugagccagcuug

SEQ ID NO: 3191937 - RNA, 16 nt, Mycobacterium bovis subsp bovis AF2122/97
cgugagccaugccgcu

SEQ ID NO: 3191938 - RNA, 15 nt, Mycobacterium bovis subsp bovis AF2122/97
cgugagccuguccac

SEQ ID NO: 3191939 - RNA, 16 nt, Mycobacterium bovis subsp bovis AF2122/97
cgugagccuguccacg

SEQ ID NO: 3191940 - RNA, 14 nt, Mycobacterium bovis subsp bovis AF2122/97
cgugagcgccgcgg

SEQ ID NO: 3191941 - RNA, 13 nt, Mycobacterium bovis subsp bovis AF2122/97
cgugagcggccag

SEQ ID NO: 3191942 - RNA, 17 nt, Mycobacterium bovis subsp bovis AF2122/97
cgugagcucgucgaggc

SEQ ID NO: 3191943 - RNA, 21 nt, Mycobacterium bovis subsp bovis AF2122/97
cgugaggucccggcugggauc

SEQ ID NO: 3191944 - RNA, 16 nt, Mycobacterium bovis subsp bovis AF2122/97
cgugagucacccggcc

SEQ ID NO: 3191945 - RNA, 16 nt, Mycobacterium bovis subsp bovis AF2122/97
cgugagugccggcgug

SEQ ID NO: 3191946 - RNA, 18 nt, Mycobacterium bovis subsp bovis AF2122/97
cgugagugccggcgugcg

SEQ ID NO: 3191947 - RNA, 13 nt, Mycobacterium bovis subsp bovis AF2122/97
cgugaguucacgu

SEQ ID NO: 3191948 - RNA, 19 nt, Mycobacterium bovis subsp bovis AF2122/97
cgugaguucacguucggcg

SEQ ID NO: 3191949 - RNA, 18 nt, Mycobacterium bovis subsp bovis AF2122/97
cgugaguucgcaaucaga

SEQ ID NO: 3191950 - RNA, 17 nt, Mycobacterium bovis subsp bovis AF2122/97
cgugauacagcucggug

SEQ ID NO: 3191951 - RNA, 19 nt, Mycobacterium bovis subsp bovis AF2122/97
cgugauacagcucggugca

SEQ ID NO: 3191952 - RNA, 13 nt, Mycobacterium bovis subsp bovis AF2122/97
cgugauagcgcgu

SEQ ID NO: 3191953 - RNA, 20 nt, Mycobacterium bovis subsp bovis AF2122/97
cgugauaucagagggccgcg

SEQ ID NO: 3191954 - RNA, 22 nt, Mycobacterium bovis subsp bovis AF2122/97
cgugaucaacuuccgcagcgcc

SEQ ID NO: 3191955 - RNA, 16 nt, Mycobacterium bovis subsp bovis AF2122/97
cgugaucaccggcauc

SEQ ID NO: 3191956 - RNA, 13 nt, Mycobacterium bovis subsp bovis AF2122/97
cgugaucagguca

SEQ ID NO: 3191957 - RNA, 19 nt, Mycobacterium bovis subsp bovis AF2122/97
cgugaucccgcccaaggug

SEQ ID NO: 3191958 - RNA, 15 nt, Mycobacterium bovis subsp bovis AF2122/97
cgugauccgccgaca

SEQ ID NO: 3191959 - RNA, 16 nt, Mycobacterium bovis subsp bovis AF2122/97
cgugaucgacgaccgu

SEQ ID NO: 3191960 - RNA, 15 nt, Mycobacterium bovis subsp bovis AF2122/97
cgugaucgaggcggc

SEQ ID NO: 3191961 - RNA, 20 nt, Mycobacterium bovis subsp bovis AF2122/97
cgugaucgaggcggcggucg

SEQ ID NO: 3191962 - RNA, 14 nt, Mycobacterium bovis subsp bovis AF2122/97
cgugaucggcgaac

SEQ ID NO: 3191963 - RNA, 16 nt, Mycobacterium bovis subsp bovis AF2122/97
cgugaucggcgucagg

SEQ ID NO: 3191964 - RNA, 23 nt, Mycobacterium bovis subsp bovis AF2122/97
cgugaucuucugccuuggccggc

SEQ ID NO: 3191965 - RNA, 22 nt, Mycobacterium bovis subsp bovis AF2122/97
cgugaugccacggcgucgcucg

SEQ ID NO: 3191966 - RNA, 16 nt, Mycobacterium bovis subsp bovis AF2122/97
cgugaugcggucgcgg

SEQ ID NO: 3191967 - RNA, 17 nt, Mycobacterium bovis subsp bovis AF2122/97
cgugaugcguucggccg

SEQ ID NO: 3191968 - RNA, 22 nt, Mycobacterium bovis subsp bovis AF2122/97
cgugauggcguuugccggccga

SEQ ID NO: 3191969 - RNA, 20 nt, Mycobacterium bovis subsp bovis AF2122/97
cgugaugggucaccucggag

SEQ ID NO: 3191970 - RNA, 17 nt, Mycobacterium bovis subsp bovis AF2122/97
cgugauggugacuucgg

SEQ ID NO: 3191971 - RNA, 20 nt, Mycobacterium bovis subsp bovis AF2122/97
cgugauggugacuucggugg

SEQ ID NO: 3191972 - RNA, 17 nt, Mycobacterium bovis subsp bovis AF2122/97
cgugaugguugcucgag

SEQ ID NO: 3191973 - RNA, 13 nt, Mycobacterium bovis subsp bovis AF2122/97
cgugaugucaacg

SEQ ID NO: 3191974 - RNA, 11 nt, Mycobacterium bovis subsp bovis AF2122/97
cgugcaaccau

SEQ ID NO: 3191975 - RNA, 20 nt, Mycobacterium bovis subsp bovis AF2122/97
cgugcacaggcaucguccgc

SEQ ID NO: 3191976 - RNA, 14 nt, Mycobacterium bovis subsp bovis AF2122/97
cgugcacaggucag

SEQ ID NO: 3191977 - RNA, 12 nt, Mycobacterium bovis subsp bovis AF2122/97
cgugcaccagcu

SEQ ID NO: 3191978 - RNA, 15 nt, Mycobacterium bovis subsp bovis AF2122/97
cgugcaccagcucac

SEQ ID NO: 3191979 - RNA, 19 nt, Mycobacterium bovis subsp bovis AF2122/97
cgugcaccagguugcaacc

SEQ ID NO: 3191980 - RNA, 21 nt, Mycobacterium bovis subsp bovis AF2122/97
cgugcaccagguugcaaccuu

SEQ ID NO: 3191981 - RNA, 18 nt, Mycobacterium bovis subsp bovis AF2122/97
cgugcaccauacucaccg

SEQ ID NO: 3191982 - RNA, 12 nt, Mycobacterium bovis subsp bovis AF2122/97
cgugcaccgcga

SEQ ID NO: 3191983 - RNA, 24 nt, Mycobacterium bovis subsp bovis AF2122/97
cgugcaccgcgaccgcgcacggcu

SEQ ID NO: 3191984 - RNA, 15 nt, Mycobacterium bovis subsp bovis AF2122/97
cgugcaccgucggga

SEQ ID NO: 3191985 - RNA, 14 nt, Mycobacterium bovis subsp bovis AF2122/97
cgugcacgaucgcg

SEQ ID NO: 3191986 - RNA, 17 nt, Mycobacterium bovis subsp bovis AF2122/97
cgugcacgaucgcggug

SEQ ID NO: 3191987 - RNA, 22 nt, Mycobacterium bovis subsp bovis AF2122/97
cgugcacgcacagcccgaugcc

SEQ ID NO: 3191988 - RNA, 16 nt, Mycobacterium bovis subsp bovis AF2122/97
cgugcacggcgaggcc

SEQ ID NO: 3191989 - RNA, 15 nt, Mycobacterium bovis subsp bovis AF2122/97
cgugcacggcggcca

SEQ ID NO: 3191990 - RNA, 17 nt, Mycobacterium bovis subsp bovis AF2122/97
cgugcacggcggccagg

SEQ ID NO: 3191991 - RNA, 16 nt, Mycobacterium bovis subsp bovis AF2122/97
cgugcacugaccgcgg

SEQ ID NO: 3191992 - RNA, 20 nt, Mycobacterium bovis subsp bovis AF2122/97
cgugcagaauccguucgacg

SEQ ID NO: 3191993 - RNA, 14 nt, Mycobacterium bovis subsp bovis AF2122/97
cgugcagacccggu

SEQ ID NO: 3191994 - RNA, 20 nt, Mycobacterium bovis subsp bovis AF2122/97
cgugcagcacccccucggcu

SEQ ID NO: 3191995 - RNA, 20 nt, Mycobacterium bovis subsp bovis AF2122/97
cgugcagcacuuggccagcu

SEQ ID NO: 3191996 - RNA, 18 nt, Mycobacterium bovis subsp bovis AF2122/97
cgugcagccauugacggu

SEQ ID NO: 3191997 - RNA, 21 nt, Mycobacterium bovis subsp bovis AF2122/97
cgugcagccauugacggucca

SEQ ID NO: 3191998 - RNA, 23 nt, Mycobacterium bovis subsp bovis AF2122/97
cgugcagccgcaggugggcguug

SEQ ID NO: 3191999 - RNA, 18 nt, Mycobacterium bovis subsp bovis AF2122/97
cgugcagcggcgccgcca

SEQ ID NO: 3192000 - RNA, 16 nt, Mycobacterium bovis subsp bovis AF2122/97
cgugcagcggcgggcg

SEQ ID NO: 3192001 - RNA, 19 nt, Mycobacterium bovis subsp bovis AF2122/97
cgugcagcggcgggcgaug

SEQ ID NO: 3192002 - RNA, 20 nt, Mycobacterium bovis subsp bovis AF2122/97
cgugcagcggcgggcgauga

SEQ ID NO: 3192003 - RNA, 17 nt, Mycobacterium bovis subsp bovis AF2122/97
cgugcaggaacacccau

SEQ ID NO: 3192004 - RNA, 22 nt, Mycobacterium bovis subsp bovis AF2122/97
cgugcaggaccagcaccgccgc

SEQ ID NO: 3192005 - RNA, 17 nt, Mycobacterium bovis subsp bovis AF2122/97
cgugcaggaucggcuug

SEQ ID NO: 3192006 - RNA, 15 nt, Mycobacterium bovis subsp bovis AF2122/97
cgugcaggcgacggc

SEQ ID NO: 3192007 - RNA, 23 nt, Mycobacterium bovis subsp bovis AF2122/97
cgugcaggcugguuucggccgca

SEQ ID NO: 3192008 - RNA, 17 nt, Mycobacterium bovis subsp bovis AF2122/97
cgugcauaagcccgcga

SEQ ID NO: 3192009 - RNA, 23 nt, Mycobacterium bovis subsp bovis AF2122/97
cgugcaucgcgauuccggcggcc

SEQ ID NO: 3192010 - RNA, 22 nt, Mycobacterium bovis subsp bovis AF2122/97
cgugcaugggacauccagaucg

SEQ ID NO: 3192011 - RNA, 23 nt, Mycobacterium bovis subsp bovis AF2122/97
cgugccaaugauucggcacgccg

SEQ ID NO: 3192012 - RNA, 15 nt, Mycobacterium bovis subsp bovis AF2122/97
cgugccacagcucgc

SEQ ID NO: 3192013 - RNA, 19 nt, Mycobacterium bovis subsp bovis AF2122/97
cgugccacagcucgccgug

SEQ ID NO: 3192014 - RNA, 16 nt, Mycobacterium bovis subsp bovis AF2122/97
cgugccacucgaugcu

SEQ ID NO: 3192015 - RNA, 20 nt, Mycobacterium bovis subsp bovis AF2122/97
cgugccagcaggggacgggc

SEQ ID NO: 3192016 - RNA, 22 nt, Mycobacterium bovis subsp bovis AF2122/97
cgugccagcaggggacgggcgg

SEQ ID NO: 3192017 - RNA, 14 nt, Mycobacterium bovis subsp bovis AF2122/97
cgugccagcgcccc

SEQ ID NO: 3192018 - RNA, 15 nt, Mycobacterium bovis subsp bovis AF2122/97
cgugccagcugccga

SEQ ID NO: 3192019 - RNA, 23 nt, Mycobacterium bovis subsp bovis AF2122/97
cgugccaugguugaugugcagga

SEQ ID NO: 3192020 - RNA, 17 nt, Mycobacterium bovis subsp bovis AF2122/97
cgugcccaggccaccgg

SEQ ID NO: 3192021 - RNA, 22 nt, Mycobacterium bovis subsp bovis AF2122/97
cgugcccccggcuuuuccggca

SEQ ID NO: 3192022 - RNA, 14 nt, Mycobacterium bovis subsp bovis AF2122/97
cgugccccggcgcg

SEQ ID NO: 3192023 - RNA, 16 nt, Mycobacterium bovis subsp bovis AF2122/97
cgugccccggcgcggu

SEQ ID NO: 3192024 - RNA, 13 nt, Mycobacterium bovis subsp bovis AF2122/97
cgugccccggcgg

SEQ ID NO: 3192025 - RNA, 18 nt, Mycobacterium bovis subsp bovis AF2122/97
cgugccccgggcccaggu

SEQ ID NO: 3192026 - RNA, 15 nt, Mycobacterium bovis subsp bovis AF2122/97
cgugcccgccaccgg

SEQ ID NO: 3192027 - RNA, 16 nt, Mycobacterium bovis subsp bovis AF2122/97
cgugcccgccaccggc

SEQ ID NO: 3192028 - RNA, 19 nt, Mycobacterium bovis subsp bovis AF2122/97
cgugcccgccaccggcgcg

SEQ ID NO: 3192029 - RNA, 12 nt, Mycobacterium bovis subsp bovis AF2122/97
cgugcccgggcg

SEQ ID NO: 3192030 - RNA, 20 nt, Mycobacterium bovis subsp bovis AF2122/97
cgugcccguauaaccggcca

SEQ ID NO: 3192031 - RNA, 17 nt, Mycobacterium bovis subsp bovis AF2122/97
cgugcccguggugaugg

SEQ ID NO: 3192032 - RNA, 17 nt, Mycobacterium bovis subsp bovis AF2122/97
cgugccgaaaaucgcag

SEQ ID NO: 3192033 - RNA, 19 nt, Mycobacterium bovis subsp bovis AF2122/97
cgugccgaaaaucgcagcc

SEQ ID NO: 3192034 - RNA, 23 nt, Mycobacterium bovis subsp bovis AF2122/97
cgugccgaacagggaggucgccg

SEQ ID NO: 3192035 - RNA, 23 nt, Mycobacterium bovis subsp bovis AF2122/97
cgugccgaacgccagaccgccga

SEQ ID NO: 3192036 - RNA, 21 nt, Mycobacterium bovis subsp bovis AF2122/97
cgugccgaaguggagccccga

SEQ ID NO: 3192037 - RNA, 15 nt, Mycobacterium bovis subsp bovis AF2122/97
cgugccgaccagcau

SEQ ID NO: 3192038 - RNA, 16 nt, Mycobacterium bovis subsp bovis AF2122/97
cgugccgacgccccga

SEQ ID NO: 3192039 - RNA, 12 nt, Mycobacterium bovis subsp bovis AF2122/97
cgugccgagcuu

SEQ ID NO: 3192040 - RNA, 23 nt, Mycobacterium bovis subsp bovis AF2122/97
cgugccgcaccgccugcucggcg

SEQ ID NO: 3192041 - RNA, 12 nt, Mycobacterium bovis subsp bovis AF2122/97
cgugccgcagcg

SEQ ID NO: 3192042 - RNA, 14 nt, Mycobacterium bovis subsp bovis AF2122/97
cgugccgcagcggc

SEQ ID NO: 3192043 - RNA, 16 nt, Mycobacterium bovis subsp bovis AF2122/97
cgugccgcagcggcgg

SEQ ID NO: 3192044 - RNA, 12 nt, Mycobacterium bovis subsp bovis AF2122/97
cgugccgccagc

SEQ ID NO: 3192045 - RNA, 18 nt, Mycobacterium bovis subsp bovis AF2122/97
cgugccgcccgccucugu

SEQ ID NO: 3192046 - RNA, 17 nt, Mycobacterium bovis subsp bovis AF2122/97
cgugccgcccggucggg

SEQ ID NO: 3192047 - RNA, 21 nt, Mycobacterium bovis subsp bovis AF2122/97
cgugccgcccggucgggcgcg

SEQ ID NO: 3192048 - RNA, 11 nt, Mycobacterium bovis subsp bovis AF2122/97
cgugccgccga

SEQ ID NO: 3192049 - RNA, 19 nt, Mycobacterium bovis subsp bovis AF2122/97
cgugccgccgacaccaccg

SEQ ID NO: 3192050 - RNA, 12 nt, Mycobacterium bovis subsp bovis AF2122/97
cgugccgccgca

SEQ ID NO: 3192051 - RNA, 13 nt, Mycobacterium bovis subsp bovis AF2122/97
cgugccgccgcag

SEQ ID NO: 3192052 - RNA, 19 nt, Mycobacterium bovis subsp bovis AF2122/97
cgugccgcggcgacgguga

SEQ ID NO: 3192053 - RNA, 20 nt, Mycobacterium bovis subsp bovis AF2122/97
cgugccgcggcgacggugag

SEQ ID NO: 3192054 - RNA, 13 nt, Mycobacterium bovis subsp bovis AF2122/97
cgugccggcagcg

SEQ ID NO: 3192055 - RNA, 13 nt, Mycobacterium bovis subsp bovis AF2122/97
cgugccggcguug

SEQ ID NO: 3192056 - RNA, 14 nt, Mycobacterium bovis subsp bovis AF2122/97
cgugccgggaccgg

SEQ ID NO: 3192057 - RNA, 14 nt, Mycobacterium bovis subsp bovis AF2122/97
cgugccgggccaga

SEQ ID NO: 3192058 - RNA, 15 nt, Mycobacterium bovis subsp bovis AF2122/97
cgugccgggcgacgg

SEQ ID NO: 3192059 - RNA, 16 nt, Mycobacterium bovis subsp bovis AF2122/97
cgugccggggcugccg

SEQ ID NO: 3192060 - RNA, 18 nt, Mycobacterium bovis subsp bovis AF2122/97
cgugccggggcugccgaa

SEQ ID NO: 3192061 - RNA, 15 nt, Mycobacterium bovis subsp bovis AF2122/97
cgugccgggucaccg

SEQ ID NO: 3192062 - RNA, 17 nt, Mycobacterium bovis subsp bovis AF2122/97
cgugccgggucaccgau

SEQ ID NO: 3192063 - RNA, 17 nt, Mycobacterium bovis subsp bovis AF2122/97
cgugccgguuuggccga

SEQ ID NO: 3192064 - RNA, 20 nt, Mycobacterium bovis subsp bovis AF2122/97
cgugccgucggcgugcagca

SEQ ID NO: 3192065 - RNA, 20 nt, Mycobacterium bovis subsp bovis AF2122/97
cgugccguugaagcccaaca

SEQ ID NO: 3192066 - RNA, 17 nt, Mycobacterium bovis subsp bovis AF2122/97
cgugccucgaggacggc

SEQ ID NO: 3192067 - RNA, 21 nt, Mycobacterium bovis subsp bovis AF2122/97
cgugccucggacaaagccguc

SEQ ID NO: 3192068 - RNA, 18 nt, Mycobacterium bovis subsp bovis AF2122/97
cgugccugcaguucggcg

SEQ ID NO: 3192069 - RNA, 14 nt, Mycobacterium bovis subsp bovis AF2122/97
cgugccuggccggu

SEQ ID NO: 3192070 - RNA, 16 nt, Mycobacterium bovis subsp bovis AF2122/97
cgugccuggccggugc

SEQ ID NO: 3192071 - RNA, 17 nt, Mycobacterium bovis subsp bovis AF2122/97
cgugccuggccggugcg

SEQ ID NO: 3192072 - RNA, 19 nt, Mycobacterium bovis subsp bovis AF2122/97
cgugccuggccggugcgca

SEQ ID NO: 3192073 - RNA, 15 nt, Mycobacterium bovis subsp bovis AF2122/97
cgugccuuccucgcc

SEQ ID NO: 3192074 - RNA, 17 nt, Mycobacterium bovis subsp bovis AF2122/97
cgugccuuccucgccgg

SEQ ID NO: 3192075 - RNA, 18 nt, Mycobacterium bovis subsp bovis AF2122/97
cgugccuuccucgccgga

SEQ ID NO: 3192076 - RNA, 18 nt, Mycobacterium bovis subsp bovis AF2122/97
cgugcgacgauaucggga

SEQ ID NO: 3192077 - RNA, 20 nt, Mycobacterium bovis subsp bovis AF2122/97
cgugcgacgauaucgggagc

SEQ ID NO: 3192078 - RNA, 21 nt, Mycobacterium bovis subsp bovis AF2122/97
cgugcgacuucgagauugccg

SEQ ID NO: 3192079 - RNA, 17 nt, Mycobacterium bovis subsp bovis AF2122/97
cgugcgagggcacggcg

SEQ ID NO: 3192080 - RNA, 14 nt, Mycobacterium bovis subsp bovis AF2122/97
cgugcgaucaccuc

SEQ ID NO: 3192081 - RNA, 21 nt, Mycobacterium bovis subsp bovis AF2122/97
cgugcgaucaccuccgcgacg

SEQ ID NO: 3192082 - RNA, 17 nt, Mycobacterium bovis subsp bovis AF2122/97
cgugcgaugcacaaccg

SEQ ID NO: 3192083 - RNA, 16 nt, Mycobacterium bovis subsp bovis AF2122/97
cgugcgaugcagcgcg

SEQ ID NO: 3192084 - RNA, 17 nt, Mycobacterium bovis subsp bovis AF2122/97
cgugcgaugcagcgcgc

SEQ ID NO: 3192085 - RNA, 18 nt, Mycobacterium bovis subsp bovis AF2122/97
cgugcgaugcagcgcgcc

SEQ ID NO: 3192086 - RNA, 23 nt, Mycobacterium bovis subsp bovis AF2122/97
cgugcgauucacacucgggcggc

SEQ ID NO: 3192087 - RNA, 18 nt, Mycobacterium bovis subsp bovis AF2122/97
cgugcgauucugcgucug

SEQ ID NO: 3192088 - RNA, 15 nt, Mycobacterium bovis subsp bovis AF2122/97
cgugcgcaacgcguc

SEQ ID NO: 3192089 - RNA, 19 nt, Mycobacterium bovis subsp bovis AF2122/97
cgugcgcaacgcgucgucg

SEQ ID NO: 3192090 - RNA, 13 nt, Mycobacterium bovis subsp bovis AF2122/97
cgugcgcacggcg

SEQ ID NO: 3192091 - RNA, 17 nt, Mycobacterium bovis subsp bovis AF2122/97
cgugcgcacggcgccga

SEQ ID NO: 3192092 - RNA, 16 nt, Mycobacterium bovis subsp bovis AF2122/97
cgugcgcaucagcggu

SEQ ID NO: 3192093 - RNA, 13 nt, Mycobacterium bovis subsp bovis AF2122/97
cgugcgcaucccg

SEQ ID NO: 3192094 - RNA, 16 nt, Mycobacterium bovis subsp bovis AF2122/97
cgugcgccacggcugu

SEQ ID NO: 3192095 - RNA, 13 nt, Mycobacterium bovis subsp bovis AF2122/97
cgugcgccgacgg

SEQ ID NO: 3192096 - RNA, 16 nt, Mycobacterium bovis subsp bovis AF2122/97
cgugcgccgacggugc

SEQ ID NO: 3192097 - RNA, 17 nt, Mycobacterium bovis subsp bovis AF2122/97
cgugcgccgacggugca

SEQ ID NO: 3192098 - RNA, 19 nt, Mycobacterium bovis subsp bovis AF2122/97
cgugcgccggggacacagc

SEQ ID NO: 3192099 - RNA, 20 nt, Mycobacterium bovis subsp bovis AF2122/97
cgugcgccggggacacagcg

SEQ ID NO: 3192100 - RNA, 20 nt, Mycobacterium bovis subsp bovis AF2122/97
cgugcgccgugcgaucguca

SEQ ID NO: 3192101 - RNA, 13 nt, Mycobacterium bovis subsp bovis AF2122/97
cgugcgcgcgcag

SEQ ID NO: 3192102 - RNA, 15 nt, Mycobacterium bovis subsp bovis AF2122/97
cgugcgcgcgcagcu

SEQ ID NO: 3192103 - RNA, 16 nt, Mycobacterium bovis subsp bovis AF2122/97
cgugcgcgcgcagcug

SEQ ID NO: 3192104 - RNA, 22 nt, Mycobacterium bovis subsp bovis AF2122/97
cgugcgcgcgcagcugacguca

SEQ ID NO: 3192105 - RNA, 14 nt, Mycobacterium bovis subsp bovis AF2122/97
cgugcgcggccggc

SEQ ID NO: 3192106 - RNA, 15 nt, Mycobacterium bovis subsp bovis AF2122/97
cgugcgcggccggca

SEQ ID NO: 3192107 - RNA, 17 nt, Mycobacterium bovis subsp bovis AF2122/97
cgugcgcggccggcacg

SEQ ID NO: 3192108 - RNA, 18 nt, Mycobacterium bovis subsp bovis AF2122/97
cgugcgcggccggcacga

SEQ ID NO: 3192109 - RNA, 15 nt, Mycobacterium bovis subsp bovis AF2122/97
cgugcgcggugaugg

SEQ ID NO: 3192110 - RNA, 22 nt, Mycobacterium bovis subsp bovis AF2122/97
cgugcgcgucggugucgaugcu

SEQ ID NO: 3192111 - RNA, 21 nt, Mycobacterium bovis subsp bovis AF2122/97
cgugcgcuuggucgaccgccg

SEQ ID NO: 3192112 - RNA, 22 nt, Mycobacterium bovis subsp bovis AF2122/97
cgugcgcuuggucgaccgccga

SEQ ID NO: 3192113 - RNA, 21 nt, Mycobacterium bovis subsp bovis AF2122/97
cgugcggcgaccgucaaccug

SEQ ID NO: 3192114 - RNA, 15 nt, Mycobacterium bovis subsp bovis AF2122/97
cgugcggcgcggcga

SEQ ID NO: 3192115 - RNA, 14 nt, Mycobacterium bovis subsp bovis AF2122/97
cgugcggcggccuc

SEQ ID NO: 3192116 - RNA, 15 nt, Mycobacterium bovis subsp bovis AF2122/97
cgugcggcggccucg

SEQ ID NO: 3192117 - RNA, 14 nt, Mycobacterium bovis subsp bovis AF2122/97
cgugcgggcaguug

SEQ ID NO: 3192118 - RNA, 13 nt, Mycobacterium bovis subsp bovis AF2122/97
cgugcgggcgggc

SEQ ID NO: 3192119 - RNA, 14 nt, Mycobacterium bovis subsp bovis AF2122/97
cgugcgggcgggcg

SEQ ID NO: 3192120 - RNA, 19 nt, Mycobacterium bovis subsp bovis AF2122/97
cgugcgguauuugaacgcc

SEQ ID NO: 3192121 - RNA, 23 nt, Mycobacterium bovis subsp bovis AF2122/97
cgugcgguauuugaacgcccgcu

SEQ ID NO: 3192122 - RNA, 14 nt, Mycobacterium bovis subsp bovis AF2122/97
cgugcggucgcgcc

SEQ ID NO: 3192123 - RNA, 15 nt, Mycobacterium bovis subsp bovis AF2122/97
cgugcggucgcgccc

SEQ ID NO: 3192124 - RNA, 14 nt, Mycobacterium bovis subsp bovis AF2122/97
cgugcggucguugg

SEQ ID NO: 3192125 - RNA, 15 nt, Mycobacterium bovis subsp bovis AF2122/97
cgugcgguggcgcgc

SEQ ID NO: 3192126 - RNA, 12 nt, Mycobacterium bovis subsp bovis AF2122/97
cgugcgguggcu

SEQ ID NO: 3192127 - RNA, 15 nt, Mycobacterium bovis subsp bovis AF2122/97
cgugcgucggcccgg

SEQ ID NO: 3192128 - RNA, 19 nt, Mycobacterium bovis subsp bovis AF2122/97
cgugcgucggcccggugcu

SEQ ID NO: 3192129 - RNA, 18 nt, Mycobacterium bovis subsp bovis AF2122/97
cgugcgugggcgcggcgc

SEQ ID NO: 3192130 - RNA, 17 nt, Mycobacterium bovis subsp bovis AF2122/97
cgugcuacccauucggc

SEQ ID NO: 3192131 - RNA, 18 nt, Mycobacterium bovis subsp bovis AF2122/97
cgugcuacccauucggcg

SEQ ID NO: 3192132 - RNA, 12 nt, Mycobacterium bovis subsp bovis AF2122/97
cgugcucaccgg

SEQ ID NO: 3192133 - RNA, 15 nt, Mycobacterium bovis subsp bovis AF2122/97
cgugcucaccggcgc

SEQ ID NO: 3192134 - RNA, 16 nt, Mycobacterium bovis subsp bovis AF2122/97
cgugcucaccggcgcc

SEQ ID NO: 3192135 - RNA, 13 nt, Mycobacterium bovis subsp bovis AF2122/97
cgugcuccugccc

SEQ ID NO: 3192136 - RNA, 14 nt, Mycobacterium bovis subsp bovis AF2122/97
cgugcuccugcccg

SEQ ID NO: 3192137 - RNA, 14 nt, Mycobacterium bovis subsp bovis AF2122/97
cgugcucgacgcgc

SEQ ID NO: 3192138 - RNA, 20 nt, Mycobacterium bovis subsp bovis AF2122/97
cgugcucgacgcgcaucgca

SEQ ID NO: 3192139 - RNA, 13 nt, Mycobacterium bovis subsp bovis AF2122/97
cgugcucgccgua

SEQ ID NO: 3192140 - RNA, 18 nt, Mycobacterium bovis subsp bovis AF2122/97
cgugcucggaggcgauca

SEQ ID NO: 3192141 - RNA, 21 nt, Mycobacterium bovis subsp bovis AF2122/97
cgugcucgucguacaugggca

SEQ ID NO: 3192142 - RNA, 14 nt, Mycobacterium bovis subsp bovis AF2122/97
cgugcucucggcga

SEQ ID NO: 3192143 - RNA, 22 nt, Mycobacterium bovis subsp bovis AF2122/97
cgugcugaauugccaagcgcgc

SEQ ID NO: 3192144 - RNA, 12 nt, Mycobacterium bovis subsp bovis AF2122/97
cgugcugccauu

SEQ ID NO: 3192145 - RNA, 19 nt, Mycobacterium bovis subsp bovis AF2122/97
cgugcugcccgcaacacug

SEQ ID NO: 3192146 - RNA, 21 nt, Mycobacterium bovis subsp bovis AF2122/97
cgugcugccgauagcgcggca

SEQ ID NO: 3192147 - RNA, 19 nt, Mycobacterium bovis subsp bovis AF2122/97
cgugcugccgccuuggucg

SEQ ID NO: 3192148 - RNA, 20 nt, Mycobacterium bovis subsp bovis AF2122/97
cgugcugccggagacacccg

SEQ ID NO: 3192149 - RNA, 23 nt, Mycobacterium bovis subsp bovis AF2122/97
cgugcugccguauccaggcgugc

SEQ ID NO: 3192150 - RNA, 14 nt, Mycobacterium bovis subsp bovis AF2122/97
cgugcugcuagcca

SEQ ID NO: 3192151 - RNA, 14 nt, Mycobacterium bovis subsp bovis AF2122/97
cgugcuggcaccag

SEQ ID NO: 3192152 - RNA, 15 nt, Mycobacterium bovis subsp bovis AF2122/97
cgugcuggcaccagc

SEQ ID NO: 3192153 - RNA, 14 nt, Mycobacterium bovis subsp bovis AF2122/97
cgugcuggcgccga

SEQ ID NO: 3192154 - RNA, 15 nt, Mycobacterium bovis subsp bovis AF2122/97
cgugcuggcgccgaa

SEQ ID NO: 3192155 - RNA, 16 nt, Mycobacterium bovis subsp bovis AF2122/97
cgugcugggcaucacc

SEQ ID NO: 3192156 - RNA, 18 nt, Mycobacterium bovis subsp bovis AF2122/97
cgugcugggcaucaccga

SEQ ID NO: 3192157 - RNA, 16 nt, Mycobacterium bovis subsp bovis AF2122/97
cgugcugggccgacgg

SEQ ID NO: 3192158 - RNA, 16 nt, Mycobacterium bovis subsp bovis AF2122/97
cgugcugggcgccgcg

SEQ ID NO: 3192159 - RNA, 19 nt, Mycobacterium bovis subsp bovis AF2122/97
cgugcugggugacaccggu

SEQ ID NO: 3192160 - RNA, 21 nt, Mycobacterium bovis subsp bovis AF2122/97
cgugcuggugguaucggcgug

SEQ ID NO: 3192161 - RNA, 19 nt, Mycobacterium bovis subsp bovis AF2122/97
cgugcuguggaugccgacg

SEQ ID NO: 3192162 - RNA, 22 nt, Mycobacterium bovis subsp bovis AF2122/97
cgugcuguggaugccgacggcg

SEQ ID NO: 3192163 - RNA, 21 nt, Mycobacterium bovis subsp bovis AF2122/97
cgugcuuaacacaugcaaguc

SEQ ID NO: 3192164 - RNA, 17 nt, Mycobacterium bovis subsp bovis AF2122/97
cgugcuuccauucgcgg

SEQ ID NO: 3192165 - RNA, 14 nt, Mycobacterium bovis subsp bovis AF2122/97
cgugcuugaccgcc

SEQ ID NO: 3192166 - RNA, 15 nt, Mycobacterium bovis subsp bovis AF2122/97
cgugcuugaccgccu

SEQ ID NO: 3192167 - RNA, 14 nt, Mycobacterium bovis subsp bovis AF2122/97
cgugcuugcccggu

SEQ ID NO: 3192168 - RNA, 18 nt, Mycobacterium bovis subsp bovis AF2122/97
cgugcuuguugcgcgacg

SEQ ID NO: 3192169 - RNA, 19 nt, Mycobacterium bovis subsp bovis AF2122/97
cgugcuuuccuugcgcgcc

SEQ ID NO: 3192170 - RNA, 16 nt, Mycobacterium bovis subsp bovis AF2122/97
cguggaaagccggcgu

SEQ ID NO: 3192171 - RNA, 22 nt, Mycobacterium bovis subsp bovis AF2122/97
cguggaacugcagcggcuugcc

SEQ ID NO: 3192172 - RNA, 15 nt, Mycobacterium bovis subsp bovis AF2122/97
cguggaagacgucga

SEQ ID NO: 3192173 - RNA, 20 nt, Mycobacterium bovis subsp bovis AF2122/97
cguggaagauguugccgccg

SEQ ID NO: 3192174 - RNA, 20 nt, Mycobacterium bovis subsp bovis AF2122/97
cguggaagccgacgaccagc

SEQ ID NO: 3192175 - RNA, 15 nt, Mycobacterium bovis subsp bovis AF2122/97
cguggaauggcgccg

SEQ ID NO: 3192176 - RNA, 21 nt, Mycobacterium bovis subsp bovis AF2122/97
cguggaauggcgccggccggc

SEQ ID NO: 3192177 - RNA, 22 nt, Mycobacterium bovis subsp bovis AF2122/97
cguggaauggcgccggccggca

SEQ ID NO: 3192178 - RNA, 17 nt, Mycobacterium bovis subsp bovis AF2122/97
cguggacaucgggcggc

SEQ ID NO: 3192179 - RNA, 23 nt, Mycobacterium bovis subsp bovis AF2122/97
cguggacaucgggcggcaccgcu

SEQ ID NO: 3192180 - RNA, 14 nt, Mycobacterium bovis subsp bovis AF2122/97
cguggaccacggcg

SEQ ID NO: 3192181 - RNA, 15 nt, Mycobacterium bovis subsp bovis AF2122/97
cguggaccacggcgu

SEQ ID NO: 3192182 - RNA, 14 nt, Mycobacterium bovis subsp bovis AF2122/97
cguggaccggcacg

SEQ ID NO: 3192183 - RNA, 15 nt, Mycobacterium bovis subsp bovis AF2122/97
cguggaccggcacgu

SEQ ID NO: 3192184 - RNA, 15 nt, Mycobacterium bovis subsp bovis AF2122/97
cguggacgcccgccc

SEQ ID NO: 3192185 - RNA, 17 nt, Mycobacterium bovis subsp bovis AF2122/97
cguggacgcccgcccgc

SEQ ID NO: 3192186 - RNA, 24 nt, Mycobacterium bovis subsp bovis AF2122/97
cguggacgcccgcccgcacgacga

SEQ ID NO: 3192187 - RNA, 17 nt, Mycobacterium bovis subsp bovis AF2122/97
cguggacuuuggugucg

SEQ ID NO: 3192188 - RNA, 20 nt, Mycobacterium bovis subsp bovis AF2122/97
cguggagauacauuucccag

SEQ ID NO: 3192189 - RNA, 14 nt, Mycobacterium bovis subsp bovis AF2122/97
cguggagaucacgu

SEQ ID NO: 3192190 - RNA, 22 nt, Mycobacterium bovis subsp bovis AF2122/97
cguggagcucacgugcugccga

SEQ ID NO: 3192191 - RNA, 23 nt, Mycobacterium bovis subsp bovis AF2122/97
cguggaggacuacuaggccccug

SEQ ID NO: 3192192 - RNA, 15 nt, Mycobacterium bovis subsp bovis AF2122/97
cguggauccagccau

SEQ ID NO: 3192193 - RNA, 16 nt, Mycobacterium bovis subsp bovis AF2122/97
cguggaucggcagccc

SEQ ID NO: 3192194 - RNA, 22 nt, Mycobacterium bovis subsp bovis AF2122/97
cguggaucugaagagcggagcc

SEQ ID NO: 3192195 - RNA, 16 nt, Mycobacterium bovis subsp bovis AF2122/97
cguggaucugccucuc

SEQ ID NO: 3192196 - RNA, 18 nt, Mycobacterium bovis subsp bovis AF2122/97
cguggaucuuggccagca

SEQ ID NO: 3192197 - RNA, 21 nt, Mycobacterium bovis subsp bovis AF2122/97
cguggaucuuggccagcagcg

SEQ ID NO: 3192198 - RNA, 20 nt, Mycobacterium bovis subsp bovis AF2122/97
cguggauggccgccaggcgc

SEQ ID NO: 3192199 - RNA, 14 nt, Mycobacterium bovis subsp bovis AF2122/97
cguggaugucgcgg

SEQ ID NO: 3192200 - RNA, 15 nt, Mycobacterium bovis subsp bovis AF2122/97
cguggcaacgagcag

SEQ ID NO: 3192201 - RNA, 22 nt, Mycobacterium bovis subsp bovis AF2122/97
cguggcaccaccaagguguggc

SEQ ID NO: 3192202 - RNA, 14 nt, Mycobacterium bovis subsp bovis AF2122/97
cguggcaccgacag

SEQ ID NO: 3192203 - RNA, 17 nt, Mycobacterium bovis subsp bovis AF2122/97
cguggcaccgacagcag

SEQ ID NO: 3192204 - RNA, 16 nt, Mycobacterium bovis subsp bovis AF2122/97
cguggcacugacgcgc

SEQ ID NO: 3192205 - RNA, 20 nt, Mycobacterium bovis subsp bovis AF2122/97
cguggcacugacgcgcccga

SEQ ID NO: 3192206 - RNA, 19 nt, Mycobacterium bovis subsp bovis AF2122/97
cguggcaguacaccggcgu

SEQ ID NO: 3192207 - RNA, 23 nt, Mycobacterium bovis subsp bovis AF2122/97
cguggcagucgcacggugccgcc

SEQ ID NO: 3192208 - RNA, 18 nt, Mycobacterium bovis subsp bovis AF2122/97
cguggcagugcaggcggc

SEQ ID NO: 3192209 - RNA, 15 nt, Mycobacterium bovis subsp bovis AF2122/97
cguggcaucgccucc

SEQ ID NO: 3192210 - RNA, 16 nt, Mycobacterium bovis subsp bovis AF2122/97
cguggcaucgccucca

SEQ ID NO: 3192211 - RNA, 22 nt, Mycobacterium bovis subsp bovis AF2122/97
cguggccaauccggcggcgacg

SEQ ID NO: 3192212 - RNA, 17 nt, Mycobacterium bovis subsp bovis AF2122/97
cguggccacggcauucg

SEQ ID NO: 3192213 - RNA, 19 nt, Mycobacterium bovis subsp bovis AF2122/97
cguggccacggcauucgac

SEQ ID NO: 3192214 - RNA, 14 nt, Mycobacterium bovis subsp bovis AF2122/97
cguggccccaccga

SEQ ID NO: 3192215 - RNA, 15 nt, Mycobacterium bovis subsp bovis AF2122/97
cguggcccuccucgg

SEQ ID NO: 3192216 - RNA, 21 nt, Mycobacterium bovis subsp bovis AF2122/97
cguggcccuccucggugaggu

SEQ ID NO: 3192217 - RNA, 16 nt, Mycobacterium bovis subsp bovis AF2122/97
cguggccgacagcggg

SEQ ID NO: 3192218 - RNA, 16 nt, Mycobacterium bovis subsp bovis AF2122/97
cguggccgccggcgcu

SEQ ID NO: 3192219 - RNA, 17 nt, Mycobacterium bovis subsp bovis AF2122/97
cguggccgccggcgcug

SEQ ID NO: 3192220 - RNA, 17 nt, Mycobacterium bovis subsp bovis AF2122/97
cguggccgcgaucccgg

SEQ ID NO: 3192221 - RNA, 18 nt, Mycobacterium bovis subsp bovis AF2122/97
cguggccgcgaucccggc

SEQ ID NO: 3192222 - RNA, 15 nt, Mycobacterium bovis subsp bovis AF2122/97
cguggcgaaccaggg

SEQ ID NO: 3192223 - RNA, 17 nt, Mycobacterium bovis subsp bovis AF2122/97
cguggcgaaugacggcc

SEQ ID NO: 3192224 - RNA, 21 nt, Mycobacterium bovis subsp bovis AF2122/97
cguggcgaaugacggccaguu

SEQ ID NO: 3192225 - RNA, 23 nt, Mycobacterium bovis subsp bovis AF2122/97
cguggcgaaugacggccaguugg

SEQ ID NO: 3192226 - RNA, 16 nt, Mycobacterium bovis subsp bovis AF2122/97
cguggcgaauucgacc

SEQ ID NO: 3192227 - RNA, 17 nt, Mycobacterium bovis subsp bovis AF2122/97
cguggcgcaccaccgcc

SEQ ID NO: 3192228 - RNA, 14 nt, Mycobacterium bovis subsp bovis AF2122/97
cguggcgccacggc

SEQ ID NO: 3192229 - RNA, 18 nt, Mycobacterium bovis subsp bovis AF2122/97
cguggcgccacggcagcg

SEQ ID NO: 3192230 - RNA, 18 nt, Mycobacterium bovis subsp bovis AF2122/97
cguggcgcccgugccgcc

SEQ ID NO: 3192231 - RNA, 22 nt, Mycobacterium bovis subsp bovis AF2122/97
cguggcgcccgugccgcccgcg

SEQ ID NO: 3192232 - RNA, 14 nt, Mycobacterium bovis subsp bovis AF2122/97
cguggcgccggcca

SEQ ID NO: 3192233 - RNA, 18 nt, Mycobacterium bovis subsp bovis AF2122/97
cguggcgccggccacgag

SEQ ID NO: 3192234 - RNA, 18 nt, Mycobacterium bovis subsp bovis AF2122/97
cguggcgccggucgccgg

SEQ ID NO: 3192235 - RNA, 19 nt, Mycobacterium bovis subsp bovis AF2122/97
cguggcgccggucgccggc

SEQ ID NO: 3192236 - RNA, 13 nt, Mycobacterium bovis subsp bovis AF2122/97
cguggcgcgccgc

SEQ ID NO: 3192237 - RNA, 14 nt, Mycobacterium bovis subsp bovis AF2122/97
cguggcgcgccgca

SEQ ID NO: 3192238 - RNA, 16 nt, Mycobacterium bovis subsp bovis AF2122/97
cguggcgcgccgcauc

SEQ ID NO: 3192239 - RNA, 13 nt, Mycobacterium bovis subsp bovis AF2122/97
cguggcgcucggc

SEQ ID NO: 3192240 - RNA, 14 nt, Mycobacterium bovis subsp bovis AF2122/97
cguggcgcucggcg

SEQ ID NO: 3192241 - RNA, 20 nt, Mycobacterium bovis subsp bovis AF2122/97
cguggcggaucgcgagcgcc

SEQ ID NO: 3192242 - RNA, 12 nt, Mycobacterium bovis subsp bovis AF2122/97
cguggcggccuc

SEQ ID NO: 3192243 - RNA, 12 nt, Mycobacterium bovis subsp bovis AF2122/97
cguggcggcgcg

SEQ ID NO: 3192244 - RNA, 13 nt, Mycobacterium bovis subsp bovis AF2122/97
cguggcggcgcgc

SEQ ID NO: 3192245 - RNA, 22 nt, Mycobacterium bovis subsp bovis AF2122/97
cguggcggcgggccucggcgac

SEQ ID NO: 3192246 - RNA, 16 nt, Mycobacterium bovis subsp bovis AF2122/97
cguggcgggcugcagc

SEQ ID NO: 3192247 - RNA, 17 nt, Mycobacterium bovis subsp bovis AF2122/97
cguggcgggcugcagcc

SEQ ID NO: 3192248 - RNA, 22 nt, Mycobacterium bovis subsp bovis AF2122/97
cguggcgggcugcagccgacag

SEQ ID NO: 3192249 - RNA, 20 nt, Mycobacterium bovis subsp bovis AF2122/97
cguggcggggaaaccggcca

SEQ ID NO: 3192250 - RNA, 15 nt, Mycobacterium bovis subsp bovis AF2122/97
cguggcgggggcuua

SEQ ID NO: 3192251 - RNA, 16 nt, Mycobacterium bovis subsp bovis AF2122/97
cguggcgguggccguc

SEQ ID NO: 3192252 - RNA, 16 nt, Mycobacterium bovis subsp bovis AF2122/97
cguggcgucggcguca

SEQ ID NO: 3192253 - RNA, 16 nt, Mycobacterium bovis subsp bovis AF2122/97
cguggcgucgguggca

SEQ ID NO: 3192254 - RNA, 19 nt, Mycobacterium bovis subsp bovis AF2122/97
cguggcgucgugcgcggcc

SEQ ID NO: 3192255 - RNA, 22 nt, Mycobacterium bovis subsp bovis AF2122/97
cguggcgucgugcgcggccggc

SEQ ID NO: 3192256 - RNA, 16 nt, Mycobacterium bovis subsp bovis AF2122/97
cguggcguugccgccu

SEQ ID NO: 3192257 - RNA, 19 nt, Mycobacterium bovis subsp bovis AF2122/97
cguggcucggcggguauau

SEQ ID NO: 3192258 - RNA, 15 nt, Mycobacterium bovis subsp bovis AF2122/97
cguggcugcgcucgc

SEQ ID NO: 3192259 - RNA, 23 nt, Mycobacterium bovis subsp bovis AF2122/97
cguggcuggcaugccggcgugcg

SEQ ID NO: 3192260 - RNA, 18 nt, Mycobacterium bovis subsp bovis AF2122/97
cguggcuucacccaaccc

SEQ ID NO: 3192261 - RNA, 23 nt, Mycobacterium bovis subsp bovis AF2122/97
cguggcuucacccaaccccgccg

SEQ ID NO: 3192262 - RNA, 16 nt, Mycobacterium bovis subsp bovis AF2122/97
cgugggaaccaccagc

SEQ ID NO: 3192263 - RNA, 23 nt, Mycobacterium bovis subsp bovis AF2122/97
cgugggagguggcgcggggccgc

SEQ ID NO: 3192264 - RNA, 14 nt, Mycobacterium bovis subsp bovis AF2122/97
cgugggcagcgcga

SEQ ID NO: 3192265 - RNA, 19 nt, Mycobacterium bovis subsp bovis AF2122/97
cgugggcagcgcgaucacc

SEQ ID NO: 3192266 - RNA, 20 nt, Mycobacterium bovis subsp bovis AF2122/97
cgugggcagcgcgaucaccg

SEQ ID NO: 3192267 - RNA, 18 nt, Mycobacterium bovis subsp bovis AF2122/97
cgugggcagcgcgcccga

SEQ ID NO: 3192268 - RNA, 23 nt, Mycobacterium bovis subsp bovis AF2122/97
cgugggcaugcggauucgcgcug

SEQ ID NO: 3192269 - RNA, 13 nt, Mycobacterium bovis subsp bovis AF2122/97
cgugggccacgau

SEQ ID NO: 3192270 - RNA, 22 nt, Mycobacterium bovis subsp bovis AF2122/97
cgugggccacuugaugcucgau

SEQ ID NO: 3192271 - RNA, 23 nt, Mycobacterium bovis subsp bovis AF2122/97
cgugggccacuugaugcucgaug

SEQ ID NO: 3192272 - RNA, 14 nt, Mycobacterium bovis subsp bovis AF2122/97
cgugggccugcccg

SEQ ID NO: 3192273 - RNA, 19 nt, Mycobacterium bovis subsp bovis AF2122/97
cgugggccuguugcugccc

SEQ ID NO: 3192274 - RNA, 15 nt, Mycobacterium bovis subsp bovis AF2122/97
cgugggcgacggcgg

SEQ ID NO: 3192275 - RNA, 15 nt, Mycobacterium bovis subsp bovis AF2122/97
cgugggcgcggcgcc

SEQ ID NO: 3192276 - RNA, 16 nt, Mycobacterium bovis subsp bovis AF2122/97
cgugggcgcggcgcca

SEQ ID NO: 3192277 - RNA, 20 nt, Mycobacterium bovis subsp bovis AF2122/97
cgugggcggaacgaugccgg

SEQ ID NO: 3192278 - RNA, 18 nt, Mycobacterium bovis subsp bovis AF2122/97
cguggggaccggcaggcc

SEQ ID NO: 3192279 - RNA, 22 nt, Mycobacterium bovis subsp bovis AF2122/97
cguggguccguuuuaccucggc

SEQ ID NO: 3192280 - RNA, 14 nt, Mycobacterium bovis subsp bovis AF2122/97
cgugggugccggcu

SEQ ID NO: 3192281 - RNA, 18 nt, Mycobacterium bovis subsp bovis AF2122/97
cgugggugucggcuagca

SEQ ID NO: 3192282 - RNA, 16 nt, Mycobacterium bovis subsp bovis AF2122/97
cgugggugucgguggc

SEQ ID NO: 3192283 - RNA, 17 nt, Mycobacterium bovis subsp bovis AF2122/97
cgugggugucgguggcc

SEQ ID NO: 3192284 - RNA, 23 nt, Mycobacterium bovis subsp bovis AF2122/97
cgugggugucgguggccgcggcg

SEQ ID NO: 3192285 - RNA, 20 nt, Mycobacterium bovis subsp bovis AF2122/97
cguggguucacguucggugg

SEQ ID NO: 3192286 - RNA, 22 nt, Mycobacterium bovis subsp bovis AF2122/97
cgugguaccgcuuguccaccgu

SEQ ID NO: 3192287 - RNA, 19 nt, Mycobacterium bovis subsp bovis AF2122/97
cgugguacuuucacgcucg

SEQ ID NO: 3192288 - RNA, 18 nt, Mycobacterium bovis subsp bovis AF2122/97
cgugguagacggccugcg

SEQ ID NO: 3192289 - RNA, 15 nt, Mycobacterium bovis subsp bovis AF2122/97
cgugguagccggcga

SEQ ID NO: 3192290 - RNA, 21 nt, Mycobacterium bovis subsp bovis AF2122/97
cguggucaccccuucgccagc

SEQ ID NO: 3192291 - RNA, 23 nt, Mycobacterium bovis subsp bovis AF2122/97
cguggucaccccuucgccagcgc

SEQ ID NO: 3192292 - RNA, 14 nt, Mycobacterium bovis subsp bovis AF2122/97
cguggucaguugug

SEQ ID NO: 3192293 - RNA, 22 nt, Mycobacterium bovis subsp bovis AF2122/97
cguggucaguugugcguugcgc

SEQ ID NO: 3192294 - RNA, 15 nt, Mycobacterium bovis subsp bovis AF2122/97
cgugguccaaccggg

SEQ ID NO: 3192295 - RNA, 17 nt, Mycobacterium bovis subsp bovis AF2122/97
cgugguccaaccgggcc

SEQ ID NO: 3192296 - RNA, 23 nt, Mycobacterium bovis subsp bovis AF2122/97
cguggucccucggggggaucucg

SEQ ID NO: 3192297 - RNA, 21 nt, Mycobacterium bovis subsp bovis AF2122/97
cgugguccuuguuguggugga

SEQ ID NO: 3192298 - RNA, 20 nt, Mycobacterium bovis subsp bovis AF2122/97
cguggucgacgugaucgcgg

SEQ ID NO: 3192299 - RNA, 13 nt, Mycobacterium bovis subsp bovis AF2122/97
cguggucgagcag

SEQ ID NO: 3192300 - RNA, 20 nt, Mycobacterium bovis subsp bovis AF2122/97
cguggucgagggcggcgucg

SEQ ID NO: 3192301 - RNA, 12 nt, Mycobacterium bovis subsp bovis AF2122/97
cguggucgcccc

SEQ ID NO: 3192302 - RNA, 14 nt, Mycobacterium bovis subsp bovis AF2122/97
cguggucgccccga

SEQ ID NO: 3192303 - RNA, 18 nt, Mycobacterium bovis subsp bovis AF2122/97
cguggucgcgcggcaccg

SEQ ID NO: 3192304 - RNA, 13 nt, Mycobacterium bovis subsp bovis AF2122/97
cguggucggagcg

SEQ ID NO: 3192305 - RNA, 15 nt, Mycobacterium bovis subsp bovis AF2122/97
cguggucggagcggg

SEQ ID NO: 3192306 - RNA, 22 nt, Mycobacterium bovis subsp bovis AF2122/97
cguggucggagcgggugcgggc

SEQ ID NO: 3192307 - RNA, 13 nt, Mycobacterium bovis subsp bovis AF2122/97
cguggucggccac

SEQ ID NO: 3192308 - RNA, 14 nt, Mycobacterium bovis subsp bovis AF2122/97
cguggucggccacc

SEQ ID NO: 3192309 - RNA, 16 nt, Mycobacterium bovis subsp bovis AF2122/97
cguggucggccacccc

SEQ ID NO: 3192310 - RNA, 14 nt, Mycobacterium bovis subsp bovis AF2122/97
cguggucggccucg

SEQ ID NO: 3192311 - RNA, 15 nt, Mycobacterium bovis subsp bovis AF2122/97
cguggucggcgaccc

SEQ ID NO: 3192312 - RNA, 19 nt, Mycobacterium bovis subsp bovis AF2122/97
cguggucgggaaaugucgc

SEQ ID NO: 3192313 - RNA, 18 nt, Mycobacterium bovis subsp bovis AF2122/97
cguggucucggucagccc

SEQ ID NO: 3192314 - RNA, 21 nt, Mycobacterium bovis subsp bovis AF2122/97
cguggucucggucagccccau

SEQ ID NO: 3192315 - RNA, 14 nt, Mycobacterium bovis subsp bovis AF2122/97
cguggugcggccgg

SEQ ID NO: 3192316 - RNA, 17 nt, Mycobacterium bovis subsp bovis AF2122/97
cguggugcugaccgcgc

SEQ ID NO: 3192317 - RNA, 13 nt, Mycobacterium bovis subsp bovis AF2122/97
cgugguggacgac

SEQ ID NO: 3192318 - RNA, 18 nt, Mycobacterium bovis subsp bovis AF2122/97
cgugguggacgaccgcgc

SEQ ID NO: 3192319 - RNA, 19 nt, Mycobacterium bovis subsp bovis AF2122/97
cgugguggacgaccgcgcg

SEQ ID NO: 3192320 - RNA, 22 nt, Mycobacterium bovis subsp bovis AF2122/97
cgugguggacgaccgcgcggca

SEQ ID NO: 3192321 - RNA, 17 nt, Mycobacterium bovis subsp bovis AF2122/97
cgugguggaugagccgg

SEQ ID NO: 3192322 - RNA, 22 nt, Mycobacterium bovis subsp bovis AF2122/97
cgugguggcauaaccgcugaua

SEQ ID NO: 3192323 - RNA, 15 nt, Mycobacterium bovis subsp bovis AF2122/97
cgugguggccacgga

SEQ ID NO: 3192324 - RNA, 17 nt, Mycobacterium bovis subsp bovis AF2122/97
cgugguggcguaucggg

SEQ ID NO: 3192325 - RNA, 19 nt, Mycobacterium bovis subsp bovis AF2122/97
cguggugggcgcagaguca

SEQ ID NO: 3192326 - RNA, 14 nt, Mycobacterium bovis subsp bovis AF2122/97
cgugguguacccgc

SEQ ID NO: 3192327 - RNA, 16 nt, Mycobacterium bovis subsp bovis AF2122/97
cgugguguaucgacgg

SEQ ID NO: 3192328 - RNA, 19 nt, Mycobacterium bovis subsp bovis AF2122/97
cgugguguaucgacggcgg

SEQ ID NO: 3192329 - RNA, 22 nt, Mycobacterium bovis subsp bovis AF2122/97
cgugguguaucgacggcggccu

SEQ ID NO: 3192330 - RNA, 16 nt, Mycobacterium bovis subsp bovis AF2122/97
cgugguguccaccgca

SEQ ID NO: 3192331 - RNA, 12 nt, Mycobacterium bovis subsp bovis AF2122/97
cgugguuccggc

SEQ ID NO: 3192332 - RNA, 20 nt, Mycobacterium bovis subsp bovis AF2122/97
cgugguuccggcgugcagca

SEQ ID NO: 3192333 - RNA, 16 nt, Mycobacterium bovis subsp bovis AF2122/97
cgugguucggcgucga

SEQ ID NO: 3192334 - RNA, 19 nt, Mycobacterium bovis subsp bovis AF2122/97
cgugguugcacguucggcg

SEQ ID NO: 3192335 - RNA, 19 nt, Mycobacterium bovis subsp bovis AF2122/97
cgugguugccgaagccgga

SEQ ID NO: 3192336 - RNA, 17 nt, Mycobacterium bovis subsp bovis AF2122/97
cgugguuuugucgacgu

SEQ ID NO: 3192337 - RNA, 20 nt, Mycobacterium bovis subsp bovis AF2122/97
cgugguuuugucgacguucg

SEQ ID NO: 3192338 - RNA, 15 nt, Mycobacterium bovis subsp bovis AF2122/97
cguguaaccccaggc

SEQ ID NO: 3192339 - RNA, 17 nt, Mycobacterium bovis subsp bovis AF2122/97
cguguaaccccaggcgc

SEQ ID NO: 3192340 - RNA, 15 nt, Mycobacterium bovis subsp bovis AF2122/97
cguguaacgccgacu

SEQ ID NO: 3192341 - RNA, 17 nt, Mycobacterium bovis subsp bovis AF2122/97
cguguacauugccgacc

SEQ ID NO: 3192342 - RNA, 20 nt, Mycobacterium bovis subsp bovis AF2122/97
cguguacauugccgacccgu

SEQ ID NO: 3192343 - RNA, 15 nt, Mycobacterium bovis subsp bovis AF2122/97
cguguaccuccucga

SEQ ID NO: 3192344 - RNA, 16 nt, Mycobacterium bovis subsp bovis AF2122/97
cguguacgugcucgua

SEQ ID NO: 3192345 - RNA, 14 nt, Mycobacterium bovis subsp bovis AF2122/97
cguguacugcuccu

SEQ ID NO: 3192346 - RNA, 16 nt, Mycobacterium bovis subsp bovis AF2122/97
cguguagccugcggcg

SEQ ID NO: 3192347 - RNA, 21 nt, Mycobacterium bovis subsp bovis AF2122/97
cguguagccugcggcggucau

SEQ ID NO: 3192348 - RNA, 16 nt, Mycobacterium bovis subsp bovis AF2122/97
cguguagcugcggguc

SEQ ID NO: 3192349 - RNA, 20 nt, Mycobacterium bovis subsp bovis AF2122/97
cguguaguggcccgcgggca

SEQ ID NO: 3192350 - RNA, 20 nt, Mycobacterium bovis subsp bovis AF2122/97
cgugucacccaauggagccg

SEQ ID NO: 3192351 - RNA, 23 nt, Mycobacterium bovis subsp bovis AF2122/97
cgugucacccaauggagccgcga

SEQ ID NO: 3192352 - RNA, 15 nt, Mycobacterium bovis subsp bovis AF2122/97
cgugucacgcgacca

SEQ ID NO: 3192353 - RNA, 22 nt, Mycobacterium bovis subsp bovis AF2122/97
cgugucaugcucaccgaggaac

SEQ ID NO: 3192354 - RNA, 19 nt, Mycobacterium bovis subsp bovis AF2122/97
cgugucccaacgccacugc

SEQ ID NO: 3192355 - RNA, 23 nt, Mycobacterium bovis subsp bovis AF2122/97
cguguccccccagauccgcagcg

SEQ ID NO: 3192356 - RNA, 13 nt, Mycobacterium bovis subsp bovis AF2122/97
cguguccgccgga

SEQ ID NO: 3192357 - RNA, 23 nt, Mycobacterium bovis subsp bovis AF2122/97
cguguccgccggauagcaccggc

SEQ ID NO: 3192358 - RNA, 21 nt, Mycobacterium bovis subsp bovis AF2122/97
cguguccggggaccucggcga

SEQ ID NO: 3192359 - RNA, 18 nt, Mycobacterium bovis subsp bovis AF2122/97
cguguccuuugccaccuc

SEQ ID NO: 3192360 - RNA, 22 nt, Mycobacterium bovis subsp bovis AF2122/97
cguguccuuugccaccucggcg

SEQ ID NO: 3192361 - RNA, 14 nt, Mycobacterium bovis subsp bovis AF2122/97
cgugucgacuccga

SEQ ID NO: 3192362 - RNA, 18 nt, Mycobacterium bovis subsp bovis AF2122/97
cgugucgccacaccgggg

SEQ ID NO: 3192363 - RNA, 13 nt, Mycobacterium bovis subsp bovis AF2122/97
cgugucgccgcca

SEQ ID NO: 3192364 - RNA, 17 nt, Mycobacterium bovis subsp bovis AF2122/97
cgugucgccgccaccag

SEQ ID NO: 3192365 - RNA, 18 nt, Mycobacterium bovis subsp bovis AF2122/97
cgugucgccgccaccagc

SEQ ID NO: 3192366 - RNA, 22 nt, Mycobacterium bovis subsp bovis AF2122/97
cgugucgccgccaccagcgcac

SEQ ID NO: 3192367 - RNA, 13 nt, Mycobacterium bovis subsp bovis AF2122/97
cgugucgccgccg

SEQ ID NO: 3192368 - RNA, 14 nt, Mycobacterium bovis subsp bovis AF2122/97
cgugucgccgccgu

SEQ ID NO: 3192369 - RNA, 16 nt, Mycobacterium bovis subsp bovis AF2122/97
cgugucgccgccguug

SEQ ID NO: 3192370 - RNA, 20 nt, Mycobacterium bovis subsp bovis AF2122/97
cgugucgccgccguugccgc

SEQ ID NO: 3192371 - RNA, 19 nt, Mycobacterium bovis subsp bovis AF2122/97
cgugucgccggcgaaguug

SEQ ID NO: 3192372 - RNA, 15 nt, Mycobacterium bovis subsp bovis AF2122/97
cgugucgccucgaug

SEQ ID NO: 3192373 - RNA, 23 nt, Mycobacterium bovis subsp bovis AF2122/97
cgugucgcgucgcaggauuccca

SEQ ID NO: 3192374 - RNA, 14 nt, Mycobacterium bovis subsp bovis AF2122/97
cgugucgcugcggc

SEQ ID NO: 3192375 - RNA, 23 nt, Mycobacterium bovis subsp bovis AF2122/97
cgugucggacaaggacugaccgu

SEQ ID NO: 3192376 - RNA, 14 nt, Mycobacterium bovis subsp bovis AF2122/97
cgugucggccggcc

SEQ ID NO: 3192377 - RNA, 19 nt, Mycobacterium bovis subsp bovis AF2122/97
cgugucggcggugccgacg

SEQ ID NO: 3192378 - RNA, 22 nt, Mycobacterium bovis subsp bovis AF2122/97
cgugucgggaacgaguacgggc

SEQ ID NO: 3192379 - RNA, 14 nt, Mycobacterium bovis subsp bovis AF2122/97
cgugucgggcgcga

SEQ ID NO: 3192380 - RNA, 15 nt, Mycobacterium bovis subsp bovis AF2122/97
cgugucggugcgcgc

SEQ ID NO: 3192381 - RNA, 17 nt, Mycobacterium bovis subsp bovis AF2122/97
cgugucggugcgcgcag

SEQ ID NO: 3192382 - RNA, 15 nt, Mycobacterium bovis subsp bovis AF2122/97
cgugucguugccagg

SEQ ID NO: 3192383 - RNA, 21 nt, Mycobacterium bovis subsp bovis AF2122/97
cgugucguugccagggcgggc

SEQ ID NO: 3192384 - RNA, 22 nt, Mycobacterium bovis subsp bovis AF2122/97
cgugucguugccagggcgggcg

SEQ ID NO: 3192385 - RNA, 14 nt, Mycobacterium bovis subsp bovis AF2122/97
cgugucuccuuguc

SEQ ID NO: 3192386 - RNA, 17 nt, Mycobacterium bovis subsp bovis AF2122/97
cgugucugggaccccgc

SEQ ID NO: 3192387 - RNA, 24 nt, Mycobacterium bovis subsp bovis AF2122/97
cgugucugggaccccgcugcgacg

SEQ ID NO: 3192388 - RNA, 22 nt, Mycobacterium bovis subsp bovis AF2122/97
cgugucuguacaacgacacgcc

SEQ ID NO: 3192389 - RNA, 18 nt, Mycobacterium bovis subsp bovis AF2122/97
cgugucuugucgcgcagc

SEQ ID NO: 3192390 - RNA, 19 nt, Mycobacterium bovis subsp bovis AF2122/97
cgugucuugucgcgcagca

SEQ ID NO: 3192391 - RNA, 23 nt, Mycobacterium bovis subsp bovis AF2122/97
cgugucuugucgcgcagcaucuc

SEQ ID NO: 3192392 - RNA, 21 nt, Mycobacterium bovis subsp bovis AF2122/97
cgugugaggccuucgccgacu

SEQ ID NO: 3192393 - RNA, 15 nt, Mycobacterium bovis subsp bovis AF2122/97
cgugugagggccggg

SEQ ID NO: 3192394 - RNA, 16 nt, Mycobacterium bovis subsp bovis AF2122/97
cgugugcaccaucauc

SEQ ID NO: 3192395 - RNA, 22 nt, Mycobacterium bovis subsp bovis AF2122/97
cgugugcaccaucaucaccucu

SEQ ID NO: 3192396 - RNA, 18 nt, Mycobacterium bovis subsp bovis AF2122/97
cgugugcaucggcgaccg

SEQ ID NO: 3192397 - RNA, 16 nt, Mycobacterium bovis subsp bovis AF2122/97
cgugugccacggggca

SEQ ID NO: 3192398 - RNA, 20 nt, Mycobacterium bovis subsp bovis AF2122/97
cgugugcucuugcgccacgg

SEQ ID NO: 3192399 - RNA, 21 nt, Mycobacterium bovis subsp bovis AF2122/97
cgugugcucuugcgccacggc

SEQ ID NO: 3192400 - RNA, 14 nt, Mycobacterium bovis subsp bovis AF2122/97
cguguggagcucgc

SEQ ID NO: 3192401 - RNA, 20 nt, Mycobacterium bovis subsp bovis AF2122/97
cguguggagcucgcggcgca

SEQ ID NO: 3192402 - RNA, 14 nt, Mycobacterium bovis subsp bovis AF2122/97
cguguggccguugg

SEQ ID NO: 3192403 - RNA, 19 nt, Mycobacterium bovis subsp bovis AF2122/97
cguguggugugucaccgga

SEQ ID NO: 3192404 - RNA, 22 nt, Mycobacterium bovis subsp bovis AF2122/97
cgugugugcgauccagggccga

SEQ ID NO: 3192405 - RNA, 19 nt, Mycobacterium bovis subsp bovis AF2122/97
cgugugugcgccuccggga

SEQ ID NO: 3192406 - RNA, 17 nt, Mycobacterium bovis subsp bovis AF2122/97
cguguguuaggcccgca

SEQ ID NO: 3192407 - RNA, 14 nt, Mycobacterium bovis subsp bovis AF2122/97
cguguucgaccgca

SEQ ID NO: 3192408 - RNA, 20 nt, Mycobacterium bovis subsp bovis AF2122/97
cguguucgccacacccgugu

SEQ ID NO: 3192409 - RNA, 17 nt, Mycobacterium bovis subsp bovis AF2122/97
cguguucugaucggugg

SEQ ID NO: 3192410 - RNA, 12 nt, Mycobacterium bovis subsp bovis AF2122/97
cguguugaagaa

SEQ ID NO: 3192411 - RNA, 14 nt, Mycobacterium bovis subsp bovis AF2122/97
cguguugaagaagc

SEQ ID NO: 3192412 - RNA, 14 nt, Mycobacterium bovis subsp bovis AF2122/97
cguguugaccgggu

SEQ ID NO: 3192413 - RNA, 16 nt, Mycobacterium bovis subsp bovis AF2122/97
cguguugaccgggucg

SEQ ID NO: 3192414 - RNA, 23 nt, Mycobacterium bovis subsp bovis AF2122/97
cguguugcacgcgggugccgacg

SEQ ID NO: 3192415 - RNA, 15 nt, Mycobacterium bovis subsp bovis AF2122/97
cguguuggccggguc

SEQ ID NO: 3192416 - RNA, 17 nt, Mycobacterium bovis subsp bovis AF2122/97
cguguuguugaagcccg

SEQ ID NO: 3192417 - RNA, 20 nt, Mycobacterium bovis subsp bovis AF2122/97
cguuaacugcgccuaacccc

SEQ ID NO: 3192418 - RNA, 21 nt, Mycobacterium bovis subsp bovis AF2122/97
cguuaaucaaggugaucagca

SEQ ID NO: 3192419 - RNA, 20 nt, Mycobacterium bovis subsp bovis AF2122/97
cguuaccaccgucaccgccg

SEQ ID NO: 3192420 - RNA, 23 nt, Mycobacterium bovis subsp bovis AF2122/97
cguuaccaccgucaccgccggca

SEQ ID NO: 3192421 - RNA, 14 nt, Mycobacterium bovis subsp bovis AF2122/97
cguuaccccaccgg

SEQ ID NO: 3192422 - RNA, 17 nt, Mycobacterium bovis subsp bovis AF2122/97
cguuaccgacgccggug

SEQ ID NO: 3192423 - RNA, 12 nt, Mycobacterium bovis subsp bovis AF2122/97
cguuaccgagcc

SEQ ID NO: 3192424 - RNA, 15 nt, Mycobacterium bovis subsp bovis AF2122/97
cguuaccgccggcgc

SEQ ID NO: 3192425 - RNA, 16 nt, Mycobacterium bovis subsp bovis AF2122/97
cguuaccgccggcgcc

SEQ ID NO: 3192426 - RNA, 19 nt, Mycobacterium bovis subsp bovis AF2122/97
cguuaccgccggcgccggu

SEQ ID NO: 3192427 - RNA, 12 nt, Mycobacterium bovis subsp bovis AF2122/97
cguuaccgccgu

SEQ ID NO: 3192428 - RNA, 18 nt, Mycobacterium bovis subsp bovis AF2122/97
cguuacgcucgcgggcca

SEQ ID NO: 3192429 - RNA, 15 nt, Mycobacterium bovis subsp bovis AF2122/97
cguuacgcucggcga

SEQ ID NO: 3192430 - RNA, 20 nt, Mycobacterium bovis subsp bovis AF2122/97
cguuacggagggcacgggua

SEQ ID NO: 3192431 - RNA, 18 nt, Mycobacterium bovis subsp bovis AF2122/97
cguuagcauugaguucgg

SEQ ID NO: 3192432 - RNA, 23 nt, Mycobacterium bovis subsp bovis AF2122/97
cguuagccaggucggugggcggc

SEQ ID NO: 3192433 - RNA, 17 nt, Mycobacterium bovis subsp bovis AF2122/97
cguuagcuuagcugccg

SEQ ID NO: 3192434 - RNA, 21 nt, Mycobacterium bovis subsp bovis AF2122/97
cguuagcuuagcugccgucgg

SEQ ID NO: 3192435 - RNA, 14 nt, Mycobacterium bovis subsp bovis AF2122/97
cguuaggucacucc

SEQ ID NO: 3192436 - RNA, 18 nt, Mycobacterium bovis subsp bovis AF2122/97
cguuaucgacaccaccau

SEQ ID NO: 3192437 - RNA, 18 nt, Mycobacterium bovis subsp bovis AF2122/97
cguuaucgaccgccgcga

SEQ ID NO: 3192438 - RNA, 16 nt, Mycobacterium bovis subsp bovis AF2122/97
cguuaugaccucgacg

SEQ ID NO: 3192439 - RNA, 22 nt, Mycobacterium bovis subsp bovis AF2122/97
cguucaacaugaguggcaaucc

SEQ ID NO: 3192440 - RNA, 18 nt, Mycobacterium bovis subsp bovis AF2122/97
cguucaacgacggcaagc

SEQ ID NO: 3192441 - RNA, 18 nt, Mycobacterium bovis subsp bovis AF2122/97
cguucaaggucuccagac

SEQ ID NO: 3192442 - RNA, 14 nt, Mycobacterium bovis subsp bovis AF2122/97
cguucaccgcgcgc

SEQ ID NO: 3192443 - RNA, 15 nt, Mycobacterium bovis subsp bovis AF2122/97
cguucaccgcgcgcu

SEQ ID NO: 3192444 - RNA, 16 nt, Mycobacterium bovis subsp bovis AF2122/97
cguucaccugcgucgg

SEQ ID NO: 3192445 - RNA, 18 nt, Mycobacterium bovis subsp bovis AF2122/97
cguucacgcgcggaucgg

SEQ ID NO: 3192446 - RNA, 14 nt, Mycobacterium bovis subsp bovis AF2122/97
cguucacuggucuc

SEQ ID NO: 3192447 - RNA, 14 nt, Mycobacterium bovis subsp bovis AF2122/97
cguucagccaggcg

SEQ ID NO: 3192448 - RNA, 13 nt, Mycobacterium bovis subsp bovis AF2122/97
cguucagcgacca

SEQ ID NO: 3192449 - RNA, 13 nt, Mycobacterium bovis subsp bovis AF2122/97
cguucagcgacgg

SEQ ID NO: 3192450 - RNA, 13 nt, Mycobacterium bovis subsp bovis AF2122/97
cguucagcgccag

SEQ ID NO: 3192451 - RNA, 15 nt, Mycobacterium bovis subsp bovis AF2122/97
cguucagcgccagcg

SEQ ID NO: 3192452 - RNA, 14 nt, Mycobacterium bovis subsp bovis AF2122/97
cguucagcgucgac

SEQ ID NO: 3192453 - RNA, 21 nt, Mycobacterium bovis subsp bovis AF2122/97
cguucagguguugacgccaac

SEQ ID NO: 3192454 - RNA, 18 nt, Mycobacterium bovis subsp bovis AF2122/97
cguucaucauccacaccg

SEQ ID NO: 3192455 - RNA, 18 nt, Mycobacterium bovis subsp bovis AF2122/97
cguucaugaucggcagaa

SEQ ID NO: 3192456 - RNA, 21 nt, Mycobacterium bovis subsp bovis AF2122/97
cguucaugaucggcagaaucc

SEQ ID NO: 3192457 - RNA, 16 nt, Mycobacterium bovis subsp bovis AF2122/97
cguucaugcggcggcg

SEQ ID NO: 3192458 - RNA, 14 nt, Mycobacterium bovis subsp bovis AF2122/97
cguuccacacagau

SEQ ID NO: 3192459 - RNA, 15 nt, Mycobacterium bovis subsp bovis AF2122/97
cguuccacgccggca

SEQ ID NO: 3192460 - RNA, 17 nt, Mycobacterium bovis subsp bovis AF2122/97
cguuccacgccggcauc

SEQ ID NO: 3192461 - RNA, 21 nt, Mycobacterium bovis subsp bovis AF2122/97
cguuccacgucguacucgguc

SEQ ID NO: 3192462 - RNA, 23 nt, Mycobacterium bovis subsp bovis AF2122/97
cguuccagcaguacaccgcccgg

SEQ ID NO: 3192463 - RNA, 23 nt, Mycobacterium bovis subsp bovis AF2122/97
cguuccagcaucggugcgggcgc

SEQ ID NO: 3192464 - RNA, 19 nt, Mycobacterium bovis subsp bovis AF2122/97
cguuccagggucacggucg

SEQ ID NO: 3192465 - RNA, 22 nt, Mycobacterium bovis subsp bovis AF2122/97
cguuccaucagggccuuggcgg

SEQ ID NO: 3192466 - RNA, 21 nt, Mycobacterium bovis subsp bovis AF2122/97
cguucccacccacgccgacua

SEQ ID NO: 3192467 - RNA, 17 nt, Mycobacterium bovis subsp bovis AF2122/97
cguucccccggcaccgc

SEQ ID NO: 3192468 - RNA, 22 nt, Mycobacterium bovis subsp bovis AF2122/97
cguucccgccauugccgccguc

SEQ ID NO: 3192469 - RNA, 15 nt, Mycobacterium bovis subsp bovis AF2122/97
cguucccgccggcgc

SEQ ID NO: 3192470 - RNA, 16 nt, Mycobacterium bovis subsp bovis AF2122/97
cguucccgccggcgcc

SEQ ID NO: 3192471 - RNA, 15 nt, Mycobacterium bovis subsp bovis AF2122/97
cguuccgccgccucg

SEQ ID NO: 3192472 - RNA, 14 nt, Mycobacterium bovis subsp bovis AF2122/97
cguuccgcuggacg

SEQ ID NO: 3192473 - RNA, 16 nt, Mycobacterium bovis subsp bovis AF2122/97
cguuccgggccgauca

SEQ ID NO: 3192474 - RNA, 16 nt, Mycobacterium bovis subsp bovis AF2122/97
cguuccguugugcgcc

SEQ ID NO: 3192475 - RNA, 15 nt, Mycobacterium bovis subsp bovis AF2122/97
cguuccuccagcagc

SEQ ID NO: 3192476 - RNA, 14 nt, Mycobacterium bovis subsp bovis AF2122/97
cguucgacccagcg

SEQ ID NO: 3192477 - RNA, 16 nt, Mycobacterium bovis subsp bovis AF2122/97
cguucgaccguguaac

SEQ ID NO: 3192478 - RNA, 22 nt, Mycobacterium bovis subsp bovis AF2122/97
cguucgacucgaccgcgacggc

SEQ ID NO: 3192479 - RNA, 16 nt, Mycobacterium bovis subsp bovis AF2122/97
cguucgagagccccga

SEQ ID NO: 3192480 - RNA, 18 nt, Mycobacterium bovis subsp bovis AF2122/97
cguucgagagccccgacc

SEQ ID NO: 3192481 - RNA, 21 nt, Mycobacterium bovis subsp bovis AF2122/97
cguucgagagccccgaccagc

SEQ ID NO: 3192482 - RNA, 23 nt, Mycobacterium bovis subsp bovis AF2122/97
cguucgagagccccgaccagcag

SEQ ID NO: 3192483 - RNA, 13 nt, Mycobacterium bovis subsp bovis AF2122/97
cguucgccaggcc

SEQ ID NO: 3192484 - RNA, 15 nt, Mycobacterium bovis subsp bovis AF2122/97
cguucgcccgcccgu

SEQ ID NO: 3192485 - RNA, 17 nt, Mycobacterium bovis subsp bovis AF2122/97
cguucgccgaguauugg

SEQ ID NO: 3192486 - RNA, 12 nt, Mycobacterium bovis subsp bovis AF2122/97
cguucgccgccc

SEQ ID NO: 3192487 - RNA, 14 nt, Mycobacterium bovis subsp bovis AF2122/97
cguucgccgcccgg

SEQ ID NO: 3192488 - RNA, 14 nt, Mycobacterium bovis subsp bovis AF2122/97
cguucgccgucggu

SEQ ID NO: 3192489 - RNA, 22 nt, Mycobacterium bovis subsp bovis AF2122/97
cguucgcgggcgucccgcauac

SEQ ID NO: 3192490 - RNA, 22 nt, Mycobacterium bovis subsp bovis AF2122/97
cguucgcgggugcgcugcagcg

SEQ ID NO: 3192491 - RNA, 16 nt, Mycobacterium bovis subsp bovis AF2122/97
cguucgcgucacacca

SEQ ID NO: 3192492 - RNA, 18 nt, Mycobacterium bovis subsp bovis AF2122/97
cguucgcgucacaccagc

SEQ ID NO: 3192493 - RNA, 17 nt, Mycobacterium bovis subsp bovis AF2122/97
cguucgcgugccagcgc

SEQ ID NO: 3192494 - RNA, 18 nt, Mycobacterium bovis subsp bovis AF2122/97
cguucgcugguccuuguc

SEQ ID NO: 3192495 - RNA, 23 nt, Mycobacterium bovis subsp bovis AF2122/97
cguucggaugucccuugacggug

SEQ ID NO: 3192496 - RNA, 14 nt, Mycobacterium bovis subsp bovis AF2122/97
cguucggcacaacc

SEQ ID NO: 3192497 - RNA, 18 nt, Mycobacterium bovis subsp bovis AF2122/97
cguucggcacaaccaacg

SEQ ID NO: 3192498 - RNA, 16 nt, Mycobacterium bovis subsp bovis AF2122/97
cguucggcaccugguu

SEQ ID NO: 3192499 - RNA, 14 nt, Mycobacterium bovis subsp bovis AF2122/97
cguucggccgacuc

SEQ ID NO: 3192500 - RNA, 19 nt, Mycobacterium bovis subsp bovis AF2122/97
cguucggcgacgcgccggu

SEQ ID NO: 3192501 - RNA, 14 nt, Mycobacterium bovis subsp bovis AF2122/97
cguucggcgagcag

SEQ ID NO: 3192502 - RNA, 16 nt, Mycobacterium bovis subsp bovis AF2122/97
cguucggcgagcagcg

SEQ ID NO: 3192503 - RNA, 13 nt, Mycobacterium bovis subsp bovis AF2122/97
cguucggcgcaca

SEQ ID NO: 3192504 - RNA, 14 nt, Mycobacterium bovis subsp bovis AF2122/97
cguucggcgcacag

SEQ ID NO: 3192505 - RNA, 13 nt, Mycobacterium bovis subsp bovis AF2122/97
cguucggcgcccg

SEQ ID NO: 3192506 - RNA, 15 nt, Mycobacterium bovis subsp bovis AF2122/97
cguucggcgcccgcu

SEQ ID NO: 3192507 - RNA, 11 nt, Mycobacterium bovis subsp bovis AF2122/97
cguucggcgcu

SEQ ID NO: 3192508 - RNA, 15 nt, Mycobacterium bovis subsp bovis AF2122/97
cguucggcgucguug

SEQ ID NO: 3192509 - RNA, 12 nt, Mycobacterium bovis subsp bovis AF2122/97
cguucgggcccg

SEQ ID NO: 3192510 - RNA, 20 nt, Mycobacterium bovis subsp bovis AF2122/97
cguucggggccccgcggcgc

SEQ ID NO: 3192511 - RNA, 23 nt, Mycobacterium bovis subsp bovis AF2122/97
cguucggggccccgcggcgccgc

SEQ ID NO: 3192512 - RNA, 14 nt, Mycobacterium bovis subsp bovis AF2122/97
cguucgucgcgggu

SEQ ID NO: 3192513 - RNA, 17 nt, Mycobacterium bovis subsp bovis AF2122/97
cguucgucggucccagg

SEQ ID NO: 3192514 - RNA, 18 nt, Mycobacterium bovis subsp bovis AF2122/97
cguucgucguaguccagg

SEQ ID NO: 3192515 - RNA, 16 nt, Mycobacterium bovis subsp bovis AF2122/97
cguucgugagcggcca

SEQ ID NO: 3192516 - RNA, 17 nt, Mycobacterium bovis subsp bovis AF2122/97
cguucgugagcggccag

SEQ ID NO: 3192517 - RNA, 18 nt, Mycobacterium bovis subsp bovis AF2122/97
cguucgugagcggccagg

SEQ ID NO: 3192518 - RNA, 15 nt, Mycobacterium bovis subsp bovis AF2122/97
cguucgugcagccca

SEQ ID NO: 3192519 - RNA, 13 nt, Mycobacterium bovis subsp bovis AF2122/97
cguucuccggcac

SEQ ID NO: 3192520 - RNA, 24 nt, Mycobacterium bovis subsp bovis AF2122/97
cguucucggugaaguggcgcacca

SEQ ID NO: 3192521 - RNA, 20 nt, Mycobacterium bovis subsp bovis AF2122/97
cguucugacggcuugcguga

SEQ ID NO: 3192522 - RNA, 16 nt, Mycobacterium bovis subsp bovis AF2122/97
cguucugcaccagcuc

SEQ ID NO: 3192523 - RNA, 17 nt, Mycobacterium bovis subsp bovis AF2122/97
cguucuggaaccccgag

SEQ ID NO: 3192524 - RNA, 19 nt, Mycobacterium bovis subsp bovis AF2122/97
cguucugucccggcgcgcc

SEQ ID NO: 3192525 - RNA, 16 nt, Mycobacterium bovis subsp bovis AF2122/97
cguucuucagccaggg

SEQ ID NO: 3192526 - RNA, 22 nt, Mycobacterium bovis subsp bovis AF2122/97
cguugaacgcacucaucgccgg

SEQ ID NO: 3192527 - RNA, 15 nt, Mycobacterium bovis subsp bovis AF2122/97
cguugaacgcgugcu

SEQ ID NO: 3192528 - RNA, 18 nt, Mycobacterium bovis subsp bovis AF2122/97
cguugaacggcaccagcg

SEQ ID NO: 3192529 - RNA, 17 nt, Mycobacterium bovis subsp bovis AF2122/97
cguugaacugugcggca

SEQ ID NO: 3192530 - RNA, 20 nt, Mycobacterium bovis subsp bovis AF2122/97
cguugaacugugcggcagcc

SEQ ID NO: 3192531 - RNA, 18 nt, Mycobacterium bovis subsp bovis AF2122/97
cguugaagaauccggccc

SEQ ID NO: 3192532 - RNA, 15 nt, Mycobacterium bovis subsp bovis AF2122/97
cguugaagacggcca

SEQ ID NO: 3192533 - RNA, 19 nt, Mycobacterium bovis subsp bovis AF2122/97
cguugaagacggccaccgg

SEQ ID NO: 3192534 - RNA, 16 nt, Mycobacterium bovis subsp bovis AF2122/97
cguugaagcccaacag

SEQ ID NO: 3192535 - RNA, 18 nt, Mycobacterium bovis subsp bovis AF2122/97
cguugaagucgccgguga

SEQ ID NO: 3192536 - RNA, 23 nt, Mycobacterium bovis subsp bovis AF2122/97
cguugaccagaaccuggagccgu

SEQ ID NO: 3192537 - RNA, 19 nt, Mycobacterium bovis subsp bovis AF2122/97
cguugaccagcacgacugc

SEQ ID NO: 3192538 - RNA, 20 nt, Mycobacterium bovis subsp bovis AF2122/97
cguugaccagcacgacugca

SEQ ID NO: 3192539 - RNA, 21 nt, Mycobacterium bovis subsp bovis AF2122/97
cguugacccaucucgucgucg

SEQ ID NO: 3192540 - RNA, 13 nt, Mycobacterium bovis subsp bovis AF2122/97
cguugacccggcg

SEQ ID NO: 3192541 - RNA, 14 nt, Mycobacterium bovis subsp bovis AF2122/97
cguugaccgcaucg

SEQ ID NO: 3192542 - RNA, 22 nt, Mycobacterium bovis subsp bovis AF2122/97
cguugaccgcaucgucgagcca

SEQ ID NO: 3192543 - RNA, 17 nt, Mycobacterium bovis subsp bovis AF2122/97
cguugaccgcggucugc

SEQ ID NO: 3192544 - RNA, 20 nt, Mycobacterium bovis subsp bovis AF2122/97
cguugaccgcggucugcgcg

SEQ ID NO: 3192545 - RNA, 22 nt, Mycobacterium bovis subsp bovis AF2122/97
cguugaccgcgugagcagacgc

SEQ ID NO: 3192546 - RNA, 18 nt, Mycobacterium bovis subsp bovis AF2122/97
cguugaccgggucgccga

SEQ ID NO: 3192547 - RNA, 14 nt, Mycobacterium bovis subsp bovis AF2122/97
cguugaccucuucg

SEQ ID NO: 3192548 - RNA, 17 nt, Mycobacterium bovis subsp bovis AF2122/97
cguugaccucuucgggc

SEQ ID NO: 3192549 - RNA, 18 nt, Mycobacterium bovis subsp bovis AF2122/97
cguugacggcuucggcag

SEQ ID NO: 3192550 - RNA, 20 nt, Mycobacterium bovis subsp bovis AF2122/97
cguugacggcuucggcagcc

SEQ ID NO: 3192551 - RNA, 22 nt, Mycobacterium bovis subsp bovis AF2122/97
cguugacggcuucggcagccgc

SEQ ID NO: 3192552 - RNA, 22 nt, Mycobacterium bovis subsp bovis AF2122/97
cguugacggugucuugccacca

SEQ ID NO: 3192553 - RNA, 20 nt, Mycobacterium bovis subsp bovis AF2122/97
cguugacgguugccccggcg

SEQ ID NO: 3192554 - RNA, 15 nt, Mycobacterium bovis subsp bovis AF2122/97
cguugacguccaaca

SEQ ID NO: 3192555 - RNA, 17 nt, Mycobacterium bovis subsp bovis AF2122/97
cguugacguccaacagc

SEQ ID NO: 3192556 - RNA, 13 nt, Mycobacterium bovis subsp bovis AF2122/97
cguugacgucgag

SEQ ID NO: 3192557 - RNA, 20 nt, Mycobacterium bovis subsp bovis AF2122/97
cguugagauaccccgagacc

SEQ ID NO: 3192558 - RNA, 14 nt, Mycobacterium bovis subsp bovis AF2122/97
cguugagcagcacc

SEQ ID NO: 3192559 - RNA, 15 nt, Mycobacterium bovis subsp bovis AF2122/97
cguugagcagcaccc

SEQ ID NO: 3192560 - RNA, 22 nt, Mycobacterium bovis subsp bovis AF2122/97
cguugagcaggugcccgaggug

SEQ ID NO: 3192561 - RNA, 12 nt, Mycobacterium bovis subsp bovis AF2122/97
cguugagcuggc

SEQ ID NO: 3192562 - RNA, 13 nt, Mycobacterium bovis subsp bovis AF2122/97
cguugaggccggu

SEQ ID NO: 3192563 - RNA, 20 nt, Mycobacterium bovis subsp bovis AF2122/97
cguugagguaggugagcgcg

SEQ ID NO: 3192564 - RNA, 21 nt, Mycobacterium bovis subsp bovis AF2122/97
cguugagguaggugagcgcgc

SEQ ID NO: 3192565 - RNA, 23 nt, Mycobacterium bovis subsp bovis AF2122/97
cguugagguaggugagcgcgcuc

SEQ ID NO: 3192566 - RNA, 16 nt, Mycobacterium bovis subsp bovis AF2122/97
cguugagguauucgaa

SEQ ID NO: 3192567 - RNA, 15 nt, Mycobacterium bovis subsp bovis AF2122/97
cguugaggucgauca

SEQ ID NO: 3192568 - RNA, 20 nt, Mycobacterium bovis subsp bovis AF2122/97
cguugagguucuucugcgcc

SEQ ID NO: 3192569 - RNA, 22 nt, Mycobacterium bovis subsp bovis AF2122/97
cguugaguggaugcgccgcacg

SEQ ID NO: 3192570 - RNA, 14 nt, Mycobacterium bovis subsp bovis AF2122/97
cguugagugggagc

SEQ ID NO: 3192571 - RNA, 23 nt, Mycobacterium bovis subsp bovis AF2122/97
cguugauaaaaaccuggcccgcc

SEQ ID NO: 3192572 - RNA, 16 nt, Mycobacterium bovis subsp bovis AF2122/97
cguugauacgcgucga

SEQ ID NO: 3192573 - RNA, 17 nt, Mycobacterium bovis subsp bovis AF2122/97
cguugauacggcaugcg

SEQ ID NO: 3192574 - RNA, 21 nt, Mycobacterium bovis subsp bovis AF2122/97
cguugaucaagaaggccagcg

SEQ ID NO: 3192575 - RNA, 20 nt, Mycobacterium bovis subsp bovis AF2122/97
cguugaucacauucagcacg

SEQ ID NO: 3192576 - RNA, 17 nt, Mycobacterium bovis subsp bovis AF2122/97
cguugauccccagcucc

SEQ ID NO: 3192577 - RNA, 17 nt, Mycobacterium bovis subsp bovis AF2122/97
cguugaucccgaaccgu

SEQ ID NO: 3192578 - RNA, 20 nt, Mycobacterium bovis subsp bovis AF2122/97
cguugaucgacaucaccacc

SEQ ID NO: 3192579 - RNA, 14 nt, Mycobacterium bovis subsp bovis AF2122/97
cguugaucggcacg

SEQ ID NO: 3192580 - RNA, 17 nt, Mycobacterium bovis subsp bovis AF2122/97
cguugaugaccaggucg

SEQ ID NO: 3192581 - RNA, 17 nt, Mycobacterium bovis subsp bovis AF2122/97
cguugaugaccgccgcc

SEQ ID NO: 3192582 - RNA, 18 nt, Mycobacterium bovis subsp bovis AF2122/97
cguugaugaccgccgccg

SEQ ID NO: 3192583 - RNA, 19 nt, Mycobacterium bovis subsp bovis AF2122/97
cguugaugaccgccgccgg

SEQ ID NO: 3192584 - RNA, 22 nt, Mycobacterium bovis subsp bovis AF2122/97
cguugaugacguugcagccggc

SEQ ID NO: 3192585 - RNA, 15 nt, Mycobacterium bovis subsp bovis AF2122/97
cguugaugccgccgg

SEQ ID NO: 3192586 - RNA, 14 nt, Mycobacterium bovis subsp bovis AF2122/97
cguugaugucggcc

SEQ ID NO: 3192587 - RNA, 16 nt, Mycobacterium bovis subsp bovis AF2122/97
cguugaugucggccag

SEQ ID NO: 3192588 - RNA, 14 nt, Mycobacterium bovis subsp bovis AF2122/97
cguugauucggccg

SEQ ID NO: 3192589 - RNA, 16 nt, Mycobacterium bovis subsp bovis AF2122/97
cguugauucggccgcc

SEQ ID NO: 3192590 - RNA, 21 nt, Mycobacterium bovis subsp bovis AF2122/97
cguugauucggccgccgacgu

SEQ ID NO: 3192591 - RNA, 15 nt, Mycobacterium bovis subsp bovis AF2122/97
cguugauucgggagg

SEQ ID NO: 3192592 - RNA, 15 nt, Mycobacterium bovis subsp bovis AF2122/97
cguugauuucggcgg

SEQ ID NO: 3192593 - RNA, 15 nt, Mycobacterium bovis subsp bovis AF2122/97
cguugcacagcagcg

SEQ ID NO: 3192594 - RNA, 13 nt, Mycobacterium bovis subsp bovis AF2122/97
cguugcaccauuc

SEQ ID NO: 3192595 - RNA, 16 nt, Mycobacterium bovis subsp bovis AF2122/97
cguugcacugcugguu

SEQ ID NO: 3192596 - RNA, 15 nt, Mycobacterium bovis subsp bovis AF2122/97
cguugcagaccacca

SEQ ID NO: 3192597 - RNA, 21 nt, Mycobacterium bovis subsp bovis AF2122/97
cguugcagaccaccagugagg

SEQ ID NO: 3192598 - RNA, 16 nt, Mycobacterium bovis subsp bovis AF2122/97
cguugcagcucgaucc

SEQ ID NO: 3192599 - RNA, 21 nt, Mycobacterium bovis subsp bovis AF2122/97
cguugcaggacgcccacaugc

SEQ ID NO: 3192600 - RNA, 11 nt, Mycobacterium bovis subsp bovis AF2122/97
cguugcaggug

SEQ ID NO: 3192601 - RNA, 16 nt, Mycobacterium bovis subsp bovis AF2122/97
cguugccaaagcccac

SEQ ID NO: 3192602 - RNA, 12 nt, Mycobacterium bovis subsp bovis AF2122/97
cguugccaccgg

SEQ ID NO: 3192603 - RNA, 15 nt, Mycobacterium bovis subsp bovis AF2122/97
cguugccaccggugc

SEQ ID NO: 3192604 - RNA, 21 nt, Mycobacterium bovis subsp bovis AF2122/97
cguugccaccggugccggcga

SEQ ID NO: 3192605 - RNA, 20 nt, Mycobacterium bovis subsp bovis AF2122/97
cguugccaccguugccgccg

SEQ ID NO: 3192606 - RNA, 16 nt, Mycobacterium bovis subsp bovis AF2122/97
cguugccagggcgggc

SEQ ID NO: 3192607 - RNA, 15 nt, Mycobacterium bovis subsp bovis AF2122/97
cguugcccaacccgg

SEQ ID NO: 3192608 - RNA, 21 nt, Mycobacterium bovis subsp bovis AF2122/97
cguugcccacguugacggcga

SEQ ID NO: 3192609 - RNA, 20 nt, Mycobacterium bovis subsp bovis AF2122/97
cguugcccccauugccgccg

SEQ ID NO: 3192610 - RNA, 21 nt, Mycobacterium bovis subsp bovis AF2122/97
cguugcccccauugccgccgu

SEQ ID NO: 3192611 - RNA, 22 nt, Mycobacterium bovis subsp bovis AF2122/97
cguugcccccauugccgccguc

SEQ ID NO: 3192612 - RNA, 21 nt, Mycobacterium bovis subsp bovis AF2122/97
cguugcccccguugccgccug

SEQ ID NO: 3192613 - RNA, 13 nt, Mycobacterium bovis subsp bovis AF2122/97
cguugcccgaccc

SEQ ID NO: 3192614 - RNA, 17 nt, Mycobacterium bovis subsp bovis AF2122/97
cguugcccgacccgccg

SEQ ID NO: 3192615 - RNA, 17 nt, Mycobacterium bovis subsp bovis AF2122/97
cguugcccgcgaaggca

SEQ ID NO: 3192616 - RNA, 16 nt, Mycobacterium bovis subsp bovis AF2122/97
cguugcccuccuucuc

SEQ ID NO: 3192617 - RNA, 19 nt, Mycobacterium bovis subsp bovis AF2122/97
cguugccgaaacccgaguu

SEQ ID NO: 3192618 - RNA, 13 nt, Mycobacterium bovis subsp bovis AF2122/97
cguugccgaacca

SEQ ID NO: 3192619 - RNA, 16 nt, Mycobacterium bovis subsp bovis AF2122/97
cguugccgaucaccac

SEQ ID NO: 3192620 - RNA, 20 nt, Mycobacterium bovis subsp bovis AF2122/97
cguugccgaucaccacggcg

SEQ ID NO: 3192621 - RNA, 18 nt, Mycobacterium bovis subsp bovis AF2122/97
cguugccgaucagcccgg

SEQ ID NO: 3192622 - RNA, 14 nt, Mycobacterium bovis subsp bovis AF2122/97
cguugccgaucugc

SEQ ID NO: 3192623 - RNA, 20 nt, Mycobacterium bovis subsp bovis AF2122/97
cguugccgaucugcucgccg

SEQ ID NO: 3192624 - RNA, 22 nt, Mycobacterium bovis subsp bovis AF2122/97
cguugccgaucugcucgccgag

SEQ ID NO: 3192625 - RNA, 20 nt, Mycobacterium bovis subsp bovis AF2122/97
cguugccgccgaagccgacg

SEQ ID NO: 3192626 - RNA, 14 nt, Mycobacterium bovis subsp bovis AF2122/97
cguugccgccgacg

SEQ ID NO: 3192627 - RNA, 12 nt, Mycobacterium bovis subsp bovis AF2122/97
cguugccgccgc

SEQ ID NO: 3192628 - RNA, 22 nt, Mycobacterium bovis subsp bovis AF2122/97
cguugccgccgccuccgccgag

SEQ ID NO: 3192629 - RNA, 14 nt, Mycobacterium bovis subsp bovis AF2122/97
cguugccgccggcg

SEQ ID NO: 3192630 - RNA, 16 nt, Mycobacterium bovis subsp bovis AF2122/97
cguugccgccggcgcc

SEQ ID NO: 3192631 - RNA, 20 nt, Mycobacterium bovis subsp bovis AF2122/97
cguugccgccggcgccgccg

SEQ ID NO: 3192632 - RNA, 21 nt, Mycobacterium bovis subsp bovis AF2122/97
cguugccgccggcgccgccga

SEQ ID NO: 3192633 - RNA, 23 nt, Mycobacterium bovis subsp bovis AF2122/97
cguugccgccggcgccgccguua

SEQ ID NO: 3192634 - RNA, 20 nt, Mycobacterium bovis subsp bovis AF2122/97
cguugccgccggcgccggca

SEQ ID NO: 3192635 - RNA, 15 nt, Mycobacterium bovis subsp bovis AF2122/97
cguugccgccggcuc

SEQ ID NO: 3192636 - RNA, 14 nt, Mycobacterium bovis subsp bovis AF2122/97
cguugccgccggug

SEQ ID NO: 3192637 - RNA, 22 nt, Mycobacterium bovis subsp bovis AF2122/97
cguugccgccggugccacccuu

SEQ ID NO: 3192638 - RNA, 18 nt, Mycobacterium bovis subsp bovis AF2122/97
cguugccgccgucaccgc

SEQ ID NO: 3192639 - RNA, 16 nt, Mycobacterium bovis subsp bovis AF2122/97
cguugccgccgucccc

SEQ ID NO: 3192640 - RNA, 20 nt, Mycobacterium bovis subsp bovis AF2122/97
cguugccgccgucgccgccg

SEQ ID NO: 3192641 - RNA, 21 nt, Mycobacterium bovis subsp bovis AF2122/97
cguugccgccguuaccgccgc

SEQ ID NO: 3192642 - RNA, 20 nt, Mycobacterium bovis subsp bovis AF2122/97
cguugccgccuuugcccccg

SEQ ID NO: 3192643 - RNA, 15 nt, Mycobacterium bovis subsp bovis AF2122/97
cguugccgcggucgg

SEQ ID NO: 3192644 - RNA, 20 nt, Mycobacterium bovis subsp bovis AF2122/97
cguugccgcggucggcgacg

SEQ ID NO: 3192645 - RNA, 15 nt, Mycobacterium bovis subsp bovis AF2122/97
cguugccggcgacca

SEQ ID NO: 3192646 - RNA, 18 nt, Mycobacterium bovis subsp bovis AF2122/97
cguugccggcguugccgc

SEQ ID NO: 3192647 - RNA, 20 nt, Mycobacterium bovis subsp bovis AF2122/97
cguugccggcguugccgccg

SEQ ID NO: 3192648 - RNA, 17 nt, Mycobacterium bovis subsp bovis AF2122/97
cguugccggucgcaugg

SEQ ID NO: 3192649 - RNA, 15 nt, Mycobacterium bovis subsp bovis AF2122/97
cguugccggugccgc

SEQ ID NO: 3192650 - RNA, 17 nt, Mycobacterium bovis subsp bovis AF2122/97
cguugccggugccgccg

SEQ ID NO: 3192651 - RNA, 18 nt, Mycobacterium bovis subsp bovis AF2122/97
cguugccggugccgccgc

SEQ ID NO: 3192652 - RNA, 16 nt, Mycobacterium bovis subsp bovis AF2122/97
cguugccguacagccc

SEQ ID NO: 3192653 - RNA, 20 nt, Mycobacterium bovis subsp bovis AF2122/97
cguugccguacagcccggcc

SEQ ID NO: 3192654 - RNA, 21 nt, Mycobacterium bovis subsp bovis AF2122/97
cguugccguagcugacggccu

SEQ ID NO: 3192655 - RNA, 15 nt, Mycobacterium bovis subsp bovis AF2122/97
cguugccgucgucgc

SEQ ID NO: 3192656 - RNA, 19 nt, Mycobacterium bovis subsp bovis AF2122/97
cguugccguuggugccgcc

SEQ ID NO: 3192657 - RNA, 21 nt, Mycobacterium bovis subsp bovis AF2122/97
cguugccguuggugccgccug

SEQ ID NO: 3192658 - RNA, 15 nt, Mycobacterium bovis subsp bovis AF2122/97
cguugccucgcgacg

SEQ ID NO: 3192659 - RNA, 17 nt, Mycobacterium bovis subsp bovis AF2122/97
cguugccucgcgacgag

SEQ ID NO: 3192660 - RNA, 22 nt, Mycobacterium bovis subsp bovis AF2122/97
cguugcgacaccuccgucagcg

SEQ ID NO: 3192661 - RNA, 12 nt, Mycobacterium bovis subsp bovis AF2122/97
cguugcgccagc

SEQ ID NO: 3192662 - RNA, 21 nt, Mycobacterium bovis subsp bovis AF2122/97
cguugcgccucuuccuggcgu

SEQ ID NO: 3192663 - RNA, 19 nt, Mycobacterium bovis subsp bovis AF2122/97
cguugcggaaucagcaccc

SEQ ID NO: 3192664 - RNA, 17 nt, Mycobacterium bovis subsp bovis AF2122/97
cguugcggacggcguug

SEQ ID NO: 3192665 - RNA, 15 nt, Mycobacterium bovis subsp bovis AF2122/97
cguugcggcaacagc

SEQ ID NO: 3192666 - RNA, 23 nt, Mycobacterium bovis subsp bovis AF2122/97
cguugcgggcgggaaccccggcc

SEQ ID NO: 3192667 - RNA, 20 nt, Mycobacterium bovis subsp bovis AF2122/97
cguugcguagcaggucgacg

SEQ ID NO: 3192668 - RNA, 19 nt, Mycobacterium bovis subsp bovis AF2122/97
cguugcguuggcgccacca

SEQ ID NO: 3192669 - RNA, 17 nt, Mycobacterium bovis subsp bovis AF2122/97
cguugcucggucucguc

SEQ ID NO: 3192670 - RNA, 19 nt, Mycobacterium bovis subsp bovis AF2122/97
cguugcucggucucgucgc

SEQ ID NO: 3192671 - RNA, 16 nt, Mycobacterium bovis subsp bovis AF2122/97
cguugcugauggugcc

SEQ ID NO: 3192672 - RNA, 20 nt, Mycobacterium bovis subsp bovis AF2122/97
cguugcugauggugccgaac

SEQ ID NO: 3192673 - RNA, 17 nt, Mycobacterium bovis subsp bovis AF2122/97
cguugcugaugucgccg

SEQ ID NO: 3192674 - RNA, 21 nt, Mycobacterium bovis subsp bovis AF2122/97
cguugcugaugucgccggugu

SEQ ID NO: 3192675 - RNA, 17 nt, Mycobacterium bovis subsp bovis AF2122/97
cguugcugccggcguag

SEQ ID NO: 3192676 - RNA, 15 nt, Mycobacterium bovis subsp bovis AF2122/97
cguugcuggcggcca

SEQ ID NO: 3192677 - RNA, 14 nt, Mycobacterium bovis subsp bovis AF2122/97
cguugcuggcuggg

SEQ ID NO: 3192678 - RNA, 17 nt, Mycobacterium bovis subsp bovis AF2122/97
cguugcuggucgccguc

SEQ ID NO: 3192679 - RNA, 19 nt, Mycobacterium bovis subsp bovis AF2122/97
cguugcuggucgccgucga

SEQ ID NO: 3192680 - RNA, 14 nt, Mycobacterium bovis subsp bovis AF2122/97
cguuggcagcacag

SEQ ID NO: 3192681 - RNA, 13 nt, Mycobacterium bovis subsp bovis AF2122/97
cguuggcagcccu

SEQ ID NO: 3192682 - RNA, 17 nt, Mycobacterium bovis subsp bovis AF2122/97
cguuggcaggcagguug

SEQ ID NO: 3192683 - RNA, 18 nt, Mycobacterium bovis subsp bovis AF2122/97
cguuggccccgcggagcg

SEQ ID NO: 3192684 - RNA, 13 nt, Mycobacterium bovis subsp bovis AF2122/97
cguuggcccgccu

SEQ ID NO: 3192685 - RNA, 17 nt, Mycobacterium bovis subsp bovis AF2122/97
cguuggccgggcacgcg

SEQ ID NO: 3192686 - RNA, 16 nt, Mycobacterium bovis subsp bovis AF2122/97
cguuggcgaccaccgc

SEQ ID NO: 3192687 - RNA, 14 nt, Mycobacterium bovis subsp bovis AF2122/97
cguuggcgccacca

SEQ ID NO: 3192688 - RNA, 20 nt, Mycobacterium bovis subsp bovis AF2122/97
cguuggcgccaccagucacg

SEQ ID NO: 3192689 - RNA, 15 nt, Mycobacterium bovis subsp bovis AF2122/97
cguuggcggcaaggg

SEQ ID NO: 3192690 - RNA, 18 nt, Mycobacterium bovis subsp bovis AF2122/97
cguuggcggccagcgcac

SEQ ID NO: 3192691 - RNA, 19 nt, Mycobacterium bovis subsp bovis AF2122/97
cguuggcggccagcgcacc

SEQ ID NO: 3192692 - RNA, 19 nt, Mycobacterium bovis subsp bovis AF2122/97
cguuggcggcggucggcug

SEQ ID NO: 3192693 - RNA, 21 nt, Mycobacterium bovis subsp bovis AF2122/97
cguuggcggcggucggcuggg

SEQ ID NO: 3192694 - RNA, 16 nt, Mycobacterium bovis subsp bovis AF2122/97
cguuggcggcgguggc

SEQ ID NO: 3192695 - RNA, 20 nt, Mycobacterium bovis subsp bovis AF2122/97
cguuggcgguaaaccacucg

SEQ ID NO: 3192696 - RNA, 16 nt, Mycobacterium bovis subsp bovis AF2122/97
cguuggcgugcucacc

SEQ ID NO: 3192697 - RNA, 14 nt, Mycobacterium bovis subsp bovis AF2122/97
cguuggcucgagcc

SEQ ID NO: 3192698 - RNA, 16 nt, Mycobacterium bovis subsp bovis AF2122/97
cguuggcucgagccgc

SEQ ID NO: 3192699 - RNA, 22 nt, Mycobacterium bovis subsp bovis AF2122/97
cguuggcuggugcaggugacga

SEQ ID NO: 3192700 - RNA, 17 nt, Mycobacterium bovis subsp bovis AF2122/97
cguuggcuucuucgguc

SEQ ID NO: 3192701 - RNA, 18 nt, Mycobacterium bovis subsp bovis AF2122/97
cguugggaccagugcggu

SEQ ID NO: 3192702 - RNA, 17 nt, Mycobacterium bovis subsp bovis AF2122/97
cguugggaucccagcgc

SEQ ID NO: 3192703 - RNA, 18 nt, Mycobacterium bovis subsp bovis AF2122/97
cguugggaucccagcgca

SEQ ID NO: 3192704 - RNA, 20 nt, Mycobacterium bovis subsp bovis AF2122/97
cguugggaucgcgcagcgcc

SEQ ID NO: 3192705 - RNA, 14 nt, Mycobacterium bovis subsp bovis AF2122/97
cguugggaugacac

SEQ ID NO: 3192706 - RNA, 20 nt, Mycobacterium bovis subsp bovis AF2122/97
cguugggcagcuccaccagg

SEQ ID NO: 3192707 - RNA, 13 nt, Mycobacterium bovis subsp bovis AF2122/97
cguugggccgacu

SEQ ID NO: 3192708 - RNA, 14 nt, Mycobacterium bovis subsp bovis AF2122/97
cguugggccgcgcc

SEQ ID NO: 3192709 - RNA, 15 nt, Mycobacterium bovis subsp bovis AF2122/97
cguuggggcugccgu

SEQ ID NO: 3192710 - RNA, 21 nt, Mycobacterium bovis subsp bovis AF2122/97
cguugggguuggcauguggac

SEQ ID NO: 3192711 - RNA, 20 nt, Mycobacterium bovis subsp bovis AF2122/97
cguuggguugaaaacgcccg

SEQ ID NO: 3192712 - RNA, 23 nt, Mycobacterium bovis subsp bovis AF2122/97
cguuggguugaaaacgcccggca

SEQ ID NO: 3192713 - RNA, 21 nt, Mycobacterium bovis subsp bovis AF2122/97
cguugguagccggugaccgcg

SEQ ID NO: 3192714 - RNA, 21 nt, Mycobacterium bovis subsp bovis AF2122/97
cguuggucaucaacgccacga

SEQ ID NO: 3192715 - RNA, 17 nt, Mycobacterium bovis subsp bovis AF2122/97
cguuggugaggcccccc

SEQ ID NO: 3192716 - RNA, 15 nt, Mycobacterium bovis subsp bovis AF2122/97
cguuggugcagacca

SEQ ID NO: 3192717 - RNA, 20 nt, Mycobacterium bovis subsp bovis AF2122/97
cguugguggucugccaaaag

SEQ ID NO: 3192718 - RNA, 16 nt, Mycobacterium bovis subsp bovis AF2122/97
cguuguacucgugcgg

SEQ ID NO: 3192719 - RNA, 14 nt, Mycobacterium bovis subsp bovis AF2122/97
cguuguaggagaac

SEQ ID NO: 3192720 - RNA, 13 nt, Mycobacterium bovis subsp bovis AF2122/97
cguuguaggcuuc

SEQ ID NO: 3192721 - RNA, 16 nt, Mycobacterium bovis subsp bovis AF2122/97
cguuguaggcuuccag

SEQ ID NO: 3192722 - RNA, 17 nt, Mycobacterium bovis subsp bovis AF2122/97
cguuguaugcguuacgc

SEQ ID NO: 3192723 - RNA, 22 nt, Mycobacterium bovis subsp bovis AF2122/97
cguuguaugcguuacgccgcga

SEQ ID NO: 3192724 - RNA, 18 nt, Mycobacterium bovis subsp bovis AF2122/97
cguuguaugcugcgcgcc

SEQ ID NO: 3192725 - RNA, 19 nt, Mycobacterium bovis subsp bovis AF2122/97
cguuguaugcugcgcgccg

SEQ ID NO: 3192726 - RNA, 20 nt, Mycobacterium bovis subsp bovis AF2122/97
cguugucagcgaacggccag

SEQ ID NO: 3192727 - RNA, 18 nt, Mycobacterium bovis subsp bovis AF2122/97
cguuguccaccgccacca

SEQ ID NO: 3192728 - RNA, 21 nt, Mycobacterium bovis subsp bovis AF2122/97
cguugucggcggggcgccgga

SEQ ID NO: 3192729 - RNA, 20 nt, Mycobacterium bovis subsp bovis AF2122/97
cguugucggcuggacggcgc

SEQ ID NO: 3192730 - RNA, 21 nt, Mycobacterium bovis subsp bovis AF2122/97
cguugugcagguggccgucgc

SEQ ID NO: 3192731 - RNA, 17 nt, Mycobacterium bovis subsp bovis AF2122/97
cguuguggcguguggcu

SEQ ID NO: 3192732 - RNA, 16 nt, Mycobacterium bovis subsp bovis AF2122/97
cguugugucaccggcg

SEQ ID NO: 3192733 - RNA, 20 nt, Mycobacterium bovis subsp bovis AF2122/97
cguugugucaccggcgucgc

SEQ ID NO: 3192734 - RNA, 15 nt, Mycobacterium bovis subsp bovis AF2122/97
cguuguucaccgacg

SEQ ID NO: 3192735 - RNA, 20 nt, Mycobacterium bovis subsp bovis AF2122/97
cguuguucccauagccagcc

SEQ ID NO: 3192736 - RNA, 17 nt, Mycobacterium bovis subsp bovis AF2122/97
cguuguugaccaccacg

SEQ ID NO: 3192737 - RNA, 19 nt, Mycobacterium bovis subsp bovis AF2122/97
cguuguuggauccggccac

SEQ ID NO: 3192738 - RNA, 15 nt, Mycobacterium bovis subsp bovis AF2122/97
cguuguugggcgagg

SEQ ID NO: 3192739 - RNA, 18 nt, Mycobacterium bovis subsp bovis AF2122/97
cguuguugggcgagggug

SEQ ID NO: 3192740 - RNA, 12 nt, Mycobacterium bovis subsp bovis AF2122/97
cguuguugucga

SEQ ID NO: 3192741 - RNA, 17 nt, Mycobacterium bovis subsp bovis AF2122/97
cguuuacauagaccacc

SEQ ID NO: 3192742 - RNA, 17 nt, Mycobacterium bovis subsp bovis AF2122/97
cguuuagggugcccgcg

SEQ ID NO: 3192743 - RNA, 15 nt, Mycobacterium bovis subsp bovis AF2122/97
cguuuaucagcaaga

SEQ ID NO: 3192744 - RNA, 22 nt, Mycobacterium bovis subsp bovis AF2122/97
cguuuauuguccugccgacagu

SEQ ID NO: 3192745 - RNA, 17 nt, Mycobacterium bovis subsp bovis AF2122/97
cguuucacccgggcugc

SEQ ID NO: 3192746 - RNA, 22 nt, Mycobacterium bovis subsp bovis AF2122/97
cguuucacccgggcugcuugcg

SEQ ID NO: 3192747 - RNA, 20 nt, Mycobacterium bovis subsp bovis AF2122/97
cguuucacgaaacccagucg

SEQ ID NO: 3192748 - RNA, 16 nt, Mycobacterium bovis subsp bovis AF2122/97
cguuucccuggccgcc

SEQ ID NO: 3192749 - RNA, 18 nt, Mycobacterium bovis subsp bovis AF2122/97
cguuucccuggccgccgc

SEQ ID NO: 3192750 - RNA, 15 nt, Mycobacterium bovis subsp bovis AF2122/97
cguuuccgccgccgc

SEQ ID NO: 3192751 - RNA, 20 nt, Mycobacterium bovis subsp bovis AF2122/97
cguuuccgccgccgccgcca

SEQ ID NO: 3192752 - RNA, 12 nt, Mycobacterium bovis subsp bovis AF2122/97
cguuuccgcugg

SEQ ID NO: 3192753 - RNA, 21 nt, Mycobacterium bovis subsp bovis AF2122/97
cguuuccgcugggagcggaug

SEQ ID NO: 3192754 - RNA, 14 nt, Mycobacterium bovis subsp bovis AF2122/97
cguuucgcagccgc

SEQ ID NO: 3192755 - RNA, 15 nt, Mycobacterium bovis subsp bovis AF2122/97
cguuucgccagccgg

SEQ ID NO: 3192756 - RNA, 16 nt, Mycobacterium bovis subsp bovis AF2122/97
cguuucgccagccggc

SEQ ID NO: 3192757 - RNA, 16 nt, Mycobacterium bovis subsp bovis AF2122/97
cguuucgcgacgucug

SEQ ID NO: 3192758 - RNA, 18 nt, Mycobacterium bovis subsp bovis AF2122/97
cguuucgcgaugugcgcc

SEQ ID NO: 3192759 - RNA, 22 nt, Mycobacterium bovis subsp bovis AF2122/97
cguuucgcgaugugcgccaccu

SEQ ID NO: 3192760 - RNA, 17 nt, Mycobacterium bovis subsp bovis AF2122/97
cguuugaacuucgccgu

SEQ ID NO: 3192761 - RNA, 12 nt, Mycobacterium bovis subsp bovis AF2122/97
cguuugacgcgc

SEQ ID NO: 3192762 - RNA, 16 nt, Mycobacterium bovis subsp bovis AF2122/97
cguuugacgcgcucgc

SEQ ID NO: 3192763 - RNA, 18 nt, Mycobacterium bovis subsp bovis AF2122/97
cguuugagcggccaccgu

SEQ ID NO: 3192764 - RNA, 21 nt, Mycobacterium bovis subsp bovis AF2122/97
cguuugcgagcaggggaguug

SEQ ID NO: 3192765 - RNA, 12 nt, Mycobacterium bovis subsp bovis AF2122/97
cguuuggacggg

SEQ ID NO: 3192766 - RNA, 14 nt, Mycobacterium bovis subsp bovis AF2122/97
cguuuggcugccga

SEQ ID NO: 3192767 - RNA, 15 nt, Mycobacterium bovis subsp bovis AF2122/97
cguuuggcugccgaa

SEQ ID NO: 3192768 - RNA, 20 nt, Mycobacterium bovis subsp bovis AF2122/97
cguuuuccgggcuguucgcg

SEQ ID NO: 3192769 - RNA, 17 nt, Mycobacterium bovis subsp bovis AF2122/97
cguuuuccugaucgcgc

SEQ ID NO: 3192770 - RNA, 16 nt, Mycobacterium bovis subsp bovis AF2122/97
cguuuucgccgauccc

SEQ ID NO: 3192771 - RNA, 14 nt, Mycobacterium bovis subsp bovis AF2122/97
cguuuucggccuga

SEQ ID NO: 3192772 - RNA, 15 nt, Mycobacterium bovis subsp bovis AF2122/97
cguuuugcggcccgg

SEQ ID NO: 3192773 - RNA, 20 nt, Mycobacterium bovis subsp bovis AF2122/97
cguuuugggugaucgcacag

SEQ ID NO: 3192774 - RNA, 22 nt, Mycobacterium bovis subsp bovis AF2122/97
cguuuuggugcggaccugcgcc

SEQ ID NO: 3192775 - RNA, 19 nt, Mycobacterium bovis subsp bovis AF2122/97
cuaaacaggccgccaccgu

SEQ ID NO: 3192776 - RNA, 12 nt, Mycobacterium bovis subsp bovis AF2122/97
cuaaaccagcca

SEQ ID NO: 3192777 - RNA, 18 nt, Mycobacterium bovis subsp bovis AF2122/97
cuaaaccagccaccacca

SEQ ID NO: 3192778 - RNA, 23 nt, Mycobacterium bovis subsp bovis AF2122/97
cuaaaucuggccgauuuaguggg

SEQ ID NO: 3192779 - RNA, 19 nt, Mycobacterium bovis subsp bovis AF2122/97
cuaacaacaccaccagcac

SEQ ID NO: 3192780 - RNA, 20 nt, Mycobacterium bovis subsp bovis AF2122/97
cuaacaacaccaccagcacg

SEQ ID NO: 3192781 - RNA, 17 nt, Mycobacterium bovis subsp bovis AF2122/97
cuaacaccgcaggcaca

SEQ ID NO: 3192782 - RNA, 20 nt, Mycobacterium bovis subsp bovis AF2122/97
cuaaccacuguuucugagcg

SEQ ID NO: 3192783 - RNA, 18 nt, Mycobacterium bovis subsp bovis AF2122/97
cuaaccccggcucgacgc

SEQ ID NO: 3192784 - RNA, 22 nt, Mycobacterium bovis subsp bovis AF2122/97
cuaacccgcaccggaucggcua

SEQ ID NO: 3192785 - RNA, 14 nt, Mycobacterium bovis subsp bovis AF2122/97
cuaacccgcgccgg

SEQ ID NO: 3192786 - RNA, 13 nt, Mycobacterium bovis subsp bovis AF2122/97
cuaacccugcccu

SEQ ID NO: 3192787 - RNA, 23 nt, Mycobacterium bovis subsp bovis AF2122/97
cuaaccgcuuggugugauacaac

SEQ ID NO: 3192788 - RNA, 22 nt, Mycobacterium bovis subsp bovis AF2122/97
cuaacgcaccugcgcgcggccg

SEQ ID NO: 3192789 - RNA, 15 nt, Mycobacterium bovis subsp bovis AF2122/97
cuaacggcagccacc

SEQ ID NO: 3192790 - RNA, 18 nt, Mycobacterium bovis subsp bovis AF2122/97
cuaacggcagccaccguc

SEQ ID NO: 3192791 - RNA, 19 nt, Mycobacterium bovis subsp bovis AF2122/97
cuaacggcagccaccguca

SEQ ID NO: 3192792 - RNA, 15 nt, Mycobacterium bovis subsp bovis AF2122/97
cuaacuggcccggac

SEQ ID NO: 3192793 - RNA, 17 nt, Mycobacterium bovis subsp bovis AF2122/97
cuaagcauucagcgcgc

SEQ ID NO: 3192794 - RNA, 19 nt, Mycobacterium bovis subsp bovis AF2122/97
cuaagcauucagcgcgccg

SEQ ID NO: 3192795 - RNA, 13 nt, Mycobacterium bovis subsp bovis AF2122/97
cuaaggcucacca

SEQ ID NO: 3192796 - RNA, 16 nt, Mycobacterium bovis subsp bovis AF2122/97
cuaaggcucaccaggc

SEQ ID NO: 3192797 - RNA, 18 nt, Mycobacterium bovis subsp bovis AF2122/97
cuaaggcucaccaggcga

SEQ ID NO: 3192798 - RNA, 19 nt, Mycobacterium bovis subsp bovis AF2122/97
cuaaguccccgcuuggcga

SEQ ID NO: 3192799 - RNA, 21 nt, Mycobacterium bovis subsp bovis AF2122/97
cuaaguucgccacgcccgacg

SEQ ID NO: 3192800 - RNA, 13 nt, Mycobacterium bovis subsp bovis AF2122/97
cuaaucagccagg

SEQ ID NO: 3192801 - RNA, 21 nt, Mycobacterium bovis subsp bovis AF2122/97
cuaaugucgauuucgaugacg

SEQ ID NO: 3192802 - RNA, 15 nt, Mycobacterium bovis subsp bovis AF2122/97
cuaauugcggccgcc

SEQ ID NO: 3192803 - RNA, 22 nt, Mycobacterium bovis subsp bovis AF2122/97
cuacacccauuacugagcuucc

SEQ ID NO: 3192804 - RNA, 14 nt, Mycobacterium bovis subsp bovis AF2122/97
cuacaccggcaagc

SEQ ID NO: 3192805 - RNA, 21 nt, Mycobacterium bovis subsp bovis AF2122/97
cuacaccggcaagccacgccg

SEQ ID NO: 3192806 - RNA, 18 nt, Mycobacterium bovis subsp bovis AF2122/97
cuacagcguugccaggug

SEQ ID NO: 3192807 - RNA, 14 nt, Mycobacterium bovis subsp bovis AF2122/97
cuacaucgaucaga

SEQ ID NO: 3192808 - RNA, 19 nt, Mycobacterium bovis subsp bovis AF2122/97
cuacaugggggcguuggcg

SEQ ID NO: 3192809 - RNA, 21 nt, Mycobacterium bovis subsp bovis AF2122/97
cuacaugggggcguuggcggg

SEQ ID NO: 3192810 - RNA, 18 nt, Mycobacterium bovis subsp bovis AF2122/97
cuaccaacaccgcccgca

SEQ ID NO: 3192811 - RNA, 22 nt, Mycobacterium bovis subsp bovis AF2122/97
cuaccaaccgguacuccugggu

SEQ ID NO: 3192812 - RNA, 22 nt, Mycobacterium bovis subsp bovis AF2122/97
cuaccaacgcaacacgggcgcc

SEQ ID NO: 3192813 - RNA, 12 nt, Mycobacterium bovis subsp bovis AF2122/97
cuaccacccgca

SEQ ID NO: 3192814 - RNA, 22 nt, Mycobacterium bovis subsp bovis AF2122/97
cuaccacccgcaggucgcuggc

SEQ ID NO: 3192815 - RNA, 11 nt, Mycobacterium bovis subsp bovis AF2122/97
cuaccaccgcg

SEQ ID NO: 3192816 - RNA, 18 nt, Mycobacterium bovis subsp bovis AF2122/97
cuaccacggaggguugcc

SEQ ID NO: 3192817 - RNA, 15 nt, Mycobacterium bovis subsp bovis AF2122/97
cuaccagcaccggga

SEQ ID NO: 3192818 - RNA, 23 nt, Mycobacterium bovis subsp bovis AF2122/97
cuaccagccauagugcggcagcg

SEQ ID NO: 3192819 - RNA, 15 nt, Mycobacterium bovis subsp bovis AF2122/97
cuaccagccgccccg

SEQ ID NO: 3192820 - RNA, 15 nt, Mycobacterium bovis subsp bovis AF2122/97
cuaccaggcgcggcc

SEQ ID NO: 3192821 - RNA, 15 nt, Mycobacterium bovis subsp bovis AF2122/97
cuacccaccggccgg

SEQ ID NO: 3192822 - RNA, 15 nt, Mycobacterium bovis subsp bovis AF2122/97
cuacccagccagccg

SEQ ID NO: 3192823 - RNA, 13 nt, Mycobacterium bovis subsp bovis AF2122/97
cuacccauggccc

SEQ ID NO: 3192824 - RNA, 17 nt, Mycobacterium bovis subsp bovis AF2122/97
cuacccauggcccguug

SEQ ID NO: 3192825 - RNA, 18 nt, Mycobacterium bovis subsp bovis AF2122/97
cuacccgagccggcacgc

SEQ ID NO: 3192826 - RNA, 16 nt, Mycobacterium bovis subsp bovis AF2122/97
cuacccgcggcgcgaa

SEQ ID NO: 3192827 - RNA, 17 nt, Mycobacterium bovis subsp bovis AF2122/97
cuacccggacagggcgg

SEQ ID NO: 3192828 - RNA, 15 nt, Mycobacterium bovis subsp bovis AF2122/97
cuacccgggccaggc

SEQ ID NO: 3192829 - RNA, 14 nt, Mycobacterium bovis subsp bovis AF2122/97
cuaccgacgcaccu

SEQ ID NO: 3192830 - RNA, 20 nt, Mycobacterium bovis subsp bovis AF2122/97
cuaccgagaucaccgccacc

SEQ ID NO: 3192831 - RNA, 20 nt, Mycobacterium bovis subsp bovis AF2122/97
cuaccgagauugggcuggga

SEQ ID NO: 3192832 - RNA, 17 nt, Mycobacterium bovis subsp bovis AF2122/97
cuaccgaugaaccaggc

SEQ ID NO: 3192833 - RNA, 17 nt, Mycobacterium bovis subsp bovis AF2122/97
cuaccgcaggugccacc

SEQ ID NO: 3192834 - RNA, 14 nt, Mycobacterium bovis subsp bovis AF2122/97
cuaccgcccgcgcc

SEQ ID NO: 3192835 - RNA, 20 nt, Mycobacterium bovis subsp bovis AF2122/97
cuaccgcccgcgccaccggc

SEQ ID NO: 3192836 - RNA, 14 nt, Mycobacterium bovis subsp bovis AF2122/97
cuaccgccgaccgg

SEQ ID NO: 3192837 - RNA, 18 nt, Mycobacterium bovis subsp bovis AF2122/97
cuaccgccggcggcggcc

SEQ ID NO: 3192838 - RNA, 20 nt, Mycobacterium bovis subsp bovis AF2122/97
cuaccgccggcggcggccgc

SEQ ID NO: 3192839 - RNA, 12 nt, Mycobacterium bovis subsp bovis AF2122/97
cuaccgccgggg

SEQ ID NO: 3192840 - RNA, 18 nt, Mycobacterium bovis subsp bovis AF2122/97
cuaccgccuugucggcga

SEQ ID NO: 3192841 - RNA, 16 nt, Mycobacterium bovis subsp bovis AF2122/97
cuaccgcuucccccgg

SEQ ID NO: 3192842 - RNA, 12 nt, Mycobacterium bovis subsp bovis AF2122/97
cuaccggcccga

SEQ ID NO: 3192843 - RNA, 12 nt, Mycobacterium bovis subsp bovis AF2122/97
cuaccggcgccg

SEQ ID NO: 3192844 - RNA, 15 nt, Mycobacterium bovis subsp bovis AF2122/97
cuaccggcgccgcgc

SEQ ID NO: 3192845 - RNA, 20 nt, Mycobacterium bovis subsp bovis AF2122/97
cuaccggcgccgcgcggcuu

SEQ ID NO: 3192846 - RNA, 18 nt, Mycobacterium bovis subsp bovis AF2122/97
cuaccggcgugucacguc

SEQ ID NO: 3192847 - RNA, 18 nt, Mycobacterium bovis subsp bovis AF2122/97
cuaccggcuacggcgaca

SEQ ID NO: 3192848 - RNA, 17 nt, Mycobacterium bovis subsp bovis AF2122/97
cuaccggcucguagcug

SEQ ID NO: 3192849 - RNA, 23 nt, Mycobacterium bovis subsp bovis AF2122/97
cuaccggcuuggcgggaccguga

SEQ ID NO: 3192850 - RNA, 19 nt, Mycobacterium bovis subsp bovis AF2122/97
cuaccguacgcagcgugug

SEQ ID NO: 3192851 - RNA, 16 nt, Mycobacterium bovis subsp bovis AF2122/97
cuaccgucaguagcca

SEQ ID NO: 3192852 - RNA, 15 nt, Mycobacterium bovis subsp bovis AF2122/97
cuaccgucgaccacu

SEQ ID NO: 3192853 - RNA, 16 nt, Mycobacterium bovis subsp bovis AF2122/97
cuaccgugcuggcacc

SEQ ID NO: 3192854 - RNA, 16 nt, Mycobacterium bovis subsp bovis AF2122/97
cuaccguuguugagga

SEQ ID NO: 3192855 - RNA, 13 nt, Mycobacterium bovis subsp bovis AF2122/97
cuaccuaacccgc

SEQ ID NO: 3192856 - RNA, 21 nt, Mycobacterium bovis subsp bovis AF2122/97
cuaccuaacccgcgccggccg

SEQ ID NO: 3192857 - RNA, 13 nt, Mycobacterium bovis subsp bovis AF2122/97
cuaccuccgccac

SEQ ID NO: 3192858 - RNA, 15 nt, Mycobacterium bovis subsp bovis AF2122/97
cuaccuccgccacca

SEQ ID NO: 3192859 - RNA, 17 nt, Mycobacterium bovis subsp bovis AF2122/97
cuaccugcacccaggca

SEQ ID NO: 3192860 - RNA, 16 nt, Mycobacterium bovis subsp bovis AF2122/97
cuaccuguugacacaa

SEQ ID NO: 3192861 - RNA, 15 nt, Mycobacterium bovis subsp bovis AF2122/97
cuaccuuggacucgg

SEQ ID NO: 3192862 - RNA, 23 nt, Mycobacterium bovis subsp bovis AF2122/97
cuacgacgguccguucgcgccgu

SEQ ID NO: 3192863 - RNA, 20 nt, Mycobacterium bovis subsp bovis AF2122/97
cuacgcagccguagcugggc

SEQ ID NO: 3192864 - RNA, 16 nt, Mycobacterium bovis subsp bovis AF2122/97
cuacgccagccgcgcu

SEQ ID NO: 3192865 - RNA, 17 nt, Mycobacterium bovis subsp bovis AF2122/97
cuacgccccacugccgu

SEQ ID NO: 3192866 - RNA, 21 nt, Mycobacterium bovis subsp bovis AF2122/97
cuacgcgcgcucgcucaccgg

SEQ ID NO: 3192867 - RNA, 22 nt, Mycobacterium bovis subsp bovis AF2122/97
cuacgcgcgcucgcucaccggc

SEQ ID NO: 3192868 - RNA, 20 nt, Mycobacterium bovis subsp bovis AF2122/97
cuacgcggccgaggucaccc

SEQ ID NO: 3192869 - RNA, 14 nt, Mycobacterium bovis subsp bovis AF2122/97
cuacggccuggcca

SEQ ID NO: 3192870 - RNA, 16 nt, Mycobacterium bovis subsp bovis AF2122/97
cuacggccuggccacc

SEQ ID NO: 3192871 - RNA, 19 nt, Mycobacterium bovis subsp bovis AF2122/97
cuacggcugcccguucugc

SEQ ID NO: 3192872 - RNA, 12 nt, Mycobacterium bovis subsp bovis AF2122/97
cuacgggccgcg

SEQ ID NO: 3192873 - RNA, 16 nt, Mycobacterium bovis subsp bovis AF2122/97
cuacgucggcucgucg

SEQ ID NO: 3192874 - RNA, 21 nt, Mycobacterium bovis subsp bovis AF2122/97
cuacguuggccgagcagggcc

SEQ ID NO: 3192875 - RNA, 16 nt, Mycobacterium bovis subsp bovis AF2122/97
cuacuaggcccagcac

SEQ ID NO: 3192876 - RNA, 13 nt, Mycobacterium bovis subsp bovis AF2122/97
cuacucccccgcg

SEQ ID NO: 3192877 - RNA, 15 nt, Mycobacterium bovis subsp bovis AF2122/97
cuacucgaacaaccc

SEQ ID NO: 3192878 - RNA, 14 nt, Mycobacterium bovis subsp bovis AF2122/97
cuacugggugggua

SEQ ID NO: 3192879 - RNA, 14 nt, Mycobacterium bovis subsp bovis AF2122/97
cuacuuccucgacg

SEQ ID NO: 3192880 - RNA, 23 nt, Mycobacterium bovis subsp bovis AF2122/97
cuagaacagacggggucgcccgg

SEQ ID NO: 3192881 - RNA, 13 nt, Mycobacterium bovis subsp bovis AF2122/97
cuagaccgggcgg

SEQ ID NO: 3192882 - RNA, 16 nt, Mycobacterium bovis subsp bovis AF2122/97
cuagacgccgccgcug

SEQ ID NO: 3192883 - RNA, 22 nt, Mycobacterium bovis subsp bovis AF2122/97
cuagaggcggcccccggcagcg

SEQ ID NO: 3192884 - RNA, 20 nt, Mycobacterium bovis subsp bovis AF2122/97
cuagauauggaccgccgccg

SEQ ID NO: 3192885 - RNA, 16 nt, Mycobacterium bovis subsp bovis AF2122/97
cuagaucgccgagcgu

SEQ ID NO: 3192886 - RNA, 21 nt, Mycobacterium bovis subsp bovis AF2122/97
cuagaucgucgucaacccggu

SEQ ID NO: 3192887 - RNA, 14 nt, Mycobacterium bovis subsp bovis AF2122/97
cuagcaccgcgccg

SEQ ID NO: 3192888 - RNA, 19 nt, Mycobacterium bovis subsp bovis AF2122/97
cuagcacggggaccgggcu

SEQ ID NO: 3192889 - RNA, 12 nt, Mycobacterium bovis subsp bovis AF2122/97
cuagcagcagcc

SEQ ID NO: 3192890 - RNA, 21 nt, Mycobacterium bovis subsp bovis AF2122/97
cuagcagcagcccgacagugg

SEQ ID NO: 3192891 - RNA, 16 nt, Mycobacterium bovis subsp bovis AF2122/97
cuagcagcgcugcgau

SEQ ID NO: 3192892 - RNA, 18 nt, Mycobacterium bovis subsp bovis AF2122/97
cuagcagggugccggcgc

SEQ ID NO: 3192893 - RNA, 19 nt, Mycobacterium bovis subsp bovis AF2122/97
cuagcagggugccggcgcc

SEQ ID NO: 3192894 - RNA, 18 nt, Mycobacterium bovis subsp bovis AF2122/97
cuagcagguacucgcccc

SEQ ID NO: 3192895 - RNA, 16 nt, Mycobacterium bovis subsp bovis AF2122/97
cuagccaacgagcgcg

SEQ ID NO: 3192896 - RNA, 22 nt, Mycobacterium bovis subsp bovis AF2122/97
cuagccagggaucagccgugcg

SEQ ID NO: 3192897 - RNA, 12 nt, Mycobacterium bovis subsp bovis AF2122/97
cuagcccaccac

SEQ ID NO: 3192898 - RNA, 22 nt, Mycobacterium bovis subsp bovis AF2122/97
cuagccccugaaggccagccaa

SEQ ID NO: 3192899 - RNA, 14 nt, Mycobacterium bovis subsp bovis AF2122/97
cuagcccgaccggu

SEQ ID NO: 3192900 - RNA, 21 nt, Mycobacterium bovis subsp bovis AF2122/97
cuagcccgaccgguccagcca

SEQ ID NO: 3192901 - RNA, 15 nt, Mycobacterium bovis subsp bovis AF2122/97
cuagcccggcagcac

SEQ ID NO: 3192902 - RNA, 19 nt, Mycobacterium bovis subsp bovis AF2122/97
cuagcccgguaucgucccg

SEQ ID NO: 3192903 - RNA, 19 nt, Mycobacterium bovis subsp bovis AF2122/97
cuagcccguuguccagaac

SEQ ID NO: 3192904 - RNA, 16 nt, Mycobacterium bovis subsp bovis AF2122/97
cuagccgcggcaccgc

SEQ ID NO: 3192905 - RNA, 17 nt, Mycobacterium bovis subsp bovis AF2122/97
cuagccgcggcaccgcc

SEQ ID NO: 3192906 - RNA, 23 nt, Mycobacterium bovis subsp bovis AF2122/97
cuagccggguguuggggaucgca

SEQ ID NO: 3192907 - RNA, 23 nt, Mycobacterium bovis subsp bovis AF2122/97
cuagcgagccggcgccgggucga

SEQ ID NO: 3192908 - RNA, 13 nt, Mycobacterium bovis subsp bovis AF2122/97
cuagcgagcggca

SEQ ID NO: 3192909 - RNA, 20 nt, Mycobacterium bovis subsp bovis AF2122/97
cuagcgccaaauccggcuug

SEQ ID NO: 3192910 - RNA, 17 nt, Mycobacterium bovis subsp bovis AF2122/97
cuagcgccccuggcacc

SEQ ID NO: 3192911 - RNA, 19 nt, Mycobacterium bovis subsp bovis AF2122/97
cuagcgccccuggcaccuc

SEQ ID NO: 3192912 - RNA, 14 nt, Mycobacterium bovis subsp bovis AF2122/97
cuagcgccucgccg

SEQ ID NO: 3192913 - RNA, 15 nt, Mycobacterium bovis subsp bovis AF2122/97
cuagcgccucgccgg

SEQ ID NO: 3192914 - RNA, 17 nt, Mycobacterium bovis subsp bovis AF2122/97
cuagcgccucgccggcc

SEQ ID NO: 3192915 - RNA, 20 nt, Mycobacterium bovis subsp bovis AF2122/97
cuagcgccucgccggccacc

SEQ ID NO: 3192916 - RNA, 23 nt, Mycobacterium bovis subsp bovis AF2122/97
cuagcgccucgccggccacccgc

SEQ ID NO: 3192917 - RNA, 11 nt, Mycobacterium bovis subsp bovis AF2122/97
cuagcgcggcg

SEQ ID NO: 3192918 - RNA, 15 nt, Mycobacterium bovis subsp bovis AF2122/97
cuagcgcggcgacga

SEQ ID NO: 3192919 - RNA, 16 nt, Mycobacterium bovis subsp bovis AF2122/97
cuagcgcggcgacgau

SEQ ID NO: 3192920 - RNA, 19 nt, Mycobacterium bovis subsp bovis AF2122/97
cuagcgcuauaggccgcau

SEQ ID NO: 3192921 - RNA, 15 nt, Mycobacterium bovis subsp bovis AF2122/97
cuagcggcucaccgc

SEQ ID NO: 3192922 - RNA, 16 nt, Mycobacterium bovis subsp bovis AF2122/97
cuagcggcucaccgcg

SEQ ID NO: 3192923 - RNA, 21 nt, Mycobacterium bovis subsp bovis AF2122/97
cuagcggcucaccgcgcauca

SEQ ID NO: 3192924 - RNA, 22 nt, Mycobacterium bovis subsp bovis AF2122/97
cuagcgguauuugaugagcaac

SEQ ID NO: 3192925 - RNA, 19 nt, Mycobacterium bovis subsp bovis AF2122/97
cuagcgguggaaaaagccc

SEQ ID NO: 3192926 - RNA, 17 nt, Mycobacterium bovis subsp bovis AF2122/97
cuagcucggccugaagc

SEQ ID NO: 3192927 - RNA, 16 nt, Mycobacterium bovis subsp bovis AF2122/97
cuagcugcugaugcgg

SEQ ID NO: 3192928 - RNA, 18 nt, Mycobacterium bovis subsp bovis AF2122/97
cuagcuggugcgcccgac

SEQ ID NO: 3192929 - RNA, 18 nt, Mycobacterium bovis subsp bovis AF2122/97
cuagcuugacaacccugu

SEQ ID NO: 3192930 - RNA, 15 nt, Mycobacterium bovis subsp bovis AF2122/97
cuagcuuggcggcca

SEQ ID NO: 3192931 - RNA, 15 nt, Mycobacterium bovis subsp bovis AF2122/97
cuaggaacgccaccc

SEQ ID NO: 3192932 - RNA, 14 nt, Mycobacterium bovis subsp bovis AF2122/97
cuaggaccaccagc

SEQ ID NO: 3192933 - RNA, 20 nt, Mycobacterium bovis subsp bovis AF2122/97
cuaggaccgcgguggccaga

SEQ ID NO: 3192934 - RNA, 16 nt, Mycobacterium bovis subsp bovis AF2122/97
cuaggacgccgcccuc

SEQ ID NO: 3192935 - RNA, 17 nt, Mycobacterium bovis subsp bovis AF2122/97
cuaggacgccgcccucu

SEQ ID NO: 3192936 - RNA, 23 nt, Mycobacterium bovis subsp bovis AF2122/97
cuaggacgccgcccucucacggc

SEQ ID NO: 3192937 - RNA, 16 nt, Mycobacterium bovis subsp bovis AF2122/97
cuaggacggcugccgu

SEQ ID NO: 3192938 - RNA, 22 nt, Mycobacterium bovis subsp bovis AF2122/97
cuaggacggcugccgucagccg

SEQ ID NO: 3192939 - RNA, 20 nt, Mycobacterium bovis subsp bovis AF2122/97
cuaggaucggauggcggcca

SEQ ID NO: 3192940 - RNA, 21 nt, Mycobacterium bovis subsp bovis AF2122/97
cuaggaucggauggcggccac

SEQ ID NO: 3192941 - RNA, 16 nt, Mycobacterium bovis subsp bovis AF2122/97
cuaggcaugccacaca

SEQ ID NO: 3192942 - RNA, 14 nt, Mycobacterium bovis subsp bovis AF2122/97
cuaggccaaacccc

SEQ ID NO: 3192943 - RNA, 19 nt, Mycobacterium bovis subsp bovis AF2122/97
cuaggccaagccgcggcua

SEQ ID NO: 3192944 - RNA, 15 nt, Mycobacterium bovis subsp bovis AF2122/97
cuaggccaccggcga

SEQ ID NO: 3192945 - RNA, 16 nt, Mycobacterium bovis subsp bovis AF2122/97
cuaggccagcacggcg

SEQ ID NO: 3192946 - RNA, 15 nt, Mycobacterium bovis subsp bovis AF2122/97
cuaggccccaccauu

SEQ ID NO: 3192947 - RNA, 16 nt, Mycobacterium bovis subsp bovis AF2122/97
cuaggccccuggccgc

SEQ ID NO: 3192948 - RNA, 14 nt, Mycobacterium bovis subsp bovis AF2122/97
cuaggccucagaac

SEQ ID NO: 3192949 - RNA, 16 nt, Mycobacterium bovis subsp bovis AF2122/97
cuaggccucagaaccg

SEQ ID NO: 3192950 - RNA, 15 nt, Mycobacterium bovis subsp bovis AF2122/97
cuaggcgcuccuuca

SEQ ID NO: 3192951 - RNA, 18 nt, Mycobacterium bovis subsp bovis AF2122/97
cuagggaaaggcgccggu

SEQ ID NO: 3192952 - RNA, 14 nt, Mycobacterium bovis subsp bovis AF2122/97
cuagggcagcagcc

SEQ ID NO: 3192953 - RNA, 15 nt, Mycobacterium bovis subsp bovis AF2122/97
cuagggcagcagccc

SEQ ID NO: 3192954 - RNA, 23 nt, Mycobacterium bovis subsp bovis AF2122/97
cuagggcagcagcccgggcagcc

SEQ ID NO: 3192955 - RNA, 14 nt, Mycobacterium bovis subsp bovis AF2122/97
cuagggucaccgac

SEQ ID NO: 3192956 - RNA, 14 nt, Mycobacterium bovis subsp bovis AF2122/97
cuagggugagcccg

SEQ ID NO: 3192957 - RNA, 16 nt, Mycobacterium bovis subsp bovis AF2122/97
cuagggugagcccggg

SEQ ID NO: 3192958 - RNA, 13 nt, Mycobacterium bovis subsp bovis AF2122/97
cuaggucagcggg

SEQ ID NO: 3192959 - RNA, 19 nt, Mycobacterium bovis subsp bovis AF2122/97
cuagguccgaacuugacga

SEQ ID NO: 3192960 - RNA, 18 nt, Mycobacterium bovis subsp bovis AF2122/97
cuaggucgcgcugaaggu

SEQ ID NO: 3192961 - RNA, 16 nt, Mycobacterium bovis subsp bovis AF2122/97
cuaggugacgccgcca

SEQ ID NO: 3192962 - RNA, 21 nt, Mycobacterium bovis subsp bovis AF2122/97
cuagguggacgugcagccgca

SEQ ID NO: 3192963 - RNA, 13 nt, Mycobacterium bovis subsp bovis AF2122/97
cuagucaccuuga

SEQ ID NO: 3192964 - RNA, 19 nt, Mycobacterium bovis subsp bovis AF2122/97
cuaguccggcacugcggcc

SEQ ID NO: 3192965 - RNA, 12 nt, Mycobacterium bovis subsp bovis AF2122/97
cuagucgcggcc

SEQ ID NO: 3192966 - RNA, 13 nt, Mycobacterium bovis subsp bovis AF2122/97
cuagucgcggccg

SEQ ID NO: 3192967 - RNA, 17 nt, Mycobacterium bovis subsp bovis AF2122/97
cuagucguagacggcga

SEQ ID NO: 3192968 - RNA, 19 nt, Mycobacterium bovis subsp bovis AF2122/97
cuagugacugguauuuccc

SEQ ID NO: 3192969 - RNA, 23 nt, Mycobacterium bovis subsp bovis AF2122/97
cuagugccaggaucgcggcgccg

SEQ ID NO: 3192970 - RNA, 22 nt, Mycobacterium bovis subsp bovis AF2122/97
cuagugcgggccgugacccuca

SEQ ID NO: 3192971 - RNA, 19 nt, Mycobacterium bovis subsp bovis AF2122/97
cuaguucgagcugccaggc

SEQ ID NO: 3192972 - RNA, 20 nt, Mycobacterium bovis subsp bovis AF2122/97
cuaguugggugggugcagca

SEQ ID NO: 3192973 - RNA, 15 nt, Mycobacterium bovis subsp bovis AF2122/97
cuauaccgcuggggc

SEQ ID NO: 3192974 - RNA, 18 nt, Mycobacterium bovis subsp bovis AF2122/97
cuauacgcaacaggccaa

SEQ ID NO: 3192975 - RNA, 23 nt, Mycobacterium bovis subsp bovis AF2122/97
cuauaucccgccccgggccacca

SEQ ID NO: 3192976 - RNA, 19 nt, Mycobacterium bovis subsp bovis AF2122/97
cuaucagacgauucggcgg

SEQ ID NO: 3192977 - RNA, 15 nt, Mycobacterium bovis subsp bovis AF2122/97
cuauccggcggccag

SEQ ID NO: 3192978 - RNA, 23 nt, Mycobacterium bovis subsp bovis AF2122/97
cuauccuugguuagccgcggccc

SEQ ID NO: 3192979 - RNA, 23 nt, Mycobacterium bovis subsp bovis AF2122/97
cuaucgaggaggcggucgaucag

SEQ ID NO: 3192980 - RNA, 16 nt, Mycobacterium bovis subsp bovis AF2122/97
cuaucgcagaacggac

SEQ ID NO: 3192981 - RNA, 17 nt, Mycobacterium bovis subsp bovis AF2122/97
cuaucgcagaacggacc

SEQ ID NO: 3192982 - RNA, 14 nt, Mycobacterium bovis subsp bovis AF2122/97
cuaucgccgcgcgu

SEQ ID NO: 3192983 - RNA, 20 nt, Mycobacterium bovis subsp bovis AF2122/97
cuaucgggaagccgccgggc

SEQ ID NO: 3192984 - RNA, 16 nt, Mycobacterium bovis subsp bovis AF2122/97
cuaucgguucagcugc

SEQ ID NO: 3192985 - RNA, 20 nt, Mycobacterium bovis subsp bovis AF2122/97
cuaucguggcggcgucgaca

SEQ ID NO: 3192986 - RNA, 18 nt, Mycobacterium bovis subsp bovis AF2122/97
cuaucguuaucgacacca

SEQ ID NO: 3192987 - RNA, 23 nt, Mycobacterium bovis subsp bovis AF2122/97
cuaucguugugcggacaucaccg

SEQ ID NO: 3192988 - RNA, 17 nt, Mycobacterium bovis subsp bovis AF2122/97
cuaucuccaugcucgag

SEQ ID NO: 3192989 - RNA, 15 nt, Mycobacterium bovis subsp bovis AF2122/97
cuaucucgcucgacg

SEQ ID NO: 3192990 - RNA, 16 nt, Mycobacterium bovis subsp bovis AF2122/97
cuaugcguccaggcga

SEQ ID NO: 3192991 - RNA, 14 nt, Mycobacterium bovis subsp bovis AF2122/97
cuaugcugcccggc

SEQ ID NO: 3192992 - RNA, 13 nt, Mycobacterium bovis subsp bovis AF2122/97
cuaugcuggcagc

SEQ ID NO: 3192993 - RNA, 19 nt, Mycobacterium bovis subsp bovis AF2122/97
cuaugcuggcgcagcgcca

SEQ ID NO: 3192994 - RNA, 20 nt, Mycobacterium bovis subsp bovis AF2122/97
cuaugcuggcgcagcgccau

SEQ ID NO: 3192995 - RNA, 21 nt, Mycobacterium bovis subsp bovis AF2122/97
cuauggaugaccgaaccuggu

SEQ ID NO: 3192996 - RNA, 17 nt, Mycobacterium bovis subsp bovis AF2122/97
cuauggcaagcggccgc

SEQ ID NO: 3192997 - RNA, 19 nt, Mycobacterium bovis subsp bovis AF2122/97
cuauggcgccgcggcuggg

SEQ ID NO: 3192998 - RNA, 22 nt, Mycobacterium bovis subsp bovis AF2122/97
cuauggcggcuucgacgucggc

SEQ ID NO: 3192999 - RNA, 23 nt, Mycobacterium bovis subsp bovis AF2122/97
cuauggugccggugauggccgac

SEQ ID NO: 3193000 - RNA, 17 nt, Mycobacterium bovis subsp bovis AF2122/97
cuaugucauagcgcacc

SEQ ID NO: 3193001 - RNA, 18 nt, Mycobacterium bovis subsp bovis AF2122/97
cuaugucauagcgcacca

SEQ ID NO: 3193002 - RNA, 15 nt, Mycobacterium bovis subsp bovis AF2122/97
cuauuccaugucguc

SEQ ID NO: 3193003 - RNA, 23 nt, Mycobacterium bovis subsp bovis AF2122/97
cuauuccgaauuaccuugcgguu

SEQ ID NO: 3193004 - RNA, 20 nt, Mycobacterium bovis subsp bovis AF2122/97
cuauucgccagcgccggaug

SEQ ID NO: 3193005 - RNA, 13 nt, Mycobacterium bovis subsp bovis AF2122/97
cuauucggcggca

SEQ ID NO: 3193006 - RNA, 21 nt, Mycobacterium bovis subsp bovis AF2122/97
cuauuucgcggauuucucgcc

SEQ ID NO: 3193007 - RNA, 16 nt, Mycobacterium bovis subsp bovis AF2122/97
cuauuugccugccgcg

SEQ ID NO: 3193008 - RNA, 16 nt, Mycobacterium bovis subsp bovis AF2122/97
cuauuugcgaccccgc

SEQ ID NO: 3193009 - RNA, 14 nt, Mycobacterium bovis subsp bovis AF2122/97
cucaacaccagcaa

SEQ ID NO: 3193010 - RNA, 15 nt, Mycobacterium bovis subsp bovis AF2122/97
cucaacaccaggccg

SEQ ID NO: 3193011 - RNA, 16 nt, Mycobacterium bovis subsp bovis AF2122/97
cucaacaccaggccgu

SEQ ID NO: 3193012 - RNA, 20 nt, Mycobacterium bovis subsp bovis AF2122/97
cucaacaccaggccguccuc

SEQ ID NO: 3193013 - RNA, 16 nt, Mycobacterium bovis subsp bovis AF2122/97
cucaacacccggccga

SEQ ID NO: 3193014 - RNA, 18 nt, Mycobacterium bovis subsp bovis AF2122/97
cucaacacccggccgacc

SEQ ID NO: 3193015 - RNA, 18 nt, Mycobacterium bovis subsp bovis AF2122/97
cucaacaguucacgaccc

SEQ ID NO: 3193016 - RNA, 19 nt, Mycobacterium bovis subsp bovis AF2122/97
cucaaccaccucgccaaca

SEQ ID NO: 3193017 - RNA, 19 nt, Mycobacterium bovis subsp bovis AF2122/97
cucaaccagcagacgccgu

SEQ ID NO: 3193018 - RNA, 24 nt, Mycobacterium bovis subsp bovis AF2122/97
cucaaccagcagacgccguagccg

SEQ ID NO: 3193019 - RNA, 12 nt, Mycobacterium bovis subsp bovis AF2122/97
cucaaccccguc

SEQ ID NO: 3193020 - RNA, 15 nt, Mycobacterium bovis subsp bovis AF2122/97
cucaaccccguccuc

SEQ ID NO: 3193021 - RNA, 18 nt, Mycobacterium bovis subsp bovis AF2122/97
cucaacccgugcgacuuc

SEQ ID NO: 3193022 - RNA, 18 nt, Mycobacterium bovis subsp bovis AF2122/97
cucaaccucuggcggcgg

SEQ ID NO: 3193023 - RNA, 19 nt, Mycobacterium bovis subsp bovis AF2122/97
cucaaccugaaccggccgc

SEQ ID NO: 3193024 - RNA, 16 nt, Mycobacterium bovis subsp bovis AF2122/97
cucaacgacaccauag

SEQ ID NO: 3193025 - RNA, 22 nt, Mycobacterium bovis subsp bovis AF2122/97
cucaacgacaccauaggccgac

SEQ ID NO: 3193026 - RNA, 16 nt, Mycobacterium bovis subsp bovis AF2122/97
cucaacggcgacaucg

SEQ ID NO: 3193027 - RNA, 13 nt, Mycobacterium bovis subsp bovis AF2122/97
cucaacggcggca

SEQ ID NO: 3193028 - RNA, 16 nt, Mycobacterium bovis subsp bovis AF2122/97
cucaacggcggcaacg

SEQ ID NO: 3193029 - RNA, 13 nt, Mycobacterium bovis subsp bovis AF2122/97
cucaacgggccgc

SEQ ID NO: 3193030 - RNA, 14 nt, Mycobacterium bovis subsp bovis AF2122/97
cucaacgggccgca

SEQ ID NO: 3193031 - RNA, 17 nt, Mycobacterium bovis subsp bovis AF2122/97
cucaagauaacggcgac

SEQ ID NO: 3193032 - RNA, 15 nt, Mycobacterium bovis subsp bovis AF2122/97
cucaagauuuccauc

SEQ ID NO: 3193033 - RNA, 21 nt, Mycobacterium bovis subsp bovis AF2122/97
cucaagauuuccaucgcaaug

SEQ ID NO: 3193034 - RNA, 16 nt, Mycobacterium bovis subsp bovis AF2122/97
cucaagcaauggugcg

SEQ ID NO: 3193035 - RNA, 15 nt, Mycobacterium bovis subsp bovis AF2122/97
cucaaggacgcaccg

SEQ ID NO: 3193036 - RNA, 16 nt, Mycobacterium bovis subsp bovis AF2122/97
cucaaggcuucggcgg

SEQ ID NO: 3193037 - RNA, 20 nt, Mycobacterium bovis subsp bovis AF2122/97
cucaagggcaucaaccaacu

SEQ ID NO: 3193038 - RNA, 16 nt, Mycobacterium bovis subsp bovis AF2122/97
cucaagucucccggcc

SEQ ID NO: 3193039 - RNA, 19 nt, Mycobacterium bovis subsp bovis AF2122/97
cucaagucucccggccgca

SEQ ID NO: 3193040 - RNA, 18 nt, Mycobacterium bovis subsp bovis AF2122/97
cucaaguugggcguucag

SEQ ID NO: 3193041 - RNA, 15 nt, Mycobacterium bovis subsp bovis AF2122/97
cucacacuggcuuug

SEQ ID NO: 3193042 - RNA, 14 nt, Mycobacterium bovis subsp bovis AF2122/97
cucacagcacagcg

SEQ ID NO: 3193043 - RNA, 23 nt, Mycobacterium bovis subsp bovis AF2122/97
cucacagcacagcgcagccugca

SEQ ID NO: 3193044 - RNA, 22 nt, Mycobacterium bovis subsp bovis AF2122/97
cucacaugcccggacgauggcg

SEQ ID NO: 3193045 - RNA, 21 nt, Mycobacterium bovis subsp bovis AF2122/97
cucacaugugcgcgucgcgcg

SEQ ID NO: 3193046 - RNA, 16 nt, Mycobacterium bovis subsp bovis AF2122/97
cucacauuggccaggu

SEQ ID NO: 3193047 - RNA, 23 nt, Mycobacterium bovis subsp bovis AF2122/97
cucaccaaucugcgggccgguga

SEQ ID NO: 3193048 - RNA, 12 nt, Mycobacterium bovis subsp bovis AF2122/97
cucaccaccaga

SEQ ID NO: 3193049 - RNA, 18 nt, Mycobacterium bovis subsp bovis AF2122/97
cucaccacccagauugcc

SEQ ID NO: 3193050 - RNA, 20 nt, Mycobacterium bovis subsp bovis AF2122/97
cucaccacgaggcuugcggc

SEQ ID NO: 3193051 - RNA, 16 nt, Mycobacterium bovis subsp bovis AF2122/97
cucaccacgucgaccg

SEQ ID NO: 3193052 - RNA, 20 nt, Mycobacterium bovis subsp bovis AF2122/97
cucaccacgucgaccgaacc

SEQ ID NO: 3193053 - RNA, 16 nt, Mycobacterium bovis subsp bovis AF2122/97
cucaccagcggucagc

SEQ ID NO: 3193054 - RNA, 21 nt, Mycobacterium bovis subsp bovis AF2122/97
cucaccagcggucagccggcc

SEQ ID NO: 3193055 - RNA, 12 nt, Mycobacterium bovis subsp bovis AF2122/97
cucaccagcucc

SEQ ID NO: 3193056 - RNA, 20 nt, Mycobacterium bovis subsp bovis AF2122/97
cucaccaggcgagccggcgc

SEQ ID NO: 3193057 - RNA, 22 nt, Mycobacterium bovis subsp bovis AF2122/97
cucaccaggcgagccggcgcgc

SEQ ID NO: 3193058 - RNA, 12 nt, Mycobacterium bovis subsp bovis AF2122/97
cucaccagucag

SEQ ID NO: 3193059 - RNA, 21 nt, Mycobacterium bovis subsp bovis AF2122/97
cucaccaugggacacaaucca

SEQ ID NO: 3193060 - RNA, 15 nt, Mycobacterium bovis subsp bovis AF2122/97
cucacccagcucgcg

SEQ ID NO: 3193061 - RNA, 22 nt, Mycobacterium bovis subsp bovis AF2122/97
cucacccagcugggucccgcug

SEQ ID NO: 3193062 - RNA, 13 nt, Mycobacterium bovis subsp bovis AF2122/97
cucacccaggcgc

SEQ ID NO: 3193063 - RNA, 16 nt, Mycobacterium bovis subsp bovis AF2122/97
cucacccaggcgccga

SEQ ID NO: 3193064 - RNA, 20 nt, Mycobacterium bovis subsp bovis AF2122/97
cucacccaggcgccgauguc

SEQ ID NO: 3193065 - RNA, 21 nt, Mycobacterium bovis subsp bovis AF2122/97
cucacccgagccaucaccgca

SEQ ID NO: 3193066 - RNA, 12 nt, Mycobacterium bovis subsp bovis AF2122/97
cucacccgcccg

SEQ ID NO: 3193067 - RNA, 19 nt, Mycobacterium bovis subsp bovis AF2122/97
cucacccgcccggaacggg

SEQ ID NO: 3193068 - RNA, 23 nt, Mycobacterium bovis subsp bovis AF2122/97
cucacccgccgcgguuaucgccg

SEQ ID NO: 3193069 - RNA, 19 nt, Mycobacterium bovis subsp bovis AF2122/97
cucacccggcgucucgcag

SEQ ID NO: 3193070 - RNA, 14 nt, Mycobacterium bovis subsp bovis AF2122/97
cucacccgggcagc

SEQ ID NO: 3193071 - RNA, 22 nt, Mycobacterium bovis subsp bovis AF2122/97
cucacccugcucgaacgcugag

SEQ ID NO: 3193072 - RNA, 18 nt, Mycobacterium bovis subsp bovis AF2122/97
cucaccgaaacgaugcgg

SEQ ID NO: 3193073 - RNA, 19 nt, Mycobacterium bovis subsp bovis AF2122/97
cucaccgaucccgcggccg

SEQ ID NO: 3193074 - RNA, 20 nt, Mycobacterium bovis subsp bovis AF2122/97
cucaccgaucccgcggccgg

SEQ ID NO: 3193075 - RNA, 22 nt, Mycobacterium bovis subsp bovis AF2122/97
cucaccgaucccgcggccgggc

SEQ ID NO: 3193076 - RNA, 18 nt, Mycobacterium bovis subsp bovis AF2122/97
cucaccgaucucgaccag

SEQ ID NO: 3193077 - RNA, 11 nt, Mycobacterium bovis subsp bovis AF2122/97
cucaccgccgc

SEQ ID NO: 3193078 - RNA, 21 nt, Mycobacterium bovis subsp bovis AF2122/97
cucaccgccgcuaccgcccgc

SEQ ID NO: 3193079 - RNA, 12 nt, Mycobacterium bovis subsp bovis AF2122/97
cucaccggcgcc

SEQ ID NO: 3193080 - RNA, 16 nt, Mycobacterium bovis subsp bovis AF2122/97
cucaccggcgcccagc

SEQ ID NO: 3193081 - RNA, 20 nt, Mycobacterium bovis subsp bovis AF2122/97
cucaccggcuggugccaacu

SEQ ID NO: 3193082 - RNA, 19 nt, Mycobacterium bovis subsp bovis AF2122/97
cucaccgggcccgacgacg

SEQ ID NO: 3193083 - RNA, 22 nt, Mycobacterium bovis subsp bovis AF2122/97
cucaccgucgggguaauacgcg

SEQ ID NO: 3193084 - RNA, 19 nt, Mycobacterium bovis subsp bovis AF2122/97
cucaccgugaaccgcccgc

SEQ ID NO: 3193085 - RNA, 20 nt, Mycobacterium bovis subsp bovis AF2122/97
cucaccgugaaccgcccgcc

SEQ ID NO: 3193086 - RNA, 16 nt, Mycobacterium bovis subsp bovis AF2122/97
cucaccucaugaucuc

SEQ ID NO: 3193087 - RNA, 18 nt, Mycobacterium bovis subsp bovis AF2122/97
cucacgaagaccgcgucg

SEQ ID NO: 3193088 - RNA, 19 nt, Mycobacterium bovis subsp bovis AF2122/97
cucacgaagaccgcgucgg

SEQ ID NO: 3193089 - RNA, 13 nt, Mycobacterium bovis subsp bovis AF2122/97
cucacgaccggcc

SEQ ID NO: 3193090 - RNA, 14 nt, Mycobacterium bovis subsp bovis AF2122/97
cucacgagcaaacc

SEQ ID NO: 3193091 - RNA, 20 nt, Mycobacterium bovis subsp bovis AF2122/97
cucacgaggcacaaucaccg

SEQ ID NO: 3193092 - RNA, 18 nt, Mycobacterium bovis subsp bovis AF2122/97
cucacgaucacccgcacg

SEQ ID NO: 3193093 - RNA, 23 nt, Mycobacterium bovis subsp bovis AF2122/97
cucacgcaggaaaaccccggcca

SEQ ID NO: 3193094 - RNA, 19 nt, Mycobacterium bovis subsp bovis AF2122/97
cucacgcugaagccgcugg

SEQ ID NO: 3193095 - RNA, 21 nt, Mycobacterium bovis subsp bovis AF2122/97
cucacggauucgggcgaagcu

SEQ ID NO: 3193096 - RNA, 17 nt, Mycobacterium bovis subsp bovis AF2122/97
cucacggcauccgcuca

SEQ ID NO: 3193097 - RNA, 18 nt, Mycobacterium bovis subsp bovis AF2122/97
cucacgggcgaucgugcg

SEQ ID NO: 3193098 - RNA, 20 nt, Mycobacterium bovis subsp bovis AF2122/97
cucacgggcgaucgugcgga

SEQ ID NO: 3193099 - RNA, 21 nt, Mycobacterium bovis subsp bovis AF2122/97
cucacgucuaacacgcggucc

SEQ ID NO: 3193100 - RNA, 15 nt, Mycobacterium bovis subsp bovis AF2122/97
cucacgugcccgcgc

SEQ ID NO: 3193101 - RNA, 16 nt, Mycobacterium bovis subsp bovis AF2122/97
cucacgugcccgcgcg

SEQ ID NO: 3193102 - RNA, 17 nt, Mycobacterium bovis subsp bovis AF2122/97
cucacgugcccgcgcgg

SEQ ID NO: 3193103 - RNA, 19 nt, Mycobacterium bovis subsp bovis AF2122/97
cucacgugcccgcgcggcg

SEQ ID NO: 3193104 - RNA, 20 nt, Mycobacterium bovis subsp bovis AF2122/97
cucacgugcccgcgcggcgc

SEQ ID NO: 3193105 - RNA, 17 nt, Mycobacterium bovis subsp bovis AF2122/97
cucacguggacugaccu

SEQ ID NO: 3193106 - RNA, 22 nt, Mycobacterium bovis subsp bovis AF2122/97
cucacguggacugaccucguca

SEQ ID NO: 3193107 - RNA, 14 nt, Mycobacterium bovis subsp bovis AF2122/97
cucacugcagcgcc

SEQ ID NO: 3193108 - RNA, 20 nt, Mycobacterium bovis subsp bovis AF2122/97
cucacuggugacccugauga

SEQ ID NO: 3193109 - RNA, 22 nt, Mycobacterium bovis subsp bovis AF2122/97
cucacugugguaggccggggcg

SEQ ID NO: 3193110 - RNA, 14 nt, Mycobacterium bovis subsp bovis AF2122/97
cucacuucacgccg

SEQ ID NO: 3193111 - RNA, 16 nt, Mycobacterium bovis subsp bovis AF2122/97
cucacuucacgccgcc

SEQ ID NO: 3193112 - RNA, 17 nt, Mycobacterium bovis subsp bovis AF2122/97
cucacuucacgccgccc

SEQ ID NO: 3193113 - RNA, 20 nt, Mycobacterium bovis subsp bovis AF2122/97
cucagaccaaggcgaagguc

SEQ ID NO: 3193114 - RNA, 14 nt, Mycobacterium bovis subsp bovis AF2122/97
cucagaccggcgcc

SEQ ID NO: 3193115 - RNA, 20 nt, Mycobacterium bovis subsp bovis AF2122/97
cucagcacgcguucaacgaa

SEQ ID NO: 3193116 - RNA, 13 nt, Mycobacterium bovis subsp bovis AF2122/97
cucagccaccgcg

SEQ ID NO: 3193117 - RNA, 22 nt, Mycobacterium bovis subsp bovis AF2122/97
cucagccaccgcggucagcucg

SEQ ID NO: 3193118 - RNA, 12 nt, Mycobacterium bovis subsp bovis AF2122/97
cucagccaccgg

SEQ ID NO: 3193119 - RNA, 23 nt, Mycobacterium bovis subsp bovis AF2122/97
cucagccaucucuugcaaccugg

SEQ ID NO: 3193120 - RNA, 14 nt, Mycobacterium bovis subsp bovis AF2122/97
cucagcccgacacc

SEQ ID NO: 3193121 - RNA, 16 nt, Mycobacterium bovis subsp bovis AF2122/97
cucagcccggccagcc

SEQ ID NO: 3193122 - RNA, 19 nt, Mycobacterium bovis subsp bovis AF2122/97
cucagcccggccagccgca

SEQ ID NO: 3193123 - RNA, 12 nt, Mycobacterium bovis subsp bovis AF2122/97
cucagccgcgcc

SEQ ID NO: 3193124 - RNA, 13 nt, Mycobacterium bovis subsp bovis AF2122/97
cucagccgcggcc

SEQ ID NO: 3193125 - RNA, 12 nt, Mycobacterium bovis subsp bovis AF2122/97
cucagccguccg

SEQ ID NO: 3193126 - RNA, 12 nt, Mycobacterium bovis subsp bovis AF2122/97
cucagcgcggcc

SEQ ID NO: 3193127 - RNA, 17 nt, Mycobacterium bovis subsp bovis AF2122/97
cucagcgcggccacgcc

SEQ ID NO: 3193128 - RNA, 18 nt, Mycobacterium bovis subsp bovis AF2122/97
cucagcgcggccacgccg

SEQ ID NO: 3193129 - RNA, 12 nt, Mycobacterium bovis subsp bovis AF2122/97
cucagcggcgac

SEQ ID NO: 3193130 - RNA, 16 nt, Mycobacterium bovis subsp bovis AF2122/97
cucagcgguggcgugg

SEQ ID NO: 3193131 - RNA, 20 nt, Mycobacterium bovis subsp bovis AF2122/97
cucagcgguggcguggugga

SEQ ID NO: 3193132 - RNA, 13 nt, Mycobacterium bovis subsp bovis AF2122/97
cucagcgugcgcu

SEQ ID NO: 3193133 - RNA, 15 nt, Mycobacterium bovis subsp bovis AF2122/97
cucagcuagcgcggg

SEQ ID NO: 3193134 - RNA, 16 nt, Mycobacterium bovis subsp bovis AF2122/97
cucagcuccggcgacu

SEQ ID NO: 3193135 - RNA, 15 nt, Mycobacterium bovis subsp bovis AF2122/97
cucagcuggucggcu

SEQ ID NO: 3193136 - RNA, 22 nt, Mycobacterium bovis subsp bovis AF2122/97
cucaggacgaacgcuggcggcg

SEQ ID NO: 3193137 - RNA, 19 nt, Mycobacterium bovis subsp bovis AF2122/97
cucaggcaaucgcgggcga

SEQ ID NO: 3193138 - RNA, 14 nt, Mycobacterium bovis subsp bovis AF2122/97
cucaggccgguacc

SEQ ID NO: 3193139 - RNA, 20 nt, Mycobacterium bovis subsp bovis AF2122/97
cucaggccgguaccgggacg

SEQ ID NO: 3193140 - RNA, 21 nt, Mycobacterium bovis subsp bovis AF2122/97
cucaggccgguaccgggacga

SEQ ID NO: 3193141 - RNA, 16 nt, Mycobacterium bovis subsp bovis AF2122/97
cucagggugcgccgca

SEQ ID NO: 3193142 - RNA, 14 nt, Mycobacterium bovis subsp bovis AF2122/97
cucaggucaccggc

SEQ ID NO: 3193143 - RNA, 17 nt, Mycobacterium bovis subsp bovis AF2122/97
cucaggucaccggccgc

SEQ ID NO: 3193144 - RNA, 18 nt, Mycobacterium bovis subsp bovis AF2122/97
cucaggucaccggccgcc

SEQ ID NO: 3193145 - RNA, 12 nt, Mycobacterium bovis subsp bovis AF2122/97
cucaggucaucg

SEQ ID NO: 3193146 - RNA, 18 nt, Mycobacterium bovis subsp bovis AF2122/97
cucaggucaucggcggcg

SEQ ID NO: 3193147 - RNA, 15 nt, Mycobacterium bovis subsp bovis AF2122/97
cucaggucgcagacc

SEQ ID NO: 3193148 - RNA, 17 nt, Mycobacterium bovis subsp bovis AF2122/97
cucaggucgcagaccag

SEQ ID NO: 3193149 - RNA, 15 nt, Mycobacterium bovis subsp bovis AF2122/97
cucagguucagcuug

SEQ ID NO: 3193150 - RNA, 17 nt, Mycobacterium bovis subsp bovis AF2122/97
cucagugaugcgccccg

SEQ ID NO: 3193151 - RNA, 14 nt, Mycobacterium bovis subsp bovis AF2122/97
cucagugcucgccc

SEQ ID NO: 3193152 - RNA, 22 nt, Mycobacterium bovis subsp bovis AF2122/97
cucaguguacaccgcgcccgcc

SEQ ID NO: 3193153 - RNA, 21 nt, Mycobacterium bovis subsp bovis AF2122/97
cucaguucugcacagugcggc

SEQ ID NO: 3193154 - RNA, 18 nt, Mycobacterium bovis subsp bovis AF2122/97
cucaguuuggcgggugcg

SEQ ID NO: 3193155 - RNA, 23 nt, Mycobacterium bovis subsp bovis AF2122/97
cucauaccgggaggacaccagcu

SEQ ID NO: 3193156 - RNA, 23 nt, Mycobacterium bovis subsp bovis AF2122/97
cucauagcgacggcgcucggcga

SEQ ID NO: 3193157 - RNA, 15 nt, Mycobacterium bovis subsp bovis AF2122/97
cucauagugcagguc

SEQ ID NO: 3193158 - RNA, 23 nt, Mycobacterium bovis subsp bovis AF2122/97
cucaucaaacccccggggcgcuc

SEQ ID NO: 3193159 - RNA, 17 nt, Mycobacterium bovis subsp bovis AF2122/97
cucaucacccagcgccg

SEQ ID NO: 3193160 - RNA, 19 nt, Mycobacterium bovis subsp bovis AF2122/97
cucaucacccagcgccgac

SEQ ID NO: 3193161 - RNA, 22 nt, Mycobacterium bovis subsp bovis AF2122/97
cucauccaccgauggcgcgcuc

SEQ ID NO: 3193162 - RNA, 23 nt, Mycobacterium bovis subsp bovis AF2122/97
cucaucccgagaucaccuuggca

SEQ ID NO: 3193163 - RNA, 14 nt, Mycobacterium bovis subsp bovis AF2122/97
cucauccgccgggc

SEQ ID NO: 3193164 - RNA, 22 nt, Mycobacterium bovis subsp bovis AF2122/97
cucaucgaagcuucggccuucu

SEQ ID NO: 3193165 - RNA, 17 nt, Mycobacterium bovis subsp bovis AF2122/97
cucaucgaccgcggccg

SEQ ID NO: 3193166 - RNA, 23 nt, Mycobacterium bovis subsp bovis AF2122/97
cucaucgaucacacguccgcgca

SEQ ID NO: 3193167 - RNA, 13 nt, Mycobacterium bovis subsp bovis AF2122/97
cucaucgcagacg

SEQ ID NO: 3193168 - RNA, 20 nt, Mycobacterium bovis subsp bovis AF2122/97
cucaucgcagacggcugcca

SEQ ID NO: 3193169 - RNA, 17 nt, Mycobacterium bovis subsp bovis AF2122/97
cucaucgcgcacgcccu

SEQ ID NO: 3193170 - RNA, 15 nt, Mycobacterium bovis subsp bovis AF2122/97
cucaucgcgcccgcc

SEQ ID NO: 3193171 - RNA, 17 nt, Mycobacterium bovis subsp bovis AF2122/97
cucaucggacagcgccu

SEQ ID NO: 3193172 - RNA, 20 nt, Mycobacterium bovis subsp bovis AF2122/97
cucaucggacagcgccuggc

SEQ ID NO: 3193173 - RNA, 21 nt, Mycobacterium bovis subsp bovis AF2122/97
cucaucggccgcggucggcca

SEQ ID NO: 3193174 - RNA, 23 nt, Mycobacterium bovis subsp bovis AF2122/97
cucaucggccgcggucggccacc

SEQ ID NO: 3193175 - RNA, 17 nt, Mycobacterium bovis subsp bovis AF2122/97
cucaucggcgugcuugc

SEQ ID NO: 3193176 - RNA, 15 nt, Mycobacterium bovis subsp bovis AF2122/97
cucaucgugguaacc

SEQ ID NO: 3193177 - RNA, 22 nt, Mycobacterium bovis subsp bovis AF2122/97
cucaucugaggcuuccagcucg

SEQ ID NO: 3193178 - RNA, 19 nt, Mycobacterium bovis subsp bovis AF2122/97
cucaucuguaaccuccucg

SEQ ID NO: 3193179 - RNA, 15 nt, Mycobacterium bovis subsp bovis AF2122/97
cucaugaccgcucgg

SEQ ID NO: 3193180 - RNA, 17 nt, Mycobacterium bovis subsp bovis AF2122/97
cucaugcaucugcuucu

SEQ ID NO: 3193181 - RNA, 18 nt, Mycobacterium bovis subsp bovis AF2122/97
cucaugcccgacgagucg

SEQ ID NO: 3193182 - RNA, 16 nt, Mycobacterium bovis subsp bovis AF2122/97
cucaugccgagcgacc

SEQ ID NO: 3193183 - RNA, 13 nt, Mycobacterium bovis subsp bovis AF2122/97
cucaugcuggaag

SEQ ID NO: 3193184 - RNA, 20 nt, Mycobacterium bovis subsp bovis AF2122/97
cucaugggcgccaucccgcc

SEQ ID NO: 3193185 - RNA, 19 nt, Mycobacterium bovis subsp bovis AF2122/97
cucaugucgggcaacuuca

SEQ ID NO: 3193186 - RNA, 17 nt, Mycobacterium bovis subsp bovis AF2122/97
cucauuggcauugccca

SEQ ID NO: 3193187 - RNA, 19 nt, Mycobacterium bovis subsp bovis AF2122/97
cuccaaaagccucagccgc

SEQ ID NO: 3193188 - RNA, 16 nt, Mycobacterium bovis subsp bovis AF2122/97
cuccaaaaucgcggcc

SEQ ID NO: 3193189 - RNA, 19 nt, Mycobacterium bovis subsp bovis AF2122/97
cuccaaaaucgcggccaca

SEQ ID NO: 3193190 - RNA, 20 nt, Mycobacterium bovis subsp bovis AF2122/97
cuccaacaacuccagcaggu

SEQ ID NO: 3193191 - RNA, 19 nt, Mycobacterium bovis subsp bovis AF2122/97
cuccaagcaauuccaccgc

SEQ ID NO: 3193192 - RNA, 21 nt, Mycobacterium bovis subsp bovis AF2122/97
cuccaagcaauuccaccgccg

SEQ ID NO: 3193193 - RNA, 22 nt, Mycobacterium bovis subsp bovis AF2122/97
cuccaagccgggugggagcagc

SEQ ID NO: 3193194 - RNA, 14 nt, Mycobacterium bovis subsp bovis AF2122/97
cuccaagcucgaca

SEQ ID NO: 3193195 - RNA, 16 nt, Mycobacterium bovis subsp bovis AF2122/97
cuccaagcucgacaac

SEQ ID NO: 3193196 - RNA, 17 nt, Mycobacterium bovis subsp bovis AF2122/97
cuccaaggcggucacca

SEQ ID NO: 3193197 - RNA, 13 nt, Mycobacterium bovis subsp bovis AF2122/97
cuccaaguagcac

SEQ ID NO: 3193198 - RNA, 15 nt, Mycobacterium bovis subsp bovis AF2122/97
cuccaauugcggccg

SEQ ID NO: 3193199 - RNA, 18 nt, Mycobacterium bovis subsp bovis AF2122/97
cuccaauugcggccgcgc

SEQ ID NO: 3193200 - RNA, 18 nt, Mycobacterium bovis subsp bovis AF2122/97
cuccacacacugugcucg

SEQ ID NO: 3193201 - RNA, 18 nt, Mycobacterium bovis subsp bovis AF2122/97
cuccaccaacucgacgug

SEQ ID NO: 3193202 - RNA, 19 nt, Mycobacterium bovis subsp bovis AF2122/97
cuccaccaacucgacgugc

SEQ ID NO: 3193203 - RNA, 14 nt, Mycobacterium bovis subsp bovis AF2122/97
cuccaccaccgacg

SEQ ID NO: 3193204 - RNA, 14 nt, Mycobacterium bovis subsp bovis AF2122/97
cuccaccaccgucg

SEQ ID NO: 3193205 - RNA, 14 nt, Mycobacterium bovis subsp bovis AF2122/97
cuccaccacgaccg

SEQ ID NO: 3193206 - RNA, 22 nt, Mycobacterium bovis subsp bovis AF2122/97
cuccaccaggucgugcccggga

SEQ ID NO: 3193207 - RNA, 22 nt, Mycobacterium bovis subsp bovis AF2122/97
cuccaccagugccccgccgagc

SEQ ID NO: 3193208 - RNA, 14 nt, Mycobacterium bovis subsp bovis AF2122/97
cuccacccaggccg

SEQ ID NO: 3193209 - RNA, 14 nt, Mycobacterium bovis subsp bovis AF2122/97
cuccacccuugccg

SEQ ID NO: 3193210 - RNA, 15 nt, Mycobacterium bovis subsp bovis AF2122/97
cuccaccgccgcgcg

SEQ ID NO: 3193211 - RNA, 16 nt, Mycobacterium bovis subsp bovis AF2122/97
cuccaccgccgcgcgg

SEQ ID NO: 3193212 - RNA, 13 nt, Mycobacterium bovis subsp bovis AF2122/97
cuccaccgcgccg

SEQ ID NO: 3193213 - RNA, 15 nt, Mycobacterium bovis subsp bovis AF2122/97
cuccaccgcgccguc

SEQ ID NO: 3193214 - RNA, 14 nt, Mycobacterium bovis subsp bovis AF2122/97
cuccaccgcgucca

SEQ ID NO: 3193215 - RNA, 13 nt, Mycobacterium bovis subsp bovis AF2122/97
cuccaccgcuggc

SEQ ID NO: 3193216 - RNA, 16 nt, Mycobacterium bovis subsp bovis AF2122/97
cuccaccgggcccgcc

SEQ ID NO: 3193217 - RNA, 17 nt, Mycobacterium bovis subsp bovis AF2122/97
cuccaccgggcccgccg

SEQ ID NO: 3193218 - RNA, 19 nt, Mycobacterium bovis subsp bovis AF2122/97
cuccaccgggcccgccggc

SEQ ID NO: 3193219 - RNA, 20 nt, Mycobacterium bovis subsp bovis AF2122/97
cuccaccgggcccgccggcc

SEQ ID NO: 3193220 - RNA, 23 nt, Mycobacterium bovis subsp bovis AF2122/97
cuccaccgggcccgccggccccg

SEQ ID NO: 3193221 - RNA, 15 nt, Mycobacterium bovis subsp bovis AF2122/97
cuccaccgucgccgc

SEQ ID NO: 3193222 - RNA, 18 nt, Mycobacterium bovis subsp bovis AF2122/97
cuccaccgucgccgccgg

SEQ ID NO: 3193223 - RNA, 20 nt, Mycobacterium bovis subsp bovis AF2122/97
cuccacgaucggcccagccc

SEQ ID NO: 3193224 - RNA, 23 nt, Mycobacterium bovis subsp bovis AF2122/97
cuccacgcagcccgucggcgccg

SEQ ID NO: 3193225 - RNA, 16 nt, Mycobacterium bovis subsp bovis AF2122/97
cuccacgcuggcgccc

SEQ ID NO: 3193226 - RNA, 19 nt, Mycobacterium bovis subsp bovis AF2122/97
cuccacggcgggaacggug

SEQ ID NO: 3193227 - RNA, 15 nt, Mycobacterium bovis subsp bovis AF2122/97
cuccacggcggugcc

SEQ ID NO: 3193228 - RNA, 19 nt, Mycobacterium bovis subsp bovis AF2122/97
cuccacggucgggaccggc

SEQ ID NO: 3193229 - RNA, 19 nt, Mycobacterium bovis subsp bovis AF2122/97
cuccacguacgcggcugcg

SEQ ID NO: 3193230 - RNA, 13 nt, Mycobacterium bovis subsp bovis AF2122/97
cuccacguccggc

SEQ ID NO: 3193231 - RNA, 14 nt, Mycobacterium bovis subsp bovis AF2122/97
cuccacguccggcg

SEQ ID NO: 3193232 - RNA, 23 nt, Mycobacterium bovis subsp bovis AF2122/97
cuccacuuggggcgccagggucg

SEQ ID NO: 3193233 - RNA, 18 nt, Mycobacterium bovis subsp bovis AF2122/97
cuccacuuucugcgguca

SEQ ID NO: 3193234 - RNA, 19 nt, Mycobacterium bovis subsp bovis AF2122/97
cuccacuuuuccgccggcc

SEQ ID NO: 3193235 - RNA, 20 nt, Mycobacterium bovis subsp bovis AF2122/97
cuccagacguuccaucacgg

SEQ ID NO: 3193236 - RNA, 22 nt, Mycobacterium bovis subsp bovis AF2122/97
cuccagacguuccaucacggac

SEQ ID NO: 3193237 - RNA, 17 nt, Mycobacterium bovis subsp bovis AF2122/97
cuccagauacaggaaca

SEQ ID NO: 3193238 - RNA, 17 nt, Mycobacterium bovis subsp bovis AF2122/97
cuccagauaccaccgcc

SEQ ID NO: 3193239 - RNA, 15 nt, Mycobacterium bovis subsp bovis AF2122/97
cuccagauccacgcc

SEQ ID NO: 3193240 - RNA, 16 nt, Mycobacterium bovis subsp bovis AF2122/97
cuccagauccacgccg

SEQ ID NO: 3193241 - RNA, 24 nt, Mycobacterium bovis subsp bovis AF2122/97
cuccagcaaaacccgcuccacccc

SEQ ID NO: 3193242 - RNA, 16 nt, Mycobacterium bovis subsp bovis AF2122/97
cuccagcaaggccagc

SEQ ID NO: 3193243 - RNA, 18 nt, Mycobacterium bovis subsp bovis AF2122/97
cuccagcaaggccagcac

SEQ ID NO: 3193244 - RNA, 18 nt, Mycobacterium bovis subsp bovis AF2122/97
cuccagcaccaccggaac

SEQ ID NO: 3193245 - RNA, 16 nt, Mycobacterium bovis subsp bovis AF2122/97
cuccagcaccacggcg

SEQ ID NO: 3193246 - RNA, 18 nt, Mycobacterium bovis subsp bovis AF2122/97
cuccagcaccacggcgcg

SEQ ID NO: 3193247 - RNA, 14 nt, Mycobacterium bovis subsp bovis AF2122/97
cuccagcaccagca

SEQ ID NO: 3193248 - RNA, 21 nt, Mycobacterium bovis subsp bovis AF2122/97
cuccagcaccagcacggcaac

SEQ ID NO: 3193249 - RNA, 23 nt, Mycobacterium bovis subsp bovis AF2122/97
cuccagcacccgcugcacgccgu

SEQ ID NO: 3193250 - RNA, 17 nt, Mycobacterium bovis subsp bovis AF2122/97
cuccagcacccggucga

SEQ ID NO: 3193251 - RNA, 22 nt, Mycobacterium bovis subsp bovis AF2122/97
cuccagcacccggucgauucgg

SEQ ID NO: 3193252 - RNA, 13 nt, Mycobacterium bovis subsp bovis AF2122/97
cuccagcagcccg

SEQ ID NO: 3193253 - RNA, 20 nt, Mycobacterium bovis subsp bovis AF2122/97
cuccagcagcucgccggcac

SEQ ID NO: 3193254 - RNA, 21 nt, Mycobacterium bovis subsp bovis AF2122/97
cuccagcagcucgccggcacg

SEQ ID NO: 3193255 - RNA, 20 nt, Mycobacterium bovis subsp bovis AF2122/97
cuccagcagguccgcggccg

SEQ ID NO: 3193256 - RNA, 21 nt, Mycobacterium bovis subsp bovis AF2122/97
cuccagcaggucgccugcccc

SEQ ID NO: 3193257 - RNA, 15 nt, Mycobacterium bovis subsp bovis AF2122/97
cuccagccgcaacac

SEQ ID NO: 3193258 - RNA, 13 nt, Mycobacterium bovis subsp bovis AF2122/97
cuccagccgcgcg

SEQ ID NO: 3193259 - RNA, 22 nt, Mycobacterium bovis subsp bovis AF2122/97
cuccagcgaaccgacccggccg

SEQ ID NO: 3193260 - RNA, 17 nt, Mycobacterium bovis subsp bovis AF2122/97
cuccagcgcaccgguga

SEQ ID NO: 3193261 - RNA, 15 nt, Mycobacterium bovis subsp bovis AF2122/97
cuccagcgcccgguc

SEQ ID NO: 3193262 - RNA, 16 nt, Mycobacterium bovis subsp bovis AF2122/97
cuccagcgcccgguca

SEQ ID NO: 3193263 - RNA, 18 nt, Mycobacterium bovis subsp bovis AF2122/97
cuccagcgcgcgccgcag

SEQ ID NO: 3193264 - RNA, 19 nt, Mycobacterium bovis subsp bovis AF2122/97
cuccagcgcgcgccgcagc

SEQ ID NO: 3193265 - RNA, 20 nt, Mycobacterium bovis subsp bovis AF2122/97
cuccagcucggccagugccg

SEQ ID NO: 3193266 - RNA, 13 nt, Mycobacterium bovis subsp bovis AF2122/97
cuccagcucggcg

SEQ ID NO: 3193267 - RNA, 17 nt, Mycobacterium bovis subsp bovis AF2122/97
cuccagcugagcggccg

SEQ ID NO: 3193268 - RNA, 20 nt, Mycobacterium bovis subsp bovis AF2122/97
cuccagcugagcggccggca

SEQ ID NO: 3193269 - RNA, 18 nt, Mycobacterium bovis subsp bovis AF2122/97
cuccagcugcgcgggcga

SEQ ID NO: 3193270 - RNA, 23 nt, Mycobacterium bovis subsp bovis AF2122/97
cuccagcuugccgaccugcgcga

SEQ ID NO: 3193271 - RNA, 16 nt, Mycobacterium bovis subsp bovis AF2122/97
cuccaggagccgagga

SEQ ID NO: 3193272 - RNA, 14 nt, Mycobacterium bovis subsp bovis AF2122/97
cuccaggaucgccg

SEQ ID NO: 3193273 - RNA, 13 nt, Mycobacterium bovis subsp bovis AF2122/97
cuccaggcccggc

SEQ ID NO: 3193274 - RNA, 17 nt, Mycobacterium bovis subsp bovis AF2122/97
cuccaggccuaguccgg

SEQ ID NO: 3193275 - RNA, 18 nt, Mycobacterium bovis subsp bovis AF2122/97
cuccaggccuaguccggc

SEQ ID NO: 3193276 - RNA, 20 nt, Mycobacterium bovis subsp bovis AF2122/97
cuccaggccuaguccggcac

SEQ ID NO: 3193277 - RNA, 14 nt, Mycobacterium bovis subsp bovis AF2122/97
cuccaggcgccacc

SEQ ID NO: 3193278 - RNA, 18 nt, Mycobacterium bovis subsp bovis AF2122/97
cuccaggcgcgccgcacc

SEQ ID NO: 3193279 - RNA, 15 nt, Mycobacterium bovis subsp bovis AF2122/97
cuccagggcccugcu

SEQ ID NO: 3193280 - RNA, 21 nt, Mycobacterium bovis subsp bovis AF2122/97
cuccagggcccugcuggccca

SEQ ID NO: 3193281 - RNA, 22 nt, Mycobacterium bovis subsp bovis AF2122/97
cuccagguccacauccagggug

SEQ ID NO: 3193282 - RNA, 13 nt, Mycobacterium bovis subsp bovis AF2122/97
cuccaggucgaca

SEQ ID NO: 3193283 - RNA, 15 nt, Mycobacterium bovis subsp bovis AF2122/97
cuccaguagccggug

SEQ ID NO: 3193284 - RNA, 16 nt, Mycobacterium bovis subsp bovis AF2122/97
cuccaguagccggugc

SEQ ID NO: 3193285 - RNA, 17 nt, Mycobacterium bovis subsp bovis AF2122/97
cuccaguagccggugcc

SEQ ID NO: 3193286 - RNA, 20 nt, Mycobacterium bovis subsp bovis AF2122/97
cuccaguccuaucagugagc

SEQ ID NO: 3193287 - RNA, 12 nt, Mycobacterium bovis subsp bovis AF2122/97
cuccagugcggc

SEQ ID NO: 3193288 - RNA, 15 nt, Mycobacterium bovis subsp bovis AF2122/97
cuccagugcggccuu

SEQ ID NO: 3193289 - RNA, 20 nt, Mycobacterium bovis subsp bovis AF2122/97
cuccagugcggccuuggcga

SEQ ID NO: 3193290 - RNA, 14 nt, Mycobacterium bovis subsp bovis AF2122/97
cuccaguggcgcca

SEQ ID NO: 3193291 - RNA, 14 nt, Mycobacterium bovis subsp bovis AF2122/97
cuccaucagcgcga

SEQ ID NO: 3193292 - RNA, 16 nt, Mycobacterium bovis subsp bovis AF2122/97
cuccaucagcgcgacc

SEQ ID NO: 3193293 - RNA, 23 nt, Mycobacterium bovis subsp bovis AF2122/97
cuccaucgcgacaucgguggcgg

SEQ ID NO: 3193294 - RNA, 16 nt, Mycobacterium bovis subsp bovis AF2122/97
cuccaucgucggcaac

SEQ ID NO: 3193295 - RNA, 19 nt, Mycobacterium bovis subsp bovis AF2122/97
cuccaugaaucgcgcuuca

SEQ ID NO: 3193296 - RNA, 21 nt, Mycobacterium bovis subsp bovis AF2122/97
cucccaaaugucguaggccgc

SEQ ID NO: 3193297 - RNA, 18 nt, Mycobacterium bovis subsp bovis AF2122/97
cucccaccagcggcggcc

SEQ ID NO: 3193298 - RNA, 20 nt, Mycobacterium bovis subsp bovis AF2122/97
cucccacgccgccguugccg

SEQ ID NO: 3193299 - RNA, 18 nt, Mycobacterium bovis subsp bovis AF2122/97
cucccaggccgccgccag

SEQ ID NO: 3193300 - RNA, 18 nt, Mycobacterium bovis subsp bovis AF2122/97
cucccagggcucggcggc

SEQ ID NO: 3193301 - RNA, 19 nt, Mycobacterium bovis subsp bovis AF2122/97
cucccagggcucggcggcc

SEQ ID NO: 3193302 - RNA, 20 nt, Mycobacterium bovis subsp bovis AF2122/97
cucccagggcucggcggccc

SEQ ID NO: 3193303 - RNA, 13 nt, Mycobacterium bovis subsp bovis AF2122/97
cucccagugagca

SEQ ID NO: 3193304 - RNA, 21 nt, Mycobacterium bovis subsp bovis AF2122/97
cucccagugagcaugcgacgu

SEQ ID NO: 3193305 - RNA, 20 nt, Mycobacterium bovis subsp bovis AF2122/97
cucccaucccaugucgagga

SEQ ID NO: 3193306 - RNA, 21 nt, Mycobacterium bovis subsp bovis AF2122/97
cucccauucccaacacagccg

SEQ ID NO: 3193307 - RNA, 15 nt, Mycobacterium bovis subsp bovis AF2122/97
cuccccaagucgacg

SEQ ID NO: 3193308 - RNA, 20 nt, Mycobacterium bovis subsp bovis AF2122/97
cuccccaagucgacgguggc

SEQ ID NO: 3193309 - RNA, 21 nt, Mycobacterium bovis subsp bovis AF2122/97
cuccccaagucgacgguggcg

SEQ ID NO: 3193310 - RNA, 12 nt, Mycobacterium bovis subsp bovis AF2122/97
cucccccacaca

SEQ ID NO: 3193311 - RNA, 18 nt, Mycobacterium bovis subsp bovis AF2122/97
cucccccggcuccgcaac

SEQ ID NO: 3193312 - RNA, 19 nt, Mycobacterium bovis subsp bovis AF2122/97
cuccccgaccgccaccgcc

SEQ ID NO: 3193313 - RNA, 17 nt, Mycobacterium bovis subsp bovis AF2122/97
cuccccgaccgcgcccg

SEQ ID NO: 3193314 - RNA, 18 nt, Mycobacterium bovis subsp bovis AF2122/97
cuccccgaucagcaccga

SEQ ID NO: 3193315 - RNA, 19 nt, Mycobacterium bovis subsp bovis AF2122/97
cuccccgaucagcaccgac

SEQ ID NO: 3193316 - RNA, 20 nt, Mycobacterium bovis subsp bovis AF2122/97
cuccccgaucugcuccucgg

SEQ ID NO: 3193317 - RNA, 13 nt, Mycobacterium bovis subsp bovis AF2122/97
cuccccgccgggc

SEQ ID NO: 3193318 - RNA, 16 nt, Mycobacterium bovis subsp bovis AF2122/97
cuccccgcgcgcugau

SEQ ID NO: 3193319 - RNA, 18 nt, Mycobacterium bovis subsp bovis AF2122/97
cuccccgcuagcccacca

SEQ ID NO: 3193320 - RNA, 18 nt, Mycobacterium bovis subsp bovis AF2122/97
cuccccggauuccucguc

SEQ ID NO: 3193321 - RNA, 23 nt, Mycobacterium bovis subsp bovis AF2122/97
cuccccggauuccucgucaccgc

SEQ ID NO: 3193322 - RNA, 17 nt, Mycobacterium bovis subsp bovis AF2122/97
cucccgaaaagcgccuc

SEQ ID NO: 3193323 - RNA, 14 nt, Mycobacterium bovis subsp bovis AF2122/97
cucccgaccgccga

SEQ ID NO: 3193324 - RNA, 20 nt, Mycobacterium bovis subsp bovis AF2122/97
cucccgauucucgaucuggu

SEQ ID NO: 3193325 - RNA, 22 nt, Mycobacterium bovis subsp bovis AF2122/97
cucccgcaacauuuucgcccgc

SEQ ID NO: 3193326 - RNA, 21 nt, Mycobacterium bovis subsp bovis AF2122/97
cucccgcaaugcgagcgcgcc

SEQ ID NO: 3193327 - RNA, 16 nt, Mycobacterium bovis subsp bovis AF2122/97
cucccgccacugcugg

SEQ ID NO: 3193328 - RNA, 15 nt, Mycobacterium bovis subsp bovis AF2122/97
cucccgcgaucgcga

SEQ ID NO: 3193329 - RNA, 14 nt, Mycobacterium bovis subsp bovis AF2122/97
cucccgcgccggcg

SEQ ID NO: 3193330 - RNA, 20 nt, Mycobacterium bovis subsp bovis AF2122/97
cucccgcgcuuggcuccaca

SEQ ID NO: 3193331 - RNA, 18 nt, Mycobacterium bovis subsp bovis AF2122/97
cucccgcgguacgggggu

SEQ ID NO: 3193332 - RNA, 17 nt, Mycobacterium bovis subsp bovis AF2122/97
cucccgcgugcggggga

SEQ ID NO: 3193333 - RNA, 12 nt, Mycobacterium bovis subsp bovis AF2122/97
cucccggccgcc

SEQ ID NO: 3193334 - RNA, 22 nt, Mycobacterium bovis subsp bovis AF2122/97
cucccgggugcgacgcgaccgc

SEQ ID NO: 3193335 - RNA, 19 nt, Mycobacterium bovis subsp bovis AF2122/97
cucccgguugggguggcgg

SEQ ID NO: 3193336 - RNA, 23 nt, Mycobacterium bovis subsp bovis AF2122/97
cucccgguugggguggcggugcc

SEQ ID NO: 3193337 - RNA, 15 nt, Mycobacterium bovis subsp bovis AF2122/97
cucccgucucgacag

SEQ ID NO: 3193338 - RNA, 13 nt, Mycobacterium bovis subsp bovis AF2122/97
cucccgugcuggc

SEQ ID NO: 3193339 - RNA, 22 nt, Mycobacterium bovis subsp bovis AF2122/97
cucccuacgagcccacgcgcca

SEQ ID NO: 3193340 - RNA, 16 nt, Mycobacterium bovis subsp bovis AF2122/97
cucccucgaucacggc

SEQ ID NO: 3193341 - RNA, 21 nt, Mycobacterium bovis subsp bovis AF2122/97
cucccucgaucacggcggccc

SEQ ID NO: 3193342 - RNA, 17 nt, Mycobacterium bovis subsp bovis AF2122/97
cucccucuacacccgga

SEQ ID NO: 3193343 - RNA, 12 nt, Mycobacterium bovis subsp bovis AF2122/97
cucccugggcgu

SEQ ID NO: 3193344 - RNA, 18 nt, Mycobacterium bovis subsp bovis AF2122/97
cucccugggcgucgacca

SEQ ID NO: 3193345 - RNA, 15 nt, Mycobacterium bovis subsp bovis AF2122/97
cucccuggggccguc

SEQ ID NO: 3193346 - RNA, 13 nt, Mycobacterium bovis subsp bovis AF2122/97
cucccuuccgcgc

SEQ ID NO: 3193347 - RNA, 16 nt, Mycobacterium bovis subsp bovis AF2122/97
cucccuuccgcgcuuc

SEQ ID NO: 3193348 - RNA, 22 nt, Mycobacterium bovis subsp bovis AF2122/97
cuccgaaaucgucaguaccgca

SEQ ID NO: 3193349 - RNA, 18 nt, Mycobacterium bovis subsp bovis AF2122/97
cuccgaacauggccagca

SEQ ID NO: 3193350 - RNA, 15 nt, Mycobacterium bovis subsp bovis AF2122/97
cuccgaaggccgcca

SEQ ID NO: 3193351 - RNA, 16 nt, Mycobacterium bovis subsp bovis AF2122/97
cuccgaaguccacgca

SEQ ID NO: 3193352 - RNA, 23 nt, Mycobacterium bovis subsp bovis AF2122/97
cuccgacgcgaucuguccgcgaa

SEQ ID NO: 3193353 - RNA, 14 nt, Mycobacterium bovis subsp bovis AF2122/97
cuccgacgggcgaa

SEQ ID NO: 3193354 - RNA, 14 nt, Mycobacterium bovis subsp bovis AF2122/97
cuccgacggggguc

SEQ ID NO: 3193355 - RNA, 20 nt, Mycobacterium bovis subsp bovis AF2122/97
cuccgacgggggucgggcgu

SEQ ID NO: 3193356 - RNA, 20 nt, Mycobacterium bovis subsp bovis AF2122/97
cuccgacucgauauaacccg

SEQ ID NO: 3193357 - RNA, 21 nt, Mycobacterium bovis subsp bovis AF2122/97
cuccgacucgauauaacccgg

SEQ ID NO: 3193358 - RNA, 22 nt, Mycobacterium bovis subsp bovis AF2122/97
cuccgacucgauauaacccggc

SEQ ID NO: 3193359 - RNA, 20 nt, Mycobacterium bovis subsp bovis AF2122/97
cuccgagcacaggaucaccc

SEQ ID NO: 3193360 - RNA, 14 nt, Mycobacterium bovis subsp bovis AF2122/97
cuccgaggccgcca

SEQ ID NO: 3193361 - RNA, 16 nt, Mycobacterium bovis subsp bovis AF2122/97
cuccgagggcugcgug

SEQ ID NO: 3193362 - RNA, 20 nt, Mycobacterium bovis subsp bovis AF2122/97
cuccgauccacauggugacc

SEQ ID NO: 3193363 - RNA, 15 nt, Mycobacterium bovis subsp bovis AF2122/97
cuccgaucgggccca

SEQ ID NO: 3193364 - RNA, 18 nt, Mycobacterium bovis subsp bovis AF2122/97
cuccgaugccgacggcgc

SEQ ID NO: 3193365 - RNA, 20 nt, Mycobacterium bovis subsp bovis AF2122/97
cuccgaugccgacggcgccc

SEQ ID NO: 3193366 - RNA, 23 nt, Mycobacterium bovis subsp bovis AF2122/97
cuccgaugugccgauuggccugc

SEQ ID NO: 3193367 - RNA, 21 nt, Mycobacterium bovis subsp bovis AF2122/97
cuccgcaaucgcgacgggguc

SEQ ID NO: 3193368 - RNA, 16 nt, Mycobacterium bovis subsp bovis AF2122/97
cuccgcagcgaagacc

SEQ ID NO: 3193369 - RNA, 23 nt, Mycobacterium bovis subsp bovis AF2122/97
cuccgcagcgaagaccagcggcg

SEQ ID NO: 3193370 - RNA, 12 nt, Mycobacterium bovis subsp bovis AF2122/97
cuccgcagcuau

SEQ ID NO: 3193371 - RNA, 16 nt, Mycobacterium bovis subsp bovis AF2122/97
cuccgccaaggaggcc

SEQ ID NO: 3193372 - RNA, 20 nt, Mycobacterium bovis subsp bovis AF2122/97
cuccgccagaauugccggcg

SEQ ID NO: 3193373 - RNA, 15 nt, Mycobacterium bovis subsp bovis AF2122/97
cuccgcccgcgggcc

SEQ ID NO: 3193374 - RNA, 16 nt, Mycobacterium bovis subsp bovis AF2122/97
cuccgcccgcgggccc

SEQ ID NO: 3193375 - RNA, 22 nt, Mycobacterium bovis subsp bovis AF2122/97
cuccgcccggcgugucgccgcc

SEQ ID NO: 3193376 - RNA, 17 nt, Mycobacterium bovis subsp bovis AF2122/97
cuccgccgaggaaacca

SEQ ID NO: 3193377 - RNA, 20 nt, Mycobacterium bovis subsp bovis AF2122/97
cuccgccgaggaaaccacca

SEQ ID NO: 3193378 - RNA, 14 nt, Mycobacterium bovis subsp bovis AF2122/97
cuccgccgcgggcu

SEQ ID NO: 3193379 - RNA, 21 nt, Mycobacterium bovis subsp bovis AF2122/97
cuccgccgcgggcuccccggc

SEQ ID NO: 3193380 - RNA, 23 nt, Mycobacterium bovis subsp bovis AF2122/97
cuccgccgcgggcuccccggcaa

SEQ ID NO: 3193381 - RNA, 12 nt, Mycobacterium bovis subsp bovis AF2122/97
cuccgccgguca

SEQ ID NO: 3193382 - RNA, 20 nt, Mycobacterium bovis subsp bovis AF2122/97
cuccgccggucaugauccga

SEQ ID NO: 3193383 - RNA, 21 nt, Mycobacterium bovis subsp bovis AF2122/97
cuccgccggucccgcgugcca

SEQ ID NO: 3193384 - RNA, 15 nt, Mycobacterium bovis subsp bovis AF2122/97
cuccgccgucgccgc

SEQ ID NO: 3193385 - RNA, 16 nt, Mycobacterium bovis subsp bovis AF2122/97
cuccgccgugaguuca

SEQ ID NO: 3193386 - RNA, 14 nt, Mycobacterium bovis subsp bovis AF2122/97
cuccgccguugacg

SEQ ID NO: 3193387 - RNA, 23 nt, Mycobacterium bovis subsp bovis AF2122/97
cuccgccguugacgccguugcca

SEQ ID NO: 3193388 - RNA, 15 nt, Mycobacterium bovis subsp bovis AF2122/97
cuccgccguugccgc

SEQ ID NO: 3193389 - RNA, 17 nt, Mycobacterium bovis subsp bovis AF2122/97
cuccgccguugccgccg

SEQ ID NO: 3193390 - RNA, 15 nt, Mycobacterium bovis subsp bovis AF2122/97
cuccgcgagcccggc

SEQ ID NO: 3193391 - RNA, 19 nt, Mycobacterium bovis subsp bovis AF2122/97
cuccgcgagcccggccucg

SEQ ID NO: 3193392 - RNA, 13 nt, Mycobacterium bovis subsp bovis AF2122/97
cuccgcgauccgc

SEQ ID NO: 3193393 - RNA, 18 nt, Mycobacterium bovis subsp bovis AF2122/97
cuccgcggaacccagcac

SEQ ID NO: 3193394 - RNA, 20 nt, Mycobacterium bovis subsp bovis AF2122/97
cuccgcggcgaaccagcgcg

SEQ ID NO: 3193395 - RNA, 15 nt, Mycobacterium bovis subsp bovis AF2122/97
cuccgcggcgcagca

SEQ ID NO: 3193396 - RNA, 23 nt, Mycobacterium bovis subsp bovis AF2122/97
cuccgcggcgcagcacggcggcc

SEQ ID NO: 3193397 - RNA, 15 nt, Mycobacterium bovis subsp bovis AF2122/97
cuccgcggcgcgcaa

SEQ ID NO: 3193398 - RNA, 21 nt, Mycobacterium bovis subsp bovis AF2122/97
cuccgcggcucaaucuccucc

SEQ ID NO: 3193399 - RNA, 20 nt, Mycobacterium bovis subsp bovis AF2122/97
cuccgcguccaaggcgcgcu

SEQ ID NO: 3193400 - RNA, 17 nt, Mycobacterium bovis subsp bovis AF2122/97
cuccgcguccgccaaug

SEQ ID NO: 3193401 - RNA, 16 nt, Mycobacterium bovis subsp bovis AF2122/97
cuccgcgucggucagc

SEQ ID NO: 3193402 - RNA, 15 nt, Mycobacterium bovis subsp bovis AF2122/97
cuccgcguugggcac

SEQ ID NO: 3193403 - RNA, 21 nt, Mycobacterium bovis subsp bovis AF2122/97
cuccgcucgguaccggucgac

SEQ ID NO: 3193404 - RNA, 18 nt, Mycobacterium bovis subsp bovis AF2122/97
cuccgcugaugagccgca

SEQ ID NO: 3193405 - RNA, 19 nt, Mycobacterium bovis subsp bovis AF2122/97
cuccgcugaugagccgcag

SEQ ID NO: 3193406 - RNA, 12 nt, Mycobacterium bovis subsp bovis AF2122/97
cuccgcugccgc

SEQ ID NO: 3193407 - RNA, 15 nt, Mycobacterium bovis subsp bovis AF2122/97
cuccgcugccgcccg

SEQ ID NO: 3193408 - RNA, 17 nt, Mycobacterium bovis subsp bovis AF2122/97
cuccggaaagcucucgg

SEQ ID NO: 3193409 - RNA, 22 nt, Mycobacterium bovis subsp bovis AF2122/97
cuccggaaccacucgcucagga

SEQ ID NO: 3193410 - RNA, 19 nt, Mycobacterium bovis subsp bovis AF2122/97
cuccggacaccccgcacgg

SEQ ID NO: 3193411 - RNA, 13 nt, Mycobacterium bovis subsp bovis AF2122/97
cuccggacgcacg

SEQ ID NO: 3193412 - RNA, 22 nt, Mycobacterium bovis subsp bovis AF2122/97
cuccggauugcuguacugcggu

SEQ ID NO: 3193413 - RNA, 23 nt, Mycobacterium bovis subsp bovis AF2122/97
cuccggauugcuguacugcggug

SEQ ID NO: 3193414 - RNA, 16 nt, Mycobacterium bovis subsp bovis AF2122/97
cuccggcaacagcacc

SEQ ID NO: 3193415 - RNA, 16 nt, Mycobacterium bovis subsp bovis AF2122/97
cuccggcaagcacacc

SEQ ID NO: 3193416 - RNA, 17 nt, Mycobacterium bovis subsp bovis AF2122/97
cuccggcaagcacaccg

SEQ ID NO: 3193417 - RNA, 23 nt, Mycobacterium bovis subsp bovis AF2122/97
cuccggcaagcacaccgccagcg

SEQ ID NO: 3193418 - RNA, 18 nt, Mycobacterium bovis subsp bovis AF2122/97
cuccggcaccaacgccac

SEQ ID NO: 3193419 - RNA, 14 nt, Mycobacterium bovis subsp bovis AF2122/97
cuccggcaccggca

SEQ ID NO: 3193420 - RNA, 22 nt, Mycobacterium bovis subsp bovis AF2122/97
cuccggccacacucgccagggc

SEQ ID NO: 3193421 - RNA, 17 nt, Mycobacterium bovis subsp bovis AF2122/97
cuccggcccugccgccg

SEQ ID NO: 3193422 - RNA, 18 nt, Mycobacterium bovis subsp bovis AF2122/97
cuccggcccugccgccgg

SEQ ID NO: 3193423 - RNA, 19 nt, Mycobacterium bovis subsp bovis AF2122/97
cuccggccgcacgccgacc

SEQ ID NO: 3193424 - RNA, 20 nt, Mycobacterium bovis subsp bovis AF2122/97
cuccggccgcacgccgacca

SEQ ID NO: 3193425 - RNA, 21 nt, Mycobacterium bovis subsp bovis AF2122/97
cuccggccgcacgccuacgau

SEQ ID NO: 3193426 - RNA, 18 nt, Mycobacterium bovis subsp bovis AF2122/97
cuccggccgcguuggggu

SEQ ID NO: 3193427 - RNA, 13 nt, Mycobacterium bovis subsp bovis AF2122/97
cuccggccggcca

SEQ ID NO: 3193428 - RNA, 20 nt, Mycobacterium bovis subsp bovis AF2122/97
cuccggcgacgaucucgccg

SEQ ID NO: 3193429 - RNA, 16 nt, Mycobacterium bovis subsp bovis AF2122/97
cuccggcgcaccuggg

SEQ ID NO: 3193430 - RNA, 20 nt, Mycobacterium bovis subsp bovis AF2122/97
cuccggcgcaccugggcugc

SEQ ID NO: 3193431 - RNA, 21 nt, Mycobacterium bovis subsp bovis AF2122/97
cuccggcgcaccugggcugcc

SEQ ID NO: 3193432 - RNA, 13 nt, Mycobacterium bovis subsp bovis AF2122/97
cuccggcgccacc

SEQ ID NO: 3193433 - RNA, 14 nt, Mycobacterium bovis subsp bovis AF2122/97
cuccggcgccaccg

SEQ ID NO: 3193434 - RNA, 16 nt, Mycobacterium bovis subsp bovis AF2122/97
cuccggcggcagcggc

SEQ ID NO: 3193435 - RNA, 20 nt, Mycobacterium bovis subsp bovis AF2122/97
cuccggcggcagcggcgccg

SEQ ID NO: 3193436 - RNA, 22 nt, Mycobacterium bovis subsp bovis AF2122/97
cuccggcggcagcggcgccgcc

SEQ ID NO: 3193437 - RNA, 22 nt, Mycobacterium bovis subsp bovis AF2122/97
cuccggcggcgaagaagccggc

SEQ ID NO: 3193438 - RNA, 13 nt, Mycobacterium bovis subsp bovis AF2122/97
cuccggcggugcc

SEQ ID NO: 3193439 - RNA, 17 nt, Mycobacterium bovis subsp bovis AF2122/97
cuccggcggugccgucg

SEQ ID NO: 3193440 - RNA, 17 nt, Mycobacterium bovis subsp bovis AF2122/97
cuccggcgucggcggcc

SEQ ID NO: 3193441 - RNA, 22 nt, Mycobacterium bovis subsp bovis AF2122/97
cuccggcguggcuuguucggac

SEQ ID NO: 3193442 - RNA, 19 nt, Mycobacterium bovis subsp bovis AF2122/97
cuccggcucgacaacaucg

SEQ ID NO: 3193443 - RNA, 23 nt, Mycobacterium bovis subsp bovis AF2122/97
cuccgggaugaagcucgaccgcc

SEQ ID NO: 3193444 - RNA, 14 nt, Mycobacterium bovis subsp bovis AF2122/97
cuccgggaugucga

SEQ ID NO: 3193445 - RNA, 11 nt, Mycobacterium bovis subsp bovis AF2122/97
cuccgggcgca

SEQ ID NO: 3193446 - RNA, 14 nt, Mycobacterium bovis subsp bovis AF2122/97
cuccgggcgcacca

SEQ ID NO: 3193447 - RNA, 14 nt, Mycobacterium bovis subsp bovis AF2122/97
cuccgggucgacga

SEQ ID NO: 3193448 - RNA, 18 nt, Mycobacterium bovis subsp bovis AF2122/97
cuccgggucgaugucggg

SEQ ID NO: 3193449 - RNA, 14 nt, Mycobacterium bovis subsp bovis AF2122/97
cuccgguaucggcg

SEQ ID NO: 3193450 - RNA, 15 nt, Mycobacterium bovis subsp bovis AF2122/97
cuccggucagcgcgg

SEQ ID NO: 3193451 - RNA, 17 nt, Mycobacterium bovis subsp bovis AF2122/97
cuccggugaucaccgac

SEQ ID NO: 3193452 - RNA, 23 nt, Mycobacterium bovis subsp bovis AF2122/97
cuccggugcauauuggaucgucg

SEQ ID NO: 3193453 - RNA, 16 nt, Mycobacterium bovis subsp bovis AF2122/97
cuccggugccggcaac

SEQ ID NO: 3193454 - RNA, 16 nt, Mycobacterium bovis subsp bovis AF2122/97
cuccggugcgcagcca

SEQ ID NO: 3193455 - RNA, 15 nt, Mycobacterium bovis subsp bovis AF2122/97
cuccgguggccaaca

SEQ ID NO: 3193456 - RNA, 22 nt, Mycobacterium bovis subsp bovis AF2122/97
cuccgguguguuuggcaugguc

SEQ ID NO: 3193457 - RNA, 20 nt, Mycobacterium bovis subsp bovis AF2122/97
cuccguaaacgaggucgccg

SEQ ID NO: 3193458 - RNA, 23 nt, Mycobacterium bovis subsp bovis AF2122/97
cuccguaacgccaagcucggccc

SEQ ID NO: 3193459 - RNA, 16 nt, Mycobacterium bovis subsp bovis AF2122/97
cuccgucagcgccgcg

SEQ ID NO: 3193460 - RNA, 13 nt, Mycobacterium bovis subsp bovis AF2122/97
cuccgucgcggcc

SEQ ID NO: 3193461 - RNA, 14 nt, Mycobacterium bovis subsp bovis AF2122/97
cuccgucgcggccg

SEQ ID NO: 3193462 - RNA, 19 nt, Mycobacterium bovis subsp bovis AF2122/97
cuccgucggccaggccacg

SEQ ID NO: 3193463 - RNA, 23 nt, Mycobacterium bovis subsp bovis AF2122/97
cuccgugacaccggggacgucga

SEQ ID NO: 3193464 - RNA, 14 nt, Mycobacterium bovis subsp bovis AF2122/97
cuccgugagccgga

SEQ ID NO: 3193465 - RNA, 15 nt, Mycobacterium bovis subsp bovis AF2122/97
cuccgugaucgaggc

SEQ ID NO: 3193466 - RNA, 19 nt, Mycobacterium bovis subsp bovis AF2122/97
cuccgugaucgaggcggcg

SEQ ID NO: 3193467 - RNA, 20 nt, Mycobacterium bovis subsp bovis AF2122/97
cuccgugaucgaggcggcgg

SEQ ID NO: 3193468 - RNA, 12 nt, Mycobacterium bovis subsp bovis AF2122/97
cuccgugccgag

SEQ ID NO: 3193469 - RNA, 18 nt, Mycobacterium bovis subsp bovis AF2122/97
cuccgugggcagcgcgcc

SEQ ID NO: 3193470 - RNA, 14 nt, Mycobacterium bovis subsp bovis AF2122/97
cuccguugccccca

SEQ ID NO: 3193471 - RNA, 20 nt, Mycobacterium bovis subsp bovis AF2122/97
cuccguugcccccauugccg

SEQ ID NO: 3193472 - RNA, 15 nt, Mycobacterium bovis subsp bovis AF2122/97
cuccuaucugccggu

SEQ ID NO: 3193473 - RNA, 15 nt, Mycobacterium bovis subsp bovis AF2122/97
cuccucagccaccgc

SEQ ID NO: 3193474 - RNA, 19 nt, Mycobacterium bovis subsp bovis AF2122/97
cuccucagccaccgcgguc

SEQ ID NO: 3193475 - RNA, 13 nt, Mycobacterium bovis subsp bovis AF2122/97
cuccucagccgcc

SEQ ID NO: 3193476 - RNA, 20 nt, Mycobacterium bovis subsp bovis AF2122/97
cuccucauagagcggcacca

SEQ ID NO: 3193477 - RNA, 19 nt, Mycobacterium bovis subsp bovis AF2122/97
cuccuccaccagugccccg

SEQ ID NO: 3193478 - RNA, 21 nt, Mycobacterium bovis subsp bovis AF2122/97
cuccuccaccagugccccgcc

SEQ ID NO: 3193479 - RNA, 15 nt, Mycobacterium bovis subsp bovis AF2122/97
cuccuccccgaccgc

SEQ ID NO: 3193480 - RNA, 16 nt, Mycobacterium bovis subsp bovis AF2122/97
cuccuccccggcccgc

SEQ ID NO: 3193481 - RNA, 17 nt, Mycobacterium bovis subsp bovis AF2122/97
cuccuccgacagggccu

SEQ ID NO: 3193482 - RNA, 18 nt, Mycobacterium bovis subsp bovis AF2122/97
cuccuccggaaagcucuc

SEQ ID NO: 3193483 - RNA, 20 nt, Mycobacterium bovis subsp bovis AF2122/97
cuccuccguuuggcugccga

SEQ ID NO: 3193484 - RNA, 18 nt, Mycobacterium bovis subsp bovis AF2122/97
cuccuccuugagccgggc

SEQ ID NO: 3193485 - RNA, 16 nt, Mycobacterium bovis subsp bovis AF2122/97
cuccucgaccagagcc

SEQ ID NO: 3193486 - RNA, 18 nt, Mycobacterium bovis subsp bovis AF2122/97
cuccucgaccguggcggc

SEQ ID NO: 3193487 - RNA, 15 nt, Mycobacterium bovis subsp bovis AF2122/97
cuccucgcgggcggc

SEQ ID NO: 3193488 - RNA, 16 nt, Mycobacterium bovis subsp bovis AF2122/97
cuccucgcgggcggcg

SEQ ID NO: 3193489 - RNA, 14 nt, Mycobacterium bovis subsp bovis AF2122/97
cuccucggccagcg

SEQ ID NO: 3193490 - RNA, 12 nt, Mycobacterium bovis subsp bovis AF2122/97
cuccucggcgcg

SEQ ID NO: 3193491 - RNA, 20 nt, Mycobacterium bovis subsp bovis AF2122/97
cuccucggcguggcaguaca

SEQ ID NO: 3193492 - RNA, 22 nt, Mycobacterium bovis subsp bovis AF2122/97
cuccucggugugcucgccgacc

SEQ ID NO: 3193493 - RNA, 14 nt, Mycobacterium bovis subsp bovis AF2122/97
cuccucgucgacgu

SEQ ID NO: 3193494 - RNA, 19 nt, Mycobacterium bovis subsp bovis AF2122/97
cuccucgucgacgucggca

SEQ ID NO: 3193495 - RNA, 20 nt, Mycobacterium bovis subsp bovis AF2122/97
cuccucgucgcucccgguug

SEQ ID NO: 3193496 - RNA, 21 nt, Mycobacterium bovis subsp bovis AF2122/97
cuccucgucgguuccgggcgc

SEQ ID NO: 3193497 - RNA, 15 nt, Mycobacterium bovis subsp bovis AF2122/97
cuccucgugcacgca

SEQ ID NO: 3193498 - RNA, 17 nt, Mycobacterium bovis subsp bovis AF2122/97
cuccucgugcacgcaca

SEQ ID NO: 3193499 - RNA, 23 nt, Mycobacterium bovis subsp bovis AF2122/97
cuccucgugcacgcacagcccga

SEQ ID NO: 3193500 - RNA, 17 nt, Mycobacterium bovis subsp bovis AF2122/97
cuccucgugcaggacca

SEQ ID NO: 3193501 - RNA, 23 nt, Mycobacterium bovis subsp bovis AF2122/97
cuccucgugcaggaccagcaccg

SEQ ID NO: 3193502 - RNA, 19 nt, Mycobacterium bovis subsp bovis AF2122/97
cuccugagaugcggccaug

SEQ ID NO: 3193503 - RNA, 21 nt, Mycobacterium bovis subsp bovis AF2122/97
cuccugaguugcggugugccg

SEQ ID NO: 3193504 - RNA, 12 nt, Mycobacterium bovis subsp bovis AF2122/97
cuccugcacaca

SEQ ID NO: 3193505 - RNA, 16 nt, Mycobacterium bovis subsp bovis AF2122/97
cuccugcacacaggac

SEQ ID NO: 3193506 - RNA, 18 nt, Mycobacterium bovis subsp bovis AF2122/97
cuccugcacacaggacuu

SEQ ID NO: 3193507 - RNA, 13 nt, Mycobacterium bovis subsp bovis AF2122/97
cuccugcagcccg

SEQ ID NO: 3193508 - RNA, 21 nt, Mycobacterium bovis subsp bovis AF2122/97
cuccugcggcaccgcugagga

SEQ ID NO: 3193509 - RNA, 18 nt, Mycobacterium bovis subsp bovis AF2122/97
cuccugcguccagaucuc

SEQ ID NO: 3193510 - RNA, 19 nt, Mycobacterium bovis subsp bovis AF2122/97
cuccugcucgucgagccga

SEQ ID NO: 3193511 - RNA, 17 nt, Mycobacterium bovis subsp bovis AF2122/97
cuccugcuggcccugcu

SEQ ID NO: 3193512 - RNA, 22 nt, Mycobacterium bovis subsp bovis AF2122/97
cuccuggaaaggacggccggcc

SEQ ID NO: 3193513 - RNA, 23 nt, Mycobacterium bovis subsp bovis AF2122/97
cuccuggaaaggacggccggccg

SEQ ID NO: 3193514 - RNA, 18 nt, Mycobacterium bovis subsp bovis AF2122/97
cuccuggaaggaggccgg

SEQ ID NO: 3193515 - RNA, 16 nt, Mycobacterium bovis subsp bovis AF2122/97
cuccuggcaaccgaau

SEQ ID NO: 3193516 - RNA, 20 nt, Mycobacterium bovis subsp bovis AF2122/97
cuccuggcggguggcgauga

SEQ ID NO: 3193517 - RNA, 20 nt, Mycobacterium bovis subsp bovis AF2122/97
cuccuguaacugcuccuggu

SEQ ID NO: 3193518 - RNA, 19 nt, Mycobacterium bovis subsp bovis AF2122/97
cuccugugcggagccgcca

SEQ ID NO: 3193519 - RNA, 22 nt, Mycobacterium bovis subsp bovis AF2122/97
cuccuuaucgucgacgccgauc

SEQ ID NO: 3193520 - RNA, 17 nt, Mycobacterium bovis subsp bovis AF2122/97
cuccuugaaccgggaca

SEQ ID NO: 3193521 - RNA, 14 nt, Mycobacterium bovis subsp bovis AF2122/97
cuccuugagccggg

SEQ ID NO: 3193522 - RNA, 15 nt, Mycobacterium bovis subsp bovis AF2122/97
cuccuugagcuucuc

SEQ ID NO: 3193523 - RNA, 13 nt, Mycobacterium bovis subsp bovis AF2122/97
cuccuugagguca

SEQ ID NO: 3193524 - RNA, 16 nt, Mycobacterium bovis subsp bovis AF2122/97
cuccuugaggucaccc

SEQ ID NO: 3193525 - RNA, 17 nt, Mycobacterium bovis subsp bovis AF2122/97
cuccuuggcccagcggu

SEQ ID NO: 3193526 - RNA, 17 nt, Mycobacterium bovis subsp bovis AF2122/97
cuccuuggccguucggc

SEQ ID NO: 3193527 - RNA, 18 nt, Mycobacterium bovis subsp bovis AF2122/97
cuccuugggcgacgcggc

SEQ ID NO: 3193528 - RNA, 21 nt, Mycobacterium bovis subsp bovis AF2122/97
cuccuugggcgacgcggcgcc

SEQ ID NO: 3193529 - RNA, 18 nt, Mycobacterium bovis subsp bovis AF2122/97
cucgaaccgacgcguccg

SEQ ID NO: 3193530 - RNA, 19 nt, Mycobacterium bovis subsp bovis AF2122/97
cucgaacgccgcccgcugg

SEQ ID NO: 3193531 - RNA, 17 nt, Mycobacterium bovis subsp bovis AF2122/97
cucgaacugggucggca

SEQ ID NO: 3193532 - RNA, 20 nt, Mycobacterium bovis subsp bovis AF2122/97
cucgaacugggucggcacgg

SEQ ID NO: 3193533 - RNA, 21 nt, Mycobacterium bovis subsp bovis AF2122/97
cucgaagaacuggugcuucca

SEQ ID NO: 3193534 - RNA, 21 nt, Mycobacterium bovis subsp bovis AF2122/97
cucgaagaugucgucaccgug

SEQ ID NO: 3193535 - RNA, 22 nt, Mycobacterium bovis subsp bovis AF2122/97
cucgaagaugucgucaccgugg

SEQ ID NO: 3193536 - RNA, 17 nt, Mycobacterium bovis subsp bovis AF2122/97
cucgaaggcacugcgau

SEQ ID NO: 3193537 - RNA, 23 nt, Mycobacterium bovis subsp bovis AF2122/97
cucgaaggcacugcgaucgcgac

SEQ ID NO: 3193538 - RNA, 14 nt, Mycobacterium bovis subsp bovis AF2122/97
cucgaaggccgcac

SEQ ID NO: 3193539 - RNA, 19 nt, Mycobacterium bovis subsp bovis AF2122/97
cucgaaggccgccaaccgu

SEQ ID NO: 3193540 - RNA, 21 nt, Mycobacterium bovis subsp bovis AF2122/97
cucgaaggcguucgacucgac

SEQ ID NO: 3193541 - RNA, 17 nt, Mycobacterium bovis subsp bovis AF2122/97
cucgaagucgcccaguc

SEQ ID NO: 3193542 - RNA, 15 nt, Mycobacterium bovis subsp bovis AF2122/97
cucgaaguuggcuuu

SEQ ID NO: 3193543 - RNA, 14 nt, Mycobacterium bovis subsp bovis AF2122/97
cucgaauacaccuu

SEQ ID NO: 3193544 - RNA, 20 nt, Mycobacterium bovis subsp bovis AF2122/97
cucgaaucgucacggacccu

SEQ ID NO: 3193545 - RNA, 19 nt, Mycobacterium bovis subsp bovis AF2122/97
cucgacaacugcccgauga

SEQ ID NO: 3193546 - RNA, 17 nt, Mycobacterium bovis subsp bovis AF2122/97
cucgacacccagccgca

SEQ ID NO: 3193547 - RNA, 16 nt, Mycobacterium bovis subsp bovis AF2122/97
cucgacacgccgugcg

SEQ ID NO: 3193548 - RNA, 13 nt, Mycobacterium bovis subsp bovis AF2122/97
cucgacagcggca

SEQ ID NO: 3193549 - RNA, 15 nt, Mycobacterium bovis subsp bovis AF2122/97
cucgacagugcugcc

SEQ ID NO: 3193550 - RNA, 17 nt, Mycobacterium bovis subsp bovis AF2122/97
cucgacaguggcgacgg

SEQ ID NO: 3193551 - RNA, 15 nt, Mycobacterium bovis subsp bovis AF2122/97
cucgacaucggccag

SEQ ID NO: 3193552 - RNA, 18 nt, Mycobacterium bovis subsp bovis AF2122/97
cucgaccaaguugaccuu

SEQ ID NO: 3193553 - RNA, 13 nt, Mycobacterium bovis subsp bovis AF2122/97
cucgaccaccgcc

SEQ ID NO: 3193554 - RNA, 14 nt, Mycobacterium bovis subsp bovis AF2122/97
cucgaccaccgccg

SEQ ID NO: 3193555 - RNA, 18 nt, Mycobacterium bovis subsp bovis AF2122/97
cucgaccaccgccggccc

SEQ ID NO: 3193556 - RNA, 20 nt, Mycobacterium bovis subsp bovis AF2122/97
cucgaccaccgccggcccgc

SEQ ID NO: 3193557 - RNA, 15 nt, Mycobacterium bovis subsp bovis AF2122/97
cucgaccagagccgc

SEQ ID NO: 3193558 - RNA, 12 nt, Mycobacterium bovis subsp bovis AF2122/97
cucgaccagcgc

SEQ ID NO: 3193559 - RNA, 13 nt, Mycobacterium bovis subsp bovis AF2122/97
cucgaccagcgcc

SEQ ID NO: 3193560 - RNA, 22 nt, Mycobacterium bovis subsp bovis AF2122/97
cucgaccagcgccgauaccagc

SEQ ID NO: 3193561 - RNA, 16 nt, Mycobacterium bovis subsp bovis AF2122/97
cucgaccaggaacggc

SEQ ID NO: 3193562 - RNA, 20 nt, Mycobacterium bovis subsp bovis AF2122/97
cucgaccaggaacggcucgg

SEQ ID NO: 3193563 - RNA, 12 nt, Mycobacterium bovis subsp bovis AF2122/97
cucgaccaggac

SEQ ID NO: 3193564 - RNA, 16 nt, Mycobacterium bovis subsp bovis AF2122/97
cucgaccaggaccggc

SEQ ID NO: 3193565 - RNA, 23 nt, Mycobacterium bovis subsp bovis AF2122/97
cucgaccaggaccggcugcaggu

SEQ ID NO: 3193566 - RNA, 15 nt, Mycobacterium bovis subsp bovis AF2122/97
cucgaccgauagcug

SEQ ID NO: 3193567 - RNA, 20 nt, Mycobacterium bovis subsp bovis AF2122/97
cucgaccgccagcccgguga

SEQ ID NO: 3193568 - RNA, 22 nt, Mycobacterium bovis subsp bovis AF2122/97
cucgaccgccagcccggugaug

SEQ ID NO: 3193569 - RNA, 15 nt, Mycobacterium bovis subsp bovis AF2122/97
cucgaccgccagccg

SEQ ID NO: 3193570 - RNA, 22 nt, Mycobacterium bovis subsp bovis AF2122/97
cucgaccgccagccgcgagccg

SEQ ID NO: 3193571 - RNA, 22 nt, Mycobacterium bovis subsp bovis AF2122/97
cucgaccgcgagcaugaugucc

SEQ ID NO: 3193572 - RNA, 21 nt, Mycobacterium bovis subsp bovis AF2122/97
cucgaccgcggccuuggcggc

SEQ ID NO: 3193573 - RNA, 23 nt, Mycobacterium bovis subsp bovis AF2122/97
cucgaccgcguccuugggcgucg

SEQ ID NO: 3193574 - RNA, 19 nt, Mycobacterium bovis subsp bovis AF2122/97
cucgaccguauugaccagc

SEQ ID NO: 3193575 - RNA, 16 nt, Mycobacterium bovis subsp bovis AF2122/97
cucgaccgucaccgga

SEQ ID NO: 3193576 - RNA, 16 nt, Mycobacterium bovis subsp bovis AF2122/97
cucgaccguggcggcc

SEQ ID NO: 3193577 - RNA, 17 nt, Mycobacterium bovis subsp bovis AF2122/97
cucgaccugacugguca

SEQ ID NO: 3193578 - RNA, 16 nt, Mycobacterium bovis subsp bovis AF2122/97
cucgaccugaggcacc

SEQ ID NO: 3193579 - RNA, 20 nt, Mycobacterium bovis subsp bovis AF2122/97
cucgaccuggaugggcucga

SEQ ID NO: 3193580 - RNA, 24 nt, Mycobacterium bovis subsp bovis AF2122/97
cucgacgaagaucuucaccggccg

SEQ ID NO: 3193581 - RNA, 14 nt, Mycobacterium bovis subsp bovis AF2122/97
cucgacgacgggcg

SEQ ID NO: 3193582 - RNA, 20 nt, Mycobacterium bovis subsp bovis AF2122/97
cucgacgacgggcgccaacg

SEQ ID NO: 3193583 - RNA, 16 nt, Mycobacterium bovis subsp bovis AF2122/97
cucgacgagcacgccg

SEQ ID NO: 3193584 - RNA, 19 nt, Mycobacterium bovis subsp bovis AF2122/97
cucgacgagcacgccgacc

SEQ ID NO: 3193585 - RNA, 15 nt, Mycobacterium bovis subsp bovis AF2122/97
cucgacgaggccacg

SEQ ID NO: 3193586 - RNA, 16 nt, Mycobacterium bovis subsp bovis AF2122/97
cucgacgaucagcacg

SEQ ID NO: 3193587 - RNA, 18 nt, Mycobacterium bovis subsp bovis AF2122/97
cucgacgaucugcagcac

SEQ ID NO: 3193588 - RNA, 19 nt, Mycobacterium bovis subsp bovis AF2122/97
cucgacgaucugcagcacu

SEQ ID NO: 3193589 - RNA, 18 nt, Mycobacterium bovis subsp bovis AF2122/97
cucgacgcaccuaugguc

SEQ ID NO: 3193590 - RNA, 13 nt, Mycobacterium bovis subsp bovis AF2122/97
cucgacgcccgcc

SEQ ID NO: 3193591 - RNA, 14 nt, Mycobacterium bovis subsp bovis AF2122/97
cucgacgcccgccc

SEQ ID NO: 3193592 - RNA, 16 nt, Mycobacterium bovis subsp bovis AF2122/97
cucgacgcccgcccug

SEQ ID NO: 3193593 - RNA, 22 nt, Mycobacterium bovis subsp bovis AF2122/97
cucgacgcccgcccuggcaacg

SEQ ID NO: 3193594 - RNA, 15 nt, Mycobacterium bovis subsp bovis AF2122/97
cucgacgccgcgcag

SEQ ID NO: 3193595 - RNA, 13 nt, Mycobacterium bovis subsp bovis AF2122/97
cucgacgcgcauc

SEQ ID NO: 3193596 - RNA, 16 nt, Mycobacterium bovis subsp bovis AF2122/97
cucgacgcgcaucgca

SEQ ID NO: 3193597 - RNA, 17 nt, Mycobacterium bovis subsp bovis AF2122/97
cucgacgcgcucgggcg

SEQ ID NO: 3193598 - RNA, 14 nt, Mycobacterium bovis subsp bovis AF2122/97
cucgacgcggcagg

SEQ ID NO: 3193599 - RNA, 17 nt, Mycobacterium bovis subsp bovis AF2122/97
cucgacgcgucgccggc

SEQ ID NO: 3193600 - RNA, 14 nt, Mycobacterium bovis subsp bovis AF2122/97
cucgacggcccgcc

SEQ ID NO: 3193601 - RNA, 15 nt, Mycobacterium bovis subsp bovis AF2122/97
cucgacggcccgccg

SEQ ID NO: 3193602 - RNA, 17 nt, Mycobacterium bovis subsp bovis AF2122/97
cucgacggcccgccguc

SEQ ID NO: 3193603 - RNA, 18 nt, Mycobacterium bovis subsp bovis AF2122/97
cucgacggcccgccgucc

SEQ ID NO: 3193604 - RNA, 20 nt, Mycobacterium bovis subsp bovis AF2122/97
cucgacggcccgccguccgg

SEQ ID NO: 3193605 - RNA, 14 nt, Mycobacterium bovis subsp bovis AF2122/97
cucgacggcggccg

SEQ ID NO: 3193606 - RNA, 14 nt, Mycobacterium bovis subsp bovis AF2122/97
cucgacggcgucga

SEQ ID NO: 3193607 - RNA, 15 nt, Mycobacterium bovis subsp bovis AF2122/97
cucgacggucaucgc

SEQ ID NO: 3193608 - RNA, 12 nt, Mycobacterium bovis subsp bovis AF2122/97
cucgacggugac

SEQ ID NO: 3193609 - RNA, 14 nt, Mycobacterium bovis subsp bovis AF2122/97
cucgacggugacga

SEQ ID NO: 3193610 - RNA, 17 nt, Mycobacterium bovis subsp bovis AF2122/97
cucgacggugacgacca

SEQ ID NO: 3193611 - RNA, 19 nt, Mycobacterium bovis subsp bovis AF2122/97
cucgacggugacgaccacg

SEQ ID NO: 3193612 - RNA, 16 nt, Mycobacterium bovis subsp bovis AF2122/97
cucgacguacagcgcg

SEQ ID NO: 3193613 - RNA, 17 nt, Mycobacterium bovis subsp bovis AF2122/97
cucgacguacagcgcgg

SEQ ID NO: 3193614 - RNA, 22 nt, Mycobacterium bovis subsp bovis AF2122/97
cucgacguccaucccggcgccg

SEQ ID NO: 3193615 - RNA, 18 nt, Mycobacterium bovis subsp bovis AF2122/97
cucgacgucgggcauggc

SEQ ID NO: 3193616 - RNA, 20 nt, Mycobacterium bovis subsp bovis AF2122/97
cucgacgucgucgucgacgg

SEQ ID NO: 3193617 - RNA, 13 nt, Mycobacterium bovis subsp bovis AF2122/97
cucgacgugcacg

SEQ ID NO: 3193618 - RNA, 14 nt, Mycobacterium bovis subsp bovis AF2122/97
cucgagacggucga

SEQ ID NO: 3193619 - RNA, 20 nt, Mycobacterium bovis subsp bovis AF2122/97
cucgagagcaugguccagca

SEQ ID NO: 3193620 - RNA, 18 nt, Mycobacterium bovis subsp bovis AF2122/97
cucgagaguggccucguc

SEQ ID NO: 3193621 - RNA, 21 nt, Mycobacterium bovis subsp bovis AF2122/97
cucgagcaccgcgaacauggu

SEQ ID NO: 3193622 - RNA, 14 nt, Mycobacterium bovis subsp bovis AF2122/97
cucgagcagcgcgc

SEQ ID NO: 3193623 - RNA, 20 nt, Mycobacterium bovis subsp bovis AF2122/97
cucgagcaggcgcaccaggc

SEQ ID NO: 3193624 - RNA, 16 nt, Mycobacterium bovis subsp bovis AF2122/97
cucgagcaugcccagc

SEQ ID NO: 3193625 - RNA, 22 nt, Mycobacterium bovis subsp bovis AF2122/97
cucgagcaugcccagcgaaucc

SEQ ID NO: 3193626 - RNA, 19 nt, Mycobacterium bovis subsp bovis AF2122/97
cucgagcccgcguucagga

SEQ ID NO: 3193627 - RNA, 12 nt, Mycobacterium bovis subsp bovis AF2122/97
cucgagccgccc

SEQ ID NO: 3193628 - RNA, 12 nt, Mycobacterium bovis subsp bovis AF2122/97
cucgagccgccg

SEQ ID NO: 3193629 - RNA, 15 nt, Mycobacterium bovis subsp bovis AF2122/97
cucgagcgcggcgau

SEQ ID NO: 3193630 - RNA, 17 nt, Mycobacterium bovis subsp bovis AF2122/97
cucgagcgcggcgaucg

SEQ ID NO: 3193631 - RNA, 20 nt, Mycobacterium bovis subsp bovis AF2122/97
cucgagcgguggcgucgucg

SEQ ID NO: 3193632 - RNA, 19 nt, Mycobacterium bovis subsp bovis AF2122/97
cucgagcugcuggcgcgcc

SEQ ID NO: 3193633 - RNA, 18 nt, Mycobacterium bovis subsp bovis AF2122/97
cucgaggaccugcucggg

SEQ ID NO: 3193634 - RNA, 19 nt, Mycobacterium bovis subsp bovis AF2122/97
cucgaggacggcguagacg

SEQ ID NO: 3193635 - RNA, 21 nt, Mycobacterium bovis subsp bovis AF2122/97
cucgagggauguagugcugcu

SEQ ID NO: 3193636 - RNA, 19 nt, Mycobacterium bovis subsp bovis AF2122/97
cucgagguccucgucggcg

SEQ ID NO: 3193637 - RNA, 23 nt, Mycobacterium bovis subsp bovis AF2122/97
cucgagguccucgucggcgucga

SEQ ID NO: 3193638 - RNA, 18 nt, Mycobacterium bovis subsp bovis AF2122/97
cucgaggucgagcgccgc

SEQ ID NO: 3193639 - RNA, 13 nt, Mycobacterium bovis subsp bovis AF2122/97
cucgaggucucca

SEQ ID NO: 3193640 - RNA, 18 nt, Mycobacterium bovis subsp bovis AF2122/97
cucgagguguagcccucc

SEQ ID NO: 3193641 - RNA, 19 nt, Mycobacterium bovis subsp bovis AF2122/97
cucgagguuuccgagggug

SEQ ID NO: 3193642 - RNA, 18 nt, Mycobacterium bovis subsp bovis AF2122/97
cucgaguacccaaccggu

SEQ ID NO: 3193643 - RNA, 19 nt, Mycobacterium bovis subsp bovis AF2122/97
cucgaguccaggcagcuug

SEQ ID NO: 3193644 - RNA, 22 nt, Mycobacterium bovis subsp bovis AF2122/97
cucgaguccaggcagcuugcca

SEQ ID NO: 3193645 - RNA, 14 nt, Mycobacterium bovis subsp bovis AF2122/97
cucgagucgcagca

SEQ ID NO: 3193646 - RNA, 16 nt, Mycobacterium bovis subsp bovis AF2122/97
cucgagucgcagcacg

SEQ ID NO: 3193647 - RNA, 14 nt, Mycobacterium bovis subsp bovis AF2122/97
cucgagucugcgca

SEQ ID NO: 3193648 - RNA, 13 nt, Mycobacterium bovis subsp bovis AF2122/97
cucgagugccgcc

SEQ ID NO: 3193649 - RNA, 21 nt, Mycobacterium bovis subsp bovis AF2122/97
cucgaguggaucauguucggc

SEQ ID NO: 3193650 - RNA, 23 nt, Mycobacterium bovis subsp bovis AF2122/97
cucgaguggaucauguucggcca

SEQ ID NO: 3193651 - RNA, 14 nt, Mycobacterium bovis subsp bovis AF2122/97
cucgaguggcgaac

SEQ ID NO: 3193652 - RNA, 15 nt, Mycobacterium bovis subsp bovis AF2122/97
cucgaguggcgaacg

SEQ ID NO: 3193653 - RNA, 14 nt, Mycobacterium bovis subsp bovis AF2122/97
cucgaguguggccg

SEQ ID NO: 3193654 - RNA, 22 nt, Mycobacterium bovis subsp bovis AF2122/97
cucgaguugcgcggcaguggcc

SEQ ID NO: 3193655 - RNA, 16 nt, Mycobacterium bovis subsp bovis AF2122/97
cucgaguugcucgaca

SEQ ID NO: 3193656 - RNA, 16 nt, Mycobacterium bovis subsp bovis AF2122/97
cucgauauaacccggc

SEQ ID NO: 3193657 - RNA, 18 nt, Mycobacterium bovis subsp bovis AF2122/97
cucgauauaacccggcuc

SEQ ID NO: 3193658 - RNA, 20 nt, Mycobacterium bovis subsp bovis AF2122/97
cucgauauaacccggcucca

SEQ ID NO: 3193659 - RNA, 22 nt, Mycobacterium bovis subsp bovis AF2122/97
cucgaucaccaugauguagcgg

SEQ ID NO: 3193660 - RNA, 16 nt, Mycobacterium bovis subsp bovis AF2122/97
cucgaucacggcggcc

SEQ ID NO: 3193661 - RNA, 15 nt, Mycobacterium bovis subsp bovis AF2122/97
cucgaucacggcggg

SEQ ID NO: 3193662 - RNA, 17 nt, Mycobacterium bovis subsp bovis AF2122/97
cucgaucagacgcucga

SEQ ID NO: 3193663 - RNA, 15 nt, Mycobacterium bovis subsp bovis AF2122/97
cucgaucagcgccgg

SEQ ID NO: 3193664 - RNA, 24 nt, Mycobacterium bovis subsp bovis AF2122/97
cucgaucagguuggugcucagcgg

SEQ ID NO: 3193665 - RNA, 23 nt, Mycobacterium bovis subsp bovis AF2122/97
cucgaucaucaugucggcgcagg

SEQ ID NO: 3193666 - RNA, 16 nt, Mycobacterium bovis subsp bovis AF2122/97
cucgaucaucgggagc

SEQ ID NO: 3193667 - RNA, 24 nt, Mycobacterium bovis subsp bovis AF2122/97
cucgauccacugccgcgcgcccgc

SEQ ID NO: 3193668 - RNA, 12 nt, Mycobacterium bovis subsp bovis AF2122/97
cucgauccgcaa

SEQ ID NO: 3193669 - RNA, 15 nt, Mycobacterium bovis subsp bovis AF2122/97
cucgaucgcgccguc

SEQ ID NO: 3193670 - RNA, 12 nt, Mycobacterium bovis subsp bovis AF2122/97
cucgaucggcag

SEQ ID NO: 3193671 - RNA, 14 nt, Mycobacterium bovis subsp bovis AF2122/97
cucgaucggcagcc

SEQ ID NO: 3193672 - RNA, 15 nt, Mycobacterium bovis subsp bovis AF2122/97
cucgaucggcagcca

SEQ ID NO: 3193673 - RNA, 18 nt, Mycobacterium bovis subsp bovis AF2122/97
cucgaucuggucaagacc

SEQ ID NO: 3193674 - RNA, 21 nt, Mycobacterium bovis subsp bovis AF2122/97
cucgaucuggucaagacccgc

SEQ ID NO: 3193675 - RNA, 22 nt, Mycobacterium bovis subsp bovis AF2122/97
cucgaucuggucaagacccgca

SEQ ID NO: 3193676 - RNA, 17 nt, Mycobacterium bovis subsp bovis AF2122/97
cucgaucuugggccacg

SEQ ID NO: 3193677 - RNA, 20 nt, Mycobacterium bovis subsp bovis AF2122/97
cucgaugaugucgagcacac

SEQ ID NO: 3193678 - RNA, 23 nt, Mycobacterium bovis subsp bovis AF2122/97
cucgaugaugucgagcacaccgu

SEQ ID NO: 3193679 - RNA, 14 nt, Mycobacterium bovis subsp bovis AF2122/97
cucgaugccgcgua

SEQ ID NO: 3193680 - RNA, 21 nt, Mycobacterium bovis subsp bovis AF2122/97
cucgaugcgacgaaccucggc

SEQ ID NO: 3193681 - RNA, 15 nt, Mycobacterium bovis subsp bovis AF2122/97
cucgaugcgggcgcc

SEQ ID NO: 3193682 - RNA, 20 nt, Mycobacterium bovis subsp bovis AF2122/97
cucgaugcggguggcgccgg

SEQ ID NO: 3193683 - RNA, 17 nt, Mycobacterium bovis subsp bovis AF2122/97
cucgauggaaaacgcca

SEQ ID NO: 3193684 - RNA, 13 nt, Mycobacterium bovis subsp bovis AF2122/97
cucgauggccagg

SEQ ID NO: 3193685 - RNA, 19 nt, Mycobacterium bovis subsp bovis AF2122/97
cucgauggcggccaccagc

SEQ ID NO: 3193686 - RNA, 12 nt, Mycobacterium bovis subsp bovis AF2122/97
cucgauggcggu

SEQ ID NO: 3193687 - RNA, 20 nt, Mycobacterium bovis subsp bovis AF2122/97
cucgauggucucccggcuga

SEQ ID NO: 3193688 - RNA, 21 nt, Mycobacterium bovis subsp bovis AF2122/97
cucgaugguuuucucgaaguc

SEQ ID NO: 3193689 - RNA, 16 nt, Mycobacterium bovis subsp bovis AF2122/97
cucgaugucagcggcc

SEQ ID NO: 3193690 - RNA, 19 nt, Mycobacterium bovis subsp bovis AF2122/97
cucgauguccgauaccgcg

SEQ ID NO: 3193691 - RNA, 18 nt, Mycobacterium bovis subsp bovis AF2122/97
cucgaugucgcggucgcc

SEQ ID NO: 3193692 - RNA, 17 nt, Mycobacterium bovis subsp bovis AF2122/97
cucgauuaucgcgcgca

SEQ ID NO: 3193693 - RNA, 19 nt, Mycobacterium bovis subsp bovis AF2122/97
cucgauucccggcgcggug

SEQ ID NO: 3193694 - RNA, 20 nt, Mycobacterium bovis subsp bovis AF2122/97
cucgauucccggcgcggugg

SEQ ID NO: 3193695 - RNA, 22 nt, Mycobacterium bovis subsp bovis AF2122/97
cucgauucccggcgcgguggcc

SEQ ID NO: 3193696 - RNA, 16 nt, Mycobacterium bovis subsp bovis AF2122/97
cucgauuguggccagc

SEQ ID NO: 3193697 - RNA, 17 nt, Mycobacterium bovis subsp bovis AF2122/97
cucgauuguggccagcg

SEQ ID NO: 3193698 - RNA, 15 nt, Mycobacterium bovis subsp bovis AF2122/97
cucgcaaacaagauc

SEQ ID NO: 3193699 - RNA, 16 nt, Mycobacterium bovis subsp bovis AF2122/97
cucgcaaucguuggcc

SEQ ID NO: 3193700 - RNA, 20 nt, Mycobacterium bovis subsp bovis AF2122/97
cucgcacaauggcggcgccg

SEQ ID NO: 3193701 - RNA, 14 nt, Mycobacterium bovis subsp bovis AF2122/97
cucgcacagccgcu

SEQ ID NO: 3193702 - RNA, 19 nt, Mycobacterium bovis subsp bovis AF2122/97
cucgcacagccgcuuggcg

SEQ ID NO: 3193703 - RNA, 13 nt, Mycobacterium bovis subsp bovis AF2122/97
cucgcaccgcccg

SEQ ID NO: 3193704 - RNA, 15 nt, Mycobacterium bovis subsp bovis AF2122/97
cucgcaccgcccgcc

SEQ ID NO: 3193705 - RNA, 15 nt, Mycobacterium bovis subsp bovis AF2122/97
cucgcaccgcgccgu

SEQ ID NO: 3193706 - RNA, 15 nt, Mycobacterium bovis subsp bovis AF2122/97
cucgcacucguugcc

SEQ ID NO: 3193707 - RNA, 23 nt, Mycobacterium bovis subsp bovis AF2122/97
cucgcacucguugccgaccaugc

SEQ ID NO: 3193708 - RNA, 22 nt, Mycobacterium bovis subsp bovis AF2122/97
cucgcagagccgucaccgacug

SEQ ID NO: 3193709 - RNA, 21 nt, Mycobacterium bovis subsp bovis AF2122/97
cucgcagcaacggcggcgucg

SEQ ID NO: 3193710 - RNA, 13 nt, Mycobacterium bovis subsp bovis AF2122/97
cucgcagccaacg

SEQ ID NO: 3193711 - RNA, 13 nt, Mycobacterium bovis subsp bovis AF2122/97
cucgcagcgggcg

SEQ ID NO: 3193712 - RNA, 18 nt, Mycobacterium bovis subsp bovis AF2122/97
cucgcaggcgcagauucc

SEQ ID NO: 3193713 - RNA, 21 nt, Mycobacterium bovis subsp bovis AF2122/97
cucgcagguggugacacgacg

SEQ ID NO: 3193714 - RNA, 23 nt, Mycobacterium bovis subsp bovis AF2122/97
cucgcaguucaucgggcaccaac

SEQ ID NO: 3193715 - RNA, 14 nt, Mycobacterium bovis subsp bovis AF2122/97
cucgcaugcucacg

SEQ ID NO: 3193716 - RNA, 20 nt, Mycobacterium bovis subsp bovis AF2122/97
cucgcauguucuccacgccg

SEQ ID NO: 3193717 - RNA, 13 nt, Mycobacterium bovis subsp bovis AF2122/97
cucgcauucggcg

SEQ ID NO: 3193718 - RNA, 22 nt, Mycobacterium bovis subsp bovis AF2122/97
cucgccaaccagucgcacgacg

SEQ ID NO: 3193719 - RNA, 14 nt, Mycobacterium bovis subsp bovis AF2122/97
cucgccaccgcggc

SEQ ID NO: 3193720 - RNA, 15 nt, Mycobacterium bovis subsp bovis AF2122/97
cucgccaccgcggcg

SEQ ID NO: 3193721 - RNA, 19 nt, Mycobacterium bovis subsp bovis AF2122/97
cucgccacggucgccgacc

SEQ ID NO: 3193722 - RNA, 21 nt, Mycobacterium bovis subsp bovis AF2122/97
cucgccacucagcccgacacc

SEQ ID NO: 3193723 - RNA, 22 nt, Mycobacterium bovis subsp bovis AF2122/97
cucgccacucagcccgacaccg

SEQ ID NO: 3193724 - RNA, 22 nt, Mycobacterium bovis subsp bovis AF2122/97
cucgccagagucggagacccgu

SEQ ID NO: 3193725 - RNA, 23 nt, Mycobacterium bovis subsp bovis AF2122/97
cucgccagagucggagacccguc

SEQ ID NO: 3193726 - RNA, 14 nt, Mycobacterium bovis subsp bovis AF2122/97
cucgccaggggaac

SEQ ID NO: 3193727 - RNA, 19 nt, Mycobacterium bovis subsp bovis AF2122/97
cucgccaguucgcgccacg

SEQ ID NO: 3193728 - RNA, 21 nt, Mycobacterium bovis subsp bovis AF2122/97
cucgccaguucgcgccacgca

SEQ ID NO: 3193729 - RNA, 14 nt, Mycobacterium bovis subsp bovis AF2122/97
cucgcccaagcgca

SEQ ID NO: 3193730 - RNA, 17 nt, Mycobacterium bovis subsp bovis AF2122/97
cucgcccacccgcugcg

SEQ ID NO: 3193731 - RNA, 15 nt, Mycobacterium bovis subsp bovis AF2122/97
cucgcccaccuccug

SEQ ID NO: 3193732 - RNA, 20 nt, Mycobacterium bovis subsp bovis AF2122/97
cucgcccaccuccugguuga

SEQ ID NO: 3193733 - RNA, 11 nt, Mycobacterium bovis subsp bovis AF2122/97
cucgcccaggg

SEQ ID NO: 3193734 - RNA, 22 nt, Mycobacterium bovis subsp bovis AF2122/97
cucgcccccucuagcgccucgc

SEQ ID NO: 3193735 - RNA, 15 nt, Mycobacterium bovis subsp bovis AF2122/97
cucgcccgccgccac

SEQ ID NO: 3193736 - RNA, 24 nt, Mycobacterium bovis subsp bovis AF2122/97
cucgcccugagaacacguucggcg

SEQ ID NO: 3193737 - RNA, 13 nt, Mycobacterium bovis subsp bovis AF2122/97
cucgcccugcaga

SEQ ID NO: 3193738 - RNA, 14 nt, Mycobacterium bovis subsp bovis AF2122/97
cucgccgaagcggg

SEQ ID NO: 3193739 - RNA, 13 nt, Mycobacterium bovis subsp bovis AF2122/97
cucgccgaccagc

SEQ ID NO: 3193740 - RNA, 23 nt, Mycobacterium bovis subsp bovis AF2122/97
cucgccgaccagcuugaccgacc

SEQ ID NO: 3193741 - RNA, 15 nt, Mycobacterium bovis subsp bovis AF2122/97
cucgccgacccgccg

SEQ ID NO: 3193742 - RNA, 14 nt, Mycobacterium bovis subsp bovis AF2122/97
cucgccgagcucgg

SEQ ID NO: 3193743 - RNA, 14 nt, Mycobacterium bovis subsp bovis AF2122/97
cucgccgagcugug

SEQ ID NO: 3193744 - RNA, 21 nt, Mycobacterium bovis subsp bovis AF2122/97
cucgccgaggccuaccaggcg

SEQ ID NO: 3193745 - RNA, 14 nt, Mycobacterium bovis subsp bovis AF2122/97
cucgccgcacgccg

SEQ ID NO: 3193746 - RNA, 16 nt, Mycobacterium bovis subsp bovis AF2122/97
cucgccgccagcgcuc

SEQ ID NO: 3193747 - RNA, 12 nt, Mycobacterium bovis subsp bovis AF2122/97
cucgccgccgcu

SEQ ID NO: 3193748 - RNA, 13 nt, Mycobacterium bovis subsp bovis AF2122/97
cucgccgcgcacc

SEQ ID NO: 3193749 - RNA, 17 nt, Mycobacterium bovis subsp bovis AF2122/97
cucgccgcgcaccgacc

SEQ ID NO: 3193750 - RNA, 23 nt, Mycobacterium bovis subsp bovis AF2122/97
cucgccgcgcaccgaccgcaccg

SEQ ID NO: 3193751 - RNA, 18 nt, Mycobacterium bovis subsp bovis AF2122/97
cucgccggaucguucgcg

SEQ ID NO: 3193752 - RNA, 24 nt, Mycobacterium bovis subsp bovis AF2122/97
cucgccggaucuugccgcuggugg

SEQ ID NO: 3193753 - RNA, 16 nt, Mycobacterium bovis subsp bovis AF2122/97
cucgccggcaccgacg

SEQ ID NO: 3193754 - RNA, 14 nt, Mycobacterium bovis subsp bovis AF2122/97
cucgccggcacgca

SEQ ID NO: 3193755 - RNA, 16 nt, Mycobacterium bovis subsp bovis AF2122/97
cucgccggcacgcagc

SEQ ID NO: 3193756 - RNA, 14 nt, Mycobacterium bovis subsp bovis AF2122/97
cucgccggccaacu

SEQ ID NO: 3193757 - RNA, 13 nt, Mycobacterium bovis subsp bovis AF2122/97
cucgccggccacc

SEQ ID NO: 3193758 - RNA, 14 nt, Mycobacterium bovis subsp bovis AF2122/97
cucgccggccacca

SEQ ID NO: 3193759 - RNA, 16 nt, Mycobacterium bovis subsp bovis AF2122/97
cucgccggccaccagc

SEQ ID NO: 3193760 - RNA, 12 nt, Mycobacterium bovis subsp bovis AF2122/97
cucgccggcgaa

SEQ ID NO: 3193761 - RNA, 13 nt, Mycobacterium bovis subsp bovis AF2122/97
cucgccggcgcgc

SEQ ID NO: 3193762 - RNA, 15 nt, Mycobacterium bovis subsp bovis AF2122/97
cucgccggcgcgcac

SEQ ID NO: 3193763 - RNA, 16 nt, Mycobacterium bovis subsp bovis AF2122/97
cucgccggcgcgcagc

SEQ ID NO: 3193764 - RNA, 22 nt, Mycobacterium bovis subsp bovis AF2122/97
cucgccggcgcgcagccgggcc

SEQ ID NO: 3193765 - RNA, 19 nt, Mycobacterium bovis subsp bovis AF2122/97
cucgccggcggcccgcucg

SEQ ID NO: 3193766 - RNA, 16 nt, Mycobacterium bovis subsp bovis AF2122/97
cucgccgggaaacacc

SEQ ID NO: 3193767 - RNA, 14 nt, Mycobacterium bovis subsp bovis AF2122/97
cucgccgggcagcu

SEQ ID NO: 3193768 - RNA, 23 nt, Mycobacterium bovis subsp bovis AF2122/97
cucgccgggcagcuacggggcgg

SEQ ID NO: 3193769 - RNA, 20 nt, Mycobacterium bovis subsp bovis AF2122/97
cucgccgggccacguccugc

SEQ ID NO: 3193770 - RNA, 23 nt, Mycobacterium bovis subsp bovis AF2122/97
cucgccgguaggcggccagcgcg

SEQ ID NO: 3193771 - RNA, 23 nt, Mycobacterium bovis subsp bovis AF2122/97
cucgccggugacgggguugaccg

SEQ ID NO: 3193772 - RNA, 13 nt, Mycobacterium bovis subsp bovis AF2122/97
cucgccggugagc

SEQ ID NO: 3193773 - RNA, 14 nt, Mycobacterium bovis subsp bovis AF2122/97
cucgccggugagcc

SEQ ID NO: 3193774 - RNA, 20 nt, Mycobacterium bovis subsp bovis AF2122/97
cucgccgguguccuuggccg

SEQ ID NO: 3193775 - RNA, 20 nt, Mycobacterium bovis subsp bovis AF2122/97
cucgccguacaucagcgcga

SEQ ID NO: 3193776 - RNA, 21 nt, Mycobacterium bovis subsp bovis AF2122/97
cucgccguagagcuggugcgg

SEQ ID NO: 3193777 - RNA, 20 nt, Mycobacterium bovis subsp bovis AF2122/97
cucgccgucauagcaggccu

SEQ ID NO: 3193778 - RNA, 21 nt, Mycobacterium bovis subsp bovis AF2122/97
cucgccgucauagcaggccuc

SEQ ID NO: 3193779 - RNA, 16 nt, Mycobacterium bovis subsp bovis AF2122/97
cucgccgugaccaggu

SEQ ID NO: 3193780 - RNA, 18 nt, Mycobacterium bovis subsp bovis AF2122/97
cucgccgugguggaugag

SEQ ID NO: 3193781 - RNA, 15 nt, Mycobacterium bovis subsp bovis AF2122/97
cucgccguugauguc

SEQ ID NO: 3193782 - RNA, 16 nt, Mycobacterium bovis subsp bovis AF2122/97
cucgccugagcgcucg

SEQ ID NO: 3193783 - RNA, 14 nt, Mycobacterium bovis subsp bovis AF2122/97
cucgccugcacccg

SEQ ID NO: 3193784 - RNA, 16 nt, Mycobacterium bovis subsp bovis AF2122/97
cucgccugcacccggc

SEQ ID NO: 3193785 - RNA, 19 nt, Mycobacterium bovis subsp bovis AF2122/97
cucgccugcccgaaccacc

SEQ ID NO: 3193786 - RNA, 15 nt, Mycobacterium bovis subsp bovis AF2122/97
cucgcgaaaccgccg

SEQ ID NO: 3193787 - RNA, 16 nt, Mycobacterium bovis subsp bovis AF2122/97
cucgcgaagaucagcg

SEQ ID NO: 3193788 - RNA, 22 nt, Mycobacterium bovis subsp bovis AF2122/97
cucgcgaagccgguucgcccag

SEQ ID NO: 3193789 - RNA, 19 nt, Mycobacterium bovis subsp bovis AF2122/97
cucgcgaggugacucggca

SEQ ID NO: 3193790 - RNA, 16 nt, Mycobacterium bovis subsp bovis AF2122/97
cucgcgcaagcggacc

SEQ ID NO: 3193791 - RNA, 23 nt, Mycobacterium bovis subsp bovis AF2122/97
cucgcgcaagcggacccgaccgu

SEQ ID NO: 3193792 - RNA, 16 nt, Mycobacterium bovis subsp bovis AF2122/97
cucgcgcacauaggcg

SEQ ID NO: 3193793 - RNA, 20 nt, Mycobacterium bovis subsp bovis AF2122/97
cucgcgcaccugaucgguca

SEQ ID NO: 3193794 - RNA, 13 nt, Mycobacterium bovis subsp bovis AF2122/97
cucgcgcacgucg

SEQ ID NO: 3193795 - RNA, 17 nt, Mycobacterium bovis subsp bovis AF2122/97
cucgcgcacgucgacga

SEQ ID NO: 3193796 - RNA, 23 nt, Mycobacterium bovis subsp bovis AF2122/97
cucgcgcagauauuccucgucgg

SEQ ID NO: 3193797 - RNA, 13 nt, Mycobacterium bovis subsp bovis AF2122/97
cucgcgcagccgg

SEQ ID NO: 3193798 - RNA, 21 nt, Mycobacterium bovis subsp bovis AF2122/97
cucgcgcagggaucgcaggga

SEQ ID NO: 3193799 - RNA, 21 nt, Mycobacterium bovis subsp bovis AF2122/97
cucgcgccaggucggugacga

SEQ ID NO: 3193800 - RNA, 13 nt, Mycobacterium bovis subsp bovis AF2122/97
cucgcgcccgcua

SEQ ID NO: 3193801 - RNA, 14 nt, Mycobacterium bovis subsp bovis AF2122/97
cucgcgcgcggcga

SEQ ID NO: 3193802 - RNA, 15 nt, Mycobacterium bovis subsp bovis AF2122/97
cucgcgcgcugggcg

SEQ ID NO: 3193803 - RNA, 20 nt, Mycobacterium bovis subsp bovis AF2122/97
cucgcgcgcugggcgcgcuc

SEQ ID NO: 3193804 - RNA, 13 nt, Mycobacterium bovis subsp bovis AF2122/97
cucgcgcucgccg

SEQ ID NO: 3193805 - RNA, 19 nt, Mycobacterium bovis subsp bovis AF2122/97
cucgcgcuugcgccgccca

SEQ ID NO: 3193806 - RNA, 16 nt, Mycobacterium bovis subsp bovis AF2122/97
cucgcggaccucggcg

SEQ ID NO: 3193807 - RNA, 20 nt, Mycobacterium bovis subsp bovis AF2122/97
cucgcggaccucggcgaccu

SEQ ID NO: 3193808 - RNA, 16 nt, Mycobacterium bovis subsp bovis AF2122/97
cucgcggauccgggcg

SEQ ID NO: 3193809 - RNA, 16 nt, Mycobacterium bovis subsp bovis AF2122/97
cucgcggaugagcucg

SEQ ID NO: 3193810 - RNA, 20 nt, Mycobacterium bovis subsp bovis AF2122/97
cucgcggaugagcucggcca

SEQ ID NO: 3193811 - RNA, 16 nt, Mycobacterium bovis subsp bovis AF2122/97
cucgcggauuggcacu

SEQ ID NO: 3193812 - RNA, 13 nt, Mycobacterium bovis subsp bovis AF2122/97
cucgcggccggcg

SEQ ID NO: 3193813 - RNA, 23 nt, Mycobacterium bovis subsp bovis AF2122/97
cucgcggccggcgucggcgucga

SEQ ID NO: 3193814 - RNA, 14 nt, Mycobacterium bovis subsp bovis AF2122/97
cucgcggcgcggcc

SEQ ID NO: 3193815 - RNA, 16 nt, Mycobacterium bovis subsp bovis AF2122/97
cucgcggcgcggccgc

SEQ ID NO: 3193816 - RNA, 15 nt, Mycobacterium bovis subsp bovis AF2122/97
cucgcgggcagggcc

SEQ ID NO: 3193817 - RNA, 22 nt, Mycobacterium bovis subsp bovis AF2122/97
cucgcgggcagggccucggucg

SEQ ID NO: 3193818 - RNA, 21 nt, Mycobacterium bovis subsp bovis AF2122/97
cucgcgggccaaagccgucag

SEQ ID NO: 3193819 - RNA, 16 nt, Mycobacterium bovis subsp bovis AF2122/97
cucgcgggcccgcgcg

SEQ ID NO: 3193820 - RNA, 18 nt, Mycobacterium bovis subsp bovis AF2122/97
cucgcgggcgaccaccgc

SEQ ID NO: 3193821 - RNA, 19 nt, Mycobacterium bovis subsp bovis AF2122/97
cucgcgggcgaccaccgcg

SEQ ID NO: 3193822 - RNA, 15 nt, Mycobacterium bovis subsp bovis AF2122/97
cucgcgggcggcgug

SEQ ID NO: 3193823 - RNA, 16 nt, Mycobacterium bovis subsp bovis AF2122/97
cucgcgguagcgccgu

SEQ ID NO: 3193824 - RNA, 19 nt, Mycobacterium bovis subsp bovis AF2122/97
cucgcgguagucguugccg

SEQ ID NO: 3193825 - RNA, 21 nt, Mycobacterium bovis subsp bovis AF2122/97
cucgcgguaguugucccgccg

SEQ ID NO: 3193826 - RNA, 17 nt, Mycobacterium bovis subsp bovis AF2122/97
cucgcggucgacagcgc

SEQ ID NO: 3193827 - RNA, 23 nt, Mycobacterium bovis subsp bovis AF2122/97
cucgcggugcggcaacagcgcca

SEQ ID NO: 3193828 - RNA, 16 nt, Mycobacterium bovis subsp bovis AF2122/97
cucgcgguggccgaac

SEQ ID NO: 3193829 - RNA, 19 nt, Mycobacterium bovis subsp bovis AF2122/97
cucgcgguuuuggucgcga

SEQ ID NO: 3193830 - RNA, 17 nt, Mycobacterium bovis subsp bovis AF2122/97
cucgcguagggccagcg

SEQ ID NO: 3193831 - RNA, 14 nt, Mycobacterium bovis subsp bovis AF2122/97
cucgcguggcaccg

SEQ ID NO: 3193832 - RNA, 14 nt, Mycobacterium bovis subsp bovis AF2122/97
cucgcguggccgcc

SEQ ID NO: 3193833 - RNA, 17 nt, Mycobacterium bovis subsp bovis AF2122/97
cucgcguucgcuggucc

SEQ ID NO: 3193834 - RNA, 15 nt, Mycobacterium bovis subsp bovis AF2122/97
cucgcuaacucccca

SEQ ID NO: 3193835 - RNA, 16 nt, Mycobacterium bovis subsp bovis AF2122/97
cucgcuauugggugca

SEQ ID NO: 3193836 - RNA, 12 nt, Mycobacterium bovis subsp bovis AF2122/97
cucgcucaccgg

SEQ ID NO: 3193837 - RNA, 14 nt, Mycobacterium bovis subsp bovis AF2122/97
cucgcucaccggcg

SEQ ID NO: 3193838 - RNA, 14 nt, Mycobacterium bovis subsp bovis AF2122/97
cucgcucaccggcu

SEQ ID NO: 3193839 - RNA, 20 nt, Mycobacterium bovis subsp bovis AF2122/97
cucgcucaccggcuggugcc

SEQ ID NO: 3193840 - RNA, 21 nt, Mycobacterium bovis subsp bovis AF2122/97
cucgcucaccggcuggugcca

SEQ ID NO: 3193841 - RNA, 14 nt, Mycobacterium bovis subsp bovis AF2122/97
cucgcuccgaccgg

SEQ ID NO: 3193842 - RNA, 18 nt, Mycobacterium bovis subsp bovis AF2122/97
cucgcugauaguggcgcg

SEQ ID NO: 3193843 - RNA, 21 nt, Mycobacterium bovis subsp bovis AF2122/97
cucgcugaucagcaugcggcc

SEQ ID NO: 3193844 - RNA, 20 nt, Mycobacterium bovis subsp bovis AF2122/97
cucgcugaucaggucuucga

SEQ ID NO: 3193845 - RNA, 22 nt, Mycobacterium bovis subsp bovis AF2122/97
cucgcugaucuggggcaccacg

SEQ ID NO: 3193846 - RNA, 23 nt, Mycobacterium bovis subsp bovis AF2122/97
cucgcugcaccagcugcucgucg

SEQ ID NO: 3193847 - RNA, 15 nt, Mycobacterium bovis subsp bovis AF2122/97
cucgcuggugaacca

SEQ ID NO: 3193848 - RNA, 14 nt, Mycobacterium bovis subsp bovis AF2122/97
cucgcuguugaagc

SEQ ID NO: 3193849 - RNA, 18 nt, Mycobacterium bovis subsp bovis AF2122/97
cucgcuguugaagccgcc

SEQ ID NO: 3193850 - RNA, 20 nt, Mycobacterium bovis subsp bovis AF2122/97
cucgcuuagcgucgcugccc

SEQ ID NO: 3193851 - RNA, 14 nt, Mycobacterium bovis subsp bovis AF2122/97
cucggaaucggcgg

SEQ ID NO: 3193852 - RNA, 12 nt, Mycobacterium bovis subsp bovis AF2122/97
cucggacacgcu

SEQ ID NO: 3193853 - RNA, 13 nt, Mycobacterium bovis subsp bovis AF2122/97
cucggacccaccc

SEQ ID NO: 3193854 - RNA, 16 nt, Mycobacterium bovis subsp bovis AF2122/97
cucggacgcgccggcg

SEQ ID NO: 3193855 - RNA, 15 nt, Mycobacterium bovis subsp bovis AF2122/97
cucggacugcagcgc

SEQ ID NO: 3193856 - RNA, 19 nt, Mycobacterium bovis subsp bovis AF2122/97
cucggacugcagcgcggcc

SEQ ID NO: 3193857 - RNA, 14 nt, Mycobacterium bovis subsp bovis AF2122/97
cucggagaucgcca

SEQ ID NO: 3193858 - RNA, 22 nt, Mycobacterium bovis subsp bovis AF2122/97
cucggaggcgaccacgucggcg

SEQ ID NO: 3193859 - RNA, 17 nt, Mycobacterium bovis subsp bovis AF2122/97
cucggaucggcucgcca

SEQ ID NO: 3193860 - RNA, 20 nt, Mycobacterium bovis subsp bovis AF2122/97
cucggaucuugacguucgcg

SEQ ID NO: 3193861 - RNA, 23 nt, Mycobacterium bovis subsp bovis AF2122/97
cucggcaaccaccucgugggcca

SEQ ID NO: 3193862 - RNA, 21 nt, Mycobacterium bovis subsp bovis AF2122/97
cucggcaaccugcgaccaggc

SEQ ID NO: 3193863 - RNA, 15 nt, Mycobacterium bovis subsp bovis AF2122/97
cucggcaagucgacg

SEQ ID NO: 3193864 - RNA, 22 nt, Mycobacterium bovis subsp bovis AF2122/97
cucggcaagucgacgccgcagc

SEQ ID NO: 3193865 - RNA, 12 nt, Mycobacterium bovis subsp bovis AF2122/97
cucggcaccaca

SEQ ID NO: 3193866 - RNA, 17 nt, Mycobacterium bovis subsp bovis AF2122/97
cucggcacccggcagag

SEQ ID NO: 3193867 - RNA, 20 nt, Mycobacterium bovis subsp bovis AF2122/97
cucggcacccggcagagcac

SEQ ID NO: 3193868 - RNA, 16 nt, Mycobacterium bovis subsp bovis AF2122/97
cucggcaccgcggccg

SEQ ID NO: 3193869 - RNA, 19 nt, Mycobacterium bovis subsp bovis AF2122/97
cucggcacggaccgcgucg

SEQ ID NO: 3193870 - RNA, 11 nt, Mycobacterium bovis subsp bovis AF2122/97
cucggcaggcc

SEQ ID NO: 3193871 - RNA, 15 nt, Mycobacterium bovis subsp bovis AF2122/97
cucggcauccaggcu

SEQ ID NO: 3193872 - RNA, 23 nt, Mycobacterium bovis subsp bovis AF2122/97
cucggcauccaggcugucgcggg

SEQ ID NO: 3193873 - RNA, 18 nt, Mycobacterium bovis subsp bovis AF2122/97
cucggcaucccguucagc

SEQ ID NO: 3193874 - RNA, 15 nt, Mycobacterium bovis subsp bovis AF2122/97
cucggcaucgagcag

SEQ ID NO: 3193875 - RNA, 22 nt, Mycobacterium bovis subsp bovis AF2122/97
cucggcaugagucgaaccaggu

SEQ ID NO: 3193876 - RNA, 19 nt, Mycobacterium bovis subsp bovis AF2122/97
cucggcaugcagccccacu

SEQ ID NO: 3193877 - RNA, 15 nt, Mycobacterium bovis subsp bovis AF2122/97
cucggcauucaccgc

SEQ ID NO: 3193878 - RNA, 16 nt, Mycobacterium bovis subsp bovis AF2122/97
cucggcauucaccgcg

SEQ ID NO: 3193879 - RNA, 17 nt, Mycobacterium bovis subsp bovis AF2122/97
cucggccaacgacggcc

SEQ ID NO: 3193880 - RNA, 12 nt, Mycobacterium bovis subsp bovis AF2122/97
cucggccaccag

SEQ ID NO: 3193881 - RNA, 13 nt, Mycobacterium bovis subsp bovis AF2122/97
cucggccaccagc

SEQ ID NO: 3193882 - RNA, 14 nt, Mycobacterium bovis subsp bovis AF2122/97
cucggccaccagcg

SEQ ID NO: 3193883 - RNA, 16 nt, Mycobacterium bovis subsp bovis AF2122/97
cucggccaccagcgcc

SEQ ID NO: 3193884 - RNA, 20 nt, Mycobacterium bovis subsp bovis AF2122/97
cucggccaccagcgcccggc

SEQ ID NO: 3193885 - RNA, 14 nt, Mycobacterium bovis subsp bovis AF2122/97
cucggccacccgca

SEQ ID NO: 3193886 - RNA, 13 nt, Mycobacterium bovis subsp bovis AF2122/97
cucggccaccgaa

SEQ ID NO: 3193887 - RNA, 12 nt, Mycobacterium bovis subsp bovis AF2122/97
cucggccacgaa

SEQ ID NO: 3193888 - RNA, 13 nt, Mycobacterium bovis subsp bovis AF2122/97
cucggccacggcg

SEQ ID NO: 3193889 - RNA, 13 nt, Mycobacterium bovis subsp bovis AF2122/97
cucggccagcacg

SEQ ID NO: 3193890 - RNA, 17 nt, Mycobacterium bovis subsp bovis AF2122/97
cucggccagcacgccgc

SEQ ID NO: 3193891 - RNA, 18 nt, Mycobacterium bovis subsp bovis AF2122/97
cucggccagcacgccgcc

SEQ ID NO: 3193892 - RNA, 20 nt, Mycobacterium bovis subsp bovis AF2122/97
cucggccagcaucagcucga

SEQ ID NO: 3193893 - RNA, 13 nt, Mycobacterium bovis subsp bovis AF2122/97
cucggccagccag

SEQ ID NO: 3193894 - RNA, 13 nt, Mycobacterium bovis subsp bovis AF2122/97
cucggccaggaug

SEQ ID NO: 3193895 - RNA, 19 nt, Mycobacterium bovis subsp bovis AF2122/97
cucggccaggcuggccaac

SEQ ID NO: 3193896 - RNA, 14 nt, Mycobacterium bovis subsp bovis AF2122/97
cucggccauagcgc

SEQ ID NO: 3193897 - RNA, 15 nt, Mycobacterium bovis subsp bovis AF2122/97
cucggccauagcgcc

SEQ ID NO: 3193898 - RNA, 17 nt, Mycobacterium bovis subsp bovis AF2122/97
cucggccauagcgccgc

SEQ ID NO: 3193899 - RNA, 21 nt, Mycobacterium bovis subsp bovis AF2122/97
cucggccauagcgccgcgccc

SEQ ID NO: 3193900 - RNA, 22 nt, Mycobacterium bovis subsp bovis AF2122/97
cucggccauagcgccgcgccca

SEQ ID NO: 3193901 - RNA, 17 nt, Mycobacterium bovis subsp bovis AF2122/97
cucggccaucagaaccu

SEQ ID NO: 3193902 - RNA, 22 nt, Mycobacterium bovis subsp bovis AF2122/97
cucggccaucagaaccuccucg

SEQ ID NO: 3193903 - RNA, 19 nt, Mycobacterium bovis subsp bovis AF2122/97
cucggccaucugcucgugg

SEQ ID NO: 3193904 - RNA, 13 nt, Mycobacterium bovis subsp bovis AF2122/97
cucggccccgccg

SEQ ID NO: 3193905 - RNA, 15 nt, Mycobacterium bovis subsp bovis AF2122/97
cucggccccgccgcc

SEQ ID NO: 3193906 - RNA, 14 nt, Mycobacterium bovis subsp bovis AF2122/97
cucggcccggcagg

SEQ ID NO: 3193907 - RNA, 16 nt, Mycobacterium bovis subsp bovis AF2122/97
cucggccgacgagauc

SEQ ID NO: 3193908 - RNA, 18 nt, Mycobacterium bovis subsp bovis AF2122/97
cucggccgaggaccagag

SEQ ID NO: 3193909 - RNA, 20 nt, Mycobacterium bovis subsp bovis AF2122/97
cucggccgaugcgcagugca

SEQ ID NO: 3193910 - RNA, 15 nt, Mycobacterium bovis subsp bovis AF2122/97
cucggccgcaccagc

SEQ ID NO: 3193911 - RNA, 16 nt, Mycobacterium bovis subsp bovis AF2122/97
cucggccgcaccagca

SEQ ID NO: 3193912 - RNA, 13 nt, Mycobacterium bovis subsp bovis AF2122/97
cucggccgcaggc

SEQ ID NO: 3193913 - RNA, 17 nt, Mycobacterium bovis subsp bovis AF2122/97
cucggccgcaggcuugc

SEQ ID NO: 3193914 - RNA, 14 nt, Mycobacterium bovis subsp bovis AF2122/97
cucggccgccagcc

SEQ ID NO: 3193915 - RNA, 20 nt, Mycobacterium bovis subsp bovis AF2122/97
cucggccgccagccccaccc

SEQ ID NO: 3193916 - RNA, 12 nt, Mycobacterium bovis subsp bovis AF2122/97
cucggccgcccg

SEQ ID NO: 3193917 - RNA, 12 nt, Mycobacterium bovis subsp bovis AF2122/97
cucggccggcgg

SEQ ID NO: 3193918 - RNA, 13 nt, Mycobacterium bovis subsp bovis AF2122/97
cucggccggcggc

SEQ ID NO: 3193919 - RNA, 16 nt, Mycobacterium bovis subsp bovis AF2122/97
cucggccggcggcgcc

SEQ ID NO: 3193920 - RNA, 13 nt, Mycobacterium bovis subsp bovis AF2122/97
cucggccgucagg

SEQ ID NO: 3193921 - RNA, 15 nt, Mycobacterium bovis subsp bovis AF2122/97
cucggccgugaccga

SEQ ID NO: 3193922 - RNA, 21 nt, Mycobacterium bovis subsp bovis AF2122/97
cucggccgugaccgagccgcg

SEQ ID NO: 3193923 - RNA, 13 nt, Mycobacterium bovis subsp bovis AF2122/97
cucggccucgucg

SEQ ID NO: 3193924 - RNA, 13 nt, Mycobacterium bovis subsp bovis AF2122/97
cucggccuggaug

SEQ ID NO: 3193925 - RNA, 22 nt, Mycobacterium bovis subsp bovis AF2122/97
cucggccuguucggcggcugcc

SEQ ID NO: 3193926 - RNA, 17 nt, Mycobacterium bovis subsp bovis AF2122/97
cucggcgaaacccggga

SEQ ID NO: 3193927 - RNA, 20 nt, Mycobacterium bovis subsp bovis AF2122/97
cucggcgaaccuugguugcc

SEQ ID NO: 3193928 - RNA, 18 nt, Mycobacterium bovis subsp bovis AF2122/97
cucggcgaaggccgcgcg

SEQ ID NO: 3193929 - RNA, 17 nt, Mycobacterium bovis subsp bovis AF2122/97
cucggcgaccgacgccg

SEQ ID NO: 3193930 - RNA, 20 nt, Mycobacterium bovis subsp bovis AF2122/97
cucggcgaccugccggaccg

SEQ ID NO: 3193931 - RNA, 22 nt, Mycobacterium bovis subsp bovis AF2122/97
cucggcgaccugccggaccgcg

SEQ ID NO: 3193932 - RNA, 18 nt, Mycobacterium bovis subsp bovis AF2122/97
cucggcgaccugcucgcu

SEQ ID NO: 3193933 - RNA, 22 nt, Mycobacterium bovis subsp bovis AF2122/97
cucggcgacgaugucgagcgcg

SEQ ID NO: 3193934 - RNA, 22 nt, Mycobacterium bovis subsp bovis AF2122/97
cucggcgagcaacacgagcgca

SEQ ID NO: 3193935 - RNA, 15 nt, Mycobacterium bovis subsp bovis AF2122/97
cucggcgagcacguc

SEQ ID NO: 3193936 - RNA, 16 nt, Mycobacterium bovis subsp bovis AF2122/97
cucggcgagcacguca

SEQ ID NO: 3193937 - RNA, 13 nt, Mycobacterium bovis subsp bovis AF2122/97
cucggcgagcuca

SEQ ID NO: 3193938 - RNA, 23 nt, Mycobacterium bovis subsp bovis AF2122/97
cucggcgagugucuuagccagca

SEQ ID NO: 3193939 - RNA, 13 nt, Mycobacterium bovis subsp bovis AF2122/97
cucggcgaguucg

SEQ ID NO: 3193940 - RNA, 20 nt, Mycobacterium bovis subsp bovis AF2122/97
cucggcgaguucggcagcgg

SEQ ID NO: 3193941 - RNA, 23 nt, Mycobacterium bovis subsp bovis AF2122/97
cucggcgaguucggcagcgggcu

SEQ ID NO: 3193942 - RNA, 15 nt, Mycobacterium bovis subsp bovis AF2122/97
cucggcgaucacgcg

SEQ ID NO: 3193943 - RNA, 11 nt, Mycobacterium bovis subsp bovis AF2122/97
cucggcgauga

SEQ ID NO: 3193944 - RNA, 21 nt, Mycobacterium bovis subsp bovis AF2122/97
cucggcgaugacaucaccgac

SEQ ID NO: 3193945 - RNA, 20 nt, Mycobacterium bovis subsp bovis AF2122/97
cucggcgaugggccgguccg

SEQ ID NO: 3193946 - RNA, 22 nt, Mycobacterium bovis subsp bovis AF2122/97
cucggcgauuuugcgucgcgcc

SEQ ID NO: 3193947 - RNA, 12 nt, Mycobacterium bovis subsp bovis AF2122/97
cucggcgcagca

SEQ ID NO: 3193948 - RNA, 17 nt, Mycobacterium bovis subsp bovis AF2122/97
cucggcgcagcacaucc

SEQ ID NO: 3193949 - RNA, 14 nt, Mycobacterium bovis subsp bovis AF2122/97
cucggcgcagccgg

SEQ ID NO: 3193950 - RNA, 15 nt, Mycobacterium bovis subsp bovis AF2122/97
cucggcgcagccggu

SEQ ID NO: 3193951 - RNA, 17 nt, Mycobacterium bovis subsp bovis AF2122/97
cucggcgcagccgguga

SEQ ID NO: 3193952 - RNA, 18 nt, Mycobacterium bovis subsp bovis AF2122/97
cucggcgcccagcucguc

SEQ ID NO: 3193953 - RNA, 18 nt, Mycobacterium bovis subsp bovis AF2122/97
cucggcgcccuccuuggc

SEQ ID NO: 3193954 - RNA, 19 nt, Mycobacterium bovis subsp bovis AF2122/97
cucggcgcccuccuuggcg

SEQ ID NO: 3193955 - RNA, 13 nt, Mycobacterium bovis subsp bovis AF2122/97
cucggcgccgccc

SEQ ID NO: 3193956 - RNA, 14 nt, Mycobacterium bovis subsp bovis AF2122/97
cucggcgccgccca

SEQ ID NO: 3193957 - RNA, 17 nt, Mycobacterium bovis subsp bovis AF2122/97
cucggcgccgcccagca

SEQ ID NO: 3193958 - RNA, 22 nt, Mycobacterium bovis subsp bovis AF2122/97
cucggcgccgucggagccggcc

SEQ ID NO: 3193959 - RNA, 19 nt, Mycobacterium bovis subsp bovis AF2122/97
cucggcgcgccggucgccg

SEQ ID NO: 3193960 - RNA, 20 nt, Mycobacterium bovis subsp bovis AF2122/97
cucggcgcgccggucgccga

SEQ ID NO: 3193961 - RNA, 13 nt, Mycobacterium bovis subsp bovis AF2122/97
cucggcgcggugg

SEQ ID NO: 3193962 - RNA, 14 nt, Mycobacterium bovis subsp bovis AF2122/97
cucggcgcgguggg

SEQ ID NO: 3193963 - RNA, 22 nt, Mycobacterium bovis subsp bovis AF2122/97
cucggcgcgguggggcgcgccg

SEQ ID NO: 3193964 - RNA, 17 nt, Mycobacterium bovis subsp bovis AF2122/97
cucggcgcucaugggcg

SEQ ID NO: 3193965 - RNA, 13 nt, Mycobacterium bovis subsp bovis AF2122/97
cucggcgcugcgc

SEQ ID NO: 3193966 - RNA, 20 nt, Mycobacterium bovis subsp bovis AF2122/97
cucggcgcugcgcaccgccg

SEQ ID NO: 3193967 - RNA, 14 nt, Mycobacterium bovis subsp bovis AF2122/97
cucggcggaagacc

SEQ ID NO: 3193968 - RNA, 23 nt, Mycobacterium bovis subsp bovis AF2122/97
cucggcggaagaccggaucgccu

SEQ ID NO: 3193969 - RNA, 17 nt, Mycobacterium bovis subsp bovis AF2122/97
cucggcggacccgguga

SEQ ID NO: 3193970 - RNA, 18 nt, Mycobacterium bovis subsp bovis AF2122/97
cucggcggacccggugac

SEQ ID NO: 3193971 - RNA, 19 nt, Mycobacterium bovis subsp bovis AF2122/97
cucggcggacccggugacc

SEQ ID NO: 3193972 - RNA, 16 nt, Mycobacterium bovis subsp bovis AF2122/97
cucggcggccaacagc

SEQ ID NO: 3193973 - RNA, 14 nt, Mycobacterium bovis subsp bovis AF2122/97
cucggcggccagcg

SEQ ID NO: 3193974 - RNA, 15 nt, Mycobacterium bovis subsp bovis AF2122/97
cucggcggccagcga

SEQ ID NO: 3193975 - RNA, 14 nt, Mycobacterium bovis subsp bovis AF2122/97
cucggcggccagcu

SEQ ID NO: 3193976 - RNA, 14 nt, Mycobacterium bovis subsp bovis AF2122/97
cucggcggcccggc

SEQ ID NO: 3193977 - RNA, 16 nt, Mycobacterium bovis subsp bovis AF2122/97
cucggcggcccggccg

SEQ ID NO: 3193978 - RNA, 19 nt, Mycobacterium bovis subsp bovis AF2122/97
cucggcggcccggccgaac

SEQ ID NO: 3193979 - RNA, 12 nt, Mycobacterium bovis subsp bovis AF2122/97
cucggcggccgc

SEQ ID NO: 3193980 - RNA, 22 nt, Mycobacterium bovis subsp bovis AF2122/97
cucggcggccgcgugcucgccg

SEQ ID NO: 3193981 - RNA, 12 nt, Mycobacterium bovis subsp bovis AF2122/97
cucggcggccuc

SEQ ID NO: 3193982 - RNA, 15 nt, Mycobacterium bovis subsp bovis AF2122/97
cucggcggccucgcu

SEQ ID NO: 3193983 - RNA, 20 nt, Mycobacterium bovis subsp bovis AF2122/97
cucggcggccuuaggugacc

SEQ ID NO: 3193984 - RNA, 21 nt, Mycobacterium bovis subsp bovis AF2122/97
cucggcggccuuaggugacca

SEQ ID NO: 3193985 - RNA, 22 nt, Mycobacterium bovis subsp bovis AF2122/97
cucggcggcgcggucgaagcug

SEQ ID NO: 3193986 - RNA, 14 nt, Mycobacterium bovis subsp bovis AF2122/97
cucggcggcggcac

SEQ ID NO: 3193987 - RNA, 15 nt, Mycobacterium bovis subsp bovis AF2122/97
cucggcggcggcacg

SEQ ID NO: 3193988 - RNA, 16 nt, Mycobacterium bovis subsp bovis AF2122/97
cucggcgggauccucg

SEQ ID NO: 3193989 - RNA, 21 nt, Mycobacterium bovis subsp bovis AF2122/97
cucggcgguaaaugccugccc

SEQ ID NO: 3193990 - RNA, 17 nt, Mycobacterium bovis subsp bovis AF2122/97
cucggcggucgggagau

SEQ ID NO: 3193991 - RNA, 16 nt, Mycobacterium bovis subsp bovis AF2122/97
cucggcggucuuggcg

SEQ ID NO: 3193992 - RNA, 20 nt, Mycobacterium bovis subsp bovis AF2122/97
cucggcggucuuggcgcgcc

SEQ ID NO: 3193993 - RNA, 15 nt, Mycobacterium bovis subsp bovis AF2122/97
cucggcggugccgcg

SEQ ID NO: 3193994 - RNA, 18 nt, Mycobacterium bovis subsp bovis AF2122/97
cucggcggugccgcggcu

SEQ ID NO: 3193995 - RNA, 17 nt, Mycobacterium bovis subsp bovis AF2122/97
cucggcgguuccggcgg

SEQ ID NO: 3193996 - RNA, 17 nt, Mycobacterium bovis subsp bovis AF2122/97
cucggcguacucgugca

SEQ ID NO: 3193997 - RNA, 23 nt, Mycobacterium bovis subsp bovis AF2122/97
cucggcguacucgugcaccgucg

SEQ ID NO: 3193998 - RNA, 23 nt, Mycobacterium bovis subsp bovis AF2122/97
cucggcguaggcgauggcggcgc

SEQ ID NO: 3193999 - RNA, 15 nt, Mycobacterium bovis subsp bovis AF2122/97
cucggcgucgaccag

SEQ ID NO: 3194000 - RNA, 12 nt, Mycobacterium bovis subsp bovis AF2122/97
cucggcgucgag

SEQ ID NO: 3194001 - RNA, 16 nt, Mycobacterium bovis subsp bovis AF2122/97
cucggcgucgccgcca

SEQ ID NO: 3194002 - RNA, 17 nt, Mycobacterium bovis subsp bovis AF2122/97
cucggcgucgccgccau

SEQ ID NO: 3194003 - RNA, 21 nt, Mycobacterium bovis subsp bovis AF2122/97
cucggcgucgccgccauugcc

SEQ ID NO: 3194004 - RNA, 21 nt, Mycobacterium bovis subsp bovis AF2122/97
cucggcgucgugguggccacg

SEQ ID NO: 3194005 - RNA, 19 nt, Mycobacterium bovis subsp bovis AF2122/97
cucggcgugaucaccggca

SEQ ID NO: 3194006 - RNA, 16 nt, Mycobacterium bovis subsp bovis AF2122/97
cucggcgugcucggcc

SEQ ID NO: 3194007 - RNA, 18 nt, Mycobacterium bovis subsp bovis AF2122/97
cucggcgugcugguaacc

SEQ ID NO: 3194008 - RNA, 19 nt, Mycobacterium bovis subsp bovis AF2122/97
cucggcguguccgccgaac

SEQ ID NO: 3194009 - RNA, 15 nt, Mycobacterium bovis subsp bovis AF2122/97
cucggcgugucugcc

SEQ ID NO: 3194010 - RNA, 16 nt, Mycobacterium bovis subsp bovis AF2122/97
cucggcuagugugacc

SEQ ID NO: 3194011 - RNA, 18 nt, Mycobacterium bovis subsp bovis AF2122/97
cucggcuagugugaccgu

SEQ ID NO: 3194012 - RNA, 16 nt, Mycobacterium bovis subsp bovis AF2122/97
cucggcuauggguucg

SEQ ID NO: 3194013 - RNA, 15 nt, Mycobacterium bovis subsp bovis AF2122/97
cucggcugcucgacg

SEQ ID NO: 3194014 - RNA, 17 nt, Mycobacterium bovis subsp bovis AF2122/97
cucgggacucccgcgcg

SEQ ID NO: 3194015 - RNA, 18 nt, Mycobacterium bovis subsp bovis AF2122/97
cucgggacugcgcggcuu

SEQ ID NO: 3194016 - RNA, 15 nt, Mycobacterium bovis subsp bovis AF2122/97
cucgggaucaccgau

SEQ ID NO: 3194017 - RNA, 13 nt, Mycobacterium bovis subsp bovis AF2122/97
cucgggaucggcg

SEQ ID NO: 3194018 - RNA, 20 nt, Mycobacterium bovis subsp bovis AF2122/97
cucgggaucggcggggucga

SEQ ID NO: 3194019 - RNA, 17 nt, Mycobacterium bovis subsp bovis AF2122/97
cucgggauucggcagcg

SEQ ID NO: 3194020 - RNA, 16 nt, Mycobacterium bovis subsp bovis AF2122/97
cucgggcaaggccacc

SEQ ID NO: 3194021 - RNA, 17 nt, Mycobacterium bovis subsp bovis AF2122/97
cucgggcaaggccaccg

SEQ ID NO: 3194022 - RNA, 19 nt, Mycobacterium bovis subsp bovis AF2122/97
cucgggcaaggccaccggc

SEQ ID NO: 3194023 - RNA, 20 nt, Mycobacterium bovis subsp bovis AF2122/97
cucgggcaaugucgacaccg

SEQ ID NO: 3194024 - RNA, 23 nt, Mycobacterium bovis subsp bovis AF2122/97
cucgggcaaugucgacaccggcg

SEQ ID NO: 3194025 - RNA, 17 nt, Mycobacterium bovis subsp bovis AF2122/97
cucgggcaccuggucgg

SEQ ID NO: 3194026 - RNA, 22 nt, Mycobacterium bovis subsp bovis AF2122/97
cucgggcaccuggucggccgca

SEQ ID NO: 3194027 - RNA, 16 nt, Mycobacterium bovis subsp bovis AF2122/97
cucgggcagcgcggcc

SEQ ID NO: 3194028 - RNA, 19 nt, Mycobacterium bovis subsp bovis AF2122/97
cucgggcagcgucacccug

SEQ ID NO: 3194029 - RNA, 19 nt, Mycobacterium bovis subsp bovis AF2122/97
cucgggcagcuucaacacc

SEQ ID NO: 3194030 - RNA, 17 nt, Mycobacterium bovis subsp bovis AF2122/97
cucgggcaggccccacu

SEQ ID NO: 3194031 - RNA, 18 nt, Mycobacterium bovis subsp bovis AF2122/97
cucgggcaggccccacug

SEQ ID NO: 3194032 - RNA, 23 nt, Mycobacterium bovis subsp bovis AF2122/97
cucgggcaggccccacuggugca

SEQ ID NO: 3194033 - RNA, 18 nt, Mycobacterium bovis subsp bovis AF2122/97
cucgggcaggcggccagc

SEQ ID NO: 3194034 - RNA, 20 nt, Mycobacterium bovis subsp bovis AF2122/97
cucgggcaggcggccagcga

SEQ ID NO: 3194035 - RNA, 21 nt, Mycobacterium bovis subsp bovis AF2122/97
cucgggcgcgggugaccaggc

SEQ ID NO: 3194036 - RNA, 12 nt, Mycobacterium bovis subsp bovis AF2122/97
cucgggcggcuu

SEQ ID NO: 3194037 - RNA, 14 nt, Mycobacterium bovis subsp bovis AF2122/97
cucgggcgugaucc

SEQ ID NO: 3194038 - RNA, 18 nt, Mycobacterium bovis subsp bovis AF2122/97
cucggggaacaccgcggu

SEQ ID NO: 3194039 - RNA, 13 nt, Mycobacterium bovis subsp bovis AF2122/97
cucggggcgauga

SEQ ID NO: 3194040 - RNA, 12 nt, Mycobacterium bovis subsp bovis AF2122/97
cucgggggcugc

SEQ ID NO: 3194041 - RNA, 19 nt, Mycobacterium bovis subsp bovis AF2122/97
cucggguccaaccacgagc

SEQ ID NO: 3194042 - RNA, 19 nt, Mycobacterium bovis subsp bovis AF2122/97
cucgguaagugccucgcgg

SEQ ID NO: 3194043 - RNA, 15 nt, Mycobacterium bovis subsp bovis AF2122/97
cucgguaccaccggc

SEQ ID NO: 3194044 - RNA, 14 nt, Mycobacterium bovis subsp bovis AF2122/97
cucgguaggccggc

SEQ ID NO: 3194045 - RNA, 15 nt, Mycobacterium bovis subsp bovis AF2122/97
cucgguaggccggca

SEQ ID NO: 3194046 - RNA, 16 nt, Mycobacterium bovis subsp bovis AF2122/97
cucgguaggcgguguc

SEQ ID NO: 3194047 - RNA, 18 nt, Mycobacterium bovis subsp bovis AF2122/97
cucgguauauccggguga

SEQ ID NO: 3194048 - RNA, 19 nt, Mycobacterium bovis subsp bovis AF2122/97
cucggucaacgcuucggca

SEQ ID NO: 3194049 - RNA, 21 nt, Mycobacterium bovis subsp bovis AF2122/97
cucggucaacgcuucggcacg

SEQ ID NO: 3194050 - RNA, 20 nt, Mycobacterium bovis subsp bovis AF2122/97
cucggucagaugcgcgggga

SEQ ID NO: 3194051 - RNA, 17 nt, Mycobacterium bovis subsp bovis AF2122/97
cucggucagcgucaggu

SEQ ID NO: 3194052 - RNA, 20 nt, Mycobacterium bovis subsp bovis AF2122/97
cucggucaggcggcuggccc

SEQ ID NO: 3194053 - RNA, 21 nt, Mycobacterium bovis subsp bovis AF2122/97
cucgguccaauuccagcucac

SEQ ID NO: 3194054 - RNA, 13 nt, Mycobacterium bovis subsp bovis AF2122/97
cucggucccgccg

SEQ ID NO: 3194055 - RNA, 18 nt, Mycobacterium bovis subsp bovis AF2122/97
cucggucccguugccgcc

SEQ ID NO: 3194056 - RNA, 15 nt, Mycobacterium bovis subsp bovis AF2122/97
cucggucgaugcuca

SEQ ID NO: 3194057 - RNA, 22 nt, Mycobacterium bovis subsp bovis AF2122/97
cucggucgaugcucagugccaa

SEQ ID NO: 3194058 - RNA, 13 nt, Mycobacterium bovis subsp bovis AF2122/97
cucggucgccacc

SEQ ID NO: 3194059 - RNA, 14 nt, Mycobacterium bovis subsp bovis AF2122/97
cucggucgccaccg

SEQ ID NO: 3194060 - RNA, 16 nt, Mycobacterium bovis subsp bovis AF2122/97
cucggucgccaccgcc

SEQ ID NO: 3194061 - RNA, 23 nt, Mycobacterium bovis subsp bovis AF2122/97
cucggucgccaccgccggcagca

SEQ ID NO: 3194062 - RNA, 15 nt, Mycobacterium bovis subsp bovis AF2122/97
cucggucgccuccuc

SEQ ID NO: 3194063 - RNA, 14 nt, Mycobacterium bovis subsp bovis AF2122/97
cucggucggcagcu

SEQ ID NO: 3194064 - RNA, 17 nt, Mycobacterium bovis subsp bovis AF2122/97
cucggucggcagcucca

SEQ ID NO: 3194065 - RNA, 14 nt, Mycobacterium bovis subsp bovis AF2122/97
cucggucucgucgc

SEQ ID NO: 3194066 - RNA, 14 nt, Mycobacterium bovis subsp bovis AF2122/97
cucggucugcaugc

SEQ ID NO: 3194067 - RNA, 17 nt, Mycobacterium bovis subsp bovis AF2122/97
cucggugaacgccgccc

SEQ ID NO: 3194068 - RNA, 19 nt, Mycobacterium bovis subsp bovis AF2122/97
cucggugaacgccgccccg

SEQ ID NO: 3194069 - RNA, 19 nt, Mycobacterium bovis subsp bovis AF2122/97
cucggugaaguggcgcacc

SEQ ID NO: 3194070 - RNA, 16 nt, Mycobacterium bovis subsp bovis AF2122/97
cucggugaccaggccg

SEQ ID NO: 3194071 - RNA, 22 nt, Mycobacterium bovis subsp bovis AF2122/97
cucggugagcagcucggugaca

SEQ ID NO: 3194072 - RNA, 20 nt, Mycobacterium bovis subsp bovis AF2122/97
cucggugaugcccagcgccg

SEQ ID NO: 3194073 - RNA, 21 nt, Mycobacterium bovis subsp bovis AF2122/97
cucggugaugcccagcgccga

SEQ ID NO: 3194074 - RNA, 14 nt, Mycobacterium bovis subsp bovis AF2122/97
cucggugcagcagc

SEQ ID NO: 3194075 - RNA, 16 nt, Mycobacterium bovis subsp bovis AF2122/97
cucggugccacugccg

SEQ ID NO: 3194076 - RNA, 13 nt, Mycobacterium bovis subsp bovis AF2122/97
cucggugccccca

SEQ ID NO: 3194077 - RNA, 13 nt, Mycobacterium bovis subsp bovis AF2122/97
cucggugccgccc

SEQ ID NO: 3194078 - RNA, 17 nt, Mycobacterium bovis subsp bovis AF2122/97
cucggugccgcccagga

SEQ ID NO: 3194079 - RNA, 13 nt, Mycobacterium bovis subsp bovis AF2122/97
cucggugcgcagc

SEQ ID NO: 3194080 - RNA, 21 nt, Mycobacterium bovis subsp bovis AF2122/97
cucggugcggaacaccgcccg

SEQ ID NO: 3194081 - RNA, 22 nt, Mycobacterium bovis subsp bovis AF2122/97
cucggugcggaacaccgcccgg

SEQ ID NO: 3194082 - RNA, 13 nt, Mycobacterium bovis subsp bovis AF2122/97
cucggugcggcug

SEQ ID NO: 3194083 - RNA, 23 nt, Mycobacterium bovis subsp bovis AF2122/97
cucggugcggugauuccagccgg

SEQ ID NO: 3194084 - RNA, 17 nt, Mycobacterium bovis subsp bovis AF2122/97
cucggugcugcgccgau

SEQ ID NO: 3194085 - RNA, 14 nt, Mycobacterium bovis subsp bovis AF2122/97
cucgguggacggca

SEQ ID NO: 3194086 - RNA, 16 nt, Mycobacterium bovis subsp bovis AF2122/97
cucgguggcgccgggg

SEQ ID NO: 3194087 - RNA, 15 nt, Mycobacterium bovis subsp bovis AF2122/97
cucgguggcugcgcc

SEQ ID NO: 3194088 - RNA, 17 nt, Mycobacterium bovis subsp bovis AF2122/97
cucgguggcugcgccgg

SEQ ID NO: 3194089 - RNA, 21 nt, Mycobacterium bovis subsp bovis AF2122/97
cucgguggucuuggcccggcg

SEQ ID NO: 3194090 - RNA, 22 nt, Mycobacterium bovis subsp bovis AF2122/97
cucgguggucuuggcccggcgg

SEQ ID NO: 3194091 - RNA, 22 nt, Mycobacterium bovis subsp bovis AF2122/97
cucgguggugaccaaguagucg

SEQ ID NO: 3194092 - RNA, 14 nt, Mycobacterium bovis subsp bovis AF2122/97
cucgguguccucga

SEQ ID NO: 3194093 - RNA, 16 nt, Mycobacterium bovis subsp bovis AF2122/97
cucggugucggccgcg

SEQ ID NO: 3194094 - RNA, 19 nt, Mycobacterium bovis subsp bovis AF2122/97
cucggugugcucgccgacc

SEQ ID NO: 3194095 - RNA, 20 nt, Mycobacterium bovis subsp bovis AF2122/97
cucggugugcucgccgacca

SEQ ID NO: 3194096 - RNA, 22 nt, Mycobacterium bovis subsp bovis AF2122/97
cucggugugcucgccgaccagc

SEQ ID NO: 3194097 - RNA, 18 nt, Mycobacterium bovis subsp bovis AF2122/97
cucgguuugcguccuggu

SEQ ID NO: 3194098 - RNA, 16 nt, Mycobacterium bovis subsp bovis AF2122/97
cucguaacgcggcacc

SEQ ID NO: 3194099 - RNA, 14 nt, Mycobacterium bovis subsp bovis AF2122/97
cucguacggaccgu

SEQ ID NO: 3194100 - RNA, 16 nt, Mycobacterium bovis subsp bovis AF2122/97
cucguagagcaccgca

SEQ ID NO: 3194101 - RNA, 19 nt, Mycobacterium bovis subsp bovis AF2122/97
cucguagccgccgucgccg

SEQ ID NO: 3194102 - RNA, 16 nt, Mycobacterium bovis subsp bovis AF2122/97
cucguaggugaagagc

SEQ ID NO: 3194103 - RNA, 20 nt, Mycobacterium bovis subsp bovis AF2122/97
cucguaggugaagagcacgu

SEQ ID NO: 3194104 - RNA, 15 nt, Mycobacterium bovis subsp bovis AF2122/97
cucguaggugccgaa

SEQ ID NO: 3194105 - RNA, 21 nt, Mycobacterium bovis subsp bovis AF2122/97
cucguaggugccgaagaugac

SEQ ID NO: 3194106 - RNA, 17 nt, Mycobacterium bovis subsp bovis AF2122/97
cucguauacccgggcgg

SEQ ID NO: 3194107 - RNA, 18 nt, Mycobacterium bovis subsp bovis AF2122/97
cucguaugccguggccgc

SEQ ID NO: 3194108 - RNA, 20 nt, Mycobacterium bovis subsp bovis AF2122/97
cucguaugccguggccgcca

SEQ ID NO: 3194109 - RNA, 20 nt, Mycobacterium bovis subsp bovis AF2122/97
cucgucaccaaacccgaugg

SEQ ID NO: 3194110 - RNA, 16 nt, Mycobacterium bovis subsp bovis AF2122/97
cucgucacccgguguc

SEQ ID NO: 3194111 - RNA, 23 nt, Mycobacterium bovis subsp bovis AF2122/97
cucgucacccgguguccagugca

SEQ ID NO: 3194112 - RNA, 18 nt, Mycobacterium bovis subsp bovis AF2122/97
cucgucaccgcgaccagc

SEQ ID NO: 3194113 - RNA, 20 nt, Mycobacterium bovis subsp bovis AF2122/97
cucgucauccauccgggccg

SEQ ID NO: 3194114 - RNA, 20 nt, Mycobacterium bovis subsp bovis AF2122/97
cucguccaagccggccacgc

SEQ ID NO: 3194115 - RNA, 22 nt, Mycobacterium bovis subsp bovis AF2122/97
cucguccaagccggccacgcau

SEQ ID NO: 3194116 - RNA, 14 nt, Mycobacterium bovis subsp bovis AF2122/97
cucguccagcaacc

SEQ ID NO: 3194117 - RNA, 15 nt, Mycobacterium bovis subsp bovis AF2122/97
cucguccagcaaccu

SEQ ID NO: 3194118 - RNA, 17 nt, Mycobacterium bovis subsp bovis AF2122/97
cucguccaggucggccg

SEQ ID NO: 3194119 - RNA, 18 nt, Mycobacterium bovis subsp bovis AF2122/97
cucguccaggucggccgc

SEQ ID NO: 3194120 - RNA, 22 nt, Mycobacterium bovis subsp bovis AF2122/97
cucguccaggucggccgccucg

SEQ ID NO: 3194121 - RNA, 15 nt, Mycobacterium bovis subsp bovis AF2122/97
cucgucccacagguu

SEQ ID NO: 3194122 - RNA, 15 nt, Mycobacterium bovis subsp bovis AF2122/97
cucgucgagccgacc

SEQ ID NO: 3194123 - RNA, 16 nt, Mycobacterium bovis subsp bovis AF2122/97
cucgucgagccgaccg

SEQ ID NO: 3194124 - RNA, 20 nt, Mycobacterium bovis subsp bovis AF2122/97
cucgucgagccgaccgcggg

SEQ ID NO: 3194125 - RNA, 23 nt, Mycobacterium bovis subsp bovis AF2122/97
cucgucgaggaagaucaccuccc

SEQ ID NO: 3194126 - RNA, 21 nt, Mycobacterium bovis subsp bovis AF2122/97
cucgucgaggcugaccguggc

SEQ ID NO: 3194127 - RNA, 18 nt, Mycobacterium bovis subsp bovis AF2122/97
cucgucgagguccucguc

SEQ ID NO: 3194128 - RNA, 14 nt, Mycobacterium bovis subsp bovis AF2122/97
cucgucgaucgccg

SEQ ID NO: 3194129 - RNA, 19 nt, Mycobacterium bovis subsp bovis AF2122/97
cucgucgaucgccgcgccg

SEQ ID NO: 3194130 - RNA, 15 nt, Mycobacterium bovis subsp bovis AF2122/97
cucgucgaucuccuc

SEQ ID NO: 3194131 - RNA, 18 nt, Mycobacterium bovis subsp bovis AF2122/97
cucgucgaugucgacguc

SEQ ID NO: 3194132 - RNA, 19 nt, Mycobacterium bovis subsp bovis AF2122/97
cucgucgaugucguuggcc

SEQ ID NO: 3194133 - RNA, 22 nt, Mycobacterium bovis subsp bovis AF2122/97
cucgucgaugucguuggccacc

SEQ ID NO: 3194134 - RNA, 21 nt, Mycobacterium bovis subsp bovis AF2122/97
cucgucgauguucgccgcgcg

SEQ ID NO: 3194135 - RNA, 15 nt, Mycobacterium bovis subsp bovis AF2122/97
cucgucgcaucacca

SEQ ID NO: 3194136 - RNA, 19 nt, Mycobacterium bovis subsp bovis AF2122/97
cucgucgcaucaccagggu

SEQ ID NO: 3194137 - RNA, 21 nt, Mycobacterium bovis subsp bovis AF2122/97
cucgucgccgguggcacccgc

SEQ ID NO: 3194138 - RNA, 17 nt, Mycobacterium bovis subsp bovis AF2122/97
cucgucgcgggccaccg

SEQ ID NO: 3194139 - RNA, 23 nt, Mycobacterium bovis subsp bovis AF2122/97
cucgucgcgggccaccgcuguca

SEQ ID NO: 3194140 - RNA, 15 nt, Mycobacterium bovis subsp bovis AF2122/97
cucgucgcgucgcca

SEQ ID NO: 3194141 - RNA, 21 nt, Mycobacterium bovis subsp bovis AF2122/97
cucgucgcucccgguuggggu

SEQ ID NO: 3194142 - RNA, 15 nt, Mycobacterium bovis subsp bovis AF2122/97
cucgucgcugcccau

SEQ ID NO: 3194143 - RNA, 13 nt, Mycobacterium bovis subsp bovis AF2122/97
cucgucggccacc

SEQ ID NO: 3194144 - RNA, 14 nt, Mycobacterium bovis subsp bovis AF2122/97
cucgucggccaccg

SEQ ID NO: 3194145 - RNA, 18 nt, Mycobacterium bovis subsp bovis AF2122/97
cucgucggccaccgcggc

SEQ ID NO: 3194146 - RNA, 19 nt, Mycobacterium bovis subsp bovis AF2122/97
cucgucggccaccgcggcg

SEQ ID NO: 3194147 - RNA, 16 nt, Mycobacterium bovis subsp bovis AF2122/97
cucgucggccagugcg

SEQ ID NO: 3194148 - RNA, 15 nt, Mycobacterium bovis subsp bovis AF2122/97
cucgucggccgacac

SEQ ID NO: 3194149 - RNA, 20 nt, Mycobacterium bovis subsp bovis AF2122/97
cucgucggccgacaccgcca

SEQ ID NO: 3194150 - RNA, 23 nt, Mycobacterium bovis subsp bovis AF2122/97
cucgucggcgaagguguccucca

SEQ ID NO: 3194151 - RNA, 13 nt, Mycobacterium bovis subsp bovis AF2122/97
cucgucggcgaug

SEQ ID NO: 3194152 - RNA, 12 nt, Mycobacterium bovis subsp bovis AF2122/97
cucgucggcgcc

SEQ ID NO: 3194153 - RNA, 16 nt, Mycobacterium bovis subsp bovis AF2122/97
cucgucggcgccggcg

SEQ ID NO: 3194154 - RNA, 21 nt, Mycobacterium bovis subsp bovis AF2122/97
cucgucggcgccggcggccgc

SEQ ID NO: 3194155 - RNA, 16 nt, Mycobacterium bovis subsp bovis AF2122/97
cucgucgggaucggcg

SEQ ID NO: 3194156 - RNA, 15 nt, Mycobacterium bovis subsp bovis AF2122/97
cucgucggucaccga

SEQ ID NO: 3194157 - RNA, 23 nt, Mycobacterium bovis subsp bovis AF2122/97
cucgucggugugccagugcugca

SEQ ID NO: 3194158 - RNA, 16 nt, Mycobacterium bovis subsp bovis AF2122/97
cucgucguccggccac

SEQ ID NO: 3194159 - RNA, 19 nt, Mycobacterium bovis subsp bovis AF2122/97
cucgucguccggccacggu

SEQ ID NO: 3194160 - RNA, 14 nt, Mycobacterium bovis subsp bovis AF2122/97
cucgucgucgaggu

SEQ ID NO: 3194161 - RNA, 18 nt, Mycobacterium bovis subsp bovis AF2122/97
cucgucgucgauccagcc

SEQ ID NO: 3194162 - RNA, 19 nt, Mycobacterium bovis subsp bovis AF2122/97
cucgucgucggacucgucc

SEQ ID NO: 3194163 - RNA, 20 nt, Mycobacterium bovis subsp bovis AF2122/97
cucgucgucgggaacgccga

SEQ ID NO: 3194164 - RNA, 20 nt, Mycobacterium bovis subsp bovis AF2122/97
cucgucgugagucacccggc

SEQ ID NO: 3194165 - RNA, 21 nt, Mycobacterium bovis subsp bovis AF2122/97
cucgucgugagucacccggcc

SEQ ID NO: 3194166 - RNA, 22 nt, Mycobacterium bovis subsp bovis AF2122/97
cucgucgugagucacccggccg

SEQ ID NO: 3194167 - RNA, 23 nt, Mycobacterium bovis subsp bovis AF2122/97
cucgugaacaacuccguugaggu

SEQ ID NO: 3194168 - RNA, 19 nt, Mycobacterium bovis subsp bovis AF2122/97
cucgugaccgccguugucg

SEQ ID NO: 3194169 - RNA, 14 nt, Mycobacterium bovis subsp bovis AF2122/97
cucgugauagcgcg

SEQ ID NO: 3194170 - RNA, 17 nt, Mycobacterium bovis subsp bovis AF2122/97
cucgugcaccgucggga

SEQ ID NO: 3194171 - RNA, 13 nt, Mycobacterium bovis subsp bovis AF2122/97
cucgugcagcacu

SEQ ID NO: 3194172 - RNA, 16 nt, Mycobacterium bovis subsp bovis AF2122/97
cucgugcaggaccagc

SEQ ID NO: 3194173 - RNA, 17 nt, Mycobacterium bovis subsp bovis AF2122/97
cucgugcaggaccagca

SEQ ID NO: 3194174 - RNA, 23 nt, Mycobacterium bovis subsp bovis AF2122/97
cucgugcgugggcgcggcgccag

SEQ ID NO: 3194175 - RNA, 14 nt, Mycobacterium bovis subsp bovis AF2122/97
cucgugcucggcca

SEQ ID NO: 3194176 - RNA, 16 nt, Mycobacterium bovis subsp bovis AF2122/97
cucgugcucggccaga

SEQ ID NO: 3194177 - RNA, 19 nt, Mycobacterium bovis subsp bovis AF2122/97
cucguggaacuccguccgc

SEQ ID NO: 3194178 - RNA, 20 nt, Mycobacterium bovis subsp bovis AF2122/97
cucguggaacuccguccgcc

SEQ ID NO: 3194179 - RNA, 15 nt, Mycobacterium bovis subsp bovis AF2122/97
cucguggaucugccu

SEQ ID NO: 3194180 - RNA, 16 nt, Mycobacterium bovis subsp bovis AF2122/97
cucguggauggccgcc

SEQ ID NO: 3194181 - RNA, 21 nt, Mycobacterium bovis subsp bovis AF2122/97
cucguggauggccgccaggcg

SEQ ID NO: 3194182 - RNA, 13 nt, Mycobacterium bovis subsp bovis AF2122/97
cucguggcgacgg

SEQ ID NO: 3194183 - RNA, 14 nt, Mycobacterium bovis subsp bovis AF2122/97
cucgugggcgacga

SEQ ID NO: 3194184 - RNA, 18 nt, Mycobacterium bovis subsp bovis AF2122/97
cucguguaccggagcggu

SEQ ID NO: 3194185 - RNA, 19 nt, Mycobacterium bovis subsp bovis AF2122/97
cucguguccgccgucaccc

SEQ ID NO: 3194186 - RNA, 14 nt, Mycobacterium bovis subsp bovis AF2122/97
cucgugucugccuc

SEQ ID NO: 3194187 - RNA, 19 nt, Mycobacterium bovis subsp bovis AF2122/97
cucguguuguugaagcccg

SEQ ID NO: 3194188 - RNA, 20 nt, Mycobacterium bovis subsp bovis AF2122/97
cucguguuguugaagcccga

SEQ ID NO: 3194189 - RNA, 13 nt, Mycobacterium bovis subsp bovis AF2122/97
cucguuacgccga

SEQ ID NO: 3194190 - RNA, 20 nt, Mycobacterium bovis subsp bovis AF2122/97
cucguuagaguaggccacca

SEQ ID NO: 3194191 - RNA, 18 nt, Mycobacterium bovis subsp bovis AF2122/97
cucguuaucgaccgccgc

SEQ ID NO: 3194192 - RNA, 23 nt, Mycobacterium bovis subsp bovis AF2122/97
cucguucaacuuggggucguucg

SEQ ID NO: 3194193 - RNA, 24 nt, Mycobacterium bovis subsp bovis AF2122/97
cucguucagcgucgacugaacggu

SEQ ID NO: 3194194 - RNA, 19 nt, Mycobacterium bovis subsp bovis AF2122/97
cucguuccacugugcgagc

SEQ ID NO: 3194195 - RNA, 15 nt, Mycobacterium bovis subsp bovis AF2122/97
cucguucgugcagcc

SEQ ID NO: 3194196 - RNA, 23 nt, Mycobacterium bovis subsp bovis AF2122/97
cucguugaccgggucgccgauga

SEQ ID NO: 3194197 - RNA, 16 nt, Mycobacterium bovis subsp bovis AF2122/97
cucguugagcagcugg

SEQ ID NO: 3194198 - RNA, 15 nt, Mycobacterium bovis subsp bovis AF2122/97
cucguugccgaccau

SEQ ID NO: 3194199 - RNA, 13 nt, Mycobacterium bovis subsp bovis AF2122/97
cucguugcugccg

SEQ ID NO: 3194200 - RNA, 14 nt, Mycobacterium bovis subsp bovis AF2122/97
cucguugcugccgg

SEQ ID NO: 3194201 - RNA, 20 nt, Mycobacterium bovis subsp bovis AF2122/97
cucguugcuggcggccagca

SEQ ID NO: 3194202 - RNA, 17 nt, Mycobacterium bovis subsp bovis AF2122/97
cucguuugcgagcaggg

SEQ ID NO: 3194203 - RNA, 15 nt, Mycobacterium bovis subsp bovis AF2122/97
cucuacucgcggccg

SEQ ID NO: 3194204 - RNA, 19 nt, Mycobacterium bovis subsp bovis AF2122/97
cucuagcaaagccagcgca

SEQ ID NO: 3194205 - RNA, 22 nt, Mycobacterium bovis subsp bovis AF2122/97
cucuagcaaagccagcgcagcc

SEQ ID NO: 3194206 - RNA, 23 nt, Mycobacterium bovis subsp bovis AF2122/97
cucuagcgccucgccggccaccc

SEQ ID NO: 3194207 - RNA, 23 nt, Mycobacterium bovis subsp bovis AF2122/97
cucuaucagacgauucggcggcc

SEQ ID NO: 3194208 - RNA, 14 nt, Mycobacterium bovis subsp bovis AF2122/97
cucuaugcgggcag

SEQ ID NO: 3194209 - RNA, 16 nt, Mycobacterium bovis subsp bovis AF2122/97
cucucacggcgguagc

SEQ ID NO: 3194210 - RNA, 20 nt, Mycobacterium bovis subsp bovis AF2122/97
cucucagcacgguuguugua

SEQ ID NO: 3194211 - RNA, 20 nt, Mycobacterium bovis subsp bovis AF2122/97
cucuccauggccgauuccgc

SEQ ID NO: 3194212 - RNA, 14 nt, Mycobacterium bovis subsp bovis AF2122/97
cucuccccuggccc

SEQ ID NO: 3194213 - RNA, 13 nt, Mycobacterium bovis subsp bovis AF2122/97
cucuccggugauc

SEQ ID NO: 3194214 - RNA, 23 nt, Mycobacterium bovis subsp bovis AF2122/97
cucuccuggaaaggacggccggc

SEQ ID NO: 3194215 - RNA, 16 nt, Mycobacterium bovis subsp bovis AF2122/97
cucucgcagcuccucg

SEQ ID NO: 3194216 - RNA, 18 nt, Mycobacterium bovis subsp bovis AF2122/97
cucucgcuuagcgucgcu

SEQ ID NO: 3194217 - RNA, 16 nt, Mycobacterium bovis subsp bovis AF2122/97
cucucggcacccggca

SEQ ID NO: 3194218 - RNA, 14 nt, Mycobacterium bovis subsp bovis AF2122/97
cucucggcgucgag

SEQ ID NO: 3194219 - RNA, 18 nt, Mycobacterium bovis subsp bovis AF2122/97
cucucggucaguuccucu

SEQ ID NO: 3194220 - RNA, 19 nt, Mycobacterium bovis subsp bovis AF2122/97
cucucggucaguuccucua

SEQ ID NO: 3194221 - RNA, 19 nt, Mycobacterium bovis subsp bovis AF2122/97
cucucggugaacgccgccc

SEQ ID NO: 3194222 - RNA, 21 nt, Mycobacterium bovis subsp bovis AF2122/97
cucucgucguauugccucacc

SEQ ID NO: 3194223 - RNA, 18 nt, Mycobacterium bovis subsp bovis AF2122/97
cucucguggauggccgcc

SEQ ID NO: 3194224 - RNA, 19 nt, Mycobacterium bovis subsp bovis AF2122/97
cucucguggauggccgcca

SEQ ID NO: 3194225 - RNA, 21 nt, Mycobacterium bovis subsp bovis AF2122/97
cucucguguaucgagcggcac

SEQ ID NO: 3194226 - RNA, 14 nt, Mycobacterium bovis subsp bovis AF2122/97
cucucugcgccagg

SEQ ID NO: 3194227 - RNA, 15 nt, Mycobacterium bovis subsp bovis AF2122/97
cucucugcgccaggc

SEQ ID NO: 3194228 - RNA, 20 nt, Mycobacterium bovis subsp bovis AF2122/97
cucucugcgccaggcggcaa

SEQ ID NO: 3194229 - RNA, 23 nt, Mycobacterium bovis subsp bovis AF2122/97
cucucugucgcguuguggcugaa

SEQ ID NO: 3194230 - RNA, 14 nt, Mycobacterium bovis subsp bovis AF2122/97
cucugaccagccgg

SEQ ID NO: 3194231 - RNA, 13 nt, Mycobacterium bovis subsp bovis AF2122/97
cucugagcgggcg

SEQ ID NO: 3194232 - RNA, 19 nt, Mycobacterium bovis subsp bovis AF2122/97
cucugagcgggcgggccug

SEQ ID NO: 3194233 - RNA, 20 nt, Mycobacterium bovis subsp bovis AF2122/97
cucugagcgggcgggccugc

SEQ ID NO: 3194234 - RNA, 17 nt, Mycobacterium bovis subsp bovis AF2122/97
cucugcgacaccacgaa

SEQ ID NO: 3194235 - RNA, 22 nt, Mycobacterium bovis subsp bovis AF2122/97
cucugcgagcguggacuugagu

SEQ ID NO: 3194236 - RNA, 15 nt, Mycobacterium bovis subsp bovis AF2122/97
cucugcgccacagca

SEQ ID NO: 3194237 - RNA, 13 nt, Mycobacterium bovis subsp bovis AF2122/97
cucugcguccacc

SEQ ID NO: 3194238 - RNA, 15 nt, Mycobacterium bovis subsp bovis AF2122/97
cucugcguccagcaa

SEQ ID NO: 3194239 - RNA, 16 nt, Mycobacterium bovis subsp bovis AF2122/97
cucugcgucugcucac

SEQ ID NO: 3194240 - RNA, 22 nt, Mycobacterium bovis subsp bovis AF2122/97
cucugcgucugcucaccagcgg

SEQ ID NO: 3194241 - RNA, 22 nt, Mycobacterium bovis subsp bovis AF2122/97
cucuggauucuucagcgcggca

SEQ ID NO: 3194242 - RNA, 23 nt, Mycobacterium bovis subsp bovis AF2122/97
cucuggcgagggcuaccggcgcc

SEQ ID NO: 3194243 - RNA, 13 nt, Mycobacterium bovis subsp bovis AF2122/97
cucuggugacggu

SEQ ID NO: 3194244 - RNA, 20 nt, Mycobacterium bovis subsp bovis AF2122/97
cucuggugacggugaagccg

SEQ ID NO: 3194245 - RNA, 23 nt, Mycobacterium bovis subsp bovis AF2122/97
cucugguuuuacacaccagcggu

SEQ ID NO: 3194246 - RNA, 15 nt, Mycobacterium bovis subsp bovis AF2122/97
cucuguaccccaacg

SEQ ID NO: 3194247 - RNA, 16 nt, Mycobacterium bovis subsp bovis AF2122/97
cucugucgcguugugg

SEQ ID NO: 3194248 - RNA, 14 nt, Mycobacterium bovis subsp bovis AF2122/97
cucugucuucagcu

SEQ ID NO: 3194249 - RNA, 17 nt, Mycobacterium bovis subsp bovis AF2122/97
cucugucuucagcugcg

SEQ ID NO: 3194250 - RNA, 19 nt, Mycobacterium bovis subsp bovis AF2122/97
cucugucuucagcugcgga

SEQ ID NO: 3194251 - RNA, 16 nt, Mycobacterium bovis subsp bovis AF2122/97
cucuucagcaagccaa

SEQ ID NO: 3194252 - RNA, 13 nt, Mycobacterium bovis subsp bovis AF2122/97
cucuucagcuacc

SEQ ID NO: 3194253 - RNA, 22 nt, Mycobacterium bovis subsp bovis AF2122/97
cucuucaggcccucgggacugc

SEQ ID NO: 3194254 - RNA, 20 nt, Mycobacterium bovis subsp bovis AF2122/97
cucuuccuggcgugagccga

SEQ ID NO: 3194255 - RNA, 20 nt, Mycobacterium bovis subsp bovis AF2122/97
cucuucgaucuguuccugca

SEQ ID NO: 3194256 - RNA, 20 nt, Mycobacterium bovis subsp bovis AF2122/97
cucuucgaugaagcugguga

SEQ ID NO: 3194257 - RNA, 13 nt, Mycobacterium bovis subsp bovis AF2122/97
cucuucgcgcgcu

SEQ ID NO: 3194258 - RNA, 14 nt, Mycobacterium bovis subsp bovis AF2122/97
cucuucggagccga

SEQ ID NO: 3194259 - RNA, 13 nt, Mycobacterium bovis subsp bovis AF2122/97
cucuucggcacca

SEQ ID NO: 3194260 - RNA, 17 nt, Mycobacterium bovis subsp bovis AF2122/97
cucuucggcaccaccgc

SEQ ID NO: 3194261 - RNA, 13 nt, Mycobacterium bovis subsp bovis AF2122/97
cucuucggcggug

SEQ ID NO: 3194262 - RNA, 16 nt, Mycobacterium bovis subsp bovis AF2122/97
cucuucgggugcagcc

SEQ ID NO: 3194263 - RNA, 14 nt, Mycobacterium bovis subsp bovis AF2122/97
cucuugcaaccugg

SEQ ID NO: 3194264 - RNA, 19 nt, Mycobacterium bovis subsp bovis AF2122/97
cucuuugagugccgcgucg

SEQ ID NO: 3194265 - RNA, 14 nt, Mycobacterium bovis subsp bovis AF2122/97
cucuuuuagccaca

SEQ ID NO: 3194266 - RNA, 13 nt, Mycobacterium bovis subsp bovis AF2122/97
cugaaaacaccgc

SEQ ID NO: 3194267 - RNA, 23 nt, Mycobacterium bovis subsp bovis AF2122/97
cugaaaccuugcggcagaccaag

SEQ ID NO: 3194268 - RNA, 19 nt, Mycobacterium bovis subsp bovis AF2122/97
cugaaaucgguggccacca

SEQ ID NO: 3194269 - RNA, 21 nt, Mycobacterium bovis subsp bovis AF2122/97
cugaaaucgguggccaccacc

SEQ ID NO: 3194270 - RNA, 19 nt, Mycobacterium bovis subsp bovis AF2122/97
cugaaaugccgucgucaaa

SEQ ID NO: 3194271 - RNA, 15 nt, Mycobacterium bovis subsp bovis AF2122/97
cugaacaccgcgggc

SEQ ID NO: 3194272 - RNA, 20 nt, Mycobacterium bovis subsp bovis AF2122/97
cugaacacgaauccggccac

SEQ ID NO: 3194273 - RNA, 13 nt, Mycobacterium bovis subsp bovis AF2122/97
cugaacaggccgg

SEQ ID NO: 3194274 - RNA, 20 nt, Mycobacterium bovis subsp bovis AF2122/97
cugaacaguugcacaccggc

SEQ ID NO: 3194275 - RNA, 21 nt, Mycobacterium bovis subsp bovis AF2122/97
cugaacauacgaaacaugcgc

SEQ ID NO: 3194276 - RNA, 13 nt, Mycobacterium bovis subsp bovis AF2122/97
cugaaccagcuga

SEQ ID NO: 3194277 - RNA, 14 nt, Mycobacterium bovis subsp bovis AF2122/97
cugaaccggccgcg

SEQ ID NO: 3194278 - RNA, 15 nt, Mycobacterium bovis subsp bovis AF2122/97
cugaaccggccgcga

SEQ ID NO: 3194279 - RNA, 16 nt, Mycobacterium bovis subsp bovis AF2122/97
cugaaccggccgcgac

SEQ ID NO: 3194280 - RNA, 19 nt, Mycobacterium bovis subsp bovis AF2122/97
cugaaccggccgcgacgac

SEQ ID NO: 3194281 - RNA, 23 nt, Mycobacterium bovis subsp bovis AF2122/97
cugaaccgguugacacccgggcc

SEQ ID NO: 3194282 - RNA, 18 nt, Mycobacterium bovis subsp bovis AF2122/97
cugaacgguucggccggg

SEQ ID NO: 3194283 - RNA, 22 nt, Mycobacterium bovis subsp bovis AF2122/97
cugaacgguucggccggggcga

SEQ ID NO: 3194284 - RNA, 15 nt, Mycobacterium bovis subsp bovis AF2122/97
cugaacucaacacca

SEQ ID NO: 3194285 - RNA, 17 nt, Mycobacterium bovis subsp bovis AF2122/97
cugaacucaacaccagc

SEQ ID NO: 3194286 - RNA, 18 nt, Mycobacterium bovis subsp bovis AF2122/97
cugaacucaacaccagca

SEQ ID NO: 3194287 - RNA, 13 nt, Mycobacterium bovis subsp bovis AF2122/97
cugaacugguugg

SEQ ID NO: 3194288 - RNA, 13 nt, Mycobacterium bovis subsp bovis AF2122/97
cugaagagcaaug

SEQ ID NO: 3194289 - RNA, 23 nt, Mycobacterium bovis subsp bovis AF2122/97
cugaagagcaauggcgcgguccu

SEQ ID NO: 3194290 - RNA, 21 nt, Mycobacterium bovis subsp bovis AF2122/97
cugaagagcggagccggcgca

SEQ ID NO: 3194291 - RNA, 13 nt, Mycobacterium bovis subsp bovis AF2122/97
cugaagccagcgc

SEQ ID NO: 3194292 - RNA, 17 nt, Mycobacterium bovis subsp bovis AF2122/97
cugaagccagcgcagca

SEQ ID NO: 3194293 - RNA, 18 nt, Mycobacterium bovis subsp bovis AF2122/97
cugaagccagcgcagcac

SEQ ID NO: 3194294 - RNA, 19 nt, Mycobacterium bovis subsp bovis AF2122/97
cugaagccagcgcagcacc

SEQ ID NO: 3194295 - RNA, 13 nt, Mycobacterium bovis subsp bovis AF2122/97
cugaagcccgaca

SEQ ID NO: 3194296 - RNA, 14 nt, Mycobacterium bovis subsp bovis AF2122/97
cugaagccgcgcug

SEQ ID NO: 3194297 - RNA, 15 nt, Mycobacterium bovis subsp bovis AF2122/97
cugaagccgcgcugc

SEQ ID NO: 3194298 - RNA, 19 nt, Mycobacterium bovis subsp bovis AF2122/97
cugaagcuuguccagauau

SEQ ID NO: 3194299 - RNA, 16 nt, Mycobacterium bovis subsp bovis AF2122/97
cugaaggccagccaac

SEQ ID NO: 3194300 - RNA, 13 nt, Mycobacterium bovis subsp bovis AF2122/97
cugaaggccggua

SEQ ID NO: 3194301 - RNA, 19 nt, Mycobacterium bovis subsp bovis AF2122/97
cugaagggcaagaacccgg

SEQ ID NO: 3194302 - RNA, 18 nt, Mycobacterium bovis subsp bovis AF2122/97
cugaagggccgccucgcg

SEQ ID NO: 3194303 - RNA, 19 nt, Mycobacterium bovis subsp bovis AF2122/97
cugaagggccgccucgcgg

SEQ ID NO: 3194304 - RNA, 22 nt, Mycobacterium bovis subsp bovis AF2122/97
cugaagguggcgaacccgguca

SEQ ID NO: 3194305 - RNA, 22 nt, Mycobacterium bovis subsp bovis AF2122/97
cugaaguggcacaagcugggga

SEQ ID NO: 3194306 - RNA, 14 nt, Mycobacterium bovis subsp bovis AF2122/97
cugaaucaccccgg

SEQ ID NO: 3194307 - RNA, 19 nt, Mycobacterium bovis subsp bovis AF2122/97
cugaaucgguucggccaga

SEQ ID NO: 3194308 - RNA, 22 nt, Mycobacterium bovis subsp bovis AF2122/97
cugaauguugguuugccggcgg

SEQ ID NO: 3194309 - RNA, 13 nt, Mycobacterium bovis subsp bovis AF2122/97
cugaauucggcga

SEQ ID NO: 3194310 - RNA, 14 nt, Mycobacterium bovis subsp bovis AF2122/97
cugaauuggcgccg

SEQ ID NO: 3194311 - RNA, 21 nt, Mycobacterium bovis subsp bovis AF2122/97
cugacaacggccacaugccac

SEQ ID NO: 3194312 - RNA, 20 nt, Mycobacterium bovis subsp bovis AF2122/97
cugacaagccuuaccccgca

SEQ ID NO: 3194313 - RNA, 22 nt, Mycobacterium bovis subsp bovis AF2122/97
cugacaccgauccggccgccga

SEQ ID NO: 3194314 - RNA, 18 nt, Mycobacterium bovis subsp bovis AF2122/97
cugacacgcccgcgagcu

SEQ ID NO: 3194315 - RNA, 20 nt, Mycobacterium bovis subsp bovis AF2122/97
cugacagaccgggcaccaga

SEQ ID NO: 3194316 - RNA, 17 nt, Mycobacterium bovis subsp bovis AF2122/97
cugacauuuccaccacg

SEQ ID NO: 3194317 - RNA, 13 nt, Mycobacterium bovis subsp bovis AF2122/97
cugaccacgguag

SEQ ID NO: 3194318 - RNA, 17 nt, Mycobacterium bovis subsp bovis AF2122/97
cugaccacgucggacag

SEQ ID NO: 3194319 - RNA, 22 nt, Mycobacterium bovis subsp bovis AF2122/97
cugaccacgucggacagcuuuc

SEQ ID NO: 3194320 - RNA, 11 nt, Mycobacterium bovis subsp bovis AF2122/97
cugaccagccg

SEQ ID NO: 3194321 - RNA, 13 nt, Mycobacterium bovis subsp bovis AF2122/97
cugaccagcgucc

SEQ ID NO: 3194322 - RNA, 15 nt, Mycobacterium bovis subsp bovis AF2122/97
cugaccaucacaccc

SEQ ID NO: 3194323 - RNA, 22 nt, Mycobacterium bovis subsp bovis AF2122/97
cugaccaucacacccaucaccc

SEQ ID NO: 3194324 - RNA, 23 nt, Mycobacterium bovis subsp bovis AF2122/97
cugaccaucacacccaucacccu

SEQ ID NO: 3194325 - RNA, 17 nt, Mycobacterium bovis subsp bovis AF2122/97
cugaccaugaccgggcu

SEQ ID NO: 3194326 - RNA, 20 nt, Mycobacterium bovis subsp bovis AF2122/97
cugaccaugaccgggcuggc

SEQ ID NO: 3194327 - RNA, 17 nt, Mycobacterium bovis subsp bovis AF2122/97
cugaccccccgaccccg

SEQ ID NO: 3194328 - RNA, 19 nt, Mycobacterium bovis subsp bovis AF2122/97
cugaccccccgaccccgac

SEQ ID NO: 3194329 - RNA, 21 nt, Mycobacterium bovis subsp bovis AF2122/97
cugaccccccgaccccgacgg

SEQ ID NO: 3194330 - RNA, 12 nt, Mycobacterium bovis subsp bovis AF2122/97
cugaccccgccg

SEQ ID NO: 3194331 - RNA, 17 nt, Mycobacterium bovis subsp bovis AF2122/97
cugaccccgccgccacg

SEQ ID NO: 3194332 - RNA, 18 nt, Mycobacterium bovis subsp bovis AF2122/97
cugaccccgccgccacgg

SEQ ID NO: 3194333 - RNA, 18 nt, Mycobacterium bovis subsp bovis AF2122/97
cugaccccgccggcugcg

SEQ ID NO: 3194334 - RNA, 17 nt, Mycobacterium bovis subsp bovis AF2122/97
cugacccggagccgcca

SEQ ID NO: 3194335 - RNA, 19 nt, Mycobacterium bovis subsp bovis AF2122/97
cugacccggagccgccagg

SEQ ID NO: 3194336 - RNA, 13 nt, Mycobacterium bovis subsp bovis AF2122/97
cugacccugaucg

SEQ ID NO: 3194337 - RNA, 15 nt, Mycobacterium bovis subsp bovis AF2122/97
cugaccgaagaagcc

SEQ ID NO: 3194338 - RNA, 17 nt, Mycobacterium bovis subsp bovis AF2122/97
cugaccgaagaagcccg

SEQ ID NO: 3194339 - RNA, 22 nt, Mycobacterium bovis subsp bovis AF2122/97
cugaccgaauggccgccgcagc

SEQ ID NO: 3194340 - RNA, 13 nt, Mycobacterium bovis subsp bovis AF2122/97
cugaccgccaccc

SEQ ID NO: 3194341 - RNA, 13 nt, Mycobacterium bovis subsp bovis AF2122/97
cugaccgccagcg

SEQ ID NO: 3194342 - RNA, 22 nt, Mycobacterium bovis subsp bovis AF2122/97
cugaccgccagcggccgcucca

SEQ ID NO: 3194343 - RNA, 13 nt, Mycobacterium bovis subsp bovis AF2122/97
cugaccgcgccgg

SEQ ID NO: 3194344 - RNA, 24 nt, Mycobacterium bovis subsp bovis AF2122/97
cugaccggcucgccggcgcgcacc

SEQ ID NO: 3194345 - RNA, 19 nt, Mycobacterium bovis subsp bovis AF2122/97
cugaccggggucggccugc

SEQ ID NO: 3194346 - RNA, 17 nt, Mycobacterium bovis subsp bovis AF2122/97
cugaccggucacccgug

SEQ ID NO: 3194347 - RNA, 19 nt, Mycobacterium bovis subsp bovis AF2122/97
cugaccggucacccgugcu

SEQ ID NO: 3194348 - RNA, 18 nt, Mycobacterium bovis subsp bovis AF2122/97
cugaccgguucccgggca

SEQ ID NO: 3194349 - RNA, 20 nt, Mycobacterium bovis subsp bovis AF2122/97
cugaccgguucccgggcagc

SEQ ID NO: 3194350 - RNA, 21 nt, Mycobacterium bovis subsp bovis AF2122/97
cugaccgguucccgggcagcc

SEQ ID NO: 3194351 - RNA, 17 nt, Mycobacterium bovis subsp bovis AF2122/97
cugaccgucugcgaccc

SEQ ID NO: 3194352 - RNA, 14 nt, Mycobacterium bovis subsp bovis AF2122/97
cugaccgugcugaa

SEQ ID NO: 3194353 - RNA, 12 nt, Mycobacterium bovis subsp bovis AF2122/97
cugaccguggcg

SEQ ID NO: 3194354 - RNA, 18 nt, Mycobacterium bovis subsp bovis AF2122/97
cugaccguggcgccgguc

SEQ ID NO: 3194355 - RNA, 18 nt, Mycobacterium bovis subsp bovis AF2122/97
cugaccucccacccccgg

SEQ ID NO: 3194356 - RNA, 22 nt, Mycobacterium bovis subsp bovis AF2122/97
cugaccucgucaaucaccaccg

SEQ ID NO: 3194357 - RNA, 17 nt, Mycobacterium bovis subsp bovis AF2122/97
cugaccuucaggcccug

SEQ ID NO: 3194358 - RNA, 19 nt, Mycobacterium bovis subsp bovis AF2122/97
cugaccuucucacgcacca

SEQ ID NO: 3194359 - RNA, 21 nt, Mycobacterium bovis subsp bovis AF2122/97
cugaccuucucacgcaccaug

SEQ ID NO: 3194360 - RNA, 20 nt, Mycobacterium bovis subsp bovis AF2122/97
cugaccuuguugaccaccac

SEQ ID NO: 3194361 - RNA, 17 nt, Mycobacterium bovis subsp bovis AF2122/97
cugacgaaauccgccgg

SEQ ID NO: 3194362 - RNA, 16 nt, Mycobacterium bovis subsp bovis AF2122/97
cugacgaauccacugg

SEQ ID NO: 3194363 - RNA, 18 nt, Mycobacterium bovis subsp bovis AF2122/97
cugacgaaucgccuaccg

SEQ ID NO: 3194364 - RNA, 16 nt, Mycobacterium bovis subsp bovis AF2122/97
cugacgaccaaccacc

SEQ ID NO: 3194365 - RNA, 19 nt, Mycobacterium bovis subsp bovis AF2122/97
cugacgaccaaccaccgaa

SEQ ID NO: 3194366 - RNA, 11 nt, Mycobacterium bovis subsp bovis AF2122/97
cugacgaccgg

SEQ ID NO: 3194367 - RNA, 17 nt, Mycobacterium bovis subsp bovis AF2122/97
cugacgaccggcuaccg

SEQ ID NO: 3194368 - RNA, 21 nt, Mycobacterium bovis subsp bovis AF2122/97
cugacgacgagggccagcagc

SEQ ID NO: 3194369 - RNA, 22 nt, Mycobacterium bovis subsp bovis AF2122/97
cugacgacgagggccagcagcc

SEQ ID NO: 3194370 - RNA, 13 nt, Mycobacterium bovis subsp bovis AF2122/97
cugacgacugggc

SEQ ID NO: 3194371 - RNA, 18 nt, Mycobacterium bovis subsp bovis AF2122/97
cugacgacugggcgccca

SEQ ID NO: 3194372 - RNA, 22 nt, Mycobacterium bovis subsp bovis AF2122/97
cugacgagcagcuagcccggca

SEQ ID NO: 3194373 - RNA, 17 nt, Mycobacterium bovis subsp bovis AF2122/97
cugacgagccgguggcg

SEQ ID NO: 3194374 - RNA, 18 nt, Mycobacterium bovis subsp bovis AF2122/97
cugacgagccgguggcgu

SEQ ID NO: 3194375 - RNA, 20 nt, Mycobacterium bovis subsp bovis AF2122/97
cugacgaucauugcacccac

SEQ ID NO: 3194376 - RNA, 16 nt, Mycobacterium bovis subsp bovis AF2122/97
cugacgauggccaggc

SEQ ID NO: 3194377 - RNA, 23 nt, Mycobacterium bovis subsp bovis AF2122/97
cugacgccauucaucggcaucga

SEQ ID NO: 3194378 - RNA, 18 nt, Mycobacterium bovis subsp bovis AF2122/97
cugacgccccgccacaau

SEQ ID NO: 3194379 - RNA, 17 nt, Mycobacterium bovis subsp bovis AF2122/97
cugacgcccuccuggcg

SEQ ID NO: 3194380 - RNA, 14 nt, Mycobacterium bovis subsp bovis AF2122/97
cugacgccgagcug

SEQ ID NO: 3194381 - RNA, 15 nt, Mycobacterium bovis subsp bovis AF2122/97
cugacgcggccgggc

SEQ ID NO: 3194382 - RNA, 16 nt, Mycobacterium bovis subsp bovis AF2122/97
cugacgcggccgggcg

SEQ ID NO: 3194383 - RNA, 18 nt, Mycobacterium bovis subsp bovis AF2122/97
cugacgcgucagcggcga

SEQ ID NO: 3194384 - RNA, 20 nt, Mycobacterium bovis subsp bovis AF2122/97
cugacgcgucagcggcgagc

SEQ ID NO: 3194385 - RNA, 22 nt, Mycobacterium bovis subsp bovis AF2122/97
cugacgcgucagcggcgagcag

SEQ ID NO: 3194386 - RNA, 14 nt, Mycobacterium bovis subsp bovis AF2122/97
cugacgcucggucg

SEQ ID NO: 3194387 - RNA, 15 nt, Mycobacterium bovis subsp bovis AF2122/97
cugacgcuuggccag

SEQ ID NO: 3194388 - RNA, 15 nt, Mycobacterium bovis subsp bovis AF2122/97
cugacggcaaacgac

SEQ ID NO: 3194389 - RNA, 11 nt, Mycobacterium bovis subsp bovis AF2122/97
cugacggccau

SEQ ID NO: 3194390 - RNA, 18 nt, Mycobacterium bovis subsp bovis AF2122/97
cugacggccauggacgcc

SEQ ID NO: 3194391 - RNA, 15 nt, Mycobacterium bovis subsp bovis AF2122/97
cugacggcuuccaac

SEQ ID NO: 3194392 - RNA, 22 nt, Mycobacterium bovis subsp bovis AF2122/97
cugacggcuuccaacucggcgg

SEQ ID NO: 3194393 - RNA, 14 nt, Mycobacterium bovis subsp bovis AF2122/97
cugacggugcagga

SEQ ID NO: 3194394 - RNA, 17 nt, Mycobacterium bovis subsp bovis AF2122/97
cugacggugcaggacca

SEQ ID NO: 3194395 - RNA, 13 nt, Mycobacterium bovis subsp bovis AF2122/97
cugacggugggga

SEQ ID NO: 3194396 - RNA, 14 nt, Mycobacterium bovis subsp bovis AF2122/97
cugacgguggggau

SEQ ID NO: 3194397 - RNA, 13 nt, Mycobacterium bovis subsp bovis AF2122/97
cugacggugguga

SEQ ID NO: 3194398 - RNA, 19 nt, Mycobacterium bovis subsp bovis AF2122/97
gccauuucgucgucgcuga

SEQ ID NO: 3194399 - RNA, 19 nt, Mycobacterium bovis subsp bovis AF2122/97
gcccaaaaagaccgccgcu

SEQ ID NO: 3194400 - RNA, 20 nt, Mycobacterium bovis subsp bovis AF2122/97
gcccaaaaccgcgaacccga

SEQ ID NO: 3194401 - RNA, 17 nt, Mycobacterium bovis subsp bovis AF2122/97
gcccaaaagcgcggcaa

SEQ ID NO: 3194402 - RNA, 18 nt, Mycobacterium bovis subsp bovis AF2122/97
gcccaaaagcgcggcaac

SEQ ID NO: 3194403 - RNA, 18 nt, Mycobacterium bovis subsp bovis AF2122/97
gcccaaaaggaagaccuc

SEQ ID NO: 3194404 - RNA, 21 nt, Mycobacterium bovis subsp bovis AF2122/97
gcccaaaaggaagaccucggc

SEQ ID NO: 3194405 - RNA, 15 nt, Mycobacterium bovis subsp bovis AF2122/97
gcccaaacggcgugu

SEQ ID NO: 3194406 - RNA, 21 nt, Mycobacterium bovis subsp bovis AF2122/97
gcccaaaggcuguaacacccg

SEQ ID NO: 3194407 - RNA, 21 nt, Mycobacterium bovis subsp bovis AF2122/97
gcccaacaacgcuucggcgug

SEQ ID NO: 3194408 - RNA, 16 nt, Mycobacterium bovis subsp bovis AF2122/97
gcccaacaccgccaga

SEQ ID NO: 3194409 - RNA, 13 nt, Mycobacterium bovis subsp bovis AF2122/97
gcccaacaccgcg

SEQ ID NO: 3194410 - RNA, 15 nt, Mycobacterium bovis subsp bovis AF2122/97
gcccaacaccgcgcc

SEQ ID NO: 3194411 - RNA, 13 nt, Mycobacterium bovis subsp bovis AF2122/97
gcccaacagacau

SEQ ID NO: 3194412 - RNA, 17 nt, Mycobacterium bovis subsp bovis AF2122/97
gcccaacaggcgggaca

SEQ ID NO: 3194413 - RNA, 17 nt, Mycobacterium bovis subsp bovis AF2122/97
gcccaacgacggcaaca

SEQ ID NO: 3194414 - RNA, 13 nt, Mycobacterium bovis subsp bovis AF2122/97
gcccaacgcgagc

SEQ ID NO: 3194415 - RNA, 20 nt, Mycobacterium bovis subsp bovis AF2122/97
gcccaacgcgagcuugauuc

SEQ ID NO: 3194416 - RNA, 13 nt, Mycobacterium bovis subsp bovis AF2122/97
gcccaacgcgaug

SEQ ID NO: 3194417 - RNA, 18 nt, Mycobacterium bovis subsp bovis AF2122/97
gcccaacggaagaccgcg

SEQ ID NO: 3194418 - RNA, 20 nt, Mycobacterium bovis subsp bovis AF2122/97
gcccaacggaagaccgcggg

SEQ ID NO: 3194419 - RNA, 15 nt, Mycobacterium bovis subsp bovis AF2122/97
gcccaacucggccag

SEQ ID NO: 3194420 - RNA, 16 nt, Mycobacterium bovis subsp bovis AF2122/97
gcccaacucggccagc

SEQ ID NO: 3194421 - RNA, 19 nt, Mycobacterium bovis subsp bovis AF2122/97
gcccaagaucucgcgggcc

SEQ ID NO: 3194422 - RNA, 19 nt, Mycobacterium bovis subsp bovis AF2122/97
gcccaagcaguccacgagc

SEQ ID NO: 3194423 - RNA, 23 nt, Mycobacterium bovis subsp bovis AF2122/97
gcccaagcccucgacguccaucc

SEQ ID NO: 3194424 - RNA, 16 nt, Mycobacterium bovis subsp bovis AF2122/97
gcccaagccguggccg

SEQ ID NO: 3194425 - RNA, 20 nt, Mycobacterium bovis subsp bovis AF2122/97
gcccaagcucagggugggcg

SEQ ID NO: 3194426 - RNA, 19 nt, Mycobacterium bovis subsp bovis AF2122/97
gcccaagguggcggccagu

SEQ ID NO: 3194427 - RNA, 22 nt, Mycobacterium bovis subsp bovis AF2122/97
gcccaauccaccgauucggcga

SEQ ID NO: 3194428 - RNA, 15 nt, Mycobacterium bovis subsp bovis AF2122/97
gcccaauucgacugc

SEQ ID NO: 3194429 - RNA, 16 nt, Mycobacterium bovis subsp bovis AF2122/97
gcccaauugcgccgag

SEQ ID NO: 3194430 - RNA, 18 nt, Mycobacterium bovis subsp bovis AF2122/97
gcccaauuucgugccgaa

SEQ ID NO: 3194431 - RNA, 22 nt, Mycobacterium bovis subsp bovis AF2122/97
gcccaauuucgugccgaaaugg

SEQ ID NO: 3194432 - RNA, 16 nt, Mycobacterium bovis subsp bovis AF2122/97
gcccacaaagauccgg

SEQ ID NO: 3194433 - RNA, 22 nt, Mycobacterium bovis subsp bovis AF2122/97
gcccacaaugacucggccgcac

SEQ ID NO: 3194434 - RNA, 14 nt, Mycobacterium bovis subsp bovis AF2122/97
cacggcuagcgccg

SEQ ID NO: 3194435 - RNA, 17 nt, Mycobacterium bovis subsp bovis AF2122/97
cacggcucgccggcucg

SEQ ID NO: 3194436 - RNA, 16 nt, Mycobacterium bovis subsp bovis AF2122/97
cacggcuguggccgca

SEQ ID NO: 3194437 - RNA, 22 nt, Mycobacterium bovis subsp bovis AF2122/97
cacggcuucgccgcgggacaga

SEQ ID NO: 3194438 - RNA, 21 nt, Mycobacterium bovis subsp bovis AF2122/97
cacggcuucgcgguuggcggc

SEQ ID NO: 3194439 - RNA, 21 nt, Mycobacterium bovis subsp bovis AF2122/97
cacggcuucggcgagcgcauc

SEQ ID NO: 3194440 - RNA, 22 nt, Mycobacterium bovis subsp bovis AF2122/97
cacggcuucggcgagcgcaucg

SEQ ID NO: 3194441 - RNA, 14 nt, Mycobacterium bovis subsp bovis AF2122/97
cacggcuuugcggc

SEQ ID NO: 3194442 - RNA, 20 nt, Mycobacterium bovis subsp bovis AF2122/97
cacggcuuugcggcgcgacc

SEQ ID NO: 3194443 - RNA, 17 nt, Mycobacterium bovis subsp bovis AF2122/97
cacggcuuuucgacgcu

SEQ ID NO: 3194444 - RNA, 16 nt, Mycobacterium bovis subsp bovis AF2122/97
cacgggaaucgcucgc

SEQ ID NO: 3194445 - RNA, 15 nt, Mycobacterium bovis subsp bovis AF2122/97
cacgggacgacggca

SEQ ID NO: 3194446 - RNA, 20 nt, Mycobacterium bovis subsp bovis AF2122/97
cacgggaguacgggagccgg

SEQ ID NO: 3194447 - RNA, 22 nt, Mycobacterium bovis subsp bovis AF2122/97
cacgggaucgaucugcggaggc

SEQ ID NO: 3194448 - RNA, 18 nt, Mycobacterium bovis subsp bovis AF2122/97
cacgggaucugcggaggc

SEQ ID NO: 3194449 - RNA, 15 nt, Mycobacterium bovis subsp bovis AF2122/97
cacgggcacgaucgu

SEQ ID NO: 3194450 - RNA, 22 nt, Mycobacterium bovis subsp bovis AF2122/97
cacgggcacgaucgucgcggcc

SEQ ID NO: 3194451 - RNA, 13 nt, Mycobacterium bovis subsp bovis AF2122/97
cacgggcagcuuc

SEQ ID NO: 3194452 - RNA, 20 nt, Mycobacterium bovis subsp bovis AF2122/97
cacgggcagcuucaaugucg

SEQ ID NO: 3194453 - RNA, 23 nt, Mycobacterium bovis subsp bovis AF2122/97
cacgggcagcuucaaugucggug

SEQ ID NO: 3194454 - RNA, 14 nt, Mycobacterium bovis subsp bovis AF2122/97
cacgggccaccagc

SEQ ID NO: 3194455 - RNA, 13 nt, Mycobacterium bovis subsp bovis AF2122/97
cacgggccggccg

SEQ ID NO: 3194456 - RNA, 14 nt, Mycobacterium bovis subsp bovis AF2122/97
cacgggccggccga

SEQ ID NO: 3194457 - RNA, 16 nt, Mycobacterium bovis subsp bovis AF2122/97
cacgggccguccagga

SEQ ID NO: 3194458 - RNA, 15 nt, Mycobacterium bovis subsp bovis AF2122/97
cacgggcggccaccg

SEQ ID NO: 3194459 - RNA, 18 nt, Mycobacterium bovis subsp bovis AF2122/97
cacgggcggccaccgcac

SEQ ID NO: 3194460 - RNA, 13 nt, Mycobacterium bovis subsp bovis AF2122/97
cacgggcggccau

SEQ ID NO: 3194461 - RNA, 23 nt, Mycobacterium bovis subsp bovis AF2122/97
cacgggcggccauggcacugccg

SEQ ID NO: 3194462 - RNA, 19 nt, Mycobacterium bovis subsp bovis AF2122/97
cacgggcggggacggcggc

SEQ ID NO: 3194463 - RNA, 20 nt, Mycobacterium bovis subsp bovis AF2122/97
cacgggcggggacggcggca

SEQ ID NO: 3194464 - RNA, 23 nt, Mycobacterium bovis subsp bovis AF2122/97
cacgggcgucgucgguaaugccg

SEQ ID NO: 3194465 - RNA, 17 nt, Mycobacterium bovis subsp bovis AF2122/97
cacgggcuaccggcagc

SEQ ID NO: 3194466 - RNA, 17 nt, Mycobacterium bovis subsp bovis AF2122/97
cacggggaccgggcugu

SEQ ID NO: 3194467 - RNA, 21 nt, Mycobacterium bovis subsp bovis AF2122/97
cacggggauuggcgacgucgc

SEQ ID NO: 3194468 - RNA, 20 nt, Mycobacterium bovis subsp bovis AF2122/97
cacggggcgugacagggcgg

SEQ ID NO: 3194469 - RNA, 21 nt, Mycobacterium bovis subsp bovis AF2122/97
cacggggcgugacagggcggc

SEQ ID NO: 3194470 - RNA, 13 nt, Mycobacterium bovis subsp bovis AF2122/97
cacggggcugccg

SEQ ID NO: 3194471 - RNA, 21 nt, Mycobacterium bovis subsp bovis AF2122/97
cacggguacggucucacggcg

SEQ ID NO: 3194472 - RNA, 15 nt, Mycobacterium bovis subsp bovis AF2122/97
cacggguagcgucca

SEQ ID NO: 3194473 - RNA, 17 nt, Mycobacterium bovis subsp bovis AF2122/97
cacggguagcugccgcg

SEQ ID NO: 3194474 - RNA, 19 nt, Mycobacterium bovis subsp bovis AF2122/97
cacggguagcugccgcggc

SEQ ID NO: 3194475 - RNA, 21 nt, Mycobacterium bovis subsp bovis AF2122/97
cacggguagcugccgcggccg

SEQ ID NO: 3194476 - RNA, 23 nt, Mycobacterium bovis subsp bovis AF2122/97
cacggguagcugccgcggccggc

SEQ ID NO: 3194477 - RNA, 17 nt, Mycobacterium bovis subsp bovis AF2122/97
cacgggucgucaugcca

SEQ ID NO: 3194478 - RNA, 18 nt, Mycobacterium bovis subsp bovis AF2122/97
cacgggucgucaugccag

SEQ ID NO: 3194479 - RNA, 18 nt, Mycobacterium bovis subsp bovis AF2122/97
cacgggugagcaccacgu

SEQ ID NO: 3194480 - RNA, 22 nt, Mycobacterium bovis subsp bovis AF2122/97
cacggguguucucgcgcgucgc

SEQ ID NO: 3194481 - RNA, 23 nt, Mycobacterium bovis subsp bovis AF2122/97
cacggguguucucgcgcgucgcg

SEQ ID NO: 3194482 - RNA, 19 nt, Mycobacterium bovis subsp bovis AF2122/97
cacgguacauccagagaca

SEQ ID NO: 3194483 - RNA, 22 nt, Mycobacterium bovis subsp bovis AF2122/97
cacgguagacaagucggcgcug

SEQ ID NO: 3194484 - RNA, 13 nt, Mycobacterium bovis subsp bovis AF2122/97
cacggucaagccg

SEQ ID NO: 3194485 - RNA, 19 nt, Mycobacterium bovis subsp bovis AF2122/97
cacggucaagccggcgccc

SEQ ID NO: 3194486 - RNA, 23 nt, Mycobacterium bovis subsp bovis AF2122/97
cacggucaagccggcgcccgccg

SEQ ID NO: 3194487 - RNA, 16 nt, Mycobacterium bovis subsp bovis AF2122/97
cacggucacacgccag

SEQ ID NO: 3194488 - RNA, 19 nt, Mycobacterium bovis subsp bovis AF2122/97
cacggucacacgccagccg

SEQ ID NO: 3194489 - RNA, 20 nt, Mycobacterium bovis subsp bovis AF2122/97
cacggucacacgccagccgg

SEQ ID NO: 3194490 - RNA, 15 nt, Mycobacterium bovis subsp bovis AF2122/97
cacggucaccggcac

SEQ ID NO: 3194491 - RNA, 16 nt, Mycobacterium bovis subsp bovis AF2122/97
cacggucaccggcacg

SEQ ID NO: 3194492 - RNA, 14 nt, Mycobacterium bovis subsp bovis AF2122/97
cacggucagcacgc

SEQ ID NO: 3194493 - RNA, 20 nt, Mycobacterium bovis subsp bovis AF2122/97
cacggucagcacgcugacca

SEQ ID NO: 3194494 - RNA, 17 nt, Mycobacterium bovis subsp bovis AF2122/97
cacggucagccaggugu

SEQ ID NO: 3194495 - RNA, 14 nt, Mycobacterium bovis subsp bovis AF2122/97
cacggucagcucgc

SEQ ID NO: 3194496 - RNA, 21 nt, Mycobacterium bovis subsp bovis AF2122/97
cacggucagcucgcugacggc

SEQ ID NO: 3194497 - RNA, 22 nt, Mycobacterium bovis subsp bovis AF2122/97
cacggucagcucgcugacggca

SEQ ID NO: 3194498 - RNA, 17 nt, Mycobacterium bovis subsp bovis AF2122/97
cacggucaggcguaggu

SEQ ID NO: 3194499 - RNA, 18 nt, Mycobacterium bovis subsp bovis AF2122/97
cacggucaggcguagguc

SEQ ID NO: 3194500 - RNA, 16 nt, Mycobacterium bovis subsp bovis AF2122/97
cacggucaucucggug

SEQ ID NO: 3194501 - RNA, 17 nt, Mycobacterium bovis subsp bovis AF2122/97
cacggucaugccgccgc

SEQ ID NO: 3194502 - RNA, 18 nt, Mycobacterium bovis subsp bovis AF2122/97
cacggucaugccgccgcc

SEQ ID NO: 3194503 - RNA, 19 nt, Mycobacterium bovis subsp bovis AF2122/97
cacggucaugccgccgccg

SEQ ID NO: 3194504 - RNA, 16 nt, Mycobacterium bovis subsp bovis AF2122/97
cacggucauugggugu

SEQ ID NO: 3194505 - RNA, 22 nt, Mycobacterium bovis subsp bovis AF2122/97
cacggucauugggugucaaugu

SEQ ID NO: 3194506 - RNA, 16 nt, Mycobacterium bovis subsp bovis AF2122/97
cacgguccacgguggc

SEQ ID NO: 3194507 - RNA, 19 nt, Mycobacterium bovis subsp bovis AF2122/97
cacgguccacgguggcgcc

SEQ ID NO: 3194508 - RNA, 14 nt, Mycobacterium bovis subsp bovis AF2122/97
cacgguccgccacg

SEQ ID NO: 3194509 - RNA, 21 nt, Mycobacterium bovis subsp bovis AF2122/97
cacgguccggcccaccagcgc

SEQ ID NO: 3194510 - RNA, 23 nt, Mycobacterium bovis subsp bovis AF2122/97
cacgguccggcccaccagcgcag

SEQ ID NO: 3194511 - RNA, 19 nt, Mycobacterium bovis subsp bovis AF2122/97
cacggucgaccaggacggu

SEQ ID NO: 3194512 - RNA, 14 nt, Mycobacterium bovis subsp bovis AF2122/97
cacggucgacgaug

SEQ ID NO: 3194513 - RNA, 13 nt, Mycobacterium bovis subsp bovis AF2122/97
cacggucgccgac

SEQ ID NO: 3194514 - RNA, 14 nt, Mycobacterium bovis subsp bovis AF2122/97
cacggucgcggauc

SEQ ID NO: 3194515 - RNA, 16 nt, Mycobacterium bovis subsp bovis AF2122/97
cacggugaacaauccg

SEQ ID NO: 3194516 - RNA, 21 nt, Mycobacterium bovis subsp bovis AF2122/97
cacggugagccgguggcccgc

SEQ ID NO: 3194517 - RNA, 17 nt, Mycobacterium bovis subsp bovis AF2122/97
cacggugaucagcagca

SEQ ID NO: 3194518 - RNA, 15 nt, Mycobacterium bovis subsp bovis AF2122/97
cacggugaucuucuu

SEQ ID NO: 3194519 - RNA, 19 nt, Mycobacterium bovis subsp bovis AF2122/97
cacggugaucuucuucagg

SEQ ID NO: 3194520 - RNA, 19 nt, Mycobacterium bovis subsp bovis AF2122/97
cacggugaugaggaucgcg

SEQ ID NO: 3194521 - RNA, 12 nt, Mycobacterium bovis subsp bovis AF2122/97
cacggugcccag

SEQ ID NO: 3194522 - RNA, 15 nt, Mycobacterium bovis subsp bovis AF2122/97
cacggugcccagggc

SEQ ID NO: 3194523 - RNA, 13 nt, Mycobacterium bovis subsp bovis AF2122/97
cacggugccgccg

SEQ ID NO: 3194524 - RNA, 14 nt, Mycobacterium bovis subsp bovis AF2122/97
cacggugccggcac

SEQ ID NO: 3194525 - RNA, 16 nt, Mycobacterium bovis subsp bovis AF2122/97
cacggugccggcaccc

SEQ ID NO: 3194526 - RNA, 20 nt, Mycobacterium bovis subsp bovis AF2122/97
cacggugcguucgugcugcc

SEQ ID NO: 3194527 - RNA, 22 nt, Mycobacterium bovis subsp bovis AF2122/97
cacgguggacgauacgcgcacc

SEQ ID NO: 3194528 - RNA, 16 nt, Mycobacterium bovis subsp bovis AF2122/97
cacgguggagcgcgcc

SEQ ID NO: 3194529 - RNA, 17 nt, Mycobacterium bovis subsp bovis AF2122/97
cacgguggagcgcgccu

SEQ ID NO: 3194530 - RNA, 16 nt, Mycobacterium bovis subsp bovis AF2122/97
cacgguggccgagccg

SEQ ID NO: 3194531 - RNA, 22 nt, Mycobacterium bovis subsp bovis AF2122/97
cacgguggccgagccgcgguca

SEQ ID NO: 3194532 - RNA, 13 nt, Mycobacterium bovis subsp bovis AF2122/97
cacgguggccgca

SEQ ID NO: 3194533 - RNA, 14 nt, Mycobacterium bovis subsp bovis AF2122/97
cacgguggccgcac

SEQ ID NO: 3194534 - RNA, 17 nt, Mycobacterium bovis subsp bovis AF2122/97
cacgguggccgcaucga

SEQ ID NO: 3194535 - RNA, 20 nt, Mycobacterium bovis subsp bovis AF2122/97
cacgguggccgcugccagcc

SEQ ID NO: 3194536 - RNA, 15 nt, Mycobacterium bovis subsp bovis AF2122/97
cacgguggcgccgaa

SEQ ID NO: 3194537 - RNA, 16 nt, Mycobacterium bovis subsp bovis AF2122/97
cacgguggcgccgaac

SEQ ID NO: 3194538 - RNA, 17 nt, Mycobacterium bovis subsp bovis AF2122/97
cacgguggcucuguagc

SEQ ID NO: 3194539 - RNA, 23 nt, Mycobacterium bovis subsp bovis AF2122/97
cacgguggcucuguagcgucgca

SEQ ID NO: 3194540 - RNA, 17 nt, Mycobacterium bovis subsp bovis AF2122/97
cacggugggcgccgaca

SEQ ID NO: 3194541 - RNA, 18 nt, Mycobacterium bovis subsp bovis AF2122/97
cacggugggcgccgacac

SEQ ID NO: 3194542 - RNA, 20 nt, Mycobacterium bovis subsp bovis AF2122/97
cacggugggcgccgacaccg

SEQ ID NO: 3194543 - RNA, 15 nt, Mycobacterium bovis subsp bovis AF2122/97
cacggugggcgcugg

SEQ ID NO: 3194544 - RNA, 22 nt, Mycobacterium bovis subsp bovis AF2122/97
cacgguggugggcuaggucgcg

SEQ ID NO: 3194545 - RNA, 18 nt, Mycobacterium bovis subsp bovis AF2122/97
cacgguggugucagccac

SEQ ID NO: 3194546 - RNA, 23 nt, Mycobacterium bovis subsp bovis AF2122/97
cacgguguauugggguggcagcu

SEQ ID NO: 3194547 - RNA, 13 nt, Mycobacterium bovis subsp bovis AF2122/97
cacggugucccgc

SEQ ID NO: 3194548 - RNA, 17 nt, Mycobacterium bovis subsp bovis AF2122/97
cacggugucgcgcgacc

SEQ ID NO: 3194549 - RNA, 20 nt, Mycobacterium bovis subsp bovis AF2122/97
cacggugucgcgcgaccugg

SEQ ID NO: 3194550 - RNA, 15 nt, Mycobacterium bovis subsp bovis AF2122/97
cacggugugcacggc

SEQ ID NO: 3194551 - RNA, 19 nt, Mycobacterium bovis subsp bovis AF2122/97
cacgguguugcgcacccgc

SEQ ID NO: 3194552 - RNA, 20 nt, Mycobacterium bovis subsp bovis AF2122/97
cacgguguugcgcacccgcg

SEQ ID NO: 3194553 - RNA, 16 nt, Mycobacterium bovis subsp bovis AF2122/97
cacgguuagacgucgu

SEQ ID NO: 3194554 - RNA, 19 nt, Mycobacterium bovis subsp bovis AF2122/97
cacgguucgcccgucgcca

SEQ ID NO: 3194555 - RNA, 16 nt, Mycobacterium bovis subsp bovis AF2122/97
cacgguucgggcagca

SEQ ID NO: 3194556 - RNA, 22 nt, Mycobacterium bovis subsp bovis AF2122/97
cacgguucgggcagcacccgcg

SEQ ID NO: 3194557 - RNA, 17 nt, Mycobacterium bovis subsp bovis AF2122/97
cacgguucuuggcgucu

SEQ ID NO: 3194558 - RNA, 15 nt, Mycobacterium bovis subsp bovis AF2122/97
cacgguugccggcgg

SEQ ID NO: 3194559 - RNA, 16 nt, Mycobacterium bovis subsp bovis AF2122/97
cacgguugccggcggc

SEQ ID NO: 3194560 - RNA, 21 nt, Mycobacterium bovis subsp bovis AF2122/97
cacgguugccggcggcgacgu

SEQ ID NO: 3194561 - RNA, 15 nt, Mycobacterium bovis subsp bovis AF2122/97
cacgguuggccacca

SEQ ID NO: 3194562 - RNA, 21 nt, Mycobacterium bovis subsp bovis AF2122/97
cacgguuggccaccagcuggc

SEQ ID NO: 3194563 - RNA, 13 nt, Mycobacterium bovis subsp bovis AF2122/97
cacgguuggcgcu

SEQ ID NO: 3194564 - RNA, 17 nt, Mycobacterium bovis subsp bovis AF2122/97
cacgguuguuguagauc

SEQ ID NO: 3194565 - RNA, 15 nt, Mycobacterium bovis subsp bovis AF2122/97
cacguaagcgguugu

SEQ ID NO: 3194566 - RNA, 14 nt, Mycobacterium bovis subsp bovis AF2122/97
cacguacgccgccg

SEQ ID NO: 3194567 - RNA, 15 nt, Mycobacterium bovis subsp bovis AF2122/97
cacguacgccgccga

SEQ ID NO: 3194568 - RNA, 17 nt, Mycobacterium bovis subsp bovis AF2122/97
cacguacgcgauuucga

SEQ ID NO: 3194569 - RNA, 14 nt, Mycobacterium bovis subsp bovis AF2122/97
cacguacuccaccg

SEQ ID NO: 3194570 - RNA, 21 nt, Mycobacterium bovis subsp bovis AF2122/97
cacguacuuggacgacccggg

SEQ ID NO: 3194571 - RNA, 14 nt, Mycobacterium bovis subsp bovis AF2122/97
cacguagcagcgcc

SEQ ID NO: 3194572 - RNA, 15 nt, Mycobacterium bovis subsp bovis AF2122/97
cacguagcgaccgcg

SEQ ID NO: 3194573 - RNA, 17 nt, Mycobacterium bovis subsp bovis AF2122/97
cacguagcgaccgcggu

SEQ ID NO: 3194574 - RNA, 17 nt, Mycobacterium bovis subsp bovis AF2122/97
cacguaguagccgagca

SEQ ID NO: 3194575 - RNA, 17 nt, Mycobacterium bovis subsp bovis AF2122/97
cacgucaaacaacgcaa

SEQ ID NO: 3194576 - RNA, 18 nt, Mycobacterium bovis subsp bovis AF2122/97
cacgucacgcgcggcggc

SEQ ID NO: 3194577 - RNA, 20 nt, Mycobacterium bovis subsp bovis AF2122/97
cacgucagcggaugggcuga

SEQ ID NO: 3194578 - RNA, 18 nt, Mycobacterium bovis subsp bovis AF2122/97
cacgucaucggcuggccg

SEQ ID NO: 3194579 - RNA, 15 nt, Mycobacterium bovis subsp bovis AF2122/97
cacgucaucuggcgc

SEQ ID NO: 3194580 - RNA, 13 nt, Mycobacterium bovis subsp bovis AF2122/97
cacguccaacucg

SEQ ID NO: 3194581 - RNA, 12 nt, Mycobacterium bovis subsp bovis AF2122/97
cacgucccagag

SEQ ID NO: 3194582 - RNA, 22 nt, Mycobacterium bovis subsp bovis AF2122/97
cacgucccgguaauccacucca

SEQ ID NO: 3194583 - RNA, 24 nt, Mycobacterium bovis subsp bovis AF2122/97
cacguccgaucggcgcgccgaucg

SEQ ID NO: 3194584 - RNA, 17 nt, Mycobacterium bovis subsp bovis AF2122/97
cacguccgcaaccucgc

SEQ ID NO: 3194585 - RNA, 14 nt, Mycobacterium bovis subsp bovis AF2122/97
cacguccgcgcacc

SEQ ID NO: 3194586 - RNA, 19 nt, Mycobacterium bovis subsp bovis AF2122/97
cacguccgcgggggaccgc

SEQ ID NO: 3194587 - RNA, 21 nt, Mycobacterium bovis subsp bovis AF2122/97
cacguccgcgggggaccgccc

SEQ ID NO: 3194588 - RNA, 14 nt, Mycobacterium bovis subsp bovis AF2122/97
cacguccggcgaug

SEQ ID NO: 3194589 - RNA, 20 nt, Mycobacterium bovis subsp bovis AF2122/97
cacguccggcgaugaccaga

SEQ ID NO: 3194590 - RNA, 12 nt, Mycobacterium bovis subsp bovis AF2122/97
cacguccugccc

SEQ ID NO: 3194591 - RNA, 15 nt, Mycobacterium bovis subsp bovis AF2122/97
cacguccugcccguc

SEQ ID NO: 3194592 - RNA, 21 nt, Mycobacterium bovis subsp bovis AF2122/97
cacguccugcccgucgucggc

SEQ ID NO: 3194593 - RNA, 22 nt, Mycobacterium bovis subsp bovis AF2122/97
cacgucgaaaucggugcacaac

SEQ ID NO: 3194594 - RNA, 23 nt, Mycobacterium bovis subsp bovis AF2122/97
cacgucgaacucguugaagaauc

SEQ ID NO: 3194595 - RNA, 23 nt, Mycobacterium bovis subsp bovis AF2122/97
cacgucgacaccgaggaccucgu

SEQ ID NO: 3194596 - RNA, 22 nt, Mycobacterium bovis subsp bovis AF2122/97
cacgucgaccaauaccaguccg

SEQ ID NO: 3194597 - RNA, 20 nt, Mycobacterium bovis subsp bovis AF2122/97
cacgucgacccccugccaca

SEQ ID NO: 3194598 - RNA, 17 nt, Mycobacterium bovis subsp bovis AF2122/97
cacgucgaccucggcaa

SEQ ID NO: 3194599 - RNA, 20 nt, Mycobacterium bovis subsp bovis AF2122/97
cacgucgaccucggcaacca

SEQ ID NO: 3194600 - RNA, 20 nt, Mycobacterium bovis subsp bovis AF2122/97
cacgucgacggcggccgcca

SEQ ID NO: 3194601 - RNA, 21 nt, Mycobacterium bovis subsp bovis AF2122/97
cacgucgacggcggccgccac

SEQ ID NO: 3194602 - RNA, 20 nt, Mycobacterium bovis subsp bovis AF2122/97
cacgucgagcagccgcgaca

SEQ ID NO: 3194603 - RNA, 17 nt, Mycobacterium bovis subsp bovis AF2122/97
cacgucgagcgugaacc

SEQ ID NO: 3194604 - RNA, 17 nt, Mycobacterium bovis subsp bovis AF2122/97
cacgucgaggcggcagu

SEQ ID NO: 3194605 - RNA, 17 nt, Mycobacterium bovis subsp bovis AF2122/97
cacgucgagguccacca

SEQ ID NO: 3194606 - RNA, 22 nt, Mycobacterium bovis subsp bovis AF2122/97
cacgucgaucagugcaagaccg

SEQ ID NO: 3194607 - RNA, 16 nt, Mycobacterium bovis subsp bovis AF2122/97
cacgucgcccccggcc

SEQ ID NO: 3194608 - RNA, 17 nt, Mycobacterium bovis subsp bovis AF2122/97
cacgucgcccccggcca

SEQ ID NO: 3194609 - RNA, 20 nt, Mycobacterium bovis subsp bovis AF2122/97
cacgucgcccccggccaugg

SEQ ID NO: 3194610 - RNA, 17 nt, Mycobacterium bovis subsp bovis AF2122/97
cacgucgcgccaggcgc

SEQ ID NO: 3194611 - RNA, 13 nt, Mycobacterium bovis subsp bovis AF2122/97
cacgucgcgggua

SEQ ID NO: 3194612 - RNA, 15 nt, Mycobacterium bovis subsp bovis AF2122/97
cacgucgcgguaggc

SEQ ID NO: 3194613 - RNA, 19 nt, Mycobacterium bovis subsp bovis AF2122/97
cacgucggauccgcccgcc

SEQ ID NO: 3194614 - RNA, 13 nt, Mycobacterium bovis subsp bovis AF2122/97
cacgucggccagu

SEQ ID NO: 3194615 - RNA, 14 nt, Mycobacterium bovis subsp bovis AF2122/97
cacgucggcgggcg

SEQ ID NO: 3194616 - RNA, 15 nt, Mycobacterium bovis subsp bovis AF2122/97
cacgucggcgggcgu

SEQ ID NO: 3194617 - RNA, 23 nt, Mycobacterium bovis subsp bovis AF2122/97
cacgucggguugcacggcgauug

SEQ ID NO: 3194618 - RNA, 12 nt, Mycobacterium bovis subsp bovis AF2122/97
cacgucgucagc

SEQ ID NO: 3194619 - RNA, 21 nt, Mycobacterium bovis subsp bovis AF2122/97
cacgucgucagccaccgcaug

SEQ ID NO: 3194620 - RNA, 15 nt, Mycobacterium bovis subsp bovis AF2122/97
cacgucucgcgaggu

SEQ ID NO: 3194621 - RNA, 22 nt, Mycobacterium bovis subsp bovis AF2122/97
cacgucuugcugcacgcucugc

SEQ ID NO: 3194622 - RNA, 16 nt, Mycobacterium bovis subsp bovis AF2122/97
cacgugaaggcgaugg

SEQ ID NO: 3194623 - RNA, 22 nt, Mycobacterium bovis subsp bovis AF2122/97
cacgugaaggcgauggcaccgu

SEQ ID NO: 3194624 - RNA, 16 nt, Mycobacterium bovis subsp bovis AF2122/97
cacgugaugcccuggg

SEQ ID NO: 3194625 - RNA, 14 nt, Mycobacterium bovis subsp bovis AF2122/97
cacgugcacggcga

SEQ ID NO: 3194626 - RNA, 20 nt, Mycobacterium bovis subsp bovis AF2122/97
cacgugccaaaugaugacga

SEQ ID NO: 3194627 - RNA, 14 nt, Mycobacterium bovis subsp bovis AF2122/97
cacgugcccgcgcg

SEQ ID NO: 3194628 - RNA, 17 nt, Mycobacterium bovis subsp bovis AF2122/97
cacgugcugccgauagc

SEQ ID NO: 3194629 - RNA, 21 nt, Mycobacterium bovis subsp bovis AF2122/97
cacgugcugccgauagcgcgg

SEQ ID NO: 3194630 - RNA, 16 nt, Mycobacterium bovis subsp bovis AF2122/97
cacguggaccggcacg

SEQ ID NO: 3194631 - RNA, 13 nt, Mycobacterium bovis subsp bovis AF2122/97
cacguggucggcc

SEQ ID NO: 3194632 - RNA, 16 nt, Mycobacterium bovis subsp bovis AF2122/97
cacguggucggccacc

SEQ ID NO: 3194633 - RNA, 17 nt, Mycobacterium bovis subsp bovis AF2122/97
cacguggucggccaccc

SEQ ID NO: 3194634 - RNA, 19 nt, Mycobacterium bovis subsp bovis AF2122/97
cacguggucggccacccca

SEQ ID NO: 3194635 - RNA, 14 nt, Mycobacterium bovis subsp bovis AF2122/97
cacguggugcggcc

SEQ ID NO: 3194636 - RNA, 16 nt, Mycobacterium bovis subsp bovis AF2122/97
cacguggugcggccgg

SEQ ID NO: 3194637 - RNA, 19 nt, Mycobacterium bovis subsp bovis AF2122/97
cacguggugcggccggguc

SEQ ID NO: 3194638 - RNA, 19 nt, Mycobacterium bovis subsp bovis AF2122/97
cacguuauucaugcccaug

SEQ ID NO: 3194639 - RNA, 13 nt, Mycobacterium bovis subsp bovis AF2122/97
cacguucgcggcc

SEQ ID NO: 3194640 - RNA, 23 nt, Mycobacterium bovis subsp bovis AF2122/97
cacguucggcgaugaucaccagu

SEQ ID NO: 3194641 - RNA, 19 nt, Mycobacterium bovis subsp bovis AF2122/97
cacguucggcgcacagcga

SEQ ID NO: 3194642 - RNA, 13 nt, Mycobacterium bovis subsp bovis AF2122/97
cacguucggcgcu

SEQ ID NO: 3194643 - RNA, 23 nt, Mycobacterium bovis subsp bovis AF2122/97
cacguucggcgcugccaggccgc

SEQ ID NO: 3194644 - RNA, 12 nt, Mycobacterium bovis subsp bovis AF2122/97
cacguucggcgu

SEQ ID NO: 3194645 - RNA, 19 nt, Mycobacterium bovis subsp bovis AF2122/97
cacguucgguggagggcga

SEQ ID NO: 3194646 - RNA, 16 nt, Mycobacterium bovis subsp bovis AF2122/97
cacguucucaccacca

SEQ ID NO: 3194647 - RNA, 19 nt, Mycobacterium bovis subsp bovis AF2122/97
cacguugaccgugauauca

SEQ ID NO: 3194648 - RNA, 22 nt, Mycobacterium bovis subsp bovis AF2122/97
cacguugacggcgaacccgccg

SEQ ID NO: 3194649 - RNA, 14 nt, Mycobacterium bovis subsp bovis AF2122/97
cacguugacgucca

SEQ ID NO: 3194650 - RNA, 16 nt, Mycobacterium bovis subsp bovis AF2122/97
cacguugauccgcgca

SEQ ID NO: 3194651 - RNA, 20 nt, Mycobacterium bovis subsp bovis AF2122/97
cacguugaugaugccggcgu

SEQ ID NO: 3194652 - RNA, 14 nt, Mycobacterium bovis subsp bovis AF2122/97
cacguugauucggg

SEQ ID NO: 3194653 - RNA, 17 nt, Mycobacterium bovis subsp bovis AF2122/97
cacguugauucgggagg

SEQ ID NO: 3194654 - RNA, 17 nt, Mycobacterium bovis subsp bovis AF2122/97
cacguugcacagcuugg

SEQ ID NO: 3194655 - RNA, 20 nt, Mycobacterium bovis subsp bovis AF2122/97
cacguugcagcucgauccgc

SEQ ID NO: 3194656 - RNA, 21 nt, Mycobacterium bovis subsp bovis AF2122/97
cacguugccgaucccggcgag

SEQ ID NO: 3194657 - RNA, 23 nt, Mycobacterium bovis subsp bovis AF2122/97
cacguugccgaucccggcgagca

SEQ ID NO: 3194658 - RNA, 14 nt, Mycobacterium bovis subsp bovis AF2122/97
cacguugcgcugga

SEQ ID NO: 3194659 - RNA, 22 nt, Mycobacterium bovis subsp bovis AF2122/97
cacguuggccccgcggagcgca

SEQ ID NO: 3194660 - RNA, 22 nt, Mycobacterium bovis subsp bovis AF2122/97
cacguuggcggccagcgcaccg

SEQ ID NO: 3194661 - RNA, 17 nt, Mycobacterium bovis subsp bovis AF2122/97
cacguuguucaccgacg

SEQ ID NO: 3194662 - RNA, 17 nt, Mycobacterium bovis subsp bovis AF2122/97
cacguuuagggugcccg

SEQ ID NO: 3194663 - RNA, 16 nt, Mycobacterium bovis subsp bovis AF2122/97
cacguuucacgugguc

SEQ ID NO: 3194664 - RNA, 20 nt, Mycobacterium bovis subsp bovis AF2122/97
cacuaaccuggcguagauca

SEQ ID NO: 3194665 - RNA, 22 nt, Mycobacterium bovis subsp bovis AF2122/97
cacuaaccuggcguagaucauc

SEQ ID NO: 3194666 - RNA, 15 nt, Mycobacterium bovis subsp bovis AF2122/97
cacuacacaggaagc

SEQ ID NO: 3194667 - RNA, 15 nt, Mycobacterium bovis subsp bovis AF2122/97
cacuaccgaucacau

SEQ ID NO: 3194668 - RNA, 16 nt, Mycobacterium bovis subsp bovis AF2122/97
cacuaccgccgcgacc

SEQ ID NO: 3194669 - RNA, 18 nt, Mycobacterium bovis subsp bovis AF2122/97
cacuaccgccgcgaccgc

SEQ ID NO: 3194670 - RNA, 13 nt, Mycobacterium bovis subsp bovis AF2122/97
cacuacgcagccg

SEQ ID NO: 3194671 - RNA, 14 nt, Mycobacterium bovis subsp bovis AF2122/97
cacuacggccuggc

SEQ ID NO: 3194672 - RNA, 16 nt, Mycobacterium bovis subsp bovis AF2122/97
cacuacggccuggcca

SEQ ID NO: 3194673 - RNA, 18 nt, Mycobacterium bovis subsp bovis AF2122/97
cacuacucgaacaacccc

SEQ ID NO: 3194674 - RNA, 22 nt, Mycobacterium bovis subsp bovis AF2122/97
cacuagcauugucgccggaugc

SEQ ID NO: 3194675 - RNA, 16 nt, Mycobacterium bovis subsp bovis AF2122/97
cacuagcgagccggcg

SEQ ID NO: 3194676 - RNA, 22 nt, Mycobacterium bovis subsp bovis AF2122/97
cacuagcgagccggcgccgggu

SEQ ID NO: 3194677 - RNA, 18 nt, Mycobacterium bovis subsp bovis AF2122/97
cacuagcuucgcuugccg

SEQ ID NO: 3194678 - RNA, 17 nt, Mycobacterium bovis subsp bovis AF2122/97
cacuaggaagguggccc

SEQ ID NO: 3194679 - RNA, 19 nt, Mycobacterium bovis subsp bovis AF2122/97
cacucaaccugaaccggcc

SEQ ID NO: 3194680 - RNA, 17 nt, Mycobacterium bovis subsp bovis AF2122/97
cacucaacgaccuggga

SEQ ID NO: 3194681 - RNA, 14 nt, Mycobacterium bovis subsp bovis AF2122/97
cacucacauccugg

SEQ ID NO: 3194682 - RNA, 15 nt, Mycobacterium bovis subsp bovis AF2122/97
cacucacauuggcca

SEQ ID NO: 3194683 - RNA, 18 nt, Mycobacterium bovis subsp bovis AF2122/97
cacucacauuggccaggu

SEQ ID NO: 3194684 - RNA, 12 nt, Mycobacterium bovis subsp bovis AF2122/97
cacucaccuugu

SEQ ID NO: 3194685 - RNA, 18 nt, Mycobacterium bovis subsp bovis AF2122/97
cacucacgggugcuggca

SEQ ID NO: 3194686 - RNA, 23 nt, Mycobacterium bovis subsp bovis AF2122/97
cacucagcaggggaucguccggc

SEQ ID NO: 3194687 - RNA, 18 nt, Mycobacterium bovis subsp bovis AF2122/97
cacucagcccgacaccga

SEQ ID NO: 3194688 - RNA, 22 nt, Mycobacterium bovis subsp bovis AF2122/97
cacucaggaucccgguggcagc

SEQ ID NO: 3194689 - RNA, 23 nt, Mycobacterium bovis subsp bovis AF2122/97
cacucagguacggcgggcggccg

SEQ ID NO: 3194690 - RNA, 12 nt, Mycobacterium bovis subsp bovis AF2122/97
cacuccaaaugg

SEQ ID NO: 3194691 - RNA, 23 nt, Mycobacterium bovis subsp bovis AF2122/97
cacuccaagucacagcucaccau

SEQ ID NO: 3194692 - RNA, 18 nt, Mycobacterium bovis subsp bovis AF2122/97
cacuccaccgcuggcccg

SEQ ID NO: 3194693 - RNA, 17 nt, Mycobacterium bovis subsp bovis AF2122/97
cacuccagcagcucgcc

SEQ ID NO: 3194694 - RNA, 14 nt, Mycobacterium bovis subsp bovis AF2122/97
gcggccagcucaug

SEQ ID NO: 3194695 - RNA, 17 nt, Mycobacterium bovis subsp bovis AF2122/97
gcggccagcucggccag

SEQ ID NO: 3194696 - RNA, 18 nt, Mycobacterium bovis subsp bovis AF2122/97
gcggccagcucggccagc

SEQ ID NO: 3194697 - RNA, 15 nt, Mycobacterium bovis subsp bovis AF2122/97
gcggccagcugcagc

SEQ ID NO: 3194698 - RNA, 23 nt, Mycobacterium bovis subsp bovis AF2122/97
gcggccaggaugccugccacccg

SEQ ID NO: 3194699 - RNA, 13 nt, Mycobacterium bovis subsp bovis AF2122/97
gcggccaggcgcg

SEQ ID NO: 3194700 - RNA, 17 nt, Mycobacterium bovis subsp bovis AF2122/97
gcggccaggcgcgacgu

SEQ ID NO: 3194701 - RNA, 13 nt, Mycobacterium bovis subsp bovis AF2122/97
gcggccaggcggu

SEQ ID NO: 3194702 - RNA, 17 nt, Mycobacterium bovis subsp bovis AF2122/97
gcggccaggcgguacgg

SEQ ID NO: 3194703 - RNA, 21 nt, Mycobacterium bovis subsp bovis AF2122/97
gcggccagggcacccaucccg

SEQ ID NO: 3194704 - RNA, 13 nt, Mycobacterium bovis subsp bovis AF2122/97
gcggccaggucgc

SEQ ID NO: 3194705 - RNA, 16 nt, Mycobacterium bovis subsp bovis AF2122/97
gcggccaggucgccuu

SEQ ID NO: 3194706 - RNA, 22 nt, Mycobacterium bovis subsp bovis AF2122/97
gcggccaggugcaggcuucugg

SEQ ID NO: 3194707 - RNA, 16 nt, Mycobacterium bovis subsp bovis AF2122/97
gcggccaguacgaucu

SEQ ID NO: 3194708 - RNA, 15 nt, Mycobacterium bovis subsp bovis AF2122/97
gcggccaguacgucg

SEQ ID NO: 3194709 - RNA, 22 nt, Mycobacterium bovis subsp bovis AF2122/97
gcggccagucaggaaaccggcg

SEQ ID NO: 3194710 - RNA, 21 nt, Mycobacterium bovis subsp bovis AF2122/97
gcggccaguucggcggccgcc

SEQ ID NO: 3194711 - RNA, 17 nt, Mycobacterium bovis subsp bovis AF2122/97
gcggccauaucgcccac

SEQ ID NO: 3194712 - RNA, 17 nt, Mycobacterium bovis subsp bovis AF2122/97
gcggccaucccgcguuc

SEQ ID NO: 3194713 - RNA, 18 nt, Mycobacterium bovis subsp bovis AF2122/97
gcggccaucccgcguucg

SEQ ID NO: 3194714 - RNA, 19 nt, Mycobacterium bovis subsp bovis AF2122/97
gcggccauccggcggcggc

SEQ ID NO: 3194715 - RNA, 22 nt, Mycobacterium bovis subsp bovis AF2122/97
gcggccauccggcggcggccag

SEQ ID NO: 3194716 - RNA, 14 nt, Mycobacterium bovis subsp bovis AF2122/97
gcggccaucgccga

SEQ ID NO: 3194717 - RNA, 18 nt, Mycobacterium bovis subsp bovis AF2122/97
gcggccaucgccgacacc

SEQ ID NO: 3194718 - RNA, 13 nt, Mycobacterium bovis subsp bovis AF2122/97
gcggccauggcac

SEQ ID NO: 3194719 - RNA, 15 nt, Mycobacterium bovis subsp bovis AF2122/97
gcggccauggcacug

SEQ ID NO: 3194720 - RNA, 18 nt, Mycobacterium bovis subsp bovis AF2122/97
gcggccaugucagcggcc

SEQ ID NO: 3194721 - RNA, 20 nt, Mycobacterium bovis subsp bovis AF2122/97
gcggccauuagcagcacccg

SEQ ID NO: 3194722 - RNA, 21 nt, Mycobacterium bovis subsp bovis AF2122/97
gcggccauuagcagcacccgg

SEQ ID NO: 3194723 - RNA, 19 nt, Mycobacterium bovis subsp bovis AF2122/97
gcggcccaaccggucgugg

SEQ ID NO: 3194724 - RNA, 14 nt, Mycobacterium bovis subsp bovis AF2122/97
gcggcccacaccag

SEQ ID NO: 3194725 - RNA, 15 nt, Mycobacterium bovis subsp bovis AF2122/97
gcggcccacaccagc

SEQ ID NO: 3194726 - RNA, 16 nt, Mycobacterium bovis subsp bovis AF2122/97
gcggcccacaccagcg

SEQ ID NO: 3194727 - RNA, 23 nt, Mycobacterium bovis subsp bovis AF2122/97
gcggcccacucucgccacgccgu

SEQ ID NO: 3194728 - RNA, 20 nt, Mycobacterium bovis subsp bovis AF2122/97
gcggcccaucgggcgcccau

SEQ ID NO: 3194729 - RNA, 20 nt, Mycobacterium bovis subsp bovis AF2122/97
gcggcccaugaucucggcga

SEQ ID NO: 3194730 - RNA, 22 nt, Mycobacterium bovis subsp bovis AF2122/97
gcggcccaugaucucggcgaac

SEQ ID NO: 3194731 - RNA, 20 nt, Mycobacterium bovis subsp bovis AF2122/97
gcggccccaggggcaccagc

SEQ ID NO: 3194732 - RNA, 19 nt, Mycobacterium bovis subsp bovis AF2122/97
gcggccccgacacagcggc

SEQ ID NO: 3194733 - RNA, 14 nt, Mycobacterium bovis subsp bovis AF2122/97
gcggccccgacaua

SEQ ID NO: 3194734 - RNA, 19 nt, Mycobacterium bovis subsp bovis AF2122/97
gcggccccgacugccgcgg

SEQ ID NO: 3194735 - RNA, 13 nt, Mycobacterium bovis subsp bovis AF2122/97
gcggccccgccgu

SEQ ID NO: 3194736 - RNA, 13 nt, Mycobacterium bovis subsp bovis AF2122/97
gcggccccgcgcc

SEQ ID NO: 3194737 - RNA, 16 nt, Mycobacterium bovis subsp bovis AF2122/97
gcggccccgcgccacc

SEQ ID NO: 3194738 - RNA, 23 nt, Mycobacterium bovis subsp bovis AF2122/97
gcggccccggcauugcccgagcc

SEQ ID NO: 3194739 - RNA, 14 nt, Mycobacterium bovis subsp bovis AF2122/97
gcggccccgucgcc

SEQ ID NO: 3194740 - RNA, 16 nt, Mycobacterium bovis subsp bovis AF2122/97
gcggccccgucgccga

SEQ ID NO: 3194741 - RNA, 19 nt, Mycobacterium bovis subsp bovis AF2122/97
gcggcccgagaagcguugc

SEQ ID NO: 3194742 - RNA, 18 nt, Mycobacterium bovis subsp bovis AF2122/97
gcggcccgaggcucgggc

SEQ ID NO: 3194743 - RNA, 19 nt, Mycobacterium bovis subsp bovis AF2122/97
gcggcccgaggcucgggcc

SEQ ID NO: 3194744 - RNA, 18 nt, Mycobacterium bovis subsp bovis AF2122/97
gcggcccgaucaccagcc

SEQ ID NO: 3194745 - RNA, 14 nt, Mycobacterium bovis subsp bovis AF2122/97
gcggcccgcagccc

SEQ ID NO: 3194746 - RNA, 15 nt, Mycobacterium bovis subsp bovis AF2122/97
gcggcccgcagcccg

SEQ ID NO: 3194747 - RNA, 19 nt, Mycobacterium bovis subsp bovis AF2122/97
gcggcccgcagcccgccgg

SEQ ID NO: 3194748 - RNA, 23 nt, Mycobacterium bovis subsp bovis AF2122/97
gcggcccgccgaguucugcugga

SEQ ID NO: 3194749 - RNA, 13 nt, Mycobacterium bovis subsp bovis AF2122/97
gcggcccgccucg

SEQ ID NO: 3194750 - RNA, 17 nt, Mycobacterium bovis subsp bovis AF2122/97
gcggcccgcgaucgggc

SEQ ID NO: 3194751 - RNA, 20 nt, Mycobacterium bovis subsp bovis AF2122/97
gcggcccgcgaucgggccga

SEQ ID NO: 3194752 - RNA, 22 nt, Mycobacterium bovis subsp bovis AF2122/97
gcggcccgcuccacggucaggc

SEQ ID NO: 3194753 - RNA, 13 nt, Mycobacterium bovis subsp bovis AF2122/97
gcggcccgcucga

SEQ ID NO: 3194754 - RNA, 13 nt, Mycobacterium bovis subsp bovis AF2122/97
gcggcccgcucgg

SEQ ID NO: 3194755 - RNA, 13 nt, Mycobacterium bovis subsp bovis AF2122/97
gcggcccgcugug

SEQ ID NO: 3194756 - RNA, 19 nt, Mycobacterium bovis subsp bovis AF2122/97
gcggcccggacgucggcgg

SEQ ID NO: 3194757 - RNA, 18 nt, Mycobacterium bovis subsp bovis AF2122/97
gcggcccgggaacccgcu

SEQ ID NO: 3194758 - RNA, 16 nt, Mycobacterium bovis subsp bovis AF2122/97
gcggcccggguggccc

SEQ ID NO: 3194759 - RNA, 18 nt, Mycobacterium bovis subsp bovis AF2122/97
gcggcccggguuggccga

SEQ ID NO: 3194760 - RNA, 21 nt, Mycobacterium bovis subsp bovis AF2122/97
gcggcccggucuacgccaccg

SEQ ID NO: 3194761 - RNA, 22 nt, Mycobacterium bovis subsp bovis AF2122/97
gcggcccggucuacgccaccga

SEQ ID NO: 3194762 - RNA, 14 nt, Mycobacterium bovis subsp bovis AF2122/97
gcggcccgucaccg

SEQ ID NO: 3194763 - RNA, 17 nt, Mycobacterium bovis subsp bovis AF2122/97
gcggcccgucaccgcgg

SEQ ID NO: 3194764 - RNA, 20 nt, Mycobacterium bovis subsp bovis AF2122/97
gcggcccguuugccgguucg

SEQ ID NO: 3194765 - RNA, 19 nt, Mycobacterium bovis subsp bovis AF2122/97
gcggcccuaaacaccgcga

SEQ ID NO: 3194766 - RNA, 23 nt, Mycobacterium bovis subsp bovis AF2122/97
gcggcccucgaauucggccggcg

SEQ ID NO: 3194767 - RNA, 17 nt, Mycobacterium bovis subsp bovis AF2122/97
gcggcccucgagcagug

SEQ ID NO: 3194768 - RNA, 20 nt, Mycobacterium bovis subsp bovis AF2122/97
gcggcccugcuugcaggcga

SEQ ID NO: 3194769 - RNA, 17 nt, Mycobacterium bovis subsp bovis AF2122/97
gcggcccuucaccagcc

SEQ ID NO: 3194770 - RNA, 20 nt, Mycobacterium bovis subsp bovis AF2122/97
gcggccgaaacuucgcccgg

SEQ ID NO: 3194771 - RNA, 22 nt, Mycobacterium bovis subsp bovis AF2122/97
gcggccgaauuccucaaggucg

SEQ ID NO: 3194772 - RNA, 14 nt, Mycobacterium bovis subsp bovis AF2122/97
gcggccgaccgcga

SEQ ID NO: 3194773 - RNA, 14 nt, Mycobacterium bovis subsp bovis AF2122/97
gcggccgacgggug

SEQ ID NO: 3194774 - RNA, 18 nt, Mycobacterium bovis subsp bovis AF2122/97
gcggccgagggauugccg

SEQ ID NO: 3194775 - RNA, 16 nt, Mycobacterium bovis subsp bovis AF2122/97
gcggccgaggucaccc

SEQ ID NO: 3194776 - RNA, 17 nt, Mycobacterium bovis subsp bovis AF2122/97
gcggccgcaagccgcga

SEQ ID NO: 3194777 - RNA, 22 nt, Mycobacterium bovis subsp bovis AF2122/97
gcggccgcaaucaugucagcgc

SEQ ID NO: 3194778 - RNA, 14 nt, Mycobacterium bovis subsp bovis AF2122/97
gcggccgcagccag

SEQ ID NO: 3194779 - RNA, 19 nt, Mycobacterium bovis subsp bovis AF2122/97
gcggccgcagccagcaagu

SEQ ID NO: 3194780 - RNA, 17 nt, Mycobacterium bovis subsp bovis AF2122/97
gcggccgcagcggccag

SEQ ID NO: 3194781 - RNA, 18 nt, Mycobacterium bovis subsp bovis AF2122/97
gcggccgcagcggccagc

SEQ ID NO: 3194782 - RNA, 19 nt, Mycobacterium bovis subsp bovis AF2122/97
gcggccgcagcggccagcc

SEQ ID NO: 3194783 - RNA, 14 nt, Mycobacterium bovis subsp bovis AF2122/97
gcggccgccacucc

SEQ ID NO: 3194784 - RNA, 13 nt, Mycobacterium bovis subsp bovis AF2122/97
gcggccgccccag

SEQ ID NO: 3194785 - RNA, 22 nt, Mycobacterium bovis subsp bovis AF2122/97
gcggccgccccaggcugguccg

SEQ ID NO: 3194786 - RNA, 22 nt, Mycobacterium bovis subsp bovis AF2122/97
gcggccgcccggacccaaagca

SEQ ID NO: 3194787 - RNA, 12 nt, Mycobacterium bovis subsp bovis AF2122/97
gcggccgccgag

SEQ ID NO: 3194788 - RNA, 11 nt, Mycobacterium bovis subsp bovis AF2122/97
gcggccgccgc

SEQ ID NO: 3194789 - RNA, 15 nt, Mycobacterium bovis subsp bovis AF2122/97
gcggccgccgcggcu

SEQ ID NO: 3194790 - RNA, 12 nt, Mycobacterium bovis subsp bovis AF2122/97
gcggccgccggg

SEQ ID NO: 3194791 - RNA, 13 nt, Mycobacterium bovis subsp bovis AF2122/97
gcggccgccggga

SEQ ID NO: 3194792 - RNA, 18 nt, Mycobacterium bovis subsp bovis AF2122/97
gcggccgccguccccgcc

SEQ ID NO: 3194793 - RNA, 22 nt, Mycobacterium bovis subsp bovis AF2122/97
gcggccgccguccccgccgucg

SEQ ID NO: 3194794 - RNA, 19 nt, Mycobacterium bovis subsp bovis AF2122/97
gcggccgccuacccguucu

SEQ ID NO: 3194795 - RNA, 15 nt, Mycobacterium bovis subsp bovis AF2122/97
gcggccgcgaccagc

SEQ ID NO: 3194796 - RNA, 18 nt, Mycobacterium bovis subsp bovis AF2122/97
gcggccgcgaccagcgcc

SEQ ID NO: 3194797 - RNA, 16 nt, Mycobacterium bovis subsp bovis AF2122/97
gcggccgcgauggcgu

SEQ ID NO: 3194798 - RNA, 15 nt, Mycobacterium bovis subsp bovis AF2122/97
gcggccgcgcgcauc

SEQ ID NO: 3194799 - RNA, 14 nt, Mycobacterium bovis subsp bovis AF2122/97
gcggccgcgcgcuc

SEQ ID NO: 3194800 - RNA, 12 nt, Mycobacterium bovis subsp bovis AF2122/97
gcggccgcggcc

SEQ ID NO: 3194801 - RNA, 13 nt, Mycobacterium bovis subsp bovis AF2122/97
gcggccgcggcga

SEQ ID NO: 3194802 - RNA, 14 nt, Mycobacterium bovis subsp bovis AF2122/97
gcggccgcggucga

SEQ ID NO: 3194803 - RNA, 24 nt, Mycobacterium bovis subsp bovis AF2122/97
gcggccgcggucgauguccgcagc

SEQ ID NO: 3194804 - RNA, 13 nt, Mycobacterium bovis subsp bovis AF2122/97
gcggccgcgguga

SEQ ID NO: 3194805 - RNA, 16 nt, Mycobacterium bovis subsp bovis AF2122/97
gcggccgcgucgucga

SEQ ID NO: 3194806 - RNA, 17 nt, Mycobacterium bovis subsp bovis AF2122/97
gcggccgcgugccgccc

SEQ ID NO: 3194807 - RNA, 18 nt, Mycobacterium bovis subsp bovis AF2122/97
gcggccgcgugccgcccg

SEQ ID NO: 3194808 - RNA, 14 nt, Mycobacterium bovis subsp bovis AF2122/97
gcggccgcuccacc

SEQ ID NO: 3194809 - RNA, 15 nt, Mycobacterium bovis subsp bovis AF2122/97
gcggccgcuccaccu

SEQ ID NO: 3194810 - RNA, 20 nt, Mycobacterium bovis subsp bovis AF2122/97
gcggccggauguugaccggc

SEQ ID NO: 3194811 - RNA, 18 nt, Mycobacterium bovis subsp bovis AF2122/97
gcggccggcacgaccgcu

SEQ ID NO: 3194812 - RNA, 15 nt, Mycobacterium bovis subsp bovis AF2122/97
gcggccggccgcuca

SEQ ID NO: 3194813 - RNA, 18 nt, Mycobacterium bovis subsp bovis AF2122/97
gcggccggccgcucaccc

SEQ ID NO: 3194814 - RNA, 14 nt, Mycobacterium bovis subsp bovis AF2122/97
gcggccggccgucc

SEQ ID NO: 3194815 - RNA, 14 nt, Mycobacterium bovis subsp bovis AF2122/97
gcggccggcgccgg

SEQ ID NO: 3194816 - RNA, 23 nt, Mycobacterium bovis subsp bovis AF2122/97
gcggccggcgcucgcggcggcgc

SEQ ID NO: 3194817 - RNA, 14 nt, Mycobacterium bovis subsp bovis AF2122/97
gcggccggcggccg

SEQ ID NO: 3194818 - RNA, 15 nt, Mycobacterium bovis subsp bovis AF2122/97
gcggccggcggccgc

SEQ ID NO: 3194819 - RNA, 19 nt, Mycobacterium bovis subsp bovis AF2122/97
gcggccggcgugccagcac

SEQ ID NO: 3194820 - RNA, 13 nt, Mycobacterium bovis subsp bovis AF2122/97
gcggccgggacca

SEQ ID NO: 3194821 - RNA, 14 nt, Mycobacterium bovis subsp bovis AF2122/97
gcggccgggcggcc

SEQ ID NO: 3194822 - RNA, 18 nt, Mycobacterium bovis subsp bovis AF2122/97
gcggccgggcuccccaag

SEQ ID NO: 3194823 - RNA, 23 nt, Mycobacterium bovis subsp bovis AF2122/97
gcggccgggcuccccaagucgac

SEQ ID NO: 3194824 - RNA, 15 nt, Mycobacterium bovis subsp bovis AF2122/97
gcggccgggucgcgc

SEQ ID NO: 3194825 - RNA, 21 nt, Mycobacterium bovis subsp bovis AF2122/97
gcggccgggucgcgcuggcgc

SEQ ID NO: 3194826 - RNA, 16 nt, Mycobacterium bovis subsp bovis AF2122/97
gcggccgggucgguga

SEQ ID NO: 3194827 - RNA, 20 nt, Mycobacterium bovis subsp bovis AF2122/97
gcggccggguggcccggcga

SEQ ID NO: 3194828 - RNA, 17 nt, Mycobacterium bovis subsp bovis AF2122/97
gcggccggguucgcguc

SEQ ID NO: 3194829 - RNA, 23 nt, Mycobacterium bovis subsp bovis AF2122/97
gcggccggguucgcgucugacau

SEQ ID NO: 3194830 - RNA, 20 nt, Mycobacterium bovis subsp bovis AF2122/97
gcggccgguacacguccagu

SEQ ID NO: 3194831 - RNA, 22 nt, Mycobacterium bovis subsp bovis AF2122/97
gcggccgguacacguccagugg

SEQ ID NO: 3194832 - RNA, 18 nt, Mycobacterium bovis subsp bovis AF2122/97
gcggccguaacggcgaaa

SEQ ID NO: 3194833 - RNA, 16 nt, Mycobacterium bovis subsp bovis AF2122/97
gcggccguagugcacg

SEQ ID NO: 3194834 - RNA, 13 nt, Mycobacterium bovis subsp bovis AF2122/97
gcggccgucaccg

SEQ ID NO: 3194835 - RNA, 16 nt, Mycobacterium bovis subsp bovis AF2122/97
gcggccgucaccgguc

SEQ ID NO: 3194836 - RNA, 19 nt, Mycobacterium bovis subsp bovis AF2122/97
gcggccgucaccggucggc

SEQ ID NO: 3194837 - RNA, 17 nt, Mycobacterium bovis subsp bovis AF2122/97
gcggccgucgaugguca

SEQ ID NO: 3194838 - RNA, 19 nt, Mycobacterium bovis subsp bovis AF2122/97
gcggccgucgauggucagc

SEQ ID NO: 3194839 - RNA, 12 nt, Mycobacterium bovis subsp bovis AF2122/97
gcggccgucgcg

SEQ ID NO: 3194840 - RNA, 16 nt, Mycobacterium bovis subsp bovis AF2122/97
gcggccgucgggacgg

SEQ ID NO: 3194841 - RNA, 17 nt, Mycobacterium bovis subsp bovis AF2122/97
gcggccgucgucggcca

SEQ ID NO: 3194842 - RNA, 12 nt, Mycobacterium bovis subsp bovis AF2122/97
gcggccgugaac

SEQ ID NO: 3194843 - RNA, 22 nt, Mycobacterium bovis subsp bovis AF2122/97
gcggccgugaacggcgcgggcc

SEQ ID NO: 3194844 - RNA, 16 nt, Mycobacterium bovis subsp bovis AF2122/97
gcggccguggccucga

SEQ ID NO: 3194845 - RNA, 20 nt, Mycobacterium bovis subsp bovis AF2122/97
gcggccguggcguggcuugg

SEQ ID NO: 3194846 - RNA, 14 nt, Mycobacterium bovis subsp bovis AF2122/97
gcggccgugguggu

SEQ ID NO: 3194847 - RNA, 15 nt, Mycobacterium bovis subsp bovis AF2122/97
gcggccgugucgggc

SEQ ID NO: 3194848 - RNA, 18 nt, Mycobacterium bovis subsp bovis AF2122/97
gcggccgugucgggcgcg

SEQ ID NO: 3194849 - RNA, 13 nt, Mycobacterium bovis subsp bovis AF2122/97
gcggccguucgcc

SEQ ID NO: 3194850 - RNA, 17 nt, Mycobacterium bovis subsp bovis AF2122/97
gcggccuaggacgccgc

SEQ ID NO: 3194851 - RNA, 19 nt, Mycobacterium bovis subsp bovis AF2122/97
gcggccuaggacgccgccc

SEQ ID NO: 3194852 - RNA, 17 nt, Mycobacterium bovis subsp bovis AF2122/97
gcggccuagggcggcgg

SEQ ID NO: 3194853 - RNA, 19 nt, Mycobacterium bovis subsp bovis AF2122/97
gcggccuagggcggcggcg

SEQ ID NO: 3194854 - RNA, 20 nt, Mycobacterium bovis subsp bovis AF2122/97
gcggccuagggcggcggcgc

SEQ ID NO: 3194855 - RNA, 17 nt, Mycobacterium bovis subsp bovis AF2122/97
gcggccuccagcacccg

SEQ ID NO: 3194856 - RNA, 15 nt, Mycobacterium bovis subsp bovis AF2122/97
gcggccuccccgacc

SEQ ID NO: 3194857 - RNA, 17 nt, Mycobacterium bovis subsp bovis AF2122/97
gcggccuccccgaccug

SEQ ID NO: 3194858 - RNA, 14 nt, Mycobacterium bovis subsp bovis AF2122/97
gcggccuccgggcc

SEQ ID NO: 3194859 - RNA, 15 nt, Mycobacterium bovis subsp bovis AF2122/97
gcggccucgaccucu

SEQ ID NO: 3194860 - RNA, 13 nt, Mycobacterium bovis subsp bovis AF2122/97
gcggccucgccgg

SEQ ID NO: 3194861 - RNA, 18 nt, Mycobacterium bovis subsp bovis AF2122/97
gcggccucgcugcucagc

SEQ ID NO: 3194862 - RNA, 15 nt, Mycobacterium bovis subsp bovis AF2122/97
gcggccucgucgagu

SEQ ID NO: 3194863 - RNA, 21 nt, Mycobacterium bovis subsp bovis AF2122/97
gcggccugcccgccguuacgg

SEQ ID NO: 3194864 - RNA, 15 nt, Mycobacterium bovis subsp bovis AF2122/97
gcggccugcucgacc

SEQ ID NO: 3194865 - RNA, 13 nt, Mycobacterium bovis subsp bovis AF2122/97
gcggccugcucgg

SEQ ID NO: 3194866 - RNA, 15 nt, Mycobacterium bovis subsp bovis AF2122/97
gcggccuggcacccg

SEQ ID NO: 3194867 - RNA, 21 nt, Mycobacterium bovis subsp bovis AF2122/97
gcggccugggccagccgcuca

SEQ ID NO: 3194868 - RNA, 16 nt, Mycobacterium bovis subsp bovis AF2122/97
gcggccuggucggcca

SEQ ID NO: 3194869 - RNA, 21 nt, Mycobacterium bovis subsp bovis AF2122/97
gcggccuggucggccaggucg

SEQ ID NO: 3194870 - RNA, 15 nt, Mycobacterium bovis subsp bovis AF2122/97
gcggccuucggccgg

SEQ ID NO: 3194871 - RNA, 23 nt, Mycobacterium bovis subsp bovis AF2122/97
gcggccuucggccggcguguucu

SEQ ID NO: 3194872 - RNA, 20 nt, Mycobacterium bovis subsp bovis AF2122/97
gcggccuugccgggccgcgc

SEQ ID NO: 3194873 - RNA, 20 nt, Mycobacterium bovis subsp bovis AF2122/97
gcggccuugcgcacaggcgc

SEQ ID NO: 3194874 - RNA, 15 nt, Mycobacterium bovis subsp bovis AF2122/97
gcggccuugcgggcu

SEQ ID NO: 3194875 - RNA, 21 nt, Mycobacterium bovis subsp bovis AF2122/97
gcggccuugcgggcucucggc

SEQ ID NO: 3194876 - RNA, 17 nt, Mycobacterium bovis subsp bovis AF2122/97
gcggccuugcucagcac

SEQ ID NO: 3194877 - RNA, 18 nt, Mycobacterium bovis subsp bovis AF2122/97
gcggccuugcucagcacg

SEQ ID NO: 3194878 - RNA, 13 nt, Mycobacterium bovis subsp bovis AF2122/97
gcggccuuggcga

SEQ ID NO: 3194879 - RNA, 16 nt, Mycobacterium bovis subsp bovis AF2122/97
gcggccuuggcgacgu

SEQ ID NO: 3194880 - RNA, 20 nt, Mycobacterium bovis subsp bovis AF2122/97
gcggccuuggcgacgucgcg

SEQ ID NO: 3194881 - RNA, 15 nt, Mycobacterium bovis subsp bovis AF2122/97
gcggccuuggugggc

SEQ ID NO: 3194882 - RNA, 17 nt, Mycobacterium bovis subsp bovis AF2122/97
gcggccuuugucgccuu

SEQ ID NO: 3194883 - RNA, 22 nt, Mycobacterium bovis subsp bovis AF2122/97
gcggcgaaaaccaucgcuugcg

SEQ ID NO: 3194884 - RNA, 20 nt, Mycobacterium bovis subsp bovis AF2122/97
gcggcgaacaucaccgucgc

SEQ ID NO: 3194885 - RNA, 12 nt, Mycobacterium bovis subsp bovis AF2122/97
gcggcgaacucu

SEQ ID NO: 3194886 - RNA, 21 nt, Mycobacterium bovis subsp bovis AF2122/97
gcggcgaacucuacgguggug

SEQ ID NO: 3194887 - RNA, 22 nt, Mycobacterium bovis subsp bovis AF2122/97
gcggcgaacucuacgguggugc

SEQ ID NO: 3194888 - RNA, 19 nt, Mycobacterium bovis subsp bovis AF2122/97
gcggcgaagauaucggcac

SEQ ID NO: 3194889 - RNA, 16 nt, Mycobacterium bovis subsp bovis AF2122/97
gcggcgaagccgggug

SEQ ID NO: 3194890 - RNA, 18 nt, Mycobacterium bovis subsp bovis AF2122/97
gcggcgaaugccagugac

SEQ ID NO: 3194891 - RNA, 12 nt, Mycobacterium bovis subsp bovis AF2122/97
gcggcgacacgc

SEQ ID NO: 3194892 - RNA, 14 nt, Mycobacterium bovis subsp bovis AF2122/97
gcggcgacauccac

SEQ ID NO: 3194893 - RNA, 19 nt, Mycobacterium bovis subsp bovis AF2122/97
gcggcgacauccacaccgc

SEQ ID NO: 3194894 - RNA, 20 nt, Mycobacterium bovis subsp bovis AF2122/97
gcggcgacauccacaccgcg

SEQ ID NO: 3194895 - RNA, 21 nt, Mycobacterium bovis subsp bovis AF2122/97
gcggcgacauccacaccgcgg

SEQ ID NO: 3194896 - RNA, 12 nt, Mycobacterium bovis subsp bovis AF2122/97
gcggcgaccacc

SEQ ID NO: 3194897 - RNA, 12 nt, Mycobacterium bovis subsp bovis AF2122/97
gcggcgaccagg

SEQ ID NO: 3194898 - RNA, 19 nt, Mycobacterium bovis subsp bovis AF2122/97
gcggcgaccauaagcucgu

SEQ ID NO: 3194899 - RNA, 23 nt, Mycobacterium bovis subsp bovis AF2122/97
gcggcgacccgccuguaccggcg

SEQ ID NO: 3194900 - RNA, 14 nt, Mycobacterium bovis subsp bovis AF2122/97
gcggcgacccgguc

SEQ ID NO: 3194901 - RNA, 17 nt, Mycobacterium bovis subsp bovis AF2122/97
gcggcgaccgcauccgg

SEQ ID NO: 3194902 - RNA, 12 nt, Mycobacterium bovis subsp bovis AF2122/97
gcggcgaccgcc

SEQ ID NO: 3194903 - RNA, 22 nt, Mycobacterium bovis subsp bovis AF2122/97
gcggcgaccgcggucgccaaga

SEQ ID NO: 3194904 - RNA, 18 nt, Mycobacterium bovis subsp bovis AF2122/97
gcggcgaccucggcggcg

SEQ ID NO: 3194905 - RNA, 15 nt, Mycobacterium bovis subsp bovis AF2122/97
gcggcgaccuguccg

SEQ ID NO: 3194906 - RNA, 13 nt, Mycobacterium bovis subsp bovis AF2122/97
gcggcgacgaccg

SEQ ID NO: 3194907 - RNA, 14 nt, Mycobacterium bovis subsp bovis AF2122/97
gcggcgacgaccgu

SEQ ID NO: 3194908 - RNA, 16 nt, Mycobacterium bovis subsp bovis AF2122/97
gcggcgacgaccgucg

SEQ ID NO: 3194909 - RNA, 18 nt, Mycobacterium bovis subsp bovis AF2122/97
gcggcgacgaccgucggc

SEQ ID NO: 3194910 - RNA, 16 nt, Mycobacterium bovis subsp bovis AF2122/97
gcggcgacgacggccu

SEQ ID NO: 3194911 - RNA, 14 nt, Mycobacterium bovis subsp bovis AF2122/97
gcggcgacgagcgc

SEQ ID NO: 3194912 - RNA, 17 nt, Mycobacterium bovis subsp bovis AF2122/97
gcggcgacgagcgcagc

SEQ ID NO: 3194913 - RNA, 16 nt, Mycobacterium bovis subsp bovis AF2122/97
gcggcgacgccgcugg

SEQ ID NO: 3194914 - RNA, 18 nt, Mycobacterium bovis subsp bovis AF2122/97
gcggcgacggccgcucgg

SEQ ID NO: 3194915 - RNA, 13 nt, Mycobacterium bovis subsp bovis AF2122/97
gcggcgacggcgg

SEQ ID NO: 3194916 - RNA, 15 nt, Mycobacterium bovis subsp bovis AF2122/97
gcggcgacggcggag

SEQ ID NO: 3194917 - RNA, 14 nt, Mycobacterium bovis subsp bovis AF2122/97
gcggcgacggcggc

SEQ ID NO: 3194918 - RNA, 14 nt, Mycobacterium bovis subsp bovis AF2122/97
gcggcgacggugcc

SEQ ID NO: 3194919 - RNA, 21 nt, Mycobacterium bovis subsp bovis AF2122/97
gcggcgacggugccaccgcga

SEQ ID NO: 3194920 - RNA, 14 nt, Mycobacterium bovis subsp bovis AF2122/97
gcggcgacuaccca

SEQ ID NO: 3194921 - RNA, 18 nt, Mycobacterium bovis subsp bovis AF2122/97
gcggcgacuacccagcca

SEQ ID NO: 3194922 - RNA, 14 nt, Mycobacterium bovis subsp bovis AF2122/97
gcggcgagcaccac

SEQ ID NO: 3194923 - RNA, 15 nt, Mycobacterium bovis subsp bovis AF2122/97
gcggcgagcaccacc

SEQ ID NO: 3194924 - RNA, 14 nt, Mycobacterium bovis subsp bovis AF2122/97
gcggcgagcacgcg

SEQ ID NO: 3194925 - RNA, 15 nt, Mycobacterium bovis subsp bovis AF2122/97
gcggcgagcagagaa

SEQ ID NO: 3194926 - RNA, 15 nt, Mycobacterium bovis subsp bovis AF2122/97
gcggcgagcagcagg

SEQ ID NO: 3194927 - RNA, 13 nt, Mycobacterium bovis subsp bovis AF2122/97
gcggcgagcgcga

SEQ ID NO: 3194928 - RNA, 18 nt, Mycobacterium bovis subsp bovis AF2122/97
gcggcgagcuccgaugcc

SEQ ID NO: 3194929 - RNA, 15 nt, Mycobacterium bovis subsp bovis AF2122/97
gcggcgaggacgcgc

SEQ ID NO: 3194930 - RNA, 16 nt, Mycobacterium bovis subsp bovis AF2122/97
gcggcgaggcggucgc

SEQ ID NO: 3194931 - RNA, 16 nt, Mycobacterium bovis subsp bovis AF2122/97
gcggcgagggcgguca

SEQ ID NO: 3194932 - RNA, 22 nt, Mycobacterium bovis subsp bovis AF2122/97
gcggcgagguauaaacgcggcg

SEQ ID NO: 3194933 - RNA, 16 nt, Mycobacterium bovis subsp bovis AF2122/97
gcggcgaguuggccgu

SEQ ID NO: 3194934 - RNA, 22 nt, Mycobacterium bovis subsp bovis AF2122/97
gcggcgauacccaucgaucgaa

SEQ ID NO: 3194935 - RNA, 15 nt, Mycobacterium bovis subsp bovis AF2122/97
gcggcgaucaacucg

SEQ ID NO: 3194936 - RNA, 20 nt, Mycobacterium bovis subsp bovis AF2122/97
gcggcgaucaacucgggcag

SEQ ID NO: 3194937 - RNA, 18 nt, Mycobacterium bovis subsp bovis AF2122/97
gcggcgauccggucgggg

SEQ ID NO: 3194938 - RNA, 21 nt, Mycobacterium bovis subsp bovis AF2122/97
gcggcgauccggucgggggcg

SEQ ID NO: 3194939 - RNA, 16 nt, Mycobacterium bovis subsp bovis AF2122/97
gcggcgaucgagguga

SEQ ID NO: 3194940 - RNA, 15 nt, Mycobacterium bovis subsp bovis AF2122/97
gcggcgaucgcuccg

SEQ ID NO: 3194941 - RNA, 21 nt, Mycobacterium bovis subsp bovis AF2122/97
gcggcgaucgcuccgcggcgc

SEQ ID NO: 3194942 - RNA, 15 nt, Mycobacterium bovis subsp bovis AF2122/97
gcggcgaugauggcg

SEQ ID NO: 3194943 - RNA, 19 nt, Mycobacterium bovis subsp bovis AF2122/97
gcggcgaugguagucgcga

SEQ ID NO: 3194944 - RNA, 19 nt, Mycobacterium bovis subsp bovis AF2122/97
gcggcgaugguaucgccgc

SEQ ID NO: 3194945 - RNA, 15 nt, Mycobacterium bovis subsp bovis AF2122/97
gcggcgcacaacccg

SEQ ID NO: 3194946 - RNA, 16 nt, Mycobacterium bovis subsp bovis AF2122/97
gcggcgcagcacggcg

SEQ ID NO: 3194947 - RNA, 15 nt, Mycobacterium bovis subsp bovis AF2122/97
gcggcgcagcgacgc

SEQ ID NO: 3194948 - RNA, 22 nt, Mycobacterium bovis subsp bovis AF2122/97
gcggcgcauaggcggccaucga

SEQ ID NO: 3194949 - RNA, 13 nt, Mycobacterium bovis subsp bovis AF2122/97
gcggcgccacgug

SEQ ID NO: 3194950 - RNA, 17 nt, Mycobacterium bovis subsp bovis AF2122/97
gcggcgccacguggucg

SEQ ID NO: 3194951 - RNA, 19 nt, Mycobacterium bovis subsp bovis AF2122/97
gcggcgccaguauggccgc

SEQ ID NO: 3194952 - RNA, 13 nt, Mycobacterium bovis subsp bovis AF2122/97
gcggcgcccagga

SEQ ID NO: 3194953 - RNA, 16 nt, Mycobacterium bovis subsp bovis AF2122/97
gcggcgcccaggaacu

SEQ ID NO: 3194954 - RNA, 19 nt, Mycobacterium bovis subsp bovis AF2122/97
gcggcgcccaucgcgacgg

SEQ ID NO: 3194955 - RNA, 14 nt, Mycobacterium bovis subsp bovis AF2122/97
gcggcgcccgccac

SEQ ID NO: 3194956 - RNA, 16 nt, Mycobacterium bovis subsp bovis AF2122/97
gcggcgcccgccaccg

SEQ ID NO: 3194957 - RNA, 15 nt, Mycobacterium bovis subsp bovis AF2122/97
gcggcgcccuggccg

SEQ ID NO: 3194958 - RNA, 19 nt, Mycobacterium bovis subsp bovis AF2122/97
gcggcgcccuggccgcccu

SEQ ID NO: 3194959 - RNA, 12 nt, Mycobacterium bovis subsp bovis AF2122/97
gcggcgccgcaa

SEQ ID NO: 3194960 - RNA, 13 nt, Mycobacterium bovis subsp bovis AF2122/97
gcggcgccgcacc

SEQ ID NO: 3194961 - RNA, 17 nt, Mycobacterium bovis subsp bovis AF2122/97
gcggcgccgcacccaca

SEQ ID NO: 3194962 - RNA, 22 nt, Mycobacterium bovis subsp bovis AF2122/97
gcggcgccgcagaucaccgcca

SEQ ID NO: 3194963 - RNA, 14 nt, Mycobacterium bovis subsp bovis AF2122/97
gcggcgccgccacg

SEQ ID NO: 3194964 - RNA, 14 nt, Mycobacterium bovis subsp bovis AF2122/97
gcggcgccgccauc

SEQ ID NO: 3194965 - RNA, 20 nt, Mycobacterium bovis subsp bovis AF2122/97
gcggcgccgccaucaacaag

SEQ ID NO: 3194966 - RNA, 12 nt, Mycobacterium bovis subsp bovis AF2122/97
gcggcgccgccc

SEQ ID NO: 3194967 - RNA, 18 nt, Mycobacterium bovis subsp bovis AF2122/97
gcggcgccggaggcggcg

SEQ ID NO: 3194968 - RNA, 21 nt, Mycobacterium bovis subsp bovis AF2122/97
gcggcgccggccucgccgggg

SEQ ID NO: 3194969 - RNA, 15 nt, Mycobacterium bovis subsp bovis AF2122/97
gcggcgccggggggc

SEQ ID NO: 3194970 - RNA, 18 nt, Mycobacterium bovis subsp bovis AF2122/97
gcggcgccggggggcugc

SEQ ID NO: 3194971 - RNA, 15 nt, Mycobacterium bovis subsp bovis AF2122/97
gcggcgccggugggc

SEQ ID NO: 3194972 - RNA, 17 nt, Mycobacterium bovis subsp bovis AF2122/97
gcggcgccggugggcgg

SEQ ID NO: 3194973 - RNA, 21 nt, Mycobacterium bovis subsp bovis AF2122/97
gcggcgccggugggcgguccg

SEQ ID NO: 3194974 - RNA, 22 nt, Mycobacterium bovis subsp bovis AF2122/97
gcggcgccgucgucagcgggua

SEQ ID NO: 3194975 - RNA, 12 nt, Mycobacterium bovis subsp bovis AF2122/97
gcggcgccguga

SEQ ID NO: 3194976 - RNA, 14 nt, Mycobacterium bovis subsp bovis AF2122/97
gcggcgccuccgcu

SEQ ID NO: 3194977 - RNA, 19 nt, Mycobacterium bovis subsp bovis AF2122/97
gcggcgccuuccacggagu

SEQ ID NO: 3194978 - RNA, 21 nt, Mycobacterium bovis subsp bovis AF2122/97
gcggcgcgacagacagcaccg

SEQ ID NO: 3194979 - RNA, 14 nt, Mycobacterium bovis subsp bovis AF2122/97
gcggcgcgaccguc

SEQ ID NO: 3194980 - RNA, 12 nt, Mycobacterium bovis subsp bovis AF2122/97
gcggcgcgagcc

SEQ ID NO: 3194981 - RNA, 20 nt, Mycobacterium bovis subsp bovis AF2122/97
gcggcgcgaucgacgcucgg

SEQ ID NO: 3194982 - RNA, 13 nt, Mycobacterium bovis subsp bovis AF2122/97
gcggcgcgaucgu

SEQ ID NO: 3194983 - RNA, 17 nt, Mycobacterium bovis subsp bovis AF2122/97
gcggcgcgcaacacauc

SEQ ID NO: 3194984 - RNA, 21 nt, Mycobacterium bovis subsp bovis AF2122/97
gcggcgcgcaacacauccagu

SEQ ID NO: 3194985 - RNA, 13 nt, Mycobacterium bovis subsp bovis AF2122/97
gcggcgcgcagga

SEQ ID NO: 3194986 - RNA, 14 nt, Mycobacterium bovis subsp bovis AF2122/97
gcggcgcgcccgga

SEQ ID NO: 3194987 - RNA, 23 nt, Mycobacterium bovis subsp bovis AF2122/97
gcggcgcgcugaaaugccgucgu

SEQ ID NO: 3194988 - RNA, 21 nt, Mycobacterium bovis subsp bovis AF2122/97
gcggcgcggagagccugcucg

SEQ ID NO: 3194989 - RNA, 12 nt, Mycobacterium bovis subsp bovis AF2122/97
gcggcgcggccg

SEQ ID NO: 3194990 - RNA, 17 nt, Mycobacterium bovis subsp bovis AF2122/97
gcggcgcggccgcagcc

SEQ ID NO: 3194991 - RNA, 12 nt, Mycobacterium bovis subsp bovis AF2122/97
gcggcgcggcga

SEQ ID NO: 3194992 - RNA, 13 nt, Mycobacterium bovis subsp bovis AF2122/97
gcggcgcggcgac

SEQ ID NO: 3194993 - RNA, 17 nt, Mycobacterium bovis subsp bovis AF2122/97
gcggcgcgggggugggc

SEQ ID NO: 3194994 - RNA, 15 nt, Mycobacterium bovis subsp bovis AF2122/97
gcggcgcgggucggc

SEQ ID NO: 3194995 - RNA, 17 nt, Mycobacterium bovis subsp bovis AF2122/97
gcggcgcgggucggcga

SEQ ID NO: 3194996 - RNA, 22 nt, Mycobacterium bovis subsp bovis AF2122/97
gcggcgcgguuucggcgucacc

SEQ ID NO: 3194997 - RNA, 14 nt, Mycobacterium bovis subsp bovis AF2122/97
gcggcgcgucgcgg

SEQ ID NO: 3194998 - RNA, 19 nt, Mycobacterium bovis subsp bovis AF2122/97
gcggcgcguuagaaaucga

SEQ ID NO: 3194999 - RNA, 13 nt, Mycobacterium bovis subsp bovis AF2122/97
gcggcgcucggcc

SEQ ID NO: 3195000 - RNA, 14 nt, Mycobacterium bovis subsp bovis AF2122/97
gcggcgcucggcca

SEQ ID NO: 3195001 - RNA, 16 nt, Mycobacterium bovis subsp bovis AF2122/97
gcggcgcuggccagca

SEQ ID NO: 3195002 - RNA, 12 nt, Mycobacterium bovis subsp bovis AF2122/97
gcggcgcuggcu

SEQ ID NO: 3195003 - RNA, 17 nt, Mycobacterium bovis subsp bovis AF2122/97
gcggcgcuggcugcggu

SEQ ID NO: 3195004 - RNA, 11 nt, Mycobacterium bovis subsp bovis AF2122/97
gcggcgcuggg

SEQ ID NO: 3195005 - RNA, 13 nt, Mycobacterium bovis subsp bovis AF2122/97
gcggcgcugggac

SEQ ID NO: 3195006 - RNA, 20 nt, Mycobacterium bovis subsp bovis AF2122/97
gcggcgcuggucgcgguggc

SEQ ID NO: 3195007 - RNA, 12 nt, Mycobacterium bovis subsp bovis AF2122/97
gcggcgcugguu

SEQ ID NO: 3195008 - RNA, 13 nt, Mycobacterium bovis subsp bovis AF2122/97
gcggcgcugguug

SEQ ID NO: 3195009 - RNA, 23 nt, Mycobacterium bovis subsp bovis AF2122/97
gcggcggaaggacggcagccacc

SEQ ID NO: 3195010 - RNA, 19 nt, Mycobacterium bovis subsp bovis AF2122/97
gcggcggaaggcgucgaac

SEQ ID NO: 3195011 - RNA, 20 nt, Mycobacterium bovis subsp bovis AF2122/97
gcggcggacaugcaccucga

SEQ ID NO: 3195012 - RNA, 17 nt, Mycobacterium bovis subsp bovis AF2122/97
gcggcggacccgcucgc

SEQ ID NO: 3195013 - RNA, 14 nt, Mycobacterium bovis subsp bovis AF2122/97
gcggcggaccgucc

SEQ ID NO: 3195014 - RNA, 20 nt, Mycobacterium bovis subsp bovis AF2122/97
gcggcggaccguccgacggc

SEQ ID NO: 3195015 - RNA, 15 nt, Mycobacterium bovis subsp bovis AF2122/97
gcggcggagccgggu

SEQ ID NO: 3195016 - RNA, 17 nt, Mycobacterium bovis subsp bovis AF2122/97
gcggcggauggcgucga

SEQ ID NO: 3195017 - RNA, 21 nt, Mycobacterium bovis subsp bovis AF2122/97
gcggcggauggcgucgaccac

SEQ ID NO: 3195018 - RNA, 13 nt, Mycobacterium bovis subsp bovis AF2122/97
gcggcggauuccg

SEQ ID NO: 3195019 - RNA, 19 nt, Mycobacterium bovis subsp bovis AF2122/97
gcggcggauuccggcaucg

SEQ ID NO: 3195020 - RNA, 16 nt, Mycobacterium bovis subsp bovis AF2122/97
gcggcggcaaccccga

SEQ ID NO: 3195021 - RNA, 17 nt, Mycobacterium bovis subsp bovis AF2122/97
gcggcggcaaccccgag

SEQ ID NO: 3195022 - RNA, 22 nt, Mycobacterium bovis subsp bovis AF2122/97
gcggcggcaacccugcccggcc

SEQ ID NO: 3195023 - RNA, 17 nt, Mycobacterium bovis subsp bovis AF2122/97
gcggcggcaacgguggc

SEQ ID NO: 3195024 - RNA, 14 nt, Mycobacterium bovis subsp bovis AF2122/97
gcggcggcacgcuc

SEQ ID NO: 3195025 - RNA, 20 nt, Mycobacterium bovis subsp bovis AF2122/97
gcggcggcacuacgcagccg

SEQ ID NO: 3195026 - RNA, 14 nt, Mycobacterium bovis subsp bovis AF2122/97
gcggcggcagcacc

SEQ ID NO: 3195027 - RNA, 13 nt, Mycobacterium bovis subsp bovis AF2122/97
gcggcggcagcgg

SEQ ID NO: 3195028 - RNA, 23 nt, Mycobacterium bovis subsp bovis AF2122/97
gcggcggcagcggcgaucaggcg

SEQ ID NO: 3195029 - RNA, 19 nt, Mycobacterium bovis subsp bovis AF2122/97
gcggcggcaucucgcaccg

SEQ ID NO: 3195030 - RNA, 20 nt, Mycobacterium bovis subsp bovis AF2122/97
gcggcggcaucucgcaccgc

SEQ ID NO: 3195031 - RNA, 13 nt, Mycobacterium bovis subsp bovis AF2122/97
gcggcggccacgg

SEQ ID NO: 3195032 - RNA, 13 nt, Mycobacterium bovis subsp bovis AF2122/97
gcggcggccagcc

SEQ ID NO: 3195033 - RNA, 14 nt, Mycobacterium bovis subsp bovis AF2122/97
gcggcggccagcgc

SEQ ID NO: 3195034 - RNA, 16 nt, Mycobacterium bovis subsp bovis AF2122/97
gcggcggcccaucgac

SEQ ID NO: 3195035 - RNA, 18 nt, Mycobacterium bovis subsp bovis AF2122/97
gcggcggcccaucgaccg

SEQ ID NO: 3195036 - RNA, 13 nt, Mycobacterium bovis subsp bovis AF2122/97
gcggcggcccgca

SEQ ID NO: 3195037 - RNA, 13 nt, Mycobacterium bovis subsp bovis AF2122/97
gcggcggccgcag

SEQ ID NO: 3195038 - RNA, 14 nt, Mycobacterium bovis subsp bovis AF2122/97
gcggcggccgcagc

SEQ ID NO: 3195039 - RNA, 17 nt, Mycobacterium bovis subsp bovis AF2122/97
gcggcggccgcagcggc

SEQ ID NO: 3195040 - RNA, 14 nt, Mycobacterium bovis subsp bovis AF2122/97
gcggcggccgcggc

SEQ ID NO: 3195041 - RNA, 17 nt, Mycobacterium bovis subsp bovis AF2122/97
gcggcggccuccaccac

SEQ ID NO: 3195042 - RNA, 15 nt, Mycobacterium bovis subsp bovis AF2122/97
gcggcggccuggcac

SEQ ID NO: 3195043 - RNA, 13 nt, Mycobacterium bovis subsp bovis AF2122/97
gcggcggccuggg

SEQ ID NO: 3195044 - RNA, 13 nt, Mycobacterium bovis subsp bovis AF2122/97
gcggaccggcgcg

SEQ ID NO: 3195045 - RNA, 14 nt, Mycobacterium bovis subsp bovis AF2122/97
gcggaccggcgcgc

SEQ ID NO: 3195046 - RNA, 16 nt, Mycobacterium bovis subsp bovis AF2122/97
gcggaccggcgcgcuc

SEQ ID NO: 3195047 - RNA, 13 nt, Mycobacterium bovis subsp bovis AF2122/97
gcggaccguccga

SEQ ID NO: 3195048 - RNA, 14 nt, Mycobacterium bovis subsp bovis AF2122/97
gcggaccguccgac

SEQ ID NO: 3195049 - RNA, 16 nt, Mycobacterium bovis subsp bovis AF2122/97
gcggaccguccgacgg

SEQ ID NO: 3195050 - RNA, 19 nt, Mycobacterium bovis subsp bovis AF2122/97
gcggaccguccgacggcgg

SEQ ID NO: 3195051 - RNA, 14 nt, Mycobacterium bovis subsp bovis AF2122/97
gcggaccguguugu

SEQ ID NO: 3195052 - RNA, 19 nt, Mycobacterium bovis subsp bovis AF2122/97
gcggaccucgaagcccagc

SEQ ID NO: 3195053 - RNA, 13 nt, Mycobacterium bovis subsp bovis AF2122/97
gcggaccugcgag

SEQ ID NO: 3195054 - RNA, 21 nt, Mycobacterium bovis subsp bovis AF2122/97
gcggaccugcgagaucggaug

SEQ ID NO: 3195055 - RNA, 17 nt, Mycobacterium bovis subsp bovis AF2122/97
gcggaccugcgccggug

SEQ ID NO: 3195056 - RNA, 15 nt, Mycobacterium bovis subsp bovis AF2122/97
gcggaccuggcggcg

SEQ ID NO: 3195057 - RNA, 13 nt, Mycobacterium bovis subsp bovis AF2122/97
gcggacgaccuug

SEQ ID NO: 3195058 - RNA, 15 nt, Mycobacterium bovis subsp bovis AF2122/97
gcggacgacgucggg

SEQ ID NO: 3195059 - RNA, 22 nt, Mycobacterium bovis subsp bovis AF2122/97
gcggacgccgcgccggcgggcg

SEQ ID NO: 3195060 - RNA, 23 nt, Mycobacterium bovis subsp bovis AF2122/97
gcggacggaauucgguuggcucg

SEQ ID NO: 3195061 - RNA, 11 nt, Mycobacterium bovis subsp bovis AF2122/97
gcggacggcgu

SEQ ID NO: 3195062 - RNA, 13 nt, Mycobacterium bovis subsp bovis AF2122/97
gcggacggcgucg

SEQ ID NO: 3195063 - RNA, 14 nt, Mycobacterium bovis subsp bovis AF2122/97
gcggacggcgucga

SEQ ID NO: 3195064 - RNA, 23 nt, Mycobacterium bovis subsp bovis AF2122/97
gcggacggcguugagcaggugcc

SEQ ID NO: 3195065 - RNA, 17 nt, Mycobacterium bovis subsp bovis AF2122/97
gcggacgggacgcaugc

SEQ ID NO: 3195066 - RNA, 19 nt, Mycobacterium bovis subsp bovis AF2122/97
gcggacgguguacaggucg

SEQ ID NO: 3195067 - RNA, 22 nt, Mycobacterium bovis subsp bovis AF2122/97
gcggacgguguacaggucgccg

SEQ ID NO: 3195068 - RNA, 23 nt, Mycobacterium bovis subsp bovis AF2122/97
gcggacgguguacaggucgccgg

SEQ ID NO: 3195069 - RNA, 15 nt, Mycobacterium bovis subsp bovis AF2122/97
gcggacgucgccccg

SEQ ID NO: 3195070 - RNA, 13 nt, Mycobacterium bovis subsp bovis AF2122/97
gcggacgugccgg

SEQ ID NO: 3195071 - RNA, 16 nt, Mycobacterium bovis subsp bovis AF2122/97
gcggacguggucggag

SEQ ID NO: 3195072 - RNA, 15 nt, Mycobacterium bovis subsp bovis AF2122/97
gcggacucacgaggc

SEQ ID NO: 3195073 - RNA, 19 nt, Mycobacterium bovis subsp bovis AF2122/97
gcggacucgagucugcgca

SEQ ID NO: 3195074 - RNA, 21 nt, Mycobacterium bovis subsp bovis AF2122/97
gcggacucgagucugcgcaga

SEQ ID NO: 3195075 - RNA, 14 nt, Mycobacterium bovis subsp bovis AF2122/97
gcggacucgggcag

SEQ ID NO: 3195076 - RNA, 15 nt, Mycobacterium bovis subsp bovis AF2122/97
gcggacucgggcagg

SEQ ID NO: 3195077 - RNA, 22 nt, Mycobacterium bovis subsp bovis AF2122/97
gcggacugagagauggucgggc

SEQ ID NO: 3195078 - RNA, 23 nt, Mycobacterium bovis subsp bovis AF2122/97
gcggacugagagauggucgggcg

SEQ ID NO: 3195079 - RNA, 18 nt, Mycobacterium bovis subsp bovis AF2122/97
gcggacuggcauccgccc

SEQ ID NO: 3195080 - RNA, 20 nt, Mycobacterium bovis subsp bovis AF2122/97
gcggacuucgaugucgaggu

SEQ ID NO: 3195081 - RNA, 16 nt, Mycobacterium bovis subsp bovis AF2122/97
gcggacuucgccgccc

SEQ ID NO: 3195082 - RNA, 21 nt, Mycobacterium bovis subsp bovis AF2122/97
gcggacuucguuccgugccga

SEQ ID NO: 3195083 - RNA, 20 nt, Mycobacterium bovis subsp bovis AF2122/97
gcggacuugcgagccguaga

SEQ ID NO: 3195084 - RNA, 14 nt, Mycobacterium bovis subsp bovis AF2122/97
gcggagaaaagcgc

SEQ ID NO: 3195085 - RNA, 20 nt, Mycobacterium bovis subsp bovis AF2122/97
gcggagaaaagcgcgcuacg

SEQ ID NO: 3195086 - RNA, 17 nt, Mycobacterium bovis subsp bovis AF2122/97
gcggagaacaucccccg

SEQ ID NO: 3195087 - RNA, 18 nt, Mycobacterium bovis subsp bovis AF2122/97
gcggagaacaucccccgg

SEQ ID NO: 3195088 - RNA, 23 nt, Mycobacterium bovis subsp bovis AF2122/97
gcggagaacaucccccggcuggu

SEQ ID NO: 3195089 - RNA, 17 nt, Mycobacterium bovis subsp bovis AF2122/97
gcggagaaggcgaccaa

SEQ ID NO: 3195090 - RNA, 18 nt, Mycobacterium bovis subsp bovis AF2122/97
gcggagaaggcgcgggcg

SEQ ID NO: 3195091 - RNA, 18 nt, Mycobacterium bovis subsp bovis AF2122/97
gcggagaccccgcgcgcu

SEQ ID NO: 3195092 - RNA, 23 nt, Mycobacterium bovis subsp bovis AF2122/97
gcggagacuccagcaaggccagc

SEQ ID NO: 3195093 - RNA, 20 nt, Mycobacterium bovis subsp bovis AF2122/97
gcggagagccugcucgcagc

SEQ ID NO: 3195094 - RNA, 19 nt, Mycobacterium bovis subsp bovis AF2122/97
gcggagagcgccuuagcca

SEQ ID NO: 3195095 - RNA, 20 nt, Mycobacterium bovis subsp bovis AF2122/97
gcggagauaccggaccccaa

SEQ ID NO: 3195096 - RNA, 21 nt, Mycobacterium bovis subsp bovis AF2122/97
gcggagcaauuccacgaucgg

SEQ ID NO: 3195097 - RNA, 19 nt, Mycobacterium bovis subsp bovis AF2122/97
gcggagcacuucgucgaac

SEQ ID NO: 3195098 - RNA, 13 nt, Mycobacterium bovis subsp bovis AF2122/97
gcggagccaggac

SEQ ID NO: 3195099 - RNA, 18 nt, Mycobacterium bovis subsp bovis AF2122/97
gcggagccaggacgacgc

SEQ ID NO: 3195100 - RNA, 21 nt, Mycobacterium bovis subsp bovis AF2122/97
gcggagccaggacgacgccga

SEQ ID NO: 3195101 - RNA, 13 nt, Mycobacterium bovis subsp bovis AF2122/97
gcggagccgauga

SEQ ID NO: 3195102 - RNA, 12 nt, Mycobacterium bovis subsp bovis AF2122/97
gcggagccgcca

SEQ ID NO: 3195103 - RNA, 23 nt, Mycobacterium bovis subsp bovis AF2122/97
gcggagccgccgacucggcaccg

SEQ ID NO: 3195104 - RNA, 13 nt, Mycobacterium bovis subsp bovis AF2122/97
gcggagccgccgc

SEQ ID NO: 3195105 - RNA, 12 nt, Mycobacterium bovis subsp bovis AF2122/97
gcggagccggcg

SEQ ID NO: 3195106 - RNA, 13 nt, Mycobacterium bovis subsp bovis AF2122/97
gcggagccggcgc

SEQ ID NO: 3195107 - RNA, 15 nt, Mycobacterium bovis subsp bovis AF2122/97
gcggagccggcgcau

SEQ ID NO: 3195108 - RNA, 17 nt, Mycobacterium bovis subsp bovis AF2122/97
gcggagcgugagccaug

SEQ ID NO: 3195109 - RNA, 17 nt, Mycobacterium bovis subsp bovis AF2122/97
gcggagcucacgccggg

SEQ ID NO: 3195110 - RNA, 22 nt, Mycobacterium bovis subsp bovis AF2122/97
gcggaggcgaccccggccccga

SEQ ID NO: 3195111 - RNA, 12 nt, Mycobacterium bovis subsp bovis AF2122/97
gcggaggcggcc

SEQ ID NO: 3195112 - RNA, 16 nt, Mycobacterium bovis subsp bovis AF2122/97
gcggaggcugggcuga

SEQ ID NO: 3195113 - RNA, 20 nt, Mycobacterium bovis subsp bovis AF2122/97
gcggaguaaacaaacccaac

SEQ ID NO: 3195114 - RNA, 13 nt, Mycobacterium bovis subsp bovis AF2122/97
gcggaguacucca

SEQ ID NO: 3195115 - RNA, 16 nt, Mycobacterium bovis subsp bovis AF2122/97
gcggaguacuccagcc

SEQ ID NO: 3195116 - RNA, 20 nt, Mycobacterium bovis subsp bovis AF2122/97
gcggaguacuccagccgcaa

SEQ ID NO: 3195117 - RNA, 16 nt, Mycobacterium bovis subsp bovis AF2122/97
gcggaguagccgcagc

SEQ ID NO: 3195118 - RNA, 19 nt, Mycobacterium bovis subsp bovis AF2122/97
gcggaguccgucgacaccg

SEQ ID NO: 3195119 - RNA, 22 nt, Mycobacterium bovis subsp bovis AF2122/97
gcggagucugcugaucgagcgg

SEQ ID NO: 3195120 - RNA, 19 nt, Mycobacterium bovis subsp bovis AF2122/97
gcggagugcauguccgacc

SEQ ID NO: 3195121 - RNA, 18 nt, Mycobacterium bovis subsp bovis AF2122/97
gcggaguuuuucggggug

SEQ ID NO: 3195122 - RNA, 20 nt, Mycobacterium bovis subsp bovis AF2122/97
gcggaguuuuucgggguggc

SEQ ID NO: 3195123 - RNA, 16 nt, Mycobacterium bovis subsp bovis AF2122/97
gcggauaaccggcaug

SEQ ID NO: 3195124 - RNA, 15 nt, Mycobacterium bovis subsp bovis AF2122/97
gcggauacagccgcc

SEQ ID NO: 3195125 - RNA, 21 nt, Mycobacterium bovis subsp bovis AF2122/97
gcggauacagccgccgccggc

SEQ ID NO: 3195126 - RNA, 22 nt, Mycobacterium bovis subsp bovis AF2122/97
gcggauacgccccugguccacc

SEQ ID NO: 3195127 - RNA, 21 nt, Mycobacterium bovis subsp bovis AF2122/97
gcggauagaugacgggcucgu

SEQ ID NO: 3195128 - RNA, 19 nt, Mycobacterium bovis subsp bovis AF2122/97
gcggauagcaacggugcuc

SEQ ID NO: 3195129 - RNA, 21 nt, Mycobacterium bovis subsp bovis AF2122/97
gcggauagcggcaaagccggg

SEQ ID NO: 3195130 - RNA, 19 nt, Mycobacterium bovis subsp bovis AF2122/97
gcggauagcuguugaccgu

SEQ ID NO: 3195131 - RNA, 15 nt, Mycobacterium bovis subsp bovis AF2122/97
gcggauaggccgcgc

SEQ ID NO: 3195132 - RNA, 23 nt, Mycobacterium bovis subsp bovis AF2122/97
gcggauaucuugcgcauguccau

SEQ ID NO: 3195133 - RNA, 12 nt, Mycobacterium bovis subsp bovis AF2122/97
gcggaucaagcg

SEQ ID NO: 3195134 - RNA, 16 nt, Mycobacterium bovis subsp bovis AF2122/97
gcggaucaagcgcaca

SEQ ID NO: 3195135 - RNA, 19 nt, Mycobacterium bovis subsp bovis AF2122/97
gcggaucaccaucgccgcc

SEQ ID NO: 3195136 - RNA, 20 nt, Mycobacterium bovis subsp bovis AF2122/97
gcggaucaccaucgccgccg

SEQ ID NO: 3195137 - RNA, 18 nt, Mycobacterium bovis subsp bovis AF2122/97
gcggaucagaggacccgu

SEQ ID NO: 3195138 - RNA, 16 nt, Mycobacterium bovis subsp bovis AF2122/97
gcggaucaggucuggc

SEQ ID NO: 3195139 - RNA, 19 nt, Mycobacterium bovis subsp bovis AF2122/97
gcggaucaggucuggcgcg

SEQ ID NO: 3195140 - RNA, 22 nt, Mycobacterium bovis subsp bovis AF2122/97
gcggaucauccuucgccggcgc

SEQ ID NO: 3195141 - RNA, 23 nt, Mycobacterium bovis subsp bovis AF2122/97
gcggaucauccuucgccggcgcc

SEQ ID NO: 3195142 - RNA, 23 nt, Mycobacterium bovis subsp bovis AF2122/97
gcggauccaccacgcuggccucg

SEQ ID NO: 3195143 - RNA, 16 nt, Mycobacterium bovis subsp bovis AF2122/97
gcggaucccgaggcgc

SEQ ID NO: 3195144 - RNA, 21 nt, Mycobacterium bovis subsp bovis AF2122/97
gcggaucccgaggcgcccaac

SEQ ID NO: 3195145 - RNA, 14 nt, Mycobacterium bovis subsp bovis AF2122/97
gcggaucccgccgg

SEQ ID NO: 3195146 - RNA, 18 nt, Mycobacterium bovis subsp bovis AF2122/97
gcggauccgggcguggug

SEQ ID NO: 3195147 - RNA, 18 nt, Mycobacterium bovis subsp bovis AF2122/97
gcggaucgaccgccagcg

SEQ ID NO: 3195148 - RNA, 16 nt, Mycobacterium bovis subsp bovis AF2122/97
gcggaucgagcaguuc

SEQ ID NO: 3195149 - RNA, 22 nt, Mycobacterium bovis subsp bovis AF2122/97
gcggaucgccggggacgccgcg

SEQ ID NO: 3195150 - RNA, 16 nt, Mycobacterium bovis subsp bovis AF2122/97
gcggaucgcgagcgcc

SEQ ID NO: 3195151 - RNA, 13 nt, Mycobacterium bovis subsp bovis AF2122/97
gcggaucgcgcug

SEQ ID NO: 3195152 - RNA, 20 nt, Mycobacterium bovis subsp bovis AF2122/97
gcggaucgcgcugaucagcc

SEQ ID NO: 3195153 - RNA, 22 nt, Mycobacterium bovis subsp bovis AF2122/97
gcggaucgcgcugaucagccca

SEQ ID NO: 3195154 - RNA, 15 nt, Mycobacterium bovis subsp bovis AF2122/97
gcggaucgcgcugcg

SEQ ID NO: 3195155 - RNA, 16 nt, Mycobacterium bovis subsp bovis AF2122/97
gcggaucgcgcugcgg

SEQ ID NO: 3195156 - RNA, 17 nt, Mycobacterium bovis subsp bovis AF2122/97
gcggaucgcggucagcg

SEQ ID NO: 3195157 - RNA, 17 nt, Mycobacterium bovis subsp bovis AF2122/97
gcggaucggacaacacg

SEQ ID NO: 3195158 - RNA, 14 nt, Mycobacterium bovis subsp bovis AF2122/97
gcggaucggcggcc

SEQ ID NO: 3195159 - RNA, 16 nt, Mycobacterium bovis subsp bovis AF2122/97
gcggaucgggcacccc

SEQ ID NO: 3195160 - RNA, 18 nt, Mycobacterium bovis subsp bovis AF2122/97
gcggaucgggcaccccga

SEQ ID NO: 3195161 - RNA, 17 nt, Mycobacterium bovis subsp bovis AF2122/97
gcggaucgucgucgugu

SEQ ID NO: 3195162 - RNA, 15 nt, Mycobacterium bovis subsp bovis AF2122/97
gcggaucguggcgcc

SEQ ID NO: 3195163 - RNA, 23 nt, Mycobacterium bovis subsp bovis AF2122/97
gcggaucucaucgggccacagca

SEQ ID NO: 3195164 - RNA, 18 nt, Mycobacterium bovis subsp bovis AF2122/97
gcggaucugaucggcgcg

SEQ ID NO: 3195165 - RNA, 12 nt, Mycobacterium bovis subsp bovis AF2122/97
gcggaucuggcc

SEQ ID NO: 3195166 - RNA, 12 nt, Mycobacterium bovis subsp bovis AF2122/97
gcggaucugguc

SEQ ID NO: 3195167 - RNA, 20 nt, Mycobacterium bovis subsp bovis AF2122/97
gcggaucugguccaguggga

SEQ ID NO: 3195168 - RNA, 10 nt, Mycobacterium bovis subsp bovis AF2122/97
gcggaucugu

SEQ ID NO: 3195169 - RNA, 13 nt, Mycobacterium bovis subsp bovis AF2122/97
gcggaucuguucc

SEQ ID NO: 3195170 - RNA, 20 nt, Mycobacterium bovis subsp bovis AF2122/97
gcggaugcaugucaaguucg

SEQ ID NO: 3195171 - RNA, 12 nt, Mycobacterium bovis subsp bovis AF2122/97
gcggaugcccgc

SEQ ID NO: 3195172 - RNA, 22 nt, Mycobacterium bovis subsp bovis AF2122/97
gcggaugcucaggucaccggcc

SEQ ID NO: 3195173 - RNA, 14 nt, Mycobacterium bovis subsp bovis AF2122/97
gcggauggccgccu

SEQ ID NO: 3195174 - RNA, 14 nt, Mycobacterium bovis subsp bovis AF2122/97
gcggauguccccga

SEQ ID NO: 3195175 - RNA, 19 nt, Mycobacterium bovis subsp bovis AF2122/97
gcggauguccuugcggucc

SEQ ID NO: 3195176 - RNA, 15 nt, Mycobacterium bovis subsp bovis AF2122/97
gcggaugucgucgac

SEQ ID NO: 3195177 - RNA, 19 nt, Mycobacterium bovis subsp bovis AF2122/97
gcggaugucgucgaccagg

SEQ ID NO: 3195178 - RNA, 17 nt, Mycobacterium bovis subsp bovis AF2122/97
gcggauuaagucggcgg

SEQ ID NO: 3195179 - RNA, 18 nt, Mycobacterium bovis subsp bovis AF2122/97
gcggauuaagucggcggc

SEQ ID NO: 3195180 - RNA, 19 nt, Mycobacterium bovis subsp bovis AF2122/97
gcggauuaagucggcggcc

SEQ ID NO: 3195181 - RNA, 19 nt, Mycobacterium bovis subsp bovis AF2122/97
gcggauucacgcaccggcg

SEQ ID NO: 3195182 - RNA, 14 nt, Mycobacterium bovis subsp bovis AF2122/97
gcggauucgcgcug

SEQ ID NO: 3195183 - RNA, 21 nt, Mycobacterium bovis subsp bovis AF2122/97
gcggauucgcgcuguccacga

SEQ ID NO: 3195184 - RNA, 11 nt, Mycobacterium bovis subsp bovis AF2122/97
gcggauucggc

SEQ ID NO: 3195185 - RNA, 17 nt, Mycobacterium bovis subsp bovis AF2122/97
gcggauucggcgcugcg

SEQ ID NO: 3195186 - RNA, 18 nt, Mycobacterium bovis subsp bovis AF2122/97
gcggauucggcgcugcgg

SEQ ID NO: 3195187 - RNA, 19 nt, Mycobacterium bovis subsp bovis AF2122/97
gcggauucggcgcugcggc

SEQ ID NO: 3195188 - RNA, 16 nt, Mycobacterium bovis subsp bovis AF2122/97
gcggcaaagccgggug

SEQ ID NO: 3195189 - RNA, 20 nt, Mycobacterium bovis subsp bovis AF2122/97
gcggcaaaguuggccgcccg

SEQ ID NO: 3195190 - RNA, 22 nt, Mycobacterium bovis subsp bovis AF2122/97
gcggcaaaguuggccgcccgaa

SEQ ID NO: 3195191 - RNA, 15 nt, Mycobacterium bovis subsp bovis AF2122/97
gcggcaacaccaccu

SEQ ID NO: 3195192 - RNA, 15 nt, Mycobacterium bovis subsp bovis AF2122/97
gcggcaaccccgagc

SEQ ID NO: 3195193 - RNA, 14 nt, Mycobacterium bovis subsp bovis AF2122/97
gcggcaaccgccgc

SEQ ID NO: 3195194 - RNA, 15 nt, Mycobacterium bovis subsp bovis AF2122/97
gcggcaaccgccgcc

SEQ ID NO: 3195195 - RNA, 18 nt, Mycobacterium bovis subsp bovis AF2122/97
gcggcaaccgccgccacc

SEQ ID NO: 3195196 - RNA, 20 nt, Mycobacterium bovis subsp bovis AF2122/97
gcggcaaccgccgccaccag

SEQ ID NO: 3195197 - RNA, 22 nt, Mycobacterium bovis subsp bovis AF2122/97
gcggcaaccgucgaaaaaucga

SEQ ID NO: 3195198 - RNA, 20 nt, Mycobacterium bovis subsp bovis AF2122/97
gcggcaacgcggucugcucc

SEQ ID NO: 3195199 - RNA, 18 nt, Mycobacterium bovis subsp bovis AF2122/97
gcggcaacggcggaucgg

SEQ ID NO: 3195200 - RNA, 22 nt, Mycobacterium bovis subsp bovis AF2122/97
gcggcaacggcggaucggcggc

SEQ ID NO: 3195201 - RNA, 14 nt, Mycobacterium bovis subsp bovis AF2122/97
gcggcaacggcggc

SEQ ID NO: 3195202 - RNA, 16 nt, Mycobacterium bovis subsp bovis AF2122/97
gcggcaacggcggcau

SEQ ID NO: 3195203 - RNA, 19 nt, Mycobacterium bovis subsp bovis AF2122/97
gcggcaacggcggcaucgg

SEQ ID NO: 3195204 - RNA, 16 nt, Mycobacterium bovis subsp bovis AF2122/97
gcggcaacggcggcga

SEQ ID NO: 3195205 - RNA, 19 nt, Mycobacterium bovis subsp bovis AF2122/97
gcggcaacggcggcgacgg

SEQ ID NO: 3195206 - RNA, 22 nt, Mycobacterium bovis subsp bovis AF2122/97
gcggcaacggcggcgacggcgg

SEQ ID NO: 3195207 - RNA, 16 nt, Mycobacterium bovis subsp bovis AF2122/97
gcggcaacggcgguga

SEQ ID NO: 3195208 - RNA, 16 nt, Mycobacterium bovis subsp bovis AF2122/97
gcggcaacgggggcgc

SEQ ID NO: 3195209 - RNA, 21 nt, Mycobacterium bovis subsp bovis AF2122/97
gcggcaagcucguccggugcg

SEQ ID NO: 3195210 - RNA, 17 nt, Mycobacterium bovis subsp bovis AF2122/97
gcggcaagggcggcaac

SEQ ID NO: 3195211 - RNA, 21 nt, Mycobacterium bovis subsp bovis AF2122/97
gcggcaaggguggggccggcg

SEQ ID NO: 3195212 - RNA, 23 nt, Mycobacterium bovis subsp bovis AF2122/97
gcggcaaggguggggccggcggu

SEQ ID NO: 3195213 - RNA, 16 nt, Mycobacterium bovis subsp bovis AF2122/97
gcggcaagggugguga

SEQ ID NO: 3195214 - RNA, 15 nt, Mycobacterium bovis subsp bovis AF2122/97
gcggcaaggucaacg

SEQ ID NO: 3195215 - RNA, 16 nt, Mycobacterium bovis subsp bovis AF2122/97
gcggcaaggucaacgg

SEQ ID NO: 3195216 - RNA, 18 nt, Mycobacterium bovis subsp bovis AF2122/97
gcggcaaugaggccgucu

SEQ ID NO: 3195217 - RNA, 17 nt, Mycobacterium bovis subsp bovis AF2122/97
gcggcaauggccagcac

SEQ ID NO: 3195218 - RNA, 17 nt, Mycobacterium bovis subsp bovis AF2122/97
gcggcacacccaucacc

SEQ ID NO: 3195219 - RNA, 11 nt, Mycobacterium bovis subsp bovis AF2122/97
gcggcaccaga

SEQ ID NO: 3195220 - RNA, 13 nt, Mycobacterium bovis subsp bovis AF2122/97
gcggcaccagcac

SEQ ID NO: 3195221 - RNA, 14 nt, Mycobacterium bovis subsp bovis AF2122/97
gcggcaccagcacc

SEQ ID NO: 3195222 - RNA, 19 nt, Mycobacterium bovis subsp bovis AF2122/97
gcggcaccagcaccgucgg

SEQ ID NO: 3195223 - RNA, 22 nt, Mycobacterium bovis subsp bovis AF2122/97
gcggcacccaaccaggccgcga

SEQ ID NO: 3195224 - RNA, 17 nt, Mycobacterium bovis subsp bovis AF2122/97
gcggcacccaggugucg

SEQ ID NO: 3195225 - RNA, 18 nt, Mycobacterium bovis subsp bovis AF2122/97
gcggcacccagucggcgc

SEQ ID NO: 3195226 - RNA, 20 nt, Mycobacterium bovis subsp bovis AF2122/97
gcggcacccagucggcgccg

SEQ ID NO: 3195227 - RNA, 22 nt, Mycobacterium bovis subsp bovis AF2122/97
gcggcacccagucggcgccgcc

SEQ ID NO: 3195228 - RNA, 23 nt, Mycobacterium bovis subsp bovis AF2122/97
gcggcacccagucggcgccgccg

SEQ ID NO: 3195229 - RNA, 16 nt, Mycobacterium bovis subsp bovis AF2122/97
gcggcaccgauggcgc

SEQ ID NO: 3195230 - RNA, 17 nt, Mycobacterium bovis subsp bovis AF2122/97
gcggcaccgauggcgca

SEQ ID NO: 3195231 - RNA, 20 nt, Mycobacterium bovis subsp bovis AF2122/97
gcggcaccgauggcgcaccg

SEQ ID NO: 3195232 - RNA, 20 nt, Mycobacterium bovis subsp bovis AF2122/97
gcggcaccgccccgccaacc

SEQ ID NO: 3195233 - RNA, 13 nt, Mycobacterium bovis subsp bovis AF2122/97
gcggcaccgccga

SEQ ID NO: 3195234 - RNA, 14 nt, Mycobacterium bovis subsp bovis AF2122/97
gcggcaccgcgccg

SEQ ID NO: 3195235 - RNA, 16 nt, Mycobacterium bovis subsp bovis AF2122/97
gcggcaccgcgccggc

SEQ ID NO: 3195236 - RNA, 20 nt, Mycobacterium bovis subsp bovis AF2122/97
gcggcaccgcgccggcggaa

SEQ ID NO: 3195237 - RNA, 14 nt, Mycobacterium bovis subsp bovis AF2122/97
gcggcaccgcggcc

SEQ ID NO: 3195238 - RNA, 16 nt, Mycobacterium bovis subsp bovis AF2122/97
gcggcaccgcggccag

SEQ ID NO: 3195239 - RNA, 15 nt, Mycobacterium bovis subsp bovis AF2122/97
gcggcaccggcucag

SEQ ID NO: 3195240 - RNA, 21 nt, Mycobacterium bovis subsp bovis AF2122/97
gcggcaccucauugccguucu

SEQ ID NO: 3195241 - RNA, 22 nt, Mycobacterium bovis subsp bovis AF2122/97
gcggcaccucauugccguucuc

SEQ ID NO: 3195242 - RNA, 15 nt, Mycobacterium bovis subsp bovis AF2122/97
gcggcaccuggcuug

SEQ ID NO: 3195243 - RNA, 19 nt, Mycobacterium bovis subsp bovis AF2122/97
gcggcaccuuguagcgggc

SEQ ID NO: 3195244 - RNA, 16 nt, Mycobacterium bovis subsp bovis AF2122/97
gcggcacgaucgccaa

SEQ ID NO: 3195245 - RNA, 20 nt, Mycobacterium bovis subsp bovis AF2122/97
gcggcacgaucgccaacgac

SEQ ID NO: 3195246 - RNA, 19 nt, Mycobacterium bovis subsp bovis AF2122/97
gcggcacgcaaugucggca

SEQ ID NO: 3195247 - RNA, 16 nt, Mycobacterium bovis subsp bovis AF2122/97
gcggcacgcccacagc

SEQ ID NO: 3195248 - RNA, 15 nt, Mycobacterium bovis subsp bovis AF2122/97
gcggcacgcuccagc

SEQ ID NO: 3195249 - RNA, 18 nt, Mycobacterium bovis subsp bovis AF2122/97
gcggcacggaugcgaugg

SEQ ID NO: 3195250 - RNA, 23 nt, Mycobacterium bovis subsp bovis AF2122/97
gcggcacggaugcgauggccgac

SEQ ID NO: 3195251 - RNA, 14 nt, Mycobacterium bovis subsp bovis AF2122/97
gcggcacgggcggc

SEQ ID NO: 3195252 - RNA, 18 nt, Mycobacterium bovis subsp bovis AF2122/97
gcggcacgggcggccaug

SEQ ID NO: 3195253 - RNA, 20 nt, Mycobacterium bovis subsp bovis AF2122/97
gcggcacgggcggccauggc

SEQ ID NO: 3195254 - RNA, 17 nt, Mycobacterium bovis subsp bovis AF2122/97
gcggcacuacgcagccg

SEQ ID NO: 3195255 - RNA, 16 nt, Mycobacterium bovis subsp bovis AF2122/97
gcggcacucccugggg

SEQ ID NO: 3195256 - RNA, 16 nt, Mycobacterium bovis subsp bovis AF2122/97
gcggcacuggccccgg

SEQ ID NO: 3195257 - RNA, 19 nt, Mycobacterium bovis subsp bovis AF2122/97
gcggcagaccaagcccguc

SEQ ID NO: 3195258 - RNA, 18 nt, Mycobacterium bovis subsp bovis AF2122/97
gcggcagauacucggcga

SEQ ID NO: 3195259 - RNA, 18 nt, Mycobacterium bovis subsp bovis AF2122/97
gcggcagcaacgacgucg

SEQ ID NO: 3195260 - RNA, 14 nt, Mycobacterium bovis subsp bovis AF2122/97
gcggcagcacccac

SEQ ID NO: 3195261 - RNA, 22 nt, Mycobacterium bovis subsp bovis AF2122/97
gcggcagcacccacaucagccg

SEQ ID NO: 3195262 - RNA, 13 nt, Mycobacterium bovis subsp bovis AF2122/97
gcggcagcacccg

SEQ ID NO: 3195263 - RNA, 22 nt, Mycobacterium bovis subsp bovis AF2122/97
gcggcagcauauccgccggcga

SEQ ID NO: 3195264 - RNA, 17 nt, Mycobacterium bovis subsp bovis AF2122/97
gcggcagcccgcuggcc

SEQ ID NO: 3195265 - RNA, 15 nt, Mycobacterium bovis subsp bovis AF2122/97
gcggcagccggcgga

SEQ ID NO: 3195266 - RNA, 23 nt, Mycobacterium bovis subsp bovis AF2122/97
gcggcagccuggccucgccauug

SEQ ID NO: 3195267 - RNA, 19 nt, Mycobacterium bovis subsp bovis AF2122/97
gcggcagcgaaagcgucga

SEQ ID NO: 3195268 - RNA, 14 nt, Mycobacterium bovis subsp bovis AF2122/97
gcggcagcgaggcu

SEQ ID NO: 3195269 - RNA, 17 nt, Mycobacterium bovis subsp bovis AF2122/97
gcggcagcgaggcucgc

SEQ ID NO: 3195270 - RNA, 21 nt, Mycobacterium bovis subsp bovis AF2122/97
gcggcagcgagucgacgucga

SEQ ID NO: 3195271 - RNA, 14 nt, Mycobacterium bovis subsp bovis AF2122/97
gcggcagcgcggcc

SEQ ID NO: 3195272 - RNA, 17 nt, Mycobacterium bovis subsp bovis AF2122/97
gcggcagcggcgaucag

SEQ ID NO: 3195273 - RNA, 15 nt, Mycobacterium bovis subsp bovis AF2122/97
gcggcagcggcgccg

SEQ ID NO: 3195274 - RNA, 18 nt, Mycobacterium bovis subsp bovis AF2122/97
gcggcagcggcgccgccu

SEQ ID NO: 3195275 - RNA, 14 nt, Mycobacterium bovis subsp bovis AF2122/97
gcggcagcggcggu

SEQ ID NO: 3195276 - RNA, 22 nt, Mycobacterium bovis subsp bovis AF2122/97
gcggcagcggguuugccgggcg

SEQ ID NO: 3195277 - RNA, 15 nt, Mycobacterium bovis subsp bovis AF2122/97
gcggcagcggugcug

SEQ ID NO: 3195278 - RNA, 18 nt, Mycobacterium bovis subsp bovis AF2122/97
gcggcagcggugcuggug

SEQ ID NO: 3195279 - RNA, 15 nt, Mycobacterium bovis subsp bovis AF2122/97
gcggcagcgguggcu

SEQ ID NO: 3195280 - RNA, 21 nt, Mycobacterium bovis subsp bovis AF2122/97
gcggcagcgguuuuaggcagc

SEQ ID NO: 3195281 - RNA, 21 nt, Mycobacterium bovis subsp bovis AF2122/97
gcggcagcguugacggucagc

SEQ ID NO: 3195282 - RNA, 20 nt, Mycobacterium bovis subsp bovis AF2122/97
gcggcagcuacuaugccaac

SEQ ID NO: 3195283 - RNA, 23 nt, Mycobacterium bovis subsp bovis AF2122/97
gcggcaggaaucgggucagcacc

SEQ ID NO: 3195284 - RNA, 18 nt, Mycobacterium bovis subsp bovis AF2122/97
gcggcaggccggccaccg

SEQ ID NO: 3195285 - RNA, 15 nt, Mycobacterium bovis subsp bovis AF2122/97
gcggcaggccuggcg

SEQ ID NO: 3195286 - RNA, 16 nt, Mycobacterium bovis subsp bovis AF2122/97
gcggcaggccuggcga

SEQ ID NO: 3195287 - RNA, 21 nt, Mycobacterium bovis subsp bovis AF2122/97
gcggcagggcggugccaucgg

SEQ ID NO: 3195288 - RNA, 16 nt, Mycobacterium bovis subsp bovis AF2122/97
gcggcagguagaucag

SEQ ID NO: 3195289 - RNA, 21 nt, Mycobacterium bovis subsp bovis AF2122/97
gcggcaggucgaugcugccag

SEQ ID NO: 3195290 - RNA, 21 nt, Mycobacterium bovis subsp bovis AF2122/97
gcggcaggugcccaucgggug

SEQ ID NO: 3195291 - RNA, 14 nt, Mycobacterium bovis subsp bovis AF2122/97
gcggcaggugcggc

SEQ ID NO: 3195292 - RNA, 16 nt, Mycobacterium bovis subsp bovis AF2122/97
gcggcaggugcggcgg

SEQ ID NO: 3195293 - RNA, 19 nt, Mycobacterium bovis subsp bovis AF2122/97
gcggcaggugcggcggcau

SEQ ID NO: 3195294 - RNA, 22 nt, Mycobacterium bovis subsp bovis AF2122/97
gcggcaggugcggcggcaucgg

SEQ ID NO: 3195295 - RNA, 17 nt, Mycobacterium bovis subsp bovis AF2122/97
gcggcagguucggcgac

SEQ ID NO: 3195296 - RNA, 22 nt, Mycobacterium bovis subsp bovis AF2122/97
gcggcaguaccccucgcacaau

SEQ ID NO: 3195297 - RNA, 19 nt, Mycobacterium bovis subsp bovis AF2122/97
gcggcaguuguggcgcugc

SEQ ID NO: 3195298 - RNA, 22 nt, Mycobacterium bovis subsp bovis AF2122/97
gcggcauaaacaucgguggcgc

SEQ ID NO: 3195299 - RNA, 15 nt, Mycobacterium bovis subsp bovis AF2122/97
gcggcauacauccag

SEQ ID NO: 3195300 - RNA, 18 nt, Mycobacterium bovis subsp bovis AF2122/97
gcggcauacauccaggcu

SEQ ID NO: 3195301 - RNA, 24 nt, Mycobacterium bovis subsp bovis AF2122/97
gcggcauacauccaggcuguggcc

SEQ ID NO: 3195302 - RNA, 21 nt, Mycobacterium bovis subsp bovis AF2122/97
gcggcauagcucagaccggcg

SEQ ID NO: 3195303 - RNA, 24 nt, Mycobacterium bovis subsp bovis AF2122/97
gcggcauauggauguuggugaacg

SEQ ID NO: 3195304 - RNA, 17 nt, Mycobacterium bovis subsp bovis AF2122/97
gcggcaucaccuggcgu

SEQ ID NO: 3195305 - RNA, 17 nt, Mycobacterium bovis subsp bovis AF2122/97
gcggcaucccgccacac

SEQ ID NO: 3195306 - RNA, 19 nt, Mycobacterium bovis subsp bovis AF2122/97
gcggcauccugcacgaccc

SEQ ID NO: 3195307 - RNA, 20 nt, Mycobacterium bovis subsp bovis AF2122/97
gcggcauccugcacgacccg

SEQ ID NO: 3195308 - RNA, 17 nt, Mycobacterium bovis subsp bovis AF2122/97
gcggcaucgaguucggc

SEQ ID NO: 3195309 - RNA, 15 nt, Mycobacterium bovis subsp bovis AF2122/97
gcggcaucgcgggcg

SEQ ID NO: 3195310 - RNA, 16 nt, Mycobacterium bovis subsp bovis AF2122/97
gcggcaucgcgggcgg

SEQ ID NO: 3195311 - RNA, 18 nt, Mycobacterium bovis subsp bovis AF2122/97
gcggcaucgcgggcggcg

SEQ ID NO: 3195312 - RNA, 19 nt, Mycobacterium bovis subsp bovis AF2122/97
gcggcaucgcgggcggcgc

SEQ ID NO: 3195313 - RNA, 21 nt, Mycobacterium bovis subsp bovis AF2122/97
gcggcaucgcgggcggcgcug

SEQ ID NO: 3195314 - RNA, 13 nt, Mycobacterium bovis subsp bovis AF2122/97
gcggcaucggcca

SEQ ID NO: 3195315 - RNA, 14 nt, Mycobacterium bovis subsp bovis AF2122/97
gcggcaucggccag

SEQ ID NO: 3195316 - RNA, 15 nt, Mycobacterium bovis subsp bovis AF2122/97
gcggcaucggccagc

SEQ ID NO: 3195317 - RNA, 16 nt, Mycobacterium bovis subsp bovis AF2122/97
gcggcaucggccagcc

SEQ ID NO: 3195318 - RNA, 14 nt, Mycobacterium bovis subsp bovis AF2122/97
gcggcaucggcggc

SEQ ID NO: 3195319 - RNA, 16 nt, Mycobacterium bovis subsp bovis AF2122/97
gcggcaucggcggcaa

SEQ ID NO: 3195320 - RNA, 18 nt, Mycobacterium bovis subsp bovis AF2122/97
gcggcaucggcggcaagg

SEQ ID NO: 3195321 - RNA, 20 nt, Mycobacterium bovis subsp bovis AF2122/97
gcggcaucggcggcaagggu

SEQ ID NO: 3195322 - RNA, 22 nt, Mycobacterium bovis subsp bovis AF2122/97
gcggcaucggcggcaagggugg

SEQ ID NO: 3195323 - RNA, 17 nt, Mycobacterium bovis subsp bovis AF2122/97
gcggcaucgggguuggu

SEQ ID NO: 3195324 - RNA, 18 nt, Mycobacterium bovis subsp bovis AF2122/97
gcggcaucucgcaccgcg

SEQ ID NO: 3195325 - RNA, 21 nt, Mycobacterium bovis subsp bovis AF2122/97
gcggcaucucgcaccgcgccg

SEQ ID NO: 3195326 - RNA, 21 nt, Mycobacterium bovis subsp bovis AF2122/97
gcggcaugcaaugcuggcggc

SEQ ID NO: 3195327 - RNA, 18 nt, Mycobacterium bovis subsp bovis AF2122/97
gcggcaugcagaucucac

SEQ ID NO: 3195328 - RNA, 18 nt, Mycobacterium bovis subsp bovis AF2122/97
gcggcauggcauggcgaa

SEQ ID NO: 3195329 - RNA, 22 nt, Mycobacterium bovis subsp bovis AF2122/97
gcggcauggcauggcgaacacg

SEQ ID NO: 3195330 - RNA, 21 nt, Mycobacterium bovis subsp bovis AF2122/97
gcggcaugggcccugcacagc

SEQ ID NO: 3195331 - RNA, 23 nt, Mycobacterium bovis subsp bovis AF2122/97
gcggcaugggucgugcaggcgac

SEQ ID NO: 3195332 - RNA, 23 nt, Mycobacterium bovis subsp bovis AF2122/97
gcggcauguauuucgugccggcg

SEQ ID NO: 3195333 - RNA, 23 nt, Mycobacterium bovis subsp bovis AF2122/97
gcggcauuaccaacgcggugacg

SEQ ID NO: 3195334 - RNA, 20 nt, Mycobacterium bovis subsp bovis AF2122/97
gcggcauucucgagcacccg

SEQ ID NO: 3195335 - RNA, 22 nt, Mycobacterium bovis subsp bovis AF2122/97
gcggcauucucgagcacccgca

SEQ ID NO: 3195336 - RNA, 15 nt, Mycobacterium bovis subsp bovis AF2122/97
gcggcauuggcggug

SEQ ID NO: 3195337 - RNA, 17 nt, Mycobacterium bovis subsp bovis AF2122/97
gcggcauuuucgaggua

SEQ ID NO: 3195338 - RNA, 18 nt, Mycobacterium bovis subsp bovis AF2122/97
gcggccaacagcacccgg

SEQ ID NO: 3195339 - RNA, 22 nt, Mycobacterium bovis subsp bovis AF2122/97
gcggccaacccauuucgucagc

SEQ ID NO: 3195340 - RNA, 13 nt, Mycobacterium bovis subsp bovis AF2122/97
gcggccaacgaac

SEQ ID NO: 3195341 - RNA, 22 nt, Mycobacterium bovis subsp bovis AF2122/97
gcggccaacgaacgugccccgg

SEQ ID NO: 3195342 - RNA, 16 nt, Mycobacterium bovis subsp bovis AF2122/97
gcggccaacgacgacc

SEQ ID NO: 3195343 - RNA, 19 nt, Mycobacterium bovis subsp bovis AF2122/97
gcggccaacgacgacccgu

SEQ ID NO: 3195344 - RNA, 17 nt, Mycobacterium bovis subsp bovis AF2122/97
gcggccaaggucgaccc

SEQ ID NO: 3195345 - RNA, 20 nt, Mycobacterium bovis subsp bovis AF2122/97
gcggccaauggccgcggcac

SEQ ID NO: 3195346 - RNA, 16 nt, Mycobacterium bovis subsp bovis AF2122/97
gcggccaauggugggc

SEQ ID NO: 3195347 - RNA, 21 nt, Mycobacterium bovis subsp bovis AF2122/97
gcggccaauggugggcgagcu

SEQ ID NO: 3195348 - RNA, 22 nt, Mycobacterium bovis subsp bovis AF2122/97
gcggccacaaugcggccguucg

SEQ ID NO: 3195349 - RNA, 19 nt, Mycobacterium bovis subsp bovis AF2122/97
gcggccacauaccaccacg

SEQ ID NO: 3195350 - RNA, 21 nt, Mycobacterium bovis subsp bovis AF2122/97
gcggccacaucgccagcagca

SEQ ID NO: 3195351 - RNA, 21 nt, Mycobacterium bovis subsp bovis AF2122/97
gcggccaccacaacgccagga

SEQ ID NO: 3195352 - RNA, 13 nt, Mycobacterium bovis subsp bovis AF2122/97
gcggccaccacca

SEQ ID NO: 3195353 - RNA, 16 nt, Mycobacterium bovis subsp bovis AF2122/97
gcggccaccaccgccg

SEQ ID NO: 3195354 - RNA, 18 nt, Mycobacterium bovis subsp bovis AF2122/97
gcggccaccaccgccgcc

SEQ ID NO: 3195355 - RNA, 19 nt, Mycobacterium bovis subsp bovis AF2122/97
gcggccaccaccgccgccg

SEQ ID NO: 3195356 - RNA, 14 nt, Mycobacterium bovis subsp bovis AF2122/97
gcggccaccagauc

SEQ ID NO: 3195357 - RNA, 21 nt, Mycobacterium bovis subsp bovis AF2122/97
gcggccaccagaucgcacacc

SEQ ID NO: 3195358 - RNA, 12 nt, Mycobacterium bovis subsp bovis AF2122/97
gcggccaccagc

SEQ ID NO: 3195359 - RNA, 13 nt, Mycobacterium bovis subsp bovis AF2122/97
gcggccaccagcg

SEQ ID NO: 3195360 - RNA, 15 nt, Mycobacterium bovis subsp bovis AF2122/97
gcggccacccgcgac

SEQ ID NO: 3195361 - RNA, 17 nt, Mycobacterium bovis subsp bovis AF2122/97
gcggccacccgcgacga

SEQ ID NO: 3195362 - RNA, 13 nt, Mycobacterium bovis subsp bovis AF2122/97
gcggccaccgccg

SEQ ID NO: 3195363 - RNA, 14 nt, Mycobacterium bovis subsp bovis AF2122/97
gcggccaccgccgc

SEQ ID NO: 3195364 - RNA, 15 nt, Mycobacterium bovis subsp bovis AF2122/97
gcggccaccgccgcc

SEQ ID NO: 3195365 - RNA, 16 nt, Mycobacterium bovis subsp bovis AF2122/97
gcggccaccgccgccg

SEQ ID NO: 3195366 - RNA, 21 nt, Mycobacterium bovis subsp bovis AF2122/97
gcggccaccgucagcgcgacc

SEQ ID NO: 3195367 - RNA, 16 nt, Mycobacterium bovis subsp bovis AF2122/97
gcggccaccugcuggc

SEQ ID NO: 3195368 - RNA, 17 nt, Mycobacterium bovis subsp bovis AF2122/97
gcggccaccugcuggcc

SEQ ID NO: 3195369 - RNA, 13 nt, Mycobacterium bovis subsp bovis AF2122/97
gcggccacgccga

SEQ ID NO: 3195370 - RNA, 15 nt, Mycobacterium bovis subsp bovis AF2122/97
gcggccacgccggcg

SEQ ID NO: 3195371 - RNA, 14 nt, Mycobacterium bovis subsp bovis AF2122/97
gcggccacgguggc

SEQ ID NO: 3195372 - RNA, 16 nt, Mycobacterium bovis subsp bovis AF2122/97
gcggccacgguggcgc

SEQ ID NO: 3195373 - RNA, 14 nt, Mycobacterium bovis subsp bovis AF2122/97
gcggccagagccgc

SEQ ID NO: 3195374 - RNA, 24 nt, Mycobacterium bovis subsp bovis AF2122/97
gcggccagagccgcgcgccgguug

SEQ ID NO: 3195375 - RNA, 18 nt, Mycobacterium bovis subsp bovis AF2122/97
gcggccagauagguucca

SEQ ID NO: 3195376 - RNA, 14 nt, Mycobacterium bovis subsp bovis AF2122/97
gcggccagcaccgg

SEQ ID NO: 3195377 - RNA, 12 nt, Mycobacterium bovis subsp bovis AF2122/97
gcggccagcacg

SEQ ID NO: 3195378 - RNA, 15 nt, Mycobacterium bovis subsp bovis AF2122/97
gcggccagcacgucg

SEQ ID NO: 3195379 - RNA, 12 nt, Mycobacterium bovis subsp bovis AF2122/97
gcggccagcagc

SEQ ID NO: 3195380 - RNA, 20 nt, Mycobacterium bovis subsp bovis AF2122/97
gcggccagcagcaacgaccc

SEQ ID NO: 3195381 - RNA, 23 nt, Mycobacterium bovis subsp bovis AF2122/97
gcggccagcagcaacgacccgaa

SEQ ID NO: 3195382 - RNA, 20 nt, Mycobacterium bovis subsp bovis AF2122/97
gcggccagcaucgcgguggu

SEQ ID NO: 3195383 - RNA, 19 nt, Mycobacterium bovis subsp bovis AF2122/97
gcggccagcaucguguggu

SEQ ID NO: 3195384 - RNA, 15 nt, Mycobacterium bovis subsp bovis AF2122/97
gcggccagcccagcc

SEQ ID NO: 3195385 - RNA, 15 nt, Mycobacterium bovis subsp bovis AF2122/97
gcggccagcgcaccg

SEQ ID NO: 3195386 - RNA, 19 nt, Mycobacterium bovis subsp bovis AF2122/97
gcggccagcgcaccgccga

SEQ ID NO: 3195387 - RNA, 16 nt, Mycobacterium bovis subsp bovis AF2122/97
gcggccagcgcgcgcg

SEQ ID NO: 3195388 - RNA, 17 nt, Mycobacterium bovis subsp bovis AF2122/97
gcggccagcgcgcgcgg

SEQ ID NO: 3195389 - RNA, 20 nt, Mycobacterium bovis subsp bovis AF2122/97
gcggccagcgcgcgcgggug

SEQ ID NO: 3195390 - RNA, 17 nt, Mycobacterium bovis subsp bovis AF2122/97
gcggccagcgcggcgcg

SEQ ID NO: 3195391 - RNA, 20 nt, Mycobacterium bovis subsp bovis AF2122/97
gcgcaguaacgucgucgcgu

SEQ ID NO: 3195392 - RNA, 21 nt, Mycobacterium bovis subsp bovis AF2122/97
gcgcaguaacgucgucgcguc

SEQ ID NO: 3195393 - RNA, 22 nt, Mycobacterium bovis subsp bovis AF2122/97
gcgcaguacuugaccguccacc

SEQ ID NO: 3195394 - RNA, 16 nt, Mycobacterium bovis subsp bovis AF2122/97
gcgcaguagccgacca

SEQ ID NO: 3195395 - RNA, 19 nt, Mycobacterium bovis subsp bovis AF2122/97
gcgcaguagccgaccagga

SEQ ID NO: 3195396 - RNA, 21 nt, Mycobacterium bovis subsp bovis AF2122/97
gcgcaguagccgaccaggacc

SEQ ID NO: 3195397 - RNA, 21 nt, Mycobacterium bovis subsp bovis AF2122/97
gcgcagucugauuccacauca

SEQ ID NO: 3195398 - RNA, 16 nt, Mycobacterium bovis subsp bovis AF2122/97
gcgcagugacgccucg

SEQ ID NO: 3195399 - RNA, 22 nt, Mycobacterium bovis subsp bovis AF2122/97
gcgcagugacgccucgacaccc

SEQ ID NO: 3195400 - RNA, 19 nt, Mycobacterium bovis subsp bovis AF2122/97
gcgcagugcgacucugcgu

SEQ ID NO: 3195401 - RNA, 15 nt, Mycobacterium bovis subsp bovis AF2122/97
gcgcaguucgucgug

SEQ ID NO: 3195402 - RNA, 17 nt, Mycobacterium bovis subsp bovis AF2122/97
gcgcaguuggcaccagc

SEQ ID NO: 3195403 - RNA, 16 nt, Mycobacterium bovis subsp bovis AF2122/97
gcgcaguuggccaugc

SEQ ID NO: 3195404 - RNA, 15 nt, Mycobacterium bovis subsp bovis AF2122/97
gcgcaguuuggcggc

SEQ ID NO: 3195405 - RNA, 16 nt, Mycobacterium bovis subsp bovis AF2122/97
gcgcaguuuggcggcg

SEQ ID NO: 3195406 - RNA, 19 nt, Mycobacterium bovis subsp bovis AF2122/97
gcgcaguuuggcggcgcgc

SEQ ID NO: 3195407 - RNA, 18 nt, Mycobacterium bovis subsp bovis AF2122/97
gcgcauaccggcgucguu

SEQ ID NO: 3195408 - RNA, 16 nt, Mycobacterium bovis subsp bovis AF2122/97
gcgcauaggcgaucgu

SEQ ID NO: 3195409 - RNA, 21 nt, Mycobacterium bovis subsp bovis AF2122/97
gcgcauagggccaccgccgcc

SEQ ID NO: 3195410 - RNA, 14 nt, Mycobacterium bovis subsp bovis AF2122/97
gcgcauauccgcag

SEQ ID NO: 3195411 - RNA, 16 nt, Mycobacterium bovis subsp bovis AF2122/97
gcgcauauccgcaggc

SEQ ID NO: 3195412 - RNA, 22 nt, Mycobacterium bovis subsp bovis AF2122/97
gcgcaucaccacccgaccgcca

SEQ ID NO: 3195413 - RNA, 13 nt, Mycobacterium bovis subsp bovis AF2122/97
gcgcaucaccacu

SEQ ID NO: 3195414 - RNA, 16 nt, Mycobacterium bovis subsp bovis AF2122/97
gcgcauccaauaucgc

SEQ ID NO: 3195415 - RNA, 21 nt, Mycobacterium bovis subsp bovis AF2122/97
gcgcauccaauccacgguugc

SEQ ID NO: 3195416 - RNA, 13 nt, Mycobacterium bovis subsp bovis AF2122/97
gcgcaucccgaag

SEQ ID NO: 3195417 - RNA, 12 nt, Mycobacterium bovis subsp bovis AF2122/97
gcgcaucgcacg

SEQ ID NO: 3195418 - RNA, 22 nt, Mycobacterium bovis subsp bovis AF2122/97
gcgcaucgcacgggccaccagc

SEQ ID NO: 3195419 - RNA, 12 nt, Mycobacterium bovis subsp bovis AF2122/97
gcgcaucgccaa

SEQ ID NO: 3195420 - RNA, 15 nt, Mycobacterium bovis subsp bovis AF2122/97
gcgcaucgccaccau

SEQ ID NO: 3195421 - RNA, 17 nt, Mycobacterium bovis subsp bovis AF2122/97
gcgcaucgccgacagcg

SEQ ID NO: 3195422 - RNA, 17 nt, Mycobacterium bovis subsp bovis AF2122/97
gcgcaucgccgcuggcc

SEQ ID NO: 3195423 - RNA, 20 nt, Mycobacterium bovis subsp bovis AF2122/97
gcgcaucgccgcuggccagc

SEQ ID NO: 3195424 - RNA, 21 nt, Mycobacterium bovis subsp bovis AF2122/97
gcgcaucgccgcuggccagca

SEQ ID NO: 3195425 - RNA, 16 nt, Mycobacterium bovis subsp bovis AF2122/97
gcgcaucgccuccucg

SEQ ID NO: 3195426 - RNA, 17 nt, Mycobacterium bovis subsp bovis AF2122/97
gcgcaucgccuccucga

SEQ ID NO: 3195427 - RNA, 14 nt, Mycobacterium bovis subsp bovis AF2122/97
gcgcaucgcgccuu

SEQ ID NO: 3195428 - RNA, 13 nt, Mycobacterium bovis subsp bovis AF2122/97
gcgcaucggccag

SEQ ID NO: 3195429 - RNA, 14 nt, Mycobacterium bovis subsp bovis AF2122/97
gcgcaucggccagc

SEQ ID NO: 3195430 - RNA, 17 nt, Mycobacterium bovis subsp bovis AF2122/97
gcgcaucggccagcagc

SEQ ID NO: 3195431 - RNA, 22 nt, Mycobacterium bovis subsp bovis AF2122/97
gcgcaucgucgaaagccuggaa

SEQ ID NO: 3195432 - RNA, 14 nt, Mycobacterium bovis subsp bovis AF2122/97
gcgcaucugcucgg

SEQ ID NO: 3195433 - RNA, 15 nt, Mycobacterium bovis subsp bovis AF2122/97
gcgcaucugcucggc

SEQ ID NO: 3195434 - RNA, 13 nt, Mycobacterium bovis subsp bovis AF2122/97
gcgcaucugucgc

SEQ ID NO: 3195435 - RNA, 22 nt, Mycobacterium bovis subsp bovis AF2122/97
gcgcauggucagguaggcgucg

SEQ ID NO: 3195436 - RNA, 19 nt, Mycobacterium bovis subsp bovis AF2122/97
gcgcaugucgauccggcgc

SEQ ID NO: 3195437 - RNA, 21 nt, Mycobacterium bovis subsp bovis AF2122/97
gcgcaugugaaagacaacccg

SEQ ID NO: 3195438 - RNA, 15 nt, Mycobacterium bovis subsp bovis AF2122/97
gcgcauucccuuguc

SEQ ID NO: 3195439 - RNA, 14 nt, Mycobacterium bovis subsp bovis AF2122/97
gcgcauuccggcgc

SEQ ID NO: 3195440 - RNA, 13 nt, Mycobacterium bovis subsp bovis AF2122/97
gcgcauucgccgg

SEQ ID NO: 3195441 - RNA, 20 nt, Mycobacterium bovis subsp bovis AF2122/97
gcgcauucgccgggcggcau

SEQ ID NO: 3195442 - RNA, 15 nt, Mycobacterium bovis subsp bovis AF2122/97
gcgcauugccgacgc

SEQ ID NO: 3195443 - RNA, 21 nt, Mycobacterium bovis subsp bovis AF2122/97
gcgcauugccgacgcgcggcc

SEQ ID NO: 3195444 - RNA, 16 nt, Mycobacterium bovis subsp bovis AF2122/97
gcgcauuucaccgggg

SEQ ID NO: 3195445 - RNA, 17 nt, Mycobacterium bovis subsp bovis AF2122/97
gcgcauuucaccggggc

SEQ ID NO: 3195446 - RNA, 23 nt, Mycobacterium bovis subsp bovis AF2122/97
gcgcauuucggaucucgaccucg

SEQ ID NO: 3195447 - RNA, 16 nt, Mycobacterium bovis subsp bovis AF2122/97
gcgcauuucguggcgc

SEQ ID NO: 3195448 - RNA, 16 nt, Mycobacterium bovis subsp bovis AF2122/97
gcgcauuuguugcugc

SEQ ID NO: 3195449 - RNA, 21 nt, Mycobacterium bovis subsp bovis AF2122/97
gcgcauuuguugcugcugccg

SEQ ID NO: 3195450 - RNA, 21 nt, Mycobacterium bovis subsp bovis AF2122/97
gcgcauuuuucgccagcugac

SEQ ID NO: 3195451 - RNA, 22 nt, Mycobacterium bovis subsp bovis AF2122/97
gcgccaaaaaggaucccgccgc

SEQ ID NO: 3195452 - RNA, 18 nt, Mycobacterium bovis subsp bovis AF2122/97
gcgccaaaauccgcccac

SEQ ID NO: 3195453 - RNA, 12 nt, Mycobacterium bovis subsp bovis AF2122/97
gcgccaacaccu

SEQ ID NO: 3195454 - RNA, 17 nt, Mycobacterium bovis subsp bovis AF2122/97
gcgccaacagaugccac

SEQ ID NO: 3195455 - RNA, 21 nt, Mycobacterium bovis subsp bovis AF2122/97
gcgccaacagaugccacccag

SEQ ID NO: 3195456 - RNA, 15 nt, Mycobacterium bovis subsp bovis AF2122/97
gcgccaacccggcca

SEQ ID NO: 3195457 - RNA, 17 nt, Mycobacterium bovis subsp bovis AF2122/97
gcgccaauucagcggca

SEQ ID NO: 3195458 - RNA, 18 nt, Mycobacterium bovis subsp bovis AF2122/97
gcgccaauucagcggcaa

SEQ ID NO: 3195459 - RNA, 20 nt, Mycobacterium bovis subsp bovis AF2122/97
gcgccacacccggcacaccc

SEQ ID NO: 3195460 - RNA, 17 nt, Mycobacterium bovis subsp bovis AF2122/97
gcgccacagcagcguug

SEQ ID NO: 3195461 - RNA, 20 nt, Mycobacterium bovis subsp bovis AF2122/97
gcgccacauacaccggccgg

SEQ ID NO: 3195462 - RNA, 12 nt, Mycobacterium bovis subsp bovis AF2122/97
gcgccaccaccc

SEQ ID NO: 3195463 - RNA, 17 nt, Mycobacterium bovis subsp bovis AF2122/97
gcgccaccacccggcgc

SEQ ID NO: 3195464 - RNA, 12 nt, Mycobacterium bovis subsp bovis AF2122/97
gcgccaccagca

SEQ ID NO: 3195465 - RNA, 18 nt, Mycobacterium bovis subsp bovis AF2122/97
gcgccacccagcaccagg

SEQ ID NO: 3195466 - RNA, 14 nt, Mycobacterium bovis subsp bovis AF2122/97
gcgccacccccacc

SEQ ID NO: 3195467 - RNA, 19 nt, Mycobacterium bovis subsp bovis AF2122/97
gcgccacccccaccgucgc

SEQ ID NO: 3195468 - RNA, 15 nt, Mycobacterium bovis subsp bovis AF2122/97
gcgccacccgaucgg

SEQ ID NO: 3195469 - RNA, 21 nt, Mycobacterium bovis subsp bovis AF2122/97
gcgccacccgaucgggcguca

SEQ ID NO: 3195470 - RNA, 13 nt, Mycobacterium bovis subsp bovis AF2122/97
gcgccacccgcga

SEQ ID NO: 3195471 - RNA, 14 nt, Mycobacterium bovis subsp bovis AF2122/97
gcgccacccgcgcc

SEQ ID NO: 3195472 - RNA, 18 nt, Mycobacterium bovis subsp bovis AF2122/97
gcgccacccgcgccgccc

SEQ ID NO: 3195473 - RNA, 21 nt, Mycobacterium bovis subsp bovis AF2122/97
gcgccacccgcgccgcccgcu

SEQ ID NO: 3195474 - RNA, 16 nt, Mycobacterium bovis subsp bovis AF2122/97
gcgccacccgcggugc

SEQ ID NO: 3195475 - RNA, 17 nt, Mycobacterium bovis subsp bovis AF2122/97
gcgccacccgguccggc

SEQ ID NO: 3195476 - RNA, 21 nt, Mycobacterium bovis subsp bovis AF2122/97
gcgccacccgguccggcccgg

SEQ ID NO: 3195477 - RNA, 12 nt, Mycobacterium bovis subsp bovis AF2122/97
gcgccaccgccg

SEQ ID NO: 3195478 - RNA, 13 nt, Mycobacterium bovis subsp bovis AF2122/97
gcgccaccgccgc

SEQ ID NO: 3195479 - RNA, 15 nt, Mycobacterium bovis subsp bovis AF2122/97
gcgccaccggcaccg

SEQ ID NO: 3195480 - RNA, 15 nt, Mycobacterium bovis subsp bovis AF2122/97
gcgccaccggccgcg

SEQ ID NO: 3195481 - RNA, 14 nt, Mycobacterium bovis subsp bovis AF2122/97
gcgccaccggcgcc

SEQ ID NO: 3195482 - RNA, 15 nt, Mycobacterium bovis subsp bovis AF2122/97
gcgccaccggcgccg

SEQ ID NO: 3195483 - RNA, 24 nt, Mycobacterium bovis subsp bovis AF2122/97
gcgccaccggcguuguugaccagc

SEQ ID NO: 3195484 - RNA, 14 nt, Mycobacterium bovis subsp bovis AF2122/97
gcgccaccgucacc

SEQ ID NO: 3195485 - RNA, 15 nt, Mycobacterium bovis subsp bovis AF2122/97
gcgccaccgucaccg

SEQ ID NO: 3195486 - RNA, 21 nt, Mycobacterium bovis subsp bovis AF2122/97
gcgccaccgucaccgccguug

SEQ ID NO: 3195487 - RNA, 13 nt, Mycobacterium bovis subsp bovis AF2122/97
gcgccaccgucgc

SEQ ID NO: 3195488 - RNA, 16 nt, Mycobacterium bovis subsp bovis AF2122/97
gcgccaccguggugga

SEQ ID NO: 3195489 - RNA, 19 nt, Mycobacterium bovis subsp bovis AF2122/97
gcgccaccgugguggacga

SEQ ID NO: 3195490 - RNA, 21 nt, Mycobacterium bovis subsp bovis AF2122/97
gcgccaccguuaccgccguuu

SEQ ID NO: 3195491 - RNA, 17 nt, Mycobacterium bovis subsp bovis AF2122/97
gcgccaccguugccgaa

SEQ ID NO: 3195492 - RNA, 21 nt, Mycobacterium bovis subsp bovis AF2122/97
gcgccaccguuugcgcaccgg

SEQ ID NO: 3195493 - RNA, 16 nt, Mycobacterium bovis subsp bovis AF2122/97
gcgccaccucccacgc

SEQ ID NO: 3195494 - RNA, 17 nt, Mycobacterium bovis subsp bovis AF2122/97
gcgccaccucccacgcc

SEQ ID NO: 3195495 - RNA, 22 nt, Mycobacterium bovis subsp bovis AF2122/97
gcgccaccucccacgccgccgu

SEQ ID NO: 3195496 - RNA, 19 nt, Mycobacterium bovis subsp bovis AF2122/97
gcgccaccugaaagcuacc

SEQ ID NO: 3195497 - RNA, 13 nt, Mycobacterium bovis subsp bovis AF2122/97
gcgccacgaugac

SEQ ID NO: 3195498 - RNA, 13 nt, Mycobacterium bovis subsp bovis AF2122/97
gcgccacgcaccc

SEQ ID NO: 3195499 - RNA, 13 nt, Mycobacterium bovis subsp bovis AF2122/97
gcgccacgccacc

SEQ ID NO: 3195500 - RNA, 11 nt, Mycobacterium bovis subsp bovis AF2122/97
gcgccacgccg

SEQ ID NO: 3195501 - RNA, 12 nt, Mycobacterium bovis subsp bovis AF2122/97
gcgccacgccga

SEQ ID NO: 3195502 - RNA, 17 nt, Mycobacterium bovis subsp bovis AF2122/97
gcgccacggcagcgccc

SEQ ID NO: 3195503 - RNA, 14 nt, Mycobacterium bovis subsp bovis AF2122/97
gcgccacggcguga

SEQ ID NO: 3195504 - RNA, 23 nt, Mycobacterium bovis subsp bovis AF2122/97
gcgccacguccaucaccggcggc

SEQ ID NO: 3195505 - RNA, 14 nt, Mycobacterium bovis subsp bovis AF2122/97
gcgccacgucgacg

SEQ ID NO: 3195506 - RNA, 17 nt, Mycobacterium bovis subsp bovis AF2122/97
gcgccacgucgacgguc

SEQ ID NO: 3195507 - RNA, 18 nt, Mycobacterium bovis subsp bovis AF2122/97
gcgccacuagcccugagc

SEQ ID NO: 3195508 - RNA, 12 nt, Mycobacterium bovis subsp bovis AF2122/97
gcgccacucaag

SEQ ID NO: 3195509 - RNA, 13 nt, Mycobacterium bovis subsp bovis AF2122/97
gcgccacugaccg

SEQ ID NO: 3195510 - RNA, 20 nt, Mycobacterium bovis subsp bovis AF2122/97
gcgccacugaccgcgaucgc

SEQ ID NO: 3195511 - RNA, 16 nt, Mycobacterium bovis subsp bovis AF2122/97
gcgccacugcuuccgg

SEQ ID NO: 3195512 - RNA, 21 nt, Mycobacterium bovis subsp bovis AF2122/97
gcgccacuguagggcuuccag

SEQ ID NO: 3195513 - RNA, 17 nt, Mycobacterium bovis subsp bovis AF2122/97
gcgccacuugaugccgc

SEQ ID NO: 3195514 - RNA, 17 nt, Mycobacterium bovis subsp bovis AF2122/97
gcgccagaacgacaccg

SEQ ID NO: 3195515 - RNA, 23 nt, Mycobacterium bovis subsp bovis AF2122/97
gcgccagaacgacaccgcuugug

SEQ ID NO: 3195516 - RNA, 17 nt, Mycobacterium bovis subsp bovis AF2122/97
gcgccagaucaccgucg

SEQ ID NO: 3195517 - RNA, 18 nt, Mycobacterium bovis subsp bovis AF2122/97
gcgccagaucaccgucga

SEQ ID NO: 3195518 - RNA, 20 nt, Mycobacterium bovis subsp bovis AF2122/97
gcgccagaucaccgucgaca

SEQ ID NO: 3195519 - RNA, 16 nt, Mycobacterium bovis subsp bovis AF2122/97
gcgccagcagccaccc

SEQ ID NO: 3195520 - RNA, 13 nt, Mycobacterium bovis subsp bovis AF2122/97
gcgccagccgacc

SEQ ID NO: 3195521 - RNA, 15 nt, Mycobacterium bovis subsp bovis AF2122/97
gcgccagccgaccga

SEQ ID NO: 3195522 - RNA, 22 nt, Mycobacterium bovis subsp bovis AF2122/97
gcgccagccuccaccaggucgu

SEQ ID NO: 3195523 - RNA, 20 nt, Mycobacterium bovis subsp bovis AF2122/97
gcgccagcgauaucggcggc

SEQ ID NO: 3195524 - RNA, 16 nt, Mycobacterium bovis subsp bovis AF2122/97
gcgccagcgccugcgc

SEQ ID NO: 3195525 - RNA, 19 nt, Mycobacterium bovis subsp bovis AF2122/97
gcgccagcgccugcgcgca

SEQ ID NO: 3195526 - RNA, 23 nt, Mycobacterium bovis subsp bovis AF2122/97
gcgccagcguaaauagcgcccug

SEQ ID NO: 3195527 - RNA, 22 nt, Mycobacterium bovis subsp bovis AF2122/97
gcgccagcguuaggucgccggc

SEQ ID NO: 3195528 - RNA, 13 nt, Mycobacterium bovis subsp bovis AF2122/97
gcgccagcuccgu

SEQ ID NO: 3195529 - RNA, 14 nt, Mycobacterium bovis subsp bovis AF2122/97
gcgccagcucggcg

SEQ ID NO: 3195530 - RNA, 18 nt, Mycobacterium bovis subsp bovis AF2122/97
gcgccaggagcgcggccc

SEQ ID NO: 3195531 - RNA, 23 nt, Mycobacterium bovis subsp bovis AF2122/97
gcgccaggagcgcggcccgccuc

SEQ ID NO: 3195532 - RNA, 17 nt, Mycobacterium bovis subsp bovis AF2122/97
gcgccaggaguggccac

SEQ ID NO: 3195533 - RNA, 13 nt, Mycobacterium bovis subsp bovis AF2122/97
gcgccaggccacg

SEQ ID NO: 3195534 - RNA, 17 nt, Mycobacterium bovis subsp bovis AF2122/97
gcgccaggccacguagc

SEQ ID NO: 3195535 - RNA, 17 nt, Mycobacterium bovis subsp bovis AF2122/97
gcgccaggccgcacagc

SEQ ID NO: 3195536 - RNA, 21 nt, Mycobacterium bovis subsp bovis AF2122/97
gcgccaggccgcacagcacca

SEQ ID NO: 3195537 - RNA, 14 nt, Mycobacterium bovis subsp bovis AF2122/97
gcgccaggccguug

SEQ ID NO: 3195538 - RNA, 19 nt, Mycobacterium bovis subsp bovis AF2122/97
gcgccaggcgcgaucgcgc

SEQ ID NO: 3195539 - RNA, 17 nt, Mycobacterium bovis subsp bovis AF2122/97
gcgccaggggugugccg

SEQ ID NO: 3195540 - RNA, 13 nt, Mycobacterium bovis subsp bovis AF2122/97
gcgccaggucagc

SEQ ID NO: 3195541 - RNA, 18 nt, Mycobacterium bovis subsp bovis AF2122/97
gcgccaggucagcucgag

SEQ ID NO: 3195542 - RNA, 21 nt, Mycobacterium bovis subsp bovis AF2122/97
gcgccaggucagcucgagcgc

SEQ ID NO: 3195543 - RNA, 17 nt, Mycobacterium bovis subsp bovis AF2122/97
gcgccaguaacgcccac

SEQ ID NO: 3195544 - RNA, 20 nt, Mycobacterium bovis subsp bovis AF2122/97
gcgccaguagcacguugacg

SEQ ID NO: 3195545 - RNA, 17 nt, Mycobacterium bovis subsp bovis AF2122/97
gcgccaguauggccgcc

SEQ ID NO: 3195546 - RNA, 19 nt, Mycobacterium bovis subsp bovis AF2122/97
gcgccaguauggccgccac

SEQ ID NO: 3195547 - RNA, 20 nt, Mycobacterium bovis subsp bovis AF2122/97
gcgccaguauggccgccacc

SEQ ID NO: 3195548 - RNA, 16 nt, Mycobacterium bovis subsp bovis AF2122/97
gcgccaguggccacca

SEQ ID NO: 3195549 - RNA, 18 nt, Mycobacterium bovis subsp bovis AF2122/97
gcgccaguggccaccauc

SEQ ID NO: 3195550 - RNA, 18 nt, Mycobacterium bovis subsp bovis AF2122/97
gcgccaguguggugcggc

SEQ ID NO: 3195551 - RNA, 20 nt, Mycobacterium bovis subsp bovis AF2122/97
gcgccaguguggugcggcgc

SEQ ID NO: 3195552 - RNA, 18 nt, Mycobacterium bovis subsp bovis AF2122/97
gcgccaguucgcggcugc

SEQ ID NO: 3195553 - RNA, 21 nt, Mycobacterium bovis subsp bovis AF2122/97
gcgccauaauauugccgccuc

SEQ ID NO: 3195554 - RNA, 22 nt, Mycobacterium bovis subsp bovis AF2122/97
gcgccauaauauugccgccucc

SEQ ID NO: 3195555 - RNA, 23 nt, Mycobacterium bovis subsp bovis AF2122/97
gcgccauaauauugccgccuccg

SEQ ID NO: 3195556 - RNA, 22 nt, Mycobacterium bovis subsp bovis AF2122/97
gcgccauacuggcgguccgaug

SEQ ID NO: 3195557 - RNA, 22 nt, Mycobacterium bovis subsp bovis AF2122/97
gcgccauagccgcgacccgcgc

SEQ ID NO: 3195558 - RNA, 12 nt, Mycobacterium bovis subsp bovis AF2122/97
gcgccauccccg

SEQ ID NO: 3195559 - RNA, 16 nt, Mycobacterium bovis subsp bovis AF2122/97
gcgccauccccgccgg

SEQ ID NO: 3195560 - RNA, 18 nt, Mycobacterium bovis subsp bovis AF2122/97
gcgccauccccgccggcg

SEQ ID NO: 3195561 - RNA, 20 nt, Mycobacterium bovis subsp bovis AF2122/97
gcgccauccccgccggcgcc

SEQ ID NO: 3195562 - RNA, 23 nt, Mycobacterium bovis subsp bovis AF2122/97
gcgccauccccgccggcgccacc

SEQ ID NO: 3195563 - RNA, 15 nt, Mycobacterium bovis subsp bovis AF2122/97
gcgccaucgccucca

SEQ ID NO: 3195564 - RNA, 16 nt, Mycobacterium bovis subsp bovis AF2122/97
gcgccaucgggucacc

SEQ ID NO: 3195565 - RNA, 20 nt, Mycobacterium bovis subsp bovis AF2122/97
gcgccaucgggucacccccg

SEQ ID NO: 3195566 - RNA, 21 nt, Mycobacterium bovis subsp bovis AF2122/97
gcgccaucgggucacccccgg

SEQ ID NO: 3195567 - RNA, 14 nt, Mycobacterium bovis subsp bovis AF2122/97
gcgccaucgucgcg

SEQ ID NO: 3195568 - RNA, 13 nt, Mycobacterium bovis subsp bovis AF2122/97
gcgccaucucgac

SEQ ID NO: 3195569 - RNA, 14 nt, Mycobacterium bovis subsp bovis AF2122/97
gcgccaucucgacg

SEQ ID NO: 3195570 - RNA, 15 nt, Mycobacterium bovis subsp bovis AF2122/97
gcgccaucucgacgg

SEQ ID NO: 3195571 - RNA, 18 nt, Mycobacterium bovis subsp bovis AF2122/97
gcgccaugaagccgggcg

SEQ ID NO: 3195572 - RNA, 18 nt, Mycobacterium bovis subsp bovis AF2122/97
gcgccaugcccucggcgc

SEQ ID NO: 3195573 - RNA, 22 nt, Mycobacterium bovis subsp bovis AF2122/97
gcgccaugcugucguagcgcga

SEQ ID NO: 3195574 - RNA, 16 nt, Mycobacterium bovis subsp bovis AF2122/97
gcgccauggucgcugc

SEQ ID NO: 3195575 - RNA, 21 nt, Mycobacterium bovis subsp bovis AF2122/97
gcgccauucccgguggcugug

SEQ ID NO: 3195576 - RNA, 17 nt, Mycobacterium bovis subsp bovis AF2122/97
gcgccauucgccccacc

SEQ ID NO: 3195577 - RNA, 20 nt, Mycobacterium bovis subsp bovis AF2122/97
gcgccauugcgggaacguca

SEQ ID NO: 3195578 - RNA, 16 nt, Mycobacterium bovis subsp bovis AF2122/97
gcgccauuggcgccgc

SEQ ID NO: 3195579 - RNA, 16 nt, Mycobacterium bovis subsp bovis AF2122/97
gcgccauuggcguccc

SEQ ID NO: 3195580 - RNA, 16 nt, Mycobacterium bovis subsp bovis AF2122/97
gcgccauuucgagggc

SEQ ID NO: 3195581 - RNA, 21 nt, Mycobacterium bovis subsp bovis AF2122/97
gcgccauuucgagggcaacgg

SEQ ID NO: 3195582 - RNA, 19 nt, Mycobacterium bovis subsp bovis AF2122/97
gcgcccaacgcgggugccg

SEQ ID NO: 3195583 - RNA, 23 nt, Mycobacterium bovis subsp bovis AF2122/97
gcgcccaauccaccgauucggcg

SEQ ID NO: 3195584 - RNA, 18 nt, Mycobacterium bovis subsp bovis AF2122/97
gcgcccacagcccgggcg

SEQ ID NO: 3195585 - RNA, 13 nt, Mycobacterium bovis subsp bovis AF2122/97
gcgcccacaucgu

SEQ ID NO: 3195586 - RNA, 21 nt, Mycobacterium bovis subsp bovis AF2122/97
gcgcccaccagcggcggcaac

SEQ ID NO: 3195587 - RNA, 21 nt, Mycobacterium bovis subsp bovis AF2122/97
gcgcccaccaugaucacaccg

SEQ ID NO: 3195588 - RNA, 17 nt, Mycobacterium bovis subsp bovis AF2122/97
gcgcccaccccggccgc

SEQ ID NO: 3195589 - RNA, 18 nt, Mycobacterium bovis subsp bovis AF2122/97
gcgcccaccccggccgca

SEQ ID NO: 3195590 - RNA, 14 nt, Mycobacterium bovis subsp bovis AF2122/97
gcgcccacccgcgc

SEQ ID NO: 3195591 - RNA, 15 nt, Mycobacterium bovis subsp bovis AF2122/97
gcgcccacccgcgcc

SEQ ID NO: 3195592 - RNA, 14 nt, Mycobacterium bovis subsp bovis AF2122/97
gcgcccaccgaaac

SEQ ID NO: 3195593 - RNA, 22 nt, Mycobacterium bovis subsp bovis AF2122/97
gcgcccaccgaaaccggucagc

SEQ ID NO: 3195594 - RNA, 15 nt, Mycobacterium bovis subsp bovis AF2122/97
gcgcccaccgaugcg

SEQ ID NO: 3195595 - RNA, 20 nt, Mycobacterium bovis subsp bovis AF2122/97
gcgcccaccggcuagcugug

SEQ ID NO: 3195596 - RNA, 22 nt, Mycobacterium bovis subsp bovis AF2122/97
gcgcccacuggugaucuggucc

SEQ ID NO: 3195597 - RNA, 12 nt, Mycobacterium bovis subsp bovis AF2122/97
gcgcccagaccg

SEQ ID NO: 3195598 - RNA, 16 nt, Mycobacterium bovis subsp bovis AF2122/97
gcgcccagaccgaccc

SEQ ID NO: 3195599 - RNA, 15 nt, Mycobacterium bovis subsp bovis AF2122/97
gcgcccagaucgccg

SEQ ID NO: 3195600 - RNA, 13 nt, Mycobacterium bovis subsp bovis AF2122/97
gcgcccagcacgu

SEQ ID NO: 3195601 - RNA, 14 nt, Mycobacterium bovis subsp bovis AF2122/97
gcgcccagcgaccc

SEQ ID NO: 3195602 - RNA, 12 nt, Mycobacterium bovis subsp bovis AF2122/97
gcgcccagcgcc

SEQ ID NO: 3195603 - RNA, 21 nt, Mycobacterium bovis subsp bovis AF2122/97
gcgcccagcgcuagccgggcg

SEQ ID NO: 3195604 - RNA, 13 nt, Mycobacterium bovis subsp bovis AF2122/97
gcgcccagcucga

SEQ ID NO: 3195605 - RNA, 15 nt, Mycobacterium bovis subsp bovis AF2122/97
gcgcccauagcugcc

SEQ ID NO: 3195606 - RNA, 18 nt, Mycobacterium bovis subsp bovis AF2122/97
gcgcccauagcugccggc

SEQ ID NO: 3195607 - RNA, 23 nt, Mycobacterium bovis subsp bovis AF2122/97
gcgcccauagcugccggcccacc

SEQ ID NO: 3195608 - RNA, 17 nt, Mycobacterium bovis subsp bovis AF2122/97
gcgcccauggccaccag

SEQ ID NO: 3195609 - RNA, 23 nt, Mycobacterium bovis subsp bovis AF2122/97
gcgcccauugacguagaccgucg

SEQ ID NO: 3195610 - RNA, 16 nt, Mycobacterium bovis subsp bovis AF2122/97
gcgccccaccgcgccg

SEQ ID NO: 3195611 - RNA, 17 nt, Mycobacterium bovis subsp bovis AF2122/97
gcgccccaccggcccgg

SEQ ID NO: 3195612 - RNA, 22 nt, Mycobacterium bovis subsp bovis AF2122/97
gcgccccaccggcccgggaaau

SEQ ID NO: 3195613 - RNA, 22 nt, Mycobacterium bovis subsp bovis AF2122/97
gcgccccaguucgacggcguca

SEQ ID NO: 3195614 - RNA, 17 nt, Mycobacterium bovis subsp bovis AF2122/97
gcgccccaugcaacaca

SEQ ID NO: 3195615 - RNA, 22 nt, Mycobacterium bovis subsp bovis AF2122/97
gcgccccaugcaacacaccgcg

SEQ ID NO: 3195616 - RNA, 14 nt, Mycobacterium bovis subsp bovis AF2122/97
gcgcccccagcagc

SEQ ID NO: 3195617 - RNA, 14 nt, Mycobacterium bovis subsp bovis AF2122/97
gcgcccccgccauu

SEQ ID NO: 3195618 - RNA, 15 nt, Mycobacterium bovis subsp bovis AF2122/97
gcgcccccggugccg

SEQ ID NO: 3195619 - RNA, 12 nt, Mycobacterium bovis subsp bovis AF2122/97
gcgccccgaugc

SEQ ID NO: 3195620 - RNA, 13 nt, Mycobacterium bovis subsp bovis AF2122/97
gcgccccgccgca

SEQ ID NO: 3195621 - RNA, 14 nt, Mycobacterium bovis subsp bovis AF2122/97
gcgccccgccgcac

SEQ ID NO: 3195622 - RNA, 13 nt, Mycobacterium bovis subsp bovis AF2122/97
gcgccccgcggca

SEQ ID NO: 3195623 - RNA, 14 nt, Mycobacterium bovis subsp bovis AF2122/97
gcgccccgcggucc

SEQ ID NO: 3195624 - RNA, 17 nt, Mycobacterium bovis subsp bovis AF2122/97
gcgccccggagccucga

SEQ ID NO: 3195625 - RNA, 13 nt, Mycobacterium bovis subsp bovis AF2122/97
gcgccccggcgcg

SEQ ID NO: 3195626 - RNA, 16 nt, Mycobacterium bovis subsp bovis AF2122/97
gcgccccuggcaccuc

SEQ ID NO: 3195627 - RNA, 15 nt, Mycobacterium bovis subsp bovis AF2122/97
gcgcccgaagccggg

SEQ ID NO: 3195628 - RNA, 20 nt, Mycobacterium bovis subsp bovis AF2122/97
gcgcccgaagccgggcccca

SEQ ID NO: 3195629 - RNA, 15 nt, Mycobacterium bovis subsp bovis AF2122/97
gcgcccgaaugcgac

SEQ ID NO: 3195630 - RNA, 17 nt, Mycobacterium bovis subsp bovis AF2122/97
gcgcccgaaugcgacgu

SEQ ID NO: 3195631 - RNA, 17 nt, Mycobacterium bovis subsp bovis AF2122/97
gcgcccgacgaacagcg

SEQ ID NO: 3195632 - RNA, 21 nt, Mycobacterium bovis subsp bovis AF2122/97
gcgcccgacggaguucgacgu

SEQ ID NO: 3195633 - RNA, 12 nt, Mycobacterium bovis subsp bovis AF2122/97
gcgcccgagccg

SEQ ID NO: 3195634 - RNA, 14 nt, Mycobacterium bovis subsp bovis AF2122/97
gcgcccgagccggu

SEQ ID NO: 3195635 - RNA, 12 nt, Mycobacterium bovis subsp bovis AF2122/97
gcgcccgauccg

SEQ ID NO: 3195636 - RNA, 14 nt, Mycobacterium bovis subsp bovis AF2122/97
gcgcccgcaccacc

SEQ ID NO: 3195637 - RNA, 18 nt, Mycobacterium bovis subsp bovis AF2122/97
gcgcccgcaccaccggcc

SEQ ID NO: 3195638 - RNA, 14 nt, Mycobacterium bovis subsp bovis AF2122/97
gcgcccgcaggugg

SEQ ID NO: 3195639 - RNA, 21 nt, Mycobacterium bovis subsp bovis AF2122/97
gcgcccgccaucagcccggcg

SEQ ID NO: 3195640 - RNA, 18 nt, Mycobacterium bovis subsp bovis AF2122/97
gcgcccgcccgagccgcu

SEQ ID NO: 3195641 - RNA, 22 nt, Mycobacterium bovis subsp bovis AF2122/97
gcgcccgcccgagccgcugcga

SEQ ID NO: 3195642 - RNA, 12 nt, Mycobacterium bovis subsp bovis AF2122/97
gcgcccgccgcg

SEQ ID NO: 3195643 - RNA, 23 nt, Mycobacterium bovis subsp bovis AF2122/97
gcgcccgccgcgaacuccagcag

SEQ ID NO: 3195644 - RNA, 14 nt, Mycobacterium bovis subsp bovis AF2122/97
gcgcccgccgcggc

SEQ ID NO: 3195645 - RNA, 21 nt, Mycobacterium bovis subsp bovis AF2122/97
gcgcccgccgcggcagcaucc

SEQ ID NO: 3195646 - RNA, 12 nt, Mycobacterium bovis subsp bovis AF2122/97
gcgcccgccggc

SEQ ID NO: 3195647 - RNA, 18 nt, Mycobacterium bovis subsp bovis AF2122/97
gcgcccgccggcaaccgg

SEQ ID NO: 3195648 - RNA, 21 nt, Mycobacterium bovis subsp bovis AF2122/97
gcgcccgccggcaaccgggag

SEQ ID NO: 3195649 - RNA, 13 nt, Mycobacterium bovis subsp bovis AF2122/97
gcgcccgccggcg

SEQ ID NO: 3195650 - RNA, 14 nt, Mycobacterium bovis subsp bovis AF2122/97
gcgcccgccggcgc

SEQ ID NO: 3195651 - RNA, 21 nt, Mycobacterium bovis subsp bovis AF2122/97
gcgcccgccggcgcgagccgg

SEQ ID NO: 3195652 - RNA, 19 nt, Mycobacterium bovis subsp bovis AF2122/97
gcgcccgccucgaccgcca

SEQ ID NO: 3195653 - RNA, 13 nt, Mycobacterium bovis subsp bovis AF2122/97
gcgcccgcgagag

SEQ ID NO: 3195654 - RNA, 19 nt, Mycobacterium bovis subsp bovis AF2122/97
gcgcccgcggccgccagcg

SEQ ID NO: 3195655 - RNA, 19 nt, Mycobacterium bovis subsp bovis AF2122/97
gcgcccgcgguccggcgaa

SEQ ID NO: 3195656 - RNA, 16 nt, Mycobacterium bovis subsp bovis AF2122/97
gcgcccgcgugacgcu

SEQ ID NO: 3195657 - RNA, 19 nt, Mycobacterium bovis subsp bovis AF2122/97
gcgcccgcuaacuggcccg

SEQ ID NO: 3195658 - RNA, 13 nt, Mycobacterium bovis subsp bovis AF2122/97
gcgcccgcucggc

SEQ ID NO: 3195659 - RNA, 22 nt, Mycobacterium bovis subsp bovis AF2122/97
gcgcccgcucggccgcagccag

SEQ ID NO: 3195660 - RNA, 21 nt, Mycobacterium bovis subsp bovis AF2122/97
gcgcccggauguccgccgacg

SEQ ID NO: 3195661 - RNA, 19 nt, Mycobacterium bovis subsp bovis AF2122/97
gcgcccggccaagccggcg

SEQ ID NO: 3195662 - RNA, 12 nt, Mycobacterium bovis subsp bovis AF2122/97
gcgcccggccac

SEQ ID NO: 3195663 - RNA, 20 nt, Mycobacterium bovis subsp bovis AF2122/97
gcgcccggccacuccaguac

SEQ ID NO: 3195664 - RNA, 13 nt, Mycobacterium bovis subsp bovis AF2122/97
gcgcccggccagg

SEQ ID NO: 3195665 - RNA, 15 nt, Mycobacterium bovis subsp bovis AF2122/97
gcgcccggcccgcca

SEQ ID NO: 3195666 - RNA, 18 nt, Mycobacterium bovis subsp bovis AF2122/97
gcgcccggcccgccaccc

SEQ ID NO: 3195667 - RNA, 12 nt, Mycobacterium bovis subsp bovis AF2122/97
gcgcccggcgca

SEQ ID NO: 3195668 - RNA, 13 nt, Mycobacterium bovis subsp bovis AF2122/97
gcgcccggcgcaa

SEQ ID NO: 3195669 - RNA, 18 nt, Mycobacterium bovis subsp bovis AF2122/97
gcgcccggcgcaagcgcc

SEQ ID NO: 3195670 - RNA, 20 nt, Mycobacterium bovis subsp bovis AF2122/97
gcgcccggcgcaagcgccgc

SEQ ID NO: 3195671 - RNA, 12 nt, Mycobacterium bovis subsp bovis AF2122/97
gcgcccggcgcu

SEQ ID NO: 3195672 - RNA, 17 nt, Mycobacterium bovis subsp bovis AF2122/97
gcgcccggcggaucccg

SEQ ID NO: 3195673 - RNA, 17 nt, Mycobacterium bovis subsp bovis AF2122/97
gcgcccggcguggugag

SEQ ID NO: 3195674 - RNA, 21 nt, Mycobacterium bovis subsp bovis AF2122/97
gcgcccgggaucggggcaccg

SEQ ID NO: 3195675 - RNA, 21 nt, Mycobacterium bovis subsp bovis AF2122/97
gcgcccgggcauccuucacca

SEQ ID NO: 3195676 - RNA, 16 nt, Mycobacterium bovis subsp bovis AF2122/97
gcgcccgggucccggc

SEQ ID NO: 3195677 - RNA, 19 nt, Mycobacterium bovis subsp bovis AF2122/97
gcgcccgggucccggcagc

SEQ ID NO: 3195678 - RNA, 17 nt, Mycobacterium bovis subsp bovis AF2122/97
gcgcccggucgagccag

SEQ ID NO: 3195679 - RNA, 17 nt, Mycobacterium bovis subsp bovis AF2122/97
gcgcccguccgcgcgcc

SEQ ID NO: 3195680 - RNA, 17 nt, Mycobacterium bovis subsp bovis AF2122/97
gcgcccgucuccagcac

SEQ ID NO: 3195681 - RNA, 14 nt, Mycobacterium bovis subsp bovis AF2122/97
gcgcccgugccgcc

SEQ ID NO: 3195682 - RNA, 19 nt, Mycobacterium bovis subsp bovis AF2122/97
gcgcccgugccgcccgcgc

SEQ ID NO: 3195683 - RNA, 16 nt, Mycobacterium bovis subsp bovis AF2122/97
gcgcccguuggccaag

SEQ ID NO: 3195684 - RNA, 16 nt, Mycobacterium bovis subsp bovis AF2122/97
gcgcccucagccgcgg

SEQ ID NO: 3195685 - RNA, 18 nt, Mycobacterium bovis subsp bovis AF2122/97
gcgcccucagccgcggcc

SEQ ID NO: 3195686 - RNA, 16 nt, Mycobacterium bovis subsp bovis AF2122/97
gcgcccugcgccacac

SEQ ID NO: 3195687 - RNA, 16 nt, Mycobacterium bovis subsp bovis AF2122/97
gcgcccuggccgcccu

SEQ ID NO: 3195688 - RNA, 23 nt, Mycobacterium bovis subsp bovis AF2122/97
gcgcccuggcgugugugcgccuc

SEQ ID NO: 3195689 - RNA, 21 nt, Mycobacterium bovis subsp bovis AF2122/97
gcgcccuuaagccggcgcggc

SEQ ID NO: 3195690 - RNA, 16 nt, Mycobacterium bovis subsp bovis AF2122/97
gcgcccuucagcacgg

SEQ ID NO: 3195691 - RNA, 16 nt, Mycobacterium bovis subsp bovis AF2122/97
gcgcccuugccggcga

SEQ ID NO: 3195692 - RNA, 16 nt, Mycobacterium bovis subsp bovis AF2122/97
gcgccgaaacagcacc

SEQ ID NO: 3195693 - RNA, 17 nt, Mycobacterium bovis subsp bovis AF2122/97
gcgccgaaacagcaccc

SEQ ID NO: 3195694 - RNA, 17 nt, Mycobacterium bovis subsp bovis AF2122/97
gcgccgaaaccacuucc

SEQ ID NO: 3195695 - RNA, 20 nt, Mycobacterium bovis subsp bovis AF2122/97
gcgccgaaaccacuuccggc

SEQ ID NO: 3195696 - RNA, 15 nt, Mycobacterium bovis subsp bovis AF2122/97
gcgccgaacaccaca

SEQ ID NO: 3195697 - RNA, 22 nt, Mycobacterium bovis subsp bovis AF2122/97
gcgccgaacaccacaccgagca

SEQ ID NO: 3195698 - RNA, 18 nt, Mycobacterium bovis subsp bovis AF2122/97
gcgccgaacaccggcucc

SEQ ID NO: 3195699 - RNA, 14 nt, Mycobacterium bovis subsp bovis AF2122/97
gcgccgaacacgca

SEQ ID NO: 3195700 - RNA, 23 nt, Mycobacterium bovis subsp bovis AF2122/97
gcgccgaacacgcacacgaucgc

SEQ ID NO: 3195701 - RNA, 14 nt, Mycobacterium bovis subsp bovis AF2122/97
gcgccgaaccagcg

SEQ ID NO: 3195702 - RNA, 22 nt, Mycobacterium bovis subsp bovis AF2122/97
gcgccgaacgcaacgccgaugg

SEQ ID NO: 3195703 - RNA, 15 nt, Mycobacterium bovis subsp bovis AF2122/97
gcgccgaacgccagc

SEQ ID NO: 3195704 - RNA, 14 nt, Mycobacterium bovis subsp bovis AF2122/97
gcgccgaaggccgc

SEQ ID NO: 3195705 - RNA, 15 nt, Mycobacterium bovis subsp bovis AF2122/97
gcgccgaaggccgcc

SEQ ID NO: 3195706 - RNA, 17 nt, Mycobacterium bovis subsp bovis AF2122/97
gcgccgaaggccgccac

SEQ ID NO: 3195707 - RNA, 18 nt, Mycobacterium bovis subsp bovis AF2122/97
gcgccgaaguagccgacc

SEQ ID NO: 3195708 - RNA, 19 nt, Mycobacterium bovis subsp bovis AF2122/97
gcgccgaaguagccgaccg

SEQ ID NO: 3195709 - RNA, 15 nt, Mycobacterium bovis subsp bovis AF2122/97
gcgccgaaugccacc

SEQ ID NO: 3195710 - RNA, 18 nt, Mycobacterium bovis subsp bovis AF2122/97
gcgccgaaugccaccucg

SEQ ID NO: 3195711 - RNA, 24 nt, Mycobacterium bovis subsp bovis AF2122/97
gcgccgaaugccaccucgacgcac

SEQ ID NO: 3195712 - RNA, 16 nt, Mycobacterium bovis subsp bovis AF2122/97
gcgccgaauggcggug

SEQ ID NO: 3195713 - RNA, 16 nt, Mycobacterium bovis subsp bovis AF2122/97
gcgccgaauucauccg

SEQ ID NO: 3195714 - RNA, 17 nt, Mycobacterium bovis subsp bovis AF2122/97
gcgccgaauuggcccgg

SEQ ID NO: 3195715 - RNA, 16 nt, Mycobacterium bovis subsp bovis AF2122/97
gcgccgacaccggcug

SEQ ID NO: 3195716 - RNA, 14 nt, Mycobacterium bovis subsp bovis AF2122/97
gcgccgacagccga

SEQ ID NO: 3195717 - RNA, 17 nt, Mycobacterium bovis subsp bovis AF2122/97
gcgccgacagccgaucc

SEQ ID NO: 3195718 - RNA, 23 nt, Mycobacterium bovis subsp bovis AF2122/97
gcgccgacagccgauccgaucgc

SEQ ID NO: 3195719 - RNA, 12 nt, Mycobacterium bovis subsp bovis AF2122/97
gcgccgaccaca

SEQ ID NO: 3195720 - RNA, 13 nt, Mycobacterium bovis subsp bovis AF2122/97
gcgccgaccaccg

SEQ ID NO: 3195721 - RNA, 15 nt, Mycobacterium bovis subsp bovis AF2122/97
gcgccgaccaccgcu

SEQ ID NO: 3195722 - RNA, 22 nt, Mycobacterium bovis subsp bovis AF2122/97
gcgccgaccagaacgacgccgc

SEQ ID NO: 3195723 - RNA, 18 nt, Mycobacterium bovis subsp bovis AF2122/97
gcgccgacccaacccgau

SEQ ID NO: 3195724 - RNA, 19 nt, Mycobacterium bovis subsp bovis AF2122/97
gcgccgacccgcgcgccgg

SEQ ID NO: 3195725 - RNA, 17 nt, Mycobacterium bovis subsp bovis AF2122/97
gcgccgaccgacgucgc

SEQ ID NO: 3195726 - RNA, 15 nt, Mycobacterium bovis subsp bovis AF2122/97
gcgccgaccucaucg

SEQ ID NO: 3195727 - RNA, 19 nt, Mycobacterium bovis subsp bovis AF2122/97
gcgccgaccucaucggcac

SEQ ID NO: 3195728 - RNA, 20 nt, Mycobacterium bovis subsp bovis AF2122/97
gcgccgaccucaucggcacc

SEQ ID NO: 3195729 - RNA, 21 nt, Mycobacterium bovis subsp bovis AF2122/97
gcgccgaccucaucggcaccg

SEQ ID NO: 3195730 - RNA, 17 nt, Mycobacterium bovis subsp bovis AF2122/97
gcgccgacgacuccggc

SEQ ID NO: 3195731 - RNA, 18 nt, Mycobacterium bovis subsp bovis AF2122/97
gcgccgacggccagcagg

SEQ ID NO: 3195732 - RNA, 14 nt, Mycobacterium bovis subsp bovis AF2122/97
gcgccgacggugca

SEQ ID NO: 3195733 - RNA, 20 nt, Mycobacterium bovis subsp bovis AF2122/97
gcgccgagagcaccgcucgg

SEQ ID NO: 3195734 - RNA, 17 nt, Mycobacterium bovis subsp bovis AF2122/97
gcgccgagauccacgcc

SEQ ID NO: 3195735 - RNA, 19 nt, Mycobacterium bovis subsp bovis AF2122/97
gcgccgagauccacgccag

SEQ ID NO: 3195736 - RNA, 17 nt, Mycobacterium bovis subsp bovis AF2122/97
gcgccgagccagcaccc

SEQ ID NO: 3195737 - RNA, 18 nt, Mycobacterium bovis subsp bovis AF2122/97
gcgccgagccagcacccg

SEQ ID NO: 3195738 - RNA, 20 nt, Mycobacterium bovis subsp bovis AF2122/97
gcgccgagccagcacccgca

SEQ ID NO: 3195739 - RNA, 13 nt, Mycobacterium bovis subsp bovis AF2122/97
gcgccgagcccgg

SEQ ID NO: 3195740 - RNA, 18 nt, Mycobacterium bovis subsp bovis AF2122/97
gcgccgagcccgggccug

SEQ ID NO: 3195741 - RNA, 20 nt, Mycobacterium bovis subsp bovis AF2122/97
gcgccgaggucgaacgcccg

SEQ ID NO: 3195742 - RNA, 20 nt, Mycobacterium bovis subsp bovis AF2122/97
gcgccgaguuguucgcccac

SEQ ID NO: 3195743 - RNA, 18 nt, Mycobacterium bovis subsp bovis AF2122/97
gcgccgauacccagcggg

SEQ ID NO: 3195744 - RNA, 22 nt, Mycobacterium bovis subsp bovis AF2122/97
gcgccgauacccagcgggucgc

SEQ ID NO: 3195745 - RNA, 18 nt, Mycobacterium bovis subsp bovis AF2122/97
gcgccgauaccggcggcg

SEQ ID NO: 3195746 - RNA, 15 nt, Mycobacterium bovis subsp bovis AF2122/97
gcgccgaucaccacc

SEQ ID NO: 3195747 - RNA, 19 nt, Mycobacterium bovis subsp bovis AF2122/97
gcgccgaucacggugggcg

SEQ ID NO: 3195748 - RNA, 23 nt, Mycobacterium bovis subsp bovis AF2122/97
gcgccgaucacggugggcgccga

SEQ ID NO: 3195749 - RNA, 13 nt, Mycobacterium bovis subsp bovis AF2122/97
gcgccgaucagcg

SEQ ID NO: 3195750 - RNA, 14 nt, Mycobacterium bovis subsp bovis AF2122/97
gcgccgaucagcga

SEQ ID NO: 3195751 - RNA, 16 nt, Mycobacterium bovis subsp bovis AF2122/97
gcgccgaucggcaccg

SEQ ID NO: 3195752 - RNA, 20 nt, Mycobacterium bovis subsp bovis AF2122/97
gcgccgaucuucgcgcgcuc

SEQ ID NO: 3195753 - RNA, 17 nt, Mycobacterium bovis subsp bovis AF2122/97
gcgccgaugaacguggc

SEQ ID NO: 3195754 - RNA, 19 nt, Mycobacterium bovis subsp bovis AF2122/97
gcgccgaugaacguggcga

SEQ ID NO: 3195755 - RNA, 20 nt, Mycobacterium bovis subsp bovis AF2122/97
gcgccgaugaacguggcgac

SEQ ID NO: 3195756 - RNA, 19 nt, Mycobacterium bovis subsp bovis AF2122/97
gcgccgaugaccgcaaccg

SEQ ID NO: 3195757 - RNA, 16 nt, Mycobacterium bovis subsp bovis AF2122/97
gcgccgaugccggcca

SEQ ID NO: 3195758 - RNA, 14 nt, Mycobacterium bovis subsp bovis AF2122/97
gcgccgauggccgc

SEQ ID NO: 3195759 - RNA, 20 nt, Mycobacterium bovis subsp bovis AF2122/97
gcgccgauguggccggcgau

SEQ ID NO: 3195760 - RNA, 23 nt, Mycobacterium bovis subsp bovis AF2122/97
gcgccgauguggccggcgauggc

SEQ ID NO: 3195761 - RNA, 16 nt, Mycobacterium bovis subsp bovis AF2122/97
gcgccgauuccaccgc

SEQ ID NO: 3195762 - RNA, 19 nt, Mycobacterium bovis subsp bovis AF2122/97
gcgccgauuccaccgccga

SEQ ID NO: 3195763 - RNA, 20 nt, Mycobacterium bovis subsp bovis AF2122/97
gcgccgauuccaccgccgac

SEQ ID NO: 3195764 - RNA, 23 nt, Mycobacterium bovis subsp bovis AF2122/97
gcgccgauuccaccgccgacgcc

SEQ ID NO: 3195765 - RNA, 19 nt, Mycobacterium bovis subsp bovis AF2122/97
gcgccgcaaucagacggcg

SEQ ID NO: 3195766 - RNA, 20 nt, Mycobacterium bovis subsp bovis AF2122/97
gcgccgcaaucagacggcga

SEQ ID NO: 3195767 - RNA, 17 nt, Mycobacterium bovis subsp bovis AF2122/97
gcgccgcaaugacgucg

SEQ ID NO: 3195768 - RNA, 18 nt, Mycobacterium bovis subsp bovis AF2122/97
gcgccgcaaugacgucgu

SEQ ID NO: 3195769 - RNA, 14 nt, Mycobacterium bovis subsp bovis AF2122/97
gcgccgcacacguc

SEQ ID NO: 3195770 - RNA, 15 nt, Mycobacterium bovis subsp bovis AF2122/97
gcgccgcacacucuc

SEQ ID NO: 3195771 - RNA, 22 nt, Mycobacterium bovis subsp bovis AF2122/97
gcgccgcacagaaaacgauggu

SEQ ID NO: 3195772 - RNA, 21 nt, Mycobacterium bovis subsp bovis AF2122/97
gcgccgcacagagugaggcgc

SEQ ID NO: 3195773 - RNA, 20 nt, Mycobacterium bovis subsp bovis AF2122/97
gcgccgcaccaagcagcgac

SEQ ID NO: 3195774 - RNA, 14 nt, Mycobacterium bovis subsp bovis AF2122/97
gcgccgcaccaucg

SEQ ID NO: 3195775 - RNA, 17 nt, Mycobacterium bovis subsp bovis AF2122/97
gcgccgcaccaucggcg

SEQ ID NO: 3195776 - RNA, 12 nt, Mycobacterium bovis subsp bovis AF2122/97
gcgccgcacccg

SEQ ID NO: 3195777 - RNA, 17 nt, Mycobacterium bovis subsp bovis AF2122/97
gcgccgcacccgggacg

SEQ ID NO: 3195778 - RNA, 13 nt, Mycobacterium bovis subsp bovis AF2122/97
gcgccgcacgccg

SEQ ID NO: 3195779 - RNA, 16 nt, Mycobacterium bovis subsp bovis AF2122/97
gcgccgcacggcgacg

SEQ ID NO: 3195780 - RNA, 19 nt, Mycobacterium bovis subsp bovis AF2122/97
gcgccgcagagcaccgcga

SEQ ID NO: 3195781 - RNA, 17 nt, Mycobacterium bovis subsp bovis AF2122/97
gcgccgcagaucaccgc

SEQ ID NO: 3195782 - RNA, 20 nt, Mycobacterium bovis subsp bovis AF2122/97
gcgccgcagaucaccgccag

SEQ ID NO: 3195783 - RNA, 21 nt, Mycobacterium bovis subsp bovis AF2122/97
gcgccgcagaucaccgccagc

SEQ ID NO: 3195784 - RNA, 21 nt, Mycobacterium bovis subsp bovis AF2122/97
gcgccgcagcaggugcaucgc

SEQ ID NO: 3195785 - RNA, 17 nt, Mycobacterium bovis subsp bovis AF2122/97
gcgccgcagcgauaucc

SEQ ID NO: 3195786 - RNA, 14 nt, Mycobacterium bovis subsp bovis AF2122/97
gcgccgcagggccg

SEQ ID NO: 3195787 - RNA, 16 nt, Mycobacterium bovis subsp bovis AF2122/97
gcgccgcagggccgcg

SEQ ID NO: 3195788 - RNA, 13 nt, Mycobacterium bovis subsp bovis AF2122/97
gcgccgcaggguc

SEQ ID NO: 3195789 - RNA, 17 nt, Mycobacterium bovis subsp bovis AF2122/97
gcgccgcauaccaguac

SEQ ID NO: 3195790 - RNA, 22 nt, Mycobacterium bovis subsp bovis AF2122/97
gcgccgcaucauagacagggcc

SEQ ID NO: 3195791 - RNA, 15 nt, Mycobacterium bovis subsp bovis AF2122/97
gcgccgcauccagcc

SEQ ID NO: 3195792 - RNA, 21 nt, Mycobacterium bovis subsp bovis AF2122/97
gcgccgcauccagccgugcgg

SEQ ID NO: 3195793 - RNA, 14 nt, Mycobacterium bovis subsp bovis AF2122/97
gcgccgcaucggcg

SEQ ID NO: 3195794 - RNA, 14 nt, Mycobacterium bovis subsp bovis AF2122/97
gcgccgcauucgcg

SEQ ID NO: 3195795 - RNA, 14 nt, Mycobacterium bovis subsp bovis AF2122/97
gcgccgccaacucc

SEQ ID NO: 3195796 - RNA, 20 nt, Mycobacterium bovis subsp bovis AF2122/97
gcgccgccaacuccucagcc

SEQ ID NO: 3195797 - RNA, 23 nt, Mycobacterium bovis subsp bovis AF2122/97
gcgccgccaacuccucagccgcc

SEQ ID NO: 3195798 - RNA, 17 nt, Mycobacterium bovis subsp bovis AF2122/97
gcgccgccaagggcccc

SEQ ID NO: 3195799 - RNA, 12 nt, Mycobacterium bovis subsp bovis AF2122/97
gcgccgccacag

SEQ ID NO: 3195800 - RNA, 14 nt, Mycobacterium bovis subsp bovis AF2122/97
gcgccgccacagca

SEQ ID NO: 3195801 - RNA, 16 nt, Mycobacterium bovis subsp bovis AF2122/97
gcgccgccacagcacc

SEQ ID NO: 3195802 - RNA, 19 nt, Mycobacterium bovis subsp bovis AF2122/97
gcgccgccacagcacccac

SEQ ID NO: 3195803 - RNA, 20 nt, Mycobacterium bovis subsp bovis AF2122/97
gcgccgccaccccgcgcgcc

SEQ ID NO: 3195804 - RNA, 19 nt, Mycobacterium bovis subsp bovis AF2122/97
gcgccgccaccgaagccgc

SEQ ID NO: 3195805 - RNA, 22 nt, Mycobacterium bovis subsp bovis AF2122/97
gcgccgccaccgaagccgccgg

SEQ ID NO: 3195806 - RNA, 23 nt, Mycobacterium bovis subsp bovis AF2122/97
gcgccgccaccgaagccgccggg

SEQ ID NO: 3195807 - RNA, 14 nt, Mycobacterium bovis subsp bovis AF2122/97
gcgccgccacugcc

SEQ ID NO: 3195808 - RNA, 17 nt, Mycobacterium bovis subsp bovis AF2122/97
gcgccgccacugccggc

SEQ ID NO: 3195809 - RNA, 17 nt, Mycobacterium bovis subsp bovis AF2122/97
gcgccgccagcaccacc

SEQ ID NO: 3195810 - RNA, 18 nt, Mycobacterium bovis subsp bovis AF2122/97
gcgccgccagcaccaccg

SEQ ID NO: 3195811 - RNA, 19 nt, Mycobacterium bovis subsp bovis AF2122/97
gcgccgccagcgccgccgg

SEQ ID NO: 3195812 - RNA, 15 nt, Mycobacterium bovis subsp bovis AF2122/97
gcgccgccagucguc

SEQ ID NO: 3195813 - RNA, 16 nt, Mycobacterium bovis subsp bovis AF2122/97
gcgccgccauugccau

SEQ ID NO: 3195814 - RNA, 14 nt, Mycobacterium bovis subsp bovis AF2122/97
gcgccgcccaacgc

SEQ ID NO: 3195815 - RNA, 15 nt, Mycobacterium bovis subsp bovis AF2122/97
gcgccgcccaacgcg

SEQ ID NO: 3195816 - RNA, 18 nt, Mycobacterium bovis subsp bovis AF2122/97
gcgccgcccaacgcgagc

SEQ ID NO: 3195817 - RNA, 18 nt, Mycobacterium bovis subsp bovis AF2122/97
gcgccgcccaauccaccg

SEQ ID NO: 3195818 - RNA, 15 nt, Mycobacterium bovis subsp bovis AF2122/97
gcgccgcccagcauc

SEQ ID NO: 3195819 - RNA, 20 nt, Mycobacterium bovis subsp bovis AF2122/97
gcgccgccccauacuugcgc

SEQ ID NO: 3195820 - RNA, 17 nt, Mycobacterium bovis subsp bovis AF2122/97
gcgccgccccgcucggu

SEQ ID NO: 3195821 - RNA, 14 nt, Mycobacterium bovis subsp bovis AF2122/97
gcgccgcccgcgcc

SEQ ID NO: 3195822 - RNA, 16 nt, Mycobacterium bovis subsp bovis AF2122/97
gcgccgcccgcgccac

SEQ ID NO: 3195823 - RNA, 17 nt, Mycobacterium bovis subsp bovis AF2122/97
gcgccgcccgcgccacc

SEQ ID NO: 3195824 - RNA, 18 nt, Mycobacterium bovis subsp bovis AF2122/97
gcgccgcccgcgccaccg

SEQ ID NO: 3195825 - RNA, 19 nt, Mycobacterium bovis subsp bovis AF2122/97
gcgccgcccgcgcccccgg

SEQ ID NO: 3195826 - RNA, 22 nt, Mycobacterium bovis subsp bovis AF2122/97
gcgccgcccgcgcccccggugc

SEQ ID NO: 3195827 - RNA, 18 nt, Mycobacterium bovis subsp bovis AF2122/97
gcgccgcccgcuccuccg

SEQ ID NO: 3195828 - RNA, 20 nt, Mycobacterium bovis subsp bovis AF2122/97
gcgccgcccgcuccuccggc

SEQ ID NO: 3195829 - RNA, 23 nt, Mycobacterium bovis subsp bovis AF2122/97
gcgccgcccgcuccuccggcacc

SEQ ID NO: 3195830 - RNA, 12 nt, Mycobacterium bovis subsp bovis AF2122/97
gcgccgccgagg

SEQ ID NO: 3195831 - RNA, 13 nt, Mycobacterium bovis subsp bovis AF2122/97
gcgccgccgaucc

SEQ ID NO: 3195832 - RNA, 19 nt, Mycobacterium bovis subsp bovis AF2122/97
gcgccgccgaucccgucgg

SEQ ID NO: 3195833 - RNA, 10 nt, Mycobacterium bovis subsp bovis AF2122/97
gcgccgccgc

SEQ ID NO: 3195834 - RNA, 15 nt, Mycobacterium bovis subsp bovis AF2122/97
gcgccgccgccacca

SEQ ID NO: 3195835 - RNA, 14 nt, Mycobacterium bovis subsp bovis AF2122/97
gcgccgccgccgac

SEQ ID NO: 3195836 - RNA, 17 nt, Mycobacterium bovis subsp bovis AF2122/97
gcgccgccgcgagcgcc

SEQ ID NO: 3195837 - RNA, 14 nt, Mycobacterium bovis subsp bovis AF2122/97
gcgccgccgcuacc

SEQ ID NO: 3195838 - RNA, 14 nt, Mycobacterium bovis subsp bovis AF2122/97
gcgccgccggaagc

SEQ ID NO: 3195839 - RNA, 22 nt, Mycobacterium bovis subsp bovis AF2122/97
gcgccgccggaagcgccggccg

SEQ ID NO: 3195840 - RNA, 20 nt, Mycobacterium bovis subsp bovis AF2122/97
gcgccgccggacccaccguc

SEQ ID NO: 3195841 - RNA, 14 nt, Mycobacterium bovis subsp bovis AF2122/97
gcgccgccggcacc

SEQ ID NO: 3195842 - RNA, 18 nt, Mycobacterium bovis subsp bovis AF2122/97
gcgccgccggcacccgcc

SEQ ID NO: 3195843 - RNA, 20 nt, Mycobacterium bovis subsp bovis AF2122/97
gcgccgccggcacccgccgu

SEQ ID NO: 3195844 - RNA, 15 nt, Mycobacterium bovis subsp bovis AF2122/97
gcgccgccggcaccg

SEQ ID NO: 3195845 - RNA, 17 nt, Mycobacterium bovis subsp bovis AF2122/97
gcgccgccggcaccgcc

SEQ ID NO: 3195846 - RNA, 19 nt, Mycobacterium bovis subsp bovis AF2122/97
gcgccgccggcaccgccgg

SEQ ID NO: 3195847 - RNA, 14 nt, Mycobacterium bovis subsp bovis AF2122/97
gcgccgccggcgcc

SEQ ID NO: 3195848 - RNA, 15 nt, Mycobacterium bovis subsp bovis AF2122/97
gcgccgccggcgccg

SEQ ID NO: 3195849 - RNA, 15 nt, Mycobacterium bovis subsp bovis AF2122/97
gcgccgccggcgcgu

SEQ ID NO: 3195850 - RNA, 13 nt, Mycobacterium bovis subsp bovis AF2122/97
gcgccgccggcgg

SEQ ID NO: 3195851 - RNA, 16 nt, Mycobacterium bovis subsp bovis AF2122/97
gcgccgccggcggcgg

SEQ ID NO: 3195852 - RNA, 21 nt, Mycobacterium bovis subsp bovis AF2122/97
gcgccgccggcucgccggcga

SEQ ID NO: 3195853 - RNA, 14 nt, Mycobacterium bovis subsp bovis AF2122/97
gcgccgccggugcc

SEQ ID NO: 3195854 - RNA, 18 nt, Mycobacterium bovis subsp bovis AF2122/97
gcgccgccguccagcgcc

SEQ ID NO: 3195855 - RNA, 14 nt, Mycobacterium bovis subsp bovis AF2122/97
gcgccgccgucgcc

SEQ ID NO: 3195856 - RNA, 20 nt, Mycobacterium bovis subsp bovis AF2122/97
gcgccgccguuaccgccggc

SEQ ID NO: 3195857 - RNA, 21 nt, Mycobacterium bovis subsp bovis AF2122/97
gcgccgccguucccgccggcg

SEQ ID NO: 3195858 - RNA, 14 nt, Mycobacterium bovis subsp bovis AF2122/97
gcgccgccguugcc

SEQ ID NO: 3195859 - RNA, 18 nt, Mycobacterium bovis subsp bovis AF2122/97
gcgccgccucgggcaccu

SEQ ID NO: 3195860 - RNA, 20 nt, Mycobacterium bovis subsp bovis AF2122/97
gcgccgccuggacgccgccg

SEQ ID NO: 3195861 - RNA, 22 nt, Mycobacterium bovis subsp bovis AF2122/97
gcgccgcgacaaaucggucgac

SEQ ID NO: 3195862 - RNA, 17 nt, Mycobacterium bovis subsp bovis AF2122/97
gcgccgcgacgaugccu

SEQ ID NO: 3195863 - RNA, 17 nt, Mycobacterium bovis subsp bovis AF2122/97
gcgccgcgccgauucca

SEQ ID NO: 3195864 - RNA, 14 nt, Mycobacterium bovis subsp bovis AF2122/97
gcgccgcgccgccu

SEQ ID NO: 3195865 - RNA, 16 nt, Mycobacterium bovis subsp bovis AF2122/97
gcgccgcgccgcgccg

SEQ ID NO: 3195866 - RNA, 15 nt, Mycobacterium bovis subsp bovis AF2122/97
gcgccgcgccguccc

SEQ ID NO: 3195867 - RNA, 14 nt, Mycobacterium bovis subsp bovis AF2122/97
gcgccgcgcgcauu

SEQ ID NO: 3195868 - RNA, 13 nt, Mycobacterium bovis subsp bovis AF2122/97
gcgccgcgcgcgg

SEQ ID NO: 3195869 - RNA, 14 nt, Mycobacterium bovis subsp bovis AF2122/97
gcgccgcgcgggug

SEQ ID NO: 3195870 - RNA, 13 nt, Mycobacterium bovis subsp bovis AF2122/97
gcgccgcgcucga

SEQ ID NO: 3195871 - RNA, 17 nt, Mycobacterium bovis subsp bovis AF2122/97
gcgccgcgcucgccgau

SEQ ID NO: 3195872 - RNA, 14 nt, Mycobacterium bovis subsp bovis AF2122/97
gcgccgcgcuugcg

SEQ ID NO: 3195873 - RNA, 22 nt, Mycobacterium bovis subsp bovis AF2122/97
gcgccgcgcuugcgaucggcac

SEQ ID NO: 3195874 - RNA, 12 nt, Mycobacterium bovis subsp bovis AF2122/97
gcgccgcggccc

SEQ ID NO: 3195875 - RNA, 13 nt, Mycobacterium bovis subsp bovis AF2122/97
gcgccgcggcccg

SEQ ID NO: 3195876 - RNA, 18 nt, Mycobacterium bovis subsp bovis AF2122/97
gcgccgcggcccgcucca

SEQ ID NO: 3195877 - RNA, 14 nt, Mycobacterium bovis subsp bovis AF2122/97
gcgccgcggcgacg

SEQ ID NO: 3195878 - RNA, 15 nt, Mycobacterium bovis subsp bovis AF2122/97
gcgccgcggcgacgu

SEQ ID NO: 3195879 - RNA, 13 nt, Mycobacterium bovis subsp bovis AF2122/97
gcgccgcggcgga

SEQ ID NO: 3195880 - RNA, 12 nt, Mycobacterium bovis subsp bovis AF2122/97
gcgccgcggcua

SEQ ID NO: 3195881 - RNA, 23 nt, Mycobacterium bovis subsp bovis AF2122/97
gcgccgcggcugggggauaccgc

SEQ ID NO: 3195882 - RNA, 14 nt, Mycobacterium bovis subsp bovis AF2122/97
gcgccgcguggcug

SEQ ID NO: 3195883 - RNA, 17 nt, Mycobacterium bovis subsp bovis AF2122/97
gcgccgcguggcuggcg

SEQ ID NO: 3195884 - RNA, 19 nt, Mycobacterium bovis subsp bovis AF2122/97
gcgccgcguggcuggcggc

SEQ ID NO: 3195885 - RNA, 23 nt, Mycobacterium bovis subsp bovis AF2122/97
gcgccgcguggcuggcggcgacc

SEQ ID NO: 3195886 - RNA, 24 nt, Mycobacterium bovis subsp bovis AF2122/97
gcgccgcguggcuggcggcgaccg

SEQ ID NO: 3195887 - RNA, 21 nt, Mycobacterium bovis subsp bovis AF2122/97
gcgccgcuaggugacgccgcc

SEQ ID NO: 3195888 - RNA, 22 nt, Mycobacterium bovis subsp bovis AF2122/97
gcgccgcuaggugacgccgcca

SEQ ID NO: 3195889 - RNA, 21 nt, Mycobacterium bovis subsp bovis AF2122/97
gcgccgcugacuccugcggca

SEQ ID NO: 3195890 - RNA, 18 nt, Mycobacterium bovis subsp bovis AF2122/97
gcgccgcuuggcgauccg

SEQ ID NO: 3195891 - RNA, 22 nt, Mycobacterium bovis subsp bovis AF2122/97
gcgccggaacgagcggccgcgc

SEQ ID NO: 3195892 - RNA, 16 nt, Mycobacterium bovis subsp bovis AF2122/97
gcgccggaccagcucc

SEQ ID NO: 3195893 - RNA, 17 nt, Mycobacterium bovis subsp bovis AF2122/97
gcgccggaccagcuccu

SEQ ID NO: 3195894 - RNA, 17 nt, Mycobacterium bovis subsp bovis AF2122/97
gcgccggagaucgucgc

SEQ ID NO: 3195895 - RNA, 18 nt, Mycobacterium bovis subsp bovis AF2122/97
gcgccggagaucgucgcg

SEQ ID NO: 3195896 - RNA, 16 nt, Mycobacterium bovis subsp bovis AF2122/97
gcgccggagccaacgg

SEQ ID NO: 3195897 - RNA, 16 nt, Mycobacterium bovis subsp bovis AF2122/97
gcgccggaggcggcgc

SEQ ID NO: 3195898 - RNA, 24 nt, Mycobacterium bovis subsp bovis AF2122/97
gcgccggaguugaagaagcccgac

SEQ ID NO: 3195899 - RNA, 16 nt, Mycobacterium bovis subsp bovis AF2122/97
gcgccggauccacacc

SEQ ID NO: 3195900 - RNA, 23 nt, Mycobacterium bovis subsp bovis AF2122/97
gcgccggauggguggccagcaac

SEQ ID NO: 3195901 - RNA, 14 nt, Mycobacterium bovis subsp bovis AF2122/97
gcgccggcaucgcg

SEQ ID NO: 3195902 - RNA, 15 nt, Mycobacterium bovis subsp bovis AF2122/97
gcgccggcaucgcgc

SEQ ID NO: 3195903 - RNA, 23 nt, Mycobacterium bovis subsp bovis AF2122/97
gcgccggcaucuccaccgucgcc

SEQ ID NO: 3195904 - RNA, 18 nt, Mycobacterium bovis subsp bovis AF2122/97
gcgccggccacgagucgc

SEQ ID NO: 3195905 - RNA, 12 nt, Mycobacterium bovis subsp bovis AF2122/97
gcgccggccagg

SEQ ID NO: 3195906 - RNA, 15 nt, Mycobacterium bovis subsp bovis AF2122/97
gcgccggccaggcua

SEQ ID NO: 3195907 - RNA, 23 nt, Mycobacterium bovis subsp bovis AF2122/97
gcgccggccaggcuauggugccg

SEQ ID NO: 3195908 - RNA, 12 nt, Mycobacterium bovis subsp bovis AF2122/97
gcgccggccagu

SEQ ID NO: 3195909 - RNA, 14 nt, Mycobacterium bovis subsp bovis AF2122/97
gcgccggccaugcc

SEQ ID NO: 3195910 - RNA, 17 nt, Mycobacterium bovis subsp bovis AF2122/97
gcgccggccgcacgccg

SEQ ID NO: 3195911 - RNA, 23 nt, Mycobacterium bovis subsp bovis AF2122/97
gcgccggccgcacgccggccagc

SEQ ID NO: 3195912 - RNA, 12 nt, Mycobacterium bovis subsp bovis AF2122/97
gcgccggccgcg

SEQ ID NO: 3195913 - RNA, 16 nt, Mycobacterium bovis subsp bovis AF2122/97
gcgccggccgcggcgg

SEQ ID NO: 3195914 - RNA, 21 nt, Mycobacterium bovis subsp bovis AF2122/97
gcgccggccgcggcggccccg

SEQ ID NO: 3195915 - RNA, 18 nt, Mycobacterium bovis subsp bovis AF2122/97
gcgccggccgcgggucgc

SEQ ID NO: 3195916 - RNA, 13 nt, Mycobacterium bovis subsp bovis AF2122/97
gcgccggccgcug

SEQ ID NO: 3195917 - RNA, 17 nt, Mycobacterium bovis subsp bovis AF2122/97
gcgccggccgcugccuu

SEQ ID NO: 3195918 - RNA, 11 nt, Mycobacterium bovis subsp bovis AF2122/97
gcgccggccgg

SEQ ID NO: 3195919 - RNA, 17 nt, Mycobacterium bovis subsp bovis AF2122/97
gcgccggccggcgcagu

SEQ ID NO: 3195920 - RNA, 16 nt, Mycobacterium bovis subsp bovis AF2122/97
gcgccggccucgccgg

SEQ ID NO: 3195921 - RNA, 13 nt, Mycobacterium bovis subsp bovis AF2122/97
gcgccggcgccuc

SEQ ID NO: 3195922 - RNA, 18 nt, Mycobacterium bovis subsp bovis AF2122/97
gcgccggcgcgucggcac

SEQ ID NO: 3195923 - RNA, 16 nt, Mycobacterium bovis subsp bovis AF2122/97
gcgccggcgcugcugc

SEQ ID NO: 3195924 - RNA, 17 nt, Mycobacterium bovis subsp bovis AF2122/97
gcgccggcgcugcugcc

SEQ ID NO: 3195925 - RNA, 20 nt, Mycobacterium bovis subsp bovis AF2122/97
gcgccggcggaccccucgac

SEQ ID NO: 3195926 - RNA, 11 nt, Mycobacterium bovis subsp bovis AF2122/97
gcgccggcggc

SEQ ID NO: 3195927 - RNA, 21 nt, Mycobacterium bovis subsp bovis AF2122/97
gcgccggcggcaaagaacagc

SEQ ID NO: 3195928 - RNA, 12 nt, Mycobacterium bovis subsp bovis AF2122/97
gcgccggcggcc

SEQ ID NO: 3195929 - RNA, 13 nt, Mycobacterium bovis subsp bovis AF2122/97
gcgccggcggcca

SEQ ID NO: 3195930 - RNA, 15 nt, Mycobacterium bovis subsp bovis AF2122/97
gcgccggcggccacc

SEQ ID NO: 3195931 - RNA, 16 nt, Mycobacterium bovis subsp bovis AF2122/97
gcgccggcggccaccu

SEQ ID NO: 3195932 - RNA, 13 nt, Mycobacterium bovis subsp bovis AF2122/97
gcgccggcggccg

SEQ ID NO: 3195933 - RNA, 14 nt, Mycobacterium bovis subsp bovis AF2122/97
gcgccggcggccgc

SEQ ID NO: 3195934 - RNA, 21 nt, Mycobacterium bovis subsp bovis AF2122/97
gcgccggcgggcgcgggcgcc

SEQ ID NO: 3195935 - RNA, 20 nt, Mycobacterium bovis subsp bovis AF2122/97
gcgccggcgguagucggcca

SEQ ID NO: 3195936 - RNA, 16 nt, Mycobacterium bovis subsp bovis AF2122/97
gcgccggcgucggcgc

SEQ ID NO: 3195937 - RNA, 21 nt, Mycobacterium bovis subsp bovis AF2122/97
gcgccggcgucggcgcccagc

SEQ ID NO: 3195938 - RNA, 18 nt, Mycobacterium bovis subsp bovis AF2122/97
gcgccggcgucggucguc

SEQ ID NO: 3195939 - RNA, 12 nt, Mycobacterium bovis subsp bovis AF2122/97
gcgccggcguuu

SEQ ID NO: 3195940 - RNA, 16 nt, Mycobacterium bovis subsp bovis AF2122/97
gcgccggcuagggccc

SEQ ID NO: 3195941 - RNA, 23 nt, Mycobacterium bovis subsp bovis AF2122/97
gcgccggcuagggcccuggcggc

SEQ ID NO: 3195942 - RNA, 20 nt, Mycobacterium bovis subsp bovis AF2122/97
gcgccggcugccacacaggc

SEQ ID NO: 3195943 - RNA, 23 nt, Mycobacterium bovis subsp bovis AF2122/97
gcgccggcugccacacaggcguc

SEQ ID NO: 3195944 - RNA, 14 nt, Mycobacterium bovis subsp bovis AF2122/97
gcgccgggcggcgc

SEQ ID NO: 3195945 - RNA, 19 nt, Mycobacterium bovis subsp bovis AF2122/97
gcgccgggcguccgccggc

SEQ ID NO: 3195946 - RNA, 21 nt, Mycobacterium bovis subsp bovis AF2122/97
gcgccgggcguccgccggcga

SEQ ID NO: 3195947 - RNA, 18 nt, Mycobacterium bovis subsp bovis AF2122/97
gcgccggggacacagcgu

SEQ ID NO: 3195948 - RNA, 22 nt, Mycobacterium bovis subsp bovis AF2122/97
gcgccggggacacagcguccgu

SEQ ID NO: 3195949 - RNA, 17 nt, Mycobacterium bovis subsp bovis AF2122/97
gcgccggggccgccgau

SEQ ID NO: 3195950 - RNA, 14 nt, Mycobacterium bovis subsp bovis AF2122/97
gcgccggggcgcag

SEQ ID NO: 3195951 - RNA, 16 nt, Mycobacterium bovis subsp bovis AF2122/97
gcgccgggggcgccgc

SEQ ID NO: 3195952 - RNA, 17 nt, Mycobacterium bovis subsp bovis AF2122/97
gcgccggggggcugcug

SEQ ID NO: 3195953 - RNA, 18 nt, Mycobacterium bovis subsp bovis AF2122/97
gcgccggguccgcggaga

SEQ ID NO: 3195954 - RNA, 23 nt, Mycobacterium bovis subsp bovis AF2122/97
gcgccggucagcaauacggcggc

SEQ ID NO: 3195955 - RNA, 17 nt, Mycobacterium bovis subsp bovis AF2122/97
gcgccggucagggacga

SEQ ID NO: 3195956 - RNA, 21 nt, Mycobacterium bovis subsp bovis AF2122/97
gcgccgguccucgucggcgaa

SEQ ID NO: 3195957 - RNA, 14 nt, Mycobacterium bovis subsp bovis AF2122/97
gcgccggucgccga

SEQ ID NO: 3195958 - RNA, 19 nt, Mycobacterium bovis subsp bovis AF2122/97
gcgccggucgccgacggcg

SEQ ID NO: 3195959 - RNA, 21 nt, Mycobacterium bovis subsp bovis AF2122/97
gcgccggucgccgacggcgac

SEQ ID NO: 3195960 - RNA, 15 nt, Mycobacterium bovis subsp bovis AF2122/97
gcgccggucgccggc

SEQ ID NO: 3195961 - RNA, 18 nt, Mycobacterium bovis subsp bovis AF2122/97
gcgccggucggaucggug

SEQ ID NO: 3195962 - RNA, 20 nt, Mycobacterium bovis subsp bovis AF2122/97
gcgccggugaggcgaccgga

SEQ ID NO: 3195963 - RNA, 18 nt, Mycobacterium bovis subsp bovis AF2122/97
gcgccggugccgccuccg

SEQ ID NO: 3195964 - RNA, 23 nt, Mycobacterium bovis subsp bovis AF2122/97
gcgccggugccgccuccgccugc

SEQ ID NO: 3195965 - RNA, 17 nt, Mycobacterium bovis subsp bovis AF2122/97
gcgccggugcggcgggc

SEQ ID NO: 3195966 - RNA, 18 nt, Mycobacterium bovis subsp bovis AF2122/97
gcgccggugcggcgggcu

SEQ ID NO: 3195967 - RNA, 18 nt, Mycobacterium bovis subsp bovis AF2122/97
gcgccggugcugcgggaa

SEQ ID NO: 3195968 - RNA, 21 nt, Mycobacterium bovis subsp bovis AF2122/97
gcgccggugggcgguccgcgu

SEQ ID NO: 3195969 - RNA, 15 nt, Mycobacterium bovis subsp bovis AF2122/97
gcgccggugguaacg

SEQ ID NO: 3195970 - RNA, 22 nt, Mycobacterium bovis subsp bovis AF2122/97
gcgccggugguaacggcggcca

SEQ ID NO: 3195971 - RNA, 20 nt, Mycobacterium bovis subsp bovis AF2122/97
gcgccggugguaccggcggc

SEQ ID NO: 3195972 - RNA, 20 nt, Mycobacterium bovis subsp bovis AF2122/97
gcgccggugugcgcaccccg

SEQ ID NO: 3195973 - RNA, 19 nt, Mycobacterium bovis subsp bovis AF2122/97
gcgccgguuacccggaccg

SEQ ID NO: 3195974 - RNA, 16 nt, Mycobacterium bovis subsp bovis AF2122/97
gcgccgguuggccagu

SEQ ID NO: 3195975 - RNA, 20 nt, Mycobacterium bovis subsp bovis AF2122/97
gcgccgguuucgaggcgaag

SEQ ID NO: 3195976 - RNA, 22 nt, Mycobacterium bovis subsp bovis AF2122/97
gcgccguaaagccaacuggucg

SEQ ID NO: 3195977 - RNA, 23 nt, Mycobacterium bovis subsp bovis AF2122/97
gcgccguaaagccaacuggucgc

SEQ ID NO: 3195978 - RNA, 22 nt, Mycobacterium bovis subsp bovis AF2122/97
gcgccguaacagccggccggau

SEQ ID NO: 3195979 - RNA, 16 nt, Mycobacterium bovis subsp bovis AF2122/97
gcgccguacagcggcg

SEQ ID NO: 3195980 - RNA, 16 nt, Mycobacterium bovis subsp bovis AF2122/97
gcgccguagaccagca

SEQ ID NO: 3195981 - RNA, 14 nt, Mycobacterium bovis subsp bovis AF2122/97
gcgccguagccgau

SEQ ID NO: 3195982 - RNA, 14 nt, Mycobacterium bovis subsp bovis AF2122/97
gcgccguagugcgc

SEQ ID NO: 3195983 - RNA, 16 nt, Mycobacterium bovis subsp bovis AF2122/97
gcgccgucagcccagg

SEQ ID NO: 3195984 - RNA, 21 nt, Mycobacterium bovis subsp bovis AF2122/97
gcgccgucagcccaggugggc

SEQ ID NO: 3195985 - RNA, 15 nt, Mycobacterium bovis subsp bovis AF2122/97
gcgccgucaucgcag

SEQ ID NO: 3195986 - RNA, 17 nt, Mycobacterium bovis subsp bovis AF2122/97
gcgccgucgcagccagc

SEQ ID NO: 3195987 - RNA, 15 nt, Mycobacterium bovis subsp bovis AF2122/97
gcgccgucgcccagc

SEQ ID NO: 3195988 - RNA, 13 nt, Mycobacterium bovis subsp bovis AF2122/97
gcgccgucgccgu

SEQ ID NO: 3195989 - RNA, 17 nt, Mycobacterium bovis subsp bovis AF2122/97
gcgccgucggagccggc

SEQ ID NO: 3195990 - RNA, 19 nt, Mycobacterium bovis subsp bovis AF2122/97
gcgccgucggagccggcca

SEQ ID NO: 3195991 - RNA, 22 nt, Mycobacterium bovis subsp bovis AF2122/97
gcgccgucggagccggccaccu

SEQ ID NO: 3195992 - RNA, 14 nt, Mycobacterium bovis subsp bovis AF2122/97
gcgccgucggcgau

SEQ ID NO: 3195993 - RNA, 14 nt, Mycobacterium bovis subsp bovis AF2122/97
gcgccgucgucagc

SEQ ID NO: 3195994 - RNA, 13 nt, Mycobacterium bovis subsp bovis AF2122/97
gcgccgucgucga

SEQ ID NO: 3195995 - RNA, 18 nt, Mycobacterium bovis subsp bovis AF2122/97
gcgccgucgucgagcacc

SEQ ID NO: 3195996 - RNA, 19 nt, Mycobacterium bovis subsp bovis AF2122/97
gcgccgucgucgagcacca

SEQ ID NO: 3195997 - RNA, 20 nt, Mycobacterium bovis subsp bovis AF2122/97
gcgccgucgucgagcaccac

SEQ ID NO: 3195998 - RNA, 22 nt, Mycobacterium bovis subsp bovis AF2122/97
gcgccgucgucgagcaccaccc

SEQ ID NO: 3195999 - RNA, 18 nt, Mycobacterium bovis subsp bovis AF2122/97
gcgccgucgucgcgcagu

SEQ ID NO: 3196000 - RNA, 22 nt, Mycobacterium bovis subsp bovis AF2122/97
gcgccgucguugugccggucga

SEQ ID NO: 3196001 - RNA, 16 nt, Mycobacterium bovis subsp bovis AF2122/97
gcgccgucucgaucgc

SEQ ID NO: 3196002 - RNA, 17 nt, Mycobacterium bovis subsp bovis AF2122/97
gcgccgucucgaucgcg

SEQ ID NO: 3196003 - RNA, 21 nt, Mycobacterium bovis subsp bovis AF2122/97
gcgccgucucgaucgcgguag

SEQ ID NO: 3196004 - RNA, 14 nt, Mycobacterium bovis subsp bovis AF2122/97
gcgccgucucgcgg

SEQ ID NO: 3196005 - RNA, 19 nt, Mycobacterium bovis subsp bovis AF2122/97
gcgccgugaucagcucgcg

SEQ ID NO: 3196006 - RNA, 15 nt, Mycobacterium bovis subsp bovis AF2122/97
gcgccgugcgaucgu

SEQ ID NO: 3196007 - RNA, 16 nt, Mycobacterium bovis subsp bovis AF2122/97
gcgccgugcgaucguc

SEQ ID NO: 3196008 - RNA, 13 nt, Mycobacterium bovis subsp bovis AF2122/97
gcgccguggauca

SEQ ID NO: 3196009 - RNA, 20 nt, Mycobacterium bovis subsp bovis AF2122/97
gcgccguggaucaucccgac

SEQ ID NO: 3196010 - RNA, 15 nt, Mycobacterium bovis subsp bovis AF2122/97
gcgccguggcaucgc

SEQ ID NO: 3196011 - RNA, 17 nt, Mycobacterium bovis subsp bovis AF2122/97
gcgccguggcaucgccu

SEQ ID NO: 3196012 - RNA, 15 nt, Mycobacterium bovis subsp bovis AF2122/97
gcgccguuaccgccg

SEQ ID NO: 3196013 - RNA, 20 nt, Mycobacterium bovis subsp bovis AF2122/97
gcgccguuaccgccguugcc

SEQ ID NO: 3196014 - RNA, 18 nt, Mycobacterium bovis subsp bovis AF2122/97
gcgccguucacccuggug

SEQ ID NO: 3196015 - RNA, 22 nt, Mycobacterium bovis subsp bovis AF2122/97
gcgccguucgccuggucaccga

SEQ ID NO: 3196016 - RNA, 13 nt, Mycobacterium bovis subsp bovis AF2122/97
gcgccguucgcuc

SEQ ID NO: 3196017 - RNA, 15 nt, Mycobacterium bovis subsp bovis AF2122/97
gcgccguucgcuccc

SEQ ID NO: 3196018 - RNA, 16 nt, Mycobacterium bovis subsp bovis AF2122/97
gcgccguucgcucccc

SEQ ID NO: 3196019 - RNA, 20 nt, Mycobacterium bovis subsp bovis AF2122/97
gcgccguucgcucccccgcu

SEQ ID NO: 3196020 - RNA, 18 nt, Mycobacterium bovis subsp bovis AF2122/97
gcgccguucugaucugcg

SEQ ID NO: 3196021 - RNA, 15 nt, Mycobacterium bovis subsp bovis AF2122/97
gcgccguugccaccg

SEQ ID NO: 3196022 - RNA, 14 nt, Mycobacterium bovis subsp bovis AF2122/97
gcgccguugccgcc

SEQ ID NO: 3196023 - RNA, 18 nt, Mycobacterium bovis subsp bovis AF2122/97
gcgccguugccgccacgc

SEQ ID NO: 3196024 - RNA, 21 nt, Mycobacterium bovis subsp bovis AF2122/97
gcgccguugccgcccacgcug

SEQ ID NO: 3196025 - RNA, 17 nt, Mycobacterium bovis subsp bovis AF2122/97
gcgccguugccgccguc

SEQ ID NO: 3196026 - RNA, 20 nt, Mycobacterium bovis subsp bovis AF2122/97
gcgccguugccgccgucgcc

SEQ ID NO: 3196027 - RNA, 22 nt, Mycobacterium bovis subsp bovis AF2122/97
gcgccguugccgccgucgccgc

SEQ ID NO: 3196028 - RNA, 15 nt, Mycobacterium bovis subsp bovis AF2122/97
gcgccguugccggcg

SEQ ID NO: 3196029 - RNA, 13 nt, Mycobacterium bovis subsp bovis AF2122/97
gcgccguuggcgc

SEQ ID NO: 3196030 - RNA, 20 nt, Mycobacterium bovis subsp bovis AF2122/97
gcgccguugucggcggugaa

SEQ ID NO: 3196031 - RNA, 22 nt, Mycobacterium bovis subsp bovis AF2122/97
gcgccuaaccccggcucgacgc

SEQ ID NO: 3196032 - RNA, 14 nt, Mycobacterium bovis subsp bovis AF2122/97
gcgccuaccagcac

SEQ ID NO: 3196033 - RNA, 16 nt, Mycobacterium bovis subsp bovis AF2122/97
gcgccuaccagcaccg

SEQ ID NO: 3196034 - RNA, 15 nt, Mycobacterium bovis subsp bovis AF2122/97
gcgccuaugggccug

SEQ ID NO: 3196035 - RNA, 18 nt, Mycobacterium bovis subsp bovis AF2122/97
gcgccucaucggacagcg

SEQ ID NO: 3196036 - RNA, 15 nt, Mycobacterium bovis subsp bovis AF2122/97
gcgccuccacucuuc

SEQ ID NO: 3196037 - RNA, 14 nt, Mycobacterium bovis subsp bovis AF2122/97
gcgccuccgcucgg

SEQ ID NO: 3196038 - RNA, 15 nt, Mycobacterium bovis subsp bovis AF2122/97
gcgccuccggcaccu

SEQ ID NO: 3196039 - RNA, 14 nt, Mycobacterium bovis subsp bovis AF2122/97
gcgccuccgggacg

SEQ ID NO: 3196040 - RNA, 15 nt, Mycobacterium bovis subsp bovis AF2122/97
gcgccuccgggacgg

SEQ ID NO: 3196041 - RNA, 19 nt, Mycobacterium bovis subsp bovis AF2122/97
gcgccuccguugcccccau

SEQ ID NO: 3196042 - RNA, 22 nt, Mycobacterium bovis subsp bovis AF2122/97
gcgccucgaccugacuggucag

SEQ ID NO: 3196043 - RNA, 13 nt, Mycobacterium bovis subsp bovis AF2122/97
gcgccucgauccg

SEQ ID NO: 3196044 - RNA, 15 nt, Mycobacterium bovis subsp bovis AF2122/97
gcgccucgcccagca

SEQ ID NO: 3196045 - RNA, 17 nt, Mycobacterium bovis subsp bovis AF2122/97
gcgccucgcccagcaag

SEQ ID NO: 3196046 - RNA, 13 nt, Mycobacterium bovis subsp bovis AF2122/97
gcgccucgccggc

SEQ ID NO: 3196047 - RNA, 14 nt, Mycobacterium bovis subsp bovis AF2122/97
gcgccucgccggcc

SEQ ID NO: 3196048 - RNA, 18 nt, Mycobacterium bovis subsp bovis AF2122/97
gcgccucgccggccaccc

SEQ ID NO: 3196049 - RNA, 24 nt, Mycobacterium bovis subsp bovis AF2122/97
gcgccucgccggccacccgcgcga

SEQ ID NO: 3196050 - RNA, 18 nt, Mycobacterium bovis subsp bovis AF2122/97
gcgccucggaccagaccc

SEQ ID NO: 3196051 - RNA, 22 nt, Mycobacterium bovis subsp bovis AF2122/97
gcgccucggaccagacccacga

SEQ ID NO: 3196052 - RNA, 20 nt, Mycobacterium bovis subsp bovis AF2122/97
gcgccucggcaucgccgcgg

SEQ ID NO: 3196053 - RNA, 14 nt, Mycobacterium bovis subsp bovis AF2122/97
gcgccucggcggcc

SEQ ID NO: 3196054 - RNA, 17 nt, Mycobacterium bovis subsp bovis AF2122/97
gcgccucggcggccagc

SEQ ID NO: 3196055 - RNA, 16 nt, Mycobacterium bovis subsp bovis AF2122/97
gcgccugaauaggucg

SEQ ID NO: 3196056 - RNA, 18 nt, Mycobacterium bovis subsp bovis AF2122/97
gcgccugacucaucaccg

SEQ ID NO: 3196057 - RNA, 19 nt, Mycobacterium bovis subsp bovis AF2122/97
gcgccugacucaucaccga

SEQ ID NO: 3196058 - RNA, 11 nt, Mycobacterium bovis subsp bovis AF2122/97
gcgccugagcg

SEQ ID NO: 3196059 - RNA, 16 nt, Mycobacterium bovis subsp bovis AF2122/97
gcgccugagcggccuc

SEQ ID NO: 3196060 - RNA, 19 nt, Mycobacterium bovis subsp bovis AF2122/97
gcgccugauaggccugagc

SEQ ID NO: 3196061 - RNA, 19 nt, Mycobacterium bovis subsp bovis AF2122/97
gcgccugccucaccgccgc

SEQ ID NO: 3196062 - RNA, 14 nt, Mycobacterium bovis subsp bovis AF2122/97
gcgccugcggcagc

SEQ ID NO: 3196063 - RNA, 15 nt, Mycobacterium bovis subsp bovis AF2122/97
gcgccugcggcagca

SEQ ID NO: 3196064 - RNA, 13 nt, Mycobacterium bovis subsp bovis AF2122/97
gcgccuggagcga

SEQ ID NO: 3196065 - RNA, 20 nt, Mycobacterium bovis subsp bovis AF2122/97
gcgccuggcggcgccgcaga

SEQ ID NO: 3196066 - RNA, 20 nt, Mycobacterium bovis subsp bovis AF2122/97
gcgccuggcuggccagcugc

SEQ ID NO: 3196067 - RNA, 21 nt, Mycobacterium bovis subsp bovis AF2122/97
gcgccuggcuggccagcugcg

SEQ ID NO: 3196068 - RNA, 20 nt, Mycobacterium bovis subsp bovis AF2122/97
gcgccugugccaccgcugga

SEQ ID NO: 3196069 - RNA, 17 nt, Mycobacterium bovis subsp bovis AF2122/97
gcgccugugcgcaaggc

SEQ ID NO: 3196070 - RNA, 16 nt, Mycobacterium bovis subsp bovis AF2122/97
gcgccuucaccuggug

SEQ ID NO: 3196071 - RNA, 20 nt, Mycobacterium bovis subsp bovis AF2122/97
gcgccuuccaggcgggcggc

SEQ ID NO: 3196072 - RNA, 22 nt, Mycobacterium bovis subsp bovis AF2122/97
gcgccuuccaggcgggcggcac

SEQ ID NO: 3196073 - RNA, 17 nt, Mycobacterium bovis subsp bovis AF2122/97
gcgccuucgccagcggc

SEQ ID NO: 3196074 - RNA, 19 nt, Mycobacterium bovis subsp bovis AF2122/97
gcgccuucgccagcggcgc

SEQ ID NO: 3196075 - RNA, 21 nt, Mycobacterium bovis subsp bovis AF2122/97
gcgccuucgccagcggcgcga

SEQ ID NO: 3196076 - RNA, 14 nt, Mycobacterium bovis subsp bovis AF2122/97
gcgccuugaccaca

SEQ ID NO: 3196077 - RNA, 16 nt, Mycobacterium bovis subsp bovis AF2122/97
gcgccuugaccacagc

SEQ ID NO: 3196078 - RNA, 15 nt, Mycobacterium bovis subsp bovis AF2122/97
gcgccuugaccagca

SEQ ID NO: 3196079 - RNA, 17 nt, Mycobacterium bovis subsp bovis AF2122/97
gcgccuugaccagcagc

SEQ ID NO: 3196080 - RNA, 19 nt, Mycobacterium bovis subsp bovis AF2122/97
gcgccuugauggucuccac

SEQ ID NO: 3196081 - RNA, 20 nt, Mycobacterium bovis subsp bovis AF2122/97
gcgccuugauggucuccacc

SEQ ID NO: 3196082 - RNA, 23 nt, Mycobacterium bovis subsp bovis AF2122/97
gcgccuugcuuccgggacuacca

SEQ ID NO: 3196083 - RNA, 15 nt, Mycobacterium bovis subsp bovis AF2122/97
gcgccuuggcacccu

SEQ ID NO: 3196084 - RNA, 23 nt, Mycobacterium bovis subsp bovis AF2122/97
gcgccuuggcacccuccgccggu

SEQ ID NO: 3196085 - RNA, 13 nt, Mycobacterium bovis subsp bovis AF2122/97
gcgccuugguccg

SEQ ID NO: 3196086 - RNA, 16 nt, Mycobacterium bovis subsp bovis AF2122/97
gcgccuuggucgccgc

SEQ ID NO: 3196087 - RNA, 18 nt, Mycobacterium bovis subsp bovis AF2122/97
gcgccuuggucgccgcuu

SEQ ID NO: 3196088 - RNA, 17 nt, Mycobacterium bovis subsp bovis AF2122/97
gcgccuuggucgccggc

SEQ ID NO: 3196089 - RNA, 21 nt, Mycobacterium bovis subsp bovis AF2122/97
gcgccuuggucgccggcgucg

SEQ ID NO: 3196090 - RNA, 22 nt, Mycobacterium bovis subsp bovis AF2122/97
gcgccuuggucgccggcgucga

SEQ ID NO: 3196091 - RNA, 14 nt, Mycobacterium bovis subsp bovis AF2122/97
gcgccuugucgauc

SEQ ID NO: 3196092 - RNA, 21 nt, Mycobacterium bovis subsp bovis AF2122/97
gcgccuuguggcacacccgca

SEQ ID NO: 3196093 - RNA, 23 nt, Mycobacterium bovis subsp bovis AF2122/97
gcgccuuguggcacacccgcacc

SEQ ID NO: 3196094 - RNA, 14 nt, Mycobacterium bovis subsp bovis AF2122/97
gcgccuuugagccc

SEQ ID NO: 3196095 - RNA, 15 nt, Mycobacterium bovis subsp bovis AF2122/97
gcgccuuugcccgau

SEQ ID NO: 3196096 - RNA, 16 nt, Mycobacterium bovis subsp bovis AF2122/97
gcgcgaaaccagucca

SEQ ID NO: 3196097 - RNA, 21 nt, Mycobacterium bovis subsp bovis AF2122/97
gcgcgaaaccaguccaucgac

SEQ ID NO: 3196098 - RNA, 15 nt, Mycobacterium bovis subsp bovis AF2122/97
gcgcgaaaccgcaug

SEQ ID NO: 3196099 - RNA, 14 nt, Mycobacterium bovis subsp bovis AF2122/97
gcgcgaaacgccgc

SEQ ID NO: 3196100 - RNA, 14 nt, Mycobacterium bovis subsp bovis AF2122/97
gcgcgaaagcgccg

SEQ ID NO: 3196101 - RNA, 15 nt, Mycobacterium bovis subsp bovis AF2122/97
gcgcgaaagcgccga

SEQ ID NO: 3196102 - RNA, 16 nt, Mycobacterium bovis subsp bovis AF2122/97
gcgcgaaagcgccgaa

SEQ ID NO: 3196103 - RNA, 13 nt, Mycobacterium bovis subsp bovis AF2122/97
gcgcgaacacccg

SEQ ID NO: 3196104 - RNA, 13 nt, Mycobacterium bovis subsp bovis AF2122/97
gcgcgaaccccag

SEQ ID NO: 3196105 - RNA, 17 nt, Mycobacterium bovis subsp bovis AF2122/97
gcgcgaaccccagccga

SEQ ID NO: 3196106 - RNA, 15 nt, Mycobacterium bovis subsp bovis AF2122/97
gcgcgaacccggccc

SEQ ID NO: 3196107 - RNA, 15 nt, Mycobacterium bovis subsp bovis AF2122/97
gcgcgaaccgcuccg

SEQ ID NO: 3196108 - RNA, 16 nt, Mycobacterium bovis subsp bovis AF2122/97
gcgcgaaccugcucgg

SEQ ID NO: 3196109 - RNA, 18 nt, Mycobacterium bovis subsp bovis AF2122/97
gcgcgaaccugcucggcg

SEQ ID NO: 3196110 - RNA, 19 nt, Mycobacterium bovis subsp bovis AF2122/97
gcgcgaaccugcucggcgc

SEQ ID NO: 3196111 - RNA, 20 nt, Mycobacterium bovis subsp bovis AF2122/97
gcgcgaaccugcucggcgcg

SEQ ID NO: 3196112 - RNA, 21 nt, Mycobacterium bovis subsp bovis AF2122/97
gcgcgaaccugcucggcgcgc

SEQ ID NO: 3196113 - RNA, 15 nt, Mycobacterium bovis subsp bovis AF2122/97
gcgcgaacgccugcu

SEQ ID NO: 3196114 - RNA, 14 nt, Mycobacterium bovis subsp bovis AF2122/97
gcgcgaacggcggu

SEQ ID NO: 3196115 - RNA, 16 nt, Mycobacterium bovis subsp bovis AF2122/97
gcgcgaacgucaaccg

SEQ ID NO: 3196116 - RNA, 18 nt, Mycobacterium bovis subsp bovis AF2122/97
gcgcgaacgucaaccggg

SEQ ID NO: 3196117 - RNA, 22 nt, Mycobacterium bovis subsp bovis AF2122/97
gcgcgaacgucagugccccgca

SEQ ID NO: 3196118 - RNA, 14 nt, Mycobacterium bovis subsp bovis AF2122/97
gcgcgaagccacca

SEQ ID NO: 3196119 - RNA, 15 nt, Mycobacterium bovis subsp bovis AF2122/97
gcgcgaagccaccag

SEQ ID NO: 3196120 - RNA, 16 nt, Mycobacterium bovis subsp bovis AF2122/97
gcgcgaagccaccagg

SEQ ID NO: 3196121 - RNA, 22 nt, Mycobacterium bovis subsp bovis AF2122/97
gcgcgaaggauuugauaggcgc

SEQ ID NO: 3196122 - RNA, 14 nt, Mycobacterium bovis subsp bovis AF2122/97
gcgcgaaggggacg

SEQ ID NO: 3196123 - RNA, 15 nt, Mycobacterium bovis subsp bovis AF2122/97
gcgcgaaggucagcg

SEQ ID NO: 3196124 - RNA, 21 nt, Mycobacterium bovis subsp bovis AF2122/97
gcgcgaaguuugcgacgacgc

SEQ ID NO: 3196125 - RNA, 23 nt, Mycobacterium bovis subsp bovis AF2122/97
gcgcgaaguuugcgacgacgcca

SEQ ID NO: 3196126 - RNA, 14 nt, Mycobacterium bovis subsp bovis AF2122/97
gcgcgaaucgcguc

SEQ ID NO: 3196127 - RNA, 16 nt, Mycobacterium bovis subsp bovis AF2122/97
gcgcgaauggcggaca

SEQ ID NO: 3196128 - RNA, 20 nt, Mycobacterium bovis subsp bovis AF2122/97
gcgcgaauggcggacagggc

SEQ ID NO: 3196129 - RNA, 21 nt, Mycobacterium bovis subsp bovis AF2122/97
gcgcgacaaaguucgacgaga

SEQ ID NO: 3196130 - RNA, 17 nt, Mycobacterium bovis subsp bovis AF2122/97
gcgcgacaacccggcgu

SEQ ID NO: 3196131 - RNA, 20 nt, Mycobacterium bovis subsp bovis AF2122/97
gcgcgacaacccggcgucga

SEQ ID NO: 3196132 - RNA, 18 nt, Mycobacterium bovis subsp bovis AF2122/97
gcgcgacagacagcaccg

SEQ ID NO: 3196133 - RNA, 23 nt, Mycobacterium bovis subsp bovis AF2122/97
gcgcgacagacagcaccgccggu

SEQ ID NO: 3196134 - RNA, 17 nt, Mycobacterium bovis subsp bovis AF2122/97
gcgcgacagccguggcg

SEQ ID NO: 3196135 - RNA, 13 nt, Mycobacterium bovis subsp bovis AF2122/97
gcgcgacaggccc

SEQ ID NO: 3196136 - RNA, 16 nt, Mycobacterium bovis subsp bovis AF2122/97
gcgcgaccacccgccg

SEQ ID NO: 3196137 - RNA, 19 nt, Mycobacterium bovis subsp bovis AF2122/97
gcgcgaccacccgccgcag

SEQ ID NO: 3196138 - RNA, 22 nt, Mycobacterium bovis subsp bovis AF2122/97
gcgcgaccaggaaguagaugag

SEQ ID NO: 3196139 - RNA, 23 nt, Mycobacterium bovis subsp bovis AF2122/97
gcgcgaccauacccgcgcgcacc

SEQ ID NO: 3196140 - RNA, 16 nt, Mycobacterium bovis subsp bovis AF2122/97
gcgcgaccccaggcgc

SEQ ID NO: 3196141 - RNA, 17 nt, Mycobacterium bovis subsp bovis AF2122/97
gcgcgaccccaggcgcu

SEQ ID NO: 3196142 - RNA, 15 nt, Mycobacterium bovis subsp bovis AF2122/97
gcgcgaccgaccagc

SEQ ID NO: 3196143 - RNA, 14 nt, Mycobacterium bovis subsp bovis AF2122/97
gcgcgaccgcggcg

SEQ ID NO: 3196144 - RNA, 15 nt, Mycobacterium bovis subsp bovis AF2122/97
gcgcgaccgcggcga

SEQ ID NO: 3196145 - RNA, 17 nt, Mycobacterium bovis subsp bovis AF2122/97
gcgcgaccucgcuggcc

SEQ ID NO: 3196146 - RNA, 18 nt, Mycobacterium bovis subsp bovis AF2122/97
gcgcgaccucgcuggccg

SEQ ID NO: 3196147 - RNA, 19 nt, Mycobacterium bovis subsp bovis AF2122/97
gcgcgaccucgcuggccgc

SEQ ID NO: 3196148 - RNA, 14 nt, Mycobacterium bovis subsp bovis AF2122/97
gcgcgacgcccgaa

SEQ ID NO: 3196149 - RNA, 13 nt, Mycobacterium bovis subsp bovis AF2122/97
gcgcgacgccgcg

SEQ ID NO: 3196150 - RNA, 14 nt, Mycobacterium bovis subsp bovis AF2122/97
gcgcgacgccgcgg

SEQ ID NO: 3196151 - RNA, 18 nt, Mycobacterium bovis subsp bovis AF2122/97
gcgcgacgccguccucgc

SEQ ID NO: 3196152 - RNA, 13 nt, Mycobacterium bovis subsp bovis AF2122/97
gcgcgacggacca

SEQ ID NO: 3196153 - RNA, 13 nt, Mycobacterium bovis subsp bovis AF2122/97
gcgcgacggcaac

SEQ ID NO: 3196154 - RNA, 18 nt, Mycobacterium bovis subsp bovis AF2122/97
gcgcgacggcaacgucgc

SEQ ID NO: 3196155 - RNA, 14 nt, Mycobacterium bovis subsp bovis AF2122/97
gcgcgacggccggg

SEQ ID NO: 3196156 - RNA, 13 nt, Mycobacterium bovis subsp bovis AF2122/97
gcgcgacggcgcu

SEQ ID NO: 3196157 - RNA, 15 nt, Mycobacterium bovis subsp bovis AF2122/97
gcgcgacguccacca

SEQ ID NO: 3196158 - RNA, 18 nt, Mycobacterium bovis subsp bovis AF2122/97
gcgcgacguccaccagcc

SEQ ID NO: 3196159 - RNA, 21 nt, Mycobacterium bovis subsp bovis AF2122/97
gcgcgacuuucugcgcguggg

SEQ ID NO: 3196160 - RNA, 11 nt, Mycobacterium bovis subsp bovis AF2122/97
gcgcgagauca

SEQ ID NO: 3196161 - RNA, 16 nt, Mycobacterium bovis subsp bovis AF2122/97
gcgcgagaucagccgg

SEQ ID NO: 3196162 - RNA, 13 nt, Mycobacterium bovis subsp bovis AF2122/97
gcgcgagcagacg

SEQ ID NO: 3196163 - RNA, 15 nt, Mycobacterium bovis subsp bovis AF2122/97
gcgcgagcccgaacc

SEQ ID NO: 3196164 - RNA, 14 nt, Mycobacterium bovis subsp bovis AF2122/97
gcgcgagccgcacg

SEQ ID NO: 3196165 - RNA, 15 nt, Mycobacterium bovis subsp bovis AF2122/97
gcgcgagccgcacga

SEQ ID NO: 3196166 - RNA, 13 nt, Mycobacterium bovis subsp bovis AF2122/97
gcgcgagccgcuc

SEQ ID NO: 3196167 - RNA, 15 nt, Mycobacterium bovis subsp bovis AF2122/97
gcgcgagccgcucca

SEQ ID NO: 3196168 - RNA, 20 nt, Mycobacterium bovis subsp bovis AF2122/97
gcgcgagccggcucagacga

SEQ ID NO: 3196169 - RNA, 20 nt, Mycobacterium bovis subsp bovis AF2122/97
gcgcgaggaacgccggggcg

SEQ ID NO: 3196170 - RNA, 17 nt, Mycobacterium bovis subsp bovis AF2122/97
gcgcgaggucggcggcg

SEQ ID NO: 3196171 - RNA, 18 nt, Mycobacterium bovis subsp bovis AF2122/97
gcgcgaggucggcggcgc

SEQ ID NO: 3196172 - RNA, 19 nt, Mycobacterium bovis subsp bovis AF2122/97
gcgcgaggucggcggcgca

SEQ ID NO: 3196173 - RNA, 17 nt, Mycobacterium bovis subsp bovis AF2122/97
gcgcgaguaagcgaaca

SEQ ID NO: 3196174 - RNA, 18 nt, Mycobacterium bovis subsp bovis AF2122/97
gcgcgauacagacgggga

SEQ ID NO: 3196175 - RNA, 18 nt, Mycobacterium bovis subsp bovis AF2122/97
gcgcgauaggugcucgcg

SEQ ID NO: 3196176 - RNA, 17 nt, Mycobacterium bovis subsp bovis AF2122/97
gcgcgaucaacgcguug

SEQ ID NO: 3196177 - RNA, 13 nt, Mycobacterium bovis subsp bovis AF2122/97
gcgcgaucaccga

SEQ ID NO: 3196178 - RNA, 22 nt, Mycobacterium bovis subsp bovis AF2122/97
gcgcgaucaccgagucgacggc

SEQ ID NO: 3196179 - RNA, 21 nt, Mycobacterium bovis subsp bovis AF2122/97
gcgcgaucagguaccggcgga

SEQ ID NO: 3196180 - RNA, 17 nt, Mycobacterium bovis subsp bovis AF2122/97
gcgcgauccccgcgcug

SEQ ID NO: 3196181 - RNA, 18 nt, Mycobacterium bovis subsp bovis AF2122/97
gcgcgaucgacgcucggc

SEQ ID NO: 3196182 - RNA, 20 nt, Mycobacterium bovis subsp bovis AF2122/97
gcgcgaucgauuccgcucgu

SEQ ID NO: 3196183 - RNA, 21 nt, Mycobacterium bovis subsp bovis AF2122/97
gcgcgaucgauuccgcucguu

SEQ ID NO: 3196184 - RNA, 17 nt, Mycobacterium bovis subsp bovis AF2122/97
gcgcgaucgggccggcg

SEQ ID NO: 3196185 - RNA, 18 nt, Mycobacterium bovis subsp bovis AF2122/97
gcgcgaucgggccggcgc

SEQ ID NO: 3196186 - RNA, 14 nt, Mycobacterium bovis subsp bovis AF2122/97
gcgcgaucggugcc

SEQ ID NO: 3196187 - RNA, 12 nt, Mycobacterium bovis subsp bovis AF2122/97
gcgcgaucgucg

SEQ ID NO: 3196188 - RNA, 17 nt, Mycobacterium bovis subsp bovis AF2122/97
gcgcgaucuccuccacc

SEQ ID NO: 3196189 - RNA, 21 nt, Mycobacterium bovis subsp bovis AF2122/97
gcgcgaucugcucgccccaug

SEQ ID NO: 3196190 - RNA, 18 nt, Mycobacterium bovis subsp bovis AF2122/97
gcgcgaugaccucggcga

SEQ ID NO: 3196191 - RNA, 14 nt, Mycobacterium bovis subsp bovis AF2122/97
gcgcgaugcuggcg

SEQ ID NO: 3196192 - RNA, 16 nt, Mycobacterium bovis subsp bovis AF2122/97
gcgcgaugcuggcgaa

SEQ ID NO: 3196193 - RNA, 20 nt, Mycobacterium bovis subsp bovis AF2122/97
gcgcgauggcagcgccgaug

SEQ ID NO: 3196194 - RNA, 23 nt, Mycobacterium bovis subsp bovis AF2122/97
gcgcgauggccuggcccuuguug

SEQ ID NO: 3196195 - RNA, 16 nt, Mycobacterium bovis subsp bovis AF2122/97
gcgcgauggcgcgugg

SEQ ID NO: 3196196 - RNA, 12 nt, Mycobacterium bovis subsp bovis AF2122/97
gcgcgaugucgc

SEQ ID NO: 3196197 - RNA, 21 nt, Mycobacterium bovis subsp bovis AF2122/97
gcgcgcaacacauccaguaac

SEQ ID NO: 3196198 - RNA, 13 nt, Mycobacterium bovis subsp bovis AF2122/97
gcgcgcaacccug

SEQ ID NO: 3196199 - RNA, 15 nt, Mycobacterium bovis subsp bovis AF2122/97
gcgcgcaacccugcc

SEQ ID NO: 3196200 - RNA, 21 nt, Mycobacterium bovis subsp bovis AF2122/97
gcgcgcaacccugccgcgaug

SEQ ID NO: 3196201 - RNA, 15 nt, Mycobacterium bovis subsp bovis AF2122/97
gcgcgcaaccgcuga

SEQ ID NO: 3196202 - RNA, 19 nt, Mycobacterium bovis subsp bovis AF2122/97
gcgcgcaacgagauucguc

SEQ ID NO: 3196203 - RNA, 22 nt, Mycobacterium bovis subsp bovis AF2122/97
gcgcgcaacguacgcacgcagc

SEQ ID NO: 3196204 - RNA, 13 nt, Mycobacterium bovis subsp bovis AF2122/97
gcgcgcacacggc

SEQ ID NO: 3196205 - RNA, 15 nt, Mycobacterium bovis subsp bovis AF2122/97
gcgcgcacacggcua

SEQ ID NO: 3196206 - RNA, 13 nt, Mycobacterium bovis subsp bovis AF2122/97
gcgcgcaccaccg

SEQ ID NO: 3196207 - RNA, 18 nt, Mycobacterium bovis subsp bovis AF2122/97
gcgcgcaccaccgcggcg

SEQ ID NO: 3196208 - RNA, 19 nt, Mycobacterium bovis subsp bovis AF2122/97
gcgcgcaccaccgcggcgg

SEQ ID NO: 3196209 - RNA, 14 nt, Mycobacterium bovis subsp bovis AF2122/97
gcgcgcacgccacc

SEQ ID NO: 3196210 - RNA, 13 nt, Mycobacterium bovis subsp bovis AF2122/97
gcgcgcacggcgu

SEQ ID NO: 3196211 - RNA, 15 nt, Mycobacterium bovis subsp bovis AF2122/97
gcgcgcacggcgucg

SEQ ID NO: 3196212 - RNA, 16 nt, Mycobacterium bovis subsp bovis AF2122/97
gcgcgcagaugagcgc

SEQ ID NO: 3196213 - RNA, 19 nt, Mycobacterium bovis subsp bovis AF2122/97
gcgcgcagaugagcgcggc

SEQ ID NO: 3196214 - RNA, 20 nt, Mycobacterium bovis subsp bovis AF2122/97
gcgcgcagaugagcgcggcg

SEQ ID NO: 3196215 - RNA, 21 nt, Mycobacterium bovis subsp bovis AF2122/97
gcgcgcagaugagcgcggcga

SEQ ID NO: 3196216 - RNA, 22 nt, Mycobacterium bovis subsp bovis AF2122/97
gcgcgcagcaguuggucgcggu

SEQ ID NO: 3196217 - RNA, 15 nt, Mycobacterium bovis subsp bovis AF2122/97
gcgcgcagccgggca

SEQ ID NO: 3196218 - RNA, 19 nt, Mycobacterium bovis subsp bovis AF2122/97
gcgcgcagccgggcaccga

SEQ ID NO: 3196219 - RNA, 15 nt, Mycobacterium bovis subsp bovis AF2122/97
gcgcgcagcugacgu

SEQ ID NO: 3196220 - RNA, 15 nt, Mycobacterium bovis subsp bovis AF2122/97
gcgcgcaggccgccg

SEQ ID NO: 3196221 - RNA, 17 nt, Mycobacterium bovis subsp bovis AF2122/97
gcgcgcaggccgccgcc

SEQ ID NO: 3196222 - RNA, 13 nt, Mycobacterium bovis subsp bovis AF2122/97
gcgcgcaggugcu

SEQ ID NO: 3196223 - RNA, 20 nt, Mycobacterium bovis subsp bovis AF2122/97
gcgcgcauauccgcaggccc

SEQ ID NO: 3196224 - RNA, 21 nt, Mycobacterium bovis subsp bovis AF2122/97
gcgcgcauauccgcaggcccg

SEQ ID NO: 3196225 - RNA, 18 nt, Mycobacterium bovis subsp bovis AF2122/97
gcgcgccaaacaccccgg

SEQ ID NO: 3196226 - RNA, 18 nt, Mycobacterium bovis subsp bovis AF2122/97
gcgcgccaaguggcgcuc

SEQ ID NO: 3196227 - RNA, 12 nt, Mycobacterium bovis subsp bovis AF2122/97
gcgcgccaaucg

SEQ ID NO: 3196228 - RNA, 15 nt, Mycobacterium bovis subsp bovis AF2122/97
gcgcgccacccagca

SEQ ID NO: 3196229 - RNA, 17 nt, Mycobacterium bovis subsp bovis AF2122/97
gcgcgccacccagcacc

SEQ ID NO: 3196230 - RNA, 19 nt, Mycobacterium bovis subsp bovis AF2122/97
gcgcgccagaacgacaccg

SEQ ID NO: 3196231 - RNA, 22 nt, Mycobacterium bovis subsp bovis AF2122/97
gcgcgccagaacgacaccgcuu

SEQ ID NO: 3196232 - RNA, 16 nt, Mycobacterium bovis subsp bovis AF2122/97
gcgcgccagcucggcg

SEQ ID NO: 3196233 - RNA, 21 nt, Mycobacterium bovis subsp bovis AF2122/97
gcgcgccagcucggcggcagc

SEQ ID NO: 3196234 - RNA, 12 nt, Mycobacterium bovis subsp bovis AF2122/97
gcgcgccagcuu

SEQ ID NO: 3196235 - RNA, 22 nt, Mycobacterium bovis subsp bovis AF2122/97
gcgcgccaucgccuccagccgg

SEQ ID NO: 3196236 - RNA, 19 nt, Mycobacterium bovis subsp bovis AF2122/97
gcgcgccauuggcgccgcc

SEQ ID NO: 3196237 - RNA, 20 nt, Mycobacterium bovis subsp bovis AF2122/97
gcgcgccauuggcgccgccg

SEQ ID NO: 3196238 - RNA, 16 nt, Mycobacterium bovis subsp bovis AF2122/97
gcgcgcccaccgggcg

SEQ ID NO: 3196239 - RNA, 21 nt, Mycobacterium bovis subsp bovis AF2122/97
gcgcgcccaccgggcggcggc

SEQ ID NO: 3196240 - RNA, 23 nt, Mycobacterium bovis subsp bovis AF2122/97
gcgcgcccauuggguaaccagcg

SEQ ID NO: 3196241 - RNA, 14 nt, Mycobacterium bovis subsp bovis AF2122/97
gcgcgccccaccgc

SEQ ID NO: 3196242 - RNA, 19 nt, Mycobacterium bovis subsp bovis AF2122/97
gcgcgccccaccgcgccga

SEQ ID NO: 3196243 - RNA, 15 nt, Mycobacterium bovis subsp bovis AF2122/97
gcgcgcccgacaccc

SEQ ID NO: 3196244 - RNA, 14 nt, Mycobacterium bovis subsp bovis AF2122/97
gcgcgcccgcggcc

SEQ ID NO: 3196245 - RNA, 15 nt, Mycobacterium bovis subsp bovis AF2122/97
gcgcgcccgcggccg

SEQ ID NO: 3196246 - RNA, 13 nt, Mycobacterium bovis subsp bovis AF2122/97
gcgcgcccgggcg

SEQ ID NO: 3196247 - RNA, 17 nt, Mycobacterium bovis subsp bovis AF2122/97
gcgcgccgaaggccgcc

SEQ ID NO: 3196248 - RNA, 18 nt, Mycobacterium bovis subsp bovis AF2122/97
gcgcgccgaaggccgcca

SEQ ID NO: 3196249 - RNA, 20 nt, Mycobacterium bovis subsp bovis AF2122/97
gcgcgccgaccaccgcugcg

SEQ ID NO: 3196250 - RNA, 16 nt, Mycobacterium bovis subsp bovis AF2122/97
gcgcgccgaccagaac

SEQ ID NO: 3196251 - RNA, 18 nt, Mycobacterium bovis subsp bovis AF2122/97
gcgcgccgagcccgggcc

SEQ ID NO: 3196252 - RNA, 21 nt, Mycobacterium bovis subsp bovis AF2122/97
gcgcgccgauaugcgugagcu

SEQ ID NO: 3196253 - RNA, 14 nt, Mycobacterium bovis subsp bovis AF2122/97
gcgcgccgaucacg

SEQ ID NO: 3196254 - RNA, 20 nt, Mycobacterium bovis subsp bovis AF2122/97
gcgcgccgaucacggugggc

SEQ ID NO: 3196255 - RNA, 18 nt, Mycobacterium bovis subsp bovis AF2122/97
gcgcgccgaucggcaccg

SEQ ID NO: 3196256 - RNA, 12 nt, Mycobacterium bovis subsp bovis AF2122/97
gcgcgccgcaca

SEQ ID NO: 3196257 - RNA, 14 nt, Mycobacterium bovis subsp bovis AF2122/97
gcgcgccgcacccg

SEQ ID NO: 3196258 - RNA, 15 nt, Mycobacterium bovis subsp bovis AF2122/97
gcgcgccgcacccgg

SEQ ID NO: 3196259 - RNA, 16 nt, Mycobacterium bovis subsp bovis AF2122/97
gcgcgccgcagcgcgu

SEQ ID NO: 3196260 - RNA, 21 nt, Mycobacterium bovis subsp bovis AF2122/97
gcgcgccgcauccagccgugc

SEQ ID NO: 3196261 - RNA, 22 nt, Mycobacterium bovis subsp bovis AF2122/97
gcgcgccgcauccagccgugcg

SEQ ID NO: 3196262 - RNA, 20 nt, Mycobacterium bovis subsp bovis AF2122/97
gcgcgccgcaucggcgaaca

SEQ ID NO: 3196263 - RNA, 11 nt, Mycobacterium bovis subsp bovis AF2122/97
gcgcgccgcga

SEQ ID NO: 3196264 - RNA, 12 nt, Mycobacterium bovis subsp bovis AF2122/97
gcgcgccgcgac

SEQ ID NO: 3196265 - RNA, 14 nt, Mycobacterium bovis subsp bovis AF2122/97
gcgcgccgcgacga

SEQ ID NO: 3196266 - RNA, 14 nt, Mycobacterium bovis subsp bovis AF2122/97
gcgcgccgcugggu

SEQ ID NO: 3196267 - RNA, 16 nt, Mycobacterium bovis subsp bovis AF2122/97
gcgcgccggcgacccg

SEQ ID NO: 3196268 - RNA, 21 nt, Mycobacterium bovis subsp bovis AF2122/97
gcgcgccggcgguagucggcc

SEQ ID NO: 3196269 - RNA, 13 nt, Mycobacterium bovis subsp bovis AF2122/97
gcgcgccggcguc

SEQ ID NO: 3196270 - RNA, 22 nt, Mycobacterium bovis subsp bovis AF2122/97
gcgcgccggcuagggcccuggc

SEQ ID NO: 3196271 - RNA, 12 nt, Mycobacterium bovis subsp bovis AF2122/97
gcgcgccgggcg

SEQ ID NO: 3196272 - RNA, 14 nt, Mycobacterium bovis subsp bovis AF2122/97
gcgcgccggucgcc

SEQ ID NO: 3196273 - RNA, 22 nt, Mycobacterium bovis subsp bovis AF2122/97
gcgcgccggucgccgacggcga

SEQ ID NO: 3196274 - RNA, 13 nt, Mycobacterium bovis subsp bovis AF2122/97
gcgcgccgucggg

SEQ ID NO: 3196275 - RNA, 13 nt, Mycobacterium bovis subsp bovis AF2122/97
gcgcgccguucgc

SEQ ID NO: 3196276 - RNA, 18 nt, Mycobacterium bovis subsp bovis AF2122/97
gcgcgccuaugggccugc

SEQ ID NO: 3196277 - RNA, 19 nt, Mycobacterium bovis subsp bovis AF2122/97
gcgcgccuaugggccugcg

SEQ ID NO: 3196278 - RNA, 15 nt, Mycobacterium bovis subsp bovis AF2122/97
gcgcgccucgcccag

SEQ ID NO: 3196279 - RNA, 22 nt, Mycobacterium bovis subsp bovis AF2122/97
gcgcgccucgcccagcaaggcc

SEQ ID NO: 3196280 - RNA, 17 nt, Mycobacterium bovis subsp bovis AF2122/97
gcgcgccugugccaccg

SEQ ID NO: 3196281 - RNA, 17 nt, Mycobacterium bovis subsp bovis AF2122/97
gcgcgccuucacgcugg

SEQ ID NO: 3196282 - RNA, 19 nt, Mycobacterium bovis subsp bovis AF2122/97
gcgcgccuucacgcuggcc

SEQ ID NO: 3196283 - RNA, 16 nt, Mycobacterium bovis subsp bovis AF2122/97
gcgcgcgaacacccga

SEQ ID NO: 3196284 - RNA, 19 nt, Mycobacterium bovis subsp bovis AF2122/97
gcgcgcgaaccccagccga

SEQ ID NO: 3196285 - RNA, 20 nt, Mycobacterium bovis subsp bovis AF2122/97
gcgcgcgaccauacccgcgc

SEQ ID NO: 3196286 - RNA, 13 nt, Mycobacterium bovis subsp bovis AF2122/97
gcgcgcgauggcg

SEQ ID NO: 3196287 - RNA, 13 nt, Mycobacterium bovis subsp bovis AF2122/97
gcgcgcgcccgaa

SEQ ID NO: 3196288 - RNA, 14 nt, Mycobacterium bovis subsp bovis AF2122/97
gcgcgcgccgcagc

SEQ ID NO: 3196289 - RNA, 13 nt, Mycobacterium bovis subsp bovis AF2122/97
gcgcgcgcgccgg

SEQ ID NO: 3196290 - RNA, 13 nt, Mycobacterium bovis subsp bovis AF2122/97
gcgcgcgcggugc

SEQ ID NO: 3196291 - RNA, 21 nt, Mycobacterium bovis subsp bovis AF2122/97
gcgcgcggauggguacgacac

SEQ ID NO: 3196292 - RNA, 12 nt, Mycobacterium bovis subsp bovis AF2122/97
gcgcgcggcaac

SEQ ID NO: 3196293 - RNA, 13 nt, Mycobacterium bovis subsp bovis AF2122/97
gcgcgcggccgcg

SEQ ID NO: 3196294 - RNA, 14 nt, Mycobacterium bovis subsp bovis AF2122/97
gcgcgcggccgcgc

SEQ ID NO: 3196295 - RNA, 21 nt, Mycobacterium bovis subsp bovis AF2122/97
gcgcgcggccgcgcugcagca

SEQ ID NO: 3196296 - RNA, 12 nt, Mycobacterium bovis subsp bovis AF2122/97
gcgcgcggcgac

SEQ ID NO: 3196297 - RNA, 15 nt, Mycobacterium bovis subsp bovis AF2122/97
gcgcgcggcgaccau

SEQ ID NO: 3196298 - RNA, 20 nt, Mycobacterium bovis subsp bovis AF2122/97
gcgcgcggcgacgacggccu

SEQ ID NO: 3196299 - RNA, 17 nt, Mycobacterium bovis subsp bovis AF2122/97
gcgcgcggggccucgcg

SEQ ID NO: 3196300 - RNA, 20 nt, Mycobacterium bovis subsp bovis AF2122/97
gcgcgcggguuacccgcagc

SEQ ID NO: 3196301 - RNA, 23 nt, Mycobacterium bovis subsp bovis AF2122/97
gcgcgcggucgagguggcgggcg

SEQ ID NO: 3196302 - RNA, 17 nt, Mycobacterium bovis subsp bovis AF2122/97
gcgcgcggugcggccac

SEQ ID NO: 3196303 - RNA, 14 nt, Mycobacterium bovis subsp bovis AF2122/97
gcgcgcgucacauc

SEQ ID NO: 3196304 - RNA, 18 nt, Mycobacterium bovis subsp bovis AF2122/97
gcgcgcuacgcggccgag

SEQ ID NO: 3196305 - RNA, 13 nt, Mycobacterium bovis subsp bovis AF2122/97
gcgcgcucaacgg

SEQ ID NO: 3196306 - RNA, 18 nt, Mycobacterium bovis subsp bovis AF2122/97
gcgcgcucaacggcgaaa

SEQ ID NO: 3196307 - RNA, 14 nt, Mycobacterium bovis subsp bovis AF2122/97
gcgcgcucagguca

SEQ ID NO: 3196308 - RNA, 13 nt, Mycobacterium bovis subsp bovis AF2122/97
gcgcgcucaucga

SEQ ID NO: 3196309 - RNA, 16 nt, Mycobacterium bovis subsp bovis AF2122/97
gcgcgcucaucgaccg

SEQ ID NO: 3196310 - RNA, 21 nt, Mycobacterium bovis subsp bovis AF2122/97
gcgcgcucaucgaccgcggcc

SEQ ID NO: 3196311 - RNA, 12 nt, Mycobacterium bovis subsp bovis AF2122/97
gcgcgcucgccc

SEQ ID NO: 3196312 - RNA, 21 nt, Mycobacterium bovis subsp bovis AF2122/97
gcgcgcucgcucaccggcugg

SEQ ID NO: 3196313 - RNA, 22 nt, Mycobacterium bovis subsp bovis AF2122/97
gcgcgcucgcucaccggcuggu

SEQ ID NO: 3196314 - RNA, 18 nt, Mycobacterium bovis subsp bovis AF2122/97
gcgcgcucguggucgacg

SEQ ID NO: 3196315 - RNA, 19 nt, Mycobacterium bovis subsp bovis AF2122/97
gcgcgcugaaaugccgucg

SEQ ID NO: 3196316 - RNA, 13 nt, Mycobacterium bovis subsp bovis AF2122/97
gcgcgcugagccg

SEQ ID NO: 3196317 - RNA, 13 nt, Mycobacterium bovis subsp bovis AF2122/97
gcgcgcugccgcu

SEQ ID NO: 3196318 - RNA, 13 nt, Mycobacterium bovis subsp bovis AF2122/97
gcgcgcugcgcag

SEQ ID NO: 3196319 - RNA, 21 nt, Mycobacterium bovis subsp bovis AF2122/97
gcgcgcugcggaucguggcgc

SEQ ID NO: 3196320 - RNA, 15 nt, Mycobacterium bovis subsp bovis AF2122/97
gcgcgcuggccagcc

SEQ ID NO: 3196321 - RNA, 15 nt, Mycobacterium bovis subsp bovis AF2122/97
gcgcgcuggcgggcg

SEQ ID NO: 3196322 - RNA, 17 nt, Mycobacterium bovis subsp bovis AF2122/97
gcgcgcuggcgggcggc

SEQ ID NO: 3196323 - RNA, 14 nt, Mycobacterium bovis subsp bovis AF2122/97
gcgcgcugggcccg

SEQ ID NO: 3196324 - RNA, 16 nt, Mycobacterium bovis subsp bovis AF2122/97
gcgcgcugggcccgag

SEQ ID NO: 3196325 - RNA, 17 nt, Mycobacterium bovis subsp bovis AF2122/97
gcgcgcugggcccgagc

SEQ ID NO: 3196326 - RNA, 12 nt, Mycobacterium bovis subsp bovis AF2122/97
gcgcgcugggcg

SEQ ID NO: 3196327 - RNA, 22 nt, Mycobacterium bovis subsp bovis AF2122/97
gcgcgcuucaugagccgcugcg

SEQ ID NO: 3196328 - RNA, 20 nt, Mycobacterium bovis subsp bovis AF2122/97
gcgcggaacgcgucgccgac

SEQ ID NO: 3196329 - RNA, 15 nt, Mycobacterium bovis subsp bovis AF2122/97
gcgcggacccgccgu

SEQ ID NO: 3196330 - RNA, 22 nt, Mycobacterium bovis subsp bovis AF2122/97
gcgcggaccguguuguuagccc

SEQ ID NO: 3196331 - RNA, 19 nt, Mycobacterium bovis subsp bovis AF2122/97
gcgcggagagccugcucgc

SEQ ID NO: 3196332 - RNA, 19 nt, Mycobacterium bovis subsp bovis AF2122/97
gcgcggagugcccagggcc

SEQ ID NO: 3196333 - RNA, 19 nt, Mycobacterium bovis subsp bovis AF2122/97
gcgcggaucaacaggccgg

SEQ ID NO: 3196334 - RNA, 17 nt, Mycobacterium bovis subsp bovis AF2122/97
gcgcggaucggcggccg

SEQ ID NO: 3196335 - RNA, 18 nt, Mycobacterium bovis subsp bovis AF2122/97
gcgcggaucggcggccgc

SEQ ID NO: 3196336 - RNA, 19 nt, Mycobacterium bovis subsp bovis AF2122/97
gcgcggaucggcggccgcg

SEQ ID NO: 3196337 - RNA, 21 nt, Mycobacterium bovis subsp bovis AF2122/97
gcgcggaugaggaauucgauc

SEQ ID NO: 3196338 - RNA, 15 nt, Mycobacterium bovis subsp bovis AF2122/97
gcgcggauggccucg

SEQ ID NO: 3196339 - RNA, 20 nt, Mycobacterium bovis subsp bovis AF2122/97
gcgcggauggccucggcgau

SEQ ID NO: 3196340 - RNA, 22 nt, Mycobacterium bovis subsp bovis AF2122/97
gcgcggauggguacgacaccgc

SEQ ID NO: 3196341 - RNA, 18 nt, Mycobacterium bovis subsp bovis AF2122/97
gcgcggauuucgccguga

SEQ ID NO: 3196342 - RNA, 21 nt, Mycobacterium bovis subsp bovis AF2122/97
gcgcggcaaaguuggccgccc

SEQ ID NO: 3196343 - RNA, 16 nt, Mycobacterium bovis subsp bovis AF2122/97
gcgcggcaaccgucga

SEQ ID NO: 3196344 - RNA, 22 nt, Mycobacterium bovis subsp bovis AF2122/97
gcgcggcaagcucguccggugc

SEQ ID NO: 3196345 - RNA, 14 nt, Mycobacterium bovis subsp bovis AF2122/97
gcgcggcaccagca

SEQ ID NO: 3196346 - RNA, 14 nt, Mycobacterium bovis subsp bovis AF2122/97
gcgcggcacccggu

SEQ ID NO: 3196347 - RNA, 18 nt, Mycobacterium bovis subsp bovis AF2122/97
gcgcggcacccggucggc

SEQ ID NO: 3196348 - RNA, 11 nt, Mycobacterium bovis subsp bovis AF2122/97
gcgcggcaccg

SEQ ID NO: 3196349 - RNA, 17 nt, Mycobacterium bovis subsp bovis AF2122/97
gcgcggcaccgauggcg

SEQ ID NO: 3196350 - RNA, 21 nt, Mycobacterium bovis subsp bovis AF2122/97
gcgcggcaccgauggcgcacc

SEQ ID NO: 3196351 - RNA, 13 nt, Mycobacterium bovis subsp bovis AF2122/97
gcgcggcaggccu

SEQ ID NO: 3196352 - RNA, 14 nt, Mycobacterium bovis subsp bovis AF2122/97
gcgcggcaggccug

SEQ ID NO: 3196353 - RNA, 16 nt, Mycobacterium bovis subsp bovis AF2122/97
gcgcggcaggccuggc

SEQ ID NO: 3196354 - RNA, 17 nt, Mycobacterium bovis subsp bovis AF2122/97
gcgcggcaggccuggcg

SEQ ID NO: 3196355 - RNA, 20 nt, Mycobacterium bovis subsp bovis AF2122/97
gcgcggcaggccuggcgagc

SEQ ID NO: 3196356 - RNA, 15 nt, Mycobacterium bovis subsp bovis AF2122/97
gcgcggcaucccgcc

SEQ ID NO: 3196357 - RNA, 20 nt, Mycobacterium bovis subsp bovis AF2122/97
gcgcggccaauugcgccgcc

SEQ ID NO: 3196358 - RNA, 24 nt, Mycobacterium bovis subsp bovis AF2122/97
gcgcggccaccagaucgcacacca

SEQ ID NO: 3196359 - RNA, 17 nt, Mycobacterium bovis subsp bovis AF2122/97
gcgcggccacccgcgac

SEQ ID NO: 3196360 - RNA, 13 nt, Mycobacterium bovis subsp bovis AF2122/97
gcgcggccaccuc

SEQ ID NO: 3196361 - RNA, 16 nt, Mycobacterium bovis subsp bovis AF2122/97
gcgcggccacgccgau

SEQ ID NO: 3196362 - RNA, 18 nt, Mycobacterium bovis subsp bovis AF2122/97
gcgcggccacgccgauca

SEQ ID NO: 3196363 - RNA, 21 nt, Mycobacterium bovis subsp bovis AF2122/97
gcgcggccacgccgaucaaca

SEQ ID NO: 3196364 - RNA, 21 nt, Mycobacterium bovis subsp bovis AF2122/97
gcgcggccacuuggaugcgac

SEQ ID NO: 3196365 - RNA, 21 nt, Mycobacterium bovis subsp bovis AF2122/97
gcgcggccagagccgcgcgcc

SEQ ID NO: 3196366 - RNA, 20 nt, Mycobacterium bovis subsp bovis AF2122/97
gcgcggccagcccacucguc

SEQ ID NO: 3196367 - RNA, 22 nt, Mycobacterium bovis subsp bovis AF2122/97
gcgcggccagcccacucgucga

SEQ ID NO: 3196368 - RNA, 23 nt, Mycobacterium bovis subsp bovis AF2122/97
gcgcggccauggcagcgcgcuga

SEQ ID NO: 3196369 - RNA, 20 nt, Mycobacterium bovis subsp bovis AF2122/97
gcgcggccauuagcagcacc

SEQ ID NO: 3196370 - RNA, 20 nt, Mycobacterium bovis subsp bovis AF2122/97
gcgcggcccaccucaccgau

SEQ ID NO: 3196371 - RNA, 22 nt, Mycobacterium bovis subsp bovis AF2122/97
gcgcggcccagguccgcgugcu

SEQ ID NO: 3196372 - RNA, 12 nt, Mycobacterium bovis subsp bovis AF2122/97
gcgcggcccgcc

SEQ ID NO: 3196373 - RNA, 13 nt, Mycobacterium bovis subsp bovis AF2122/97
gcgcggcccgccg

SEQ ID NO: 3196374 - RNA, 17 nt, Mycobacterium bovis subsp bovis AF2122/97
gcgcggcccgccucggc

SEQ ID NO: 3196375 - RNA, 17 nt, Mycobacterium bovis subsp bovis AF2122/97
gcgcggccgcagccagc

SEQ ID NO: 3196376 - RNA, 13 nt, Mycobacterium bovis subsp bovis AF2122/97
gcgcggccggccg

SEQ ID NO: 3196377 - RNA, 19 nt, Mycobacterium bovis subsp bovis AF2122/97
gcgcggccggccgcucacc

SEQ ID NO: 3196378 - RNA, 20 nt, Mycobacterium bovis subsp bovis AF2122/97
gcgcggccggccgcucaccc

SEQ ID NO: 3196379 - RNA, 16 nt, Mycobacterium bovis subsp bovis AF2122/97
gcgcggccguagugca

SEQ ID NO: 3196380 - RNA, 20 nt, Mycobacterium bovis subsp bovis AF2122/97
gcgcggccguagugcacguc

SEQ ID NO: 3196381 - RNA, 19 nt, Mycobacterium bovis subsp bovis AF2122/97
gcgcggccgugaacggcgc

SEQ ID NO: 3196382 - RNA, 12 nt, Mycobacterium bovis subsp bovis AF2122/97
gcgcggccuugg

SEQ ID NO: 3196383 - RNA, 17 nt, Mycobacterium bovis subsp bovis AF2122/97
gcgcggccuuggugggc

SEQ ID NO: 3196384 - RNA, 19 nt, Mycobacterium bovis subsp bovis AF2122/97
gcgcggccuuggugggcag

SEQ ID NO: 3196385 - RNA, 22 nt, Mycobacterium bovis subsp bovis AF2122/97
gcgcggcgacaagccgagcccg

SEQ ID NO: 3196386 - RNA, 21 nt, Mycobacterium bovis subsp bovis AF2122/97
gcgcggcgaccauaagcucgu

SEQ ID NO: 3196387 - RNA, 17 nt, Mycobacterium bovis subsp bovis AF2122/97
gcgcggcgacgacggcc

SEQ ID NO: 3196388 - RNA, 20 nt, Mycobacterium bovis subsp bovis AF2122/97
gcgcggcgacgacggccugc

SEQ ID NO: 3196389 - RNA, 19 nt, Mycobacterium bovis subsp bovis AF2122/97
gcgcggcgagagccucggc

SEQ ID NO: 3196390 - RNA, 13 nt, Mycobacterium bovis subsp bovis AF2122/97
gcgcggcgagcac

SEQ ID NO: 3196391 - RNA, 19 nt, Mycobacterium bovis subsp bovis AF2122/97
gcgcggcgagcacgcgggc

SEQ ID NO: 3196392 - RNA, 14 nt, Mycobacterium bovis subsp bovis AF2122/97
gcgcggcgagggcg

SEQ ID NO: 3196393 - RNA, 20 nt, Mycobacterium bovis subsp bovis AF2122/97
gcgcggcgagggcggucagc

SEQ ID NO: 3196394 - RNA, 21 nt, Mycobacterium bovis subsp bovis AF2122/97
gcgcggcgaucgcuccgcggc

SEQ ID NO: 3196395 - RNA, 23 nt, Mycobacterium bovis subsp bovis AF2122/97
gcgcggcgaucgcuccgcggcgc

SEQ ID NO: 3196396 - RNA, 15 nt, Mycobacterium bovis subsp bovis AF2122/97
gcgcggcgcagcacc

SEQ ID NO: 3196397 - RNA, 21 nt, Mycobacterium bovis subsp bovis AF2122/97
gcgcggcgcagcaccgucggc

SEQ ID NO: 3196398 - RNA, 15 nt, Mycobacterium bovis subsp bovis AF2122/97
gcgcggcgcauuccg

SEQ ID NO: 3196399 - RNA, 12 nt, Mycobacterium bovis subsp bovis AF2122/97
gcgcggcgcccu

SEQ ID NO: 3196400 - RNA, 13 nt, Mycobacterium bovis subsp bovis AF2122/97
gcgcggcgcgaca

SEQ ID NO: 3196401 - RNA, 17 nt, Mycobacterium bovis subsp bovis AF2122/97
gcgcggcggagugcaug

SEQ ID NO: 3196402 - RNA, 13 nt, Mycobacterium bovis subsp bovis AF2122/97
gcgcggcggcauc

SEQ ID NO: 3196403 - RNA, 14 nt, Mycobacterium bovis subsp bovis AF2122/97
gcgcggcggccgcg

SEQ ID NO: 3196404 - RNA, 12 nt, Mycobacterium bovis subsp bovis AF2122/97
gcgcggcggcgc

SEQ ID NO: 3196405 - RNA, 16 nt, Mycobacterium bovis subsp bovis AF2122/97
gcgcggcggcgccggc

SEQ ID NO: 3196406 - RNA, 15 nt, Mycobacterium bovis subsp bovis AF2122/97
gcgcggcggcggagg

SEQ ID NO: 3196407 - RNA, 21 nt, Mycobacterium bovis subsp bovis AF2122/97
gcgcggcggcggaggcugggc

SEQ ID NO: 3196408 - RNA, 17 nt, Mycobacterium bovis subsp bovis AF2122/97
gcgcggcggcguccacc

SEQ ID NO: 3196409 - RNA, 14 nt, Mycobacterium bovis subsp bovis AF2122/97
gcgcggcggcgucg

SEQ ID NO: 3196410 - RNA, 13 nt, Mycobacterium bovis subsp bovis AF2122/97
gcgcggcgucgug

SEQ ID NO: 3196411 - RNA, 12 nt, Mycobacterium bovis subsp bovis AF2122/97
gcgcggcugccg

SEQ ID NO: 3196412 - RNA, 15 nt, Mycobacterium bovis subsp bovis AF2122/97
gcgcggcuggggccc

SEQ ID NO: 3196413 - RNA, 22 nt, Mycobacterium bovis subsp bovis AF2122/97
gcgcggcuggggccccgcgccg

SEQ ID NO: 3196414 - RNA, 23 nt, Mycobacterium bovis subsp bovis AF2122/97
gcgcggcuggggccccgcgccgg

SEQ ID NO: 3196415 - RNA, 16 nt, Mycobacterium bovis subsp bovis AF2122/97
gcgcggcugugcccga

SEQ ID NO: 3196416 - RNA, 14 nt, Mycobacterium bovis subsp bovis AF2122/97
gcgcggcuugggca

SEQ ID NO: 3196417 - RNA, 16 nt, Mycobacterium bovis subsp bovis AF2122/97
gcgcggcuugggcaga

SEQ ID NO: 3196418 - RNA, 21 nt, Mycobacterium bovis subsp bovis AF2122/97
gcgcggcuuguaccgcaauca

SEQ ID NO: 3196419 - RNA, 22 nt, Mycobacterium bovis subsp bovis AF2122/97
gcgcgggauguaccccggcccg

SEQ ID NO: 3196420 - RNA, 12 nt, Mycobacterium bovis subsp bovis AF2122/97
gcgcgggccacc

SEQ ID NO: 3196421 - RNA, 14 nt, Mycobacterium bovis subsp bovis AF2122/97
gcgcgggccgccgc

SEQ ID NO: 3196422 - RNA, 13 nt, Mycobacterium bovis subsp bovis AF2122/97
gcgcgggccggcg

SEQ ID NO: 3196423 - RNA, 12 nt, Mycobacterium bovis subsp bovis AF2122/97
gcgcgggccugg

SEQ ID NO: 3196424 - RNA, 13 nt, Mycobacterium bovis subsp bovis AF2122/97
gcgcgggcgacgu

SEQ ID NO: 3196425 - RNA, 13 nt, Mycobacterium bovis subsp bovis AF2122/97
gcgcgggcgagcg

SEQ ID NO: 3196426 - RNA, 15 nt, Mycobacterium bovis subsp bovis AF2122/97
gcgcgggcgccggga

SEQ ID NO: 3196427 - RNA, 16 nt, Mycobacterium bovis subsp bovis AF2122/97
gcgcgggcgccgggaa

SEQ ID NO: 3196428 - RNA, 17 nt, Mycobacterium bovis subsp bovis AF2122/97
gcgcgggcgccgggaag

SEQ ID NO: 3196429 - RNA, 21 nt, Mycobacterium bovis subsp bovis AF2122/97
gcgcgggcgccgggaagcccc

SEQ ID NO: 3196430 - RNA, 15 nt, Mycobacterium bovis subsp bovis AF2122/97
gcgcgggcggaucgc

SEQ ID NO: 3196431 - RNA, 17 nt, Mycobacterium bovis subsp bovis AF2122/97
gcgcgggcggaucgccg

SEQ ID NO: 3196432 - RNA, 17 nt, Mycobacterium bovis subsp bovis AF2122/97
gcgcgggcucgguggcg

SEQ ID NO: 3196433 - RNA, 23 nt, Mycobacterium bovis subsp bovis AF2122/97
gcgcgggcucgguggcggacggc

SEQ ID NO: 3196434 - RNA, 19 nt, Mycobacterium bovis subsp bovis AF2122/97
gcgcggggaugcgaccgcc

SEQ ID NO: 3196435 - RNA, 11 nt, Mycobacterium bovis subsp bovis AF2122/97
gcgcggggccg

SEQ ID NO: 3196436 - RNA, 16 nt, Mycobacterium bovis subsp bovis AF2122/97
gcgcggggccgccgcg

SEQ ID NO: 3196437 - RNA, 20 nt, Mycobacterium bovis subsp bovis AF2122/97
gcgcggggccgccgcggccg

SEQ ID NO: 3196438 - RNA, 14 nt, Mycobacterium bovis subsp bovis AF2122/97
gcgcgggggugggc

SEQ ID NO: 3196439 - RNA, 16 nt, Mycobacterium bovis subsp bovis AF2122/97
gcgcgggguggcggcg

SEQ ID NO: 3196440 - RNA, 18 nt, Mycobacterium bovis subsp bovis AF2122/97
gcgcgggguggcggcgcu

SEQ ID NO: 3196441 - RNA, 19 nt, Mycobacterium bovis subsp bovis AF2122/97
gcgcgggguggcggcgcug

SEQ ID NO: 3196442 - RNA, 21 nt, Mycobacterium bovis subsp bovis AF2122/97
gcgcggguacuuacgggucgc

SEQ ID NO: 3196443 - RNA, 22 nt, Mycobacterium bovis subsp bovis AF2122/97
gcgcggguacuuacgggucgcg

SEQ ID NO: 3196444 - RNA, 18 nt, Mycobacterium bovis subsp bovis AF2122/97
gcgcggguccagccaccg

SEQ ID NO: 3196445 - RNA, 15 nt, Mycobacterium bovis subsp bovis AF2122/97
gcgcgggucgcggcu

SEQ ID NO: 3196446 - RNA, 14 nt, Mycobacterium bovis subsp bovis AF2122/97
gcgcgggucggcga

SEQ ID NO: 3196447 - RNA, 17 nt, Mycobacterium bovis subsp bovis AF2122/97
gcgcgggugaccaggcg

SEQ ID NO: 3196448 - RNA, 17 nt, Mycobacterium bovis subsp bovis AF2122/97
gcgcgggugcgccggcg

SEQ ID NO: 3196449 - RNA, 14 nt, Mycobacterium bovis subsp bovis AF2122/97
gcgcgggugcucgg

SEQ ID NO: 3196450 - RNA, 19 nt, Mycobacterium bovis subsp bovis AF2122/97
gcgcggguggcagcggcga

SEQ ID NO: 3196451 - RNA, 14 nt, Mycobacterium bovis subsp bovis AF2122/97
gcgcggguggcucg

SEQ ID NO: 3196452 - RNA, 23 nt, Mycobacterium bovis subsp bovis AF2122/97
gcgcgggugguucaccucggcga

SEQ ID NO: 3196453 - RNA, 24 nt, Mycobacterium bovis subsp bovis AF2122/97
gcgcgggugguucaccucggcgac

SEQ ID NO: 3196454 - RNA, 13 nt, Mycobacterium bovis subsp bovis AF2122/97
gcgcgguaaccac

SEQ ID NO: 3196455 - RNA, 19 nt, Mycobacterium bovis subsp bovis AF2122/97
gcgcgguaccgcucgggcg

SEQ ID NO: 3196456 - RNA, 23 nt, Mycobacterium bovis subsp bovis AF2122/97
gcgcgguaccggugucaguccga

SEQ ID NO: 3196457 - RNA, 15 nt, Mycobacterium bovis subsp bovis AF2122/97
gcgcgguacugcgca

SEQ ID NO: 3196458 - RNA, 17 nt, Mycobacterium bovis subsp bovis AF2122/97
gcgcgguacugcgcagc

SEQ ID NO: 3196459 - RNA, 18 nt, Mycobacterium bovis subsp bovis AF2122/97
gcgcgguacugcgcagcg

SEQ ID NO: 3196460 - RNA, 12 nt, Mycobacterium bovis subsp bovis AF2122/97
gcgcggucaccg

SEQ ID NO: 3196461 - RNA, 19 nt, Mycobacterium bovis subsp bovis AF2122/97
gcgcggucaccgcgucacc

SEQ ID NO: 3196462 - RNA, 22 nt, Mycobacterium bovis subsp bovis AF2122/97
gcgcgguccuuguuagccucca

SEQ ID NO: 3196463 - RNA, 19 nt, Mycobacterium bovis subsp bovis AF2122/97
gcgcggucucggaaacgga

SEQ ID NO: 3196464 - RNA, 14 nt, Mycobacterium bovis subsp bovis AF2122/97
gcgcggugaccggg

SEQ ID NO: 3196465 - RNA, 14 nt, Mycobacterium bovis subsp bovis AF2122/97
gcgcggugacgagc

SEQ ID NO: 3196466 - RNA, 15 nt, Mycobacterium bovis subsp bovis AF2122/97
gcgcggugacgagcc

SEQ ID NO: 3196467 - RNA, 18 nt, Mycobacterium bovis subsp bovis AF2122/97
gcgcggugacgagccacc

SEQ ID NO: 3196468 - RNA, 20 nt, Mycobacterium bovis subsp bovis AF2122/97
gcgcggugacgagccaccac

SEQ ID NO: 3196469 - RNA, 21 nt, Mycobacterium bovis subsp bovis AF2122/97
gcgcggugacgagccaccacc

SEQ ID NO: 3196470 - RNA, 14 nt, Mycobacterium bovis subsp bovis AF2122/97
gcgcggugcccugc

SEQ ID NO: 3196471 - RNA, 15 nt, Mycobacterium bovis subsp bovis AF2122/97
gcgcggugcccugcc

SEQ ID NO: 3196472 - RNA, 17 nt, Mycobacterium bovis subsp bovis AF2122/97
gcgcggugcccugccgg

SEQ ID NO: 3196473 - RNA, 12 nt, Mycobacterium bovis subsp bovis AF2122/97
gcgcggugccgc

SEQ ID NO: 3196474 - RNA, 15 nt, Mycobacterium bovis subsp bovis AF2122/97
gcgcggugccgccac

SEQ ID NO: 3196475 - RNA, 17 nt, Mycobacterium bovis subsp bovis AF2122/97
gcgcggugccgccaccg

SEQ ID NO: 3196476 - RNA, 15 nt, Mycobacterium bovis subsp bovis AF2122/97
gcgcggugccggccg

SEQ ID NO: 3196477 - RNA, 22 nt, Mycobacterium bovis subsp bovis AF2122/97
gcgcggugcggccacucgcccg

SEQ ID NO: 3196478 - RNA, 15 nt, Mycobacterium bovis subsp bovis AF2122/97
gcgcgguggcggucg

SEQ ID NO: 3196479 - RNA, 16 nt, Mycobacterium bovis subsp bovis AF2122/97
gcgcgguggcggucgc

SEQ ID NO: 3196480 - RNA, 18 nt, Mycobacterium bovis subsp bovis AF2122/97
gcgcgguggcggucgcca

SEQ ID NO: 3196481 - RNA, 19 nt, Mycobacterium bovis subsp bovis AF2122/97
gcgcgguggcggucgccac

SEQ ID NO: 3196482 - RNA, 20 nt, Mycobacterium bovis subsp bovis AF2122/97
gcgcgguggggcgcgccggc

SEQ ID NO: 3196483 - RNA, 19 nt, Mycobacterium bovis subsp bovis AF2122/97
gcgcgguggucagcaccgg

SEQ ID NO: 3196484 - RNA, 13 nt, Mycobacterium bovis subsp bovis AF2122/97
gcgcgguggucgc

SEQ ID NO: 3196485 - RNA, 15 nt, Mycobacterium bovis subsp bovis AF2122/97
gcgcgguggucgcga

SEQ ID NO: 3196486 - RNA, 20 nt, Mycobacterium bovis subsp bovis AF2122/97
gcgcgguguagagcgcaccg

SEQ ID NO: 3196487 - RNA, 19 nt, Mycobacterium bovis subsp bovis AF2122/97
gcgcgguuuccagacgacc

SEQ ID NO: 3196488 - RNA, 20 nt, Mycobacterium bovis subsp bovis AF2122/97
gcgcgguuucggcgucaccg

SEQ ID NO: 3196489 - RNA, 22 nt, Mycobacterium bovis subsp bovis AF2122/97
gcgcgguuucggcgucaccgug

SEQ ID NO: 3196490 - RNA, 21 nt, Mycobacterium bovis subsp bovis AF2122/97
gcgcgguuuucggcugccgcu

SEQ ID NO: 3196491 - RNA, 22 nt, Mycobacterium bovis subsp bovis AF2122/97
gcgcgguuuucggcugccgcuc

SEQ ID NO: 3196492 - RNA, 24 nt, Mycobacterium bovis subsp bovis AF2122/97
gcgcgguuuucggcugccgcucga

SEQ ID NO: 3196493 - RNA, 21 nt, Mycobacterium bovis subsp bovis AF2122/97
gcgcguaauccgagcgcggcg

SEQ ID NO: 3196494 - RNA, 14 nt, Mycobacterium bovis subsp bovis AF2122/97
gcgcguacccgauc

SEQ ID NO: 3196495 - RNA, 19 nt, Mycobacterium bovis subsp bovis AF2122/97
gcgcguacccgaucagcga

SEQ ID NO: 3196496 - RNA, 14 nt, Mycobacterium bovis subsp bovis AF2122/97
gcgcguagcgggcg

SEQ ID NO: 3196497 - RNA, 15 nt, Mycobacterium bovis subsp bovis AF2122/97
gcgcguagcgggcgc

SEQ ID NO: 3196498 - RNA, 19 nt, Mycobacterium bovis subsp bovis AF2122/97
gcgcguagcgggcgcccuu

SEQ ID NO: 3196499 - RNA, 16 nt, Mycobacterium bovis subsp bovis AF2122/97
gcgcguagcgggggag

SEQ ID NO: 3196500 - RNA, 14 nt, Mycobacterium bovis subsp bovis AF2122/97
gcgcguagcucagc

SEQ ID NO: 3196501 - RNA, 19 nt, Mycobacterium bovis subsp bovis AF2122/97
gcgcguagcucagcgguag

SEQ ID NO: 3196502 - RNA, 17 nt, Mycobacterium bovis subsp bovis AF2122/97
gcgcguaggcccaacga

SEQ ID NO: 3196503 - RNA, 15 nt, Mycobacterium bovis subsp bovis AF2122/97
gcgcgucacauccga

SEQ ID NO: 3196504 - RNA, 19 nt, Mycobacterium bovis subsp bovis AF2122/97
gcgcgucagaccgcgaaca

SEQ ID NO: 3196505 - RNA, 22 nt, Mycobacterium bovis subsp bovis AF2122/97
gcgcgucaggccagcgcucacc

SEQ ID NO: 3196506 - RNA, 14 nt, Mycobacterium bovis subsp bovis AF2122/97
gcgcguccaaccaa

SEQ ID NO: 3196507 - RNA, 18 nt, Mycobacterium bovis subsp bovis AF2122/97
gcgcguccccagcgccac

SEQ ID NO: 3196508 - RNA, 15 nt, Mycobacterium bovis subsp bovis AF2122/97
gcgcguccgucggcg

SEQ ID NO: 3196509 - RNA, 13 nt, Mycobacterium bovis subsp bovis AF2122/97
gcgcgucgagcag

SEQ ID NO: 3196510 - RNA, 14 nt, Mycobacterium bovis subsp bovis AF2122/97
gcgcgucgagcagc

SEQ ID NO: 3196511 - RNA, 13 nt, Mycobacterium bovis subsp bovis AF2122/97
gcgcgucgagcga

SEQ ID NO: 3196512 - RNA, 14 nt, Mycobacterium bovis subsp bovis AF2122/97
gcgcgucgagcgac

SEQ ID NO: 3196513 - RNA, 14 nt, Mycobacterium bovis subsp bovis AF2122/97
gcgcgucgcccagu

SEQ ID NO: 3196514 - RNA, 21 nt, Mycobacterium bovis subsp bovis AF2122/97
gcgcgucgcccagugcgcaac

SEQ ID NO: 3196515 - RNA, 19 nt, Mycobacterium bovis subsp bovis AF2122/97
gcgcgucgcgcgcggcaug

SEQ ID NO: 3196516 - RNA, 22 nt, Mycobacterium bovis subsp bovis AF2122/97
gcgcgucgcgggauugcgcgcu

SEQ ID NO: 3196517 - RNA, 12 nt, Mycobacterium bovis subsp bovis AF2122/97
gcgcgucggcac

SEQ ID NO: 3196518 - RNA, 14 nt, Mycobacterium bovis subsp bovis AF2122/97
gcgcgucggcaccg

SEQ ID NO: 3196519 - RNA, 17 nt, Mycobacterium bovis subsp bovis AF2122/97
gcgcgucggcaccgauc

SEQ ID NO: 3196520 - RNA, 14 nt, Mycobacterium bovis subsp bovis AF2122/97
gcgcgucggcguug

SEQ ID NO: 3196521 - RNA, 15 nt, Mycobacterium bovis subsp bovis AF2122/97
gcgcgucggucaccg

SEQ ID NO: 3196522 - RNA, 22 nt, Mycobacterium bovis subsp bovis AF2122/97
gcgcgucggugggucucggcgu

SEQ ID NO: 3196523 - RNA, 14 nt, Mycobacterium bovis subsp bovis AF2122/97
gcgcgucgucgcgc

SEQ ID NO: 3196524 - RNA, 21 nt, Mycobacterium bovis subsp bovis AF2122/97
gcgcgucgucgcgcugaacgc

SEQ ID NO: 3196525 - RNA, 20 nt, Mycobacterium bovis subsp bovis AF2122/97
gcgcgucguugccgggguag

SEQ ID NO: 3196526 - RNA, 16 nt, Mycobacterium bovis subsp bovis AF2122/97
gcgcgugacagugacc

SEQ ID NO: 3196527 - RNA, 18 nt, Mycobacterium bovis subsp bovis AF2122/97
gcgcgugacgaccagccc

SEQ ID NO: 3196528 - RNA, 12 nt, Mycobacterium bovis subsp bovis AF2122/97
gcgcgugacgau

SEQ ID NO: 3196529 - RNA, 12 nt, Mycobacterium bovis subsp bovis AF2122/97
gcgcgugcagcc

SEQ ID NO: 3196530 - RNA, 16 nt, Mycobacterium bovis subsp bovis AF2122/97
gcgcgugcccguggug

SEQ ID NO: 3196531 - RNA, 15 nt, Mycobacterium bovis subsp bovis AF2122/97
gcgcgugcucgacgc

SEQ ID NO: 3196532 - RNA, 17 nt, Mycobacterium bovis subsp bovis AF2122/97
gcgcgugcucgacgcgc

SEQ ID NO: 3196533 - RNA, 20 nt, Mycobacterium bovis subsp bovis AF2122/97
gcgcgugcugcagaucggcc

SEQ ID NO: 3196534 - RNA, 14 nt, Mycobacterium bovis subsp bovis AF2122/97
gcgcgugcugcgga

SEQ ID NO: 3196535 - RNA, 16 nt, Mycobacterium bovis subsp bovis AF2122/97
gcgcguggaaaccggu

SEQ ID NO: 3196536 - RNA, 18 nt, Mycobacterium bovis subsp bovis AF2122/97
gcgcguggcagugcaggc

SEQ ID NO: 3196537 - RNA, 17 nt, Mycobacterium bovis subsp bovis AF2122/97
gcgcguggucgccccga

SEQ ID NO: 3196538 - RNA, 15 nt, Mycobacterium bovis subsp bovis AF2122/97
gcgcguggucgggaa

SEQ ID NO: 3196539 - RNA, 21 nt, Mycobacterium bovis subsp bovis AF2122/97
gcgcguuacccaucgccacac

SEQ ID NO: 3196540 - RNA, 22 nt, Mycobacterium bovis subsp bovis AF2122/97
gcgcguuacccaucgccacacc

SEQ ID NO: 3196541 - RNA, 14 nt, Mycobacterium bovis subsp bovis AF2122/97
gcgcguuccagcac

SEQ ID NO: 3196542 - RNA, 20 nt, Mycobacterium bovis subsp bovis AF2122/97
gcgcguuccagcacacccag

SEQ ID NO: 3196543 - RNA, 16 nt, Mycobacterium bovis subsp bovis AF2122/97
gcgcguucgaccucga

SEQ ID NO: 3196544 - RNA, 17 nt, Mycobacterium bovis subsp bovis AF2122/97
gcgcguucggcgagcag

SEQ ID NO: 3196545 - RNA, 19 nt, Mycobacterium bovis subsp bovis AF2122/97
gcgcguucggcgagcagcg

SEQ ID NO: 3196546 - RNA, 19 nt, Mycobacterium bovis subsp bovis AF2122/97
gcgcguucgucgucgcuga

SEQ ID NO: 3196547 - RNA, 18 nt, Mycobacterium bovis subsp bovis AF2122/97
gcgcguugaagucgccgg

SEQ ID NO: 3196548 - RNA, 22 nt, Mycobacterium bovis subsp bovis AF2122/97
gcgcguugaagucgccggugac

SEQ ID NO: 3196549 - RNA, 23 nt, Mycobacterium bovis subsp bovis AF2122/97
gcgcguugaccgaacgcacgucg

SEQ ID NO: 3196550 - RNA, 18 nt, Mycobacterium bovis subsp bovis AF2122/97
gcgcguugcugcagcagc

SEQ ID NO: 3196551 - RNA, 16 nt, Mycobacterium bovis subsp bovis AF2122/97
gcgcguugcuggucgc

SEQ ID NO: 3196552 - RNA, 18 nt, Mycobacterium bovis subsp bovis AF2122/97
gcgcguugcuggucgccg

SEQ ID NO: 3196553 - RNA, 22 nt, Mycobacterium bovis subsp bovis AF2122/97
gcgcguugcuggucgccgucga

SEQ ID NO: 3196554 - RNA, 21 nt, Mycobacterium bovis subsp bovis AF2122/97
gcgcguugggaccagugcggu

SEQ ID NO: 3196555 - RNA, 22 nt, Mycobacterium bovis subsp bovis AF2122/97
gcgcguuuagucuccggcgucg

SEQ ID NO: 3196556 - RNA, 23 nt, Mycobacterium bovis subsp bovis AF2122/97
gcgcguuugguuuucccggcguc

SEQ ID NO: 3196557 - RNA, 15 nt, Mycobacterium bovis subsp bovis AF2122/97
gcgcuaccagccaua

SEQ ID NO: 3196558 - RNA, 14 nt, Mycobacterium bovis subsp bovis AF2122/97
gcgcuacgcggccg

SEQ ID NO: 3196559 - RNA, 16 nt, Mycobacterium bovis subsp bovis AF2122/97
gcgcuacgucaagccg

SEQ ID NO: 3196560 - RNA, 18 nt, Mycobacterium bovis subsp bovis AF2122/97
gcgcuacuacugcagucc

SEQ ID NO: 3196561 - RNA, 16 nt, Mycobacterium bovis subsp bovis AF2122/97
gcgcuagccgggcgcg

SEQ ID NO: 3196562 - RNA, 18 nt, Mycobacterium bovis subsp bovis AF2122/97
gcgcuagccgggcgcgcc

SEQ ID NO: 3196563 - RNA, 21 nt, Mycobacterium bovis subsp bovis AF2122/97
gcgcuagccgggcgcgccggc

SEQ ID NO: 3196564 - RNA, 15 nt, Mycobacterium bovis subsp bovis AF2122/97
gcgcuagcgccgcgc

SEQ ID NO: 3196565 - RNA, 14 nt, Mycobacterium bovis subsp bovis AF2122/97
gcgcuauaggccgc

SEQ ID NO: 3196566 - RNA, 15 nt, Mycobacterium bovis subsp bovis AF2122/97
gcgcuaucaugacca

SEQ ID NO: 3196567 - RNA, 19 nt, Mycobacterium bovis subsp bovis AF2122/97
gcgcuaucaugaccaccga

SEQ ID NO: 3196568 - RNA, 15 nt, Mycobacterium bovis subsp bovis AF2122/97
gcgcucaacggcgaa

SEQ ID NO: 3196569 - RNA, 20 nt, Mycobacterium bovis subsp bovis AF2122/97
gcgcucaaugaucgcggcgg

SEQ ID NO: 3196570 - RNA, 19 nt, Mycobacterium bovis subsp bovis AF2122/97
gcgcucaaugcggucaacg

SEQ ID NO: 3196571 - RNA, 21 nt, Mycobacterium bovis subsp bovis AF2122/97
gcgcucaaugcggucaacgac

SEQ ID NO: 3196572 - RNA, 14 nt, Mycobacterium bovis subsp bovis AF2122/97
gcgcucacccgccg

SEQ ID NO: 3196573 - RNA, 15 nt, Mycobacterium bovis subsp bovis AF2122/97
gcgcucacccgccgc

SEQ ID NO: 3196574 - RNA, 16 nt, Mycobacterium bovis subsp bovis AF2122/97
gcgcucaccgacgcug

SEQ ID NO: 3196575 - RNA, 17 nt, Mycobacterium bovis subsp bovis AF2122/97
gcgcucaccgacgcuga

SEQ ID NO: 3196576 - RNA, 18 nt, Mycobacterium bovis subsp bovis AF2122/97
gcgcucaccgacgcugac

SEQ ID NO: 3196577 - RNA, 15 nt, Mycobacterium bovis subsp bovis AF2122/97
gcgcucaccggggcc

SEQ ID NO: 3196578 - RNA, 15 nt, Mycobacterium bovis subsp bovis AF2122/97
gcgcucacugcagcg

SEQ ID NO: 3196579 - RNA, 19 nt, Mycobacterium bovis subsp bovis AF2122/97
gcgcucagcgcggccacgc

SEQ ID NO: 3196580 - RNA, 18 nt, Mycobacterium bovis subsp bovis AF2122/97
gcgcucagcuccggcgac

SEQ ID NO: 3196581 - RNA, 23 nt, Mycobacterium bovis subsp bovis AF2122/97
gcgcucagcuccggcgacucugu

SEQ ID NO: 3196582 - RNA, 12 nt, Mycobacterium bovis subsp bovis AF2122/97
gcgcucagguca

SEQ ID NO: 3196583 - RNA, 20 nt, Mycobacterium bovis subsp bovis AF2122/97
gcgcucaggucaucggcggc

SEQ ID NO: 3196584 - RNA, 23 nt, Mycobacterium bovis subsp bovis AF2122/97
gcgcucaggucaucggcggcggg

SEQ ID NO: 3196585 - RNA, 18 nt, Mycobacterium bovis subsp bovis AF2122/97
gcgcucaucacccagcgc

SEQ ID NO: 3196586 - RNA, 20 nt, Mycobacterium bovis subsp bovis AF2122/97
gcgcucaucacccagcgccg

SEQ ID NO: 3196587 - RNA, 14 nt, Mycobacterium bovis subsp bovis AF2122/97
gcgcucaucgaccg

SEQ ID NO: 3196588 - RNA, 19 nt, Mycobacterium bovis subsp bovis AF2122/97
gcgcucaucgaccgcggcc

SEQ ID NO: 3196589 - RNA, 17 nt, Mycobacterium bovis subsp bovis AF2122/97
gcgcucaucgcggcgaa

SEQ ID NO: 3196590 - RNA, 21 nt, Mycobacterium bovis subsp bovis AF2122/97
gcgcucauguucucgaccgcg

SEQ ID NO: 3196591 - RNA, 19 nt, Mycobacterium bovis subsp bovis AF2122/97
gcgcuccaacaacuccagc

SEQ ID NO: 3196592 - RNA, 19 nt, Mycobacterium bovis subsp bovis AF2122/97
gcgcuccaacaaugccagc

SEQ ID NO: 3196593 - RNA, 17 nt, Mycobacterium bovis subsp bovis AF2122/97
gcgcuccacugaccagg

SEQ ID NO: 3196594 - RNA, 13 nt, Mycobacterium bovis subsp bovis AF2122/97
gcgcuccagcacc

SEQ ID NO: 3196595 - RNA, 15 nt, Mycobacterium bovis subsp bovis AF2122/97
gcgcuccagcacccg

SEQ ID NO: 3196596 - RNA, 18 nt, Mycobacterium bovis subsp bovis AF2122/97
gcgcuccagcacccgcgc

SEQ ID NO: 3196597 - RNA, 20 nt, Mycobacterium bovis subsp bovis AF2122/97
gcgcuccagcacccgcgcga

SEQ ID NO: 3196598 - RNA, 23 nt, Mycobacterium bovis subsp bovis AF2122/97
gcgcuccagcacccgcgcgacgc

SEQ ID NO: 3196599 - RNA, 17 nt, Mycobacterium bovis subsp bovis AF2122/97
gcgcuccagccgcgcgu

SEQ ID NO: 3196600 - RNA, 21 nt, Mycobacterium bovis subsp bovis AF2122/97
gcgcuccagccgcgcguccgg

SEQ ID NO: 3196601 - RNA, 17 nt, Mycobacterium bovis subsp bovis AF2122/97
gcgcuccagcugagcgg

SEQ ID NO: 3196602 - RNA, 22 nt, Mycobacterium bovis subsp bovis AF2122/97
gcgcuccagcugagcggccggc

SEQ ID NO: 3196603 - RNA, 23 nt, Mycobacterium bovis subsp bovis AF2122/97
gcgcuccagcugagcggccggca

SEQ ID NO: 3196604 - RNA, 17 nt, Mycobacterium bovis subsp bovis AF2122/97
gcgcucccggagcacaa

SEQ ID NO: 3196605 - RNA, 13 nt, Mycobacterium bovis subsp bovis AF2122/97
gcgcucccguacg

SEQ ID NO: 3196606 - RNA, 17 nt, Mycobacterium bovis subsp bovis AF2122/97
gcgcucccguacgccgg

SEQ ID NO: 3196607 - RNA, 19 nt, Mycobacterium bovis subsp bovis AF2122/97
gcgcucccguacgccggcg

SEQ ID NO: 3196608 - RNA, 20 nt, Mycobacterium bovis subsp bovis AF2122/97
gcgcucccguacgccggcgg

SEQ ID NO: 3196609 - RNA, 17 nt, Mycobacterium bovis subsp bovis AF2122/97
gcgcuccggcgcgacgc

SEQ ID NO: 3196610 - RNA, 19 nt, Mycobacterium bovis subsp bovis AF2122/97
gcgcuccggcgcgacgccc

SEQ ID NO: 3196611 - RNA, 20 nt, Mycobacterium bovis subsp bovis AF2122/97
gcgcuccuucagggcgucga

SEQ ID NO: 3196612 - RNA, 22 nt, Mycobacterium bovis subsp bovis AF2122/97
gcgcucgaacuccccggucgcc

SEQ ID NO: 3196613 - RNA, 23 nt, Mycobacterium bovis subsp bovis AF2122/97
gcgcucgaacuccccggucgccg

SEQ ID NO: 3196614 - RNA, 15 nt, Mycobacterium bovis subsp bovis AF2122/97
gcgcucgacgagcac

SEQ ID NO: 3196615 - RNA, 17 nt, Mycobacterium bovis subsp bovis AF2122/97
gcgcucgaucacuagcg

SEQ ID NO: 3196616 - RNA, 20 nt, Mycobacterium bovis subsp bovis AF2122/97
gcgcucgauggcggccacca

SEQ ID NO: 3196617 - RNA, 21 nt, Mycobacterium bovis subsp bovis AF2122/97
gcgcucgauggcggccaccag

SEQ ID NO: 3196618 - RNA, 23 nt, Mycobacterium bovis subsp bovis AF2122/97
gcgcucgauggcggccaccagcg

SEQ ID NO: 3196619 - RNA, 17 nt, Mycobacterium bovis subsp bovis AF2122/97
gcgcucgcaccaccacg

SEQ ID NO: 3196620 - RNA, 17 nt, Mycobacterium bovis subsp bovis AF2122/97
gcgcucgcacccgcucg

SEQ ID NO: 3196621 - RNA, 20 nt, Mycobacterium bovis subsp bovis AF2122/97
gcgcucgcacccgcucggcg

SEQ ID NO: 3196622 - RNA, 21 nt, Mycobacterium bovis subsp bovis AF2122/97
gcgcucgcacccgcucggcgc

SEQ ID NO: 3196623 - RNA, 20 nt, Mycobacterium bovis subsp bovis AF2122/97
gcgcucgcccaggaagccga

SEQ ID NO: 3196624 - RNA, 16 nt, Mycobacterium bovis subsp bovis AF2122/97
gcgcucgcccgcggcc

SEQ ID NO: 3196625 - RNA, 19 nt, Mycobacterium bovis subsp bovis AF2122/97
gcgcucgcccgcggccgug

SEQ ID NO: 3196626 - RNA, 23 nt, Mycobacterium bovis subsp bovis AF2122/97
gcgcucgcccgcggccguggugg

SEQ ID NO: 3196627 - RNA, 13 nt, Mycobacterium bovis subsp bovis AF2122/97
gcgcucgcgcgcu

SEQ ID NO: 3196628 - RNA, 17 nt, Mycobacterium bovis subsp bovis AF2122/97
gcgcucgcgcgguaguc

SEQ ID NO: 3196629 - RNA, 13 nt, Mycobacterium bovis subsp bovis AF2122/97
gcgcucgcggcgg

SEQ ID NO: 3196630 - RNA, 14 nt, Mycobacterium bovis subsp bovis AF2122/97
gcgcucgcggcggc

SEQ ID NO: 3196631 - RNA, 16 nt, Mycobacterium bovis subsp bovis AF2122/97
gcgcucgcggcggcgc

SEQ ID NO: 3196632 - RNA, 16 nt, Mycobacterium bovis subsp bovis AF2122/97
gcgcucgcucaccggc

SEQ ID NO: 3196633 - RNA, 17 nt, Mycobacterium bovis subsp bovis AF2122/97
gcgcucgcucaccggcg

SEQ ID NO: 3196634 - RNA, 18 nt, Mycobacterium bovis subsp bovis AF2122/97
gcgcucgcucaccggcgc

SEQ ID NO: 3196635 - RNA, 16 nt, Mycobacterium bovis subsp bovis AF2122/97
gcgcucggcagccggc

SEQ ID NO: 3196636 - RNA, 13 nt, Mycobacterium bovis subsp bovis AF2122/97
gcgcucggcgagc

SEQ ID NO: 3196637 - RNA, 23 nt, Mycobacterium bovis subsp bovis AF2122/97
gcgcucggcgagcaacacgagcg

SEQ ID NO: 3196638 - RNA, 17 nt, Mycobacterium bovis subsp bovis AF2122/97
gcgcucggcgaucugcg

SEQ ID NO: 3196639 - RNA, 14 nt, Mycobacterium bovis subsp bovis AF2122/97
gcgcucgggcgaga

SEQ ID NO: 3196640 - RNA, 20 nt, Mycobacterium bovis subsp bovis AF2122/97
gcgcucggucuccaccaccg

SEQ ID NO: 3196641 - RNA, 21 nt, Mycobacterium bovis subsp bovis AF2122/97
gcgcucggucuccaccaccga

SEQ ID NO: 3196642 - RNA, 18 nt, Mycobacterium bovis subsp bovis AF2122/97
gcgcucguagaaucggcu

SEQ ID NO: 3196643 - RNA, 13 nt, Mycobacterium bovis subsp bovis AF2122/97
gcgcucgucgcgg

SEQ ID NO: 3196644 - RNA, 17 nt, Mycobacterium bovis subsp bovis AF2122/97
gcgcucgucgcggcccg

SEQ ID NO: 3196645 - RNA, 23 nt, Mycobacterium bovis subsp bovis AF2122/97
gcgcucgucuaccccgagccuug

SEQ ID NO: 3196646 - RNA, 16 nt, Mycobacterium bovis subsp bovis AF2122/97
gcgcucgugauguuga

SEQ ID NO: 3196647 - RNA, 18 nt, Mycobacterium bovis subsp bovis AF2122/97
gcgcucucauagcgacgg

SEQ ID NO: 3196648 - RNA, 19 nt, Mycobacterium bovis subsp bovis AF2122/97
gcgcucucauagcgacggc

SEQ ID NO: 3196649 - RNA, 21 nt, Mycobacterium bovis subsp bovis AF2122/97
gcgcucucauagcgacggcgc

SEQ ID NO: 3196650 - RNA, 16 nt, Mycobacterium bovis subsp bovis AF2122/97
gcgcugaacgcgagca

SEQ ID NO: 3196651 - RNA, 18 nt, Mycobacterium bovis subsp bovis AF2122/97
gcgcugaacuagggucgg

SEQ ID NO: 3196652 - RNA, 22 nt, Mycobacterium bovis subsp bovis AF2122/97
gcgcugaagaucaacaggcguc

SEQ ID NO: 3196653 - RNA, 17 nt, Mycobacterium bovis subsp bovis AF2122/97
gcgcugaagcccauggc

SEQ ID NO: 3196654 - RNA, 21 nt, Mycobacterium bovis subsp bovis AF2122/97
gcgcugaagccgacgauccac

SEQ ID NO: 3196655 - RNA, 18 nt, Mycobacterium bovis subsp bovis AF2122/97
gcgcugaaggccgguagc

SEQ ID NO: 3196656 - RNA, 17 nt, Mycobacterium bovis subsp bovis AF2122/97
gcgcugaagguggcgaa

SEQ ID NO: 3196657 - RNA, 23 nt, Mycobacterium bovis subsp bovis AF2122/97
gcgcugaagguggcgaacccggu

SEQ ID NO: 3196658 - RNA, 15 nt, Mycobacterium bovis subsp bovis AF2122/97
gcgcugaaucacccc

SEQ ID NO: 3196659 - RNA, 21 nt, Mycobacterium bovis subsp bovis AF2122/97
gcgcugaaucaccccggcggc

SEQ ID NO: 3196660 - RNA, 22 nt, Mycobacterium bovis subsp bovis AF2122/97
gcgcugaaucaccccggcggcc

SEQ ID NO: 3196661 - RNA, 20 nt, Mycobacterium bovis subsp bovis AF2122/97
gcgcugacgacccuccgcac

SEQ ID NO: 3196662 - RNA, 20 nt, Mycobacterium bovis subsp bovis AF2122/97
gcgcugagccguagugucgg

SEQ ID NO: 3196663 - RNA, 14 nt, Mycobacterium bovis subsp bovis AF2122/97
gcgcugagcgacug

SEQ ID NO: 3196664 - RNA, 22 nt, Mycobacterium bovis subsp bovis AF2122/97
gcgcugagcgacugcagcggcg

SEQ ID NO: 3196665 - RNA, 18 nt, Mycobacterium bovis subsp bovis AF2122/97
gcgcugagguggcggugc

SEQ ID NO: 3196666 - RNA, 14 nt, Mycobacterium bovis subsp bovis AF2122/97
gcgcugaucgcgcg

SEQ ID NO: 3196667 - RNA, 17 nt, Mycobacterium bovis subsp bovis AF2122/97
gcgcugaucgcgcgcac

SEQ ID NO: 3196668 - RNA, 19 nt, Mycobacterium bovis subsp bovis AF2122/97
gcgcugaucgcgcgcaccg

SEQ ID NO: 3196669 - RNA, 14 nt, Mycobacterium bovis subsp bovis AF2122/97
gcgcugaucggcag

SEQ ID NO: 3196670 - RNA, 15 nt, Mycobacterium bovis subsp bovis AF2122/97
gcgcugaugcgcugg

SEQ ID NO: 3196671 - RNA, 16 nt, Mycobacterium bovis subsp bovis AF2122/97
gcgcugaugcgcuggg

SEQ ID NO: 3196672 - RNA, 17 nt, Mycobacterium bovis subsp bovis AF2122/97
gcgcugaugcuggccau

SEQ ID NO: 3196673 - RNA, 19 nt, Mycobacterium bovis subsp bovis AF2122/97
gcgcugauggugcugcggc

SEQ ID NO: 3196674 - RNA, 15 nt, Mycobacterium bovis subsp bovis AF2122/97
gcgcugcaccggguc

SEQ ID NO: 3196675 - RNA, 16 nt, Mycobacterium bovis subsp bovis AF2122/97
gcgcugcagcugcucg

SEQ ID NO: 3196676 - RNA, 22 nt, Mycobacterium bovis subsp bovis AF2122/97
gcgcugccaaacuaacggcagc

SEQ ID NO: 3196677 - RNA, 23 nt, Mycobacterium bovis subsp bovis AF2122/97
gcgcugccaaacuaacggcagcc

SEQ ID NO: 3196678 - RNA, 20 nt, Mycobacterium bovis subsp bovis AF2122/97
gcgcugccaauccgaucgag

SEQ ID NO: 3196679 - RNA, 14 nt, Mycobacterium bovis subsp bovis AF2122/97
gcgcugccaccgcg

SEQ ID NO: 3196680 - RNA, 19 nt, Mycobacterium bovis subsp bovis AF2122/97
gcgcugccaccgcgguggc

SEQ ID NO: 3196681 - RNA, 18 nt, Mycobacterium bovis subsp bovis AF2122/97
gcgcugccaggccgcuga

SEQ ID NO: 3196682 - RNA, 14 nt, Mycobacterium bovis subsp bovis AF2122/97
gcgcugcccacgga

SEQ ID NO: 3196683 - RNA, 17 nt, Mycobacterium bovis subsp bovis AF2122/97
gcgcugccgacuccucg

SEQ ID NO: 3196684 - RNA, 23 nt, Mycobacterium bovis subsp bovis AF2122/97
gcgcugccgacuccucguccugg

SEQ ID NO: 3196685 - RNA, 13 nt, Mycobacterium bovis subsp bovis AF2122/97
gcgcugccgccgu

SEQ ID NO: 3196686 - RNA, 23 nt, Mycobacterium bovis subsp bovis AF2122/97
gcgcugccgccguuuccugcguc

SEQ ID NO: 3196687 - RNA, 15 nt, Mycobacterium bovis subsp bovis AF2122/97
gcgcugccggccgcg

SEQ ID NO: 3196688 - RNA, 14 nt, Mycobacterium bovis subsp bovis AF2122/97
gcgcugcgcaccgc

SEQ ID NO: 3196689 - RNA, 15 nt, Mycobacterium bovis subsp bovis AF2122/97
gcgcugcgcaccgcc

SEQ ID NO: 3196690 - RNA, 11 nt, Mycobacterium bovis subsp bovis AF2122/97
gcgcugcgcag

SEQ ID NO: 3196691 - RNA, 14 nt, Mycobacterium bovis subsp bovis AF2122/97
gcgcugcggccagc

SEQ ID NO: 3196692 - RNA, 20 nt, Mycobacterium bovis subsp bovis AF2122/97
gcgcugcggcgugccgggug

SEQ ID NO: 3196693 - RNA, 19 nt, Mycobacterium bovis subsp bovis AF2122/97
gcgcugcgggaaccccagc

SEQ ID NO: 3196694 - RNA, 16 nt, Mycobacterium bovis subsp bovis AF2122/97
gcgcugcucacgcagc

SEQ ID NO: 3196695 - RNA, 19 nt, Mycobacterium bovis subsp bovis AF2122/97
gcgcugcucacgcagcagu

SEQ ID NO: 3196696 - RNA, 18 nt, Mycobacterium bovis subsp bovis AF2122/97
gcgcuggaccgggucggg

SEQ ID NO: 3196697 - RNA, 14 nt, Mycobacterium bovis subsp bovis AF2122/97
gcgcuggacggcgg

SEQ ID NO: 3196698 - RNA, 20 nt, Mycobacterium bovis subsp bovis AF2122/97
gcgcuggacggcgggccgcg

SEQ ID NO: 3196699 - RNA, 18 nt, Mycobacterium bovis subsp bovis AF2122/97
gcgcuggaggccaccacc

SEQ ID NO: 3196700 - RNA, 17 nt, Mycobacterium bovis subsp bovis AF2122/97
gcgcuggaggcuccugg

SEQ ID NO: 3196701 - RNA, 23 nt, Mycobacterium bovis subsp bovis AF2122/97
gcgcuggaggcuccuggucgccg

SEQ ID NO: 3196702 - RNA, 19 nt, Mycobacterium bovis subsp bovis AF2122/97
gcgcuggaucucguuggug

SEQ ID NO: 3196703 - RNA, 21 nt, Mycobacterium bovis subsp bovis AF2122/97
gcgcuggaugugggcgcucgc

SEQ ID NO: 3196704 - RNA, 16 nt, Mycobacterium bovis subsp bovis AF2122/97
gcgcuggcaggccggg

SEQ ID NO: 3196705 - RNA, 21 nt, Mycobacterium bovis subsp bovis AF2122/97
gcgcuggcaggcuuagcuucc

SEQ ID NO: 3196706 - RNA, 14 nt, Mycobacterium bovis subsp bovis AF2122/97
gcgcuggccagcag

SEQ ID NO: 3196707 - RNA, 15 nt, Mycobacterium bovis subsp bovis AF2122/97
gcgcuggccagcagg

SEQ ID NO: 3196708 - RNA, 16 nt, Mycobacterium bovis subsp bovis AF2122/97
gcgcuggccagcccgg

SEQ ID NO: 3196709 - RNA, 16 nt, Mycobacterium bovis subsp bovis AF2122/97
gcgcuggccauggugg

SEQ ID NO: 3196710 - RNA, 13 nt, Mycobacterium bovis subsp bovis AF2122/97
gcgcuggccgucg

SEQ ID NO: 3196711 - RNA, 13 nt, Mycobacterium bovis subsp bovis AF2122/97
gcgcuggcgcccu

SEQ ID NO: 3196712 - RNA, 21 nt, Mycobacterium bovis subsp bovis AF2122/97
gcgcuggcgcccuugccggcg

SEQ ID NO: 3196713 - RNA, 16 nt, Mycobacterium bovis subsp bovis AF2122/97
gcgcuggcgccgccgg

SEQ ID NO: 3196714 - RNA, 14 nt, Mycobacterium bovis subsp bovis AF2122/97
gcgcuggcggcgca

SEQ ID NO: 3196715 - RNA, 16 nt, Mycobacterium bovis subsp bovis AF2122/97
gcgcuggcggcgcagc

SEQ ID NO: 3196716 - RNA, 18 nt, Mycobacterium bovis subsp bovis AF2122/97
gcgcuggcgggcgaucgc

SEQ ID NO: 3196717 - RNA, 19 nt, Mycobacterium bovis subsp bovis AF2122/97
gcgcuggcgggcgaucgcg

SEQ ID NO: 3196718 - RNA, 14 nt, Mycobacterium bovis subsp bovis AF2122/97
gcgcuggcgggcgg

SEQ ID NO: 3196719 - RNA, 17 nt, Mycobacterium bovis subsp bovis AF2122/97
gcgcuggcgggcggcgu

SEQ ID NO: 3196720 - RNA, 18 nt, Mycobacterium bovis subsp bovis AF2122/97
gcgcuggcgggcggcgug

SEQ ID NO: 3196721 - RNA, 19 nt, Mycobacterium bovis subsp bovis AF2122/97
gcgcuggcgggcggcgugg

SEQ ID NO: 3196722 - RNA, 12 nt, Mycobacterium bovis subsp bovis AF2122/97
gcgcuggcgucg

SEQ ID NO: 3196723 - RNA, 22 nt, Mycobacterium bovis subsp bovis AF2122/97
gcgcuggcugacaccgauccgg

SEQ ID NO: 3196724 - RNA, 16 nt, Mycobacterium bovis subsp bovis AF2122/97
gcgcugggacggucgc

SEQ ID NO: 3196725 - RNA, 21 nt, Mycobacterium bovis subsp bovis AF2122/97
gcgcugggauguucgaucagc

SEQ ID NO: 3196726 - RNA, 22 nt, Mycobacterium bovis subsp bovis AF2122/97
gcgcugggauguucgaucagcg

SEQ ID NO: 3196727 - RNA, 15 nt, Mycobacterium bovis subsp bovis AF2122/97
gcgcugggccagggu

SEQ ID NO: 3196728 - RNA, 15 nt, Mycobacterium bovis subsp bovis AF2122/97
gcgcugggcccgagc

SEQ ID NO: 3196729 - RNA, 14 nt, Mycobacterium bovis subsp bovis AF2122/97
gcgcugggcgcgcu

SEQ ID NO: 3196730 - RNA, 19 nt, Mycobacterium bovis subsp bovis AF2122/97
gcgcugggcgcgcucaucg

SEQ ID NO: 3196731 - RNA, 23 nt, Mycobacterium bovis subsp bovis AF2122/97
gcgcugggcgcgcucaucgaccg

SEQ ID NO: 3196732 - RNA, 20 nt, Mycobacterium bovis subsp bovis AF2122/97
gcgcugggguccgcgucggc

SEQ ID NO: 3196733 - RNA, 22 nt, Mycobacterium bovis subsp bovis AF2122/97
gcgcugggucgugucgccacac

SEQ ID NO: 3196734 - RNA, 13 nt, Mycobacterium bovis subsp bovis AF2122/97
gcgcuggucagcc

SEQ ID NO: 3196735 - RNA, 16 nt, Mycobacterium bovis subsp bovis AF2122/97
gcgcuggucgcaaugg

SEQ ID NO: 3196736 - RNA, 21 nt, Mycobacterium bovis subsp bovis AF2122/97
gcgcuggucgcgguggcggcg

SEQ ID NO: 3196737 - RNA, 20 nt, Mycobacterium bovis subsp bovis AF2122/97
gcgcuggucggagaccagcg

SEQ ID NO: 3196738 - RNA, 23 nt, Mycobacterium bovis subsp bovis AF2122/97
gcgcuggugcgccacgccaccgc

SEQ ID NO: 3196739 - RNA, 15 nt, Mycobacterium bovis subsp bovis AF2122/97
gcgcugguggcggcg

SEQ ID NO: 3196740 - RNA, 16 nt, Mycobacterium bovis subsp bovis AF2122/97
gcgcugguggcggcga

SEQ ID NO: 3196741 - RNA, 22 nt, Mycobacterium bovis subsp bovis AF2122/97
gcgcugguugaacauguccagu

SEQ ID NO: 3196742 - RNA, 20 nt, Mycobacterium bovis subsp bovis AF2122/97
gcgcuguacugccccagcac

SEQ ID NO: 3196743 - RNA, 18 nt, Mycobacterium bovis subsp bovis AF2122/97
gcgcuguagucgcgccuc

SEQ ID NO: 3196744 - RNA, 21 nt, Mycobacterium bovis subsp bovis AF2122/97
gcgcuguccacgaugacgucg

SEQ ID NO: 3196745 - RNA, 23 nt, Mycobacterium bovis subsp bovis AF2122/97
gcgcuguccacgaugacgucgac

SEQ ID NO: 3196746 - RNA, 20 nt, Mycobacterium bovis subsp bovis AF2122/97
gcgcugucgcccucgaucgc

SEQ ID NO: 3196747 - RNA, 13 nt, Mycobacterium bovis subsp bovis AF2122/97
gcgcugucguacc

SEQ ID NO: 3196748 - RNA, 18 nt, Mycobacterium bovis subsp bovis AF2122/97
gcgcugucuugcuagcgc

SEQ ID NO: 3196749 - RNA, 16 nt, Mycobacterium bovis subsp bovis AF2122/97
gcgcuguugccaucga

SEQ ID NO: 3196750 - RNA, 19 nt, Mycobacterium bovis subsp bovis AF2122/97
gcgcuguugccaucgacgc

SEQ ID NO: 3196751 - RNA, 16 nt, Mycobacterium bovis subsp bovis AF2122/97
gcgcuguugcuggcgc

SEQ ID NO: 3196752 - RNA, 22 nt, Mycobacterium bovis subsp bovis AF2122/97
gcgcuguugcuggcgcccccgc

SEQ ID NO: 3196753 - RNA, 14 nt, Mycobacterium bovis subsp bovis AF2122/97
gcgcuguuguuguc

SEQ ID NO: 3196754 - RNA, 16 nt, Mycobacterium bovis subsp bovis AF2122/97
gcgcuucacagccacc

SEQ ID NO: 3196755 - RNA, 18 nt, Mycobacterium bovis subsp bovis AF2122/97
gcgcuucacagccaccag

SEQ ID NO: 3196756 - RNA, 23 nt, Mycobacterium bovis subsp bovis AF2122/97
gcgcuucacagccaccagccggg

SEQ ID NO: 3196757 - RNA, 18 nt, Mycobacterium bovis subsp bovis AF2122/97
gcgcuucacgggccgucc

SEQ ID NO: 3196758 - RNA, 21 nt, Mycobacterium bovis subsp bovis AF2122/97
gcgcuucacgggccguccagg

SEQ ID NO: 3196759 - RNA, 17 nt, Mycobacterium bovis subsp bovis AF2122/97
gcgcuucgccacaccau

SEQ ID NO: 3196760 - RNA, 12 nt, Mycobacterium bovis subsp bovis AF2122/97
gcgcuucggcca

SEQ ID NO: 3196761 - RNA, 21 nt, Mycobacterium bovis subsp bovis AF2122/97
gcgcuucgucgccgaacagcg

SEQ ID NO: 3196762 - RNA, 17 nt, Mycobacterium bovis subsp bovis AF2122/97
gcgcuucgucggccggc

SEQ ID NO: 3196763 - RNA, 21 nt, Mycobacterium bovis subsp bovis AF2122/97
gcgcuucgucggccggcaccc

SEQ ID NO: 3196764 - RNA, 20 nt, Mycobacterium bovis subsp bovis AF2122/97
gcgcuucugcgucagccgac

SEQ ID NO: 3196765 - RNA, 21 nt, Mycobacterium bovis subsp bovis AF2122/97
gcgcuucugcuacccgagccg

SEQ ID NO: 3196766 - RNA, 22 nt, Mycobacterium bovis subsp bovis AF2122/97
gcgcuugaaacugauccacguc

SEQ ID NO: 3196767 - RNA, 20 nt, Mycobacterium bovis subsp bovis AF2122/97
gcgcuugaagguucgaucgc

SEQ ID NO: 3196768 - RNA, 21 nt, Mycobacterium bovis subsp bovis AF2122/97
gcgcuugaagguucgaucgcg

SEQ ID NO: 3196769 - RNA, 20 nt, Mycobacterium bovis subsp bovis AF2122/97
gcgcuugaccccgccgaacg

SEQ ID NO: 3196770 - RNA, 22 nt, Mycobacterium bovis subsp bovis AF2122/97
gcgcuugaccccgccgaacggc

SEQ ID NO: 3196771 - RNA, 15 nt, Mycobacterium bovis subsp bovis AF2122/97
gcgcuugacccgcgg

SEQ ID NO: 3196772 - RNA, 20 nt, Mycobacterium bovis subsp bovis AF2122/97
gcgcuugauccacccgacga

SEQ ID NO: 3196773 - RNA, 17 nt, Mycobacterium bovis subsp bovis AF2122/97
gcgcuugaugccggcca

SEQ ID NO: 3196774 - RNA, 14 nt, Mycobacterium bovis subsp bovis AF2122/97
gcgcuugcgaucgc

SEQ ID NO: 3196775 - RNA, 15 nt, Mycobacterium bovis subsp bovis AF2122/97
gcgcuugcgaucggc

SEQ ID NO: 3196776 - RNA, 23 nt, Mycobacterium bovis subsp bovis AF2122/97
gcgcuugcgaucggcacuuagcc

SEQ ID NO: 3196777 - RNA, 20 nt, Mycobacterium bovis subsp bovis AF2122/97
gcgcuugcgccgcccaugcc

SEQ ID NO: 3196778 - RNA, 13 nt, Mycobacterium bovis subsp bovis AF2122/97
gcgcuugcggccg

SEQ ID NO: 3196779 - RNA, 16 nt, Mycobacterium bovis subsp bovis AF2122/97
gcgcuuggagcggguc

SEQ ID NO: 3196780 - RNA, 21 nt, Mycobacterium bovis subsp bovis AF2122/97
gcgcuugggcacuucggcgaa

SEQ ID NO: 3196781 - RNA, 20 nt, Mycobacterium bovis subsp bovis AF2122/97
gcgcuugguccugcggucgc

SEQ ID NO: 3196782 - RNA, 19 nt, Mycobacterium bovis subsp bovis AF2122/97
gcgcuuguugaccucacgg

SEQ ID NO: 3196783 - RNA, 17 nt, Mycobacterium bovis subsp bovis AF2122/97
gcgcuuugaugccgaug

SEQ ID NO: 3196784 - RNA, 20 nt, Mycobacterium bovis subsp bovis AF2122/97
gcgcuuugaugccgaugucg

SEQ ID NO: 3196785 - RNA, 22 nt, Mycobacterium bovis subsp bovis AF2122/97
gcgcuuugaugccgaugucgau

SEQ ID NO: 3196786 - RNA, 22 nt, Mycobacterium bovis subsp bovis AF2122/97
gcggaaaacccagaucggcgac

SEQ ID NO: 3196787 - RNA, 12 nt, Mycobacterium bovis subsp bovis AF2122/97
gcggaaaaucgg

SEQ ID NO: 3196788 - RNA, 14 nt, Mycobacterium bovis subsp bovis AF2122/97
gcggaaacaacccc

SEQ ID NO: 3196789 - RNA, 13 nt, Mycobacterium bovis subsp bovis AF2122/97
gcggaaacaagca

SEQ ID NO: 3196790 - RNA, 20 nt, Mycobacterium bovis subsp bovis AF2122/97
gcggaaaccaucgccagccg

SEQ ID NO: 3196791 - RNA, 13 nt, Mycobacterium bovis subsp bovis AF2122/97
gcggaaacccggc

SEQ ID NO: 3196792 - RNA, 17 nt, Mycobacterium bovis subsp bovis AF2122/97
gcggaaacccggccgcc

SEQ ID NO: 3196793 - RNA, 18 nt, Mycobacterium bovis subsp bovis AF2122/97
gcggaaacccggccgccg

SEQ ID NO: 3196794 - RNA, 21 nt, Mycobacterium bovis subsp bovis AF2122/97
gcggaaacccggccgccgaga

SEQ ID NO: 3196795 - RNA, 22 nt, Mycobacterium bovis subsp bovis AF2122/97
gcggaaacccggccgccgagac

SEQ ID NO: 3196796 - RNA, 23 nt, Mycobacterium bovis subsp bovis AF2122/97
gcggaaacccggccgccgagacg

SEQ ID NO: 3196797 - RNA, 24 nt, Mycobacterium bovis subsp bovis AF2122/97
gcggaacaagguauggccggagcg

SEQ ID NO: 3196798 - RNA, 19 nt, Mycobacterium bovis subsp bovis AF2122/97
gcggaacaccaccaggcug

SEQ ID NO: 3196799 - RNA, 17 nt, Mycobacterium bovis subsp bovis AF2122/97
gcggaacaccagcaggc

SEQ ID NO: 3196800 - RNA, 21 nt, Mycobacterium bovis subsp bovis AF2122/97
gcggaacaccgaggcgaccgg

SEQ ID NO: 3196801 - RNA, 12 nt, Mycobacterium bovis subsp bovis AF2122/97
gcggaacaccgc

SEQ ID NO: 3196802 - RNA, 21 nt, Mycobacterium bovis subsp bovis AF2122/97
gcggaacagcuucgcgcagcc

SEQ ID NO: 3196803 - RNA, 22 nt, Mycobacterium bovis subsp bovis AF2122/97
gcggaacagcuucgcgcagccg

SEQ ID NO: 3196804 - RNA, 20 nt, Mycobacterium bovis subsp bovis AF2122/97
gcggaacgaaagucuccgga

SEQ ID NO: 3196805 - RNA, 14 nt, Mycobacterium bovis subsp bovis AF2122/97
gcggaacgccgagc

SEQ ID NO: 3196806 - RNA, 15 nt, Mycobacterium bovis subsp bovis AF2122/97
gcggaacgccgagca

SEQ ID NO: 3196807 - RNA, 17 nt, Mycobacterium bovis subsp bovis AF2122/97
gcggaacgccgagcacg

SEQ ID NO: 3196808 - RNA, 17 nt, Mycobacterium bovis subsp bovis AF2122/97
gcggaacgcgucgccga

SEQ ID NO: 3196809 - RNA, 19 nt, Mycobacterium bovis subsp bovis AF2122/97
gcggaacgcgucgccgacg

SEQ ID NO: 3196810 - RNA, 21 nt, Mycobacterium bovis subsp bovis AF2122/97
gcggaagaagugcacugcgaa

SEQ ID NO: 3196811 - RNA, 22 nt, Mycobacterium bovis subsp bovis AF2122/97
gcggaagaagugcacugcgaac

SEQ ID NO: 3196812 - RNA, 14 nt, Mycobacterium bovis subsp bovis AF2122/97
gcggaagaagugcu

SEQ ID NO: 3196813 - RNA, 16 nt, Mycobacterium bovis subsp bovis AF2122/97
gcggaagcggcggccc

SEQ ID NO: 3196814 - RNA, 17 nt, Mycobacterium bovis subsp bovis AF2122/97
gcggaagcggcggcccu

SEQ ID NO: 3196815 - RNA, 16 nt, Mycobacterium bovis subsp bovis AF2122/97
gcggaaggacggcagc

SEQ ID NO: 3196816 - RNA, 16 nt, Mycobacterium bovis subsp bovis AF2122/97
gcggaaggcgucgaac

SEQ ID NO: 3196817 - RNA, 22 nt, Mycobacterium bovis subsp bovis AF2122/97
gcggaaguagcgcaaugcggcc

SEQ ID NO: 3196818 - RNA, 22 nt, Mycobacterium bovis subsp bovis AF2122/97
gcggaagugucgucggaccucg

SEQ ID NO: 3196819 - RNA, 23 nt, Mycobacterium bovis subsp bovis AF2122/97
gcggaauaugggugugcuccagc

SEQ ID NO: 3196820 - RNA, 14 nt, Mycobacterium bovis subsp bovis AF2122/97
gcggaaucaccgaa

SEQ ID NO: 3196821 - RNA, 17 nt, Mycobacterium bovis subsp bovis AF2122/97
gcggaaucagcacccca

SEQ ID NO: 3196822 - RNA, 17 nt, Mycobacterium bovis subsp bovis AF2122/97
gcggaaucgcaucggcg

SEQ ID NO: 3196823 - RNA, 20 nt, Mycobacterium bovis subsp bovis AF2122/97
gcggaaucgcaucggcgggg

SEQ ID NO: 3196824 - RNA, 16 nt, Mycobacterium bovis subsp bovis AF2122/97
gcggaauggaggccgc

SEQ ID NO: 3196825 - RNA, 19 nt, Mycobacterium bovis subsp bovis AF2122/97
gcggaauggaggccgccga

SEQ ID NO: 3196826 - RNA, 13 nt, Mycobacterium bovis subsp bovis AF2122/97
gcggaauggcgcc

SEQ ID NO: 3196827 - RNA, 15 nt, Mycobacterium bovis subsp bovis AF2122/97
gcggacaagucggca

SEQ ID NO: 3196828 - RNA, 14 nt, Mycobacterium bovis subsp bovis AF2122/97
gcggacaccgcggc

SEQ ID NO: 3196829 - RNA, 15 nt, Mycobacterium bovis subsp bovis AF2122/97
gcggacaccgcggcg

SEQ ID NO: 3196830 - RNA, 16 nt, Mycobacterium bovis subsp bovis AF2122/97
gcggacaccgcggcga

SEQ ID NO: 3196831 - RNA, 19 nt, Mycobacterium bovis subsp bovis AF2122/97
gcggacaccucgggcgccc

SEQ ID NO: 3196832 - RNA, 20 nt, Mycobacterium bovis subsp bovis AF2122/97
gcggacacgaucgcgucggc

SEQ ID NO: 3196833 - RNA, 22 nt, Mycobacterium bovis subsp bovis AF2122/97
gcggacacgaucgcgucggcua

SEQ ID NO: 3196834 - RNA, 16 nt, Mycobacterium bovis subsp bovis AF2122/97
gcggacacguugcgac

SEQ ID NO: 3196835 - RNA, 13 nt, Mycobacterium bovis subsp bovis AF2122/97
gcggacacugcga

SEQ ID NO: 3196836 - RNA, 23 nt, Mycobacterium bovis subsp bovis AF2122/97
gcggacacugcgaaggaccagag

SEQ ID NO: 3196837 - RNA, 22 nt, Mycobacterium bovis subsp bovis AF2122/97
gcggacaggcccgguggcggcu

SEQ ID NO: 3196838 - RNA, 15 nt, Mycobacterium bovis subsp bovis AF2122/97
gcggacagggcggca

SEQ ID NO: 3196839 - RNA, 16 nt, Mycobacterium bovis subsp bovis AF2122/97
gcggacagggcggcaa

SEQ ID NO: 3196840 - RNA, 13 nt, Mycobacterium bovis subsp bovis AF2122/97
gcggacagguagu

SEQ ID NO: 3196841 - RNA, 20 nt, Mycobacterium bovis subsp bovis AF2122/97
gcggacauccgggccgagcg

SEQ ID NO: 3196842 - RNA, 21 nt, Mycobacterium bovis subsp bovis AF2122/97
gcggacaugacagccccgccg

SEQ ID NO: 3196843 - RNA, 23 nt, Mycobacterium bovis subsp bovis AF2122/97
gcggacaugacagccccgccgcc

SEQ ID NO: 3196844 - RNA, 17 nt, Mycobacterium bovis subsp bovis AF2122/97
gcggacaugcaccucga

SEQ ID NO: 3196845 - RNA, 20 nt, Mycobacterium bovis subsp bovis AF2122/97
gcggaccacaccgucaccga

SEQ ID NO: 3196846 - RNA, 17 nt, Mycobacterium bovis subsp bovis AF2122/97
gcggaccaccgcucgcc

SEQ ID NO: 3196847 - RNA, 20 nt, Mycobacterium bovis subsp bovis AF2122/97
gcggaccagagugguggcga

SEQ ID NO: 3196848 - RNA, 16 nt, Mycobacterium bovis subsp bovis AF2122/97
gcggaccaggccgcgc

SEQ ID NO: 3196849 - RNA, 20 nt, Mycobacterium bovis subsp bovis AF2122/97
gcggaccaggccgcgcgcac

SEQ ID NO: 3196850 - RNA, 22 nt, Mycobacterium bovis subsp bovis AF2122/97
gcggaccaggccgcgcgcaccg

SEQ ID NO: 3196851 - RNA, 17 nt, Mycobacterium bovis subsp bovis AF2122/97
gcggacccagcacccga

SEQ ID NO: 3196852 - RNA, 16 nt, Mycobacterium bovis subsp bovis AF2122/97
gcggaccccucgaccg

SEQ ID NO: 3196853 - RNA, 18 nt, Mycobacterium bovis subsp bovis AF2122/97
gcggacccgacagccgcu

SEQ ID NO: 3196854 - RNA, 19 nt, Mycobacterium bovis subsp bovis AF2122/97
gcggacccgacagccgcug

SEQ ID NO: 3196855 - RNA, 15 nt, Mycobacterium bovis subsp bovis AF2122/97
gcggacccgaccguc

SEQ ID NO: 3196856 - RNA, 15 nt, Mycobacterium bovis subsp bovis AF2122/97
gcggacccgcagcug

SEQ ID NO: 3196857 - RNA, 18 nt, Mycobacterium bovis subsp bovis AF2122/97
gcggacccgcagcugcgg

SEQ ID NO: 3196858 - RNA, 20 nt, Mycobacterium bovis subsp bovis AF2122/97
gcggacccgcagcugcggau

SEQ ID NO: 3196859 - RNA, 20 nt, Mycobacterium bovis subsp bovis AF2122/97
gcggacccgcgcgucgccca

SEQ ID NO: 3196860 - RNA, 16 nt, Mycobacterium bovis subsp bovis AF2122/97
gcggacccgcucgcgg

SEQ ID NO: 3196861 - RNA, 24 nt, Mycobacterium bovis subsp bovis AF2122/97
gcggacccggugacccgcugggcc

SEQ ID NO: 3196862 - RNA, 18 nt, Mycobacterium bovis subsp bovis AF2122/97
gcggacccgucggcgugg

SEQ ID NO: 3196863 - RNA, 16 nt, Mycobacterium bovis subsp bovis AF2122/97
gcggacccucgccgaa

SEQ ID NO: 3196864 - RNA, 21 nt, Mycobacterium bovis subsp bovis AF2122/97
gcggaccgaugacgaucggcg

SEQ ID NO: 3196865 - RNA, 14 nt, Mycobacterium bovis subsp bovis AF2122/97
gcggaccgauuguc

SEQ ID NO: 3196866 - RNA, 14 nt, Mycobacterium bovis subsp bovis AF2122/97
gccgucgccgccgg

SEQ ID NO: 3196867 - RNA, 16 nt, Mycobacterium bovis subsp bovis AF2122/97
gccgucgccgccggcu

SEQ ID NO: 3196868 - RNA, 15 nt, Mycobacterium bovis subsp bovis AF2122/97
gccgucgccggugcc

SEQ ID NO: 3196869 - RNA, 20 nt, Mycobacterium bovis subsp bovis AF2122/97
gccgucgcgaaacaccagac

SEQ ID NO: 3196870 - RNA, 16 nt, Mycobacterium bovis subsp bovis AF2122/97
gccgucgcgaccgaug

SEQ ID NO: 3196871 - RNA, 15 nt, Mycobacterium bovis subsp bovis AF2122/97
gccgucgcgacgucg

SEQ ID NO: 3196872 - RNA, 16 nt, Mycobacterium bovis subsp bovis AF2122/97
gccgucgcgacgucgg

SEQ ID NO: 3196873 - RNA, 17 nt, Mycobacterium bovis subsp bovis AF2122/97
gccgucgcgacgucggc

SEQ ID NO: 3196874 - RNA, 15 nt, Mycobacterium bovis subsp bovis AF2122/97
gccgucgcggcacgc

SEQ ID NO: 3196875 - RNA, 20 nt, Mycobacterium bovis subsp bovis AF2122/97
gccgucgcggcacgcccaca

SEQ ID NO: 3196876 - RNA, 23 nt, Mycobacterium bovis subsp bovis AF2122/97
gccgucgcuagggugagcccggg

SEQ ID NO: 3196877 - RNA, 13 nt, Mycobacterium bovis subsp bovis AF2122/97
gccgucgcugacg

SEQ ID NO: 3196878 - RNA, 21 nt, Mycobacterium bovis subsp bovis AF2122/97
gccgucgcugacgcccuccug

SEQ ID NO: 3196879 - RNA, 13 nt, Mycobacterium bovis subsp bovis AF2122/97
gccgucgcuggug

SEQ ID NO: 3196880 - RNA, 17 nt, Mycobacterium bovis subsp bovis AF2122/97
gccgucgcugguguaga

SEQ ID NO: 3196881 - RNA, 15 nt, Mycobacterium bovis subsp bovis AF2122/97
gccgucggacaccgc

SEQ ID NO: 3196882 - RNA, 17 nt, Mycobacterium bovis subsp bovis AF2122/97
gccgucggagaccagcu

SEQ ID NO: 3196883 - RNA, 20 nt, Mycobacterium bovis subsp bovis AF2122/97
gccgucggagaccagcucgu

SEQ ID NO: 3196884 - RNA, 19 nt, Mycobacterium bovis subsp bovis AF2122/97
gccgucggagccggccacc

SEQ ID NO: 3196885 - RNA, 16 nt, Mycobacterium bovis subsp bovis AF2122/97
gccgucggccggcaac

SEQ ID NO: 3196886 - RNA, 17 nt, Mycobacterium bovis subsp bovis AF2122/97
gccgucggcgacuccuc

SEQ ID NO: 3196887 - RNA, 13 nt, Mycobacterium bovis subsp bovis AF2122/97
gccgucggcgagc

SEQ ID NO: 3196888 - RNA, 21 nt, Mycobacterium bovis subsp bovis AF2122/97
gccgucggcgagcagacgccg

SEQ ID NO: 3196889 - RNA, 22 nt, Mycobacterium bovis subsp bovis AF2122/97
gccgucggcgagcagacgccgc

SEQ ID NO: 3196890 - RNA, 18 nt, Mycobacterium bovis subsp bovis AF2122/97
gccgucggcgccggcauc

SEQ ID NO: 3196891 - RNA, 16 nt, Mycobacterium bovis subsp bovis AF2122/97
gccgucggcgccucgg

SEQ ID NO: 3196892 - RNA, 14 nt, Mycobacterium bovis subsp bovis AF2122/97
gccgucggcgcgca

SEQ ID NO: 3196893 - RNA, 16 nt, Mycobacterium bovis subsp bovis AF2122/97
gccgucggcgcgcacc

SEQ ID NO: 3196894 - RNA, 12 nt, Mycobacterium bovis subsp bovis AF2122/97
gccgucggcgcu

SEQ ID NO: 3196895 - RNA, 15 nt, Mycobacterium bovis subsp bovis AF2122/97
gccgucggcgcugcg

SEQ ID NO: 3196896 - RNA, 16 nt, Mycobacterium bovis subsp bovis AF2122/97
gccgucggcgggcaug

SEQ ID NO: 3196897 - RNA, 19 nt, Mycobacterium bovis subsp bovis AF2122/97
gccgucggcguacagcgcc

SEQ ID NO: 3196898 - RNA, 16 nt, Mycobacterium bovis subsp bovis AF2122/97
gccgucggcgucgaag

SEQ ID NO: 3196899 - RNA, 14 nt, Mycobacterium bovis subsp bovis AF2122/97
gccgucggcgugca

SEQ ID NO: 3196900 - RNA, 16 nt, Mycobacterium bovis subsp bovis AF2122/97
gccgucggcgugcagc

SEQ ID NO: 3196901 - RNA, 18 nt, Mycobacterium bovis subsp bovis AF2122/97
gccgucgggacggccaac

SEQ ID NO: 3196902 - RNA, 17 nt, Mycobacterium bovis subsp bovis AF2122/97
gccgucgggcagcagca

SEQ ID NO: 3196903 - RNA, 22 nt, Mycobacterium bovis subsp bovis AF2122/97
gccgucggggaguucgcgcagc

SEQ ID NO: 3196904 - RNA, 23 nt, Mycobacterium bovis subsp bovis AF2122/97
gccgucggggaguucgcgcagca

SEQ ID NO: 3196905 - RNA, 20 nt, Mycobacterium bovis subsp bovis AF2122/97
gccgucggguaggccgccgu

SEQ ID NO: 3196906 - RNA, 23 nt, Mycobacterium bovis subsp bovis AF2122/97
gccgucgggugcagcacggcgcc

SEQ ID NO: 3196907 - RNA, 21 nt, Mycobacterium bovis subsp bovis AF2122/97
gccgucggguuccuccucggc

SEQ ID NO: 3196908 - RNA, 22 nt, Mycobacterium bovis subsp bovis AF2122/97
gccgucgguaaagggcucgaug

SEQ ID NO: 3196909 - RNA, 23 nt, Mycobacterium bovis subsp bovis AF2122/97
gccgucgguaaagggcucgaugg

SEQ ID NO: 3196910 - RNA, 23 nt, Mycobacterium bovis subsp bovis AF2122/97
gccgucggugauggagccgguga

SEQ ID NO: 3196911 - RNA, 20 nt, Mycobacterium bovis subsp bovis AF2122/97
gccgucggugccgccgccgg

SEQ ID NO: 3196912 - RNA, 21 nt, Mycobacterium bovis subsp bovis AF2122/97
gccgucggugccgccgccggc

SEQ ID NO: 3196913 - RNA, 14 nt, Mycobacterium bovis subsp bovis AF2122/97
gccgucggugccgg

SEQ ID NO: 3196914 - RNA, 23 nt, Mycobacterium bovis subsp bovis AF2122/97
gccgucggugggugccagccggu

SEQ ID NO: 3196915 - RNA, 20 nt, Mycobacterium bovis subsp bovis AF2122/97
gccgucguccgcugacccgc

SEQ ID NO: 3196916 - RNA, 16 nt, Mycobacterium bovis subsp bovis AF2122/97
gccgucgucgaccacg

SEQ ID NO: 3196917 - RNA, 19 nt, Mycobacterium bovis subsp bovis AF2122/97
gccgucgucgagcaccacc

SEQ ID NO: 3196918 - RNA, 14 nt, Mycobacterium bovis subsp bovis AF2122/97
gccgucgucgccgu

SEQ ID NO: 3196919 - RNA, 20 nt, Mycobacterium bovis subsp bovis AF2122/97
gccgucgucgccgucggugc

SEQ ID NO: 3196920 - RNA, 15 nt, Mycobacterium bovis subsp bovis AF2122/97
gccgucgucggccag

SEQ ID NO: 3196921 - RNA, 12 nt, Mycobacterium bovis subsp bovis AF2122/97
gccgucgucggu

SEQ ID NO: 3196922 - RNA, 23 nt, Mycobacterium bovis subsp bovis AF2122/97
gccgucgucgucgagauagccga

SEQ ID NO: 3196923 - RNA, 23 nt, Mycobacterium bovis subsp bovis AF2122/97
gccgucgucgucgcuguaggcga

SEQ ID NO: 3196924 - RNA, 19 nt, Mycobacterium bovis subsp bovis AF2122/97
gccgucgugaucggcgaac

SEQ ID NO: 3196925 - RNA, 15 nt, Mycobacterium bovis subsp bovis AF2122/97
gccgucgugccaccg

SEQ ID NO: 3196926 - RNA, 16 nt, Mycobacterium bovis subsp bovis AF2122/97
gccgucguugccggcg

SEQ ID NO: 3196927 - RNA, 16 nt, Mycobacterium bovis subsp bovis AF2122/97
gccgucguugugccgg

SEQ ID NO: 3196928 - RNA, 19 nt, Mycobacterium bovis subsp bovis AF2122/97
gccgucuccuggucaaccg

SEQ ID NO: 3196929 - RNA, 15 nt, Mycobacterium bovis subsp bovis AF2122/97
gccgucucgaucgcg

SEQ ID NO: 3196930 - RNA, 19 nt, Mycobacterium bovis subsp bovis AF2122/97
gccgucucgcggugcggca

SEQ ID NO: 3196931 - RNA, 21 nt, Mycobacterium bovis subsp bovis AF2122/97
gccgucucgcggugcggcaac

SEQ ID NO: 3196932 - RNA, 21 nt, Mycobacterium bovis subsp bovis AF2122/97
gccgucugacagcauccuucg

SEQ ID NO: 3196933 - RNA, 19 nt, Mycobacterium bovis subsp bovis AF2122/97
gccgucugaucacucaccc

SEQ ID NO: 3196934 - RNA, 23 nt, Mycobacterium bovis subsp bovis AF2122/97
gccgucugaucacucacccgggc

SEQ ID NO: 3196935 - RNA, 21 nt, Mycobacterium bovis subsp bovis AF2122/97
gccgucugcggggugagugac

SEQ ID NO: 3196936 - RNA, 16 nt, Mycobacterium bovis subsp bovis AF2122/97
gccgucuucgccgcca

SEQ ID NO: 3196937 - RNA, 13 nt, Mycobacterium bovis subsp bovis AF2122/97
gccgucuuggccc

SEQ ID NO: 3196938 - RNA, 16 nt, Mycobacterium bovis subsp bovis AF2122/97
gccgucuuggcccggu

SEQ ID NO: 3196939 - RNA, 18 nt, Mycobacterium bovis subsp bovis AF2122/97
gccgucuuugucacgcac

SEQ ID NO: 3196940 - RNA, 18 nt, Mycobacterium bovis subsp bovis AF2122/97
gccgugaacggcgcgggc

SEQ ID NO: 3196941 - RNA, 17 nt, Mycobacterium bovis subsp bovis AF2122/97
gccgugaauucgccgaa

SEQ ID NO: 3196942 - RNA, 21 nt, Mycobacterium bovis subsp bovis AF2122/97
gccgugacaaggugcgcuggg

SEQ ID NO: 3196943 - RNA, 22 nt, Mycobacterium bovis subsp bovis AF2122/97
gccgugacaaggugcgcugggu

SEQ ID NO: 3196944 - RNA, 17 nt, Mycobacterium bovis subsp bovis AF2122/97
gccgugaccaggugcca

SEQ ID NO: 3196945 - RNA, 18 nt, Mycobacterium bovis subsp bovis AF2122/97
gccgugaccgagccgcga

SEQ ID NO: 3196946 - RNA, 23 nt, Mycobacterium bovis subsp bovis AF2122/97
gccgugaguagguccacguucgg

SEQ ID NO: 3196947 - RNA, 19 nt, Mycobacterium bovis subsp bovis AF2122/97
gccgugaguucacguucgg

SEQ ID NO: 3196948 - RNA, 20 nt, Mycobacterium bovis subsp bovis AF2122/97
gccgugaguucacguucggc

SEQ ID NO: 3196949 - RNA, 22 nt, Mycobacterium bovis subsp bovis AF2122/97
gccgugaguucacguucggcgc

SEQ ID NO: 3196950 - RNA, 20 nt, Mycobacterium bovis subsp bovis AF2122/97
gccgugauauccguacaguc

SEQ ID NO: 3196951 - RNA, 23 nt, Mycobacterium bovis subsp bovis AF2122/97
gccgugauauccguacaguccac

SEQ ID NO: 3196952 - RNA, 13 nt, Mycobacterium bovis subsp bovis AF2122/97
gccguguucgggg

SEQ ID NO: 3196953 - RNA, 22 nt, Mycobacterium bovis subsp bovis AF2122/97
gccguguucgggggcggucgcg

SEQ ID NO: 3196954 - RNA, 21 nt, Mycobacterium bovis subsp bovis AF2122/97
gccguuaccgccaaacgcugc

SEQ ID NO: 3196955 - RNA, 18 nt, Mycobacterium bovis subsp bovis AF2122/97
gccguuaccgccgcugcc

SEQ ID NO: 3196956 - RNA, 19 nt, Mycobacterium bovis subsp bovis AF2122/97
gccguuaccgccgcugccg

SEQ ID NO: 3196957 - RNA, 21 nt, Mycobacterium bovis subsp bovis AF2122/97
gccguuaccgccgcugccgau

SEQ ID NO: 3196958 - RNA, 15 nt, Mycobacterium bovis subsp bovis AF2122/97
gccguuaccgccggc

SEQ ID NO: 3196959 - RNA, 21 nt, Mycobacterium bovis subsp bovis AF2122/97
gccguuaccgccguugccgcc

SEQ ID NO: 3196960 - RNA, 21 nt, Mycobacterium bovis subsp bovis AF2122/97
gccguucaacguggaaaccgc

SEQ ID NO: 3196961 - RNA, 19 nt, Mycobacterium bovis subsp bovis AF2122/97
gccguucacccuggugguc

SEQ ID NO: 3196962 - RNA, 13 nt, Mycobacterium bovis subsp bovis AF2122/97
gccguucagcggc

SEQ ID NO: 3196963 - RNA, 19 nt, Mycobacterium bovis subsp bovis AF2122/97
gccguuccagcaucgagca

SEQ ID NO: 3196964 - RNA, 20 nt, Mycobacterium bovis subsp bovis AF2122/97
gccguuccagcaucgagcag

SEQ ID NO: 3196965 - RNA, 21 nt, Mycobacterium bovis subsp bovis AF2122/97
gccguuccagcaucggugcgg

SEQ ID NO: 3196966 - RNA, 23 nt, Mycobacterium bovis subsp bovis AF2122/97
gccguucccaccaccaccgccgg

SEQ ID NO: 3196967 - RNA, 15 nt, Mycobacterium bovis subsp bovis AF2122/97
gccguucccgccggc

SEQ ID NO: 3196968 - RNA, 16 nt, Mycobacterium bovis subsp bovis AF2122/97
gccguucccgccggcg

SEQ ID NO: 3196969 - RNA, 15 nt, Mycobacterium bovis subsp bovis AF2122/97
gccguucccggugac

SEQ ID NO: 3196970 - RNA, 14 nt, Mycobacterium bovis subsp bovis AF2122/97
gccguucgcagcug

SEQ ID NO: 3196971 - RNA, 17 nt, Mycobacterium bovis subsp bovis AF2122/97
gccguucgcgucgccga

SEQ ID NO: 3196972 - RNA, 17 nt, Mycobacterium bovis subsp bovis AF2122/97
gccguucggcaucuggu

SEQ ID NO: 3196973 - RNA, 13 nt, Mycobacterium bovis subsp bovis AF2122/97
gccguucggcgcc

SEQ ID NO: 3196974 - RNA, 21 nt, Mycobacterium bovis subsp bovis AF2122/97
gccguucggcgcccgcucggc

SEQ ID NO: 3196975 - RNA, 19 nt, Mycobacterium bovis subsp bovis AF2122/97
gccguucggcugccgcgcg

SEQ ID NO: 3196976 - RNA, 15 nt, Mycobacterium bovis subsp bovis AF2122/97
gccguucggggcgcg

SEQ ID NO: 3196977 - RNA, 17 nt, Mycobacterium bovis subsp bovis AF2122/97
gccguucgucgcgggug

SEQ ID NO: 3196978 - RNA, 23 nt, Mycobacterium bovis subsp bovis AF2122/97
gccguucgugggcauugcggcgc

SEQ ID NO: 3196979 - RNA, 15 nt, Mycobacterium bovis subsp bovis AF2122/97
gccguucucgcccac

SEQ ID NO: 3196980 - RNA, 17 nt, Mycobacterium bovis subsp bovis AF2122/97
gccguucucgcccaccc

SEQ ID NO: 3196981 - RNA, 15 nt, Mycobacterium bovis subsp bovis AF2122/97
gccguugacgguguc

SEQ ID NO: 3196982 - RNA, 17 nt, Mycobacterium bovis subsp bovis AF2122/97
gccguugaucgcaaacc

SEQ ID NO: 3196983 - RNA, 20 nt, Mycobacterium bovis subsp bovis AF2122/97
gccguugaucgcaaacccgu

SEQ ID NO: 3196984 - RNA, 19 nt, Mycobacterium bovis subsp bovis AF2122/97
gccguugauucggccgccg

SEQ ID NO: 3196985 - RNA, 20 nt, Mycobacterium bovis subsp bovis AF2122/97
gccguugauucggccgccga

SEQ ID NO: 3196986 - RNA, 16 nt, Mycobacterium bovis subsp bovis AF2122/97
gccguugccaagcagc

SEQ ID NO: 3196987 - RNA, 13 nt, Mycobacterium bovis subsp bovis AF2122/97
gccguugccaccg

SEQ ID NO: 3196988 - RNA, 17 nt, Mycobacterium bovis subsp bovis AF2122/97
gccguugccaccggugc

SEQ ID NO: 3196989 - RNA, 23 nt, Mycobacterium bovis subsp bovis AF2122/97
gccguugccaccggugccggcga

SEQ ID NO: 3196990 - RNA, 20 nt, Mycobacterium bovis subsp bovis AF2122/97
gccguugccaccguugccgc

SEQ ID NO: 3196991 - RNA, 16 nt, Mycobacterium bovis subsp bovis AF2122/97
gccguugccauugccu

SEQ ID NO: 3196992 - RNA, 14 nt, Mycobacterium bovis subsp bovis AF2122/97
gccguugcccacgu

SEQ ID NO: 3196993 - RNA, 20 nt, Mycobacterium bovis subsp bovis AF2122/97
gccguugccgaucaccacgg

SEQ ID NO: 3196994 - RNA, 20 nt, Mycobacterium bovis subsp bovis AF2122/97
gccguugccgaucagcccgg

SEQ ID NO: 3196995 - RNA, 21 nt, Mycobacterium bovis subsp bovis AF2122/97
gccguugccgaucagcccggc

SEQ ID NO: 3196996 - RNA, 19 nt, Mycobacterium bovis subsp bovis AF2122/97
gccguugccgauccccagg

SEQ ID NO: 3196997 - RNA, 21 nt, Mycobacterium bovis subsp bovis AF2122/97
gccguugccgaucgcuccggc

SEQ ID NO: 3196998 - RNA, 13 nt, Mycobacterium bovis subsp bovis AF2122/97
gccguugccgcca

SEQ ID NO: 3196999 - RNA, 23 nt, Mycobacterium bovis subsp bovis AF2122/97
gccguugccgccacgggcggcca

SEQ ID NO: 3197000 - RNA, 14 nt, Mycobacterium bovis subsp bovis AF2122/97
gccguugccgccca

SEQ ID NO: 3197001 - RNA, 20 nt, Mycobacterium bovis subsp bovis AF2122/97
gccguugccgcccacgcugc

SEQ ID NO: 3197002 - RNA, 13 nt, Mycobacterium bovis subsp bovis AF2122/97
gccguugccgccg

SEQ ID NO: 3197003 - RNA, 14 nt, Mycobacterium bovis subsp bovis AF2122/97
gccguugccgccga

SEQ ID NO: 3197004 - RNA, 15 nt, Mycobacterium bovis subsp bovis AF2122/97
gccguugccgccgaa

SEQ ID NO: 3197005 - RNA, 23 nt, Mycobacterium bovis subsp bovis AF2122/97
gccguugccgccgacgccgccgg

SEQ ID NO: 3197006 - RNA, 15 nt, Mycobacterium bovis subsp bovis AF2122/97
gccguugccgccgcc

SEQ ID NO: 3197007 - RNA, 16 nt, Mycobacterium bovis subsp bovis AF2122/97
gccguugccgccgccu

SEQ ID NO: 3197008 - RNA, 14 nt, Mycobacterium bovis subsp bovis AF2122/97
gccguugccgccgg

SEQ ID NO: 3197009 - RNA, 16 nt, Mycobacterium bovis subsp bovis AF2122/97
gccguugccgccgucg

SEQ ID NO: 3197010 - RNA, 17 nt, Mycobacterium bovis subsp bovis AF2122/97
gccguugccgccgucgc

SEQ ID NO: 3197011 - RNA, 20 nt, Mycobacterium bovis subsp bovis AF2122/97
gccguugccgccgucgccgc

SEQ ID NO: 3197012 - RNA, 14 nt, Mycobacterium bovis subsp bovis AF2122/97
gccguugccggcga

SEQ ID NO: 3197013 - RNA, 20 nt, Mycobacterium bovis subsp bovis AF2122/97
gccguugccggcguugccgc

SEQ ID NO: 3197014 - RNA, 14 nt, Mycobacterium bovis subsp bovis AF2122/97
gccguugccguaca

SEQ ID NO: 3197015 - RNA, 16 nt, Mycobacterium bovis subsp bovis AF2122/97
gccguugcgaucgcgu

SEQ ID NO: 3197016 - RNA, 20 nt, Mycobacterium bovis subsp bovis AF2122/97
gccguugcgggccaggcccu

SEQ ID NO: 3197017 - RNA, 19 nt, Mycobacterium bovis subsp bovis AF2122/97
gccguugcgucugcucggc

SEQ ID NO: 3197018 - RNA, 23 nt, Mycobacterium bovis subsp bovis AF2122/97
gccguugcgucugcucggcguac

SEQ ID NO: 3197019 - RNA, 14 nt, Mycobacterium bovis subsp bovis AF2122/97
gccguuggagccgc

SEQ ID NO: 3197020 - RNA, 22 nt, Mycobacterium bovis subsp bovis AF2122/97
gccguuggccggaucgaagacc

SEQ ID NO: 3197021 - RNA, 14 nt, Mycobacterium bovis subsp bovis AF2122/97
gccguuggcggcuu

SEQ ID NO: 3197022 - RNA, 23 nt, Mycobacterium bovis subsp bovis AF2122/97
gccguugggcaccguguagcugc

SEQ ID NO: 3197023 - RNA, 19 nt, Mycobacterium bovis subsp bovis AF2122/97
gccguugggccaccggcgc

SEQ ID NO: 3197024 - RNA, 22 nt, Mycobacterium bovis subsp bovis AF2122/97
gccguugggccaccggcgccgu

SEQ ID NO: 3197025 - RNA, 15 nt, Mycobacterium bovis subsp bovis AF2122/97
gccguugggccgcgc

SEQ ID NO: 3197026 - RNA, 23 nt, Mycobacterium bovis subsp bovis AF2122/97
gccguuggugaggccccccgcgc

SEQ ID NO: 3197027 - RNA, 15 nt, Mycobacterium bovis subsp bovis AF2122/97
gccguuggugccgcc

SEQ ID NO: 3197028 - RNA, 17 nt, Mycobacterium bovis subsp bovis AF2122/97
gccguuggugccgccug

SEQ ID NO: 3197029 - RNA, 18 nt, Mycobacterium bovis subsp bovis AF2122/97
gccguuguagacggcggc

SEQ ID NO: 3197030 - RNA, 19 nt, Mycobacterium bovis subsp bovis AF2122/97
gccguuguagacggcggca

SEQ ID NO: 3197031 - RNA, 23 nt, Mycobacterium bovis subsp bovis AF2122/97
gccguugucgaccuccucgacca

SEQ ID NO: 3197032 - RNA, 14 nt, Mycobacterium bovis subsp bovis AF2122/97
gccguugucggcgg

SEQ ID NO: 3197033 - RNA, 17 nt, Mycobacterium bovis subsp bovis AF2122/97
gccguugucggcgguga

SEQ ID NO: 3197034 - RNA, 20 nt, Mycobacterium bovis subsp bovis AF2122/97
gccguuguugaggaugacga

SEQ ID NO: 3197035 - RNA, 16 nt, Mycobacterium bovis subsp bovis AF2122/97
gccguuuccgccgccg

SEQ ID NO: 3197036 - RNA, 14 nt, Mycobacterium bovis subsp bovis AF2122/97
gccguuucggcgcc

SEQ ID NO: 3197037 - RNA, 17 nt, Mycobacterium bovis subsp bovis AF2122/97
gccuaaccccggcucga

SEQ ID NO: 3197038 - RNA, 21 nt, Mycobacterium bovis subsp bovis AF2122/97
gccuccugcuggcccugcucc

SEQ ID NO: 3197039 - RNA, 22 nt, Mycobacterium bovis subsp bovis AF2122/97
gccuccuggaaggaggccggga

SEQ ID NO: 3197040 - RNA, 18 nt, Mycobacterium bovis subsp bovis AF2122/97
gccucgaacgccgcccgc

SEQ ID NO: 3197041 - RNA, 23 nt, Mycobacterium bovis subsp bovis AF2122/97
gccucgaacgccgcccgcugggc

SEQ ID NO: 3197042 - RNA, 15 nt, Mycobacterium bovis subsp bovis AF2122/97
gccucgacacccagc

SEQ ID NO: 3197043 - RNA, 16 nt, Mycobacterium bovis subsp bovis AF2122/97
gccucgacacccagcc

SEQ ID NO: 3197044 - RNA, 18 nt, Mycobacterium bovis subsp bovis AF2122/97
gccucgacacccagccgc

SEQ ID NO: 3197045 - RNA, 19 nt, Mycobacterium bovis subsp bovis AF2122/97
gccucgacacccagccgca

SEQ ID NO: 3197046 - RNA, 22 nt, Mycobacterium bovis subsp bovis AF2122/97
gccucgacacccagccgcagcc

SEQ ID NO: 3197047 - RNA, 15 nt, Mycobacterium bovis subsp bovis AF2122/97
gccucgaccgccagc

SEQ ID NO: 3197048 - RNA, 18 nt, Mycobacterium bovis subsp bovis AF2122/97
gccucgaccgccagccgc

SEQ ID NO: 3197049 - RNA, 23 nt, Mycobacterium bovis subsp bovis AF2122/97
gccucgaccgccagccgcgagcc

SEQ ID NO: 3197050 - RNA, 21 nt, Mycobacterium bovis subsp bovis AF2122/97
gccucgaccucuucgggguag

SEQ ID NO: 3197051 - RNA, 19 nt, Mycobacterium bovis subsp bovis AF2122/97
gccucgacgcggcaggccg

SEQ ID NO: 3197052 - RNA, 23 nt, Mycobacterium bovis subsp bovis AF2122/97
gccucgagcaacggacgaagcac

SEQ ID NO: 3197053 - RNA, 14 nt, Mycobacterium bovis subsp bovis AF2122/97
gccucgaggaccac

SEQ ID NO: 3197054 - RNA, 15 nt, Mycobacterium bovis subsp bovis AF2122/97
gccucgaggaccacc

SEQ ID NO: 3197055 - RNA, 21 nt, Mycobacterium bovis subsp bovis AF2122/97
gccucgaggguuuccauggcg

SEQ ID NO: 3197056 - RNA, 17 nt, Mycobacterium bovis subsp bovis AF2122/97
gccucgaucagcgccgg

SEQ ID NO: 3197057 - RNA, 13 nt, Mycobacterium bovis subsp bovis AF2122/97
gccucgaucgacu

SEQ ID NO: 3197058 - RNA, 15 nt, Mycobacterium bovis subsp bovis AF2122/97
gccucgauggcggug

SEQ ID NO: 3197059 - RNA, 16 nt, Mycobacterium bovis subsp bovis AF2122/97
gccucgauggcggugg

SEQ ID NO: 3197060 - RNA, 15 nt, Mycobacterium bovis subsp bovis AF2122/97
gccucgauguccgau

SEQ ID NO: 3197061 - RNA, 19 nt, Mycobacterium bovis subsp bovis AF2122/97
gccucgaugucgcggucgc

SEQ ID NO: 3197062 - RNA, 23 nt, Mycobacterium bovis subsp bovis AF2122/97
gccucgaugucgcggucgcccgc

SEQ ID NO: 3197063 - RNA, 18 nt, Mycobacterium bovis subsp bovis AF2122/97
gccucgauuguggccagc

SEQ ID NO: 3197064 - RNA, 19 nt, Mycobacterium bovis subsp bovis AF2122/97
gccucgauuguggccagcg

SEQ ID NO: 3197065 - RNA, 18 nt, Mycobacterium bovis subsp bovis AF2122/97
gccucgcaccggauccac

SEQ ID NO: 3197066 - RNA, 19 nt, Mycobacterium bovis subsp bovis AF2122/97
gccucgcccagcaaggccc

SEQ ID NO: 3197067 - RNA, 17 nt, Mycobacterium bovis subsp bovis AF2122/97
gccucgccgaagugguc

SEQ ID NO: 3197068 - RNA, 14 nt, Mycobacterium bovis subsp bovis AF2122/97
gccucgccggccac

SEQ ID NO: 3197069 - RNA, 16 nt, Mycobacterium bovis subsp bovis AF2122/97
gccucgccggccacca

SEQ ID NO: 3197070 - RNA, 21 nt, Mycobacterium bovis subsp bovis AF2122/97
gccucgccguagagcuggugc

SEQ ID NO: 3197071 - RNA, 19 nt, Mycobacterium bovis subsp bovis AF2122/97
gccucgccugagcgcucga

SEQ ID NO: 3197072 - RNA, 19 nt, Mycobacterium bovis subsp bovis AF2122/97
gccucgccugcacgcccgg

SEQ ID NO: 3197073 - RNA, 23 nt, Mycobacterium bovis subsp bovis AF2122/97
gccucgcggaugagcucggccau

SEQ ID NO: 3197074 - RNA, 23 nt, Mycobacterium bovis subsp bovis AF2122/97
gccucgcgggaagucccgagugg

SEQ ID NO: 3197075 - RNA, 19 nt, Mycobacterium bovis subsp bovis AF2122/97
gccucgcggggucugucga

SEQ ID NO: 3197076 - RNA, 13 nt, Mycobacterium bovis subsp bovis AF2122/97
gccucgcguucgc

SEQ ID NO: 3197077 - RNA, 18 nt, Mycobacterium bovis subsp bovis AF2122/97
gccucgcguucgcugguc

SEQ ID NO: 3197078 - RNA, 17 nt, Mycobacterium bovis subsp bovis AF2122/97
gccucgcuaacucccca

SEQ ID NO: 3197079 - RNA, 16 nt, Mycobacterium bovis subsp bovis AF2122/97
gccucgcugcucagca

SEQ ID NO: 3197080 - RNA, 19 nt, Mycobacterium bovis subsp bovis AF2122/97
gccucgcugggcucauggc

SEQ ID NO: 3197081 - RNA, 17 nt, Mycobacterium bovis subsp bovis AF2122/97
gccucggacacggcagc

SEQ ID NO: 3197082 - RNA, 15 nt, Mycobacterium bovis subsp bovis AF2122/97
gccucggaccagacc

SEQ ID NO: 3197083 - RNA, 16 nt, Mycobacterium bovis subsp bovis AF2122/97
gccucggaccagaccc

SEQ ID NO: 3197084 - RNA, 20 nt, Mycobacterium bovis subsp bovis AF2122/97
gccucggaccagacccacga

SEQ ID NO: 3197085 - RNA, 13 nt, Mycobacterium bovis subsp bovis AF2122/97
gccucggcaucgc

SEQ ID NO: 3197086 - RNA, 16 nt, Mycobacterium bovis subsp bovis AF2122/97
gccucggcaucgccgc

SEQ ID NO: 3197087 - RNA, 18 nt, Mycobacterium bovis subsp bovis AF2122/97
gccucggcaucgccgcgg

SEQ ID NO: 3197088 - RNA, 12 nt, Mycobacterium bovis subsp bovis AF2122/97
gccucggcaugc

SEQ ID NO: 3197089 - RNA, 15 nt, Mycobacterium bovis subsp bovis AF2122/97
gccucggcaugcagc

SEQ ID NO: 3197090 - RNA, 16 nt, Mycobacterium bovis subsp bovis AF2122/97
gccucggcaugcagcc

SEQ ID NO: 3197091 - RNA, 18 nt, Mycobacterium bovis subsp bovis AF2122/97
gccucggcaugcagcccc

SEQ ID NO: 3197092 - RNA, 18 nt, Mycobacterium bovis subsp bovis AF2122/97
gccucggccagcgucagc

SEQ ID NO: 3197093 - RNA, 18 nt, Mycobacterium bovis subsp bovis AF2122/97
gccucggccaucugcucg

SEQ ID NO: 3197094 - RNA, 14 nt, Mycobacterium bovis subsp bovis AF2122/97
gccucggcgaccau

SEQ ID NO: 3197095 - RNA, 19 nt, Mycobacterium bovis subsp bovis AF2122/97
gccucggcgauaccgagga

SEQ ID NO: 3197096 - RNA, 21 nt, Mycobacterium bovis subsp bovis AF2122/97
gccucggcgaugggccggucc

SEQ ID NO: 3197097 - RNA, 16 nt, Mycobacterium bovis subsp bovis AF2122/97
gccucggcgccgccca

SEQ ID NO: 3197098 - RNA, 13 nt, Mycobacterium bovis subsp bovis AF2122/97
gccucggcgcugc

SEQ ID NO: 3197099 - RNA, 14 nt, Mycobacterium bovis subsp bovis AF2122/97
gccucggcggccag

SEQ ID NO: 3197100 - RNA, 21 nt, Mycobacterium bovis subsp bovis AF2122/97
gccucggcggccagcucggcc

SEQ ID NO: 3197101 - RNA, 18 nt, Mycobacterium bovis subsp bovis AF2122/97
gccucggcggccguggcc

SEQ ID NO: 3197102 - RNA, 16 nt, Mycobacterium bovis subsp bovis AF2122/97
gccucggcggcgccga

SEQ ID NO: 3197103 - RNA, 18 nt, Mycobacterium bovis subsp bovis AF2122/97
gccucgggacucccgcgc

SEQ ID NO: 3197104 - RNA, 20 nt, Mycobacterium bovis subsp bovis AF2122/97
gccucgggaggcagcgcgag

SEQ ID NO: 3197105 - RNA, 23 nt, Mycobacterium bovis subsp bovis AF2122/97
gccucgggaggcagcgcgaggcu

SEQ ID NO: 3197106 - RNA, 18 nt, Mycobacterium bovis subsp bovis AF2122/97
gccucgggccggcguagc

SEQ ID NO: 3197107 - RNA, 23 nt, Mycobacterium bovis subsp bovis AF2122/97
gccucggggccggaggcuugcaa

SEQ ID NO: 3197108 - RNA, 13 nt, Mycobacterium bovis subsp bovis AF2122/97
gccucggggccua

SEQ ID NO: 3197109 - RNA, 15 nt, Mycobacterium bovis subsp bovis AF2122/97
gccucggugagcagc

SEQ ID NO: 3197110 - RNA, 19 nt, Mycobacterium bovis subsp bovis AF2122/97
gccucgguuagcugcucug

SEQ ID NO: 3197111 - RNA, 15 nt, Mycobacterium bovis subsp bovis AF2122/97
gccucgucccggaca

SEQ ID NO: 3197112 - RNA, 17 nt, Mycobacterium bovis subsp bovis AF2122/97
gccucgucgaugccuag

SEQ ID NO: 3197113 - RNA, 22 nt, Mycobacterium bovis subsp bovis AF2122/97
gccucgucgauguucgccgcgc

SEQ ID NO: 3197114 - RNA, 18 nt, Mycobacterium bovis subsp bovis AF2122/97
gccucgucgccgcgguag

SEQ ID NO: 3197115 - RNA, 22 nt, Mycobacterium bovis subsp bovis AF2122/97
gccucgucgucggacucguccu

SEQ ID NO: 3197116 - RNA, 19 nt, Mycobacterium bovis subsp bovis AF2122/97
gccucguuguagccgaauc

SEQ ID NO: 3197117 - RNA, 14 nt, Mycobacterium bovis subsp bovis AF2122/97
gccucucagcacgg

SEQ ID NO: 3197118 - RNA, 22 nt, Mycobacterium bovis subsp bovis AF2122/97
gccucucuucccaaccgcccgu

SEQ ID NO: 3197119 - RNA, 16 nt, Mycobacterium bovis subsp bovis AF2122/97
gccucugaccagccgg

SEQ ID NO: 3197120 - RNA, 17 nt, Mycobacterium bovis subsp bovis AF2122/97
gccucugaccagccggu

SEQ ID NO: 3197121 - RNA, 15 nt, Mycobacterium bovis subsp bovis AF2122/97
gccucugcaucgaac

SEQ ID NO: 3197122 - RNA, 15 nt, Mycobacterium bovis subsp bovis AF2122/97
gccucugcucagccg

SEQ ID NO: 3197123 - RNA, 18 nt, Mycobacterium bovis subsp bovis AF2122/97
gccucuggaucacgucga

SEQ ID NO: 3197124 - RNA, 13 nt, Mycobacterium bovis subsp bovis AF2122/97
gccugccgcucgc

SEQ ID NO: 3197125 - RNA, 16 nt, Mycobacterium bovis subsp bovis AF2122/97
gccugccgcucgccgg

SEQ ID NO: 3197126 - RNA, 16 nt, Mycobacterium bovis subsp bovis AF2122/97
gccugccucaccgccg

SEQ ID NO: 3197127 - RNA, 16 nt, Mycobacterium bovis subsp bovis AF2122/97
gccugccucgccugca

SEQ ID NO: 3197128 - RNA, 18 nt, Mycobacterium bovis subsp bovis AF2122/97
gccugcgaaacgcuggcc

SEQ ID NO: 3197129 - RNA, 19 nt, Mycobacterium bovis subsp bovis AF2122/97
gccugcgacagcacgugcc

SEQ ID NO: 3197130 - RNA, 16 nt, Mycobacterium bovis subsp bovis AF2122/97
gccugcgacgagccca

SEQ ID NO: 3197131 - RNA, 18 nt, Mycobacterium bovis subsp bovis AF2122/97
gccugcgacgagcccacc

SEQ ID NO: 3197132 - RNA, 15 nt, Mycobacterium bovis subsp bovis AF2122/97
gccugcgcacgaccc

SEQ ID NO: 3197133 - RNA, 16 nt, Mycobacterium bovis subsp bovis AF2122/97
gccugcgcagacucga

SEQ ID NO: 3197134 - RNA, 16 nt, Mycobacterium bovis subsp bovis AF2122/97
gccugcgccacccgcg

SEQ ID NO: 3197135 - RNA, 13 nt, Mycobacterium bovis subsp bovis AF2122/97
gccugcgcccagc

SEQ ID NO: 3197136 - RNA, 14 nt, Mycobacterium bovis subsp bovis AF2122/97
gccugcgcccagcc

SEQ ID NO: 3197137 - RNA, 18 nt, Mycobacterium bovis subsp bovis AF2122/97
gccugcgccgacccgcgc

SEQ ID NO: 3197138 - RNA, 13 nt, Mycobacterium bovis subsp bovis AF2122/97
gccugcgccgcca

SEQ ID NO: 3197139 - RNA, 15 nt, Mycobacterium bovis subsp bovis AF2122/97
gccugcgccgccagc

SEQ ID NO: 3197140 - RNA, 16 nt, Mycobacterium bovis subsp bovis AF2122/97
gccugcgccgccagcg

SEQ ID NO: 3197141 - RNA, 18 nt, Mycobacterium bovis subsp bovis AF2122/97
gccugcgccgccagcgcc

SEQ ID NO: 3197142 - RNA, 13 nt, Mycobacterium bovis subsp bovis AF2122/97
gccugcgccgccc

SEQ ID NO: 3197143 - RNA, 15 nt, Mycobacterium bovis subsp bovis AF2122/97
gccugcgccgcccgc

SEQ ID NO: 3197144 - RNA, 17 nt, Mycobacterium bovis subsp bovis AF2122/97
gccugcgccgcccgcgc

SEQ ID NO: 3197145 - RNA, 18 nt, Mycobacterium bovis subsp bovis AF2122/97
gccugcgccgcccgcgcc

SEQ ID NO: 3197146 - RNA, 23 nt, Mycobacterium bovis subsp bovis AF2122/97
gccugcgccgcccgcgccaccga

SEQ ID NO: 3197147 - RNA, 15 nt, Mycobacterium bovis subsp bovis AF2122/97
gccugcgccgcgcga

SEQ ID NO: 3197148 - RNA, 13 nt, Mycobacterium bovis subsp bovis AF2122/97
gccugcgccggcg

SEQ ID NO: 3197149 - RNA, 19 nt, Mycobacterium bovis subsp bovis AF2122/97
gccugcgccggcgcugcca

SEQ ID NO: 3197150 - RNA, 22 nt, Mycobacterium bovis subsp bovis AF2122/97
gccugcgccuugaagcggugga

SEQ ID NO: 3197151 - RNA, 23 nt, Mycobacterium bovis subsp bovis AF2122/97
gccugcgccuuggucgccggcgu

SEQ ID NO: 3197152 - RNA, 15 nt, Mycobacterium bovis subsp bovis AF2122/97
gccugcgcgaccgac

SEQ ID NO: 3197153 - RNA, 19 nt, Mycobacterium bovis subsp bovis AF2122/97
gccugcgcgaccgaccagc

SEQ ID NO: 3197154 - RNA, 14 nt, Mycobacterium bovis subsp bovis AF2122/97
gccugcgcgaugcg

SEQ ID NO: 3197155 - RNA, 22 nt, Mycobacterium bovis subsp bovis AF2122/97
gccugcggcaacggcucgucga

SEQ ID NO: 3197156 - RNA, 15 nt, Mycobacterium bovis subsp bovis AF2122/97
gccugcggcaccggc

SEQ ID NO: 3197157 - RNA, 16 nt, Mycobacterium bovis subsp bovis AF2122/97
gccugcggcaccggcu

SEQ ID NO: 3197158 - RNA, 14 nt, Mycobacterium bovis subsp bovis AF2122/97
gccugcggcagcac

SEQ ID NO: 3197159 - RNA, 13 nt, Mycobacterium bovis subsp bovis AF2122/97
gccugcggcggcg

SEQ ID NO: 3197160 - RNA, 15 nt, Mycobacterium bovis subsp bovis AF2122/97
gccugcggcggucau

SEQ ID NO: 3197161 - RNA, 24 nt, Mycobacterium bovis subsp bovis AF2122/97
gccugcgggaacgcggcggcgaac

SEQ ID NO: 3197162 - RNA, 15 nt, Mycobacterium bovis subsp bovis AF2122/97
gccugcgggccggca

SEQ ID NO: 3197163 - RNA, 17 nt, Mycobacterium bovis subsp bovis AF2122/97
gccugcgggccggcauc

SEQ ID NO: 3197164 - RNA, 18 nt, Mycobacterium bovis subsp bovis AF2122/97
gccugcgggccggcaucg

SEQ ID NO: 3197165 - RNA, 22 nt, Mycobacterium bovis subsp bovis AF2122/97
gccugcgggccggcaucgucgg

SEQ ID NO: 3197166 - RNA, 20 nt, Mycobacterium bovis subsp bovis AF2122/97
gccugcgggggacacgucgu

SEQ ID NO: 3197167 - RNA, 12 nt, Mycobacterium bovis subsp bovis AF2122/97
gccugcggucag

SEQ ID NO: 3197168 - RNA, 16 nt, Mycobacterium bovis subsp bovis AF2122/97
gccugcggucagggcu

SEQ ID NO: 3197169 - RNA, 16 nt, Mycobacterium bovis subsp bovis AF2122/97
gccugcgucucgauga

SEQ ID NO: 3197170 - RNA, 15 nt, Mycobacterium bovis subsp bovis AF2122/97
gccugcguggagcgc

SEQ ID NO: 3197171 - RNA, 16 nt, Mycobacterium bovis subsp bovis AF2122/97
gccugcuaaccacggu

SEQ ID NO: 3197172 - RNA, 20 nt, Mycobacterium bovis subsp bovis AF2122/97
gccugcuaaccacggugugc

SEQ ID NO: 3197173 - RNA, 15 nt, Mycobacterium bovis subsp bovis AF2122/97
gccugcuagcagcag

SEQ ID NO: 3197174 - RNA, 17 nt, Mycobacterium bovis subsp bovis AF2122/97
gccugcucaaccagcag

SEQ ID NO: 3197175 - RNA, 19 nt, Mycobacterium bovis subsp bovis AF2122/97
gccugcuccaccgucgaac

SEQ ID NO: 3197176 - RNA, 16 nt, Mycobacterium bovis subsp bovis AF2122/97
gccugcuccucggcca

SEQ ID NO: 3197177 - RNA, 21 nt, Mycobacterium bovis subsp bovis AF2122/97
gccugcucgaccaugccgucg

SEQ ID NO: 3197178 - RNA, 17 nt, Mycobacterium bovis subsp bovis AF2122/97
gccugcucgcagcgggc

SEQ ID NO: 3197179 - RNA, 15 nt, Mycobacterium bovis subsp bovis AF2122/97
gccugcucgucggcc

SEQ ID NO: 3197180 - RNA, 20 nt, Mycobacterium bovis subsp bovis AF2122/97
gccugcucgucggccaccgc

SEQ ID NO: 3197181 - RNA, 12 nt, Mycobacterium bovis subsp bovis AF2122/97
gccugcuggccg

SEQ ID NO: 3197182 - RNA, 14 nt, Mycobacterium bovis subsp bovis AF2122/97
gccugcuggccgcg

SEQ ID NO: 3197183 - RNA, 18 nt, Mycobacterium bovis subsp bovis AF2122/97
gccugcuggucaccauca

SEQ ID NO: 3197184 - RNA, 16 nt, Mycobacterium bovis subsp bovis AF2122/97
gccugcuggucgguga

SEQ ID NO: 3197185 - RNA, 13 nt, Mycobacterium bovis subsp bovis AF2122/97
gccugcuuggcca

SEQ ID NO: 3197186 - RNA, 18 nt, Mycobacterium bovis subsp bovis AF2122/97
gccugcuugucaacccgg

SEQ ID NO: 3197187 - RNA, 17 nt, Mycobacterium bovis subsp bovis AF2122/97
gccuggaaaacccaggu

SEQ ID NO: 3197188 - RNA, 19 nt, Mycobacterium bovis subsp bovis AF2122/97
gccuggaagacggugcggg

SEQ ID NO: 3197189 - RNA, 15 nt, Mycobacterium bovis subsp bovis AF2122/97
gccuggaagaucacg

SEQ ID NO: 3197190 - RNA, 16 nt, Mycobacterium bovis subsp bovis AF2122/97
gccuggacgccgccgg

SEQ ID NO: 3197191 - RNA, 15 nt, Mycobacterium bovis subsp bovis AF2122/97
gccuggagcagccac

SEQ ID NO: 3197192 - RNA, 18 nt, Mycobacterium bovis subsp bovis AF2122/97
gccuggaucagcgcguug

SEQ ID NO: 3197193 - RNA, 18 nt, Mycobacterium bovis subsp bovis AF2122/97
gccuggaugccgaucggg

SEQ ID NO: 3197194 - RNA, 14 nt, Mycobacterium bovis subsp bovis AF2122/97
gccuggcacccggg

SEQ ID NO: 3197195 - RNA, 16 nt, Mycobacterium bovis subsp bovis AF2122/97
gccuggccaccugguu

SEQ ID NO: 3197196 - RNA, 17 nt, Mycobacterium bovis subsp bovis AF2122/97
gccuggcccacgccgca

SEQ ID NO: 3197197 - RNA, 15 nt, Mycobacterium bovis subsp bovis AF2122/97
gccuggcccgucggc

SEQ ID NO: 3197198 - RNA, 16 nt, Mycobacterium bovis subsp bovis AF2122/97
gccuggcccgucggcg

SEQ ID NO: 3197199 - RNA, 12 nt, Mycobacterium bovis subsp bovis AF2122/97
gccuggccgcca

SEQ ID NO: 3197200 - RNA, 22 nt, Mycobacterium bovis subsp bovis AF2122/97
gccuggccggaauacccgcugg

SEQ ID NO: 3197201 - RNA, 17 nt, Mycobacterium bovis subsp bovis AF2122/97
gccuggccgggaccgcc

SEQ ID NO: 3197202 - RNA, 16 nt, Mycobacterium bovis subsp bovis AF2122/97
gccuggccugcccagc

SEQ ID NO: 3197203 - RNA, 16 nt, Mycobacterium bovis subsp bovis AF2122/97
gccuggcgagccagcu

SEQ ID NO: 3197204 - RNA, 23 nt, Mycobacterium bovis subsp bovis AF2122/97
gccuggcuaguugggugggugca

SEQ ID NO: 3197205 - RNA, 13 nt, Mycobacterium bovis subsp bovis AF2122/97
gccuggcuggcca

SEQ ID NO: 3197206 - RNA, 18 nt, Mycobacterium bovis subsp bovis AF2122/97
gccuggcuggccagcugc

SEQ ID NO: 3197207 - RNA, 22 nt, Mycobacterium bovis subsp bovis AF2122/97
gccuggcuguccgcgggccgcg

SEQ ID NO: 3197208 - RNA, 23 nt, Mycobacterium bovis subsp bovis AF2122/97
gccuggcuguccgcgggccgcgc

SEQ ID NO: 3197209 - RNA, 13 nt, Mycobacterium bovis subsp bovis AF2122/97
gccugggacggcg

SEQ ID NO: 3197210 - RNA, 15 nt, Mycobacterium bovis subsp bovis AF2122/97
gccugggacggcggc

SEQ ID NO: 3197211 - RNA, 19 nt, Mycobacterium bovis subsp bovis AF2122/97
gccuugccgccggcgccgc

SEQ ID NO: 3197212 - RNA, 15 nt, Mycobacterium bovis subsp bovis AF2122/97
gccuugccgggccgc

SEQ ID NO: 3197213 - RNA, 18 nt, Mycobacterium bovis subsp bovis AF2122/97
gccuugccgggccgcgcg

SEQ ID NO: 3197214 - RNA, 15 nt, Mycobacterium bovis subsp bovis AF2122/97
gccuugcgcgcgcag

SEQ ID NO: 3197215 - RNA, 23 nt, Mycobacterium bovis subsp bovis AF2122/97
gccuugcgggcucucggcgucga

SEQ ID NO: 3197216 - RNA, 15 nt, Mycobacterium bovis subsp bovis AF2122/97
gccuugcucagccgg

SEQ ID NO: 3197217 - RNA, 22 nt, Mycobacterium bovis subsp bovis AF2122/97
gccuugcucggugaugcccagc

SEQ ID NO: 3197218 - RNA, 22 nt, Mycobacterium bovis subsp bovis AF2122/97
gccuugcuuccgggacuaccac

SEQ ID NO: 3197219 - RNA, 16 nt, Mycobacterium bovis subsp bovis AF2122/97
gccuuggacgugcgcg

SEQ ID NO: 3197220 - RNA, 22 nt, Mycobacterium bovis subsp bovis AF2122/97
gccuuggacgugcgcgccaagu

SEQ ID NO: 3197221 - RNA, 13 nt, Mycobacterium bovis subsp bovis AF2122/97
gccuuggcagccc

SEQ ID NO: 3197222 - RNA, 16 nt, Mycobacterium bovis subsp bovis AF2122/97
gccuuggcaguccagc

SEQ ID NO: 3197223 - RNA, 16 nt, Mycobacterium bovis subsp bovis AF2122/97
gccuuggccaccaucg

SEQ ID NO: 3197224 - RNA, 22 nt, Mycobacterium bovis subsp bovis AF2122/97
gccuuggccaccaucgccgccg

SEQ ID NO: 3197225 - RNA, 23 nt, Mycobacterium bovis subsp bovis AF2122/97
gccuuggccaccaucgccgccgu

SEQ ID NO: 3197226 - RNA, 14 nt, Mycobacterium bovis subsp bovis AF2122/97
gccuuggcgcccgc

SEQ ID NO: 3197227 - RNA, 12 nt, Mycobacterium bovis subsp bovis AF2122/97
gccuuggcggcc

SEQ ID NO: 3197228 - RNA, 16 nt, Mycobacterium bovis subsp bovis AF2122/97
gccuuggcggccgcga

SEQ ID NO: 3197229 - RNA, 18 nt, Mycobacterium bovis subsp bovis AF2122/97
gccuuggcggccgcgacc

SEQ ID NO: 3197230 - RNA, 14 nt, Mycobacterium bovis subsp bovis AF2122/97
gccuugggcggcac

SEQ ID NO: 3197231 - RNA, 15 nt, Mycobacterium bovis subsp bovis AF2122/97
gccuugggcggcacu

SEQ ID NO: 3197232 - RNA, 17 nt, Mycobacterium bovis subsp bovis AF2122/97
gccuugguagccggccg

SEQ ID NO: 3197233 - RNA, 23 nt, Mycobacterium bovis subsp bovis AF2122/97
gccuugguagccggccgcuuggc

SEQ ID NO: 3197234 - RNA, 16 nt, Mycobacterium bovis subsp bovis AF2122/97
gccuuggucaccuucu

SEQ ID NO: 3197235 - RNA, 16 nt, Mycobacterium bovis subsp bovis AF2122/97
gccuuggucgccgccu

SEQ ID NO: 3197236 - RNA, 17 nt, Mycobacterium bovis subsp bovis AF2122/97
gccuuggucgccgccuu

SEQ ID NO: 3197237 - RNA, 18 nt, Mycobacterium bovis subsp bovis AF2122/97
gccuuggucgccgccuuc

SEQ ID NO: 3197238 - RNA, 21 nt, Mycobacterium bovis subsp bovis AF2122/97
gccuuggucgccgccuucuug

SEQ ID NO: 3197239 - RNA, 20 nt, Mycobacterium bovis subsp bovis AF2122/97
gccuuggucgccgcuuucuu

SEQ ID NO: 3197240 - RNA, 14 nt, Mycobacterium bovis subsp bovis AF2122/97
gccuuggucgccgg

SEQ ID NO: 3197241 - RNA, 17 nt, Mycobacterium bovis subsp bovis AF2122/97
gccuuggucgcgucggc

SEQ ID NO: 3197242 - RNA, 22 nt, Mycobacterium bovis subsp bovis AF2122/97
gccuuggucgcgucggcugccg

SEQ ID NO: 3197243 - RNA, 13 nt, Mycobacterium bovis subsp bovis AF2122/97
gccuugucggcga

SEQ ID NO: 3197244 - RNA, 14 nt, Mycobacterium bovis subsp bovis AF2122/97
gccuugucggcgau

SEQ ID NO: 3197245 - RNA, 15 nt, Mycobacterium bovis subsp bovis AF2122/97
gccuugucggcgaug

SEQ ID NO: 3197246 - RNA, 18 nt, Mycobacterium bovis subsp bovis AF2122/97
gccuugucggcgugucgc

SEQ ID NO: 3197247 - RNA, 24 nt, Mycobacterium bovis subsp bovis AF2122/97
gccuugucggcgugucgcgucgca

SEQ ID NO: 3197248 - RNA, 23 nt, Mycobacterium bovis subsp bovis AF2122/97
gccuuguggaaccaucccugaaa

SEQ ID NO: 3197249 - RNA, 22 nt, Mycobacterium bovis subsp bovis AF2122/97
gccuuguuccagcgcaucgagc

SEQ ID NO: 3197250 - RNA, 16 nt, Mycobacterium bovis subsp bovis AF2122/97
gccuuguucgcccaca

SEQ ID NO: 3197251 - RNA, 17 nt, Mycobacterium bovis subsp bovis AF2122/97
gccuuguuggcgcccgg

SEQ ID NO: 3197252 - RNA, 13 nt, Mycobacterium bovis subsp bovis AF2122/97
gccuuguuguccu

SEQ ID NO: 3197253 - RNA, 18 nt, Mycobacterium bovis subsp bovis AF2122/97
gccuuguuguccuucagc

SEQ ID NO: 3197254 - RNA, 19 nt, Mycobacterium bovis subsp bovis AF2122/97
gccuuuccagcaccccgau

SEQ ID NO: 3197255 - RNA, 22 nt, Mycobacterium bovis subsp bovis AF2122/97
gccuuugagcccgcgaucacca

SEQ ID NO: 3197256 - RNA, 14 nt, Mycobacterium bovis subsp bovis AF2122/97
gccuuugcccccgg

SEQ ID NO: 3197257 - RNA, 16 nt, Mycobacterium bovis subsp bovis AF2122/97
gccuuugcccgccgcg

SEQ ID NO: 3197258 - RNA, 14 nt, Mycobacterium bovis subsp bovis AF2122/97
gccuuugccgccgg

SEQ ID NO: 3197259 - RNA, 15 nt, Mycobacterium bovis subsp bovis AF2122/97
gccuuugccgccggc

SEQ ID NO: 3197260 - RNA, 19 nt, Mycobacterium bovis subsp bovis AF2122/97
gccuuugggcuguggccgc

SEQ ID NO: 3197261 - RNA, 20 nt, Mycobacterium bovis subsp bovis AF2122/97
gcgaaaagacugcgccgccg

SEQ ID NO: 3197262 - RNA, 21 nt, Mycobacterium bovis subsp bovis AF2122/97
gcgaaaagacugcgccgccgg

SEQ ID NO: 3197263 - RNA, 13 nt, Mycobacterium bovis subsp bovis AF2122/97
gcgaaaauucguc

SEQ ID NO: 3197264 - RNA, 20 nt, Mycobacterium bovis subsp bovis AF2122/97
gcgaaacaccggccagcggc

SEQ ID NO: 3197265 - RNA, 22 nt, Mycobacterium bovis subsp bovis AF2122/97
gcgaaacaccggccagcggccc

SEQ ID NO: 3197266 - RNA, 14 nt, Mycobacterium bovis subsp bovis AF2122/97
gcgaaacagcacgc

SEQ ID NO: 3197267 - RNA, 22 nt, Mycobacterium bovis subsp bovis AF2122/97
gcgaaacagcuugcugcgcacc

SEQ ID NO: 3197268 - RNA, 12 nt, Mycobacterium bovis subsp bovis AF2122/97
gcgaaacaucuc

SEQ ID NO: 3197269 - RNA, 20 nt, Mycobacterium bovis subsp bovis AF2122/97
gcgaaacaucucggcgcagc

SEQ ID NO: 3197270 - RNA, 23 nt, Mycobacterium bovis subsp bovis AF2122/97
gcgaaacccugaaaagggcuggu

SEQ ID NO: 3197271 - RNA, 19 nt, Mycobacterium bovis subsp bovis AF2122/97
gcgaaaccgccgucccggc

SEQ ID NO: 3197272 - RNA, 15 nt, Mycobacterium bovis subsp bovis AF2122/97
gcgaaacgcccgggc

SEQ ID NO: 3197273 - RNA, 18 nt, Mycobacterium bovis subsp bovis AF2122/97
gcgaaacgcccgggcggc

SEQ ID NO: 3197274 - RNA, 16 nt, Mycobacterium bovis subsp bovis AF2122/97
gcgaaacgcuggccac

SEQ ID NO: 3197275 - RNA, 22 nt, Mycobacterium bovis subsp bovis AF2122/97
gcgaaagcacgugcacggcgag

SEQ ID NO: 3197276 - RNA, 14 nt, Mycobacterium bovis subsp bovis AF2122/97
gcgaaagcgccgaa

SEQ ID NO: 3197277 - RNA, 20 nt, Mycobacterium bovis subsp bovis AF2122/97
gcgaaagcgccgaaacagca

SEQ ID NO: 3197278 - RNA, 15 nt, Mycobacterium bovis subsp bovis AF2122/97
gcgaaagcgucgagc

SEQ ID NO: 3197279 - RNA, 22 nt, Mycobacterium bovis subsp bovis AF2122/97
gcgaaauagcugcggaggguuc

SEQ ID NO: 3197280 - RNA, 19 nt, Mycobacterium bovis subsp bovis AF2122/97
gcgaaauauuggcccguca

SEQ ID NO: 3197281 - RNA, 22 nt, Mycobacterium bovis subsp bovis AF2122/97
gcgaaauccccugcgcugcagc

SEQ ID NO: 3197282 - RNA, 15 nt, Mycobacterium bovis subsp bovis AF2122/97
gcgaaaucgacagca

SEQ ID NO: 3197283 - RNA, 17 nt, Mycobacterium bovis subsp bovis AF2122/97
gcgaaaucgacagcagc

SEQ ID NO: 3197284 - RNA, 23 nt, Mycobacterium bovis subsp bovis AF2122/97
gcgaaaucggaagagucgacgcu

SEQ ID NO: 3197285 - RNA, 16 nt, Mycobacterium bovis subsp bovis AF2122/97
gcgaaaugccggugcc

SEQ ID NO: 3197286 - RNA, 15 nt, Mycobacterium bovis subsp bovis AF2122/97
gcgaaaugccugcgc

SEQ ID NO: 3197287 - RNA, 18 nt, Mycobacterium bovis subsp bovis AF2122/97
gcgaacaaccacgcacgg

SEQ ID NO: 3197288 - RNA, 15 nt, Mycobacterium bovis subsp bovis AF2122/97
gcgaacaaccgccgc

SEQ ID NO: 3197289 - RNA, 16 nt, Mycobacterium bovis subsp bovis AF2122/97
gcgaacaacgcggacu

SEQ ID NO: 3197290 - RNA, 16 nt, Mycobacterium bovis subsp bovis AF2122/97
gcgaacaacuuggcca

SEQ ID NO: 3197291 - RNA, 20 nt, Mycobacterium bovis subsp bovis AF2122/97
gcgaacacccgaagccggcg

SEQ ID NO: 3197292 - RNA, 16 nt, Mycobacterium bovis subsp bovis AF2122/97
gcgaacacgcgaugau

SEQ ID NO: 3197293 - RNA, 15 nt, Mycobacterium bovis subsp bovis AF2122/97
gcgaacagcgggggc

SEQ ID NO: 3197294 - RNA, 14 nt, Mycobacterium bovis subsp bovis AF2122/97
gcgaacaggcgacc

SEQ ID NO: 3197295 - RNA, 16 nt, Mycobacterium bovis subsp bovis AF2122/97
gcgaacagggcugcga

SEQ ID NO: 3197296 - RNA, 21 nt, Mycobacterium bovis subsp bovis AF2122/97
gcgaacagggcugcgaugcgg

SEQ ID NO: 3197297 - RNA, 14 nt, Mycobacterium bovis subsp bovis AF2122/97
gcgaagguaguacu

SEQ ID NO: 3197298 - RNA, 15 nt, Mycobacterium bovis subsp bovis AF2122/97
gcgaaggucagcgac

SEQ ID NO: 3197299 - RNA, 20 nt, Mycobacterium bovis subsp bovis AF2122/97
gcgaagguccgugccgaugc

SEQ ID NO: 3197300 - RNA, 18 nt, Mycobacterium bovis subsp bovis AF2122/97
gcgaaguacccggcaaac

SEQ ID NO: 3197301 - RNA, 16 nt, Mycobacterium bovis subsp bovis AF2122/97
gcgaaguacgacgacc

SEQ ID NO: 3197302 - RNA, 18 nt, Mycobacterium bovis subsp bovis AF2122/97
gcgaaguacgacgacccg

SEQ ID NO: 3197303 - RNA, 18 nt, Mycobacterium bovis subsp bovis AF2122/97
gcgaagucgacucgccac

SEQ ID NO: 3197304 - RNA, 13 nt, Mycobacterium bovis subsp bovis AF2122/97
gcgaagucgucga

SEQ ID NO: 3197305 - RNA, 18 nt, Mycobacterium bovis subsp bovis AF2122/97
gcgaagucuugaccgcac

SEQ ID NO: 3197306 - RNA, 22 nt, Mycobacterium bovis subsp bovis AF2122/97
gcgaagucuugaccgcaccggc

SEQ ID NO: 3197307 - RNA, 20 nt, Mycobacterium bovis subsp bovis AF2122/97
gcgaagucuuucucccccau

SEQ ID NO: 3197308 - RNA, 15 nt, Mycobacterium bovis subsp bovis AF2122/97
gcgaagugcgcgcug

SEQ ID NO: 3197309 - RNA, 16 nt, Mycobacterium bovis subsp bovis AF2122/97
gcgaagugcgcgcugg

SEQ ID NO: 3197310 - RNA, 20 nt, Mycobacterium bovis subsp bovis AF2122/97
gcgaagugcgcgcuggaucg

SEQ ID NO: 3197311 - RNA, 22 nt, Mycobacterium bovis subsp bovis AF2122/97
gcgaaguggaucuggcgcagca

SEQ ID NO: 3197312 - RNA, 17 nt, Mycobacterium bovis subsp bovis AF2122/97
gcgaaguugcgcgacgg

SEQ ID NO: 3197313 - RNA, 16 nt, Mycobacterium bovis subsp bovis AF2122/97
gcgaaguugcggguga

SEQ ID NO: 3197314 - RNA, 19 nt, Mycobacterium bovis subsp bovis AF2122/97
gcgaaguuugcgacgacgc

SEQ ID NO: 3197315 - RNA, 14 nt, Mycobacterium bovis subsp bovis AF2122/97
gcgaauaccagacc

SEQ ID NO: 3197316 - RNA, 21 nt, Mycobacterium bovis subsp bovis AF2122/97
gcgaauaccagaccggccgac

SEQ ID NO: 3197317 - RNA, 22 nt, Mycobacterium bovis subsp bovis AF2122/97
gcgaauacgaggacgacgauca

SEQ ID NO: 3197318 - RNA, 13 nt, Mycobacterium bovis subsp bovis AF2122/97
gcgaauagccacc

SEQ ID NO: 3197319 - RNA, 19 nt, Mycobacterium bovis subsp bovis AF2122/97
gcgaaucacguggaccacg

SEQ ID NO: 3197320 - RNA, 19 nt, Mycobacterium bovis subsp bovis AF2122/97
gcgaauccagccgcgcgcc

SEQ ID NO: 3197321 - RNA, 21 nt, Mycobacterium bovis subsp bovis AF2122/97
gcgaauccagccgcgcgccgg

SEQ ID NO: 3197322 - RNA, 15 nt, Mycobacterium bovis subsp bovis AF2122/97
gcgaauccgcacagg

SEQ ID NO: 3197323 - RNA, 16 nt, Mycobacterium bovis subsp bovis AF2122/97
gcgaauccggcgggug

SEQ ID NO: 3197324 - RNA, 16 nt, Mycobacterium bovis subsp bovis AF2122/97
gcgaaucgcgucgagc

SEQ ID NO: 3197325 - RNA, 21 nt, Mycobacterium bovis subsp bovis AF2122/97
gcgaaucgcgucgagcgccgg

SEQ ID NO: 3197326 - RNA, 23 nt, Mycobacterium bovis subsp bovis AF2122/97
gcgaaucgcgucgagcgccggcc

SEQ ID NO: 3197327 - RNA, 24 nt, Mycobacterium bovis subsp bovis AF2122/97
gcgaaucgcgucgagcgccggccg

SEQ ID NO: 3197328 - RNA, 21 nt, Mycobacterium bovis subsp bovis AF2122/97
gcgaaucggcccgugccacag

SEQ ID NO: 3197329 - RNA, 23 nt, Mycobacterium bovis subsp bovis AF2122/97
gcgaaucuuugguagucugcacg

SEQ ID NO: 3197330 - RNA, 15 nt, Mycobacterium bovis subsp bovis AF2122/97
gcgaaugacggccag

SEQ ID NO: 3197331 - RNA, 22 nt, Mycobacterium bovis subsp bovis AF2122/97
gcgaaugaucuugccacuccag

SEQ ID NO: 3197332 - RNA, 17 nt, Mycobacterium bovis subsp bovis AF2122/97
gcgaaugcggccccgac

SEQ ID NO: 3197333 - RNA, 22 nt, Mycobacterium bovis subsp bovis AF2122/97
gcgaaugcggccccgacacagc

SEQ ID NO: 3197334 - RNA, 18 nt, Mycobacterium bovis subsp bovis AF2122/97
gcgaaugcgggccuccug

SEQ ID NO: 3197335 - RNA, 23 nt, Mycobacterium bovis subsp bovis AF2122/97
gcgaaugcgggccuccugcuggc

SEQ ID NO: 3197336 - RNA, 15 nt, Mycobacterium bovis subsp bovis AF2122/97
gcgaauggcggacag

SEQ ID NO: 3197337 - RNA, 15 nt, Mycobacterium bovis subsp bovis AF2122/97
gcgaaugucgcgcug

SEQ ID NO: 3197338 - RNA, 21 nt, Mycobacterium bovis subsp bovis AF2122/97
gcgaauucgaccacucgccgc

SEQ ID NO: 3197339 - RNA, 22 nt, Mycobacterium bovis subsp bovis AF2122/97
gcgaauucguagggaugcggcc

SEQ ID NO: 3197340 - RNA, 17 nt, Mycobacterium bovis subsp bovis AF2122/97
gcgacaaaucggucgac

SEQ ID NO: 3197341 - RNA, 23 nt, Mycobacterium bovis subsp bovis AF2122/97
gcgacaacaacucuucggcggac

SEQ ID NO: 3197342 - RNA, 14 nt, Mycobacterium bovis subsp bovis AF2122/97
gcgacaacaccacg

SEQ ID NO: 3197343 - RNA, 15 nt, Mycobacterium bovis subsp bovis AF2122/97
gcgacaacaccacgg

SEQ ID NO: 3197344 - RNA, 16 nt, Mycobacterium bovis subsp bovis AF2122/97
gcgacaacaccacggu

SEQ ID NO: 3197345 - RNA, 18 nt, Mycobacterium bovis subsp bovis AF2122/97
gcgacaacaccacggugc

SEQ ID NO: 3197346 - RNA, 21 nt, Mycobacterium bovis subsp bovis AF2122/97
gcgacaacaccacggugccga

SEQ ID NO: 3197347 - RNA, 22 nt, Mycobacterium bovis subsp bovis AF2122/97
gcgacaacaccacggugccgac

SEQ ID NO: 3197348 - RNA, 23 nt, Mycobacterium bovis subsp bovis AF2122/97
gcgacaacacgaccucuugggca

SEQ ID NO: 3197349 - RNA, 21 nt, Mycobacterium bovis subsp bovis AF2122/97
gcgacaacagcacguacugcu

SEQ ID NO: 3197350 - RNA, 21 nt, Mycobacterium bovis subsp bovis AF2122/97
gcgacaacccggcgucgacga

SEQ ID NO: 3197351 - RNA, 16 nt, Mycobacterium bovis subsp bovis AF2122/97
gcgacaauggugccca

SEQ ID NO: 3197352 - RNA, 19 nt, Mycobacterium bovis subsp bovis AF2122/97
gcgacaauggugcccagga

SEQ ID NO: 3197353 - RNA, 17 nt, Mycobacterium bovis subsp bovis AF2122/97
gcgacacaacggguguc

SEQ ID NO: 3197354 - RNA, 20 nt, Mycobacterium bovis subsp bovis AF2122/97
gcgacacaacgggugucggc

SEQ ID NO: 3197355 - RNA, 15 nt, Mycobacterium bovis subsp bovis AF2122/97
gcgacacacgccgcc

SEQ ID NO: 3197356 - RNA, 16 nt, Mycobacterium bovis subsp bovis AF2122/97
gcgacacacgccgccg

SEQ ID NO: 3197357 - RNA, 18 nt, Mycobacterium bovis subsp bovis AF2122/97
gcgacacacgccgccggu

SEQ ID NO: 3197358 - RNA, 23 nt, Mycobacterium bovis subsp bovis AF2122/97
gcgacacccugggugccggcagc

SEQ ID NO: 3197359 - RNA, 17 nt, Mycobacterium bovis subsp bovis AF2122/97
gcgacaccgcaggugcc

SEQ ID NO: 3197360 - RNA, 13 nt, Mycobacterium bovis subsp bovis AF2122/97
gcgacacgccagc

SEQ ID NO: 3197361 - RNA, 15 nt, Mycobacterium bovis subsp bovis AF2122/97
gcgacacgccagccg

SEQ ID NO: 3197362 - RNA, 18 nt, Mycobacterium bovis subsp bovis AF2122/97
gcgacacgccagccgugc

SEQ ID NO: 3197363 - RNA, 21 nt, Mycobacterium bovis subsp bovis AF2122/97
gcgacacgccagccgugccgg

SEQ ID NO: 3197364 - RNA, 14 nt, Mycobacterium bovis subsp bovis AF2122/97
gcgacacgccggcg

SEQ ID NO: 3197365 - RNA, 19 nt, Mycobacterium bovis subsp bovis AF2122/97
gcgacacguuggcggaugc

SEQ ID NO: 3197366 - RNA, 21 nt, Mycobacterium bovis subsp bovis AF2122/97
gcgacacucacgggugcuggc

SEQ ID NO: 3197367 - RNA, 16 nt, Mycobacterium bovis subsp bovis AF2122/97
gcgacagacagcaccg

SEQ ID NO: 3197368 - RNA, 20 nt, Mycobacterium bovis subsp bovis AF2122/97
gcgacagacagcaccgccgg

SEQ ID NO: 3197369 - RNA, 24 nt, Mycobacterium bovis subsp bovis AF2122/97
gcgacagacagcaccgccggugcg

SEQ ID NO: 3197370 - RNA, 18 nt, Mycobacterium bovis subsp bovis AF2122/97
gcgacagcacgugcccca

SEQ ID NO: 3197371 - RNA, 12 nt, Mycobacterium bovis subsp bovis AF2122/97
gcgacagcagcg

SEQ ID NO: 3197372 - RNA, 15 nt, Mycobacterium bovis subsp bovis AF2122/97
gcgacagcagcgcca

SEQ ID NO: 3197373 - RNA, 17 nt, Mycobacterium bovis subsp bovis AF2122/97
gcgacagcagcgccacc

SEQ ID NO: 3197374 - RNA, 17 nt, Mycobacterium bovis subsp bovis AF2122/97
gcgacagccaccucgac

SEQ ID NO: 3197375 - RNA, 19 nt, Mycobacterium bovis subsp bovis AF2122/97
gcgacagccaccucgacgg

SEQ ID NO: 3197376 - RNA, 15 nt, Mycobacterium bovis subsp bovis AF2122/97
gcgacagccguggcg

SEQ ID NO: 3197377 - RNA, 16 nt, Mycobacterium bovis subsp bovis AF2122/97
gcgacagccguggcgc

SEQ ID NO: 3197378 - RNA, 21 nt, Mycobacterium bovis subsp bovis AF2122/97
gcgacagccguggcgcgacgu

SEQ ID NO: 3197379 - RNA, 13 nt, Mycobacterium bovis subsp bovis AF2122/97
gcgacagcgcggc

SEQ ID NO: 3197380 - RNA, 15 nt, Mycobacterium bovis subsp bovis AF2122/97
gcgacagcgcggcgg

SEQ ID NO: 3197381 - RNA, 16 nt, Mycobacterium bovis subsp bovis AF2122/97
gcgacagcgcggcggu

SEQ ID NO: 3197382 - RNA, 18 nt, Mycobacterium bovis subsp bovis AF2122/97
gcgacagcgcggcggucg

SEQ ID NO: 3197383 - RNA, 19 nt, Mycobacterium bovis subsp bovis AF2122/97
gcgacccguagcuuggcga

SEQ ID NO: 3197384 - RNA, 18 nt, Mycobacterium bovis subsp bovis AF2122/97
gcgacccguugaacucga

SEQ ID NO: 3197385 - RNA, 21 nt, Mycobacterium bovis subsp bovis AF2122/97
gcgaccgaaaauucaggcgcc

SEQ ID NO: 3197386 - RNA, 19 nt, Mycobacterium bovis subsp bovis AF2122/97
gcgaccgagacggcgucgg

SEQ ID NO: 3197387 - RNA, 18 nt, Mycobacterium bovis subsp bovis AF2122/97
gcgaccgaugaucucacc

SEQ ID NO: 3197388 - RNA, 14 nt, Mycobacterium bovis subsp bovis AF2122/97
gcgaccgcagcugg

SEQ ID NO: 3197389 - RNA, 15 nt, Mycobacterium bovis subsp bovis AF2122/97
gcgaccgcagcuggg

SEQ ID NO: 3197390 - RNA, 21 nt, Mycobacterium bovis subsp bovis AF2122/97
gcgaccgcauugagcuggcgc

SEQ ID NO: 3197391 - RNA, 17 nt, Mycobacterium bovis subsp bovis AF2122/97
gcgaccgccaucacgac

SEQ ID NO: 3197392 - RNA, 15 nt, Mycobacterium bovis subsp bovis AF2122/97
gcgaccgccggaccg

SEQ ID NO: 3197393 - RNA, 17 nt, Mycobacterium bovis subsp bovis AF2122/97
gcgaccgccggaccgcc

SEQ ID NO: 3197394 - RNA, 16 nt, Mycobacterium bovis subsp bovis AF2122/97
gcgaccgccucgccgu

SEQ ID NO: 3197395 - RNA, 17 nt, Mycobacterium bovis subsp bovis AF2122/97
gcgaccgccugcgcggc

SEQ ID NO: 3197396 - RNA, 20 nt, Mycobacterium bovis subsp bovis AF2122/97
gcgaccgccugcgcggcugc

SEQ ID NO: 3197397 - RNA, 14 nt, Mycobacterium bovis subsp bovis AF2122/97
gcgaccgcgaccgc

SEQ ID NO: 3197398 - RNA, 15 nt, Mycobacterium bovis subsp bovis AF2122/97
gcgaccgcgaccgca

SEQ ID NO: 3197399 - RNA, 14 nt, Mycobacterium bovis subsp bovis AF2122/97
gcgaccgcgauccc

SEQ ID NO: 3197400 - RNA, 17 nt, Mycobacterium bovis subsp bovis AF2122/97
gcgaccgcgaugguggu

SEQ ID NO: 3197401 - RNA, 23 nt, Mycobacterium bovis subsp bovis AF2122/97
gcgaccgcgcacggcuggcguac

SEQ ID NO: 3197402 - RNA, 12 nt, Mycobacterium bovis subsp bovis AF2122/97
gcgaccgcggcc

SEQ ID NO: 3197403 - RNA, 15 nt, Mycobacterium bovis subsp bovis AF2122/97
gcgaccgcggccccg

SEQ ID NO: 3197404 - RNA, 18 nt, Mycobacterium bovis subsp bovis AF2122/97
gcgaccgcggccccgccg

SEQ ID NO: 3197405 - RNA, 12 nt, Mycobacterium bovis subsp bovis AF2122/97
gcgaccgcgggc

SEQ ID NO: 3197406 - RNA, 14 nt, Mycobacterium bovis subsp bovis AF2122/97
gcgaccgcggucgc

SEQ ID NO: 3197407 - RNA, 14 nt, Mycobacterium bovis subsp bovis AF2122/97
gcgaccgcugaggu

SEQ ID NO: 3197408 - RNA, 16 nt, Mycobacterium bovis subsp bovis AF2122/97
gcgaccggacgagcgu

SEQ ID NO: 3197409 - RNA, 18 nt, Mycobacterium bovis subsp bovis AF2122/97
gcgaccggcaacgcggcc

SEQ ID NO: 3197410 - RNA, 22 nt, Mycobacterium bovis subsp bovis AF2122/97
gcgaccggcaacgcggccuugc

SEQ ID NO: 3197411 - RNA, 13 nt, Mycobacterium bovis subsp bovis AF2122/97
gcgaccggccggc

SEQ ID NO: 3197412 - RNA, 15 nt, Mycobacterium bovis subsp bovis AF2122/97
gcgaccggccggccg

SEQ ID NO: 3197413 - RNA, 17 nt, Mycobacterium bovis subsp bovis AF2122/97
gcgaccggccggccgcg

SEQ ID NO: 3197414 - RNA, 20 nt, Mycobacterium bovis subsp bovis AF2122/97
gcgaccggccggccgcgggc

SEQ ID NO: 3197415 - RNA, 14 nt, Mycobacterium bovis subsp bovis AF2122/97
gcgaccggcgaccg

SEQ ID NO: 3197416 - RNA, 13 nt, Mycobacterium bovis subsp bovis AF2122/97
gcgaccggcguaa

SEQ ID NO: 3197417 - RNA, 21 nt, Mycobacterium bovis subsp bovis AF2122/97
gcgaccggcguaaccggcagc

SEQ ID NO: 3197418 - RNA, 14 nt, Mycobacterium bovis subsp bovis AF2122/97
gcgaccgggaucgg

SEQ ID NO: 3197419 - RNA, 16 nt, Mycobacterium bovis subsp bovis AF2122/97
gcgaccgggaucggcu

SEQ ID NO: 3197420 - RNA, 15 nt, Mycobacterium bovis subsp bovis AF2122/97
gcgaccggguccggc

SEQ ID NO: 3197421 - RNA, 20 nt, Mycobacterium bovis subsp bovis AF2122/97
gcgaccgguaauccguugcc

SEQ ID NO: 3197422 - RNA, 19 nt, Mycobacterium bovis subsp bovis AF2122/97
gcgaccggucugaucggcu

SEQ ID NO: 3197423 - RNA, 23 nt, Mycobacterium bovis subsp bovis AF2122/97
gcgaccggugccugcaacgccag

SEQ ID NO: 3197424 - RNA, 15 nt, Mycobacterium bovis subsp bovis AF2122/97
gcgaccgguucggcg

SEQ ID NO: 3197425 - RNA, 14 nt, Mycobacterium bovis subsp bovis AF2122/97
gcgaccgucccagc

SEQ ID NO: 3197426 - RNA, 17 nt, Mycobacterium bovis subsp bovis AF2122/97
gcgaccgucccagcgcc

SEQ ID NO: 3197427 - RNA, 19 nt, Mycobacterium bovis subsp bovis AF2122/97
gcgaccgucccagcgccgc

SEQ ID NO: 3197428 - RNA, 21 nt, Mycobacterium bovis subsp bovis AF2122/97
gcgaccgucccagcgccgcag

SEQ ID NO: 3197429 - RNA, 13 nt, Mycobacterium bovis subsp bovis AF2122/97
gcgaccgucccgg

SEQ ID NO: 3197430 - RNA, 17 nt, Mycobacterium bovis subsp bovis AF2122/97
gcgaccgucccggccuc

SEQ ID NO: 3197431 - RNA, 18 nt, Mycobacterium bovis subsp bovis AF2122/97
gcgaccgucccggccucg

SEQ ID NO: 3197432 - RNA, 18 nt, Mycobacterium bovis subsp bovis AF2122/97
gcgaccgucgucaccgcg

SEQ ID NO: 3197433 - RNA, 15 nt, Mycobacterium bovis subsp bovis AF2122/97
gcgaccgucguccag

SEQ ID NO: 3197434 - RNA, 17 nt, Mycobacterium bovis subsp bovis AF2122/97
gcgaccgucguccagac

SEQ ID NO: 3197435 - RNA, 24 nt, Mycobacterium bovis subsp bovis AF2122/97
gcgaccgucuggaguucgucaccg

SEQ ID NO: 3197436 - RNA, 14 nt, Mycobacterium bovis subsp bovis AF2122/97
gcgaccucacugcg

SEQ ID NO: 3197437 - RNA, 18 nt, Mycobacterium bovis subsp bovis AF2122/97
gcgaccucacugcggcgc

SEQ ID NO: 3197438 - RNA, 19 nt, Mycobacterium bovis subsp bovis AF2122/97
gcgaccucacugcggcgcc

SEQ ID NO: 3197439 - RNA, 13 nt, Mycobacterium bovis subsp bovis AF2122/97
gcgaccucgccgc

SEQ ID NO: 3197440 - RNA, 16 nt, Mycobacterium bovis subsp bovis AF2122/97
gcgaccucgccggacg

SEQ ID NO: 3197441 - RNA, 17 nt, Mycobacterium bovis subsp bovis AF2122/97
gcgaccucgccggacgg

SEQ ID NO: 3197442 - RNA, 18 nt, Mycobacterium bovis subsp bovis AF2122/97
gcgaccugccggaccgcg

SEQ ID NO: 3197443 - RNA, 20 nt, Mycobacterium bovis subsp bovis AF2122/97
gcgaccugccggaccgcgga

SEQ ID NO: 3197444 - RNA, 14 nt, Mycobacterium bovis subsp bovis AF2122/97
gcgaccugcgcgag

SEQ ID NO: 3197445 - RNA, 16 nt, Mycobacterium bovis subsp bovis AF2122/97
gcgaccuggucgaacu

SEQ ID NO: 3197446 - RNA, 15 nt, Mycobacterium bovis subsp bovis AF2122/97
gcgaccuugcccgcu

SEQ ID NO: 3197447 - RNA, 19 nt, Mycobacterium bovis subsp bovis AF2122/97
gcgaccuugcccgcuagcg

SEQ ID NO: 3197448 - RNA, 17 nt, Mycobacterium bovis subsp bovis AF2122/97
gcgacgaaccucggcgg

SEQ ID NO: 3197449 - RNA, 20 nt, Mycobacterium bovis subsp bovis AF2122/97
gcgacgaacugaagccccuu

SEQ ID NO: 3197450 - RNA, 15 nt, Mycobacterium bovis subsp bovis AF2122/97
gcgacgaagaagaac

SEQ ID NO: 3197451 - RNA, 21 nt, Mycobacterium bovis subsp bovis AF2122/97
gcgacgaagaagaacucggcg

SEQ ID NO: 3197452 - RNA, 21 nt, Mycobacterium bovis subsp bovis AF2122/97
gcgacgacacgccugggcgac

SEQ ID NO: 3197453 - RNA, 20 nt, Mycobacterium bovis subsp bovis AF2122/97
gcgacgacaucugcccagcg

SEQ ID NO: 3197454 - RNA, 13 nt, Mycobacterium bovis subsp bovis AF2122/97
gcgacgacauugg

SEQ ID NO: 3197455 - RNA, 17 nt, Mycobacterium bovis subsp bovis AF2122/97
gcgacgacccgggucgg

SEQ ID NO: 3197456 - RNA, 24 nt, Mycobacterium bovis subsp bovis AF2122/97
gcgacgacccgggucggcacgacc

SEQ ID NO: 3197457 - RNA, 11 nt, Mycobacterium bovis subsp bovis AF2122/97
gcgacgacgag

SEQ ID NO: 3197458 - RNA, 15 nt, Mycobacterium bovis subsp bovis AF2122/97
gcgacgacggcgccg

SEQ ID NO: 3197459 - RNA, 24 nt, Mycobacterium bovis subsp bovis AF2122/97
gcgacgacuucagcaugguggacg

SEQ ID NO: 3197460 - RNA, 14 nt, Mycobacterium bovis subsp bovis AF2122/97
gcgacgagaucagc

SEQ ID NO: 3197461 - RNA, 17 nt, Mycobacterium bovis subsp bovis AF2122/97
gcgacgagaucugcgau

SEQ ID NO: 3197462 - RNA, 17 nt, Mycobacterium bovis subsp bovis AF2122/97
gcgacgagcaacgccac

SEQ ID NO: 3197463 - RNA, 14 nt, Mycobacterium bovis subsp bovis AF2122/97
gcgacgagcagcaa

SEQ ID NO: 3197464 - RNA, 23 nt, Mycobacterium bovis subsp bovis AF2122/97
gcgacgagcccaccgucgcauac

SEQ ID NO: 3197465 - RNA, 16 nt, Mycobacterium bovis subsp bovis AF2122/97
gcgacgagcggccgug

SEQ ID NO: 3197466 - RNA, 21 nt, Mycobacterium bovis subsp bovis AF2122/97
gcgacgaggcgacgucguucu

SEQ ID NO: 3197467 - RNA, 22 nt, Mycobacterium bovis subsp bovis AF2122/97
gcgacgaguugcgaaccaugac

SEQ ID NO: 3197468 - RNA, 20 nt, Mycobacterium bovis subsp bovis AF2122/97
gcgacgauccagggucaccu

SEQ ID NO: 3197469 - RNA, 13 nt, Mycobacterium bovis subsp bovis AF2122/97
gcgacgauccgca

SEQ ID NO: 3197470 - RNA, 19 nt, Mycobacterium bovis subsp bovis AF2122/97
gcgacgucaucgccgaccc

SEQ ID NO: 3197471 - RNA, 17 nt, Mycobacterium bovis subsp bovis AF2122/97
gcgacguccaccagccg

SEQ ID NO: 3197472 - RNA, 18 nt, Mycobacterium bovis subsp bovis AF2122/97
gcgacguccaccagccgg

SEQ ID NO: 3197473 - RNA, 14 nt, Mycobacterium bovis subsp bovis AF2122/97
gcgacgucgcgcag

SEQ ID NO: 3197474 - RNA, 16 nt, Mycobacterium bovis subsp bovis AF2122/97
gcgacgucgcgcaggu

SEQ ID NO: 3197475 - RNA, 18 nt, Mycobacterium bovis subsp bovis AF2122/97
gcgacgucgcgggugaug

SEQ ID NO: 3197476 - RNA, 20 nt, Mycobacterium bovis subsp bovis AF2122/97
gcgacgucgcuagaucccag

SEQ ID NO: 3197477 - RNA, 16 nt, Mycobacterium bovis subsp bovis AF2122/97
gcgacgucggcgguga

SEQ ID NO: 3197478 - RNA, 16 nt, Mycobacterium bovis subsp bovis AF2122/97
gcgacgucucgcaugc

SEQ ID NO: 3197479 - RNA, 20 nt, Mycobacterium bovis subsp bovis AF2122/97
gcgacgucucgcaugcucac

SEQ ID NO: 3197480 - RNA, 19 nt, Mycobacterium bovis subsp bovis AF2122/97
gcgacgugaaugguggugu

SEQ ID NO: 3197481 - RNA, 19 nt, Mycobacterium bovis subsp bovis AF2122/97
gcgacguggauuguguccc

SEQ ID NO: 3197482 - RNA, 15 nt, Mycobacterium bovis subsp bovis AF2122/97
gcgacguggcgccga

SEQ ID NO: 3197483 - RNA, 20 nt, Mycobacterium bovis subsp bovis AF2122/97
gcgacguguugcacguacgg

SEQ ID NO: 3197484 - RNA, 18 nt, Mycobacterium bovis subsp bovis AF2122/97
gcgacguuaacugcgccu

SEQ ID NO: 3197485 - RNA, 16 nt, Mycobacterium bovis subsp bovis AF2122/97
gcgacguuccgcucga

SEQ ID NO: 3197486 - RNA, 16 nt, Mycobacterium bovis subsp bovis AF2122/97
gcgacguuggcgggag

SEQ ID NO: 3197487 - RNA, 17 nt, Mycobacterium bovis subsp bovis AF2122/97
gcgacguuggcgggagc

SEQ ID NO: 3197488 - RNA, 23 nt, Mycobacterium bovis subsp bovis AF2122/97
gcgacguugguugcguccgccga

SEQ ID NO: 3197489 - RNA, 14 nt, Mycobacterium bovis subsp bovis AF2122/97
gcgacuaccaucgc

SEQ ID NO: 3197490 - RNA, 14 nt, Mycobacterium bovis subsp bovis AF2122/97
gcgacuacggccuc

SEQ ID NO: 3197491 - RNA, 21 nt, Mycobacterium bovis subsp bovis AF2122/97
gcgacuacggccucgcugggc

SEQ ID NO: 3197492 - RNA, 18 nt, Mycobacterium bovis subsp bovis AF2122/97
gcgacuagacgccgccgc

SEQ ID NO: 3197493 - RNA, 19 nt, Mycobacterium bovis subsp bovis AF2122/97
gcgacuagacgccgccgcu

SEQ ID NO: 3197494 - RNA, 22 nt, Mycobacterium bovis subsp bovis AF2122/97
gcgacuagacgccgccgcugcc

SEQ ID NO: 3197495 - RNA, 21 nt, Mycobacterium bovis subsp bovis AF2122/97
gcgacuccaccccacccagcg

SEQ ID NO: 3197496 - RNA, 14 nt, Mycobacterium bovis subsp bovis AF2122/97
gcgacuccagcgcc

SEQ ID NO: 3197497 - RNA, 16 nt, Mycobacterium bovis subsp bovis AF2122/97
gcgacuccagcgcccg

SEQ ID NO: 3197498 - RNA, 14 nt, Mycobacterium bovis subsp bovis AF2122/97
gcgacucgccggcg

SEQ ID NO: 3197499 - RNA, 15 nt, Mycobacterium bovis subsp bovis AF2122/97
gcgacucgccggcga

SEQ ID NO: 3197500 - RNA, 13 nt, Mycobacterium bovis subsp bovis AF2122/97
gcgacucggugcg

SEQ ID NO: 3197501 - RNA, 17 nt, Mycobacterium bovis subsp bovis AF2122/97
gcgacucgugucugccu

SEQ ID NO: 3197502 - RNA, 18 nt, Mycobacterium bovis subsp bovis AF2122/97
gcgacucugcgucugcuc

SEQ ID NO: 3197503 - RNA, 22 nt, Mycobacterium bovis subsp bovis AF2122/97
gcgacucugcgucugcucacca

SEQ ID NO: 3197504 - RNA, 14 nt, Mycobacterium bovis subsp bovis AF2122/97
gcgacucugugacg

SEQ ID NO: 3197505 - RNA, 18 nt, Mycobacterium bovis subsp bovis AF2122/97
gcgacucugugacgggca

SEQ ID NO: 3197506 - RNA, 14 nt, Mycobacterium bovis subsp bovis AF2122/97
gcgacugagaucgc

SEQ ID NO: 3197507 - RNA, 14 nt, Mycobacterium bovis subsp bovis AF2122/97
gcgacugcagcgaa

SEQ ID NO: 3197508 - RNA, 17 nt, Mycobacterium bovis subsp bovis AF2122/97
gcgacugcagcggcgca

SEQ ID NO: 3197509 - RNA, 18 nt, Mycobacterium bovis subsp bovis AF2122/97
gcgacugcagcggcgcau

SEQ ID NO: 3197510 - RNA, 22 nt, Mycobacterium bovis subsp bovis AF2122/97
gcgacugcgaaugcugggcccg

SEQ ID NO: 3197511 - RNA, 13 nt, Mycobacterium bovis subsp bovis AF2122/97
gcgacugcgcacc

SEQ ID NO: 3197512 - RNA, 15 nt, Mycobacterium bovis subsp bovis AF2122/97
gcgacugucuggucg

SEQ ID NO: 3197513 - RNA, 23 nt, Mycobacterium bovis subsp bovis AF2122/97
gcgacugugaaucucacgacgcc

SEQ ID NO: 3197514 - RNA, 15 nt, Mycobacterium bovis subsp bovis AF2122/97
gcgacuugcaccccg

SEQ ID NO: 3197515 - RNA, 19 nt, Mycobacterium bovis subsp bovis AF2122/97
gcgacuuggcaucgcgagc

SEQ ID NO: 3197516 - RNA, 18 nt, Mycobacterium bovis subsp bovis AF2122/97
gcgagaacccacgcaugc

SEQ ID NO: 3197517 - RNA, 15 nt, Mycobacterium bovis subsp bovis AF2122/97
gcgagaacccgagcg

SEQ ID NO: 3197518 - RNA, 13 nt, Mycobacterium bovis subsp bovis AF2122/97
gcgagaagcaggg

SEQ ID NO: 3197519 - RNA, 14 nt, Mycobacterium bovis subsp bovis AF2122/97
gcgagaagcgucgc

SEQ ID NO: 3197520 - RNA, 15 nt, Mycobacterium bovis subsp bovis AF2122/97
gcgagaaggugcugc

SEQ ID NO: 3197521 - RNA, 20 nt, Mycobacterium bovis subsp bovis AF2122/97
gcgagaaggugcugcgcggg

SEQ ID NO: 3197522 - RNA, 23 nt, Mycobacterium bovis subsp bovis AF2122/97
gcgagacauugacgaggcgagcg

SEQ ID NO: 3197523 - RNA, 23 nt, Mycobacterium bovis subsp bovis AF2122/97
gcgagaccucucugcgccaggcg

SEQ ID NO: 3197524 - RNA, 18 nt, Mycobacterium bovis subsp bovis AF2122/97
gcgagacgcaugucgggc

SEQ ID NO: 3197525 - RNA, 24 nt, Mycobacterium bovis subsp bovis AF2122/97
gcgagacgcaugucgggccaggcg

SEQ ID NO: 3197526 - RNA, 22 nt, Mycobacterium bovis subsp bovis AF2122/97
gcgagacgcuccaguggcgcca

SEQ ID NO: 3197527 - RNA, 19 nt, Mycobacterium bovis subsp bovis AF2122/97
gcgagacuucgacgcggcg

SEQ ID NO: 3197528 - RNA, 21 nt, Mycobacterium bovis subsp bovis AF2122/97
gcgagacuucgacgcggcgac

SEQ ID NO: 3197529 - RNA, 22 nt, Mycobacterium bovis subsp bovis AF2122/97
gcgagacuucgacgcggcgacc

SEQ ID NO: 3197530 - RNA, 23 nt, Mycobacterium bovis subsp bovis AF2122/97
gcgagacuucgacgcggcgaccg

SEQ ID NO: 3197531 - RNA, 13 nt, Mycobacterium bovis subsp bovis AF2122/97
gcgagagccggcg

SEQ ID NO: 3197532 - RNA, 14 nt, Mycobacterium bovis subsp bovis AF2122/97
gcgagagccggcgg

SEQ ID NO: 3197533 - RNA, 15 nt, Mycobacterium bovis subsp bovis AF2122/97
gcgagagccggcggc

SEQ ID NO: 3197534 - RNA, 16 nt, Mycobacterium bovis subsp bovis AF2122/97
gcgagagccggcggcg

SEQ ID NO: 3197535 - RNA, 15 nt, Mycobacterium bovis subsp bovis AF2122/97
gcgagagccuccaug

SEQ ID NO: 3197536 - RNA, 15 nt, Mycobacterium bovis subsp bovis AF2122/97
gcgagagccucggcc

SEQ ID NO: 3197537 - RNA, 17 nt, Mycobacterium bovis subsp bovis AF2122/97
gcgagaggugcugcacc

SEQ ID NO: 3197538 - RNA, 18 nt, Mycobacterium bovis subsp bovis AF2122/97
gcgagauagcaccaguuu

SEQ ID NO: 3197539 - RNA, 15 nt, Mycobacterium bovis subsp bovis AF2122/97
gcgagaucagcaugc

SEQ ID NO: 3197540 - RNA, 18 nt, Mycobacterium bovis subsp bovis AF2122/97
gcgagaucagcaugcccu

SEQ ID NO: 3197541 - RNA, 14 nt, Mycobacterium bovis subsp bovis AF2122/97
gcgagaucgcggcg

SEQ ID NO: 3197542 - RNA, 22 nt, Mycobacterium bovis subsp bovis AF2122/97
gcgagaucgggccggccgccgc

SEQ ID NO: 3197543 - RNA, 23 nt, Mycobacterium bovis subsp bovis AF2122/97
gcgagaucuuuucaccaccucgg

SEQ ID NO: 3197544 - RNA, 15 nt, Mycobacterium bovis subsp bovis AF2122/97
gcgagcaacacgagc

SEQ ID NO: 3197545 - RNA, 13 nt, Mycobacterium bovis subsp bovis AF2122/97
gcgagcaacucgu

SEQ ID NO: 3197546 - RNA, 18 nt, Mycobacterium bovis subsp bovis AF2122/97
gcgagcaacucguccagc

SEQ ID NO: 3197547 - RNA, 18 nt, Mycobacterium bovis subsp bovis AF2122/97
gcgagcaauuccucagcc

SEQ ID NO: 3197548 - RNA, 24 nt, Mycobacterium bovis subsp bovis AF2122/97
gcgagcacacuccuagccaacgag

SEQ ID NO: 3197549 - RNA, 19 nt, Mycobacterium bovis subsp bovis AF2122/97
gcgagcacaugcugccgcu

SEQ ID NO: 3197550 - RNA, 18 nt, Mycobacterium bovis subsp bovis AF2122/97
gcgagcaccaccccagcg

SEQ ID NO: 3197551 - RNA, 20 nt, Mycobacterium bovis subsp bovis AF2122/97
gcgagcaccaccccagcggc

SEQ ID NO: 3197552 - RNA, 21 nt, Mycobacterium bovis subsp bovis AF2122/97
gcgagcaccaccccagcggcc

SEQ ID NO: 3197553 - RNA, 22 nt, Mycobacterium bovis subsp bovis AF2122/97
gcgagcaccaccccagcggcca

SEQ ID NO: 3197554 - RNA, 19 nt, Mycobacterium bovis subsp bovis AF2122/97
gcgagcacccguugaucgc

SEQ ID NO: 3197555 - RNA, 21 nt, Mycobacterium bovis subsp bovis AF2122/97
gcgagcacccguugaucgcgg

SEQ ID NO: 3197556 - RNA, 18 nt, Mycobacterium bovis subsp bovis AF2122/97
gcgaggugccgggguggc

SEQ ID NO: 3197557 - RNA, 20 nt, Mycobacterium bovis subsp bovis AF2122/97
gcgaggugcucggaucggcu

SEQ ID NO: 3197558 - RNA, 15 nt, Mycobacterium bovis subsp bovis AF2122/97
gcgagguugcgccga

SEQ ID NO: 3197559 - RNA, 18 nt, Mycobacterium bovis subsp bovis AF2122/97
gcgagguugcgccgaccg

SEQ ID NO: 3197560 - RNA, 23 nt, Mycobacterium bovis subsp bovis AF2122/97
gcgagguuggcguugguggucgg

SEQ ID NO: 3197561 - RNA, 19 nt, Mycobacterium bovis subsp bovis AF2122/97
gcgaguaacccguccggug

SEQ ID NO: 3197562 - RNA, 18 nt, Mycobacterium bovis subsp bovis AF2122/97
gcgaguacaggcgcagcg

SEQ ID NO: 3197563 - RNA, 14 nt, Mycobacterium bovis subsp bovis AF2122/97
gcgaguacgcaagc

SEQ ID NO: 3197564 - RNA, 20 nt, Mycobacterium bovis subsp bovis AF2122/97
gcgaguacggccugccgcuc

SEQ ID NO: 3197565 - RNA, 21 nt, Mycobacterium bovis subsp bovis AF2122/97
gcgaguacggccugccgcucg

SEQ ID NO: 3197566 - RNA, 23 nt, Mycobacterium bovis subsp bovis AF2122/97
gcgaguacggccugccgcucgcc

SEQ ID NO: 3197567 - RNA, 24 nt, Mycobacterium bovis subsp bovis AF2122/97
gcgaguacggccugccgcucgccg

SEQ ID NO: 3197568 - RNA, 21 nt, Mycobacterium bovis subsp bovis AF2122/97
gcgaguagccgcuaggaucgg

SEQ ID NO: 3197569 - RNA, 14 nt, Mycobacterium bovis subsp bovis AF2122/97
gcgagucccggcgg

SEQ ID NO: 3197570 - RNA, 15 nt, Mycobacterium bovis subsp bovis AF2122/97
gcgagucccggcggu

SEQ ID NO: 3197571 - RNA, 23 nt, Mycobacterium bovis subsp bovis AF2122/97
gcgaguccucgagugccgccguc

SEQ ID NO: 3197572 - RNA, 16 nt, Mycobacterium bovis subsp bovis AF2122/97
gcgagucgaacccgcg

SEQ ID NO: 3197573 - RNA, 20 nt, Mycobacterium bovis subsp bovis AF2122/97
gcgagucgaacccgcgagca

SEQ ID NO: 3197574 - RNA, 14 nt, Mycobacterium bovis subsp bovis AF2122/97
gcgagucgacgaac

SEQ ID NO: 3197575 - RNA, 12 nt, Mycobacterium bovis subsp bovis AF2122/97
gcgagucgcacu

SEQ ID NO: 3197576 - RNA, 12 nt, Mycobacterium bovis subsp bovis AF2122/97
gcgagucgcccg

SEQ ID NO: 3197577 - RNA, 15 nt, Mycobacterium bovis subsp bovis AF2122/97
gcgagucgcgcuugg

SEQ ID NO: 3197578 - RNA, 14 nt, Mycobacterium bovis subsp bovis AF2122/97
gcgagucggcgggg

SEQ ID NO: 3197579 - RNA, 22 nt, Mycobacterium bovis subsp bovis AF2122/97
gcgagucgggguacaggcugcu

SEQ ID NO: 3197580 - RNA, 23 nt, Mycobacterium bovis subsp bovis AF2122/97
gcgagucgggguacaggcugcug

SEQ ID NO: 3197581 - RNA, 23 nt, Mycobacterium bovis subsp bovis AF2122/97
gcgagucgucccagucccgcguc

SEQ ID NO: 3197582 - RNA, 16 nt, Mycobacterium bovis subsp bovis AF2122/97
gcgagugaacucgucc

SEQ ID NO: 3197583 - RNA, 14 nt, Mycobacterium bovis subsp bovis AF2122/97
gcgagugcggcacg

SEQ ID NO: 3197584 - RNA, 23 nt, Mycobacterium bovis subsp bovis AF2122/97
gcgagugcgugaucuggccgaag

SEQ ID NO: 3197585 - RNA, 16 nt, Mycobacterium bovis subsp bovis AF2122/97
gcgagugguccagcca

SEQ ID NO: 3197586 - RNA, 21 nt, Mycobacterium bovis subsp bovis AF2122/97
gcgagugucagcagaugggcg

SEQ ID NO: 3197587 - RNA, 20 nt, Mycobacterium bovis subsp bovis AF2122/97
gcgaguuaggccgccagccg

SEQ ID NO: 3197588 - RNA, 21 nt, Mycobacterium bovis subsp bovis AF2122/97
gcgaguuaggccgccagccgg

SEQ ID NO: 3197589 - RNA, 14 nt, Mycobacterium bovis subsp bovis AF2122/97
gcgaguugagcaug

SEQ ID NO: 3197590 - RNA, 13 nt, Mycobacterium bovis subsp bovis AF2122/97
gcgaguugcaguc

SEQ ID NO: 3197591 - RNA, 22 nt, Mycobacterium bovis subsp bovis AF2122/97
gcgaguuggccguggcgaauga

SEQ ID NO: 3197592 - RNA, 14 nt, Mycobacterium bovis subsp bovis AF2122/97
gcgauaaaucgccg

SEQ ID NO: 3197593 - RNA, 15 nt, Mycobacterium bovis subsp bovis AF2122/97
gcgauaaaucgccga

SEQ ID NO: 3197594 - RNA, 17 nt, Mycobacterium bovis subsp bovis AF2122/97
gcgauaacccgcaucgg

SEQ ID NO: 3197595 - RNA, 22 nt, Mycobacterium bovis subsp bovis AF2122/97
gcgauaacccgcaucggaaucg

SEQ ID NO: 3197596 - RNA, 17 nt, Mycobacterium bovis subsp bovis AF2122/97
gcgauaacuccgcggcg

SEQ ID NO: 3197597 - RNA, 18 nt, Mycobacterium bovis subsp bovis AF2122/97
gcgauaacuccgcggcga

SEQ ID NO: 3197598 - RNA, 19 nt, Mycobacterium bovis subsp bovis AF2122/97
gcgauaacuccgcggcgaa

SEQ ID NO: 3197599 - RNA, 20 nt, Mycobacterium bovis subsp bovis AF2122/97
gcgauaacuccgcggcgaac

SEQ ID NO: 3197600 - RNA, 15 nt, Mycobacterium bovis subsp bovis AF2122/97
gcgauaaggaccgcg

SEQ ID NO: 3197601 - RNA, 17 nt, Mycobacterium bovis subsp bovis AF2122/97
gcgauaaggaccgcgcc

SEQ ID NO: 3197602 - RNA, 18 nt, Mycobacterium bovis subsp bovis AF2122/97
gcgauacagacggggauc

SEQ ID NO: 3197603 - RNA, 14 nt, Mycobacterium bovis subsp bovis AF2122/97
gcgauacccaccgu

SEQ ID NO: 3197604 - RNA, 15 nt, Mycobacterium bovis subsp bovis AF2122/97
gcgauaggugcucgc

SEQ ID NO: 3197605 - RNA, 17 nt, Mycobacterium bovis subsp bovis AF2122/97
gcgauauaggacgccgc

SEQ ID NO: 3197606 - RNA, 16 nt, Mycobacterium bovis subsp bovis AF2122/97
gcgauauccacaaucc

SEQ ID NO: 3197607 - RNA, 22 nt, Mycobacterium bovis subsp bovis AF2122/97
gcgauauccacaauccgcucgg

SEQ ID NO: 3197608 - RNA, 23 nt, Mycobacterium bovis subsp bovis AF2122/97
gcgauauccacaauccgcucggu

SEQ ID NO: 3197609 - RNA, 14 nt, Mycobacterium bovis subsp bovis AF2122/97
gcgauaucgaucgg

SEQ ID NO: 3197610 - RNA, 15 nt, Mycobacterium bovis subsp bovis AF2122/97
gcgauaucgcacaug

SEQ ID NO: 3197611 - RNA, 22 nt, Mycobacterium bovis subsp bovis AF2122/97
gcgauaucggcggcuuggccgc

SEQ ID NO: 3197612 - RNA, 22 nt, Mycobacterium bovis subsp bovis AF2122/97
gcgaucaacccuacccgcauga

SEQ ID NO: 3197613 - RNA, 19 nt, Mycobacterium bovis subsp bovis AF2122/97
gcgaucaaccgcugucacc

SEQ ID NO: 3197614 - RNA, 16 nt, Mycobacterium bovis subsp bovis AF2122/97
gcgaucaacgcgcacc

SEQ ID NO: 3197615 - RNA, 15 nt, Mycobacterium bovis subsp bovis AF2122/97
gcgaucaacggaucg

SEQ ID NO: 3197616 - RNA, 23 nt, Mycobacterium bovis subsp bovis AF2122/97
gcgaucaacucgggcagcgcggc

SEQ ID NO: 3197617 - RNA, 18 nt, Mycobacterium bovis subsp bovis AF2122/97
gcgaucaaugcgaugcgg

SEQ ID NO: 3197618 - RNA, 20 nt, Mycobacterium bovis subsp bovis AF2122/97
gcgaucaaugcgaugcgguc

SEQ ID NO: 3197619 - RNA, 21 nt, Mycobacterium bovis subsp bovis AF2122/97
gcgaucaaugcgaugcggucg

SEQ ID NO: 3197620 - RNA, 13 nt, Mycobacterium bovis subsp bovis AF2122/97
gcgaucaccaccg

SEQ ID NO: 3197621 - RNA, 18 nt, Mycobacterium bovis subsp bovis AF2122/97
gcgaucacccccuggacu

SEQ ID NO: 3197622 - RNA, 18 nt, Mycobacterium bovis subsp bovis AF2122/97
gcgaucaccgagucgacg

SEQ ID NO: 3197623 - RNA, 21 nt, Mycobacterium bovis subsp bovis AF2122/97
gcgaucaccgagucgacggcc

SEQ ID NO: 3197624 - RNA, 14 nt, Mycobacterium bovis subsp bovis AF2122/97
gcgaucaccgcgcc

SEQ ID NO: 3197625 - RNA, 22 nt, Mycobacterium bovis subsp bovis AF2122/97
gcgaucaccgcgccggagaucg

SEQ ID NO: 3197626 - RNA, 17 nt, Mycobacterium bovis subsp bovis AF2122/97
gcgaucaccuccgcgac

SEQ ID NO: 3197627 - RNA, 19 nt, Mycobacterium bovis subsp bovis AF2122/97
gcgaucaccuccgcgacgg

SEQ ID NO: 3197628 - RNA, 20 nt, Mycobacterium bovis subsp bovis AF2122/97
gcgaucaccuccgcgacggc

SEQ ID NO: 3197629 - RNA, 15 nt, Mycobacterium bovis subsp bovis AF2122/97
gcgaucagcagccgc

SEQ ID NO: 3197630 - RNA, 15 nt, Mycobacterium bovis subsp bovis AF2122/97
gcgaucagcgcgcac

SEQ ID NO: 3197631 - RNA, 13 nt, Mycobacterium bovis subsp bovis AF2122/97
gcgaucagcuggg

SEQ ID NO: 3197632 - RNA, 20 nt, Mycobacterium bovis subsp bovis AF2122/97
gcgaucaggcggacgggacg

SEQ ID NO: 3197633 - RNA, 14 nt, Mycobacterium bovis subsp bovis AF2122/97
gcgaucaggcugcc

SEQ ID NO: 3197634 - RNA, 21 nt, Mycobacterium bovis subsp bovis AF2122/97
gcgaucaggcugccgcugcgc

SEQ ID NO: 3197635 - RNA, 20 nt, Mycobacterium bovis subsp bovis AF2122/97
gcgaucaguucgugacgugc

SEQ ID NO: 3197636 - RNA, 16 nt, Mycobacterium bovis subsp bovis AF2122/97
gcgaucaucaggugcg

SEQ ID NO: 3197637 - RNA, 21 nt, Mycobacterium bovis subsp bovis AF2122/97
gcgaucaucaggugcgccugg

SEQ ID NO: 3197638 - RNA, 19 nt, Mycobacterium bovis subsp bovis AF2122/97
gcgaucaugagcagcacgu

SEQ ID NO: 3197639 - RNA, 18 nt, Mycobacterium bovis subsp bovis AF2122/97
gcgauccaaugcgagguu

SEQ ID NO: 3197640 - RNA, 19 nt, Mycobacterium bovis subsp bovis AF2122/97
gcgauccacuccggcgauc

SEQ ID NO: 3197641 - RNA, 13 nt, Mycobacterium bovis subsp bovis AF2122/97
gcgauccagggcc

SEQ ID NO: 3197642 - RNA, 16 nt, Mycobacterium bovis subsp bovis AF2122/97
gcgaucuggccgaacg

SEQ ID NO: 3197643 - RNA, 22 nt, Mycobacterium bovis subsp bovis AF2122/97
gcgaucugggcuuucagcaccg

SEQ ID NO: 3197644 - RNA, 18 nt, Mycobacterium bovis subsp bovis AF2122/97
gcgaucuguccgcgaacg

SEQ ID NO: 3197645 - RNA, 15 nt, Mycobacterium bovis subsp bovis AF2122/97
gcgaucuuggaucgg

SEQ ID NO: 3197646 - RNA, 15 nt, Mycobacterium bovis subsp bovis AF2122/97
gcgaucuuggcgaca

SEQ ID NO: 3197647 - RNA, 13 nt, Mycobacterium bovis subsp bovis AF2122/97
gcgaugaacagcg

SEQ ID NO: 3197648 - RNA, 16 nt, Mycobacterium bovis subsp bovis AF2122/97
gcgaugaacagcgacg

SEQ ID NO: 3197649 - RNA, 19 nt, Mycobacterium bovis subsp bovis AF2122/97
gcgaugaccacgccgacga

SEQ ID NO: 3197650 - RNA, 14 nt, Mycobacterium bovis subsp bovis AF2122/97
gcgaugaccgggcg

SEQ ID NO: 3197651 - RNA, 14 nt, Mycobacterium bovis subsp bovis AF2122/97
gcgaugaccucggc

SEQ ID NO: 3197652 - RNA, 17 nt, Mycobacterium bovis subsp bovis AF2122/97
gcgaugaccucggcgau

SEQ ID NO: 3197653 - RNA, 22 nt, Mycobacterium bovis subsp bovis AF2122/97
gcgaugaccucggcgaugucgc

SEQ ID NO: 3197654 - RNA, 18 nt, Mycobacterium bovis subsp bovis AF2122/97
gcgaugacgaccgaucgg

SEQ ID NO: 3197655 - RNA, 20 nt, Mycobacterium bovis subsp bovis AF2122/97
gcgaugacgaccgaucggcg

SEQ ID NO: 3197656 - RNA, 16 nt, Mycobacterium bovis subsp bovis AF2122/97
gcgaugagcgcgaucu

SEQ ID NO: 3197657 - RNA, 14 nt, Mycobacterium bovis subsp bovis AF2122/97
gcgaugagcggcgc

SEQ ID NO: 3197658 - RNA, 15 nt, Mycobacterium bovis subsp bovis AF2122/97
gcgaugaugugcgac

SEQ ID NO: 3197659 - RNA, 20 nt, Mycobacterium bovis subsp bovis AF2122/97
gcgaugauguugagcuggac

SEQ ID NO: 3197660 - RNA, 16 nt, Mycobacterium bovis subsp bovis AF2122/97
gcgaugauuucgucga

SEQ ID NO: 3197661 - RNA, 20 nt, Mycobacterium bovis subsp bovis AF2122/97
gcgaugcacaaccgcugcug

SEQ ID NO: 3197662 - RNA, 16 nt, Mycobacterium bovis subsp bovis AF2122/97
gcgaugcaccccauga

SEQ ID NO: 3197663 - RNA, 15 nt, Mycobacterium bovis subsp bovis AF2122/97
gcgaugcagccggga

SEQ ID NO: 3197664 - RNA, 16 nt, Mycobacterium bovis subsp bovis AF2122/97
gcgaugcagccgggaa

SEQ ID NO: 3197665 - RNA, 18 nt, Mycobacterium bovis subsp bovis AF2122/97
gcgaugcagugcgacccg

SEQ ID NO: 3197666 - RNA, 18 nt, Mycobacterium bovis subsp bovis AF2122/97
gcgaugccccacggugcg

SEQ ID NO: 3197667 - RNA, 15 nt, Mycobacterium bovis subsp bovis AF2122/97
gcgaugccgugcugg

SEQ ID NO: 3197668 - RNA, 11 nt, Mycobacterium bovis subsp bovis AF2122/97
gcgaugccguu

SEQ ID NO: 3197669 - RNA, 13 nt, Mycobacterium bovis subsp bovis AF2122/97
gcgaugccguuca

SEQ ID NO: 3197670 - RNA, 14 nt, Mycobacterium bovis subsp bovis AF2122/97
gcgaugcgcaccag

SEQ ID NO: 3197671 - RNA, 17 nt, Mycobacterium bovis subsp bovis AF2122/97
gcgaugcgccaggcuga

SEQ ID NO: 3197672 - RNA, 15 nt, Mycobacterium bovis subsp bovis AF2122/97
gcgaugcggcccucg

SEQ ID NO: 3197673 - RNA, 23 nt, Mycobacterium bovis subsp bovis AF2122/97
gcgaugcggcccucgaauucggc

SEQ ID NO: 3197674 - RNA, 17 nt, Mycobacterium bovis subsp bovis AF2122/97
gcgaugcgggccgccag

SEQ ID NO: 3197675 - RNA, 18 nt, Mycobacterium bovis subsp bovis AF2122/97
gcgaugcggucggccaca

SEQ ID NO: 3197676 - RNA, 13 nt, Mycobacterium bovis subsp bovis AF2122/97
gcgaugcggucgu

SEQ ID NO: 3197677 - RNA, 13 nt, Mycobacterium bovis subsp bovis AF2122/97
gcgaugcggugua

SEQ ID NO: 3197678 - RNA, 22 nt, Mycobacterium bovis subsp bovis AF2122/97
gcgaugcgguuccgauagccga

SEQ ID NO: 3197679 - RNA, 14 nt, Mycobacterium bovis subsp bovis AF2122/97
gcgaugcguccgcc

SEQ ID NO: 3197680 - RNA, 18 nt, Mycobacterium bovis subsp bovis AF2122/97
gcgaugcguccgcccagc

SEQ ID NO: 3197681 - RNA, 19 nt, Mycobacterium bovis subsp bovis AF2122/97
gcgaugcguccgcccagcc

SEQ ID NO: 3197682 - RNA, 21 nt, Mycobacterium bovis subsp bovis AF2122/97
gcgaugcguccgcccagccgc

SEQ ID NO: 3197683 - RNA, 18 nt, Mycobacterium bovis subsp bovis AF2122/97
gcgaugcucacuacccgc

SEQ ID NO: 3197684 - RNA, 14 nt, Mycobacterium bovis subsp bovis AF2122/97
gcgauggcaccggc

SEQ ID NO: 3197685 - RNA, 16 nt, Mycobacterium bovis subsp bovis AF2122/97
gcgauggcaccgugga

SEQ ID NO: 3197686 - RNA, 15 nt, Mycobacterium bovis subsp bovis AF2122/97
gcgauggcagcgccg

SEQ ID NO: 3197687 - RNA, 16 nt, Mycobacterium bovis subsp bovis AF2122/97
gcgauggcagcgccga

SEQ ID NO: 3197688 - RNA, 17 nt, Mycobacterium bovis subsp bovis AF2122/97
gcgauggccaucaucga

SEQ ID NO: 3197689 - RNA, 13 nt, Mycobacterium bovis subsp bovis AF2122/97
gcgauggccgacg

SEQ ID NO: 3197690 - RNA, 17 nt, Mycobacterium bovis subsp bovis AF2122/97
gcgauggccguccgacc

SEQ ID NO: 3197691 - RNA, 17 nt, Mycobacterium bovis subsp bovis AF2122/97
gcgauggcgguccaccg

SEQ ID NO: 3197692 - RNA, 18 nt, Mycobacterium bovis subsp bovis AF2122/97
gcgauggcguagcccaug

SEQ ID NO: 3197693 - RNA, 13 nt, Mycobacterium bovis subsp bovis AF2122/97
gcgaugggagccc

SEQ ID NO: 3197694 - RNA, 19 nt, Mycobacterium bovis subsp bovis AF2122/97
gcgaugggagcccggcggc

SEQ ID NO: 3197695 - RNA, 15 nt, Mycobacterium bovis subsp bovis AF2122/97
gcgaugggcccagcg

SEQ ID NO: 3197696 - RNA, 22 nt, Mycobacterium bovis subsp bovis AF2122/97
gcgaugggcccagcggccgcga

SEQ ID NO: 3197697 - RNA, 17 nt, Mycobacterium bovis subsp bovis AF2122/97
gcgaugggccgguccgg

SEQ ID NO: 3197698 - RNA, 22 nt, Mycobacterium bovis subsp bovis AF2122/97
gcgaugggucugguguccaccg

SEQ ID NO: 3197699 - RNA, 15 nt, Mycobacterium bovis subsp bovis AF2122/97
gcgaugguaucgccg

SEQ ID NO: 3197700 - RNA, 17 nt, Mycobacterium bovis subsp bovis AF2122/97
gcgaugguaucgccgcu

SEQ ID NO: 3197701 - RNA, 15 nt, Mycobacterium bovis subsp bovis AF2122/97
gcgauggucuccucg

SEQ ID NO: 3197702 - RNA, 17 nt, Mycobacterium bovis subsp bovis AF2122/97
gcgauggugcgccgggc

SEQ ID NO: 3197703 - RNA, 18 nt, Mycobacterium bovis subsp bovis AF2122/97
gcgauggugcgccgggcg

SEQ ID NO: 3197704 - RNA, 20 nt, Mycobacterium bovis subsp bovis AF2122/97
gcgaugucccaucgcgucgg

SEQ ID NO: 3197705 - RNA, 21 nt, Mycobacterium bovis subsp bovis AF2122/97
gcgauguccuuguuggccagu

SEQ ID NO: 3197706 - RNA, 13 nt, Mycobacterium bovis subsp bovis AF2122/97
gcgaugucgccgg

SEQ ID NO: 3197707 - RNA, 20 nt, Mycobacterium bovis subsp bovis AF2122/97
gcgaugucgcgcauugccga

SEQ ID NO: 3197708 - RNA, 21 nt, Mycobacterium bovis subsp bovis AF2122/97
gcgaugucggcugguggggga

SEQ ID NO: 3197709 - RNA, 13 nt, Mycobacterium bovis subsp bovis AF2122/97
gcgaugucguucg

SEQ ID NO: 3197710 - RNA, 20 nt, Mycobacterium bovis subsp bovis AF2122/97
gcgaugugcgccaccucgac

SEQ ID NO: 3197711 - RNA, 22 nt, Mycobacterium bovis subsp bovis AF2122/97
gcgaugugcgccaccucgacgc

SEQ ID NO: 3197712 - RNA, 11 nt, Mycobacterium bovis subsp bovis AF2122/97
gcgaugugggc

SEQ ID NO: 3197713 - RNA, 19 nt, Mycobacterium bovis subsp bovis AF2122/97
gcgauuaccggcacgccgg

SEQ ID NO: 3197714 - RNA, 19 nt, Mycobacterium bovis subsp bovis AF2122/97
gcgauuagcaaaccgaccg

SEQ ID NO: 3197715 - RNA, 13 nt, Mycobacterium bovis subsp bovis AF2122/97
gcgauucccaacc

SEQ ID NO: 3197716 - RNA, 16 nt, Mycobacterium bovis subsp bovis AF2122/97
gcgauucccaaccggu

SEQ ID NO: 3197717 - RNA, 18 nt, Mycobacterium bovis subsp bovis AF2122/97
gcgauucccgcgaagcgg

SEQ ID NO: 3197718 - RNA, 17 nt, Mycobacterium bovis subsp bovis AF2122/97
gcgauuccgcgucugcu

SEQ ID NO: 3197719 - RNA, 19 nt, Mycobacterium bovis subsp bovis AF2122/97
gcgauuccgcgucugcucg

SEQ ID NO: 3197720 - RNA, 23 nt, Mycobacterium bovis subsp bovis AF2122/97
gcgauuccgcgucugcucggcgg

SEQ ID NO: 3197721 - RNA, 17 nt, Mycobacterium bovis subsp bovis AF2122/97
gcgauucgcaaucagcu

SEQ ID NO: 3197722 - RNA, 17 nt, Mycobacterium bovis subsp bovis AF2122/97
gcgauucugcgucugcu

SEQ ID NO: 3197723 - RNA, 18 nt, Mycobacterium bovis subsp bovis AF2122/97
gcgauucugcgucugcuc

SEQ ID NO: 3197724 - RNA, 22 nt, Mycobacterium bovis subsp bovis AF2122/97
gcgauucugcgucugcucgccg

SEQ ID NO: 3197725 - RNA, 22 nt, Mycobacterium bovis subsp bovis AF2122/97
gcgauucugggcuucaucggcg

SEQ ID NO: 3197726 - RNA, 23 nt, Mycobacterium bovis subsp bovis AF2122/97
gcgauucugggcuucaucggcga

SEQ ID NO: 3197727 - RNA, 19 nt, Mycobacterium bovis subsp bovis AF2122/97
gcgauucugugucugcucg

SEQ ID NO: 3197728 - RNA, 20 nt, Mycobacterium bovis subsp bovis AF2122/97
gcgauucugugucugcucgc

SEQ ID NO: 3197729 - RNA, 16 nt, Mycobacterium bovis subsp bovis AF2122/97
gcgcacccagcccagc

SEQ ID NO: 3197730 - RNA, 22 nt, Mycobacterium bovis subsp bovis AF2122/97
gcgcacccagcccagccguucg

SEQ ID NO: 3197731 - RNA, 15 nt, Mycobacterium bovis subsp bovis AF2122/97
gcgcaccccggcaua

SEQ ID NO: 3197732 - RNA, 13 nt, Mycobacterium bovis subsp bovis AF2122/97
gcgcacccgcggg

SEQ ID NO: 3197733 - RNA, 17 nt, Mycobacterium bovis subsp bovis AF2122/97
gcgcacccgcgggucgu

SEQ ID NO: 3197734 - RNA, 13 nt, Mycobacterium bovis subsp bovis AF2122/97
gcgcacccggucg

SEQ ID NO: 3197735 - RNA, 15 nt, Mycobacterium bovis subsp bovis AF2122/97
gcgcacccggucggc

SEQ ID NO: 3197736 - RNA, 20 nt, Mycobacterium bovis subsp bovis AF2122/97
gcgcacccggucggcggcau

SEQ ID NO: 3197737 - RNA, 14 nt, Mycobacterium bovis subsp bovis AF2122/97
gcgcaccgccgaug

SEQ ID NO: 3197738 - RNA, 17 nt, Mycobacterium bovis subsp bovis AF2122/97
gcgcaccgcgggaucgg

SEQ ID NO: 3197739 - RNA, 12 nt, Mycobacterium bovis subsp bovis AF2122/97
gcgcaccggagu

SEQ ID NO: 3197740 - RNA, 22 nt, Mycobacterium bovis subsp bovis AF2122/97
gcgcaccggaucgccgucgcga

SEQ ID NO: 3197741 - RNA, 16 nt, Mycobacterium bovis subsp bovis AF2122/97
gcgcaccggcgucggc

SEQ ID NO: 3197742 - RNA, 22 nt, Mycobacterium bovis subsp bovis AF2122/97
gcgcaccggcgucggcgcggcc

SEQ ID NO: 3197743 - RNA, 20 nt, Mycobacterium bovis subsp bovis AF2122/97
gcgcaccggcguucaccugc

SEQ ID NO: 3197744 - RNA, 14 nt, Mycobacterium bovis subsp bovis AF2122/97
gcgcaccggcuggc

SEQ ID NO: 3197745 - RNA, 22 nt, Mycobacterium bovis subsp bovis AF2122/97
gcgcaccggcuggcccagcgac

SEQ ID NO: 3197746 - RNA, 23 nt, Mycobacterium bovis subsp bovis AF2122/97
gcgcaccggguugagccgccgcg

SEQ ID NO: 3197747 - RNA, 23 nt, Mycobacterium bovis subsp bovis AF2122/97
gcgcaccgguauguucggcaaug

SEQ ID NO: 3197748 - RNA, 20 nt, Mycobacterium bovis subsp bovis AF2122/97
gcgcaccggucaacguggau

SEQ ID NO: 3197749 - RNA, 12 nt, Mycobacterium bovis subsp bovis AF2122/97
gcgcaccgucgc

SEQ ID NO: 3197750 - RNA, 18 nt, Mycobacterium bovis subsp bovis AF2122/97
gcgcaccgucgcggguca

SEQ ID NO: 3197751 - RNA, 19 nt, Mycobacterium bovis subsp bovis AF2122/97
gcgcaccuccugcgagugc

SEQ ID NO: 3197752 - RNA, 15 nt, Mycobacterium bovis subsp bovis AF2122/97
gcgcaccucggcgaa

SEQ ID NO: 3197753 - RNA, 18 nt, Mycobacterium bovis subsp bovis AF2122/97
gcgcaccugaaggcggcg

SEQ ID NO: 3197754 - RNA, 22 nt, Mycobacterium bovis subsp bovis AF2122/97
gcgcaccugaucggucaacucg

SEQ ID NO: 3197755 - RNA, 15 nt, Mycobacterium bovis subsp bovis AF2122/97
gcgcaccuggcgcgc

SEQ ID NO: 3197756 - RNA, 17 nt, Mycobacterium bovis subsp bovis AF2122/97
gcgcaccuggcgcgcgc

SEQ ID NO: 3197757 - RNA, 19 nt, Mycobacterium bovis subsp bovis AF2122/97
gcgcaccugggcugccggc

SEQ ID NO: 3197758 - RNA, 17 nt, Mycobacterium bovis subsp bovis AF2122/97
gcgcacgaaaccgcagc

SEQ ID NO: 3197759 - RNA, 21 nt, Mycobacterium bovis subsp bovis AF2122/97
gcgcacgaaaccgcagcgcga

SEQ ID NO: 3197760 - RNA, 18 nt, Mycobacterium bovis subsp bovis AF2122/97
gcgcacgauagccaccga

SEQ ID NO: 3197761 - RNA, 18 nt, Mycobacterium bovis subsp bovis AF2122/97
gcgcacgauuucgagcgc

SEQ ID NO: 3197762 - RNA, 14 nt, Mycobacterium bovis subsp bovis AF2122/97
gcgcacgcagccga

SEQ ID NO: 3197763 - RNA, 23 nt, Mycobacterium bovis subsp bovis AF2122/97
gcgcacgcucaguuuggccuggu

SEQ ID NO: 3197764 - RNA, 16 nt, Mycobacterium bovis subsp bovis AF2122/97
gcgcacggaccaucgc

SEQ ID NO: 3197765 - RNA, 19 nt, Mycobacterium bovis subsp bovis AF2122/97
gcgcacggaccaucgccag

SEQ ID NO: 3197766 - RNA, 22 nt, Mycobacterium bovis subsp bovis AF2122/97
gcgcacggcccgagccgcgugg

SEQ ID NO: 3197767 - RNA, 14 nt, Mycobacterium bovis subsp bovis AF2122/97
gcgcacggcgccga

SEQ ID NO: 3197768 - RNA, 18 nt, Mycobacterium bovis subsp bovis AF2122/97
gcgcacggcgccgacccg

SEQ ID NO: 3197769 - RNA, 15 nt, Mycobacterium bovis subsp bovis AF2122/97
gcgcacggcgucggc

SEQ ID NO: 3197770 - RNA, 21 nt, Mycobacterium bovis subsp bovis AF2122/97
gcgcacgguccacgguggcgc

SEQ ID NO: 3197771 - RNA, 16 nt, Mycobacterium bovis subsp bovis AF2122/97
gcgcacucccggcucg

SEQ ID NO: 3197772 - RNA, 21 nt, Mycobacterium bovis subsp bovis AF2122/97
gcgcacucgaagaugucguca

SEQ ID NO: 3197773 - RNA, 22 nt, Mycobacterium bovis subsp bovis AF2122/97
gcgcacucgaagaugucgucac

SEQ ID NO: 3197774 - RNA, 18 nt, Mycobacterium bovis subsp bovis AF2122/97
gcgcacucgaccaggacc

SEQ ID NO: 3197775 - RNA, 12 nt, Mycobacterium bovis subsp bovis AF2122/97
gcgcacucuagc

SEQ ID NO: 3197776 - RNA, 17 nt, Mycobacterium bovis subsp bovis AF2122/97
gcgcacucuagccgggu

SEQ ID NO: 3197777 - RNA, 19 nt, Mycobacterium bovis subsp bovis AF2122/97
gcgcacuugcguggcguug

SEQ ID NO: 3197778 - RNA, 19 nt, Mycobacterium bovis subsp bovis AF2122/97
gcgcagaaacgccgagcgc

SEQ ID NO: 3197779 - RNA, 22 nt, Mycobacterium bovis subsp bovis AF2122/97
gcgcagaaacgccgagcgccag

SEQ ID NO: 3197780 - RNA, 22 nt, Mycobacterium bovis subsp bovis AF2122/97
gcgcagaaagucgcgcgcgaac

SEQ ID NO: 3197781 - RNA, 16 nt, Mycobacterium bovis subsp bovis AF2122/97
gcgcagaacaccaccg

SEQ ID NO: 3197782 - RNA, 14 nt, Mycobacterium bovis subsp bovis AF2122/97
gcgcagaacgaucg

SEQ ID NO: 3197783 - RNA, 16 nt, Mycobacterium bovis subsp bovis AF2122/97
gcgcagaacgaucgcg

SEQ ID NO: 3197784 - RNA, 23 nt, Mycobacterium bovis subsp bovis AF2122/97
gcgcagaacgaucgcgcuggcgc

SEQ ID NO: 3197785 - RNA, 15 nt, Mycobacterium bovis subsp bovis AF2122/97
gcgcagacacgaccc

SEQ ID NO: 3197786 - RNA, 16 nt, Mycobacterium bovis subsp bovis AF2122/97
gcgcagacucgccacc

SEQ ID NO: 3197787 - RNA, 17 nt, Mycobacterium bovis subsp bovis AF2122/97
gcgcagacucgccaccg

SEQ ID NO: 3197788 - RNA, 18 nt, Mycobacterium bovis subsp bovis AF2122/97
gcgcagacucgccaccgc

SEQ ID NO: 3197789 - RNA, 22 nt, Mycobacterium bovis subsp bovis AF2122/97
gcgcagacucgccaccgcggcg

SEQ ID NO: 3197790 - RNA, 23 nt, Mycobacterium bovis subsp bovis AF2122/97
gcgcagacucgccaccgcggcga

SEQ ID NO: 3197791 - RNA, 20 nt, Mycobacterium bovis subsp bovis AF2122/97
gcgcagagcguuccgcucga

SEQ ID NO: 3197792 - RNA, 18 nt, Mycobacterium bovis subsp bovis AF2122/97
gcgcagauauuccucguc

SEQ ID NO: 3197793 - RNA, 21 nt, Mycobacterium bovis subsp bovis AF2122/97
gcgcagauauuccucgucggu

SEQ ID NO: 3197794 - RNA, 21 nt, Mycobacterium bovis subsp bovis AF2122/97
gcgcagaucgaaaucagcccg

SEQ ID NO: 3197795 - RNA, 17 nt, Mycobacterium bovis subsp bovis AF2122/97
gcgcagaucguccaccg

SEQ ID NO: 3197796 - RNA, 19 nt, Mycobacterium bovis subsp bovis AF2122/97
gcgcagaucguccaccgcc

SEQ ID NO: 3197797 - RNA, 14 nt, Mycobacterium bovis subsp bovis AF2122/97
gcgcagaugagcgc

SEQ ID NO: 3197798 - RNA, 18 nt, Mycobacterium bovis subsp bovis AF2122/97
gcgcagaugagcgcggcg

SEQ ID NO: 3197799 - RNA, 19 nt, Mycobacterium bovis subsp bovis AF2122/97
gcgcagaugagcgcggcga

SEQ ID NO: 3197800 - RNA, 20 nt, Mycobacterium bovis subsp bovis AF2122/97
gcgcagaugagcgcggcgac

SEQ ID NO: 3197801 - RNA, 23 nt, Mycobacterium bovis subsp bovis AF2122/97
gcgcagauuccucuucaggcccu

SEQ ID NO: 3197802 - RNA, 19 nt, Mycobacterium bovis subsp bovis AF2122/97
gcgcagcacauccugcagc

SEQ ID NO: 3197803 - RNA, 23 nt, Mycobacterium bovis subsp bovis AF2122/97
gcgcagcacauccugcagcucgg

SEQ ID NO: 3197804 - RNA, 16 nt, Mycobacterium bovis subsp bovis AF2122/97
gcgcagcaccggcucg

SEQ ID NO: 3197805 - RNA, 16 nt, Mycobacterium bovis subsp bovis AF2122/97
gcgcagcacggcggcc

SEQ ID NO: 3197806 - RNA, 14 nt, Mycobacterium bovis subsp bovis AF2122/97
gcgcagcacugcgg

SEQ ID NO: 3197807 - RNA, 18 nt, Mycobacterium bovis subsp bovis AF2122/97
gcgcagcacugcggcagc

SEQ ID NO: 3197808 - RNA, 14 nt, Mycobacterium bovis subsp bovis AF2122/97
gcgcagcagcggca

SEQ ID NO: 3197809 - RNA, 15 nt, Mycobacterium bovis subsp bovis AF2122/97
gcgcagcagugccgu

SEQ ID NO: 3197810 - RNA, 22 nt, Mycobacterium bovis subsp bovis AF2122/97
gcgcagcaguuggucgcggucc

SEQ ID NO: 3197811 - RNA, 20 nt, Mycobacterium bovis subsp bovis AF2122/97
gcgcagcauaaagaggucgg

SEQ ID NO: 3197812 - RNA, 14 nt, Mycobacterium bovis subsp bovis AF2122/97
gcgcagcaucggcg

SEQ ID NO: 3197813 - RNA, 18 nt, Mycobacterium bovis subsp bovis AF2122/97
gcgcagcaucuccgccgg

SEQ ID NO: 3197814 - RNA, 21 nt, Mycobacterium bovis subsp bovis AF2122/97
gcgcagcaucuccgccggucc

SEQ ID NO: 3197815 - RNA, 12 nt, Mycobacterium bovis subsp bovis AF2122/97
gcccagccgcgg

SEQ ID NO: 3197816 - RNA, 21 nt, Mycobacterium bovis subsp bovis AF2122/97
gcccagccggaccgcgacggc

SEQ ID NO: 3197817 - RNA, 22 nt, Mycobacterium bovis subsp bovis AF2122/97
gcccagccggaccgcgacggcg

SEQ ID NO: 3197818 - RNA, 22 nt, Mycobacterium bovis subsp bovis AF2122/97
gcccagccgggagucgucggca

SEQ ID NO: 3197819 - RNA, 19 nt, Mycobacterium bovis subsp bovis AF2122/97
gcccagccggguggacacc

SEQ ID NO: 3197820 - RNA, 19 nt, Mycobacterium bovis subsp bovis AF2122/97
gcccagccguucccgguga

SEQ ID NO: 3197821 - RNA, 16 nt, Mycobacterium bovis subsp bovis AF2122/97
gcccagccguucgucg

SEQ ID NO: 3197822 - RNA, 20 nt, Mycobacterium bovis subsp bovis AF2122/97
gcccagccguucgucgcggg

SEQ ID NO: 3197823 - RNA, 22 nt, Mycobacterium bovis subsp bovis AF2122/97
gcccagccguucgucgcgggug

SEQ ID NO: 3197824 - RNA, 15 nt, Mycobacterium bovis subsp bovis AF2122/97
gcccagcgacaacac

SEQ ID NO: 3197825 - RNA, 17 nt, Mycobacterium bovis subsp bovis AF2122/97
gcccagcgacaacacca

SEQ ID NO: 3197826 - RNA, 18 nt, Mycobacterium bovis subsp bovis AF2122/97
gcccagcgaccaguggug

SEQ ID NO: 3197827 - RNA, 15 nt, Mycobacterium bovis subsp bovis AF2122/97
gcccagcgacccggc

SEQ ID NO: 3197828 - RNA, 19 nt, Mycobacterium bovis subsp bovis AF2122/97
gcccagcgacccggccagc

SEQ ID NO: 3197829 - RNA, 20 nt, Mycobacterium bovis subsp bovis AF2122/97
gcccagcgacccggccagcg

SEQ ID NO: 3197830 - RNA, 19 nt, Mycobacterium bovis subsp bovis AF2122/97
gcccagcgaccgcugcaga

SEQ ID NO: 3197831 - RNA, 17 nt, Mycobacterium bovis subsp bovis AF2122/97
gcccagcgaggugggcg

SEQ ID NO: 3197832 - RNA, 16 nt, Mycobacterium bovis subsp bovis AF2122/97
gcccagcgcacggacc

SEQ ID NO: 3197833 - RNA, 19 nt, Mycobacterium bovis subsp bovis AF2122/97
gcccagcgcccccagcagc

SEQ ID NO: 3197834 - RNA, 20 nt, Mycobacterium bovis subsp bovis AF2122/97
gcccagcgcccgcgcggcca

SEQ ID NO: 3197835 - RNA, 22 nt, Mycobacterium bovis subsp bovis AF2122/97
gcccagcgcccgcgcggccacu

SEQ ID NO: 3197836 - RNA, 16 nt, Mycobacterium bovis subsp bovis AF2122/97
gcccagcgccuccagc

SEQ ID NO: 3197837 - RNA, 18 nt, Mycobacterium bovis subsp bovis AF2122/97
gcccagcgccuccagcac

SEQ ID NO: 3197838 - RNA, 12 nt, Mycobacterium bovis subsp bovis AF2122/97
gcccagcggccg

SEQ ID NO: 3197839 - RNA, 20 nt, Mycobacterium bovis subsp bovis AF2122/97
gcccagcggccgcgauggug

SEQ ID NO: 3197840 - RNA, 16 nt, Mycobacterium bovis subsp bovis AF2122/97
gcccagcguggcuggc

SEQ ID NO: 3197841 - RNA, 23 nt, Mycobacterium bovis subsp bovis AF2122/97
gcccagcguggcuggcaccuccc

SEQ ID NO: 3197842 - RNA, 20 nt, Mycobacterium bovis subsp bovis AF2122/97
gcccagcgugucuugucgcg

SEQ ID NO: 3197843 - RNA, 23 nt, Mycobacterium bovis subsp bovis AF2122/97
gcccagcguugucggguggcugc

SEQ ID NO: 3197844 - RNA, 16 nt, Mycobacterium bovis subsp bovis AF2122/97
gcccagcucgauaccc

SEQ ID NO: 3197845 - RNA, 17 nt, Mycobacterium bovis subsp bovis AF2122/97
gcccagcugcgccgaac

SEQ ID NO: 3197846 - RNA, 22 nt, Mycobacterium bovis subsp bovis AF2122/97
gcccagcugucauccccggcca

SEQ ID NO: 3197847 - RNA, 15 nt, Mycobacterium bovis subsp bovis AF2122/97
gcccaggacagcagc

SEQ ID NO: 3197848 - RNA, 16 nt, Mycobacterium bovis subsp bovis AF2122/97
gcccaggacagcagcc

SEQ ID NO: 3197849 - RNA, 14 nt, Mycobacterium bovis subsp bovis AF2122/97
gcccgacgagauug

SEQ ID NO: 3197850 - RNA, 21 nt, Mycobacterium bovis subsp bovis AF2122/97
gcccgacgagauugccgggcc

SEQ ID NO: 3197851 - RNA, 22 nt, Mycobacterium bovis subsp bovis AF2122/97
gcccgacgagauugccgggccg

SEQ ID NO: 3197852 - RNA, 24 nt, Mycobacterium bovis subsp bovis AF2122/97
gcccgacgagucgccgcgggcagc

SEQ ID NO: 3197853 - RNA, 17 nt, Mycobacterium bovis subsp bovis AF2122/97
gcccgacgaugcgggcg

SEQ ID NO: 3197854 - RNA, 17 nt, Mycobacterium bovis subsp bovis AF2122/97
gcccgacgccagcugcc

SEQ ID NO: 3197855 - RNA, 11 nt, Mycobacterium bovis subsp bovis AF2122/97
gcccgacgccg

SEQ ID NO: 3197856 - RNA, 16 nt, Mycobacterium bovis subsp bovis AF2122/97
gcccgacgccggucac

SEQ ID NO: 3197857 - RNA, 20 nt, Mycobacterium bovis subsp bovis AF2122/97
gcccgacgcguggcauccag

SEQ ID NO: 3197858 - RNA, 20 nt, Mycobacterium bovis subsp bovis AF2122/97
gcccgacggaguucgacguc

SEQ ID NO: 3197859 - RNA, 16 nt, Mycobacterium bovis subsp bovis AF2122/97
gcccgacggcgcccag

SEQ ID NO: 3197860 - RNA, 18 nt, Mycobacterium bovis subsp bovis AF2122/97
gcccgacggcgcccagcg

SEQ ID NO: 3197861 - RNA, 19 nt, Mycobacterium bovis subsp bovis AF2122/97
gcccgacggcgcccagcgc

SEQ ID NO: 3197862 - RNA, 22 nt, Mycobacterium bovis subsp bovis AF2122/97
gcccgacgugaagccaagcgac

SEQ ID NO: 3197863 - RNA, 23 nt, Mycobacterium bovis subsp bovis AF2122/97
gcccgacgugaagccaagcgacu

SEQ ID NO: 3197864 - RNA, 17 nt, Mycobacterium bovis subsp bovis AF2122/97
gcccgacguugccgaag

SEQ ID NO: 3197865 - RNA, 22 nt, Mycobacterium bovis subsp bovis AF2122/97
gcccgacguugcguagcagguc

SEQ ID NO: 3197866 - RNA, 15 nt, Mycobacterium bovis subsp bovis AF2122/97
gcccgacucggccgu

SEQ ID NO: 3197867 - RNA, 16 nt, Mycobacterium bovis subsp bovis AF2122/97
gcccgacucggccgug

SEQ ID NO: 3197868 - RNA, 21 nt, Mycobacterium bovis subsp bovis AF2122/97
gcccgacucggccgugaccga

SEQ ID NO: 3197869 - RNA, 19 nt, Mycobacterium bovis subsp bovis AF2122/97
gcccgacugaacgucaccg

SEQ ID NO: 3197870 - RNA, 21 nt, Mycobacterium bovis subsp bovis AF2122/97
gcccgacugccguucagcggc

SEQ ID NO: 3197871 - RNA, 22 nt, Mycobacterium bovis subsp bovis AF2122/97
gcccgacugccguucagcggcg

SEQ ID NO: 3197872 - RNA, 21 nt, Mycobacterium bovis subsp bovis AF2122/97
gcccgacuggucacugcccug

SEQ ID NO: 3197873 - RNA, 21 nt, Mycobacterium bovis subsp bovis AF2122/97
gcccgacuguagaaaacccgu

SEQ ID NO: 3197874 - RNA, 16 nt, Mycobacterium bovis subsp bovis AF2122/97
gcccgacuugacggcg

SEQ ID NO: 3197875 - RNA, 14 nt, Mycobacterium bovis subsp bovis AF2122/97
gcccgagacggugu

SEQ ID NO: 3197876 - RNA, 17 nt, Mycobacterium bovis subsp bovis AF2122/97
gcccgagacgguguugc

SEQ ID NO: 3197877 - RNA, 19 nt, Mycobacterium bovis subsp bovis AF2122/97
gcccgagacgguguugccu

SEQ ID NO: 3197878 - RNA, 13 nt, Mycobacterium bovis subsp bovis AF2122/97
gcccgagaucgcg

SEQ ID NO: 3197879 - RNA, 17 nt, Mycobacterium bovis subsp bovis AF2122/97
gcccgagcccagccggg

SEQ ID NO: 3197880 - RNA, 14 nt, Mycobacterium bovis subsp bovis AF2122/97
gcccgagcccagcg

SEQ ID NO: 3197881 - RNA, 19 nt, Mycobacterium bovis subsp bovis AF2122/97
gcccgagcccagcgccucc

SEQ ID NO: 3197882 - RNA, 18 nt, Mycobacterium bovis subsp bovis AF2122/97
gcccgagccgcugcgaca

SEQ ID NO: 3197883 - RNA, 15 nt, Mycobacterium bovis subsp bovis AF2122/97
gcccgagccggugcc

SEQ ID NO: 3197884 - RNA, 13 nt, Mycobacterium bovis subsp bovis AF2122/97
gcccgagcgcgcg

SEQ ID NO: 3197885 - RNA, 13 nt, Mycobacterium bovis subsp bovis AF2122/97
gcccgagcggcug

SEQ ID NO: 3197886 - RNA, 17 nt, Mycobacterium bovis subsp bovis AF2122/97
gcccgagcggcugagcc

SEQ ID NO: 3197887 - RNA, 18 nt, Mycobacterium bovis subsp bovis AF2122/97
gcccgagcucgccgcagc

SEQ ID NO: 3197888 - RNA, 24 nt, Mycobacterium bovis subsp bovis AF2122/97
gcccgagcuggccgucagcgucgg

SEQ ID NO: 3197889 - RNA, 13 nt, Mycobacterium bovis subsp bovis AF2122/97
gcccgaggcgaga

SEQ ID NO: 3197890 - RNA, 15 nt, Mycobacterium bovis subsp bovis AF2122/97
gcccgaggcgagacg

SEQ ID NO: 3197891 - RNA, 19 nt, Mycobacterium bovis subsp bovis AF2122/97
gcccgaggcgagacgcucc

SEQ ID NO: 3197892 - RNA, 18 nt, Mycobacterium bovis subsp bovis AF2122/97
gcccgaggugccggggcc

SEQ ID NO: 3197893 - RNA, 17 nt, Mycobacterium bovis subsp bovis AF2122/97
gcccgagucgaaaccgc

SEQ ID NO: 3197894 - RNA, 18 nt, Mycobacterium bovis subsp bovis AF2122/97
gcccgagucgaaaccgcc

SEQ ID NO: 3197895 - RNA, 19 nt, Mycobacterium bovis subsp bovis AF2122/97
gcccgagucucgucgggua

SEQ ID NO: 3197896 - RNA, 21 nt, Mycobacterium bovis subsp bovis AF2122/97
gcccgagugugaaucgcacga

SEQ ID NO: 3197897 - RNA, 12 nt, Mycobacterium bovis subsp bovis AF2122/97
gcccgaguugaa

SEQ ID NO: 3197898 - RNA, 16 nt, Mycobacterium bovis subsp bovis AF2122/97
gcccgaguugaagaag

SEQ ID NO: 3197899 - RNA, 22 nt, Mycobacterium bovis subsp bovis AF2122/97
gcccgaguugaagaagccggug

SEQ ID NO: 3197900 - RNA, 16 nt, Mycobacterium bovis subsp bovis AF2122/97
gcccgaguugaaggug

SEQ ID NO: 3197901 - RNA, 19 nt, Mycobacterium bovis subsp bovis AF2122/97
gcccgaguuggcgaagccc

SEQ ID NO: 3197902 - RNA, 20 nt, Mycobacterium bovis subsp bovis AF2122/97
gcccgaguuguggacgcccg

SEQ ID NO: 3197903 - RNA, 22 nt, Mycobacterium bovis subsp bovis AF2122/97
gcccgaguuguucgugccggcg

SEQ ID NO: 3197904 - RNA, 15 nt, Mycobacterium bovis subsp bovis AF2122/97
gcccgaguuugacca

SEQ ID NO: 3197905 - RNA, 16 nt, Mycobacterium bovis subsp bovis AF2122/97
gcccgaguuugaccag

SEQ ID NO: 3197906 - RNA, 23 nt, Mycobacterium bovis subsp bovis AF2122/97
gcccgauaaaugccgcgugggca

SEQ ID NO: 3197907 - RNA, 14 nt, Mycobacterium bovis subsp bovis AF2122/97
gcccgauacgccac

SEQ ID NO: 3197908 - RNA, 15 nt, Mycobacterium bovis subsp bovis AF2122/97
gcccgaucaccagcc

SEQ ID NO: 3197909 - RNA, 16 nt, Mycobacterium bovis subsp bovis AF2122/97
gcccgaucaccagccc

SEQ ID NO: 3197910 - RNA, 18 nt, Mycobacterium bovis subsp bovis AF2122/97
gcccgaucaccauccagc

SEQ ID NO: 3197911 - RNA, 22 nt, Mycobacterium bovis subsp bovis AF2122/97
gcccgaucaccauccagcccau

SEQ ID NO: 3197912 - RNA, 13 nt, Mycobacterium bovis subsp bovis AF2122/97
gcccgaucccgau

SEQ ID NO: 3197913 - RNA, 16 nt, Mycobacterium bovis subsp bovis AF2122/97
gcccgaucccgaucga

SEQ ID NO: 3197914 - RNA, 20 nt, Mycobacterium bovis subsp bovis AF2122/97
gcccgauccggaucccacca

SEQ ID NO: 3197915 - RNA, 23 nt, Mycobacterium bovis subsp bovis AF2122/97
gcccgauccggaucccaccaccg

SEQ ID NO: 3197916 - RNA, 16 nt, Mycobacterium bovis subsp bovis AF2122/97
gcccgaucgaagaaac

SEQ ID NO: 3197917 - RNA, 22 nt, Mycobacterium bovis subsp bovis AF2122/97
gcccgaucgaagaaacggcguc

SEQ ID NO: 3197918 - RNA, 21 nt, Mycobacterium bovis subsp bovis AF2122/97
gcccgaucgaccgcuggaucg

SEQ ID NO: 3197919 - RNA, 21 nt, Mycobacterium bovis subsp bovis AF2122/97
gcccgaucgauaucggcaauc

SEQ ID NO: 3197920 - RNA, 16 nt, Mycobacterium bovis subsp bovis AF2122/97
gcccgaucgcggcccg

SEQ ID NO: 3197921 - RNA, 14 nt, Mycobacterium bovis subsp bovis AF2122/97
gcccgaucgcuucc

SEQ ID NO: 3197922 - RNA, 23 nt, Mycobacterium bovis subsp bovis AF2122/97
gcccgaucgcuuccucguaggcg

SEQ ID NO: 3197923 - RNA, 21 nt, Mycobacterium bovis subsp bovis AF2122/97
gcccgaucguaggacucggcg

SEQ ID NO: 3197924 - RNA, 23 nt, Mycobacterium bovis subsp bovis AF2122/97
gcccgaucguaggacucggcgga

SEQ ID NO: 3197925 - RNA, 14 nt, Mycobacterium bovis subsp bovis AF2122/97
gcccgaugaucccg

SEQ ID NO: 3197926 - RNA, 15 nt, Mycobacterium bovis subsp bovis AF2122/97
gcccgaugaucccgc

SEQ ID NO: 3197927 - RNA, 20 nt, Mycobacterium bovis subsp bovis AF2122/97
gcccgaugaucccgccaccg

SEQ ID NO: 3197928 - RNA, 22 nt, Mycobacterium bovis subsp bovis AF2122/97
gcccgaugaucccgccaccgaa

SEQ ID NO: 3197929 - RNA, 15 nt, Mycobacterium bovis subsp bovis AF2122/97
gcccgaugcgccacc

SEQ ID NO: 3197930 - RNA, 17 nt, Mycobacterium bovis subsp bovis AF2122/97
gcccgaugcgccaccgg

SEQ ID NO: 3197931 - RNA, 19 nt, Mycobacterium bovis subsp bovis AF2122/97
gcccgaugcgccaccggcg

SEQ ID NO: 3197932 - RNA, 20 nt, Mycobacterium bovis subsp bovis AF2122/97
gcccgaugcgccaccggcgc

SEQ ID NO: 3197933 - RNA, 22 nt, Mycobacterium bovis subsp bovis AF2122/97
gcccgaugguacccgcgccgcg

SEQ ID NO: 3197934 - RNA, 14 nt, Mycobacterium bovis subsp bovis AF2122/97
gcccgauggugccg

SEQ ID NO: 3197935 - RNA, 19 nt, Mycobacterium bovis subsp bovis AF2122/97
gcccgccggcgugucgcgu

SEQ ID NO: 3197936 - RNA, 15 nt, Mycobacterium bovis subsp bovis AF2122/97
gcccgccggguuggu

SEQ ID NO: 3197937 - RNA, 19 nt, Mycobacterium bovis subsp bovis AF2122/97
gcccgccggugaucggcgg

SEQ ID NO: 3197938 - RNA, 20 nt, Mycobacterium bovis subsp bovis AF2122/97
gcccgccggugaucggcggc

SEQ ID NO: 3197939 - RNA, 21 nt, Mycobacterium bovis subsp bovis AF2122/97
gcccgccggugaucggcggca

SEQ ID NO: 3197940 - RNA, 23 nt, Mycobacterium bovis subsp bovis AF2122/97
gcccgccggugaucggcggcaac

SEQ ID NO: 3197941 - RNA, 17 nt, Mycobacterium bovis subsp bovis AF2122/97
gcccgccguagaccagc

SEQ ID NO: 3197942 - RNA, 23 nt, Mycobacterium bovis subsp bovis AF2122/97
gcccgccguagaccagccgucgu

SEQ ID NO: 3197943 - RNA, 13 nt, Mycobacterium bovis subsp bovis AF2122/97
gcccgccguccgg

SEQ ID NO: 3197944 - RNA, 18 nt, Mycobacterium bovis subsp bovis AF2122/97
gcccgccguccggcgccc

SEQ ID NO: 3197945 - RNA, 17 nt, Mycobacterium bovis subsp bovis AF2122/97
gcccgccgucuuggccc

SEQ ID NO: 3197946 - RNA, 17 nt, Mycobacterium bovis subsp bovis AF2122/97
gcccgccguuacggagg

SEQ ID NO: 3197947 - RNA, 22 nt, Mycobacterium bovis subsp bovis AF2122/97
gcccgccguuacggagggcacg

SEQ ID NO: 3197948 - RNA, 22 nt, Mycobacterium bovis subsp bovis AF2122/97
gcccgccuaaucggccugccgg

SEQ ID NO: 3197949 - RNA, 13 nt, Mycobacterium bovis subsp bovis AF2122/97
gcccgccucaucg

SEQ ID NO: 3197950 - RNA, 16 nt, Mycobacterium bovis subsp bovis AF2122/97
gcccgccucaucggca

SEQ ID NO: 3197951 - RNA, 17 nt, Mycobacterium bovis subsp bovis AF2122/97
gcccgccucaucggcaa

SEQ ID NO: 3197952 - RNA, 16 nt, Mycobacterium bovis subsp bovis AF2122/97
gcccgccucgaccgcc

SEQ ID NO: 3197953 - RNA, 20 nt, Mycobacterium bovis subsp bovis AF2122/97
gcccgccucgaccgccagcc

SEQ ID NO: 3197954 - RNA, 15 nt, Mycobacterium bovis subsp bovis AF2122/97
gcccgccucgcagcg

SEQ ID NO: 3197955 - RNA, 15 nt, Mycobacterium bovis subsp bovis AF2122/97
gcccgccucggcggc

SEQ ID NO: 3197956 - RNA, 15 nt, Mycobacterium bovis subsp bovis AF2122/97
gcccgccugaccgcc

SEQ ID NO: 3197957 - RNA, 18 nt, Mycobacterium bovis subsp bovis AF2122/97
gcccgccugaccgccacc

SEQ ID NO: 3197958 - RNA, 19 nt, Mycobacterium bovis subsp bovis AF2122/97
gcccgccugaccgccaccg

SEQ ID NO: 3197959 - RNA, 13 nt, Mycobacterium bovis subsp bovis AF2122/97
gcccgcgaucggg

SEQ ID NO: 3197960 - RNA, 17 nt, Mycobacterium bovis subsp bovis AF2122/97
gcccgcgaucgggccga

SEQ ID NO: 3197961 - RNA, 20 nt, Mycobacterium bovis subsp bovis AF2122/97
gcccgcgaucucggagcgca

SEQ ID NO: 3197962 - RNA, 15 nt, Mycobacterium bovis subsp bovis AF2122/97
gcccgcgcagcacug

SEQ ID NO: 3197963 - RNA, 19 nt, Mycobacterium bovis subsp bovis AF2122/97
gcccgcgcagcacugcggc

SEQ ID NO: 3197964 - RNA, 22 nt, Mycobacterium bovis subsp bovis AF2122/97
gcccgcgcagcacugcggcagc

SEQ ID NO: 3197965 - RNA, 21 nt, Mycobacterium bovis subsp bovis AF2122/97
gcccgcgcagcgguccgccgc

SEQ ID NO: 3197966 - RNA, 22 nt, Mycobacterium bovis subsp bovis AF2122/97
gcccgcgcagcgguccgccgcc

SEQ ID NO: 3197967 - RNA, 23 nt, Mycobacterium bovis subsp bovis AF2122/97
gcccgcgcagcgguccgccgccu

SEQ ID NO: 3197968 - RNA, 16 nt, Mycobacterium bovis subsp bovis AF2122/97
gcccgcgccaccagca

SEQ ID NO: 3197969 - RNA, 23 nt, Mycobacterium bovis subsp bovis AF2122/97
gcccgcgccaccagcaccgccgc

SEQ ID NO: 3197970 - RNA, 14 nt, Mycobacterium bovis subsp bovis AF2122/97
gcccgcgccaccga

SEQ ID NO: 3197971 - RNA, 16 nt, Mycobacterium bovis subsp bovis AF2122/97
gcccgcgccaccgaua

SEQ ID NO: 3197972 - RNA, 14 nt, Mycobacterium bovis subsp bovis AF2122/97
gcccgcgccaccgg

SEQ ID NO: 3197973 - RNA, 22 nt, Mycobacterium bovis subsp bovis AF2122/97
gcccgcgccgccgcuacccccg

SEQ ID NO: 3197974 - RNA, 23 nt, Mycobacterium bovis subsp bovis AF2122/97
gcccgcgccgccgcuacccccga

SEQ ID NO: 3197975 - RNA, 14 nt, Mycobacterium bovis subsp bovis AF2122/97
gcccgcgccgccgg

SEQ ID NO: 3197976 - RNA, 23 nt, Mycobacterium bovis subsp bovis AF2122/97
gcccgcgcggccaaucagcccgc

SEQ ID NO: 3197977 - RNA, 12 nt, Mycobacterium bovis subsp bovis AF2122/97
gcccgcgcggcg

SEQ ID NO: 3197978 - RNA, 14 nt, Mycobacterium bovis subsp bovis AF2122/97
gcccgcgcggcgca

SEQ ID NO: 3197979 - RNA, 13 nt, Mycobacterium bovis subsp bovis AF2122/97
gcccgcgcggcgg

SEQ ID NO: 3197980 - RNA, 14 nt, Mycobacterium bovis subsp bovis AF2122/97
gcccgcgcggcggu

SEQ ID NO: 3197981 - RNA, 12 nt, Mycobacterium bovis subsp bovis AF2122/97
gcccgcgcggug

SEQ ID NO: 3197982 - RNA, 19 nt, Mycobacterium bovis subsp bovis AF2122/97
gcccgcgcgguggcggucg

SEQ ID NO: 3197983 - RNA, 22 nt, Mycobacterium bovis subsp bovis AF2122/97
gcccgcgcgguggcggucgcca

SEQ ID NO: 3197984 - RNA, 17 nt, Mycobacterium bovis subsp bovis AF2122/97
gcccgcgcuagcgguug

SEQ ID NO: 3197985 - RNA, 15 nt, Mycobacterium bovis subsp bovis AF2122/97
gcccgcgcugccgac

SEQ ID NO: 3197986 - RNA, 20 nt, Mycobacterium bovis subsp bovis AF2122/97
gcccgcgcugccgacuccuc

SEQ ID NO: 3197987 - RNA, 15 nt, Mycobacterium bovis subsp bovis AF2122/97
gcccgcggacgugcc

SEQ ID NO: 3197988 - RNA, 18 nt, Mycobacterium bovis subsp bovis AF2122/97
gcccgcggacgugccggu

SEQ ID NO: 3197989 - RNA, 15 nt, Mycobacterium bovis subsp bovis AF2122/97
gcccgcggccgccag

SEQ ID NO: 3197990 - RNA, 19 nt, Mycobacterium bovis subsp bovis AF2122/97
gcccgcggccguggugguc

SEQ ID NO: 3197991 - RNA, 12 nt, Mycobacterium bovis subsp bovis AF2122/97
gcccgcggcgga

SEQ ID NO: 3197992 - RNA, 15 nt, Mycobacterium bovis subsp bovis AF2122/97
gcccgcgggaucagc

SEQ ID NO: 3197993 - RNA, 19 nt, Mycobacterium bovis subsp bovis AF2122/97
gcccgcgggcaguggcagc

SEQ ID NO: 3197994 - RNA, 22 nt, Mycobacterium bovis subsp bovis AF2122/97
gcccgcgggcaguggcagcccg

SEQ ID NO: 3197995 - RNA, 21 nt, Mycobacterium bovis subsp bovis AF2122/97
gcccgcgggcgguaaucgcga

SEQ ID NO: 3197996 - RNA, 15 nt, Mycobacterium bovis subsp bovis AF2122/97
gcccgcgguccggcg

SEQ ID NO: 3197997 - RNA, 16 nt, Mycobacterium bovis subsp bovis AF2122/97
gcccgcgguccggcga

SEQ ID NO: 3197998 - RNA, 18 nt, Mycobacterium bovis subsp bovis AF2122/97
gcccgcgguccggcgaaa

SEQ ID NO: 3197999 - RNA, 16 nt, Mycobacterium bovis subsp bovis AF2122/97
gcccgcggucgcgacu

SEQ ID NO: 3198000 - RNA, 20 nt, Mycobacterium bovis subsp bovis AF2122/97
gcccgcggucgcgacuacca

SEQ ID NO: 3198001 - RNA, 13 nt, Mycobacterium bovis subsp bovis AF2122/97
gcccgcggugacc

SEQ ID NO: 3198002 - RNA, 17 nt, Mycobacterium bovis subsp bovis AF2122/97
gcccgcggugaccaccc

SEQ ID NO: 3198003 - RNA, 20 nt, Mycobacterium bovis subsp bovis AF2122/97
gcccgcggugaccaccccgg

SEQ ID NO: 3198004 - RNA, 20 nt, Mycobacterium bovis subsp bovis AF2122/97
gcccgcgugacgcuuggcca

SEQ ID NO: 3198005 - RNA, 20 nt, Mycobacterium bovis subsp bovis AF2122/97
gcccgcgugcgcaucccgaa

SEQ ID NO: 3198006 - RNA, 20 nt, Mycobacterium bovis subsp bovis AF2122/97
gcccgcguucagggcacgcu

SEQ ID NO: 3198007 - RNA, 13 nt, Mycobacterium bovis subsp bovis AF2122/97
gcccgcguucucg

SEQ ID NO: 3198008 - RNA, 19 nt, Mycobacterium bovis subsp bovis AF2122/97
gcccgcguucucggcaccc

SEQ ID NO: 3198009 - RNA, 21 nt, Mycobacterium bovis subsp bovis AF2122/97
gcccgcguuugcgaagcccac

SEQ ID NO: 3198010 - RNA, 18 nt, Mycobacterium bovis subsp bovis AF2122/97
gcccgcuacggcagcccg

SEQ ID NO: 3198011 - RNA, 16 nt, Mycobacterium bovis subsp bovis AF2122/97
gcccgcuaggcgaagc

SEQ ID NO: 3198012 - RNA, 15 nt, Mycobacterium bovis subsp bovis AF2122/97
gcccgcucagccguc

SEQ ID NO: 3198013 - RNA, 22 nt, Mycobacterium bovis subsp bovis AF2122/97
gcccgcuccaacacccgccggu

SEQ ID NO: 3198014 - RNA, 14 nt, Mycobacterium bovis subsp bovis AF2122/97
gcccgcuccuccgg

SEQ ID NO: 3198015 - RNA, 21 nt, Mycobacterium bovis subsp bovis AF2122/97
gcccgcucgaaagcgucgauc

SEQ ID NO: 3198016 - RNA, 15 nt, Mycobacterium bovis subsp bovis AF2122/97
gcccgcucgaucggc

SEQ ID NO: 3198017 - RNA, 17 nt, Mycobacterium bovis subsp bovis AF2122/97
gcccgcucgaucggcag

SEQ ID NO: 3198018 - RNA, 18 nt, Mycobacterium bovis subsp bovis AF2122/97
gcccgcucgaucggcagc

SEQ ID NO: 3198019 - RNA, 20 nt, Mycobacterium bovis subsp bovis AF2122/97
gcccgcucgaucggcagcca

SEQ ID NO: 3198020 - RNA, 13 nt, Mycobacterium bovis subsp bovis AF2122/97
gcccgcucgaugu

SEQ ID NO: 3198021 - RNA, 13 nt, Mycobacterium bovis subsp bovis AF2122/97
gcccggcgcaagc

SEQ ID NO: 3198022 - RNA, 14 nt, Mycobacterium bovis subsp bovis AF2122/97
gcccggcgcaagcg

SEQ ID NO: 3198023 - RNA, 22 nt, Mycobacterium bovis subsp bovis AF2122/97
gcccggcgcaagcgccgcgcuu

SEQ ID NO: 3198024 - RNA, 16 nt, Mycobacterium bovis subsp bovis AF2122/97
gcccggcgcaccaucg

SEQ ID NO: 3198025 - RNA, 22 nt, Mycobacterium bovis subsp bovis AF2122/97
gcccggcgcaccaucgcggccg

SEQ ID NO: 3198026 - RNA, 20 nt, Mycobacterium bovis subsp bovis AF2122/97
gcccggcgcgauccccgcgc

SEQ ID NO: 3198027 - RNA, 15 nt, Mycobacterium bovis subsp bovis AF2122/97
gcccggcgcggccgc

SEQ ID NO: 3198028 - RNA, 19 nt, Mycobacterium bovis subsp bovis AF2122/97
gcccggcggaucccgaggc

SEQ ID NO: 3198029 - RNA, 11 nt, Mycobacterium bovis subsp bovis AF2122/97
gcccggcggca

SEQ ID NO: 3198030 - RNA, 13 nt, Mycobacterium bovis subsp bovis AF2122/97
gcccggcggcccg

SEQ ID NO: 3198031 - RNA, 13 nt, Mycobacterium bovis subsp bovis AF2122/97
gcccggcggccgc

SEQ ID NO: 3198032 - RNA, 14 nt, Mycobacterium bovis subsp bovis AF2122/97
gcccggcggccgcu

SEQ ID NO: 3198033 - RNA, 17 nt, Mycobacterium bovis subsp bovis AF2122/97
gcccggcggccgcuucg

SEQ ID NO: 3198034 - RNA, 19 nt, Mycobacterium bovis subsp bovis AF2122/97
gcccggcggccgcuucggc

SEQ ID NO: 3198035 - RNA, 11 nt, Mycobacterium bovis subsp bovis AF2122/97
gcccggcggcg

SEQ ID NO: 3198036 - RNA, 12 nt, Mycobacterium bovis subsp bovis AF2122/97
gcccggcggcgg

SEQ ID NO: 3198037 - RNA, 13 nt, Mycobacterium bovis subsp bovis AF2122/97
gcccggcgugcag

SEQ ID NO: 3198038 - RNA, 22 nt, Mycobacterium bovis subsp bovis AF2122/97
gcccggcguggcuucacccaac

SEQ ID NO: 3198039 - RNA, 16 nt, Mycobacterium bovis subsp bovis AF2122/97
gcccggcguggugagc

SEQ ID NO: 3198040 - RNA, 19 nt, Mycobacterium bovis subsp bovis AF2122/97
gcccggcgugucgccgcca

SEQ ID NO: 3198041 - RNA, 20 nt, Mycobacterium bovis subsp bovis AF2122/97
gcccggcgugucgccgccac

SEQ ID NO: 3198042 - RNA, 22 nt, Mycobacterium bovis subsp bovis AF2122/97
gcccggcgugucgccgccacca

SEQ ID NO: 3198043 - RNA, 18 nt, Mycobacterium bovis subsp bovis AF2122/97
gcccggcguuguugacca

SEQ ID NO: 3198044 - RNA, 16 nt, Mycobacterium bovis subsp bovis AF2122/97
gcccggcuacgacggc

SEQ ID NO: 3198045 - RNA, 19 nt, Mycobacterium bovis subsp bovis AF2122/97
gcccggcuacgacggcgcc

SEQ ID NO: 3198046 - RNA, 20 nt, Mycobacterium bovis subsp bovis AF2122/97
gcccggcuacgacggcgcca

SEQ ID NO: 3198047 - RNA, 19 nt, Mycobacterium bovis subsp bovis AF2122/97
gcccggcuaggagaucagc

SEQ ID NO: 3198048 - RNA, 15 nt, Mycobacterium bovis subsp bovis AF2122/97
gcccggcucacagca

SEQ ID NO: 3198049 - RNA, 18 nt, Mycobacterium bovis subsp bovis AF2122/97
gcccggcucacagcacag

SEQ ID NO: 3198050 - RNA, 18 nt, Mycobacterium bovis subsp bovis AF2122/97
gcccggcuccuccccggc

SEQ ID NO: 3198051 - RNA, 15 nt, Mycobacterium bovis subsp bovis AF2122/97
gcccggcucggcagg

SEQ ID NO: 3198052 - RNA, 14 nt, Mycobacterium bovis subsp bovis AF2122/97
gcccggcucggugc

SEQ ID NO: 3198053 - RNA, 19 nt, Mycobacterium bovis subsp bovis AF2122/97
gcccggcuuuugcgcccag

SEQ ID NO: 3198054 - RNA, 22 nt, Mycobacterium bovis subsp bovis AF2122/97
gcccggcuuuugcgcccagcac

SEQ ID NO: 3198055 - RNA, 21 nt, Mycobacterium bovis subsp bovis AF2122/97
gcccggcuuuugucacaggcg

SEQ ID NO: 3198056 - RNA, 22 nt, Mycobacterium bovis subsp bovis AF2122/97
gcccgggaaauagauucccggc

SEQ ID NO: 3198057 - RNA, 21 nt, Mycobacterium bovis subsp bovis AF2122/97
gcccgggacaaguucgguagc

SEQ ID NO: 3198058 - RNA, 16 nt, Mycobacterium bovis subsp bovis AF2122/97
gcccgggaucggggca

SEQ ID NO: 3198059 - RNA, 18 nt, Mycobacterium bovis subsp bovis AF2122/97
gcccgggaucggggcacc

SEQ ID NO: 3198060 - RNA, 19 nt, Mycobacterium bovis subsp bovis AF2122/97
gcccgggaucggggcaccg

SEQ ID NO: 3198061 - RNA, 22 nt, Mycobacterium bovis subsp bovis AF2122/97
gcccgggaucuagaugcggaac

SEQ ID NO: 3198062 - RNA, 12 nt, Mycobacterium bovis subsp bovis AF2122/97
gcccgggcaccg

SEQ ID NO: 3198063 - RNA, 14 nt, Mycobacterium bovis subsp bovis AF2122/97
gcccgggcaccggc

SEQ ID NO: 3198064 - RNA, 17 nt, Mycobacterium bovis subsp bovis AF2122/97
gcccgggcaccggccgg

SEQ ID NO: 3198065 - RNA, 13 nt, Mycobacterium bovis subsp bovis AF2122/97
gcccgggcagcac

SEQ ID NO: 3198066 - RNA, 14 nt, Mycobacterium bovis subsp bovis AF2122/97
gcccgggcagcccc

SEQ ID NO: 3198067 - RNA, 23 nt, Mycobacterium bovis subsp bovis AF2122/97
gcccgggcagccccuccgcgccg

SEQ ID NO: 3198068 - RNA, 22 nt, Mycobacterium bovis subsp bovis AF2122/97
gcccgggcauccuucaccagcu

SEQ ID NO: 3198069 - RNA, 19 nt, Mycobacterium bovis subsp bovis AF2122/97
gcccgggccaccggaaucc

SEQ ID NO: 3198070 - RNA, 16 nt, Mycobacterium bovis subsp bovis AF2122/97
gcccgggccguacggc

SEQ ID NO: 3198071 - RNA, 22 nt, Mycobacterium bovis subsp bovis AF2122/97
gcccgggccugaaccacgcguu

SEQ ID NO: 3198072 - RNA, 20 nt, Mycobacterium bovis subsp bovis AF2122/97
gcccgggcggaacgccggca

SEQ ID NO: 3198073 - RNA, 13 nt, Mycobacterium bovis subsp bovis AF2122/97
gcccgggcggcca

SEQ ID NO: 3198074 - RNA, 17 nt, Mycobacterium bovis subsp bovis AF2122/97
gcccgggcggccagcug

SEQ ID NO: 3198075 - RNA, 18 nt, Mycobacterium bovis subsp bovis AF2122/97
gcccgggcggccagcugc

SEQ ID NO: 3198076 - RNA, 14 nt, Mycobacterium bovis subsp bovis AF2122/97
gcccgggcgggagu

SEQ ID NO: 3198077 - RNA, 14 nt, Mycobacterium bovis subsp bovis AF2122/97
gcccgggcggucga

SEQ ID NO: 3198078 - RNA, 16 nt, Mycobacterium bovis subsp bovis AF2122/97
gcccgggcgucaagcc

SEQ ID NO: 3198079 - RNA, 15 nt, Mycobacterium bovis subsp bovis AF2122/97
gcccgggcgugggca

SEQ ID NO: 3198080 - RNA, 20 nt, Mycobacterium bovis subsp bovis AF2122/97
gcccgggcgugggcaccccg

SEQ ID NO: 3198081 - RNA, 19 nt, Mycobacterium bovis subsp bovis AF2122/97
gcccggggagacgagcaca

SEQ ID NO: 3198082 - RNA, 18 nt, Mycobacterium bovis subsp bovis AF2122/97
gcccggggcgcacagcug

SEQ ID NO: 3198083 - RNA, 17 nt, Mycobacterium bovis subsp bovis AF2122/97
gcccgggguccaucggg

SEQ ID NO: 3198084 - RNA, 21 nt, Mycobacterium bovis subsp bovis AF2122/97
gcccgggguccaucggggccg

SEQ ID NO: 3198085 - RNA, 15 nt, Mycobacterium bovis subsp bovis AF2122/97
gcccggguaucgcca

SEQ ID NO: 3198086 - RNA, 23 nt, Mycobacterium bovis subsp bovis AF2122/97
gcccggguaucgccaguggugca

SEQ ID NO: 3198087 - RNA, 20 nt, Mycobacterium bovis subsp bovis AF2122/97
gcccgggucccggcagcugg

SEQ ID NO: 3198088 - RNA, 15 nt, Mycobacterium bovis subsp bovis AF2122/97
gcccgggucggccgg

SEQ ID NO: 3198089 - RNA, 18 nt, Mycobacterium bovis subsp bovis AF2122/97
gcccgggucggccggguu

SEQ ID NO: 3198090 - RNA, 18 nt, Mycobacterium bovis subsp bovis AF2122/97
gcccgggucuccggcgca

SEQ ID NO: 3198091 - RNA, 21 nt, Mycobacterium bovis subsp bovis AF2122/97
gcccgggugaaacgauggcga

SEQ ID NO: 3198092 - RNA, 16 nt, Mycobacterium bovis subsp bovis AF2122/97
gcccgggugacgggaa

SEQ ID NO: 3198093 - RNA, 15 nt, Mycobacterium bovis subsp bovis AF2122/97
gcccggguugaccgc

SEQ ID NO: 3198094 - RNA, 16 nt, Mycobacterium bovis subsp bovis AF2122/97
gcccgguacgccgcgc

SEQ ID NO: 3198095 - RNA, 18 nt, Mycobacterium bovis subsp bovis AF2122/97
gcccgguacgccgcgccg

SEQ ID NO: 3198096 - RNA, 19 nt, Mycobacterium bovis subsp bovis AF2122/97
gcccgguacgccgcgccga

SEQ ID NO: 3198097 - RNA, 17 nt, Mycobacterium bovis subsp bovis AF2122/97
gcccgguaguacuagca

SEQ ID NO: 3198098 - RNA, 20 nt, Mycobacterium bovis subsp bovis AF2122/97
gcccgguaucgucccggcga

SEQ ID NO: 3198099 - RNA, 21 nt, Mycobacterium bovis subsp bovis AF2122/97
gcccgguaucgucccggcgac

SEQ ID NO: 3198100 - RNA, 23 nt, Mycobacterium bovis subsp bovis AF2122/97
gcccgguaucgucccggcgaccg

SEQ ID NO: 3198101 - RNA, 21 nt, Mycobacterium bovis subsp bovis AF2122/97
gcccggucauggucagcagaa

SEQ ID NO: 3198102 - RNA, 22 nt, Mycobacterium bovis subsp bovis AF2122/97
gcccggucccuuuguggggccg

SEQ ID NO: 3198103 - RNA, 21 nt, Mycobacterium bovis subsp bovis AF2122/97
gcccgguccgccauuggcgcc

SEQ ID NO: 3198104 - RNA, 15 nt, Mycobacterium bovis subsp bovis AF2122/97
gcccggucgagccag

SEQ ID NO: 3198105 - RNA, 21 nt, Mycobacterium bovis subsp bovis AF2122/97
gcccggucgagccagcggagc

SEQ ID NO: 3198106 - RNA, 15 nt, Mycobacterium bovis subsp bovis AF2122/97
gcccggucgcugauc

SEQ ID NO: 3198107 - RNA, 19 nt, Mycobacterium bovis subsp bovis AF2122/97
gcccguguuaaagaagccu

SEQ ID NO: 3198108 - RNA, 15 nt, Mycobacterium bovis subsp bovis AF2122/97
gcccguguugaagaa

SEQ ID NO: 3198109 - RNA, 22 nt, Mycobacterium bovis subsp bovis AF2122/97
gcccguucauaaagguccaacc

SEQ ID NO: 3198110 - RNA, 17 nt, Mycobacterium bovis subsp bovis AF2122/97
gcccguucaugcggcgg

SEQ ID NO: 3198111 - RNA, 19 nt, Mycobacterium bovis subsp bovis AF2122/97
gcccguucaugcggcggcg

SEQ ID NO: 3198112 - RNA, 15 nt, Mycobacterium bovis subsp bovis AF2122/97
gcccguucgugccgu

SEQ ID NO: 3198113 - RNA, 15 nt, Mycobacterium bovis subsp bovis AF2122/97
gcccguugaccugcg

SEQ ID NO: 3198114 - RNA, 16 nt, Mycobacterium bovis subsp bovis AF2122/97
gcccguugaccugcgc

SEQ ID NO: 3198115 - RNA, 19 nt, Mycobacterium bovis subsp bovis AF2122/97
gcccguugcgaauccccaa

SEQ ID NO: 3198116 - RNA, 20 nt, Mycobacterium bovis subsp bovis AF2122/97
gcccguuggcagcacaggcu

SEQ ID NO: 3198117 - RNA, 20 nt, Mycobacterium bovis subsp bovis AF2122/97
gcccguuggccaagaaugug

SEQ ID NO: 3198118 - RNA, 21 nt, Mycobacterium bovis subsp bovis AF2122/97
gcccguuggccaagaaugugg

SEQ ID NO: 3198119 - RNA, 20 nt, Mycobacterium bovis subsp bovis AF2122/97
gcccguugguagccggugac

SEQ ID NO: 3198120 - RNA, 20 nt, Mycobacterium bovis subsp bovis AF2122/97
gcccguuguccagaacggcg

SEQ ID NO: 3198121 - RNA, 23 nt, Mycobacterium bovis subsp bovis AF2122/97
gcccguuguccagaacggcgauc

SEQ ID NO: 3198122 - RNA, 17 nt, Mycobacterium bovis subsp bovis AF2122/97
gcccguugucgaccgaa

SEQ ID NO: 3198123 - RNA, 15 nt, Mycobacterium bovis subsp bovis AF2122/97
gcccguuugccgguu

SEQ ID NO: 3198124 - RNA, 16 nt, Mycobacterium bovis subsp bovis AF2122/97
gcccguuugccgguuc

SEQ ID NO: 3198125 - RNA, 23 nt, Mycobacterium bovis subsp bovis AF2122/97
gcccguuugccgguucggcgauc

SEQ ID NO: 3198126 - RNA, 16 nt, Mycobacterium bovis subsp bovis AF2122/97
gcccuaaacaccgcga

SEQ ID NO: 3198127 - RNA, 17 nt, Mycobacterium bovis subsp bovis AF2122/97
gcccuaacccugcccua

SEQ ID NO: 3198128 - RNA, 17 nt, Mycobacterium bovis subsp bovis AF2122/97
gcccuacgcagcgcggc

SEQ ID NO: 3198129 - RNA, 13 nt, Mycobacterium bovis subsp bovis AF2122/97
gcccuagcagcaa

SEQ ID NO: 3198130 - RNA, 15 nt, Mycobacterium bovis subsp bovis AF2122/97
gcccuagccggcgcg

SEQ ID NO: 3198131 - RNA, 18 nt, Mycobacterium bovis subsp bovis AF2122/97
gcccuagccggcgcgccc

SEQ ID NO: 3198132 - RNA, 17 nt, Mycobacterium bovis subsp bovis AF2122/97
gcccuagcgagcggcac

SEQ ID NO: 3198133 - RNA, 23 nt, Mycobacterium bovis subsp bovis AF2122/97
gcccuagcgcaugucgauccggc

SEQ ID NO: 3198134 - RNA, 13 nt, Mycobacterium bovis subsp bovis AF2122/97
gcccuagcuggug

SEQ ID NO: 3198135 - RNA, 22 nt, Mycobacterium bovis subsp bovis AF2122/97
gcccuauacgcaacaggccaac

SEQ ID NO: 3198136 - RNA, 15 nt, Mycobacterium bovis subsp bovis AF2122/97
gcccucaacgaucgc

SEQ ID NO: 3198137 - RNA, 21 nt, Mycobacterium bovis subsp bovis AF2122/97
gcccucaacggcggcaacggc

SEQ ID NO: 3198138 - RNA, 15 nt, Mycobacterium bovis subsp bovis AF2122/97
gcccucacaacgauu

SEQ ID NO: 3198139 - RNA, 15 nt, Mycobacterium bovis subsp bovis AF2122/97
gcccucacgccaagu

SEQ ID NO: 3198140 - RNA, 15 nt, Mycobacterium bovis subsp bovis AF2122/97
gcccucagccgcggc

SEQ ID NO: 3198141 - RNA, 20 nt, Mycobacterium bovis subsp bovis AF2122/97
gcccucaguucacguucggc

SEQ ID NO: 3198142 - RNA, 23 nt, Mycobacterium bovis subsp bovis AF2122/97
gcccucaguucacguucggcgac

SEQ ID NO: 3198143 - RNA, 18 nt, Mycobacterium bovis subsp bovis AF2122/97
gcccucauaggccugcag

SEQ ID NO: 3198144 - RNA, 13 nt, Mycobacterium bovis subsp bovis AF2122/97
gcccuccaccggu

SEQ ID NO: 3198145 - RNA, 16 nt, Mycobacterium bovis subsp bovis AF2122/97
gcccuccaccgguguu

SEQ ID NO: 3198146 - RNA, 19 nt, Mycobacterium bovis subsp bovis AF2122/97
gcccuccacugcgagcgcc

SEQ ID NO: 3198147 - RNA, 17 nt, Mycobacterium bovis subsp bovis AF2122/97
gcccuccagggcccugc

SEQ ID NO: 3198148 - RNA, 16 nt, Mycobacterium bovis subsp bovis AF2122/97
gcccucccgggcccgc

SEQ ID NO: 3198149 - RNA, 22 nt, Mycobacterium bovis subsp bovis AF2122/97
gcccucccuggggccguccggc

SEQ ID NO: 3198150 - RNA, 12 nt, Mycobacterium bovis subsp bovis AF2122/97
gcccuccgacgg

SEQ ID NO: 3198151 - RNA, 14 nt, Mycobacterium bovis subsp bovis AF2122/97
gcccuccgagcaca

SEQ ID NO: 3198152 - RNA, 15 nt, Mycobacterium bovis subsp bovis AF2122/97
gcccuccgagcacag

SEQ ID NO: 3198153 - RNA, 13 nt, Mycobacterium bovis subsp bovis AF2122/97
gcccuccggcgca

SEQ ID NO: 3198154 - RNA, 14 nt, Mycobacterium bovis subsp bovis AF2122/97
gcccuccggcgcag

SEQ ID NO: 3198155 - RNA, 21 nt, Mycobacterium bovis subsp bovis AF2122/97
gcccuccggcgcagcgaccgg

SEQ ID NO: 3198156 - RNA, 19 nt, Mycobacterium bovis subsp bovis AF2122/97
gcccuccgggcccaucgcc

SEQ ID NO: 3198157 - RNA, 19 nt, Mycobacterium bovis subsp bovis AF2122/97
gcccuccggguauggcggc

SEQ ID NO: 3198158 - RNA, 21 nt, Mycobacterium bovis subsp bovis AF2122/97
gcccuccggguauggcggcga

SEQ ID NO: 3198159 - RNA, 22 nt, Mycobacterium bovis subsp bovis AF2122/97
gcccuccggguauggcggcgac

SEQ ID NO: 3198160 - RNA, 21 nt, Mycobacterium bovis subsp bovis AF2122/97
gcccuccgugggcagcgcgcc

SEQ ID NO: 3198161 - RNA, 23 nt, Mycobacterium bovis subsp bovis AF2122/97
gcccuccgugggcagcgcgcccg

SEQ ID NO: 3198162 - RNA, 16 nt, Mycobacterium bovis subsp bovis AF2122/97
gcccuccucgaccgcg

SEQ ID NO: 3198163 - RNA, 24 nt, Mycobacterium bovis subsp bovis AF2122/97
gcccuccucgaccgcggccuuggc

SEQ ID NO: 3198164 - RNA, 22 nt, Mycobacterium bovis subsp bovis AF2122/97
gcccuccucgaugaggcgcagc

SEQ ID NO: 3198165 - RNA, 14 nt, Mycobacterium bovis subsp bovis AF2122/97
gcccuccucgguga

SEQ ID NO: 3198166 - RNA, 20 nt, Mycobacterium bovis subsp bovis AF2122/97
gcccuccuggcggguggcga

SEQ ID NO: 3198167 - RNA, 14 nt, Mycobacterium bovis subsp bovis AF2122/97
gcccucgacgccgc

SEQ ID NO: 3198168 - RNA, 16 nt, Mycobacterium bovis subsp bovis AF2122/97
gcccucgacgccgcgc

SEQ ID NO: 3198169 - RNA, 19 nt, Mycobacterium bovis subsp bovis AF2122/97
gcccucgacgccgcgcagc

SEQ ID NO: 3198170 - RNA, 13 nt, Mycobacterium bovis subsp bovis AF2122/97
gcccucgacgcgc

SEQ ID NO: 3198171 - RNA, 14 nt, Mycobacterium bovis subsp bovis AF2122/97
gcccucgacgcgcu

SEQ ID NO: 3198172 - RNA, 16 nt, Mycobacterium bovis subsp bovis AF2122/97
gcccucgacggcgucg

SEQ ID NO: 3198173 - RNA, 21 nt, Mycobacterium bovis subsp bovis AF2122/97
gcccucgacguccaucccggc

SEQ ID NO: 3198174 - RNA, 18 nt, Mycobacterium bovis subsp bovis AF2122/97
gcccucgagcagugccgu

SEQ ID NO: 3198175 - RNA, 14 nt, Mycobacterium bovis subsp bovis AF2122/97
gcccucgaucgcca

SEQ ID NO: 3198176 - RNA, 18 nt, Mycobacterium bovis subsp bovis AF2122/97
gcccucgaucgccacgac

SEQ ID NO: 3198177 - RNA, 14 nt, Mycobacterium bovis subsp bovis AF2122/97
gcccucgaugccgc

SEQ ID NO: 3198178 - RNA, 16 nt, Mycobacterium bovis subsp bovis AF2122/97
gcccucgaugccgcgu

SEQ ID NO: 3198179 - RNA, 21 nt, Mycobacterium bovis subsp bovis AF2122/97
gcccucgcuaauugcggccgc

SEQ ID NO: 3198180 - RNA, 23 nt, Mycobacterium bovis subsp bovis AF2122/97
gcccucgcuaauugcggccgccg

SEQ ID NO: 3198181 - RNA, 18 nt, Mycobacterium bovis subsp bovis AF2122/97
gcccucggccgccugacg

SEQ ID NO: 3198182 - RNA, 14 nt, Mycobacterium bovis subsp bovis AF2122/97
gcccucggcgccga

SEQ ID NO: 3198183 - RNA, 21 nt, Mycobacterium bovis subsp bovis AF2122/97
gcccucgggacugcgcggcuu

SEQ ID NO: 3198184 - RNA, 13 nt, Mycobacterium bovis subsp bovis AF2122/97
gcccucggguguc

SEQ ID NO: 3198185 - RNA, 19 nt, Mycobacterium bovis subsp bovis AF2122/97
gcccucgguagcauccagc

SEQ ID NO: 3198186 - RNA, 17 nt, Mycobacterium bovis subsp bovis AF2122/97
gcccucguaauccacgc

SEQ ID NO: 3198187 - RNA, 22 nt, Mycobacterium bovis subsp bovis AF2122/97
gcccucguaauccacgccgacc

SEQ ID NO: 3198188 - RNA, 18 nt, Mycobacterium bovis subsp bovis AF2122/97
gcccucgucgaucgccgc

SEQ ID NO: 3198189 - RNA, 21 nt, Mycobacterium bovis subsp bovis AF2122/97
gcccucgucgcgggccaccgc

SEQ ID NO: 3198190 - RNA, 15 nt, Mycobacterium bovis subsp bovis AF2122/97
gcccucgucgggauc

SEQ ID NO: 3198191 - RNA, 17 nt, Mycobacterium bovis subsp bovis AF2122/97
gcccucguuaucgaccg

SEQ ID NO: 3198192 - RNA, 18 nt, Mycobacterium bovis subsp bovis AF2122/97
gcccucguuaucgaccgc

SEQ ID NO: 3198193 - RNA, 16 nt, Mycobacterium bovis subsp bovis AF2122/97
gcccuugccgccggcc

SEQ ID NO: 3198194 - RNA, 20 nt, Mycobacterium bovis subsp bovis AF2122/97
gcccuugccgccggccccgc

SEQ ID NO: 3198195 - RNA, 23 nt, Mycobacterium bovis subsp bovis AF2122/97
gcccuugccgccggccccgccgg

SEQ ID NO: 3198196 - RNA, 15 nt, Mycobacterium bovis subsp bovis AF2122/97
gcccuugccgccuug

SEQ ID NO: 3198197 - RNA, 18 nt, Mycobacterium bovis subsp bovis AF2122/97
gcccuugccgccuuggcc

SEQ ID NO: 3198198 - RNA, 18 nt, Mycobacterium bovis subsp bovis AF2122/97
gcccuugccuuguuccag

SEQ ID NO: 3198199 - RNA, 22 nt, Mycobacterium bovis subsp bovis AF2122/97
gcccuugccuuguuccagcgca

SEQ ID NO: 3198200 - RNA, 15 nt, Mycobacterium bovis subsp bovis AF2122/97
gcccuugcggcguga

SEQ ID NO: 3198201 - RNA, 14 nt, Mycobacterium bovis subsp bovis AF2122/97
gcccuuggccagca

SEQ ID NO: 3198202 - RNA, 16 nt, Mycobacterium bovis subsp bovis AF2122/97
gcccuuggccagcagg

SEQ ID NO: 3198203 - RNA, 18 nt, Mycobacterium bovis subsp bovis AF2122/97
gcccuugggacugcggac

SEQ ID NO: 3198204 - RNA, 14 nt, Mycobacterium bovis subsp bovis AF2122/97
gcccuuguagcaca

SEQ ID NO: 3198205 - RNA, 17 nt, Mycobacterium bovis subsp bovis AF2122/97
gcccuuguagcacaccg

SEQ ID NO: 3198206 - RNA, 20 nt, Mycobacterium bovis subsp bovis AF2122/97
gcccuuguggaguacggcga

SEQ ID NO: 3198207 - RNA, 14 nt, Mycobacterium bovis subsp bovis AF2122/97
gcccuuucgacuuc

SEQ ID NO: 3198208 - RNA, 23 nt, Mycobacterium bovis subsp bovis AF2122/97
gcccuuugcuguccccgccgagg

SEQ ID NO: 3198209 - RNA, 16 nt, Mycobacterium bovis subsp bovis AF2122/97
gccgaaaaagaccgac

SEQ ID NO: 3198210 - RNA, 22 nt, Mycobacterium bovis subsp bovis AF2122/97
gccgaaaaagaccgacagcggc

SEQ ID NO: 3198211 - RNA, 16 nt, Mycobacterium bovis subsp bovis AF2122/97
gccgaaaagggcgaca

SEQ ID NO: 3198212 - RNA, 14 nt, Mycobacterium bovis subsp bovis AF2122/97
gccgaaaaucgcag

SEQ ID NO: 3198213 - RNA, 16 nt, Mycobacterium bovis subsp bovis AF2122/97
gccgaaaaucgcagcc

SEQ ID NO: 3198214 - RNA, 14 nt, Mycobacterium bovis subsp bovis AF2122/97
gccgaaaaugccgc

SEQ ID NO: 3198215 - RNA, 18 nt, Mycobacterium bovis subsp bovis AF2122/97
gccgaaaaugccgcccag

SEQ ID NO: 3198216 - RNA, 19 nt, Mycobacterium bovis subsp bovis AF2122/97
gccgaaaaugccgcccagc

SEQ ID NO: 3198217 - RNA, 23 nt, Mycobacterium bovis subsp bovis AF2122/97
gccgaaaaugccgcccagcgacc

SEQ ID NO: 3198218 - RNA, 15 nt, Mycobacterium bovis subsp bovis AF2122/97
gccgaaacagcaccc

SEQ ID NO: 3198219 - RNA, 15 nt, Mycobacterium bovis subsp bovis AF2122/97
gccgaaacauugccc

SEQ ID NO: 3198220 - RNA, 14 nt, Mycobacterium bovis subsp bovis AF2122/97
gccgaaacgccgac

SEQ ID NO: 3198221 - RNA, 19 nt, Mycobacterium bovis subsp bovis AF2122/97
gccgaaacgccgaccgcgc

SEQ ID NO: 3198222 - RNA, 17 nt, Mycobacterium bovis subsp bovis AF2122/97
gccgaaacucaccagca

SEQ ID NO: 3198223 - RNA, 18 nt, Mycobacterium bovis subsp bovis AF2122/97
gccgaaacucaccagcac

SEQ ID NO: 3198224 - RNA, 19 nt, Mycobacterium bovis subsp bovis AF2122/97
gccgaaacuucgcccgggc

SEQ ID NO: 3198225 - RNA, 18 nt, Mycobacterium bovis subsp bovis AF2122/97
gccgaaagagccagcggc

SEQ ID NO: 3198226 - RNA, 21 nt, Mycobacterium bovis subsp bovis AF2122/97
gccgaaagagccagcggcacu

SEQ ID NO: 3198227 - RNA, 19 nt, Mycobacterium bovis subsp bovis AF2122/97
gccgaaagccaggcggcaa

SEQ ID NO: 3198228 - RNA, 22 nt, Mycobacterium bovis subsp bovis AF2122/97
gccgaaagccuugccgucgagc

SEQ ID NO: 3198229 - RNA, 17 nt, Mycobacterium bovis subsp bovis AF2122/97
gccgaaaucggccagcu

SEQ ID NO: 3198230 - RNA, 20 nt, Mycobacterium bovis subsp bovis AF2122/97
gccgaaaucggccagcuucc

SEQ ID NO: 3198231 - RNA, 22 nt, Mycobacterium bovis subsp bovis AF2122/97
gccgaacaauuucugcagccca

SEQ ID NO: 3198232 - RNA, 13 nt, Mycobacterium bovis subsp bovis AF2122/97
gccgaacacaccg

SEQ ID NO: 3198233 - RNA, 18 nt, Mycobacterium bovis subsp bovis AF2122/97
gccgaacacaccgggcgg

SEQ ID NO: 3198234 - RNA, 21 nt, Mycobacterium bovis subsp bovis AF2122/97
gccgaacacaccgggcgggcu

SEQ ID NO: 3198235 - RNA, 19 nt, Mycobacterium bovis subsp bovis AF2122/97
gccgaacaccacaccgagc

SEQ ID NO: 3198236 - RNA, 12 nt, Mycobacterium bovis subsp bovis AF2122/97
gccgaacaccga

SEQ ID NO: 3198237 - RNA, 13 nt, Mycobacterium bovis subsp bovis AF2122/97
gccgaacaccgag

SEQ ID NO: 3198238 - RNA, 14 nt, Mycobacterium bovis subsp bovis AF2122/97
gccgaacaccgccg

SEQ ID NO: 3198239 - RNA, 22 nt, Mycobacterium bovis subsp bovis AF2122/97
gccgaacaccgccgcgucgagc

SEQ ID NO: 3198240 - RNA, 22 nt, Mycobacterium bovis subsp bovis AF2122/97
gccgaacaccggcuccagcaug

SEQ ID NO: 3198241 - RNA, 14 nt, Mycobacterium bovis subsp bovis AF2122/97
gccgaacaccguca

SEQ ID NO: 3198242 - RNA, 20 nt, Mycobacterium bovis subsp bovis AF2122/97
gccgaacaccgucagcgucu

SEQ ID NO: 3198243 - RNA, 22 nt, Mycobacterium bovis subsp bovis AF2122/97
gccgaacaccgucagcgucuga

SEQ ID NO: 3198244 - RNA, 12 nt, Mycobacterium bovis subsp bovis AF2122/97
gccgaacaccuc

SEQ ID NO: 3198245 - RNA, 17 nt, Mycobacterium bovis subsp bovis AF2122/97
gccgaacaccucggcac

SEQ ID NO: 3198246 - RNA, 18 nt, Mycobacterium bovis subsp bovis AF2122/97
gccgaacacgcacacgau

SEQ ID NO: 3198247 - RNA, 16 nt, Mycobacterium bovis subsp bovis AF2122/97
gccgaacagcaggccu

SEQ ID NO: 3198248 - RNA, 18 nt, Mycobacterium bovis subsp bovis AF2122/97
gccgaacagcaggccucc

SEQ ID NO: 3198249 - RNA, 20 nt, Mycobacterium bovis subsp bovis AF2122/97
gccgaacagcaggccuccaa

SEQ ID NO: 3198250 - RNA, 18 nt, Mycobacterium bovis subsp bovis AF2122/97
gccgaacagcgaaccgcc

SEQ ID NO: 3198251 - RNA, 19 nt, Mycobacterium bovis subsp bovis AF2122/97
gccgaacagcgaaccgccg

SEQ ID NO: 3198252 - RNA, 20 nt, Mycobacterium bovis subsp bovis AF2122/97
gccgaacagcgaaccgccgg

SEQ ID NO: 3198253 - RNA, 14 nt, Mycobacterium bovis subsp bovis AF2122/97
gccgaacagcgacg

SEQ ID NO: 3198254 - RNA, 13 nt, Mycobacterium bovis subsp bovis AF2122/97
gccgaacaggaug

SEQ ID NO: 3198255 - RNA, 17 nt, Mycobacterium bovis subsp bovis AF2122/97
gccgaacagggaggucg

SEQ ID NO: 3198256 - RNA, 20 nt, Mycobacterium bovis subsp bovis AF2122/97
gccgaacagggaggucgccg

SEQ ID NO: 3198257 - RNA, 20 nt, Mycobacterium bovis subsp bovis AF2122/97
gccgaacagugcggucccga

SEQ ID NO: 3198258 - RNA, 16 nt, Mycobacterium bovis subsp bovis AF2122/97
gccgaacaguucggcg

SEQ ID NO: 3198259 - RNA, 17 nt, Mycobacterium bovis subsp bovis AF2122/97
gccgaacaguucggcga

SEQ ID NO: 3198260 - RNA, 18 nt, Mycobacterium bovis subsp bovis AF2122/97
gccgaacaguucggcgag

SEQ ID NO: 3198261 - RNA, 22 nt, Mycobacterium bovis subsp bovis AF2122/97
gccgaacaguucggcgagcaca

SEQ ID NO: 3198262 - RNA, 18 nt, Mycobacterium bovis subsp bovis AF2122/97
gccgaaccacgcgcccgc

SEQ ID NO: 3198263 - RNA, 14 nt, Mycobacterium bovis subsp bovis AF2122/97
gccgaaccagcgau

SEQ ID NO: 3198264 - RNA, 18 nt, Mycobacterium bovis subsp bovis AF2122/97
gccgaaccagcgaugggu

SEQ ID NO: 3198265 - RNA, 15 nt, Mycobacterium bovis subsp bovis AF2122/97
gccgaacccaccacg

SEQ ID NO: 3198266 - RNA, 15 nt, Mycobacterium bovis subsp bovis AF2122/97
gccgaacccggcgga

SEQ ID NO: 3198267 - RNA, 15 nt, Mycobacterium bovis subsp bovis AF2122/97
gccgaacccgguguu

SEQ ID NO: 3198268 - RNA, 21 nt, Mycobacterium bovis subsp bovis AF2122/97
gccgaacccgguguugagcga

SEQ ID NO: 3198269 - RNA, 22 nt, Mycobacterium bovis subsp bovis AF2122/97
gccgaacccgguguugagcgaa

SEQ ID NO: 3198270 - RNA, 23 nt, Mycobacterium bovis subsp bovis AF2122/97
gccgaaccgcgcguaauccgagc

SEQ ID NO: 3198271 - RNA, 15 nt, Mycobacterium bovis subsp bovis AF2122/97
gccgaaccggcacca

SEQ ID NO: 3198272 - RNA, 15 nt, Mycobacterium bovis subsp bovis AF2122/97
gccgaaccggcgcau

SEQ ID NO: 3198273 - RNA, 15 nt, Mycobacterium bovis subsp bovis AF2122/97
gccgaaccguucggc

SEQ ID NO: 3198274 - RNA, 17 nt, Mycobacterium bovis subsp bovis AF2122/97
gccgaaccguucggcga

SEQ ID NO: 3198275 - RNA, 18 nt, Mycobacterium bovis subsp bovis AF2122/97
gccgaaccguucggcgac

SEQ ID NO: 3198276 - RNA, 15 nt, Mycobacterium bovis subsp bovis AF2122/97
gccgaacgacggguc

SEQ ID NO: 3198277 - RNA, 21 nt, Mycobacterium bovis subsp bovis AF2122/97
gccgaacgacggguccgggcc

SEQ ID NO: 3198278 - RNA, 20 nt, Mycobacterium bovis subsp bovis AF2122/97
gccgaacgaggaaccgucga

SEQ ID NO: 3198279 - RNA, 17 nt, Mycobacterium bovis subsp bovis AF2122/97
gccgacauggcggugcg

SEQ ID NO: 3198280 - RNA, 16 nt, Mycobacterium bovis subsp bovis AF2122/97
gccgacauugcugcuc

SEQ ID NO: 3198281 - RNA, 17 nt, Mycobacterium bovis subsp bovis AF2122/97
gccgacauugcugcucg

SEQ ID NO: 3198282 - RNA, 18 nt, Mycobacterium bovis subsp bovis AF2122/97
gccgacauugcugcucgu

SEQ ID NO: 3198283 - RNA, 14 nt, Mycobacterium bovis subsp bovis AF2122/97
gccgaccaccgccg

SEQ ID NO: 3198284 - RNA, 15 nt, Mycobacterium bovis subsp bovis AF2122/97
gccgaccaccgccgg

SEQ ID NO: 3198285 - RNA, 16 nt, Mycobacterium bovis subsp bovis AF2122/97
gccgaccaccgcugcg

SEQ ID NO: 3198286 - RNA, 19 nt, Mycobacterium bovis subsp bovis AF2122/97
gccgaccacucgagcgcuc

SEQ ID NO: 3198287 - RNA, 20 nt, Mycobacterium bovis subsp bovis AF2122/97
gccgaccacucgagcgcuca

SEQ ID NO: 3198288 - RNA, 20 nt, Mycobacterium bovis subsp bovis AF2122/97
gccgaccagagcuucgccgc

SEQ ID NO: 3198289 - RNA, 12 nt, Mycobacterium bovis subsp bovis AF2122/97
gccgaccagcac

SEQ ID NO: 3198290 - RNA, 15 nt, Mycobacterium bovis subsp bovis AF2122/97
gccgaccagcacccg

SEQ ID NO: 3198291 - RNA, 20 nt, Mycobacterium bovis subsp bovis AF2122/97
gccgaccagcacccgcucgg

SEQ ID NO: 3198292 - RNA, 12 nt, Mycobacterium bovis subsp bovis AF2122/97
gccgaccagcau

SEQ ID NO: 3198293 - RNA, 14 nt, Mycobacterium bovis subsp bovis AF2122/97
gccgaccagcgcgc

SEQ ID NO: 3198294 - RNA, 18 nt, Mycobacterium bovis subsp bovis AF2122/97
gccgaccagcgcgcugcg

SEQ ID NO: 3198295 - RNA, 17 nt, Mycobacterium bovis subsp bovis AF2122/97
gccgaccagcgcuagcg

SEQ ID NO: 3198296 - RNA, 12 nt, Mycobacterium bovis subsp bovis AF2122/97
gccgaccaggac

SEQ ID NO: 3198297 - RNA, 16 nt, Mycobacterium bovis subsp bovis AF2122/97
gccgaccaggaccacc

SEQ ID NO: 3198298 - RNA, 20 nt, Mycobacterium bovis subsp bovis AF2122/97
gccgaccauaaaacucgggg

SEQ ID NO: 3198299 - RNA, 22 nt, Mycobacterium bovis subsp bovis AF2122/97
gccgaccauaaaacucgggggc

SEQ ID NO: 3198300 - RNA, 18 nt, Mycobacterium bovis subsp bovis AF2122/97
gccgaccaucucaccggg

SEQ ID NO: 3198301 - RNA, 20 nt, Mycobacterium bovis subsp bovis AF2122/97
gccgaccaucucaccgggcc

SEQ ID NO: 3198302 - RNA, 22 nt, Mycobacterium bovis subsp bovis AF2122/97
gccgaccaucucaccgggcccg

SEQ ID NO: 3198303 - RNA, 20 nt, Mycobacterium bovis subsp bovis AF2122/97
gccgaccaugguagcgcccc

SEQ ID NO: 3198304 - RNA, 17 nt, Mycobacterium bovis subsp bovis AF2122/97
gccgacccaacccgauc

SEQ ID NO: 3198305 - RNA, 22 nt, Mycobacterium bovis subsp bovis AF2122/97
gccgacccgacgcuggucggcg

SEQ ID NO: 3198306 - RNA, 24 nt, Mycobacterium bovis subsp bovis AF2122/97
gccgacccgccacaucguggcguc

SEQ ID NO: 3198307 - RNA, 21 nt, Mycobacterium bovis subsp bovis AF2122/97
gccgacccgcccgaagaugcc

SEQ ID NO: 3198308 - RNA, 13 nt, Mycobacterium bovis subsp bovis AF2122/97
gccgacccgccgc

SEQ ID NO: 3198309 - RNA, 14 nt, Mycobacterium bovis subsp bovis AF2122/97
gccgacccgccgcg

SEQ ID NO: 3198310 - RNA, 19 nt, Mycobacterium bovis subsp bovis AF2122/97
gccgacccgccgcgcccgg

SEQ ID NO: 3198311 - RNA, 21 nt, Mycobacterium bovis subsp bovis AF2122/97
gccgacccgccgcgcccggcg

SEQ ID NO: 3198312 - RNA, 22 nt, Mycobacterium bovis subsp bovis AF2122/97
gccgacccgccgcgcccggcgc

SEQ ID NO: 3198313 - RNA, 15 nt, Mycobacterium bovis subsp bovis AF2122/97
gccgacccgccgcgg

SEQ ID NO: 3198314 - RNA, 17 nt, Mycobacterium bovis subsp bovis AF2122/97
gccgacccgccgcggac

SEQ ID NO: 3198315 - RNA, 18 nt, Mycobacterium bovis subsp bovis AF2122/97
gccgacccgccgcggaca

SEQ ID NO: 3198316 - RNA, 12 nt, Mycobacterium bovis subsp bovis AF2122/97
gccgacccgcgc

SEQ ID NO: 3198317 - RNA, 15 nt, Mycobacterium bovis subsp bovis AF2122/97
gccgacccgcgcgcc

SEQ ID NO: 3198318 - RNA, 16 nt, Mycobacterium bovis subsp bovis AF2122/97
gccgacccgcgcgccg

SEQ ID NO: 3198319 - RNA, 19 nt, Mycobacterium bovis subsp bovis AF2122/97
gccgacccgcgcgccggcg

SEQ ID NO: 3198320 - RNA, 20 nt, Mycobacterium bovis subsp bovis AF2122/97
gccgacccgcgcgccggcga

SEQ ID NO: 3198321 - RNA, 21 nt, Mycobacterium bovis subsp bovis AF2122/97
gccgacccgcgcgccggcgac

SEQ ID NO: 3198322 - RNA, 22 nt, Mycobacterium bovis subsp bovis AF2122/97
gccgacccgcgcgccggcgacc

SEQ ID NO: 3198323 - RNA, 21 nt, Mycobacterium bovis subsp bovis AF2122/97
gccgacccgggcgagcgcggc

SEQ ID NO: 3198324 - RNA, 15 nt, Mycobacterium bovis subsp bovis AF2122/97
gccgacccgggggcg

SEQ ID NO: 3198325 - RNA, 22 nt, Mycobacterium bovis subsp bovis AF2122/97
gccgacccgggggcgcccggga

SEQ ID NO: 3198326 - RNA, 18 nt, Mycobacterium bovis subsp bovis AF2122/97
gccgacccguaccagccc

SEQ ID NO: 3198327 - RNA, 22 nt, Mycobacterium bovis subsp bovis AF2122/97
gccgacccuacuuccucgacga

SEQ ID NO: 3198328 - RNA, 21 nt, Mycobacterium bovis subsp bovis AF2122/97
gccgacccuagauaugcaccc

SEQ ID NO: 3198329 - RNA, 15 nt, Mycobacterium bovis subsp bovis AF2122/97
gccgaccgaaucagc

SEQ ID NO: 3198330 - RNA, 14 nt, Mycobacterium bovis subsp bovis AF2122/97
gccgaccgacacca

SEQ ID NO: 3198331 - RNA, 16 nt, Mycobacterium bovis subsp bovis AF2122/97
gccgaccgacaccacc

SEQ ID NO: 3198332 - RNA, 20 nt, Mycobacterium bovis subsp bovis AF2122/97
gccgaccgacaccaccaggu

SEQ ID NO: 3198333 - RNA, 17 nt, Mycobacterium bovis subsp bovis AF2122/97
gccgaccgaccgcacga

SEQ ID NO: 3198334 - RNA, 22 nt, Mycobacterium bovis subsp bovis AF2122/97
gccgaccgaccgcacgaccagc

SEQ ID NO: 3198335 - RNA, 23 nt, Mycobacterium bovis subsp bovis AF2122/97
gccgaccgaccgcacgaccagcu

SEQ ID NO: 3198336 - RNA, 16 nt, Mycobacterium bovis subsp bovis AF2122/97
gccgaccgacgucgcc

SEQ ID NO: 3198337 - RNA, 20 nt, Mycobacterium bovis subsp bovis AF2122/97
gccgaccgauacaccgacgg

SEQ ID NO: 3198338 - RNA, 18 nt, Mycobacterium bovis subsp bovis AF2122/97
gccgaccgauggcucacc

SEQ ID NO: 3198339 - RNA, 19 nt, Mycobacterium bovis subsp bovis AF2122/97
gccgaccgauggcucacca

SEQ ID NO: 3198340 - RNA, 23 nt, Mycobacterium bovis subsp bovis AF2122/97
gccgaccgauggcucaccagcuc

SEQ ID NO: 3198341 - RNA, 12 nt, Mycobacterium bovis subsp bovis AF2122/97
gccgaccgcgac

SEQ ID NO: 3198342 - RNA, 14 nt, Mycobacterium bovis subsp bovis AF2122/97
gccgaccgcgaccc

SEQ ID NO: 3198343 - RNA, 18 nt, Mycobacterium bovis subsp bovis AF2122/97
gccgaccgcgacccggcc

SEQ ID NO: 3198344 - RNA, 21 nt, Mycobacterium bovis subsp bovis AF2122/97
gccgaccgcgacccggcccag

SEQ ID NO: 3198345 - RNA, 22 nt, Mycobacterium bovis subsp bovis AF2122/97
gccgaccgcgacccggcccagc

SEQ ID NO: 3198346 - RNA, 17 nt, Mycobacterium bovis subsp bovis AF2122/97
gccgaccgcgccgcauc

SEQ ID NO: 3198347 - RNA, 14 nt, Mycobacterium bovis subsp bovis AF2122/97
gccgaccgcggguc

SEQ ID NO: 3198348 - RNA, 18 nt, Mycobacterium bovis subsp bovis AF2122/97
gccgaccgcgggucgugc

SEQ ID NO: 3198349 - RNA, 22 nt, Mycobacterium bovis subsp bovis AF2122/97
gccgaccgcguuuugcaggccc

SEQ ID NO: 3198350 - RNA, 14 nt, Mycobacterium bovis subsp bovis AF2122/97
gccgaccggcaccc

SEQ ID NO: 3198351 - RNA, 20 nt, Mycobacterium bovis subsp bovis AF2122/97
gccgaccggcacccgcggcg

SEQ ID NO: 3198352 - RNA, 21 nt, Mycobacterium bovis subsp bovis AF2122/97
gccgaccggcacccgcggcga

SEQ ID NO: 3198353 - RNA, 22 nt, Mycobacterium bovis subsp bovis AF2122/97
gccgaccggcacccgcggcgaa

SEQ ID NO: 3198354 - RNA, 13 nt, Mycobacterium bovis subsp bovis AF2122/97
gccgaccggcagc

SEQ ID NO: 3198355 - RNA, 16 nt, Mycobacterium bovis subsp bovis AF2122/97
gccgaccggcagcgau

SEQ ID NO: 3198356 - RNA, 20 nt, Mycobacterium bovis subsp bovis AF2122/97
gccgaccggcccgcauccgc

SEQ ID NO: 3198357 - RNA, 21 nt, Mycobacterium bovis subsp bovis AF2122/97
gccgaccggcccgcauccgca

SEQ ID NO: 3198358 - RNA, 13 nt, Mycobacterium bovis subsp bovis AF2122/97
gccgaccggcggc

SEQ ID NO: 3198359 - RNA, 14 nt, Mycobacterium bovis subsp bovis AF2122/97
gccgaccggcggca

SEQ ID NO: 3198360 - RNA, 17 nt, Mycobacterium bovis subsp bovis AF2122/97
gccgaccggcggcaaac

SEQ ID NO: 3198361 - RNA, 14 nt, Mycobacterium bovis subsp bovis AF2122/97
gccgaccgggcucu

SEQ ID NO: 3198362 - RNA, 16 nt, Mycobacterium bovis subsp bovis AF2122/97
gccgaccgggcucugg

SEQ ID NO: 3198363 - RNA, 19 nt, Mycobacterium bovis subsp bovis AF2122/97
gccgaccgggcucuggcca

SEQ ID NO: 3198364 - RNA, 23 nt, Mycobacterium bovis subsp bovis AF2122/97
gccgaccgggcucuggccagucc

SEQ ID NO: 3198365 - RNA, 23 nt, Mycobacterium bovis subsp bovis AF2122/97
gccgacgucugguuggcuggcgg

SEQ ID NO: 3198366 - RNA, 11 nt, Mycobacterium bovis subsp bovis AF2122/97
gccgacgugac

SEQ ID NO: 3198367 - RNA, 21 nt, Mycobacterium bovis subsp bovis AF2122/97
gccgacgugacaacugcgccg

SEQ ID NO: 3198368 - RNA, 22 nt, Mycobacterium bovis subsp bovis AF2122/97
gccgacgugacaacugcgccgg

SEQ ID NO: 3198369 - RNA, 12 nt, Mycobacterium bovis subsp bovis AF2122/97
gccgacgugacc

SEQ ID NO: 3198370 - RNA, 17 nt, Mycobacterium bovis subsp bovis AF2122/97
gccgacgugaccagcuu

SEQ ID NO: 3198371 - RNA, 15 nt, Mycobacterium bovis subsp bovis AF2122/97
gccgacgugcggcgg

SEQ ID NO: 3198372 - RNA, 18 nt, Mycobacterium bovis subsp bovis AF2122/97
gccgacgugcggcggccu

SEQ ID NO: 3198373 - RNA, 18 nt, Mycobacterium bovis subsp bovis AF2122/97
gccgacguugaagccgcc

SEQ ID NO: 3198374 - RNA, 20 nt, Mycobacterium bovis subsp bovis AF2122/97
gccgacuacgaagacguucg

SEQ ID NO: 3198375 - RNA, 22 nt, Mycobacterium bovis subsp bovis AF2122/97
gccgacuaguccgagggcgucg

SEQ ID NO: 3198376 - RNA, 14 nt, Mycobacterium bovis subsp bovis AF2122/97
gccgacuaucggcc

SEQ ID NO: 3198377 - RNA, 15 nt, Mycobacterium bovis subsp bovis AF2122/97
gccgacuaucggccg

SEQ ID NO: 3198378 - RNA, 16 nt, Mycobacterium bovis subsp bovis AF2122/97
gccgacuaucggccgc

SEQ ID NO: 3198379 - RNA, 17 nt, Mycobacterium bovis subsp bovis AF2122/97
gccgacuaucggccgcc

SEQ ID NO: 3198380 - RNA, 19 nt, Mycobacterium bovis subsp bovis AF2122/97
gccgacuaucggccgccgg

SEQ ID NO: 3198381 - RNA, 13 nt, Mycobacterium bovis subsp bovis AF2122/97
gccgacucagguc

SEQ ID NO: 3198382 - RNA, 16 nt, Mycobacterium bovis subsp bovis AF2122/97
gccgacucaucggccg

SEQ ID NO: 3198383 - RNA, 17 nt, Mycobacterium bovis subsp bovis AF2122/97
gccgacucaucggccgc

SEQ ID NO: 3198384 - RNA, 23 nt, Mycobacterium bovis subsp bovis AF2122/97
gccgacucaucggccgcggucgg

SEQ ID NO: 3198385 - RNA, 18 nt, Mycobacterium bovis subsp bovis AF2122/97
gccgacuccccgccgggc

SEQ ID NO: 3198386 - RNA, 19 nt, Mycobacterium bovis subsp bovis AF2122/97
gccgacucggcaccgcggc

SEQ ID NO: 3198387 - RNA, 20 nt, Mycobacterium bovis subsp bovis AF2122/97
gccgacucggcaccgcggcc

SEQ ID NO: 3198388 - RNA, 14 nt, Mycobacterium bovis subsp bovis AF2122/97
gccgacugggcgcg

SEQ ID NO: 3198389 - RNA, 17 nt, Mycobacterium bovis subsp bovis AF2122/97
gccgacugggcgcgacc

SEQ ID NO: 3198390 - RNA, 20 nt, Mycobacterium bovis subsp bovis AF2122/97
gccgacuuccgcgucgccgg

SEQ ID NO: 3198391 - RNA, 23 nt, Mycobacterium bovis subsp bovis AF2122/97
gccgacuuccgcgucgccggccu

SEQ ID NO: 3198392 - RNA, 17 nt, Mycobacterium bovis subsp bovis AF2122/97
gccgacuucgucaacca

SEQ ID NO: 3198393 - RNA, 21 nt, Mycobacterium bovis subsp bovis AF2122/97
gccgacuugauuucgaucgcg

SEQ ID NO: 3198394 - RNA, 22 nt, Mycobacterium bovis subsp bovis AF2122/97
gccgacuugauuucgaucgcgg

SEQ ID NO: 3198395 - RNA, 23 nt, Mycobacterium bovis subsp bovis AF2122/97
gccgacuugauuucgaucgcggc

SEQ ID NO: 3198396 - RNA, 21 nt, Mycobacterium bovis subsp bovis AF2122/97
gccgacuuguacgcaucgccg

SEQ ID NO: 3198397 - RNA, 16 nt, Mycobacterium bovis subsp bovis AF2122/97
gccgacuuugucgcgg

SEQ ID NO: 3198398 - RNA, 14 nt, Mycobacterium bovis subsp bovis AF2122/97
gccgagaacaccgg

SEQ ID NO: 3198399 - RNA, 16 nt, Mycobacterium bovis subsp bovis AF2122/97
gccgagaaccagcgaa

SEQ ID NO: 3198400 - RNA, 24 nt, Mycobacterium bovis subsp bovis AF2122/97
gccgagaacgauguccgcgcgaac

SEQ ID NO: 3198401 - RNA, 20 nt, Mycobacterium bovis subsp bovis AF2122/97
gccgagaauuccccagccgc

SEQ ID NO: 3198402 - RNA, 18 nt, Mycobacterium bovis subsp bovis AF2122/97
gccgagaccacgcgcguc

SEQ ID NO: 3198403 - RNA, 21 nt, Mycobacterium bovis subsp bovis AF2122/97
gccgagaccacgcgcgucggu

SEQ ID NO: 3198404 - RNA, 19 nt, Mycobacterium bovis subsp bovis AF2122/97
gccgagaccgccgcugccg

SEQ ID NO: 3198405 - RNA, 23 nt, Mycobacterium bovis subsp bovis AF2122/97
gccgagaccgcguggucggcgaa

SEQ ID NO: 3198406 - RNA, 15 nt, Mycobacterium bovis subsp bovis AF2122/97
gccgagaccggccag

SEQ ID NO: 3198407 - RNA, 12 nt, Mycobacterium bovis subsp bovis AF2122/97
gccgagacgacc

SEQ ID NO: 3198408 - RNA, 12 nt, Mycobacterium bovis subsp bovis AF2122/97
gccgagagcacc

SEQ ID NO: 3198409 - RNA, 15 nt, Mycobacterium bovis subsp bovis AF2122/97
gccgagagcagccag

SEQ ID NO: 3198410 - RNA, 14 nt, Mycobacterium bovis subsp bovis AF2122/97
gccgagauccacgc

SEQ ID NO: 3198411 - RNA, 19 nt, Mycobacterium bovis subsp bovis AF2122/97
gccgagauccacgccagag

SEQ ID NO: 3198412 - RNA, 20 nt, Mycobacterium bovis subsp bovis AF2122/97
gccgagaucccagcgggaca

SEQ ID NO: 3198413 - RNA, 12 nt, Mycobacterium bovis subsp bovis AF2122/97
gccgagauccgc

SEQ ID NO: 3198414 - RNA, 17 nt, Mycobacterium bovis subsp bovis AF2122/97
gccgagauccgcgcuug

SEQ ID NO: 3198415 - RNA, 15 nt, Mycobacterium bovis subsp bovis AF2122/97
gccgagaucgacauc

SEQ ID NO: 3198416 - RNA, 22 nt, Mycobacterium bovis subsp bovis AF2122/97
gccgagaucgacaucguuggcc

SEQ ID NO: 3198417 - RNA, 18 nt, Mycobacterium bovis subsp bovis AF2122/97
gccgagaugaugcugccg

SEQ ID NO: 3198418 - RNA, 15 nt, Mycobacterium bovis subsp bovis AF2122/97
gccgagaugccggcg

SEQ ID NO: 3198419 - RNA, 23 nt, Mycobacterium bovis subsp bovis AF2122/97
gccgagaugccggcgagcaggcc

SEQ ID NO: 3198420 - RNA, 19 nt, Mycobacterium bovis subsp bovis AF2122/97
gccgagaugcugcacccgg

SEQ ID NO: 3198421 - RNA, 21 nt, Mycobacterium bovis subsp bovis AF2122/97
gccgagaugcuggucggcgau

SEQ ID NO: 3198422 - RNA, 19 nt, Mycobacterium bovis subsp bovis AF2122/97
gccgagcaacaccgucggc

SEQ ID NO: 3198423 - RNA, 18 nt, Mycobacterium bovis subsp bovis AF2122/97
gccgagcacacgucggga

SEQ ID NO: 3198424 - RNA, 14 nt, Mycobacterium bovis subsp bovis AF2122/97
gccgagcacgacga

SEQ ID NO: 3198425 - RNA, 15 nt, Mycobacterium bovis subsp bovis AF2122/97
gccgagcacgccgag

SEQ ID NO: 3198426 - RNA, 16 nt, Mycobacterium bovis subsp bovis AF2122/97
gccgagcacgccgagc

SEQ ID NO: 3198427 - RNA, 20 nt, Mycobacterium bovis subsp bovis AF2122/97
gccgagcacgccgagcccgc

SEQ ID NO: 3198428 - RNA, 15 nt, Mycobacterium bovis subsp bovis AF2122/97
gccgagcacgggcag

SEQ ID NO: 3198429 - RNA, 13 nt, Mycobacterium bovis subsp bovis AF2122/97
gccgagcacucgg

SEQ ID NO: 3198430 - RNA, 16 nt, Mycobacterium bovis subsp bovis AF2122/97
gccgagcagacgcaga

SEQ ID NO: 3198431 - RNA, 16 nt, Mycobacterium bovis subsp bovis AF2122/97
gccgagcagacgcgga

SEQ ID NO: 3198432 - RNA, 13 nt, Mycobacterium bovis subsp bovis AF2122/97
gccgagcagcccg

SEQ ID NO: 3198433 - RNA, 14 nt, Mycobacterium bovis subsp bovis AF2122/97
gccgagcagcccgc

SEQ ID NO: 3198434 - RNA, 17 nt, Mycobacterium bovis subsp bovis AF2122/97
gccgagcagcccgcgga

SEQ ID NO: 3198435 - RNA, 11 nt, Mycobacterium bovis subsp bovis AF2122/97
gccgagcagcu

SEQ ID NO: 3198436 - RNA, 20 nt, Mycobacterium bovis subsp bovis AF2122/97
gccgagcagcuccuugaggu

SEQ ID NO: 3198437 - RNA, 16 nt, Mycobacterium bovis subsp bovis AF2122/97
gccgagcaggucggca

SEQ ID NO: 3198438 - RNA, 18 nt, Mycobacterium bovis subsp bovis AF2122/97
gccgagcaggucggcaau

SEQ ID NO: 3198439 - RNA, 22 nt, Mycobacterium bovis subsp bovis AF2122/97
gccgagcagguuccgcacgauc

SEQ ID NO: 3198440 - RNA, 16 nt, Mycobacterium bovis subsp bovis AF2122/97
gccgagccagcacccg

SEQ ID NO: 3198441 - RNA, 15 nt, Mycobacterium bovis subsp bovis AF2122/97
gccgagccagcuccg

SEQ ID NO: 3198442 - RNA, 21 nt, Mycobacterium bovis subsp bovis AF2122/97
gccgagccagcuccggcgcuc

SEQ ID NO: 3198443 - RNA, 15 nt, Mycobacterium bovis subsp bovis AF2122/97
gccgagcccgccggg

SEQ ID NO: 3198444 - RNA, 19 nt, Mycobacterium bovis subsp bovis AF2122/97
gccgagcccgggccguacg

SEQ ID NO: 3198445 - RNA, 15 nt, Mycobacterium bovis subsp bovis AF2122/97
gccgagcccggugcu

SEQ ID NO: 3198446 - RNA, 16 nt, Mycobacterium bovis subsp bovis AF2122/97
gccgagcccgucgauc

SEQ ID NO: 3198447 - RNA, 22 nt, Mycobacterium bovis subsp bovis AF2122/97
gccgagccgauauaccagggca

SEQ ID NO: 3198448 - RNA, 14 nt, Mycobacterium bovis subsp bovis AF2122/97
gccgagccgcccgc

SEQ ID NO: 3198449 - RNA, 18 nt, Mycobacterium bovis subsp bovis AF2122/97
gccgagccgcccgcccgg

SEQ ID NO: 3198450 - RNA, 22 nt, Mycobacterium bovis subsp bovis AF2122/97
gccgagccucgcucuccauggc

SEQ ID NO: 3198451 - RNA, 16 nt, Mycobacterium bovis subsp bovis AF2122/97
gccgauaccgccggcc

SEQ ID NO: 3198452 - RNA, 17 nt, Mycobacterium bovis subsp bovis AF2122/97
gccgauaccggcggcga

SEQ ID NO: 3198453 - RNA, 18 nt, Mycobacterium bovis subsp bovis AF2122/97
gccgauaccggcggcgag

SEQ ID NO: 3198454 - RNA, 20 nt, Mycobacterium bovis subsp bovis AF2122/97
gccgauacgugaggucccgg

SEQ ID NO: 3198455 - RNA, 20 nt, Mycobacterium bovis subsp bovis AF2122/97
gccgauacuaaacaggccgc

SEQ ID NO: 3198456 - RNA, 23 nt, Mycobacterium bovis subsp bovis AF2122/97
gccgauagaacuagaucgucguc

SEQ ID NO: 3198457 - RNA, 14 nt, Mycobacterium bovis subsp bovis AF2122/97
gccgauagcaccgg

SEQ ID NO: 3198458 - RNA, 13 nt, Mycobacterium bovis subsp bovis AF2122/97
gccgauagcgcgg

SEQ ID NO: 3198459 - RNA, 15 nt, Mycobacterium bovis subsp bovis AF2122/97
gccgauagcgcggca

SEQ ID NO: 3198460 - RNA, 15 nt, Mycobacterium bovis subsp bovis AF2122/97
gccgauaucggugac

SEQ ID NO: 3198461 - RNA, 17 nt, Mycobacterium bovis subsp bovis AF2122/97
gccgauauuggcaucgu

SEQ ID NO: 3198462 - RNA, 17 nt, Mycobacterium bovis subsp bovis AF2122/97
gccgaucaacagcaccg

SEQ ID NO: 3198463 - RNA, 23 nt, Mycobacterium bovis subsp bovis AF2122/97
gccgaucaacagcaccguacggc

SEQ ID NO: 3198464 - RNA, 23 nt, Mycobacterium bovis subsp bovis AF2122/97
gccgaucaacaugccggucaucc

SEQ ID NO: 3198465 - RNA, 19 nt, Mycobacterium bovis subsp bovis AF2122/97
gccgaucaaccccccgggc

SEQ ID NO: 3198466 - RNA, 19 nt, Mycobacterium bovis subsp bovis AF2122/97
gccgaucaccaccggcaga

SEQ ID NO: 3198467 - RNA, 21 nt, Mycobacterium bovis subsp bovis AF2122/97
gccgaucaccaccggcagaug

SEQ ID NO: 3198468 - RNA, 22 nt, Mycobacterium bovis subsp bovis AF2122/97
gccgaucaccaccggcagauga

SEQ ID NO: 3198469 - RNA, 16 nt, Mycobacterium bovis subsp bovis AF2122/97
gccgaucaccgcaucg

SEQ ID NO: 3198470 - RNA, 22 nt, Mycobacterium bovis subsp bovis AF2122/97
gccgaucaccgccggggcuggu

SEQ ID NO: 3198471 - RNA, 16 nt, Mycobacterium bovis subsp bovis AF2122/97
gccgaucaccgcugug

SEQ ID NO: 3198472 - RNA, 16 nt, Mycobacterium bovis subsp bovis AF2122/97
gccgaucacggcaccg

SEQ ID NO: 3198473 - RNA, 13 nt, Mycobacterium bovis subsp bovis AF2122/97
gccgaucacgggc

SEQ ID NO: 3198474 - RNA, 18 nt, Mycobacterium bovis subsp bovis AF2122/97
gccgaucacugucgggua

SEQ ID NO: 3198475 - RNA, 17 nt, Mycobacterium bovis subsp bovis AF2122/97
gccgaucagcaguggga

SEQ ID NO: 3198476 - RNA, 15 nt, Mycobacterium bovis subsp bovis AF2122/97
gccgaucagcccggc

SEQ ID NO: 3198477 - RNA, 16 nt, Mycobacterium bovis subsp bovis AF2122/97
gccgaucagcgcggcg

SEQ ID NO: 3198478 - RNA, 16 nt, Mycobacterium bovis subsp bovis AF2122/97
gccgaucagcugcgca

SEQ ID NO: 3198479 - RNA, 15 nt, Mycobacterium bovis subsp bovis AF2122/97
gccgaucagcuggcu

SEQ ID NO: 3198480 - RNA, 17 nt, Mycobacterium bovis subsp bovis AF2122/97
gccgaucaucaccggca

SEQ ID NO: 3198481 - RNA, 16 nt, Mycobacterium bovis subsp bovis AF2122/97
gccgaucaugaccauc

SEQ ID NO: 3198482 - RNA, 14 nt, Mycobacterium bovis subsp bovis AF2122/97
gccgauccagcagg

SEQ ID NO: 3198483 - RNA, 18 nt, Mycobacterium bovis subsp bovis AF2122/97
gccgauccagcaggccgu

SEQ ID NO: 3198484 - RNA, 15 nt, Mycobacterium bovis subsp bovis AF2122/97
gccgaucccaccggc

SEQ ID NO: 3198485 - RNA, 15 nt, Mycobacterium bovis subsp bovis AF2122/97
gccgaucccggcgag

SEQ ID NO: 3198486 - RNA, 20 nt, Mycobacterium bovis subsp bovis AF2122/97
gccgaucccggcgagcaccc

SEQ ID NO: 3198487 - RNA, 14 nt, Mycobacterium bovis subsp bovis AF2122/97
gccgaucccggcgg

SEQ ID NO: 3198488 - RNA, 17 nt, Mycobacterium bovis subsp bovis AF2122/97
gccgaucccgugguggc

SEQ ID NO: 3198489 - RNA, 15 nt, Mycobacterium bovis subsp bovis AF2122/97
gccgauccgaucgca

SEQ ID NO: 3198490 - RNA, 15 nt, Mycobacterium bovis subsp bovis AF2122/97
gccgauccgguggcu

SEQ ID NO: 3198491 - RNA, 19 nt, Mycobacterium bovis subsp bovis AF2122/97
gccgaucgaaccgcugcuc

SEQ ID NO: 3198492 - RNA, 21 nt, Mycobacterium bovis subsp bovis AF2122/97
gccgaucgacacccgcucggc

SEQ ID NO: 3198493 - RNA, 15 nt, Mycobacterium bovis subsp bovis AF2122/97
gccgaucgcggcggc

SEQ ID NO: 3198494 - RNA, 17 nt, Mycobacterium bovis subsp bovis AF2122/97
gccgaucgcggcggccu

SEQ ID NO: 3198495 - RNA, 13 nt, Mycobacterium bovis subsp bovis AF2122/97
gccgaucggccgg

SEQ ID NO: 3198496 - RNA, 17 nt, Mycobacterium bovis subsp bovis AF2122/97
gccgaucggccugcagc

SEQ ID NO: 3198497 - RNA, 22 nt, Mycobacterium bovis subsp bovis AF2122/97
gccgaucggccugcagcgauga

SEQ ID NO: 3198498 - RNA, 13 nt, Mycobacterium bovis subsp bovis AF2122/97
gccgaucgggagu

SEQ ID NO: 3198499 - RNA, 22 nt, Mycobacterium bovis subsp bovis AF2122/97
gccgaucgggcucacucgccga

SEQ ID NO: 3198500 - RNA, 19 nt, Mycobacterium bovis subsp bovis AF2122/97
gccgaucgggcuucggcca

SEQ ID NO: 3198501 - RNA, 20 nt, Mycobacterium bovis subsp bovis AF2122/97
gccgaucgggcuucggccag

SEQ ID NO: 3198502 - RNA, 22 nt, Mycobacterium bovis subsp bovis AF2122/97
gccgaucgggguggucgcaccg

SEQ ID NO: 3198503 - RNA, 13 nt, Mycobacterium bovis subsp bovis AF2122/97
gccgaucggugcc

SEQ ID NO: 3198504 - RNA, 15 nt, Mycobacterium bovis subsp bovis AF2122/97
gccgaucgucucggc

SEQ ID NO: 3198505 - RNA, 16 nt, Mycobacterium bovis subsp bovis AF2122/97
gccgaucucgcccagc

SEQ ID NO: 3198506 - RNA, 19 nt, Mycobacterium bovis subsp bovis AF2122/97
gccgaucucgcccagcgag

SEQ ID NO: 3198507 - RNA, 18 nt, Mycobacterium bovis subsp bovis AF2122/97
gccgaucucuccggcggc

SEQ ID NO: 3198508 - RNA, 22 nt, Mycobacterium bovis subsp bovis AF2122/97
gccgaucucuccggcggcgaag

SEQ ID NO: 3198509 - RNA, 16 nt, Mycobacterium bovis subsp bovis AF2122/97
gccgaucugcucgccg

SEQ ID NO: 3198510 - RNA, 22 nt, Mycobacterium bovis subsp bovis AF2122/97
gccgaucugcucgccgagcucg

SEQ ID NO: 3198511 - RNA, 17 nt, Mycobacterium bovis subsp bovis AF2122/97
gccgaucugcugcagcg

SEQ ID NO: 3198512 - RNA, 18 nt, Mycobacterium bovis subsp bovis AF2122/97
gccgaucuucgcgcgcuc

SEQ ID NO: 3198513 - RNA, 19 nt, Mycobacterium bovis subsp bovis AF2122/97
gccgaucuucgcgcgcuca

SEQ ID NO: 3198514 - RNA, 16 nt, Mycobacterium bovis subsp bovis AF2122/97
gccgaugaacguggcg

SEQ ID NO: 3198515 - RNA, 15 nt, Mycobacterium bovis subsp bovis AF2122/97
gccgaugaccgaaga

SEQ ID NO: 3198516 - RNA, 22 nt, Mycobacterium bovis subsp bovis AF2122/97
gccgaugaccgaagagcgcgcg

SEQ ID NO: 3198517 - RNA, 22 nt, Mycobacterium bovis subsp bovis AF2122/97
gccgaugaccgccugcuggccg

SEQ ID NO: 3198518 - RNA, 13 nt, Mycobacterium bovis subsp bovis AF2122/97
gccgaugacgaug

SEQ ID NO: 3198519 - RNA, 20 nt, Mycobacterium bovis subsp bovis AF2122/97
gccgaugacgaugccgccga

SEQ ID NO: 3198520 - RNA, 15 nt, Mycobacterium bovis subsp bovis AF2122/97
gccgaugacgauggc

SEQ ID NO: 3198521 - RNA, 18 nt, Mycobacterium bovis subsp bovis AF2122/97
gccgaugacgauggccgc

SEQ ID NO: 3198522 - RNA, 14 nt, Mycobacterium bovis subsp bovis AF2122/97
gccgaugacggugu

SEQ ID NO: 3198523 - RNA, 15 nt, Mycobacterium bovis subsp bovis AF2122/97
gccgaugagcccagc

SEQ ID NO: 3198524 - RNA, 20 nt, Mycobacterium bovis subsp bovis AF2122/97
gccgaugagcccagccgcgg

SEQ ID NO: 3198525 - RNA, 16 nt, Mycobacterium bovis subsp bovis AF2122/97
gccgaugaugcggcgc

SEQ ID NO: 3198526 - RNA, 17 nt, Mycobacterium bovis subsp bovis AF2122/97
gccgaugaugcggcgca

SEQ ID NO: 3198527 - RNA, 18 nt, Mycobacterium bovis subsp bovis AF2122/97
gccgaugaugcggcgcag

SEQ ID NO: 3198528 - RNA, 19 nt, Mycobacterium bovis subsp bovis AF2122/97
gccgaugaugcggcgcagc

SEQ ID NO: 3198529 - RNA, 20 nt, Mycobacterium bovis subsp bovis AF2122/97
gccgaugauggacaccagcc

SEQ ID NO: 3198530 - RNA, 20 nt, Mycobacterium bovis subsp bovis AF2122/97
gccgaugcccaggaucacgg

SEQ ID NO: 3198531 - RNA, 21 nt, Mycobacterium bovis subsp bovis AF2122/97
gccgaugcccaucacgcccca

SEQ ID NO: 3198532 - RNA, 18 nt, Mycobacterium bovis subsp bovis AF2122/97
gccgaugcccgacaccgc

SEQ ID NO: 3198533 - RNA, 12 nt, Mycobacterium bovis subsp bovis AF2122/97
gccgaugccgau

SEQ ID NO: 3198534 - RNA, 14 nt, Mycobacterium bovis subsp bovis AF2122/97
gccgaugccggcca

SEQ ID NO: 3198535 - RNA, 13 nt, Mycobacterium bovis subsp bovis AF2122/97
gccgaugccggcg

SEQ ID NO: 3198536 - RNA, 18 nt, Mycobacterium bovis subsp bovis AF2122/97
gccgaugcgacccgcaga

SEQ ID NO: 3198537 - RNA, 17 nt, Mycobacterium bovis subsp bovis AF2122/97
gccgaugcgacgcagac

SEQ ID NO: 3198538 - RNA, 19 nt, Mycobacterium bovis subsp bovis AF2122/97
gccgcacgauggccgucga

SEQ ID NO: 3198539 - RNA, 20 nt, Mycobacterium bovis subsp bovis AF2122/97
gccgcacgauggccgucgau

SEQ ID NO: 3198540 - RNA, 12 nt, Mycobacterium bovis subsp bovis AF2122/97
gccgcacgccga

SEQ ID NO: 3198541 - RNA, 14 nt, Mycobacterium bovis subsp bovis AF2122/97
gccgcacgccgacc

SEQ ID NO: 3198542 - RNA, 15 nt, Mycobacterium bovis subsp bovis AF2122/97
gccgcacgccgacca

SEQ ID NO: 3198543 - RNA, 19 nt, Mycobacterium bovis subsp bovis AF2122/97
gccgcacgccgaccagcac

SEQ ID NO: 3198544 - RNA, 17 nt, Mycobacterium bovis subsp bovis AF2122/97
gccgcacgccggcaugc

SEQ ID NO: 3198545 - RNA, 22 nt, Mycobacterium bovis subsp bovis AF2122/97
gccgcacgccggcaugccagcc

SEQ ID NO: 3198546 - RNA, 16 nt, Mycobacterium bovis subsp bovis AF2122/97
gccgcacgccggccag

SEQ ID NO: 3198547 - RNA, 17 nt, Mycobacterium bovis subsp bovis AF2122/97
gccgcacgccggccagc

SEQ ID NO: 3198548 - RNA, 20 nt, Mycobacterium bovis subsp bovis AF2122/97
gccgcacgccggccagcgaa

SEQ ID NO: 3198549 - RNA, 15 nt, Mycobacterium bovis subsp bovis AF2122/97
gccgcacgcuagccg

SEQ ID NO: 3198550 - RNA, 18 nt, Mycobacterium bovis subsp bovis AF2122/97
gccgcacgcuagccgaca

SEQ ID NO: 3198551 - RNA, 12 nt, Mycobacterium bovis subsp bovis AF2122/97
gccgcacgggcc

SEQ ID NO: 3198552 - RNA, 17 nt, Mycobacterium bovis subsp bovis AF2122/97
gccgcacgggcccagga

SEQ ID NO: 3198553 - RNA, 18 nt, Mycobacterium bovis subsp bovis AF2122/97
gccgcacgguugccguca

SEQ ID NO: 3198554 - RNA, 14 nt, Mycobacterium bovis subsp bovis AF2122/97
gccgcacguucggc

SEQ ID NO: 3198555 - RNA, 15 nt, Mycobacterium bovis subsp bovis AF2122/97
gccgcacguucggcg

SEQ ID NO: 3198556 - RNA, 18 nt, Mycobacterium bovis subsp bovis AF2122/97
gccgcacguucggcgaug

SEQ ID NO: 3198557 - RNA, 19 nt, Mycobacterium bovis subsp bovis AF2122/97
gccgcacugggugcgucga

SEQ ID NO: 3198558 - RNA, 20 nt, Mycobacterium bovis subsp bovis AF2122/97
gccgcacuguugcguagcgc

SEQ ID NO: 3198559 - RNA, 22 nt, Mycobacterium bovis subsp bovis AF2122/97
gccgcagaaucccaacuccucc

SEQ ID NO: 3198560 - RNA, 17 nt, Mycobacterium bovis subsp bovis AF2122/97
gccgcagagcaccgcga

SEQ ID NO: 3198561 - RNA, 23 nt, Mycobacterium bovis subsp bovis AF2122/97
gccgcagagcaccgcgaacagca

SEQ ID NO: 3198562 - RNA, 18 nt, Mycobacterium bovis subsp bovis AF2122/97
gccgcagaugcaccugcg

SEQ ID NO: 3198563 - RNA, 13 nt, Mycobacterium bovis subsp bovis AF2122/97
gccgcagaugggc

SEQ ID NO: 3198564 - RNA, 14 nt, Mycobacterium bovis subsp bovis AF2122/97
gccgcagcaccucg

SEQ ID NO: 3198565 - RNA, 21 nt, Mycobacterium bovis subsp bovis AF2122/97
gccgcagcaccucggucccgu

SEQ ID NO: 3198566 - RNA, 20 nt, Mycobacterium bovis subsp bovis AF2122/97
gccgcagcaccucgucgauc

SEQ ID NO: 3198567 - RNA, 12 nt, Mycobacterium bovis subsp bovis AF2122/97
gccgcagcaggg

SEQ ID NO: 3198568 - RNA, 14 nt, Mycobacterium bovis subsp bovis AF2122/97
gccgcagcaucccc

SEQ ID NO: 3198569 - RNA, 15 nt, Mycobacterium bovis subsp bovis AF2122/97
gccgcagccacgucu

SEQ ID NO: 3198570 - RNA, 12 nt, Mycobacterium bovis subsp bovis AF2122/97
gccgcagccagc

SEQ ID NO: 3198571 - RNA, 14 nt, Mycobacterium bovis subsp bovis AF2122/97
gccgcagccagcaa

SEQ ID NO: 3198572 - RNA, 21 nt, Mycobacterium bovis subsp bovis AF2122/97
gccgcagcccgugacugguga

SEQ ID NO: 3198573 - RNA, 11 nt, Mycobacterium bovis subsp bovis AF2122/97
gccgcagccgc

SEQ ID NO: 3198574 - RNA, 15 nt, Mycobacterium bovis subsp bovis AF2122/97
gccgcagccgcaggc

SEQ ID NO: 3198575 - RNA, 12 nt, Mycobacterium bovis subsp bovis AF2122/97
gccgcagccugc

SEQ ID NO: 3198576 - RNA, 14 nt, Mycobacterium bovis subsp bovis AF2122/97
gccgcagccugcaa

SEQ ID NO: 3198577 - RNA, 23 nt, Mycobacterium bovis subsp bovis AF2122/97
gccgcagcgaaaacccggucggc

SEQ ID NO: 3198578 - RNA, 24 nt, Mycobacterium bovis subsp bovis AF2122/97
gccgcagcgaaaacccggucggcg

SEQ ID NO: 3198579 - RNA, 12 nt, Mycobacterium bovis subsp bovis AF2122/97
gccgcagcggcc

SEQ ID NO: 3198580 - RNA, 13 nt, Mycobacterium bovis subsp bovis AF2122/97
gccgcagcggcca

SEQ ID NO: 3198581 - RNA, 15 nt, Mycobacterium bovis subsp bovis AF2122/97
gccgcagcggccagc

SEQ ID NO: 3198582 - RNA, 17 nt, Mycobacterium bovis subsp bovis AF2122/97
gccgcagcggccagccc

SEQ ID NO: 3198583 - RNA, 13 nt, Mycobacterium bovis subsp bovis AF2122/97
gccgcagcggccu

SEQ ID NO: 3198584 - RNA, 17 nt, Mycobacterium bovis subsp bovis AF2122/97
gccgcagcggcggcaac

SEQ ID NO: 3198585 - RNA, 16 nt, Mycobacterium bovis subsp bovis AF2122/97
gccgcagcgucguaac

SEQ ID NO: 3198586 - RNA, 18 nt, Mycobacterium bovis subsp bovis AF2122/97
gccgcagcgucguaaccg

SEQ ID NO: 3198587 - RNA, 14 nt, Mycobacterium bovis subsp bovis AF2122/97
gccgcagcugagcc

SEQ ID NO: 3198588 - RNA, 19 nt, Mycobacterium bovis subsp bovis AF2122/97
gccgcagcuuggccucagc

SEQ ID NO: 3198589 - RNA, 22 nt, Mycobacterium bovis subsp bovis AF2122/97
gccgcagcuuuaaucguggcac

SEQ ID NO: 3198590 - RNA, 17 nt, Mycobacterium bovis subsp bovis AF2122/97
gccgcaggaagucgagc

SEQ ID NO: 3198591 - RNA, 20 nt, Mycobacterium bovis subsp bovis AF2122/97
gccgcaggaagucgagcaga

SEQ ID NO: 3198592 - RNA, 16 nt, Mycobacterium bovis subsp bovis AF2122/97
gccgcaggccauggga

SEQ ID NO: 3198593 - RNA, 17 nt, Mycobacterium bovis subsp bovis AF2122/97
gccgcaggcgaacacca

SEQ ID NO: 3198594 - RNA, 20 nt, Mycobacterium bovis subsp bovis AF2122/97
gccgcaggcucucuuugagc

SEQ ID NO: 3198595 - RNA, 17 nt, Mycobacterium bovis subsp bovis AF2122/97
gccgcaggcuugccgau

SEQ ID NO: 3198596 - RNA, 20 nt, Mycobacterium bovis subsp bovis AF2122/97
gccgcagggccgcgcgcacu

SEQ ID NO: 3198597 - RNA, 22 nt, Mycobacterium bovis subsp bovis AF2122/97
gccgcaggugggcguuggcgac

SEQ ID NO: 3198598 - RNA, 19 nt, Mycobacterium bovis subsp bovis AF2122/97
gccgcauacacgagguagc

SEQ ID NO: 3198599 - RNA, 20 nt, Mycobacterium bovis subsp bovis AF2122/97
gccgcauaccaguaccguca

SEQ ID NO: 3198600 - RNA, 23 nt, Mycobacterium bovis subsp bovis AF2122/97
gccgcauaggccccgccagcgcc

SEQ ID NO: 3198601 - RNA, 15 nt, Mycobacterium bovis subsp bovis AF2122/97
gccgcauaucacccg

SEQ ID NO: 3198602 - RNA, 14 nt, Mycobacterium bovis subsp bovis AF2122/97
gccgcaucacccgg

SEQ ID NO: 3198603 - RNA, 15 nt, Mycobacterium bovis subsp bovis AF2122/97
gccgcauccagccgu

SEQ ID NO: 3198604 - RNA, 17 nt, Mycobacterium bovis subsp bovis AF2122/97
gccgcauccagccgugc

SEQ ID NO: 3198605 - RNA, 20 nt, Mycobacterium bovis subsp bovis AF2122/97
gccgcauccagccgugcggc

SEQ ID NO: 3198606 - RNA, 21 nt, Mycobacterium bovis subsp bovis AF2122/97
gccgcauccccgguacgucga

SEQ ID NO: 3198607 - RNA, 23 nt, Mycobacterium bovis subsp bovis AF2122/97
gccgcaucgacgcucaucucggg

SEQ ID NO: 3198608 - RNA, 16 nt, Mycobacterium bovis subsp bovis AF2122/97
gccgcaucgcccaaca

SEQ ID NO: 3198609 - RNA, 13 nt, Mycobacterium bovis subsp bovis AF2122/97
gccgcaucggcga

SEQ ID NO: 3198610 - RNA, 15 nt, Mycobacterium bovis subsp bovis AF2122/97
gccgcaucggcgaac

SEQ ID NO: 3198611 - RNA, 13 nt, Mycobacterium bovis subsp bovis AF2122/97
gccgcaucggcgg

SEQ ID NO: 3198612 - RNA, 22 nt, Mycobacterium bovis subsp bovis AF2122/97
gccgcaucgggcguacauucgg

SEQ ID NO: 3198613 - RNA, 15 nt, Mycobacterium bovis subsp bovis AF2122/97
gccgcaucgucgccg

SEQ ID NO: 3198614 - RNA, 17 nt, Mycobacterium bovis subsp bovis AF2122/97
gccgcaucgucgccgcg

SEQ ID NO: 3198615 - RNA, 18 nt, Mycobacterium bovis subsp bovis AF2122/97
gccgcaucgucgccgcgc

SEQ ID NO: 3198616 - RNA, 20 nt, Mycobacterium bovis subsp bovis AF2122/97
gccgcaucgucgccgcgcag

SEQ ID NO: 3198617 - RNA, 21 nt, Mycobacterium bovis subsp bovis AF2122/97
gccgcaucguuuucgccgauc

SEQ ID NO: 3198618 - RNA, 17 nt, Mycobacterium bovis subsp bovis AF2122/97
gccgcaucuggccggcg

SEQ ID NO: 3198619 - RNA, 18 nt, Mycobacterium bovis subsp bovis AF2122/97
gccgcaucuggccggcgg

SEQ ID NO: 3198620 - RNA, 19 nt, Mycobacterium bovis subsp bovis AF2122/97
gccgcaucuugucgagcac

SEQ ID NO: 3198621 - RNA, 20 nt, Mycobacterium bovis subsp bovis AF2122/97
gccgcaucuugucgagcacc

SEQ ID NO: 3198622 - RNA, 13 nt, Mycobacterium bovis subsp bovis AF2122/97
gccgcaugcgcuc

SEQ ID NO: 3198623 - RNA, 19 nt, Mycobacterium bovis subsp bovis AF2122/97
gccgcaugcgcuccggcgc

SEQ ID NO: 3198624 - RNA, 14 nt, Mycobacterium bovis subsp bovis AF2122/97
gccgcaugcucagc

SEQ ID NO: 3198625 - RNA, 18 nt, Mycobacterium bovis subsp bovis AF2122/97
gccgccauaccucggcga

SEQ ID NO: 3198626 - RNA, 19 nt, Mycobacterium bovis subsp bovis AF2122/97
gccgccauaccucggcgac

SEQ ID NO: 3198627 - RNA, 20 nt, Mycobacterium bovis subsp bovis AF2122/97
gccgccaucaacaaggggca

SEQ ID NO: 3198628 - RNA, 23 nt, Mycobacterium bovis subsp bovis AF2122/97
gccgccaucaacaaggggcagca

SEQ ID NO: 3198629 - RNA, 17 nt, Mycobacterium bovis subsp bovis AF2122/97
gccgccaucaccgccgu

SEQ ID NO: 3198630 - RNA, 15 nt, Mycobacterium bovis subsp bovis AF2122/97
gccgccaucagcccu

SEQ ID NO: 3198631 - RNA, 19 nt, Mycobacterium bovis subsp bovis AF2122/97
gccgccaucagccgcugcg

SEQ ID NO: 3198632 - RNA, 20 nt, Mycobacterium bovis subsp bovis AF2122/97
gccgccaucagccgcugcgu

SEQ ID NO: 3198633 - RNA, 13 nt, Mycobacterium bovis subsp bovis AF2122/97
gccgccaucaucg

SEQ ID NO: 3198634 - RNA, 20 nt, Mycobacterium bovis subsp bovis AF2122/97
gccgccaucaucgcuuggcc

SEQ ID NO: 3198635 - RNA, 20 nt, Mycobacterium bovis subsp bovis AF2122/97
gccgccauccccuggccagc

SEQ ID NO: 3198636 - RNA, 14 nt, Mycobacterium bovis subsp bovis AF2122/97
gccgccaucgccga

SEQ ID NO: 3198637 - RNA, 16 nt, Mycobacterium bovis subsp bovis AF2122/97
gccgccaucgccgaug

SEQ ID NO: 3198638 - RNA, 15 nt, Mycobacterium bovis subsp bovis AF2122/97
gccgccaucgccgcc

SEQ ID NO: 3198639 - RNA, 18 nt, Mycobacterium bovis subsp bovis AF2122/97
gccgccaucgccgccaac

SEQ ID NO: 3198640 - RNA, 17 nt, Mycobacterium bovis subsp bovis AF2122/97
gccgccaucgccgccgg

SEQ ID NO: 3198641 - RNA, 16 nt, Mycobacterium bovis subsp bovis AF2122/97
gccgccaucucguagg

SEQ ID NO: 3198642 - RNA, 14 nt, Mycobacterium bovis subsp bovis AF2122/97
gccgccaugcgcac

SEQ ID NO: 3198643 - RNA, 16 nt, Mycobacterium bovis subsp bovis AF2122/97
gccgccaugcgcacca

SEQ ID NO: 3198644 - RNA, 19 nt, Mycobacterium bovis subsp bovis AF2122/97
gccgccauguacaggcccc

SEQ ID NO: 3198645 - RNA, 16 nt, Mycobacterium bovis subsp bovis AF2122/97
gccgccauuccagccg

SEQ ID NO: 3198646 - RNA, 17 nt, Mycobacterium bovis subsp bovis AF2122/97
gccgccauuccagccgg

SEQ ID NO: 3198647 - RNA, 18 nt, Mycobacterium bovis subsp bovis AF2122/97
gccgccauuccagccggu

SEQ ID NO: 3198648 - RNA, 19 nt, Mycobacterium bovis subsp bovis AF2122/97
gccgccauuccagccggug

SEQ ID NO: 3198649 - RNA, 16 nt, Mycobacterium bovis subsp bovis AF2122/97
gccgccauugacgccg

SEQ ID NO: 3198650 - RNA, 19 nt, Mycobacterium bovis subsp bovis AF2122/97
gccgccauugacgccguug

SEQ ID NO: 3198651 - RNA, 21 nt, Mycobacterium bovis subsp bovis AF2122/97
gccgccauugacgccguugcc

SEQ ID NO: 3198652 - RNA, 13 nt, Mycobacterium bovis subsp bovis AF2122/97
gccgccauugcca

SEQ ID NO: 3198653 - RNA, 16 nt, Mycobacterium bovis subsp bovis AF2122/97
gccgccauugccauac

SEQ ID NO: 3198654 - RNA, 13 nt, Mycobacterium bovis subsp bovis AF2122/97
gccgccauugccg

SEQ ID NO: 3198655 - RNA, 17 nt, Mycobacterium bovis subsp bovis AF2122/97
gccgccauugccgccgg

SEQ ID NO: 3198656 - RNA, 18 nt, Mycobacterium bovis subsp bovis AF2122/97
gccgccauuggacagcgc

SEQ ID NO: 3198657 - RNA, 22 nt, Mycobacterium bovis subsp bovis AF2122/97
gccgccauuggacagcgcgaga

SEQ ID NO: 3198658 - RNA, 13 nt, Mycobacterium bovis subsp bovis AF2122/97
gccgccauuggcu

SEQ ID NO: 3198659 - RNA, 14 nt, Mycobacterium bovis subsp bovis AF2122/97
gccgcccaaagaaa

SEQ ID NO: 3198660 - RNA, 17 nt, Mycobacterium bovis subsp bovis AF2122/97
gccgcccaacgcgagcu

SEQ ID NO: 3198661 - RNA, 17 nt, Mycobacterium bovis subsp bovis AF2122/97
gccgcccaagccgccgg

SEQ ID NO: 3198662 - RNA, 17 nt, Mycobacterium bovis subsp bovis AF2122/97
gccgcccaauccaccga

SEQ ID NO: 3198663 - RNA, 20 nt, Mycobacterium bovis subsp bovis AF2122/97
gccgcccaauugccuccgcu

SEQ ID NO: 3198664 - RNA, 15 nt, Mycobacterium bovis subsp bovis AF2122/97
gccgcccacggggcg

SEQ ID NO: 3198665 - RNA, 18 nt, Mycobacterium bovis subsp bovis AF2122/97
gccgcccagaccgccgac

SEQ ID NO: 3198666 - RNA, 11 nt, Mycobacterium bovis subsp bovis AF2122/97
gccgcccagcg

SEQ ID NO: 3198667 - RNA, 13 nt, Mycobacterium bovis subsp bovis AF2122/97
gccgcccagcgga

SEQ ID NO: 3198668 - RNA, 13 nt, Mycobacterium bovis subsp bovis AF2122/97
gccgcccaggagc

SEQ ID NO: 3198669 - RNA, 12 nt, Mycobacterium bovis subsp bovis AF2122/97
gccgcccaucac

SEQ ID NO: 3198670 - RNA, 17 nt, Mycobacterium bovis subsp bovis AF2122/97
gccgcccaucaccccga

SEQ ID NO: 3198671 - RNA, 19 nt, Mycobacterium bovis subsp bovis AF2122/97
gccgcccccgccggccgcg

SEQ ID NO: 3198672 - RNA, 20 nt, Mycobacterium bovis subsp bovis AF2122/97
gccgcccccgccggccgcgc

SEQ ID NO: 3198673 - RNA, 22 nt, Mycobacterium bovis subsp bovis AF2122/97
gccgccccgauaaaaaccaccc

SEQ ID NO: 3198674 - RNA, 14 nt, Mycobacterium bovis subsp bovis AF2122/97
gccgccccgcucgg

SEQ ID NO: 3198675 - RNA, 15 nt, Mycobacterium bovis subsp bovis AF2122/97
gccgccccgcucggu

SEQ ID NO: 3198676 - RNA, 11 nt, Mycobacterium bovis subsp bovis AF2122/97
gccgccccggc

SEQ ID NO: 3198677 - RNA, 14 nt, Mycobacterium bovis subsp bovis AF2122/97
gccgccccggccgc

SEQ ID NO: 3198678 - RNA, 16 nt, Mycobacterium bovis subsp bovis AF2122/97
gccgccccggccgcug

SEQ ID NO: 3198679 - RNA, 13 nt, Mycobacterium bovis subsp bovis AF2122/97
gccgccccggcgc

SEQ ID NO: 3198680 - RNA, 14 nt, Mycobacterium bovis subsp bovis AF2122/97
gccgccccggcgcu

SEQ ID NO: 3198681 - RNA, 15 nt, Mycobacterium bovis subsp bovis AF2122/97
gccgccccggcgcug

SEQ ID NO: 3198682 - RNA, 16 nt, Mycobacterium bovis subsp bovis AF2122/97
gccgccccggcgcugg

SEQ ID NO: 3198683 - RNA, 22 nt, Mycobacterium bovis subsp bovis AF2122/97
gccgccccggcgcuggugcgcc

SEQ ID NO: 3198684 - RNA, 17 nt, Mycobacterium bovis subsp bovis AF2122/97
gccgccccugcgcggcc

SEQ ID NO: 3198685 - RNA, 15 nt, Mycobacterium bovis subsp bovis AF2122/97
gccgcccgagccggu

SEQ ID NO: 3198686 - RNA, 22 nt, Mycobacterium bovis subsp bovis AF2122/97
gccgcccgaguuguggacgccc

SEQ ID NO: 3198687 - RNA, 19 nt, Mycobacterium bovis subsp bovis AF2122/97
gccgcccgcagggccgccg

SEQ ID NO: 3198688 - RNA, 20 nt, Mycobacterium bovis subsp bovis AF2122/97
gccgcccgcagggccgccgc

SEQ ID NO: 3198689 - RNA, 14 nt, Mycobacterium bovis subsp bovis AF2122/97
gccgcccgcaucgc

SEQ ID NO: 3198690 - RNA, 18 nt, Mycobacterium bovis subsp bovis AF2122/97
gccgcccgcccaccucga

SEQ ID NO: 3198691 - RNA, 16 nt, Mycobacterium bovis subsp bovis AF2122/97
gccgcccgcccggacg

SEQ ID NO: 3198692 - RNA, 22 nt, Mycobacterium bovis subsp bovis AF2122/97
gccgcccgcccggacgcaacac

SEQ ID NO: 3198693 - RNA, 19 nt, Mycobacterium bovis subsp bovis AF2122/97
gccgcccgcgccaccgaua

SEQ ID NO: 3198694 - RNA, 17 nt, Mycobacterium bovis subsp bovis AF2122/97
gccgcccgcgccgccgc

SEQ ID NO: 3198695 - RNA, 18 nt, Mycobacterium bovis subsp bovis AF2122/97
gccgcccgcgccgccgcc

SEQ ID NO: 3198696 - RNA, 18 nt, Mycobacterium bovis subsp bovis AF2122/97
gccgcccgcgccgccgcu

SEQ ID NO: 3198697 - RNA, 23 nt, Mycobacterium bovis subsp bovis AF2122/97
gccgcccgcgccgccgcuacccc

SEQ ID NO: 3198698 - RNA, 13 nt, Mycobacterium bovis subsp bovis AF2122/97
gccgcccgcuccg

SEQ ID NO: 3198699 - RNA, 15 nt, Mycobacterium bovis subsp bovis AF2122/97
gccgcccgcuccgcc

SEQ ID NO: 3198700 - RNA, 22 nt, Mycobacterium bovis subsp bovis AF2122/97
gccgcccgcuccgccgucgccg

SEQ ID NO: 3198701 - RNA, 12 nt, Mycobacterium bovis subsp bovis AF2122/97
gccgcccggcga

SEQ ID NO: 3198702 - RNA, 23 nt, Mycobacterium bovis subsp bovis AF2122/97
gccgcccggcgagcagggcgucg

SEQ ID NO: 3198703 - RNA, 13 nt, Mycobacterium bovis subsp bovis AF2122/97
gccgcccgggcga

SEQ ID NO: 3198704 - RNA, 15 nt, Mycobacterium bovis subsp bovis AF2122/97
gccgcccggucgggc

SEQ ID NO: 3198705 - RNA, 18 nt, Mycobacterium bovis subsp bovis AF2122/97
gccgcccggucgggcgcg

SEQ ID NO: 3198706 - RNA, 16 nt, Mycobacterium bovis subsp bovis AF2122/97
gccgcccgugccgccc

SEQ ID NO: 3198707 - RNA, 17 nt, Mycobacterium bovis subsp bovis AF2122/97
gccgcccucaccgccug

SEQ ID NO: 3198708 - RNA, 15 nt, Mycobacterium bovis subsp bovis AF2122/97
gccgcccuccgacgg

SEQ ID NO: 3198709 - RNA, 21 nt, Mycobacterium bovis subsp bovis AF2122/97
gccgcccucucacggcgguag

SEQ ID NO: 3198710 - RNA, 18 nt, Mycobacterium bovis subsp bovis AF2122/97
gccgcccuggacgucggc

SEQ ID NO: 3198711 - RNA, 20 nt, Mycobacterium bovis subsp bovis AF2122/97
gccgcccuggacgucggcga

SEQ ID NO: 3198712 - RNA, 18 nt, Mycobacterium bovis subsp bovis AF2122/97
gccgccgcggccaccacc

SEQ ID NO: 3198713 - RNA, 19 nt, Mycobacterium bovis subsp bovis AF2122/97
gccgccgcggccaccaccg

SEQ ID NO: 3198714 - RNA, 17 nt, Mycobacterium bovis subsp bovis AF2122/97
gccgccgcggccggcgc

SEQ ID NO: 3198715 - RNA, 12 nt, Mycobacterium bovis subsp bovis AF2122/97
gccgccgcggcg

SEQ ID NO: 3198716 - RNA, 13 nt, Mycobacterium bovis subsp bovis AF2122/97
gccgccgcggcga

SEQ ID NO: 3198717 - RNA, 16 nt, Mycobacterium bovis subsp bovis AF2122/97
gccgccgcggcgaagc

SEQ ID NO: 3198718 - RNA, 15 nt, Mycobacterium bovis subsp bovis AF2122/97
gccgccgcggcgccc

SEQ ID NO: 3198719 - RNA, 13 nt, Mycobacterium bovis subsp bovis AF2122/97
gccgccgcgggac

SEQ ID NO: 3198720 - RNA, 19 nt, Mycobacterium bovis subsp bovis AF2122/97
gccgccgcgggacaccacc

SEQ ID NO: 3198721 - RNA, 22 nt, Mycobacterium bovis subsp bovis AF2122/97
gccgccgcgggacaccaccgcc

SEQ ID NO: 3198722 - RNA, 13 nt, Mycobacterium bovis subsp bovis AF2122/97
gccgccgcgggcg

SEQ ID NO: 3198723 - RNA, 14 nt, Mycobacterium bovis subsp bovis AF2122/97
gccgccgcgucgac

SEQ ID NO: 3198724 - RNA, 20 nt, Mycobacterium bovis subsp bovis AF2122/97
gccgccgcguuucggucguu

SEQ ID NO: 3198725 - RNA, 17 nt, Mycobacterium bovis subsp bovis AF2122/97
gccgccgcuacccccga

SEQ ID NO: 3198726 - RNA, 18 nt, Mycobacterium bovis subsp bovis AF2122/97
gccgccgcuacccccgau

SEQ ID NO: 3198727 - RNA, 22 nt, Mycobacterium bovis subsp bovis AF2122/97
gccgccgcuacccccgauggcg

SEQ ID NO: 3198728 - RNA, 17 nt, Mycobacterium bovis subsp bovis AF2122/97
gccgccgcuaccgccgg

SEQ ID NO: 3198729 - RNA, 15 nt, Mycobacterium bovis subsp bovis AF2122/97
gccgccgcugccgcc

SEQ ID NO: 3198730 - RNA, 16 nt, Mycobacterium bovis subsp bovis AF2122/97
gccgccgcugccgccc

SEQ ID NO: 3198731 - RNA, 13 nt, Mycobacterium bovis subsp bovis AF2122/97
gccgccgcuggug

SEQ ID NO: 3198732 - RNA, 14 nt, Mycobacterium bovis subsp bovis AF2122/97
gccgccgcuucacc

SEQ ID NO: 3198733 - RNA, 19 nt, Mycobacterium bovis subsp bovis AF2122/97
gccgccgcuuucgccggcg

SEQ ID NO: 3198734 - RNA, 18 nt, Mycobacterium bovis subsp bovis AF2122/97
gccgccggaagcgccggc

SEQ ID NO: 3198735 - RNA, 23 nt, Mycobacterium bovis subsp bovis AF2122/97
gccgccggaagcgccggccgauc

SEQ ID NO: 3198736 - RNA, 24 nt, Mycobacterium bovis subsp bovis AF2122/97
gccgccggaagcgccggccgaucg

SEQ ID NO: 3198737 - RNA, 17 nt, Mycobacterium bovis subsp bovis AF2122/97
gccgccggaaucgagac

SEQ ID NO: 3198738 - RNA, 12 nt, Mycobacterium bovis subsp bovis AF2122/97
gccgccggaccc

SEQ ID NO: 3198739 - RNA, 19 nt, Mycobacterium bovis subsp bovis AF2122/97
gccgccggacccaccguca

SEQ ID NO: 3198740 - RNA, 21 nt, Mycobacterium bovis subsp bovis AF2122/97
gccgccggacccaccgucacc

SEQ ID NO: 3198741 - RNA, 14 nt, Mycobacterium bovis subsp bovis AF2122/97
gccgccggacccgu

SEQ ID NO: 3198742 - RNA, 21 nt, Mycobacterium bovis subsp bovis AF2122/97
gccgccggacccgucgagcag

SEQ ID NO: 3198743 - RNA, 13 nt, Mycobacterium bovis subsp bovis AF2122/97
gccgccggagauc

SEQ ID NO: 3198744 - RNA, 14 nt, Mycobacterium bovis subsp bovis AF2122/97
gccgccggaguugg

SEQ ID NO: 3198745 - RNA, 18 nt, Mycobacterium bovis subsp bovis AF2122/97
gccgccggaucgccggug

SEQ ID NO: 3198746 - RNA, 19 nt, Mycobacterium bovis subsp bovis AF2122/97
gccgccggaucgccgguga

SEQ ID NO: 3198747 - RNA, 23 nt, Mycobacterium bovis subsp bovis AF2122/97
gccgccggcaacccagugucagc

SEQ ID NO: 3198748 - RNA, 13 nt, Mycobacterium bovis subsp bovis AF2122/97
gccgccggcaccc

SEQ ID NO: 3198749 - RNA, 14 nt, Mycobacterium bovis subsp bovis AF2122/97
gccgccggcacccg

SEQ ID NO: 3198750 - RNA, 19 nt, Mycobacterium bovis subsp bovis AF2122/97
gccgccggcacccgccgug

SEQ ID NO: 3198751 - RNA, 21 nt, Mycobacterium bovis subsp bovis AF2122/97
gccgccggcacccgccgugcc

SEQ ID NO: 3198752 - RNA, 20 nt, Mycobacterium bovis subsp bovis AF2122/97
gccgccggcaccgccggcgc

SEQ ID NO: 3198753 - RNA, 22 nt, Mycobacterium bovis subsp bovis AF2122/97
gccgccggcaccgccggcgcca

SEQ ID NO: 3198754 - RNA, 16 nt, Mycobacterium bovis subsp bovis AF2122/97
gccgccggcaccgggg

SEQ ID NO: 3198755 - RNA, 23 nt, Mycobacterium bovis subsp bovis AF2122/97
gccgccggccaguccgcgcgcaa

SEQ ID NO: 3198756 - RNA, 12 nt, Mycobacterium bovis subsp bovis AF2122/97
gccgccggccau

SEQ ID NO: 3198757 - RNA, 14 nt, Mycobacterium bovis subsp bovis AF2122/97
gccgccggccccgc

SEQ ID NO: 3198758 - RNA, 15 nt, Mycobacterium bovis subsp bovis AF2122/97
gccgccggccccgcc

SEQ ID NO: 3198759 - RNA, 16 nt, Mycobacterium bovis subsp bovis AF2122/97
gccgccggccccgcca

SEQ ID NO: 3198760 - RNA, 17 nt, Mycobacterium bovis subsp bovis AF2122/97
gccgccggccccgccga

SEQ ID NO: 3198761 - RNA, 23 nt, Mycobacterium bovis subsp bovis AF2122/97
gccgccggccccgccguuuccgc

SEQ ID NO: 3198762 - RNA, 12 nt, Mycobacterium bovis subsp bovis AF2122/97
gccgccggccgc

SEQ ID NO: 3198763 - RNA, 14 nt, Mycobacterium bovis subsp bovis AF2122/97
gccgccggccgcca

SEQ ID NO: 3198764 - RNA, 16 nt, Mycobacterium bovis subsp bovis AF2122/97
gccgccggccgccagc

SEQ ID NO: 3198765 - RNA, 18 nt, Mycobacterium bovis subsp bovis AF2122/97
gccgccggccgccagcgc

SEQ ID NO: 3198766 - RNA, 19 nt, Mycobacterium bovis subsp bovis AF2122/97
gccgccggccgccagcgca

SEQ ID NO: 3198767 - RNA, 12 nt, Mycobacterium bovis subsp bovis AF2122/97
gccgccggcgaa

SEQ ID NO: 3198768 - RNA, 11 nt, Mycobacterium bovis subsp bovis AF2122/97
gccgccggcgc

SEQ ID NO: 3198769 - RNA, 15 nt, Mycobacterium bovis subsp bovis AF2122/97
gccgccggcgccacc

SEQ ID NO: 3198770 - RNA, 18 nt, Mycobacterium bovis subsp bovis AF2122/97
gccgccggcgccaccguu

SEQ ID NO: 3198771 - RNA, 18 nt, Mycobacterium bovis subsp bovis AF2122/97
gccgccggcgccagcgcc

SEQ ID NO: 3198772 - RNA, 13 nt, Mycobacterium bovis subsp bovis AF2122/97
gccgccggcgccc

SEQ ID NO: 3198773 - RNA, 18 nt, Mycobacterium bovis subsp bovis AF2122/97
gccgccggcgcccaggcc

SEQ ID NO: 3198774 - RNA, 21 nt, Mycobacterium bovis subsp bovis AF2122/97
gccgccggcgcccaggccgau

SEQ ID NO: 3198775 - RNA, 15 nt, Mycobacterium bovis subsp bovis AF2122/97
gccgccggcgccgaa

SEQ ID NO: 3198776 - RNA, 14 nt, Mycobacterium bovis subsp bovis AF2122/97
gccgccggcgccgc

SEQ ID NO: 3198777 - RNA, 15 nt, Mycobacterium bovis subsp bovis AF2122/97
gccgccggcgccgcc

SEQ ID NO: 3198778 - RNA, 16 nt, Mycobacterium bovis subsp bovis AF2122/97
gccgccggcgccgccc

SEQ ID NO: 3198779 - RNA, 17 nt, Mycobacterium bovis subsp bovis AF2122/97
gccgccggcgccgccgg

SEQ ID NO: 3198780 - RNA, 15 nt, Mycobacterium bovis subsp bovis AF2122/97
gccgccggcgccgga

SEQ ID NO: 3198781 - RNA, 20 nt, Mycobacterium bovis subsp bovis AF2122/97
gccgccggcgccggcgcugc

SEQ ID NO: 3198782 - RNA, 12 nt, Mycobacterium bovis subsp bovis AF2122/97
gccgccggcgcg

SEQ ID NO: 3198783 - RNA, 15 nt, Mycobacterium bovis subsp bovis AF2122/97
gccgccggcgcguag

SEQ ID NO: 3198784 - RNA, 12 nt, Mycobacterium bovis subsp bovis AF2122/97
gccgccggcgcu

SEQ ID NO: 3198785 - RNA, 21 nt, Mycobacterium bovis subsp bovis AF2122/97
gccgccggcgcugaucgcgaa

SEQ ID NO: 3198786 - RNA, 15 nt, Mycobacterium bovis subsp bovis AF2122/97
gccgccggcgcuggc

SEQ ID NO: 3198787 - RNA, 16 nt, Mycobacterium bovis subsp bovis AF2122/97
gccgccggcgcuggcg

SEQ ID NO: 3198788 - RNA, 17 nt, Mycobacterium bovis subsp bovis AF2122/97
gccgccggcggucgcgu

SEQ ID NO: 3198789 - RNA, 14 nt, Mycobacterium bovis subsp bovis AF2122/97
gccgccggcuccac

SEQ ID NO: 3198790 - RNA, 17 nt, Mycobacterium bovis subsp bovis AF2122/97
gccgccggcuccacccu

SEQ ID NO: 3198791 - RNA, 22 nt, Mycobacterium bovis subsp bovis AF2122/97
gccgccgggauaacccagcacc

SEQ ID NO: 3198792 - RNA, 12 nt, Mycobacterium bovis subsp bovis AF2122/97
gccgccgggcag

SEQ ID NO: 3198793 - RNA, 15 nt, Mycobacterium bovis subsp bovis AF2122/97
gccgccgggcaguuc

SEQ ID NO: 3198794 - RNA, 21 nt, Mycobacterium bovis subsp bovis AF2122/97
gccgccgggcaguucaacgag

SEQ ID NO: 3198795 - RNA, 15 nt, Mycobacterium bovis subsp bovis AF2122/97
gccgccgggggacga

SEQ ID NO: 3198796 - RNA, 16 nt, Mycobacterium bovis subsp bovis AF2122/97
gccgccgggugcgccg

SEQ ID NO: 3198797 - RNA, 21 nt, Mycobacterium bovis subsp bovis AF2122/97
gccgccgggugcgccguugcc

SEQ ID NO: 3198798 - RNA, 11 nt, Mycobacterium bovis subsp bovis AF2122/97
gccgccggugc

SEQ ID NO: 3198799 - RNA, 18 nt, Mycobacterium bovis subsp bovis AF2122/97
gccgccucgucgucggac

SEQ ID NO: 3198800 - RNA, 19 nt, Mycobacterium bovis subsp bovis AF2122/97
gccgccugcccggcccgcu

SEQ ID NO: 3198801 - RNA, 21 nt, Mycobacterium bovis subsp bovis AF2122/97
gccgccugcuccucggccagc

SEQ ID NO: 3198802 - RNA, 19 nt, Mycobacterium bovis subsp bovis AF2122/97
gccgccuggacgccgccgg

SEQ ID NO: 3198803 - RNA, 18 nt, Mycobacterium bovis subsp bovis AF2122/97
gccgccuggguugaccgc

SEQ ID NO: 3198804 - RNA, 20 nt, Mycobacterium bovis subsp bovis AF2122/97
gccgccugguaccgcggugu

SEQ ID NO: 3198805 - RNA, 14 nt, Mycobacterium bovis subsp bovis AF2122/97
gccgccugucccgc

SEQ ID NO: 3198806 - RNA, 16 nt, Mycobacterium bovis subsp bovis AF2122/97
gccgccugucccgccg

SEQ ID NO: 3198807 - RNA, 17 nt, Mycobacterium bovis subsp bovis AF2122/97
gccgccugucccgccgg

SEQ ID NO: 3198808 - RNA, 18 nt, Mycobacterium bovis subsp bovis AF2122/97
gccgccugucccgccggc

SEQ ID NO: 3198809 - RNA, 19 nt, Mycobacterium bovis subsp bovis AF2122/97
gccgccugucccgccggcc

SEQ ID NO: 3198810 - RNA, 14 nt, Mycobacterium bovis subsp bovis AF2122/97
gccgccugucgggc

SEQ ID NO: 3198811 - RNA, 18 nt, Mycobacterium bovis subsp bovis AF2122/97
gccgccuuccuggcgggc

SEQ ID NO: 3198812 - RNA, 19 nt, Mycobacterium bovis subsp bovis AF2122/97
gccgccuuccuggcgggcg

SEQ ID NO: 3198813 - RNA, 22 nt, Mycobacterium bovis subsp bovis AF2122/97
gccgccuuccuggcgggcgccu

SEQ ID NO: 3198814 - RNA, 16 nt, Mycobacterium bovis subsp bovis AF2122/97
gccgccuucucgcgaa

SEQ ID NO: 3198815 - RNA, 15 nt, Mycobacterium bovis subsp bovis AF2122/97
gccgccuucuucucg

SEQ ID NO: 3198816 - RNA, 17 nt, Mycobacterium bovis subsp bovis AF2122/97
gccgccuucuuggcggc

SEQ ID NO: 3198817 - RNA, 13 nt, Mycobacterium bovis subsp bovis AF2122/97
gccgccuuggccc

SEQ ID NO: 3198818 - RNA, 17 nt, Mycobacterium bovis subsp bovis AF2122/97
gccgccuuggcccccgg

SEQ ID NO: 3198819 - RNA, 20 nt, Mycobacterium bovis subsp bovis AF2122/97
gccgccuuggucgcgucggc

SEQ ID NO: 3198820 - RNA, 17 nt, Mycobacterium bovis subsp bovis AF2122/97
gccgcgaaacccugaaa

SEQ ID NO: 3198821 - RNA, 23 nt, Mycobacterium bovis subsp bovis AF2122/97
gccgcgaaauuacuucggccaca

SEQ ID NO: 3198822 - RNA, 18 nt, Mycobacterium bovis subsp bovis AF2122/97
gccgcgaacuccagcagc

SEQ ID NO: 3198823 - RNA, 21 nt, Mycobacterium bovis subsp bovis AF2122/97
gccgcgaacuccagcagcccg

SEQ ID NO: 3198824 - RNA, 22 nt, Mycobacterium bovis subsp bovis AF2122/97
gccgcgaacuccagcagcccgg

SEQ ID NO: 3198825 - RNA, 17 nt, Mycobacterium bovis subsp bovis AF2122/97
gccgcgaagcgcucggc

SEQ ID NO: 3198826 - RNA, 22 nt, Mycobacterium bovis subsp bovis AF2122/97
gccgcgaagcgcucggcagccg

SEQ ID NO: 3198827 - RNA, 21 nt, Mycobacterium bovis subsp bovis AF2122/97
gccgcgaaggggugcccggcg

SEQ ID NO: 3198828 - RNA, 23 nt, Mycobacterium bovis subsp bovis AF2122/97
gccgcgaaggggugcccggcggc

SEQ ID NO: 3198829 - RNA, 23 nt, Mycobacterium bovis subsp bovis AF2122/97
gccgcgaaugaagcccucgucgg

SEQ ID NO: 3198830 - RNA, 17 nt, Mycobacterium bovis subsp bovis AF2122/97
gccgcgaaugucgccgc

SEQ ID NO: 3198831 - RNA, 19 nt, Mycobacterium bovis subsp bovis AF2122/97
gccgcgaaugucgccgccu

SEQ ID NO: 3198832 - RNA, 22 nt, Mycobacterium bovis subsp bovis AF2122/97
gccgcgacaaaucggucgacga

SEQ ID NO: 3198833 - RNA, 22 nt, Mycobacterium bovis subsp bovis AF2122/97
gccgcgacaauggugcccagga

SEQ ID NO: 3198834 - RNA, 17 nt, Mycobacterium bovis subsp bovis AF2122/97
gccgcgacacgugcauc

SEQ ID NO: 3198835 - RNA, 16 nt, Mycobacterium bovis subsp bovis AF2122/97
gccgcgacauccgcgg

SEQ ID NO: 3198836 - RNA, 18 nt, Mycobacterium bovis subsp bovis AF2122/97
gccgcgacauccgcggca

SEQ ID NO: 3198837 - RNA, 16 nt, Mycobacterium bovis subsp bovis AF2122/97
gccgcgaccacgcacc

SEQ ID NO: 3198838 - RNA, 17 nt, Mycobacterium bovis subsp bovis AF2122/97
gccgcgaccacgcaccg

SEQ ID NO: 3198839 - RNA, 14 nt, Mycobacterium bovis subsp bovis AF2122/97
gccgcgaccagcgc

SEQ ID NO: 3198840 - RNA, 16 nt, Mycobacterium bovis subsp bovis AF2122/97
gccgcgaccagcgccg

SEQ ID NO: 3198841 - RNA, 19 nt, Mycobacterium bovis subsp bovis AF2122/97
gccgcgaccagcgccgcac

SEQ ID NO: 3198842 - RNA, 14 nt, Mycobacterium bovis subsp bovis AF2122/97
gccgcgacccgcgc

SEQ ID NO: 3198843 - RNA, 20 nt, Mycobacterium bovis subsp bovis AF2122/97
gccgcgacccgcgcaaucag

SEQ ID NO: 3198844 - RNA, 20 nt, Mycobacterium bovis subsp bovis AF2122/97
gccgcgaccgccucgccgua

SEQ ID NO: 3198845 - RNA, 15 nt, Mycobacterium bovis subsp bovis AF2122/97
gccgcgaccgcgagc

SEQ ID NO: 3198846 - RNA, 21 nt, Mycobacterium bovis subsp bovis AF2122/97
gccgcgaccgcgagcaucugg

SEQ ID NO: 3198847 - RNA, 18 nt, Mycobacterium bovis subsp bovis AF2122/97
gccgcgacgacacgccug

SEQ ID NO: 3198848 - RNA, 23 nt, Mycobacterium bovis subsp bovis AF2122/97
gccgcgacgaugccucggcggcc

SEQ ID NO: 3198849 - RNA, 20 nt, Mycobacterium bovis subsp bovis AF2122/97
gccgcgacgcacugccccgc

SEQ ID NO: 3198850 - RNA, 21 nt, Mycobacterium bovis subsp bovis AF2122/97
gccgcgacgcacugccccgca

SEQ ID NO: 3198851 - RNA, 14 nt, Mycobacterium bovis subsp bovis AF2122/97
gccgcgacgcggcg

SEQ ID NO: 3198852 - RNA, 16 nt, Mycobacterium bovis subsp bovis AF2122/97
gccgcgacgcggcguc

SEQ ID NO: 3198853 - RNA, 17 nt, Mycobacterium bovis subsp bovis AF2122/97
gccgcgacgggcacccg

SEQ ID NO: 3198854 - RNA, 13 nt, Mycobacterium bovis subsp bovis AF2122/97
gccgcgacugcac

SEQ ID NO: 3198855 - RNA, 14 nt, Mycobacterium bovis subsp bovis AF2122/97
gccgcgagagccgg

SEQ ID NO: 3198856 - RNA, 20 nt, Mycobacterium bovis subsp bovis AF2122/97
gccgcgagagccggcggcga

SEQ ID NO: 3198857 - RNA, 12 nt, Mycobacterium bovis subsp bovis AF2122/97
gccgcgagcacg

SEQ ID NO: 3198858 - RNA, 21 nt, Mycobacterium bovis subsp bovis AF2122/97
gccgcgagcacgucggggugc

SEQ ID NO: 3198859 - RNA, 14 nt, Mycobacterium bovis subsp bovis AF2122/97
gccgcgagcgccgg

SEQ ID NO: 3198860 - RNA, 13 nt, Mycobacterium bovis subsp bovis AF2122/97
gccgcgaggaugc

SEQ ID NO: 3198861 - RNA, 20 nt, Mycobacterium bovis subsp bovis AF2122/97
gccgcgaggaugcugagcgc

SEQ ID NO: 3198862 - RNA, 22 nt, Mycobacterium bovis subsp bovis AF2122/97
gccgcgaggaugcugagcgcca

SEQ ID NO: 3198863 - RNA, 22 nt, Mycobacterium bovis subsp bovis AF2122/97
gccgcgagguacccaucgucga

SEQ ID NO: 3198864 - RNA, 22 nt, Mycobacterium bovis subsp bovis AF2122/97
gccgcgaggugaaucgcgucga

SEQ ID NO: 3198865 - RNA, 18 nt, Mycobacterium bovis subsp bovis AF2122/97
gccgcgaguccaggcuga

SEQ ID NO: 3198866 - RNA, 22 nt, Mycobacterium bovis subsp bovis AF2122/97
gccgcgaucccggccgucgccg

SEQ ID NO: 3198867 - RNA, 14 nt, Mycobacterium bovis subsp bovis AF2122/97
gccgcgaucgacgg

SEQ ID NO: 3198868 - RNA, 17 nt, Mycobacterium bovis subsp bovis AF2122/97
gccgcgaucgacggugu

SEQ ID NO: 3198869 - RNA, 22 nt, Mycobacterium bovis subsp bovis AF2122/97
gccgcgaucgaggagaugccga

SEQ ID NO: 3198870 - RNA, 12 nt, Mycobacterium bovis subsp bovis AF2122/97
gccgcgaucggg

SEQ ID NO: 3198871 - RNA, 18 nt, Mycobacterium bovis subsp bovis AF2122/97
gccgcgaucgggcccagc

SEQ ID NO: 3198872 - RNA, 21 nt, Mycobacterium bovis subsp bovis AF2122/97
gccgcgaucgggcccagcagc

SEQ ID NO: 3198873 - RNA, 22 nt, Mycobacterium bovis subsp bovis AF2122/97
gccgcgaucgggcccagcagcg

SEQ ID NO: 3198874 - RNA, 14 nt, Mycobacterium bovis subsp bovis AF2122/97
gccgcgaucgugca

SEQ ID NO: 3198875 - RNA, 16 nt, Mycobacterium bovis subsp bovis AF2122/97
gccgcgaucgugcagg

SEQ ID NO: 3198876 - RNA, 21 nt, Mycobacterium bovis subsp bovis AF2122/97
gccgcgaucuccuuggccguu

SEQ ID NO: 3198877 - RNA, 22 nt, Mycobacterium bovis subsp bovis AF2122/97
gccgcgaugacgaccgaucggc

SEQ ID NO: 3198878 - RNA, 16 nt, Mycobacterium bovis subsp bovis AF2122/97
gccgcgaugacggugc

SEQ ID NO: 3198879 - RNA, 17 nt, Mycobacterium bovis subsp bovis AF2122/97
gccgcgaugacggugcc

SEQ ID NO: 3198880 - RNA, 20 nt, Mycobacterium bovis subsp bovis AF2122/97
gccgcgaugacggugccgac

SEQ ID NO: 3198881 - RNA, 17 nt, Mycobacterium bovis subsp bovis AF2122/97
gccgcgaugagcggcgc

SEQ ID NO: 3198882 - RNA, 18 nt, Mycobacterium bovis subsp bovis AF2122/97
gccgcgaugagcggcgcg

SEQ ID NO: 3198883 - RNA, 12 nt, Mycobacterium bovis subsp bovis AF2122/97
gccgcgauggcg

SEQ ID NO: 3198884 - RNA, 16 nt, Mycobacterium bovis subsp bovis AF2122/97
gccgcgauggcguagc

SEQ ID NO: 3198885 - RNA, 16 nt, Mycobacterium bovis subsp bovis AF2122/97
gccgcggagaaggcgc

SEQ ID NO: 3198886 - RNA, 21 nt, Mycobacterium bovis subsp bovis AF2122/97
gccgcggagaaggcgcgggcg

SEQ ID NO: 3198887 - RNA, 17 nt, Mycobacterium bovis subsp bovis AF2122/97
gccgcggaggcggccag

SEQ ID NO: 3198888 - RNA, 18 nt, Mycobacterium bovis subsp bovis AF2122/97
gccgcggaggcggccagc

SEQ ID NO: 3198889 - RNA, 22 nt, Mycobacterium bovis subsp bovis AF2122/97
gccgcggaucauccuucgccgg

SEQ ID NO: 3198890 - RNA, 19 nt, Mycobacterium bovis subsp bovis AF2122/97
gccgcggaugcucagguca

SEQ ID NO: 3198891 - RNA, 16 nt, Mycobacterium bovis subsp bovis AF2122/97
gccgcggcaacaccac

SEQ ID NO: 3198892 - RNA, 21 nt, Mycobacterium bovis subsp bovis AF2122/97
gccgcggcaacaccaccucga

SEQ ID NO: 3198893 - RNA, 16 nt, Mycobacterium bovis subsp bovis AF2122/97
gccgcggcacccaggu

SEQ ID NO: 3198894 - RNA, 12 nt, Mycobacterium bovis subsp bovis AF2122/97
gccgcggcaccg

SEQ ID NO: 3198895 - RNA, 16 nt, Mycobacterium bovis subsp bovis AF2122/97
gccgcggcaccgccga

SEQ ID NO: 3198896 - RNA, 19 nt, Mycobacterium bovis subsp bovis AF2122/97
gccgcggcaccgccgagca

SEQ ID NO: 3198897 - RNA, 23 nt, Mycobacterium bovis subsp bovis AF2122/97
gccgcggcaccgccgagcagacg

SEQ ID NO: 3198898 - RNA, 17 nt, Mycobacterium bovis subsp bovis AF2122/97
gccgcggcagggcggug

SEQ ID NO: 3198899 - RNA, 19 nt, Mycobacterium bovis subsp bovis AF2122/97
gccgcggccacaaccucgu

SEQ ID NO: 3198900 - RNA, 21 nt, Mycobacterium bovis subsp bovis AF2122/97
gccgcggccacaaccucgucg

SEQ ID NO: 3198901 - RNA, 23 nt, Mycobacterium bovis subsp bovis AF2122/97
gccgcggccacaucgccagcagc

SEQ ID NO: 3198902 - RNA, 12 nt, Mycobacterium bovis subsp bovis AF2122/97
gccgcggccacc

SEQ ID NO: 3198903 - RNA, 14 nt, Mycobacterium bovis subsp bovis AF2122/97
gccgcggccaccac

SEQ ID NO: 3198904 - RNA, 14 nt, Mycobacterium bovis subsp bovis AF2122/97
gccgcggccaccgc

SEQ ID NO: 3198905 - RNA, 19 nt, Mycobacterium bovis subsp bovis AF2122/97
gccgcggccaccgccgccg

SEQ ID NO: 3198906 - RNA, 20 nt, Mycobacterium bovis subsp bovis AF2122/97
gccgcggccaccgccgccgc

SEQ ID NO: 3198907 - RNA, 23 nt, Mycobacterium bovis subsp bovis AF2122/97
gccgcggccaccgccgccgccga

SEQ ID NO: 3198908 - RNA, 21 nt, Mycobacterium bovis subsp bovis AF2122/97
gccgcggcccgcucgaucggc

SEQ ID NO: 3198909 - RNA, 14 nt, Mycobacterium bovis subsp bovis AF2122/97
gccgcggcccucga

SEQ ID NO: 3198910 - RNA, 13 nt, Mycobacterium bovis subsp bovis AF2122/97
gccgcggccgaaa

SEQ ID NO: 3198911 - RNA, 13 nt, Mycobacterium bovis subsp bovis AF2122/97
gccgcggccgccg

SEQ ID NO: 3198912 - RNA, 14 nt, Mycobacterium bovis subsp bovis AF2122/97
gccgcggccgccgu

SEQ ID NO: 3198913 - RNA, 18 nt, Mycobacterium bovis subsp bovis AF2122/97
gccgcggccggcgcucgc

SEQ ID NO: 3198914 - RNA, 22 nt, Mycobacterium bovis subsp bovis AF2122/97
gccgcggccggcgugccagcac

SEQ ID NO: 3198915 - RNA, 12 nt, Mycobacterium bovis subsp bovis AF2122/97
gccgcggcgcca

SEQ ID NO: 3198916 - RNA, 21 nt, Mycobacterium bovis subsp bovis AF2122/97
gccgcggcgccauagccgcga

SEQ ID NO: 3198917 - RNA, 15 nt, Mycobacterium bovis subsp bovis AF2122/97
gccgcggcgcccggc

SEQ ID NO: 3198918 - RNA, 16 nt, Mycobacterium bovis subsp bovis AF2122/97
gccgcggcgcccggcg

SEQ ID NO: 3198919 - RNA, 13 nt, Mycobacterium bovis subsp bovis AF2122/97
gccgcggcgccgg

SEQ ID NO: 3198920 - RNA, 19 nt, Mycobacterium bovis subsp bovis AF2122/97
gccgcggcgccggugggcg

SEQ ID NO: 3198921 - RNA, 21 nt, Mycobacterium bovis subsp bovis AF2122/97
gccgcggcgccuccgcucggu

SEQ ID NO: 3198922 - RNA, 18 nt, Mycobacterium bovis subsp bovis AF2122/97
gccgcggcggaauucggg

SEQ ID NO: 3198923 - RNA, 22 nt, Mycobacterium bovis subsp bovis AF2122/97
gccgcggcggauggcgucgacc

SEQ ID NO: 3198924 - RNA, 11 nt, Mycobacterium bovis subsp bovis AF2122/97
gccgcggcggc

SEQ ID NO: 3198925 - RNA, 17 nt, Mycobacterium bovis subsp bovis AF2122/97
gccgcggcggcagcggc

SEQ ID NO: 3198926 - RNA, 13 nt, Mycobacterium bovis subsp bovis AF2122/97
gccgcggcggcca

SEQ ID NO: 3198927 - RNA, 14 nt, Mycobacterium bovis subsp bovis AF2122/97
gccgcggcggccag

SEQ ID NO: 3198928 - RNA, 11 nt, Mycobacterium bovis subsp bovis AF2122/97
gccgcggcggu

SEQ ID NO: 3198929 - RNA, 19 nt, Mycobacterium bovis subsp bovis AF2122/97
gccgcggcuacaucggcgg

SEQ ID NO: 3198930 - RNA, 14 nt, Mycobacterium bovis subsp bovis AF2122/97
gccgcggcuaggcc

SEQ ID NO: 3198931 - RNA, 15 nt, Mycobacterium bovis subsp bovis AF2122/97
gccgcggcuaggcca

SEQ ID NO: 3198932 - RNA, 18 nt, Mycobacterium bovis subsp bovis AF2122/97
gccgcggcuaggccagca

SEQ ID NO: 3198933 - RNA, 21 nt, Mycobacterium bovis subsp bovis AF2122/97
gccgcggcuaggccagcacgg

SEQ ID NO: 3198934 - RNA, 17 nt, Mycobacterium bovis subsp bovis AF2122/97
gccgcggcuccgagggc

SEQ ID NO: 3198935 - RNA, 16 nt, Mycobacterium bovis subsp bovis AF2122/97
gccgcggcugccaucc

SEQ ID NO: 3198936 - RNA, 19 nt, Mycobacterium bovis subsp bovis AF2122/97
gccgcggcugccaucccga

SEQ ID NO: 3198937 - RNA, 13 nt, Mycobacterium bovis subsp bovis AF2122/97
gccgcggcugggg

SEQ ID NO: 3198938 - RNA, 20 nt, Mycobacterium bovis subsp bovis AF2122/97
gccgcggcuuccccgguagc

SEQ ID NO: 3198939 - RNA, 22 nt, Mycobacterium bovis subsp bovis AF2122/97
gccgcgggacaccaccgcccgc

SEQ ID NO: 3198940 - RNA, 13 nt, Mycobacterium bovis subsp bovis AF2122/97
gccgcgggccgcg

SEQ ID NO: 3198941 - RNA, 13 nt, Mycobacterium bovis subsp bovis AF2122/97
gccgcgggcgccg

SEQ ID NO: 3198942 - RNA, 14 nt, Mycobacterium bovis subsp bovis AF2122/97
gccgcgggcgccgg

SEQ ID NO: 3198943 - RNA, 12 nt, Mycobacterium bovis subsp bovis AF2122/97
gccgcgggcgcg

SEQ ID NO: 3198944 - RNA, 14 nt, Mycobacterium bovis subsp bovis AF2122/97
gccgcgggcgcggc

SEQ ID NO: 3198945 - RNA, 15 nt, Mycobacterium bovis subsp bovis AF2122/97
gccgcgggcgcggcc

SEQ ID NO: 3198946 - RNA, 15 nt, Mycobacterium bovis subsp bovis AF2122/97
gccgcgggcuccccg

SEQ ID NO: 3198947 - RNA, 17 nt, Mycobacterium bovis subsp bovis AF2122/97
gccgcgggcuccccggc

SEQ ID NO: 3198948 - RNA, 18 nt, Mycobacterium bovis subsp bovis AF2122/97
gccgcgggcugaccaacc

SEQ ID NO: 3198949 - RNA, 15 nt, Mycobacterium bovis subsp bovis AF2122/97
gccgcggggaucagc

SEQ ID NO: 3198950 - RNA, 13 nt, Mycobacterium bovis subsp bovis AF2122/97
gccgcggggcauc

SEQ ID NO: 3198951 - RNA, 14 nt, Mycobacterium bovis subsp bovis AF2122/97
gccgcggggcaucg

SEQ ID NO: 3198952 - RNA, 16 nt, Mycobacterium bovis subsp bovis AF2122/97
gccgcggggcaucggu

SEQ ID NO: 3198953 - RNA, 15 nt, Mycobacterium bovis subsp bovis AF2122/97
gccgcgggucccggc

SEQ ID NO: 3198954 - RNA, 17 nt, Mycobacterium bovis subsp bovis AF2122/97
gccgcgggucccggccg

SEQ ID NO: 3198955 - RNA, 19 nt, Mycobacterium bovis subsp bovis AF2122/97
gccgcgggugaucugggcg

SEQ ID NO: 3198956 - RNA, 17 nt, Mycobacterium bovis subsp bovis AF2122/97
gccgcgggugcggcaug

SEQ ID NO: 3198957 - RNA, 16 nt, Mycobacterium bovis subsp bovis AF2122/97
gccgcggguugggugu

SEQ ID NO: 3198958 - RNA, 17 nt, Mycobacterium bovis subsp bovis AF2122/97
gccgcgguacccaccuc

SEQ ID NO: 3198959 - RNA, 20 nt, Mycobacterium bovis subsp bovis AF2122/97
gccgcgguagacgccgccgu

SEQ ID NO: 3198960 - RNA, 17 nt, Mycobacterium bovis subsp bovis AF2122/97
gccgcgguaggugcaug

SEQ ID NO: 3198961 - RNA, 22 nt, Mycobacterium bovis subsp bovis AF2122/97
gccgcggucaccccggcucggc

SEQ ID NO: 3198962 - RNA, 21 nt, Mycobacterium bovis subsp bovis AF2122/97
gccgcggucgauguccgcagc

SEQ ID NO: 3198963 - RNA, 15 nt, Mycobacterium bovis subsp bovis AF2122/97
gccgcggucggccac

SEQ ID NO: 3198964 - RNA, 19 nt, Mycobacterium bovis subsp bovis AF2122/97
gccgcggucggccaccaac

SEQ ID NO: 3198965 - RNA, 20 nt, Mycobacterium bovis subsp bovis AF2122/97
gccgcggucggccaccaacu

SEQ ID NO: 3198966 - RNA, 20 nt, Mycobacterium bovis subsp bovis AF2122/97
gccgcggucggcgacguaga

SEQ ID NO: 3198967 - RNA, 14 nt, Mycobacterium bovis subsp bovis AF2122/97
gccgcggucggcgu

SEQ ID NO: 3198968 - RNA, 18 nt, Mycobacterium bovis subsp bovis AF2122/97
gccgcggugacggcggcu

SEQ ID NO: 3198969 - RNA, 21 nt, Mycobacterium bovis subsp bovis AF2122/97
gccgcgguggaugcgaugcgc

SEQ ID NO: 3198970 - RNA, 20 nt, Mycobacterium bovis subsp bovis AF2122/97
gccgcgguguagaagcgggc

SEQ ID NO: 3198971 - RNA, 17 nt, Mycobacterium bovis subsp bovis AF2122/97
gccgcgguguauccgac

SEQ ID NO: 3198972 - RNA, 22 nt, Mycobacterium bovis subsp bovis AF2122/97
gccgcugacuccugcggcaccg

SEQ ID NO: 3198973 - RNA, 12 nt, Mycobacterium bovis subsp bovis AF2122/97
gccgcugagccc

SEQ ID NO: 3198974 - RNA, 17 nt, Mycobacterium bovis subsp bovis AF2122/97
gccgcugagcccugcgc

SEQ ID NO: 3198975 - RNA, 23 nt, Mycobacterium bovis subsp bovis AF2122/97
gccgcugagcccugcgccucggc

SEQ ID NO: 3198976 - RNA, 14 nt, Mycobacterium bovis subsp bovis AF2122/97
gccgcugaucaaca

SEQ ID NO: 3198977 - RNA, 22 nt, Mycobacterium bovis subsp bovis AF2122/97
gccgcugaucaaggcgcucccg

SEQ ID NO: 3198978 - RNA, 19 nt, Mycobacterium bovis subsp bovis AF2122/97
gccgcugaucugccgccgc

SEQ ID NO: 3198979 - RNA, 21 nt, Mycobacterium bovis subsp bovis AF2122/97
gccgcugaucugccgccgcgg

SEQ ID NO: 3198980 - RNA, 22 nt, Mycobacterium bovis subsp bovis AF2122/97
gccgcugaucugccgccgcggc

SEQ ID NO: 3198981 - RNA, 21 nt, Mycobacterium bovis subsp bovis AF2122/97
gccgcugauguacccggcgac

SEQ ID NO: 3198982 - RNA, 22 nt, Mycobacterium bovis subsp bovis AF2122/97
gccgcugauguacccggcgacg

SEQ ID NO: 3198983 - RNA, 22 nt, Mycobacterium bovis subsp bovis AF2122/97
gccgcugcacguggccacggca

SEQ ID NO: 3198984 - RNA, 12 nt, Mycobacterium bovis subsp bovis AF2122/97
gccgcugcaucc

SEQ ID NO: 3198985 - RNA, 17 nt, Mycobacterium bovis subsp bovis AF2122/97
gccgcugcauccgcagc

SEQ ID NO: 3198986 - RNA, 14 nt, Mycobacterium bovis subsp bovis AF2122/97
gccgcugccagccg

SEQ ID NO: 3198987 - RNA, 15 nt, Mycobacterium bovis subsp bovis AF2122/97
gccgcugccagccgu

SEQ ID NO: 3198988 - RNA, 21 nt, Mycobacterium bovis subsp bovis AF2122/97
gccgcugccagggugcgccgg

SEQ ID NO: 3198989 - RNA, 18 nt, Mycobacterium bovis subsp bovis AF2122/97
gccgcugccaugcgggug

SEQ ID NO: 3198990 - RNA, 20 nt, Mycobacterium bovis subsp bovis AF2122/97
gccgcugccgaagcggccac

SEQ ID NO: 3198991 - RNA, 21 nt, Mycobacterium bovis subsp bovis AF2122/97
gccgcugccgcccuugccgcc

SEQ ID NO: 3198992 - RNA, 14 nt, Mycobacterium bovis subsp bovis AF2122/97
gccgcugccgccga

SEQ ID NO: 3198993 - RNA, 22 nt, Mycobacterium bovis subsp bovis AF2122/97
gccgcugccgccgagcuggcgc

SEQ ID NO: 3198994 - RNA, 23 nt, Mycobacterium bovis subsp bovis AF2122/97
gccgcugccgccgagcuggcgcg

SEQ ID NO: 3198995 - RNA, 14 nt, Mycobacterium bovis subsp bovis AF2122/97
gccgcugccgccgg

SEQ ID NO: 3198996 - RNA, 15 nt, Mycobacterium bovis subsp bovis AF2122/97
gccgcugccgccggu

SEQ ID NO: 3198997 - RNA, 16 nt, Mycobacterium bovis subsp bovis AF2122/97
gccgcugccgcgcggc

SEQ ID NO: 3198998 - RNA, 19 nt, Mycobacterium bovis subsp bovis AF2122/97
gccgcugccgguggcggcg

SEQ ID NO: 3198999 - RNA, 20 nt, Mycobacterium bovis subsp bovis AF2122/97
gccgcugccgguggcggcgg

SEQ ID NO: 3199000 - RNA, 22 nt, Mycobacterium bovis subsp bovis AF2122/97
gccgcugccgguggcggcggcg

SEQ ID NO: 3199001 - RNA, 15 nt, Mycobacterium bovis subsp bovis AF2122/97
gccgcugccgguguc

SEQ ID NO: 3199002 - RNA, 13 nt, Mycobacterium bovis subsp bovis AF2122/97
gccgcugccuucu

SEQ ID NO: 3199003 - RNA, 20 nt, Mycobacterium bovis subsp bovis AF2122/97
gccgcugccuuggcgcggca

SEQ ID NO: 3199004 - RNA, 22 nt, Mycobacterium bovis subsp bovis AF2122/97
gccgcugccuuggcgcggcacc

SEQ ID NO: 3199005 - RNA, 23 nt, Mycobacterium bovis subsp bovis AF2122/97
gccgcugccuuggcgcggcaccc

SEQ ID NO: 3199006 - RNA, 23 nt, Mycobacterium bovis subsp bovis AF2122/97
gccgcugcgaaagcacgugcacg

SEQ ID NO: 3199007 - RNA, 23 nt, Mycobacterium bovis subsp bovis AF2122/97
gccgcugcgacaaaucggcggug

SEQ ID NO: 3199008 - RNA, 14 nt, Mycobacterium bovis subsp bovis AF2122/97
gccgcugcgccagg

SEQ ID NO: 3199009 - RNA, 17 nt, Mycobacterium bovis subsp bovis AF2122/97
gccgcugcgccagguca

SEQ ID NO: 3199010 - RNA, 12 nt, Mycobacterium bovis subsp bovis AF2122/97
gccgcugcgccg

SEQ ID NO: 3199011 - RNA, 16 nt, Mycobacterium bovis subsp bovis AF2122/97
gccgcugcgccgucgc

SEQ ID NO: 3199012 - RNA, 19 nt, Mycobacterium bovis subsp bovis AF2122/97
gccgcugcgccgucgcagc

SEQ ID NO: 3199013 - RNA, 17 nt, Mycobacterium bovis subsp bovis AF2122/97
gccgcuggaggcggcgc

SEQ ID NO: 3199014 - RNA, 12 nt, Mycobacterium bovis subsp bovis AF2122/97
gccgcuggcaau

SEQ ID NO: 3199015 - RNA, 22 nt, Mycobacterium bovis subsp bovis AF2122/97
gccgcuggcaaucccgcggucg

SEQ ID NO: 3199016 - RNA, 14 nt, Mycobacterium bovis subsp bovis AF2122/97
gccgcuggccagca

SEQ ID NO: 3199017 - RNA, 22 nt, Mycobacterium bovis subsp bovis AF2122/97
gccgcugggauucugggcgaaa

SEQ ID NO: 3199018 - RNA, 17 nt, Mycobacterium bovis subsp bovis AF2122/97
gccgcugggugaccagg

SEQ ID NO: 3199019 - RNA, 14 nt, Mycobacterium bovis subsp bovis AF2122/97
gccgcugguggcgc

SEQ ID NO: 3199020 - RNA, 14 nt, Mycobacterium bovis subsp bovis AF2122/97
gccgcuggugguga

SEQ ID NO: 3199021 - RNA, 16 nt, Mycobacterium bovis subsp bovis AF2122/97
gccgcugucguaccgc

SEQ ID NO: 3199022 - RNA, 21 nt, Mycobacterium bovis subsp bovis AF2122/97
gccgcugucguaccgcucggc

SEQ ID NO: 3199023 - RNA, 22 nt, Mycobacterium bovis subsp bovis AF2122/97
gccgcugucguaccgcucggcg

SEQ ID NO: 3199024 - RNA, 23 nt, Mycobacterium bovis subsp bovis AF2122/97
gccgcugucguaccgcucggcgg

SEQ ID NO: 3199025 - RNA, 14 nt, Mycobacterium bovis subsp bovis AF2122/97
gccgcugugggcga

SEQ ID NO: 3199026 - RNA, 18 nt, Mycobacterium bovis subsp bovis AF2122/97
gccgcugugggcgagucg

SEQ ID NO: 3199027 - RNA, 20 nt, Mycobacterium bovis subsp bovis AF2122/97
gccgcugugggucgauccgg

SEQ ID NO: 3199028 - RNA, 22 nt, Mycobacterium bovis subsp bovis AF2122/97
gccgcuguugaucgacaccgag

SEQ ID NO: 3199029 - RNA, 21 nt, Mycobacterium bovis subsp bovis AF2122/97
gccgcuucggcggucagcggc

SEQ ID NO: 3199030 - RNA, 23 nt, Mycobacterium bovis subsp bovis AF2122/97
gccgcuugagcgaguugcagucg

SEQ ID NO: 3199031 - RNA, 18 nt, Mycobacterium bovis subsp bovis AF2122/97
gccgcuugccccgccuug

SEQ ID NO: 3199032 - RNA, 23 nt, Mycobacterium bovis subsp bovis AF2122/97
gccgcuugccccgccuuggccac

SEQ ID NO: 3199033 - RNA, 16 nt, Mycobacterium bovis subsp bovis AF2122/97
gccgcuuggcgcggcc

SEQ ID NO: 3199034 - RNA, 17 nt, Mycobacterium bovis subsp bovis AF2122/97
gccgcuuucgccggcgc

SEQ ID NO: 3199035 - RNA, 19 nt, Mycobacterium bovis subsp bovis AF2122/97
gccgcuuucgccggcgcca

SEQ ID NO: 3199036 - RNA, 20 nt, Mycobacterium bovis subsp bovis AF2122/97
gccgcuuucgccggcgccaa

SEQ ID NO: 3199037 - RNA, 22 nt, Mycobacterium bovis subsp bovis AF2122/97
gccgcuuucuuggcgggcgccu

SEQ ID NO: 3199038 - RNA, 23 nt, Mycobacterium bovis subsp bovis AF2122/97
gccgcuuuugauugaccaacccu

SEQ ID NO: 3199039 - RNA, 20 nt, Mycobacterium bovis subsp bovis AF2122/97
gccgcuuuuggcguaguucc

SEQ ID NO: 3199040 - RNA, 14 nt, Mycobacterium bovis subsp bovis AF2122/97
gccggaaacgccag

SEQ ID NO: 3199041 - RNA, 18 nt, Mycobacterium bovis subsp bovis AF2122/97
gccggaacgagcggccgc

SEQ ID NO: 3199042 - RNA, 20 nt, Mycobacterium bovis subsp bovis AF2122/97
gccggaacgagcggccgcgc

SEQ ID NO: 3199043 - RNA, 14 nt, Mycobacterium bovis subsp bovis AF2122/97
gccggaacgcccgg

SEQ ID NO: 3199044 - RNA, 17 nt, Mycobacterium bovis subsp bovis AF2122/97
gccggaagauccgggcc

SEQ ID NO: 3199045 - RNA, 16 nt, Mycobacterium bovis subsp bovis AF2122/97
gccggaagcgccggcc

SEQ ID NO: 3199046 - RNA, 20 nt, Mycobacterium bovis subsp bovis AF2122/97
gccggaauacaccagcgacg

SEQ ID NO: 3199047 - RNA, 14 nt, Mycobacterium bovis subsp bovis AF2122/97
gccggaauacccgc

SEQ ID NO: 3199048 - RNA, 21 nt, Mycobacterium bovis subsp bovis AF2122/97
gccggaauacccggcccauug

SEQ ID NO: 3199049 - RNA, 20 nt, Mycobacterium bovis subsp bovis AF2122/97
gccggaaucgagacgguagc

SEQ ID NO: 3199050 - RNA, 22 nt, Mycobacterium bovis subsp bovis AF2122/97
gccggacaacagagucaccgcg

SEQ ID NO: 3199051 - RNA, 17 nt, Mycobacterium bovis subsp bovis AF2122/97
gccggacaaccuggggc

SEQ ID NO: 3199052 - RNA, 23 nt, Mycobacterium bovis subsp bovis AF2122/97
gccggacaaccuggggccaccag

SEQ ID NO: 3199053 - RNA, 21 nt, Mycobacterium bovis subsp bovis AF2122/97
gccggacagaucaacgcgaac

SEQ ID NO: 3199054 - RNA, 20 nt, Mycobacterium bovis subsp bovis AF2122/97
gccggacagcucgcgcucgc

SEQ ID NO: 3199055 - RNA, 24 nt, Mycobacterium bovis subsp bovis AF2122/97
gccggacaggcuugacugcacacc

SEQ ID NO: 3199056 - RNA, 17 nt, Mycobacterium bovis subsp bovis AF2122/97
gccggaccagcuccugc

SEQ ID NO: 3199057 - RNA, 17 nt, Mycobacterium bovis subsp bovis AF2122/97
gccggcaaugccgcggc

SEQ ID NO: 3199058 - RNA, 19 nt, Mycobacterium bovis subsp bovis AF2122/97
gccggcaaugccgcggcca

SEQ ID NO: 3199059 - RNA, 17 nt, Mycobacterium bovis subsp bovis AF2122/97
gccggcacccaccagug

SEQ ID NO: 3199060 - RNA, 16 nt, Mycobacterium bovis subsp bovis AF2122/97
gccggcaccccacggc

SEQ ID NO: 3199061 - RNA, 19 nt, Mycobacterium bovis subsp bovis AF2122/97
gccggcaccccacggccag

SEQ ID NO: 3199062 - RNA, 20 nt, Mycobacterium bovis subsp bovis AF2122/97
gccggcaccccacggccagu

SEQ ID NO: 3199063 - RNA, 15 nt, Mycobacterium bovis subsp bovis AF2122/97
gccggcacccgccgu

SEQ ID NO: 3199064 - RNA, 16 nt, Mycobacterium bovis subsp bovis AF2122/97
gccggcacccgccgug

SEQ ID NO: 3199065 - RNA, 23 nt, Mycobacterium bovis subsp bovis AF2122/97
gccggcacccgccgugcccccgg

SEQ ID NO: 3199066 - RNA, 14 nt, Mycobacterium bovis subsp bovis AF2122/97
gccggcacccgucg

SEQ ID NO: 3199067 - RNA, 15 nt, Mycobacterium bovis subsp bovis AF2122/97
gccggcaccgcagcg

SEQ ID NO: 3199068 - RNA, 20 nt, Mycobacterium bovis subsp bovis AF2122/97
gccggcaccgcagcggaacu

SEQ ID NO: 3199069 - RNA, 22 nt, Mycobacterium bovis subsp bovis AF2122/97
gccggcaccgccagugcccgca

SEQ ID NO: 3199070 - RNA, 13 nt, Mycobacterium bovis subsp bovis AF2122/97
gccggcaccgccg

SEQ ID NO: 3199071 - RNA, 14 nt, Mycobacterium bovis subsp bovis AF2122/97
gccggcaccgccgc

SEQ ID NO: 3199072 - RNA, 19 nt, Mycobacterium bovis subsp bovis AF2122/97
gccggcaccgccggcgcca

SEQ ID NO: 3199073 - RNA, 21 nt, Mycobacterium bovis subsp bovis AF2122/97
gccggcaccgccggcgccacc

SEQ ID NO: 3199074 - RNA, 23 nt, Mycobacterium bovis subsp bovis AF2122/97
gccggcaccgccggcgccaccgu

SEQ ID NO: 3199075 - RNA, 16 nt, Mycobacterium bovis subsp bovis AF2122/97
gccggcaccgccggug

SEQ ID NO: 3199076 - RNA, 19 nt, Mycobacterium bovis subsp bovis AF2122/97
gccggcaccgccgguggcg

SEQ ID NO: 3199077 - RNA, 13 nt, Mycobacterium bovis subsp bovis AF2122/97
gccggcaccggcc

SEQ ID NO: 3199078 - RNA, 17 nt, Mycobacterium bovis subsp bovis AF2122/97
gccggcaccggggcugc

SEQ ID NO: 3199079 - RNA, 13 nt, Mycobacterium bovis subsp bovis AF2122/97
gccggcaccguga

SEQ ID NO: 3199080 - RNA, 13 nt, Mycobacterium bovis subsp bovis AF2122/97
gccggcacgcagc

SEQ ID NO: 3199081 - RNA, 13 nt, Mycobacterium bovis subsp bovis AF2122/97
gccggcacgccga

SEQ ID NO: 3199082 - RNA, 16 nt, Mycobacterium bovis subsp bovis AF2122/97
gccggcacgccgaccg

SEQ ID NO: 3199083 - RNA, 14 nt, Mycobacterium bovis subsp bovis AF2122/97
gccggcacgcgcgc

SEQ ID NO: 3199084 - RNA, 12 nt, Mycobacterium bovis subsp bovis AF2122/97
gccggcacgggc

SEQ ID NO: 3199085 - RNA, 14 nt, Mycobacterium bovis subsp bovis AF2122/97
gccggcacgggcgg

SEQ ID NO: 3199086 - RNA, 17 nt, Mycobacterium bovis subsp bovis AF2122/97
gccggcacgggcgggga

SEQ ID NO: 3199087 - RNA, 23 nt, Mycobacterium bovis subsp bovis AF2122/97
gccggcacgggcgucgucgguaa

SEQ ID NO: 3199088 - RNA, 16 nt, Mycobacterium bovis subsp bovis AF2122/97
gccggcacugccgagc

SEQ ID NO: 3199089 - RNA, 17 nt, Mycobacterium bovis subsp bovis AF2122/97
gccggcacugccgagca

SEQ ID NO: 3199090 - RNA, 19 nt, Mycobacterium bovis subsp bovis AF2122/97
gccggcacugccgagcacg

SEQ ID NO: 3199091 - RNA, 20 nt, Mycobacterium bovis subsp bovis AF2122/97
gccggcagcagcgggcgcgc

SEQ ID NO: 3199092 - RNA, 22 nt, Mycobacterium bovis subsp bovis AF2122/97
gccggcagcaucggcaccccgg

SEQ ID NO: 3199093 - RNA, 14 nt, Mycobacterium bovis subsp bovis AF2122/97
gccggcagcgcccc

SEQ ID NO: 3199094 - RNA, 14 nt, Mycobacterium bovis subsp bovis AF2122/97
gccggcagcggcga

SEQ ID NO: 3199095 - RNA, 15 nt, Mycobacterium bovis subsp bovis AF2122/97
gccggcagcggcgcg

SEQ ID NO: 3199096 - RNA, 16 nt, Mycobacterium bovis subsp bovis AF2122/97
gccggcagcggcgcgc

SEQ ID NO: 3199097 - RNA, 12 nt, Mycobacterium bovis subsp bovis AF2122/97
gccggcaggguu

SEQ ID NO: 3199098 - RNA, 20 nt, Mycobacterium bovis subsp bovis AF2122/97
gccggcagugggggugguac

SEQ ID NO: 3199099 - RNA, 16 nt, Mycobacterium bovis subsp bovis AF2122/97
gccggcauacaccgug

SEQ ID NO: 3199100 - RNA, 17 nt, Mycobacterium bovis subsp bovis AF2122/97
gccggcauacaccguga

SEQ ID NO: 3199101 - RNA, 18 nt, Mycobacterium bovis subsp bovis AF2122/97
gccggcauagcggcccau

SEQ ID NO: 3199102 - RNA, 22 nt, Mycobacterium bovis subsp bovis AF2122/97
gccggcauccgguucgccgccg

SEQ ID NO: 3199103 - RNA, 23 nt, Mycobacterium bovis subsp bovis AF2122/97
gccggcauccgguucgccgccgu

SEQ ID NO: 3199104 - RNA, 17 nt, Mycobacterium bovis subsp bovis AF2122/97
gccggcaucgacguagc

SEQ ID NO: 3199105 - RNA, 16 nt, Mycobacterium bovis subsp bovis AF2122/97
gccggcaucgcgcaac

SEQ ID NO: 3199106 - RNA, 23 nt, Mycobacterium bovis subsp bovis AF2122/97
gccggcaucgcgcgcggcuccgu

SEQ ID NO: 3199107 - RNA, 20 nt, Mycobacterium bovis subsp bovis AF2122/97
gccggcaucggucagcgcgg

SEQ ID NO: 3199108 - RNA, 14 nt, Mycobacterium bovis subsp bovis AF2122/97
gccggcaucgucga

SEQ ID NO: 3199109 - RNA, 15 nt, Mycobacterium bovis subsp bovis AF2122/97
gccggcaucgucgac

SEQ ID NO: 3199110 - RNA, 20 nt, Mycobacterium bovis subsp bovis AF2122/97
gccggcaucgucgacgcccg

SEQ ID NO: 3199111 - RNA, 15 nt, Mycobacterium bovis subsp bovis AF2122/97
gccggcaucuccacc

SEQ ID NO: 3199112 - RNA, 20 nt, Mycobacterium bovis subsp bovis AF2122/97
gccggcaucuccaccgucgc

SEQ ID NO: 3199113 - RNA, 21 nt, Mycobacterium bovis subsp bovis AF2122/97
gccggcaucuccaccgucgcc

SEQ ID NO: 3199114 - RNA, 15 nt, Mycobacterium bovis subsp bovis AF2122/97
gccggcaugccagcc

SEQ ID NO: 3199115 - RNA, 21 nt, Mycobacterium bovis subsp bovis AF2122/97
gccggcaugcuggcgaucgcg

SEQ ID NO: 3199116 - RNA, 16 nt, Mycobacterium bovis subsp bovis AF2122/97
gccggcauggcggcau

SEQ ID NO: 3199117 - RNA, 22 nt, Mycobacterium bovis subsp bovis AF2122/97
gccggcauggcggcauagccga

SEQ ID NO: 3199118 - RNA, 15 nt, Mycobacterium bovis subsp bovis AF2122/97
gccggccaacugggc

SEQ ID NO: 3199119 - RNA, 19 nt, Mycobacterium bovis subsp bovis AF2122/97
gccggccaacugggccgag

SEQ ID NO: 3199120 - RNA, 20 nt, Mycobacterium bovis subsp bovis AF2122/97
gccggccaacugggccgagc

SEQ ID NO: 3199121 - RNA, 21 nt, Mycobacterium bovis subsp bovis AF2122/97
gccggccaacugggccgagcg

SEQ ID NO: 3199122 - RNA, 20 nt, Mycobacterium bovis subsp bovis AF2122/97
gccggccaauggccugcagc

SEQ ID NO: 3199123 - RNA, 14 nt, Mycobacterium bovis subsp bovis AF2122/97
gccggccaccaccg

SEQ ID NO: 3199124 - RNA, 16 nt, Mycobacterium bovis subsp bovis AF2122/97
gccggccaccaccgcg

SEQ ID NO: 3199125 - RNA, 19 nt, Mycobacterium bovis subsp bovis AF2122/97
gccggccaccaccgcgccg

SEQ ID NO: 3199126 - RNA, 20 nt, Mycobacterium bovis subsp bovis AF2122/97
gccggccaccaccgcgccgu

SEQ ID NO: 3199127 - RNA, 14 nt, Mycobacterium bovis subsp bovis AF2122/97
gccggccaccagcc

SEQ ID NO: 3199128 - RNA, 16 nt, Mycobacterium bovis subsp bovis AF2122/97
gccggccaccagccgg

SEQ ID NO: 3199129 - RNA, 23 nt, Mycobacterium bovis subsp bovis AF2122/97
gccggccaccagccgguccagca

SEQ ID NO: 3199130 - RNA, 14 nt, Mycobacterium bovis subsp bovis AF2122/97
gccggccaccaguc

SEQ ID NO: 3199131 - RNA, 22 nt, Mycobacterium bovis subsp bovis AF2122/97
gccggccacccgcgcgaugcug

SEQ ID NO: 3199132 - RNA, 16 nt, Mycobacterium bovis subsp bovis AF2122/97
gccggccaccgucacc

SEQ ID NO: 3199133 - RNA, 17 nt, Mycobacterium bovis subsp bovis AF2122/97
gccggccaccgucaccc

SEQ ID NO: 3199134 - RNA, 18 nt, Mycobacterium bovis subsp bovis AF2122/97
gccggccaccucggugcg

SEQ ID NO: 3199135 - RNA, 14 nt, Mycobacterium bovis subsp bovis AF2122/97
gccggccacgaguc

SEQ ID NO: 3199136 - RNA, 19 nt, Mycobacterium bovis subsp bovis AF2122/97
gccggccacgcauuccagc

SEQ ID NO: 3199137 - RNA, 14 nt, Mycobacterium bovis subsp bovis AF2122/97
gccggccacgucga

SEQ ID NO: 3199138 - RNA, 21 nt, Mycobacterium bovis subsp bovis AF2122/97
gccggccacgucgaugugcgc

SEQ ID NO: 3199139 - RNA, 24 nt, Mycobacterium bovis subsp bovis AF2122/97
gccggccacuacggccuggccacc

SEQ ID NO: 3199140 - RNA, 19 nt, Mycobacterium bovis subsp bovis AF2122/97
gccggccagacggugcagc

SEQ ID NO: 3199141 - RNA, 14 nt, Mycobacterium bovis subsp bovis AF2122/97
gccggccagccagc

SEQ ID NO: 3199142 - RNA, 16 nt, Mycobacterium bovis subsp bovis AF2122/97
gccggccagccagcga

SEQ ID NO: 3199143 - RNA, 21 nt, Mycobacterium bovis subsp bovis AF2122/97
gccggcgaacucgcgccgagc

SEQ ID NO: 3199144 - RNA, 22 nt, Mycobacterium bovis subsp bovis AF2122/97
gccggcgaagcgugcgccgacu

SEQ ID NO: 3199145 - RNA, 17 nt, Mycobacterium bovis subsp bovis AF2122/97
gccggcgaaggccagca

SEQ ID NO: 3199146 - RNA, 21 nt, Mycobacterium bovis subsp bovis AF2122/97
gccggcgaaugcgguccucga

SEQ ID NO: 3199147 - RNA, 13 nt, Mycobacterium bovis subsp bovis AF2122/97
gccggcgacaccg

SEQ ID NO: 3199148 - RNA, 14 nt, Mycobacterium bovis subsp bovis AF2122/97
gccggcgacaccgc

SEQ ID NO: 3199149 - RNA, 15 nt, Mycobacterium bovis subsp bovis AF2122/97
gccggcgacaccgca

SEQ ID NO: 3199150 - RNA, 14 nt, Mycobacterium bovis subsp bovis AF2122/97
gccggcgaccagga

SEQ ID NO: 3199151 - RNA, 13 nt, Mycobacterium bovis subsp bovis AF2122/97
gccggcgaccggg

SEQ ID NO: 3199152 - RNA, 21 nt, Mycobacterium bovis subsp bovis AF2122/97
gccggcgaccgggaucggcuc

SEQ ID NO: 3199153 - RNA, 23 nt, Mycobacterium bovis subsp bovis AF2122/97
gccggcgaccgggaucggcuccg

SEQ ID NO: 3199154 - RNA, 22 nt, Mycobacterium bovis subsp bovis AF2122/97
gccggcgaccgggcccccaggu

SEQ ID NO: 3199155 - RNA, 22 nt, Mycobacterium bovis subsp bovis AF2122/97
gccggcgacgauauagggcucc

SEQ ID NO: 3199156 - RNA, 16 nt, Mycobacterium bovis subsp bovis AF2122/97
gccggcgacgcuaccg

SEQ ID NO: 3199157 - RNA, 20 nt, Mycobacterium bovis subsp bovis AF2122/97
gccggcgacgcuaccgccgg

SEQ ID NO: 3199158 - RNA, 18 nt, Mycobacterium bovis subsp bovis AF2122/97
gccggcgacggcgucacc

SEQ ID NO: 3199159 - RNA, 18 nt, Mycobacterium bovis subsp bovis AF2122/97
gccggcgacgggucgggc

SEQ ID NO: 3199160 - RNA, 18 nt, Mycobacterium bovis subsp bovis AF2122/97
gccggcgagagcgucaac

SEQ ID NO: 3199161 - RNA, 15 nt, Mycobacterium bovis subsp bovis AF2122/97
gccggcgagcaggcc

SEQ ID NO: 3199162 - RNA, 17 nt, Mycobacterium bovis subsp bovis AF2122/97
gccggcgagcaggccgu

SEQ ID NO: 3199163 - RNA, 16 nt, Mycobacterium bovis subsp bovis AF2122/97
gccggcgagggccacg

SEQ ID NO: 3199164 - RNA, 17 nt, Mycobacterium bovis subsp bovis AF2122/97
gccggcgagggccacgg

SEQ ID NO: 3199165 - RNA, 18 nt, Mycobacterium bovis subsp bovis AF2122/97
gccggcgagggccacggc

SEQ ID NO: 3199166 - RNA, 20 nt, Mycobacterium bovis subsp bovis AF2122/97
gccggcgagggugagcaugg

SEQ ID NO: 3199167 - RNA, 12 nt, Mycobacterium bovis subsp bovis AF2122/97
gccggcgauggc

SEQ ID NO: 3199168 - RNA, 14 nt, Mycobacterium bovis subsp bovis AF2122/97
gccggcgauggccc

SEQ ID NO: 3199169 - RNA, 21 nt, Mycobacterium bovis subsp bovis AF2122/97
gccggcgauguuggccagcgc

SEQ ID NO: 3199170 - RNA, 12 nt, Mycobacterium bovis subsp bovis AF2122/97
gccggcgcacca

SEQ ID NO: 3199171 - RNA, 14 nt, Mycobacterium bovis subsp bovis AF2122/97
gccggcgcaccaca

SEQ ID NO: 3199172 - RNA, 20 nt, Mycobacterium bovis subsp bovis AF2122/97
gccggcgcaccacaccacgg

SEQ ID NO: 3199173 - RNA, 12 nt, Mycobacterium bovis subsp bovis AF2122/97
gccggcgccacc

SEQ ID NO: 3199174 - RNA, 13 nt, Mycobacterium bovis subsp bovis AF2122/97
gccggcgccaccc

SEQ ID NO: 3199175 - RNA, 22 nt, Mycobacterium bovis subsp bovis AF2122/97
gccggcgccacccccaccgucg

SEQ ID NO: 3199176 - RNA, 23 nt, Mycobacterium bovis subsp bovis AF2122/97
gccggcgccacccccaccgucgc

SEQ ID NO: 3199177 - RNA, 17 nt, Mycobacterium bovis subsp bovis AF2122/97
gccggcgccacccgcgc

SEQ ID NO: 3199178 - RNA, 19 nt, Mycobacterium bovis subsp bovis AF2122/97
gccggcgccacccgcgccg

SEQ ID NO: 3199179 - RNA, 14 nt, Mycobacterium bovis subsp bovis AF2122/97
gccggcgccaccgu

SEQ ID NO: 3199180 - RNA, 23 nt, Mycobacterium bovis subsp bovis AF2122/97
gccggcgccaccgucgccguaca

SEQ ID NO: 3199181 - RNA, 20 nt, Mycobacterium bovis subsp bovis AF2122/97
gccggcgccaccguugccga

SEQ ID NO: 3199182 - RNA, 13 nt, Mycobacterium bovis subsp bovis AF2122/97
gccggcgccagcg

SEQ ID NO: 3199183 - RNA, 17 nt, Mycobacterium bovis subsp bovis AF2122/97
gccggcgccagcgccgc

SEQ ID NO: 3199184 - RNA, 19 nt, Mycobacterium bovis subsp bovis AF2122/97
gccggcgccagcgccgcca

SEQ ID NO: 3199185 - RNA, 20 nt, Mycobacterium bovis subsp bovis AF2122/97
gccggcgccagcgccgccac

SEQ ID NO: 3199186 - RNA, 14 nt, Mycobacterium bovis subsp bovis AF2122/97
gccggcgcccaggc

SEQ ID NO: 3199187 - RNA, 17 nt, Mycobacterium bovis subsp bovis AF2122/97
gccggcgcccaggccga

SEQ ID NO: 3199188 - RNA, 20 nt, Mycobacterium bovis subsp bovis AF2122/97
gccggcgcccaggccgauca

SEQ ID NO: 3199189 - RNA, 15 nt, Mycobacterium bovis subsp bovis AF2122/97
gccggcgcccgccgc

SEQ ID NO: 3199190 - RNA, 19 nt, Mycobacterium bovis subsp bovis AF2122/97
gccggcgcccgccgcgaac

SEQ ID NO: 3199191 - RNA, 17 nt, Mycobacterium bovis subsp bovis AF2122/97
gccggcgcccggggcgg

SEQ ID NO: 3199192 - RNA, 20 nt, Mycobacterium bovis subsp bovis AF2122/97
gccggcgcccggggcggugg

SEQ ID NO: 3199193 - RNA, 14 nt, Mycobacterium bovis subsp bovis AF2122/97
gccggcgccgaaca

SEQ ID NO: 3199194 - RNA, 19 nt, Mycobacterium bovis subsp bovis AF2122/97
gccggcgccgaacaccucg

SEQ ID NO: 3199195 - RNA, 13 nt, Mycobacterium bovis subsp bovis AF2122/97
gccggcgccgcac

SEQ ID NO: 3199196 - RNA, 12 nt, Mycobacterium bovis subsp bovis AF2122/97
gccggcgccgcc

SEQ ID NO: 3199197 - RNA, 13 nt, Mycobacterium bovis subsp bovis AF2122/97
gccggcgccgcca

SEQ ID NO: 3199198 - RNA, 14 nt, Mycobacterium bovis subsp bovis AF2122/97
gccggcgccgccac

SEQ ID NO: 3199199 - RNA, 21 nt, Mycobacterium bovis subsp bovis AF2122/97
gccggcgccgccagcaccacc

SEQ ID NO: 3199200 - RNA, 14 nt, Mycobacterium bovis subsp bovis AF2122/97
gccggcgccgccau

SEQ ID NO: 3199201 - RNA, 15 nt, Mycobacterium bovis subsp bovis AF2122/97
gccggcgccgccauu

SEQ ID NO: 3199202 - RNA, 13 nt, Mycobacterium bovis subsp bovis AF2122/97
gccggcgccgccg

SEQ ID NO: 3199203 - RNA, 16 nt, Mycobacterium bovis subsp bovis AF2122/97
gccggcgccgccgaug

SEQ ID NO: 3199204 - RNA, 21 nt, Mycobacterium bovis subsp bovis AF2122/97
gccggcgccgccggugccacc

SEQ ID NO: 3199205 - RNA, 14 nt, Mycobacterium bovis subsp bovis AF2122/97
gccggcgccgccgu

SEQ ID NO: 3199206 - RNA, 19 nt, Mycobacterium bovis subsp bovis AF2122/97
gccggcgccgccgucguac

SEQ ID NO: 3199207 - RNA, 17 nt, Mycobacterium bovis subsp bovis AF2122/97
gccggcgccgccgugcg

SEQ ID NO: 3199208 - RNA, 23 nt, Mycobacterium bovis subsp bovis AF2122/97
gccggcgccgccguuaccgccgg

SEQ ID NO: 3199209 - RNA, 16 nt, Mycobacterium bovis subsp bovis AF2122/97
gccggcgccgccguuc

SEQ ID NO: 3199210 - RNA, 12 nt, Mycobacterium bovis subsp bovis AF2122/97
gccggcgccggc

SEQ ID NO: 3199211 - RNA, 14 nt, Mycobacterium bovis subsp bovis AF2122/97
gccggcgccggcgc

SEQ ID NO: 3199212 - RNA, 17 nt, Mycobacterium bovis subsp bovis AF2122/97
gccggcgccggcgcguc

SEQ ID NO: 3199213 - RNA, 17 nt, Mycobacterium bovis subsp bovis AF2122/97
gccggcgccggugccgc

SEQ ID NO: 3199214 - RNA, 17 nt, Mycobacterium bovis subsp bovis AF2122/97
gccggcgccuuggucgc

SEQ ID NO: 3199215 - RNA, 20 nt, Mycobacterium bovis subsp bovis AF2122/97
gccggcgcgagccggcucag

SEQ ID NO: 3199216 - RNA, 14 nt, Mycobacterium bovis subsp bovis AF2122/97
gccggcgcgcaccc

SEQ ID NO: 3199217 - RNA, 20 nt, Mycobacterium bovis subsp bovis AF2122/97
gccggcgcgcaccccggcau

SEQ ID NO: 3199218 - RNA, 15 nt, Mycobacterium bovis subsp bovis AF2122/97
gccggcgcgcagccg

SEQ ID NO: 3199219 - RNA, 13 nt, Mycobacterium bovis subsp bovis AF2122/97
gccggcgcgcccc

SEQ ID NO: 3199220 - RNA, 14 nt, Mycobacterium bovis subsp bovis AF2122/97
gccggcgcgcccca

SEQ ID NO: 3199221 - RNA, 16 nt, Mycobacterium bovis subsp bovis AF2122/97
gccggcgcgccccacc

SEQ ID NO: 3199222 - RNA, 18 nt, Mycobacterium bovis subsp bovis AF2122/97
gccggcgcgccccaccgc

SEQ ID NO: 3199223 - RNA, 12 nt, Mycobacterium bovis subsp bovis AF2122/97
gccggcgcgccg

SEQ ID NO: 3199224 - RNA, 15 nt, Mycobacterium bovis subsp bovis AF2122/97
gccggcgcgccgaug

SEQ ID NO: 3199225 - RNA, 13 nt, Mycobacterium bovis subsp bovis AF2122/97
gccggcgcgccgg

SEQ ID NO: 3199226 - RNA, 14 nt, Mycobacterium bovis subsp bovis AF2122/97
gccggcgcgccgga

SEQ ID NO: 3199227 - RNA, 16 nt, Mycobacterium bovis subsp bovis AF2122/97
gccggcgcgccgggcg

SEQ ID NO: 3199228 - RNA, 16 nt, Mycobacterium bovis subsp bovis AF2122/97
gccggcgcggcguaac

SEQ ID NO: 3199229 - RNA, 15 nt, Mycobacterium bovis subsp bovis AF2122/97
gccggcgcggucucg

SEQ ID NO: 3199230 - RNA, 14 nt, Mycobacterium bovis subsp bovis AF2122/97
gccggcgugucgcg

SEQ ID NO: 3199231 - RNA, 15 nt, Mycobacterium bovis subsp bovis AF2122/97
gccggcgugucgcgu

SEQ ID NO: 3199232 - RNA, 16 nt, Mycobacterium bovis subsp bovis AF2122/97
gccggcguugccgaaa

SEQ ID NO: 3199233 - RNA, 22 nt, Mycobacterium bovis subsp bovis AF2122/97
gccggcguugccgaaacccgag

SEQ ID NO: 3199234 - RNA, 17 nt, Mycobacterium bovis subsp bovis AF2122/97
gccggcguugccgccgu

SEQ ID NO: 3199235 - RNA, 20 nt, Mycobacterium bovis subsp bovis AF2122/97
gccggcguugccgccguucc

SEQ ID NO: 3199236 - RNA, 13 nt, Mycobacterium bovis subsp bovis AF2122/97
gccggcguuggcc

SEQ ID NO: 3199237 - RNA, 23 nt, Mycobacterium bovis subsp bovis AF2122/97
gccggcguuggccauggccagug

SEQ ID NO: 3199238 - RNA, 23 nt, Mycobacterium bovis subsp bovis AF2122/97
gccggcuaccgccuugucggcga

SEQ ID NO: 3199239 - RNA, 18 nt, Mycobacterium bovis subsp bovis AF2122/97
gccggcuaccgcgcuccc

SEQ ID NO: 3199240 - RNA, 19 nt, Mycobacterium bovis subsp bovis AF2122/97
gccggcuaccgcgcucccg

SEQ ID NO: 3199241 - RNA, 22 nt, Mycobacterium bovis subsp bovis AF2122/97
gccggcuaccgcgcucccggcg

SEQ ID NO: 3199242 - RNA, 21 nt, Mycobacterium bovis subsp bovis AF2122/97
gccggcuagauaacccaaccg

SEQ ID NO: 3199243 - RNA, 23 nt, Mycobacterium bovis subsp bovis AF2122/97
gccggcuagauaacccaaccgcg

SEQ ID NO: 3199244 - RNA, 19 nt, Mycobacterium bovis subsp bovis AF2122/97
gccggcuagcucggcggcu

SEQ ID NO: 3199245 - RNA, 22 nt, Mycobacterium bovis subsp bovis AF2122/97
gccggcuagcucggcggcuacc

SEQ ID NO: 3199246 - RNA, 12 nt, Mycobacterium bovis subsp bovis AF2122/97
gccggcuagggc

SEQ ID NO: 3199247 - RNA, 18 nt, Mycobacterium bovis subsp bovis AF2122/97
gccggcuagggcagcagc

SEQ ID NO: 3199248 - RNA, 22 nt, Mycobacterium bovis subsp bovis AF2122/97
gccggcuagggcagcagcccgg

SEQ ID NO: 3199249 - RNA, 19 nt, Mycobacterium bovis subsp bovis AF2122/97
gccggcuagggcccuggcg

SEQ ID NO: 3199250 - RNA, 21 nt, Mycobacterium bovis subsp bovis AF2122/97
gccggcuagggcccuggcggc

SEQ ID NO: 3199251 - RNA, 20 nt, Mycobacterium bovis subsp bovis AF2122/97
gccggcucaggugugugacg

SEQ ID NO: 3199252 - RNA, 22 nt, Mycobacterium bovis subsp bovis AF2122/97
gccggcucaggugugugacgau

SEQ ID NO: 3199253 - RNA, 17 nt, Mycobacterium bovis subsp bovis AF2122/97
gccggcuccacccuugc

SEQ ID NO: 3199254 - RNA, 20 nt, Mycobacterium bovis subsp bovis AF2122/97
gccggcuccacccuugccgc

SEQ ID NO: 3199255 - RNA, 14 nt, Mycobacterium bovis subsp bovis AF2122/97
gccggcuccgcagc

SEQ ID NO: 3199256 - RNA, 16 nt, Mycobacterium bovis subsp bovis AF2122/97
gccggcuccgccguug

SEQ ID NO: 3199257 - RNA, 21 nt, Mycobacterium bovis subsp bovis AF2122/97
gccggcuccgccguugccgcc

SEQ ID NO: 3199258 - RNA, 23 nt, Mycobacterium bovis subsp bovis AF2122/97
gccggcuccgccguugccgccgc

SEQ ID NO: 3199259 - RNA, 15 nt, Mycobacterium bovis subsp bovis AF2122/97
gccggcuccggauug

SEQ ID NO: 3199260 - RNA, 15 nt, Mycobacterium bovis subsp bovis AF2122/97
gccggcuccggcggu

SEQ ID NO: 3199261 - RNA, 15 nt, Mycobacterium bovis subsp bovis AF2122/97
gccggcucgccggcg

SEQ ID NO: 3199262 - RNA, 16 nt, Mycobacterium bovis subsp bovis AF2122/97
gccggcucgccggcga

SEQ ID NO: 3199263 - RNA, 17 nt, Mycobacterium bovis subsp bovis AF2122/97
gccggcucgccggcgac

SEQ ID NO: 3199264 - RNA, 14 nt, Mycobacterium bovis subsp bovis AF2122/97
gccggcucguccgg

SEQ ID NO: 3199265 - RNA, 18 nt, Mycobacterium bovis subsp bovis AF2122/97
gccggcucguccgggcag

SEQ ID NO: 3199266 - RNA, 18 nt, Mycobacterium bovis subsp bovis AF2122/97
gccggcugacaacgacaa

SEQ ID NO: 3199267 - RNA, 20 nt, Mycobacterium bovis subsp bovis AF2122/97
gccggcugacaacgacaaca

SEQ ID NO: 3199268 - RNA, 23 nt, Mycobacterium bovis subsp bovis AF2122/97
gccggcugacgaccaaccaccga

SEQ ID NO: 3199269 - RNA, 13 nt, Mycobacterium bovis subsp bovis AF2122/97
gccggcugcaucc

SEQ ID NO: 3199270 - RNA, 17 nt, Mycobacterium bovis subsp bovis AF2122/97
gccggcugcauccuccu

SEQ ID NO: 3199271 - RNA, 18 nt, Mycobacterium bovis subsp bovis AF2122/97
gccggcugcauccuccuc

SEQ ID NO: 3199272 - RNA, 16 nt, Mycobacterium bovis subsp bovis AF2122/97
gccggcugcggaggcg

SEQ ID NO: 3199273 - RNA, 23 nt, Mycobacterium bovis subsp bovis AF2122/97
gccggcuguuaggcgauaucgca

SEQ ID NO: 3199274 - RNA, 21 nt, Mycobacterium bovis subsp bovis AF2122/97
gccggcuuaaggcccuggccg

SEQ ID NO: 3199275 - RNA, 22 nt, Mycobacterium bovis subsp bovis AF2122/97
gccggcuuaaggcccuggccgc

SEQ ID NO: 3199276 - RNA, 16 nt, Mycobacterium bovis subsp bovis AF2122/97
gccggcuucgcccaga

SEQ ID NO: 3199277 - RNA, 17 nt, Mycobacterium bovis subsp bovis AF2122/97
gccggcuucgcccagag

SEQ ID NO: 3199278 - RNA, 22 nt, Mycobacterium bovis subsp bovis AF2122/97
gccggcuucgcccagagccgcu

SEQ ID NO: 3199279 - RNA, 12 nt, Mycobacterium bovis subsp bovis AF2122/97
gccggcuucggc

SEQ ID NO: 3199280 - RNA, 15 nt, Mycobacterium bovis subsp bovis AF2122/97
gccggcuucggcgag

SEQ ID NO: 3199281 - RNA, 14 nt, Mycobacterium bovis subsp bovis AF2122/97
gccggcuucgguga

SEQ ID NO: 3199282 - RNA, 20 nt, Mycobacterium bovis subsp bovis AF2122/97
gccggcuucggugagcgggc

SEQ ID NO: 3199283 - RNA, 21 nt, Mycobacterium bovis subsp bovis AF2122/97
gccggcuuggccuuugccguc

SEQ ID NO: 3199284 - RNA, 23 nt, Mycobacterium bovis subsp bovis AF2122/97
gccggcuuggccuuugccgucga

SEQ ID NO: 3199285 - RNA, 13 nt, Mycobacterium bovis subsp bovis AF2122/97
gccggcuugggcg

SEQ ID NO: 3199286 - RNA, 16 nt, Mycobacterium bovis subsp bovis AF2122/97
gccggcuugggcggua

SEQ ID NO: 3199287 - RNA, 24 nt, Mycobacterium bovis subsp bovis AF2122/97
gccggcuugucgaccacgaccguc

SEQ ID NO: 3199288 - RNA, 15 nt, Mycobacterium bovis subsp bovis AF2122/97
gccggcuuugagccg

SEQ ID NO: 3199289 - RNA, 20 nt, Mycobacterium bovis subsp bovis AF2122/97
gccggcuuugagccgcucga

SEQ ID NO: 3199290 - RNA, 22 nt, Mycobacterium bovis subsp bovis AF2122/97
gccggcuuuuccacgaguccgc

SEQ ID NO: 3199291 - RNA, 15 nt, Mycobacterium bovis subsp bovis AF2122/97
gccgggaaacaccgg

SEQ ID NO: 3199292 - RNA, 20 nt, Mycobacterium bovis subsp bovis AF2122/97
gccgggaaacaccggcuugg

SEQ ID NO: 3199293 - RNA, 19 nt, Mycobacterium bovis subsp bovis AF2122/97
gccgggaaaguuguaucgc

SEQ ID NO: 3199294 - RNA, 17 nt, Mycobacterium bovis subsp bovis AF2122/97
gccgggaaccaacacca

SEQ ID NO: 3199295 - RNA, 19 nt, Mycobacterium bovis subsp bovis AF2122/97
gccgggaaccaacaccagg

SEQ ID NO: 3199296 - RNA, 14 nt, Mycobacterium bovis subsp bovis AF2122/97
gccgggaaccucgc

SEQ ID NO: 3199297 - RNA, 13 nt, Mycobacterium bovis subsp bovis AF2122/97
gccgggaagccgc

SEQ ID NO: 3199298 - RNA, 18 nt, Mycobacterium bovis subsp bovis AF2122/97
gccgggaauuucgacacg

SEQ ID NO: 3199299 - RNA, 14 nt, Mycobacterium bovis subsp bovis AF2122/97
gccgggacagcgcc

SEQ ID NO: 3199300 - RNA, 16 nt, Mycobacterium bovis subsp bovis AF2122/97
gccgggacagcgccgg

SEQ ID NO: 3199301 - RNA, 17 nt, Mycobacterium bovis subsp bovis AF2122/97
gccgggaccgccccggc

SEQ ID NO: 3199302 - RNA, 13 nt, Mycobacterium bovis subsp bovis AF2122/97
gccgggaccggug

SEQ ID NO: 3199303 - RNA, 22 nt, Mycobacterium bovis subsp bovis AF2122/97
gccgggaccggugugcacgcgg

SEQ ID NO: 3199304 - RNA, 21 nt, Mycobacterium bovis subsp bovis AF2122/97
gccgggagacgcugcgcgcca

SEQ ID NO: 3199305 - RNA, 17 nt, Mycobacterium bovis subsp bovis AF2122/97
gccgggaguguguccga

SEQ ID NO: 3199306 - RNA, 17 nt, Mycobacterium bovis subsp bovis AF2122/97
gccgggauaucgucgac

SEQ ID NO: 3199307 - RNA, 22 nt, Mycobacterium bovis subsp bovis AF2122/97
gccgggauaucgucgacgccca

SEQ ID NO: 3199308 - RNA, 22 nt, Mycobacterium bovis subsp bovis AF2122/97
gccgggaucucgaaggccgcca

SEQ ID NO: 3199309 - RNA, 14 nt, Mycobacterium bovis subsp bovis AF2122/97
gccgggauugccgc

SEQ ID NO: 3199310 - RNA, 16 nt, Mycobacterium bovis subsp bovis AF2122/97
gccgggauugccgcca

SEQ ID NO: 3199311 - RNA, 17 nt, Mycobacterium bovis subsp bovis AF2122/97
gccgggauugccgccac

SEQ ID NO: 3199312 - RNA, 18 nt, Mycobacterium bovis subsp bovis AF2122/97
gccgggauugccgccacc

SEQ ID NO: 3199313 - RNA, 19 nt, Mycobacterium bovis subsp bovis AF2122/97
gccgggauugccgccaccu

SEQ ID NO: 3199314 - RNA, 19 nt, Mycobacterium bovis subsp bovis AF2122/97
gccgggauugccgucggug

SEQ ID NO: 3199315 - RNA, 14 nt, Mycobacterium bovis subsp bovis AF2122/97
gccgggcaaccagc

SEQ ID NO: 3199316 - RNA, 18 nt, Mycobacterium bovis subsp bovis AF2122/97
gccgggguucaccgucga

SEQ ID NO: 3199317 - RNA, 21 nt, Mycobacterium bovis subsp bovis AF2122/97
gccggguauugauugacugcu

SEQ ID NO: 3199318 - RNA, 14 nt, Mycobacterium bovis subsp bovis AF2122/97
gccgggucaccgau

SEQ ID NO: 3199319 - RNA, 19 nt, Mycobacterium bovis subsp bovis AF2122/97
gccgggucaccgauucggc

SEQ ID NO: 3199320 - RNA, 17 nt, Mycobacterium bovis subsp bovis AF2122/97
gccgggucagcccggcg

SEQ ID NO: 3199321 - RNA, 19 nt, Mycobacterium bovis subsp bovis AF2122/97
gccgggucagcccggcgcg

SEQ ID NO: 3199322 - RNA, 16 nt, Mycobacterium bovis subsp bovis AF2122/97
gccggguccagcccgg

SEQ ID NO: 3199323 - RNA, 15 nt, Mycobacterium bovis subsp bovis AF2122/97
gccggguccgccggg

SEQ ID NO: 3199324 - RNA, 18 nt, Mycobacterium bovis subsp bovis AF2122/97
gccggguccgcggagaac

SEQ ID NO: 3199325 - RNA, 21 nt, Mycobacterium bovis subsp bovis AF2122/97
gccgggucgaacaggccggcc

SEQ ID NO: 3199326 - RNA, 23 nt, Mycobacterium bovis subsp bovis AF2122/97
gccgggucgaacaggccggccgc

SEQ ID NO: 3199327 - RNA, 15 nt, Mycobacterium bovis subsp bovis AF2122/97
gccgggucgaucacc

SEQ ID NO: 3199328 - RNA, 19 nt, Mycobacterium bovis subsp bovis AF2122/97
gccgggucgaucaccgaca

SEQ ID NO: 3199329 - RNA, 15 nt, Mycobacterium bovis subsp bovis AF2122/97
gccgggucgaugggu

SEQ ID NO: 3199330 - RNA, 16 nt, Mycobacterium bovis subsp bovis AF2122/97
gccgggucgcgcuggc

SEQ ID NO: 3199331 - RNA, 17 nt, Mycobacterium bovis subsp bovis AF2122/97
gccgggucgcgcuggcg

SEQ ID NO: 3199332 - RNA, 16 nt, Mycobacterium bovis subsp bovis AF2122/97
gccgggucgcgggaug

SEQ ID NO: 3199333 - RNA, 14 nt, Mycobacterium bovis subsp bovis AF2122/97
gccgggucggugac

SEQ ID NO: 3199334 - RNA, 20 nt, Mycobacterium bovis subsp bovis AF2122/97
gccgggucgucuuccaggag

SEQ ID NO: 3199335 - RNA, 14 nt, Mycobacterium bovis subsp bovis AF2122/97
gccgggucucggug

SEQ ID NO: 3199336 - RNA, 20 nt, Mycobacterium bovis subsp bovis AF2122/97
gccgggucucggugcggcug

SEQ ID NO: 3199337 - RNA, 15 nt, Mycobacterium bovis subsp bovis AF2122/97
gccgggucuguuggu

SEQ ID NO: 3199338 - RNA, 22 nt, Mycobacterium bovis subsp bovis AF2122/97
gccgggucuuccggugcgccga

SEQ ID NO: 3199339 - RNA, 23 nt, Mycobacterium bovis subsp bovis AF2122/97
gccgggugaggcggugacgaagc

SEQ ID NO: 3199340 - RNA, 16 nt, Mycobacterium bovis subsp bovis AF2122/97
gccgggugaguucggc

SEQ ID NO: 3199341 - RNA, 17 nt, Mycobacterium bovis subsp bovis AF2122/97
gccgggugaguucggcg

SEQ ID NO: 3199342 - RNA, 15 nt, Mycobacterium bovis subsp bovis AF2122/97
gccgggugccacaac

SEQ ID NO: 3199343 - RNA, 14 nt, Mycobacterium bovis subsp bovis AF2122/97
gccgggugccgcca

SEQ ID NO: 3199344 - RNA, 16 nt, Mycobacterium bovis subsp bovis AF2122/97
gccgggugcgccguug

SEQ ID NO: 3199345 - RNA, 21 nt, Mycobacterium bovis subsp bovis AF2122/97
gccgggugcgccguugccgcc

SEQ ID NO: 3199346 - RNA, 23 nt, Mycobacterium bovis subsp bovis AF2122/97
gccgggugcgccguugccgccgu

SEQ ID NO: 3199347 - RNA, 18 nt, Mycobacterium bovis subsp bovis AF2122/97
gccgggugcgugcgcguc

SEQ ID NO: 3199348 - RNA, 23 nt, Mycobacterium bovis subsp bovis AF2122/97
gccggguggccacgaauccgauc

SEQ ID NO: 3199349 - RNA, 17 nt, Mycobacterium bovis subsp bovis AF2122/97
gccgggugggagcagcc

SEQ ID NO: 3199350 - RNA, 20 nt, Mycobacterium bovis subsp bovis AF2122/97
gccggguggugauugcggaa

SEQ ID NO: 3199351 - RNA, 17 nt, Mycobacterium bovis subsp bovis AF2122/97
gccggguuaucggcagc

SEQ ID NO: 3199352 - RNA, 20 nt, Mycobacterium bovis subsp bovis AF2122/97
gccggguuaucggcagcagg

SEQ ID NO: 3199353 - RNA, 12 nt, Mycobacterium bovis subsp bovis AF2122/97
gccggguuccag

SEQ ID NO: 3199354 - RNA, 16 nt, Mycobacterium bovis subsp bovis AF2122/97
gccggguucgcgucug

SEQ ID NO: 3199355 - RNA, 20 nt, Mycobacterium bovis subsp bovis AF2122/97
gccggguuggccggcgcugc

SEQ ID NO: 3199356 - RNA, 13 nt, Mycobacterium bovis subsp bovis AF2122/97
gccggguuggcgc

SEQ ID NO: 3199357 - RNA, 16 nt, Mycobacterium bovis subsp bovis AF2122/97
gccggguugguaccca

SEQ ID NO: 3199358 - RNA, 12 nt, Mycobacterium bovis subsp bovis AF2122/97
gccggguuuggu

SEQ ID NO: 3199359 - RNA, 17 nt, Mycobacterium bovis subsp bovis AF2122/97
gccggguuuggugcagc

SEQ ID NO: 3199360 - RNA, 22 nt, Mycobacterium bovis subsp bovis AF2122/97
gccgguaacgaacagcgucaac

SEQ ID NO: 3199361 - RNA, 17 nt, Mycobacterium bovis subsp bovis AF2122/97
gccgguaacuguccgcc

SEQ ID NO: 3199362 - RNA, 18 nt, Mycobacterium bovis subsp bovis AF2122/97
gccgguacacguccagug

SEQ ID NO: 3199363 - RNA, 22 nt, Mycobacterium bovis subsp bovis AF2122/97
gccgguacacguccaguggcag

SEQ ID NO: 3199364 - RNA, 13 nt, Mycobacterium bovis subsp bovis AF2122/97
gccgguaccggcg

SEQ ID NO: 3199365 - RNA, 16 nt, Mycobacterium bovis subsp bovis AF2122/97
gccgguaccggcgauc

SEQ ID NO: 3199366 - RNA, 16 nt, Mycobacterium bovis subsp bovis AF2122/97
gccgguagcacagcag

SEQ ID NO: 3199367 - RNA, 17 nt, Mycobacterium bovis subsp bovis AF2122/97
gccgguagcacagcagc

SEQ ID NO: 3199368 - RNA, 20 nt, Mycobacterium bovis subsp bovis AF2122/97
gccgguagcacagcagcaac

SEQ ID NO: 3199369 - RNA, 17 nt, Mycobacterium bovis subsp bovis AF2122/97
gccgguaggcggccagc

SEQ ID NO: 3199370 - RNA, 23 nt, Mycobacterium bovis subsp bovis AF2122/97
gccgguaggcggccagcgcgcgc

SEQ ID NO: 3199371 - RNA, 14 nt, Mycobacterium bovis subsp bovis AF2122/97
gccgguaugccgaa

SEQ ID NO: 3199372 - RNA, 15 nt, Mycobacterium bovis subsp bovis AF2122/97
gccgguaugcgccau

SEQ ID NO: 3199373 - RNA, 16 nt, Mycobacterium bovis subsp bovis AF2122/97
gccgguaugcgccauc

SEQ ID NO: 3199374 - RNA, 20 nt, Mycobacterium bovis subsp bovis AF2122/97
gccggucaccucgccggcgg

SEQ ID NO: 3199375 - RNA, 19 nt, Mycobacterium bovis subsp bovis AF2122/97
gccggucacgacguccgau

SEQ ID NO: 3199376 - RNA, 21 nt, Mycobacterium bovis subsp bovis AF2122/97
gccggucacguccgcggggga

SEQ ID NO: 3199377 - RNA, 13 nt, Mycobacterium bovis subsp bovis AF2122/97
gccggucacgucg

SEQ ID NO: 3199378 - RNA, 14 nt, Mycobacterium bovis subsp bovis AF2122/97
gccggucacgucga

SEQ ID NO: 3199379 - RNA, 22 nt, Mycobacterium bovis subsp bovis AF2122/97
gccggucagcaauacggcggcg

SEQ ID NO: 3199380 - RNA, 19 nt, Mycobacterium bovis subsp bovis AF2122/97
gccggucagcgugcaggua

SEQ ID NO: 3199381 - RNA, 15 nt, Mycobacterium bovis subsp bovis AF2122/97
gccggucaggccgcc

SEQ ID NO: 3199382 - RNA, 20 nt, Mycobacterium bovis subsp bovis AF2122/97
gccggucaggccgccgcggc

SEQ ID NO: 3199383 - RNA, 17 nt, Mycobacterium bovis subsp bovis AF2122/97
gccggucaguauggcga

SEQ ID NO: 3199384 - RNA, 18 nt, Mycobacterium bovis subsp bovis AF2122/97
gccggucaguauggcgac

SEQ ID NO: 3199385 - RNA, 21 nt, Mycobacterium bovis subsp bovis AF2122/97
gccggucauccgggcgaccac

SEQ ID NO: 3199386 - RNA, 23 nt, Mycobacterium bovis subsp bovis AF2122/97
gccggucauccgggcgaccacca

SEQ ID NO: 3199387 - RNA, 20 nt, Mycobacterium bovis subsp bovis AF2122/97
gccggucauuucaacguauc

SEQ ID NO: 3199388 - RNA, 14 nt, Mycobacterium bovis subsp bovis AF2122/97
gccgguccagaccc

SEQ ID NO: 3199389 - RNA, 18 nt, Mycobacterium bovis subsp bovis AF2122/97
gccgguccagacccagcu

SEQ ID NO: 3199390 - RNA, 19 nt, Mycobacterium bovis subsp bovis AF2122/97
gccgguccagacccagcuc

SEQ ID NO: 3199391 - RNA, 22 nt, Mycobacterium bovis subsp bovis AF2122/97
gccgguccagacccagcucguc

SEQ ID NO: 3199392 - RNA, 13 nt, Mycobacterium bovis subsp bovis AF2122/97
gccgguccagcag

SEQ ID NO: 3199393 - RNA, 18 nt, Mycobacterium bovis subsp bovis AF2122/97
gccgguccagcagcucgg

SEQ ID NO: 3199394 - RNA, 20 nt, Mycobacterium bovis subsp bovis AF2122/97
gccgguccagcagcucggcc

SEQ ID NO: 3199395 - RNA, 21 nt, Mycobacterium bovis subsp bovis AF2122/97
gccgguccagcagcucggccg

SEQ ID NO: 3199396 - RNA, 19 nt, Mycobacterium bovis subsp bovis AF2122/97
gccgguccauggacggcca

SEQ ID NO: 3199397 - RNA, 20 nt, Mycobacterium bovis subsp bovis AF2122/97
gccgguccccccguugccgc

SEQ ID NO: 3199398 - RNA, 21 nt, Mycobacterium bovis subsp bovis AF2122/97
gccgguccccccguugccgcc

SEQ ID NO: 3199399 - RNA, 13 nt, Mycobacterium bovis subsp bovis AF2122/97
gccgguccccgcc

SEQ ID NO: 3199400 - RNA, 16 nt, Mycobacterium bovis subsp bovis AF2122/97
gccgguccccgccggc

SEQ ID NO: 3199401 - RNA, 19 nt, Mycobacterium bovis subsp bovis AF2122/97
gccgguccccgccggcggg

SEQ ID NO: 3199402 - RNA, 16 nt, Mycobacterium bovis subsp bovis AF2122/97
gccggugccgccuccg

SEQ ID NO: 3199403 - RNA, 22 nt, Mycobacterium bovis subsp bovis AF2122/97
gccggugccgccuccgccugcc

SEQ ID NO: 3199404 - RNA, 16 nt, Mycobacterium bovis subsp bovis AF2122/97
gccggugccggccaga

SEQ ID NO: 3199405 - RNA, 14 nt, Mycobacterium bovis subsp bovis AF2122/97
gccggugccggcgu

SEQ ID NO: 3199406 - RNA, 20 nt, Mycobacterium bovis subsp bovis AF2122/97
gccggugccggcguugccgc

SEQ ID NO: 3199407 - RNA, 16 nt, Mycobacterium bovis subsp bovis AF2122/97
gccggugccgggcacc

SEQ ID NO: 3199408 - RNA, 16 nt, Mycobacterium bovis subsp bovis AF2122/97
gccggugcgcaccagc

SEQ ID NO: 3199409 - RNA, 15 nt, Mycobacterium bovis subsp bovis AF2122/97
gccggugcgcccugc

SEQ ID NO: 3199410 - RNA, 22 nt, Mycobacterium bovis subsp bovis AF2122/97
gccggugcgcccugcgauacca

SEQ ID NO: 3199411 - RNA, 15 nt, Mycobacterium bovis subsp bovis AF2122/97
gccggugcgcuggau

SEQ ID NO: 3199412 - RNA, 15 nt, Mycobacterium bovis subsp bovis AF2122/97
gccggugcgcugguu

SEQ ID NO: 3199413 - RNA, 14 nt, Mycobacterium bovis subsp bovis AF2122/97
gccggugcggccaa

SEQ ID NO: 3199414 - RNA, 14 nt, Mycobacterium bovis subsp bovis AF2122/97
gccggugcggcggg

SEQ ID NO: 3199415 - RNA, 12 nt, Mycobacterium bovis subsp bovis AF2122/97
gccggugcggug

SEQ ID NO: 3199416 - RNA, 19 nt, Mycobacterium bovis subsp bovis AF2122/97
gccggugcgucacagccgg

SEQ ID NO: 3199417 - RNA, 20 nt, Mycobacterium bovis subsp bovis AF2122/97
gccggugcgucacagccggg

SEQ ID NO: 3199418 - RNA, 23 nt, Mycobacterium bovis subsp bovis AF2122/97
gccggugcuccucggcaggccga

SEQ ID NO: 3199419 - RNA, 15 nt, Mycobacterium bovis subsp bovis AF2122/97
gccggugcugcggga

SEQ ID NO: 3199420 - RNA, 23 nt, Mycobacterium bovis subsp bovis AF2122/97
gccgguggcacccgcgucgagug

SEQ ID NO: 3199421 - RNA, 20 nt, Mycobacterium bovis subsp bovis AF2122/97
gccgguggcagagccgccgu

SEQ ID NO: 3199422 - RNA, 22 nt, Mycobacterium bovis subsp bovis AF2122/97
gccgguggcauucguugaugau

SEQ ID NO: 3199423 - RNA, 13 nt, Mycobacterium bovis subsp bovis AF2122/97
gccgguggccagc

SEQ ID NO: 3199424 - RNA, 16 nt, Mycobacterium bovis subsp bovis AF2122/97
gccgguggccagcacg

SEQ ID NO: 3199425 - RNA, 17 nt, Mycobacterium bovis subsp bovis AF2122/97
gccgguggcccgccggc

SEQ ID NO: 3199426 - RNA, 14 nt, Mycobacterium bovis subsp bovis AF2122/97
gccgguggccgcgc

SEQ ID NO: 3199427 - RNA, 23 nt, Mycobacterium bovis subsp bovis AF2122/97
gccgguggcgccggggccgccga

SEQ ID NO: 3199428 - RNA, 15 nt, Mycobacterium bovis subsp bovis AF2122/97
gccgguggcggcggc

SEQ ID NO: 3199429 - RNA, 19 nt, Mycobacterium bovis subsp bovis AF2122/97
gccgguggcggcggcggca

SEQ ID NO: 3199430 - RNA, 21 nt, Mycobacterium bovis subsp bovis AF2122/97
gccgguggcggcggcggcaac

SEQ ID NO: 3199431 - RNA, 23 nt, Mycobacterium bovis subsp bovis AF2122/97
gccgguggcggcggcggcaacgg

SEQ ID NO: 3199432 - RNA, 14 nt, Mycobacterium bovis subsp bovis AF2122/97
gccgguggcguggg

SEQ ID NO: 3199433 - RNA, 16 nt, Mycobacterium bovis subsp bovis AF2122/97
gccggugggccgccca

SEQ ID NO: 3199434 - RNA, 17 nt, Mycobacterium bovis subsp bovis AF2122/97
gccggugggcgguccgc

SEQ ID NO: 3199435 - RNA, 22 nt, Mycobacterium bovis subsp bovis AF2122/97
gccgguggggauagccgcgucg

SEQ ID NO: 3199436 - RNA, 23 nt, Mycobacterium bovis subsp bovis AF2122/97
gccggugggugacguaggcgcug

SEQ ID NO: 3199437 - RNA, 19 nt, Mycobacterium bovis subsp bovis AF2122/97
gccggugguaacggcggcc

SEQ ID NO: 3199438 - RNA, 14 nt, Mycobacterium bovis subsp bovis AF2122/97
gccggugguaccgg

SEQ ID NO: 3199439 - RNA, 18 nt, Mycobacterium bovis subsp bovis AF2122/97
gccggugguaccggcggc

SEQ ID NO: 3199440 - RNA, 21 nt, Mycobacterium bovis subsp bovis AF2122/97
gccggugguaccggcggcgcc

SEQ ID NO: 3199441 - RNA, 21 nt, Mycobacterium bovis subsp bovis AF2122/97
gccgguggucugcgcggugcc

SEQ ID NO: 3199442 - RNA, 14 nt, Mycobacterium bovis subsp bovis AF2122/97
gccgguggugacgg

SEQ ID NO: 3199443 - RNA, 17 nt, Mycobacterium bovis subsp bovis AF2122/97
gccgguggugacggcgg

SEQ ID NO: 3199444 - RNA, 22 nt, Mycobacterium bovis subsp bovis AF2122/97
gccgguggugacggcgguaccg

SEQ ID NO: 3199445 - RNA, 16 nt, Mycobacterium bovis subsp bovis AF2122/97
gccgguggugccggcg

SEQ ID NO: 3199446 - RNA, 20 nt, Mycobacterium bovis subsp bovis AF2122/97
gccgguggugccggcgccgc

SEQ ID NO: 3199447 - RNA, 19 nt, Mycobacterium bovis subsp bovis AF2122/97
gccgguguaacccucgaac

SEQ ID NO: 3199448 - RNA, 20 nt, Mycobacterium bovis subsp bovis AF2122/97
gccgguguaggccucggcag

SEQ ID NO: 3199449 - RNA, 18 nt, Mycobacterium bovis subsp bovis AF2122/97
gccgguguccuuggccgc

SEQ ID NO: 3199450 - RNA, 14 nt, Mycobacterium bovis subsp bovis AF2122/97
gccggugucggcug

SEQ ID NO: 3199451 - RNA, 16 nt, Mycobacterium bovis subsp bovis AF2122/97
gccggugucggcuggu

SEQ ID NO: 3199452 - RNA, 15 nt, Mycobacterium bovis subsp bovis AF2122/97
gccggugucgggcug

SEQ ID NO: 3199453 - RNA, 20 nt, Mycobacterium bovis subsp bovis AF2122/97
gccggugucgggcugucagg

SEQ ID NO: 3199454 - RNA, 18 nt, Mycobacterium bovis subsp bovis AF2122/97
gccggugucucccuugcc

SEQ ID NO: 3199455 - RNA, 22 nt, Mycobacterium bovis subsp bovis AF2122/97
gccggugucucccuugccgcca

SEQ ID NO: 3199456 - RNA, 23 nt, Mycobacterium bovis subsp bovis AF2122/97
gccggugucucccuugccgccau

SEQ ID NO: 3199457 - RNA, 15 nt, Mycobacterium bovis subsp bovis AF2122/97
gccggugugcgcacc

SEQ ID NO: 3199458 - RNA, 16 nt, Mycobacterium bovis subsp bovis AF2122/97
gccggugugcggcgua

SEQ ID NO: 3199459 - RNA, 17 nt, Mycobacterium bovis subsp bovis AF2122/97
gccggugugcggcguac

SEQ ID NO: 3199460 - RNA, 15 nt, Mycobacterium bovis subsp bovis AF2122/97
gccgguguguccagc

SEQ ID NO: 3199461 - RNA, 22 nt, Mycobacterium bovis subsp bovis AF2122/97
gccgguguguccagcggaucgu

SEQ ID NO: 3199462 - RNA, 17 nt, Mycobacterium bovis subsp bovis AF2122/97
gccgguguuagccccga

SEQ ID NO: 3199463 - RNA, 19 nt, Mycobacterium bovis subsp bovis AF2122/97
gccgguguuagugaggccc

SEQ ID NO: 3199464 - RNA, 21 nt, Mycobacterium bovis subsp bovis AF2122/97
gccgguguuagugaggcccga

SEQ ID NO: 3199465 - RNA, 21 nt, Mycobacterium bovis subsp bovis AF2122/97
gccgguguugauuccggcgug

SEQ ID NO: 3199466 - RNA, 15 nt, Mycobacterium bovis subsp bovis AF2122/97
gccgguguugccgaa

SEQ ID NO: 3199467 - RNA, 17 nt, Mycobacterium bovis subsp bovis AF2122/97
gccgguguugccgccgg

SEQ ID NO: 3199468 - RNA, 19 nt, Mycobacterium bovis subsp bovis AF2122/97
gccgguguugccgccggug

SEQ ID NO: 3199469 - RNA, 21 nt, Mycobacterium bovis subsp bovis AF2122/97
gccgguguugccgccggugcc

SEQ ID NO: 3199470 - RNA, 21 nt, Mycobacterium bovis subsp bovis AF2122/97
gccgguguuguaggccgggcc

SEQ ID NO: 3199471 - RNA, 14 nt, Mycobacterium bovis subsp bovis AF2122/97
gccgguuacccgga

SEQ ID NO: 3199472 - RNA, 21 nt, Mycobacterium bovis subsp bovis AF2122/97
gccgguucaccaugucggcca

SEQ ID NO: 3199473 - RNA, 23 nt, Mycobacterium bovis subsp bovis AF2122/97
gccgguucagggguggcgcgggc

SEQ ID NO: 3199474 - RNA, 15 nt, Mycobacterium bovis subsp bovis AF2122/97
gccgguuccgcaaug

SEQ ID NO: 3199475 - RNA, 14 nt, Mycobacterium bovis subsp bovis AF2122/97
gccgguuccgccgg

SEQ ID NO: 3199476 - RNA, 15 nt, Mycobacterium bovis subsp bovis AF2122/97
gccgguuccgccggc

SEQ ID NO: 3199477 - RNA, 21 nt, Mycobacterium bovis subsp bovis AF2122/97
gccgguuccgccggccccacc

SEQ ID NO: 3199478 - RNA, 16 nt, Mycobacterium bovis subsp bovis AF2122/97
gccgguucgcccagca

SEQ ID NO: 3199479 - RNA, 19 nt, Mycobacterium bovis subsp bovis AF2122/97
gccgguucgcccagcaggc

SEQ ID NO: 3199480 - RNA, 23 nt, Mycobacterium bovis subsp bovis AF2122/97
gccgguucgcccagcaggcccuu

SEQ ID NO: 3199481 - RNA, 21 nt, Mycobacterium bovis subsp bovis AF2122/97
gccgguucgcccgaggcgaga

SEQ ID NO: 3199482 - RNA, 13 nt, Mycobacterium bovis subsp bovis AF2122/97
gccgguucggcga

SEQ ID NO: 3199483 - RNA, 14 nt, Mycobacterium bovis subsp bovis AF2122/97
gccgguucggcgau

SEQ ID NO: 3199484 - RNA, 14 nt, Mycobacterium bovis subsp bovis AF2122/97
gccgguugccaccu

SEQ ID NO: 3199485 - RNA, 16 nt, Mycobacterium bovis subsp bovis AF2122/97
gccgguugcggcugcg

SEQ ID NO: 3199486 - RNA, 14 nt, Mycobacterium bovis subsp bovis AF2122/97
gccgguuggccagc

SEQ ID NO: 3199487 - RNA, 20 nt, Mycobacterium bovis subsp bovis AF2122/97
gccgguuggccagccacagc

SEQ ID NO: 3199488 - RNA, 15 nt, Mycobacterium bovis subsp bovis AF2122/97
gccgguuggcugccg

SEQ ID NO: 3199489 - RNA, 17 nt, Mycobacterium bovis subsp bovis AF2122/97
gccgguuggcugccggc

SEQ ID NO: 3199490 - RNA, 15 nt, Mycobacterium bovis subsp bovis AF2122/97
gccgguugucgcagc

SEQ ID NO: 3199491 - RNA, 16 nt, Mycobacterium bovis subsp bovis AF2122/97
gccgguugucgcagcg

SEQ ID NO: 3199492 - RNA, 17 nt, Mycobacterium bovis subsp bovis AF2122/97
gccgguugucgcagcgc

SEQ ID NO: 3199493 - RNA, 18 nt, Mycobacterium bovis subsp bovis AF2122/97
gccgguugucgcagcgca

SEQ ID NO: 3199494 - RNA, 16 nt, Mycobacterium bovis subsp bovis AF2122/97
gccgguuugcacgcac

SEQ ID NO: 3199495 - RNA, 18 nt, Mycobacterium bovis subsp bovis AF2122/97
gccgguuugcacgcacca

SEQ ID NO: 3199496 - RNA, 14 nt, Mycobacterium bovis subsp bovis AF2122/97
gccguaacagccgg

SEQ ID NO: 3199497 - RNA, 15 nt, Mycobacterium bovis subsp bovis AF2122/97
gccguaacagccggc

SEQ ID NO: 3199498 - RNA, 16 nt, Mycobacterium bovis subsp bovis AF2122/97
gccguaacgcggaucg

SEQ ID NO: 3199499 - RNA, 15 nt, Mycobacterium bovis subsp bovis AF2122/97
gccguaacggcgaaa

SEQ ID NO: 3199500 - RNA, 20 nt, Mycobacterium bovis subsp bovis AF2122/97
gccguaacggucgcugucgg

SEQ ID NO: 3199501 - RNA, 19 nt, Mycobacterium bovis subsp bovis AF2122/97
gccguaagcaccagccagc

SEQ ID NO: 3199502 - RNA, 14 nt, Mycobacterium bovis subsp bovis AF2122/97
gccguacaaccacc

SEQ ID NO: 3199503 - RNA, 17 nt, Mycobacterium bovis subsp bovis AF2122/97
gccguacaaccacccac

SEQ ID NO: 3199504 - RNA, 23 nt, Mycobacterium bovis subsp bovis AF2122/97
gccguacaaccacccacccgcac

SEQ ID NO: 3199505 - RNA, 15 nt, Mycobacterium bovis subsp bovis AF2122/97
gccguacagcccggc

SEQ ID NO: 3199506 - RNA, 16 nt, Mycobacterium bovis subsp bovis AF2122/97
gccguacagcccggcc

SEQ ID NO: 3199507 - RNA, 18 nt, Mycobacterium bovis subsp bovis AF2122/97
gccguacagcccggccuu

SEQ ID NO: 3199508 - RNA, 15 nt, Mycobacterium bovis subsp bovis AF2122/97
gccguacagcgcaaa

SEQ ID NO: 3199509 - RNA, 14 nt, Mycobacterium bovis subsp bovis AF2122/97
gccguacagcggcg

SEQ ID NO: 3199510 - RNA, 15 nt, Mycobacterium bovis subsp bovis AF2122/97
gccguacagcggcgg

SEQ ID NO: 3199511 - RNA, 17 nt, Mycobacterium bovis subsp bovis AF2122/97
gccguacagcggcggcg

SEQ ID NO: 3199512 - RNA, 19 nt, Mycobacterium bovis subsp bovis AF2122/97
gccguacagcggcggcguc

SEQ ID NO: 3199513 - RNA, 15 nt, Mycobacterium bovis subsp bovis AF2122/97
gccguacaucagcgc

SEQ ID NO: 3199514 - RNA, 19 nt, Mycobacterium bovis subsp bovis AF2122/97
gccguacaucagcgcgaac

SEQ ID NO: 3199515 - RNA, 15 nt, Mycobacterium bovis subsp bovis AF2122/97
gccguaccggugauc

SEQ ID NO: 3199516 - RNA, 12 nt, Mycobacterium bovis subsp bovis AF2122/97
gccguacgccgu

SEQ ID NO: 3199517 - RNA, 14 nt, Mycobacterium bovis subsp bovis AF2122/97
gccguacggcgcgu

SEQ ID NO: 3199518 - RNA, 14 nt, Mycobacterium bovis subsp bovis AF2122/97
gccguacucgauga

SEQ ID NO: 3199519 - RNA, 17 nt, Mycobacterium bovis subsp bovis AF2122/97
gccguagaccacuucga

SEQ ID NO: 3199520 - RNA, 22 nt, Mycobacterium bovis subsp bovis AF2122/97
gccguagaccacuucgauggcg

SEQ ID NO: 3199521 - RNA, 13 nt, Mycobacterium bovis subsp bovis AF2122/97
gccguagaccagc

SEQ ID NO: 3199522 - RNA, 14 nt, Mycobacterium bovis subsp bovis AF2122/97
gccguagaccagca

SEQ ID NO: 3199523 - RNA, 15 nt, Mycobacterium bovis subsp bovis AF2122/97
gccguagaccagcag

SEQ ID NO: 3199524 - RNA, 14 nt, Mycobacterium bovis subsp bovis AF2122/97
gccguagaccagcc

SEQ ID NO: 3199525 - RNA, 18 nt, Mycobacterium bovis subsp bovis AF2122/97
gccguagaccaggcccag

SEQ ID NO: 3199526 - RNA, 19 nt, Mycobacterium bovis subsp bovis AF2122/97
gccguagaccaggcccagg

SEQ ID NO: 3199527 - RNA, 13 nt, Mycobacterium bovis subsp bovis AF2122/97
gccguagaucccg

SEQ ID NO: 3199528 - RNA, 15 nt, Mycobacterium bovis subsp bovis AF2122/97
gccguagaucccgaa

SEQ ID NO: 3199529 - RNA, 20 nt, Mycobacterium bovis subsp bovis AF2122/97
gccguagcccacgacgaagu

SEQ ID NO: 3199530 - RNA, 21 nt, Mycobacterium bovis subsp bovis AF2122/97
gccguagccgaucaacagggc

SEQ ID NO: 3199531 - RNA, 14 nt, Mycobacterium bovis subsp bovis AF2122/97
gccguagccgccgu

SEQ ID NO: 3199532 - RNA, 18 nt, Mycobacterium bovis subsp bovis AF2122/97
gccguagcggucgaugau

SEQ ID NO: 3199533 - RNA, 20 nt, Mycobacterium bovis subsp bovis AF2122/97
gccguagcugacggccugca

SEQ ID NO: 3199534 - RNA, 13 nt, Mycobacterium bovis subsp bovis AF2122/97
gccguaggcggcg

SEQ ID NO: 3199535 - RNA, 19 nt, Mycobacterium bovis subsp bovis AF2122/97
gccguaggcggcgacccgc

SEQ ID NO: 3199536 - RNA, 23 nt, Mycobacterium bovis subsp bovis AF2122/97
gccguagguugcgccccgacugc

SEQ ID NO: 3199537 - RNA, 18 nt, Mycobacterium bovis subsp bovis AF2122/97
gccguaguaaggagccgg

SEQ ID NO: 3199538 - RNA, 21 nt, Mycobacterium bovis subsp bovis AF2122/97
gccguaguaaggagccgggcc

SEQ ID NO: 3199539 - RNA, 17 nt, Mycobacterium bovis subsp bovis AF2122/97
gccguaguaguggccgc

SEQ ID NO: 3199540 - RNA, 21 nt, Mycobacterium bovis subsp bovis AF2122/97
gccguaguaguggccgccacc

SEQ ID NO: 3199541 - RNA, 15 nt, Mycobacterium bovis subsp bovis AF2122/97
gccguagugcgcauc

SEQ ID NO: 3199542 - RNA, 19 nt, Mycobacterium bovis subsp bovis AF2122/97
gccguagugcgcaucgccg

SEQ ID NO: 3199543 - RNA, 16 nt, Mycobacterium bovis subsp bovis AF2122/97
gccguaguggccggcu

SEQ ID NO: 3199544 - RNA, 14 nt, Mycobacterium bovis subsp bovis AF2122/97
gccguagugucggc

SEQ ID NO: 3199545 - RNA, 20 nt, Mycobacterium bovis subsp bovis AF2122/97
gccguauaggcccgggcggc

SEQ ID NO: 3199546 - RNA, 18 nt, Mycobacterium bovis subsp bovis AF2122/97
gccguaucggacgggaug

SEQ ID NO: 3199547 - RNA, 17 nt, Mycobacterium bovis subsp bovis AF2122/97
gccguaucggggcacca

SEQ ID NO: 3199548 - RNA, 24 nt, Mycobacterium bovis subsp bovis AF2122/97
gccguaucggggcaccacgccagc

SEQ ID NO: 3199549 - RNA, 14 nt, Mycobacterium bovis subsp bovis AF2122/97
gccguaugccgcca

SEQ ID NO: 3199550 - RNA, 20 nt, Mycobacterium bovis subsp bovis AF2122/97
gccgucaaccagggugccgg

SEQ ID NO: 3199551 - RNA, 21 nt, Mycobacterium bovis subsp bovis AF2122/97
gccgucaacgaugguggcgau

SEQ ID NO: 3199552 - RNA, 23 nt, Mycobacterium bovis subsp bovis AF2122/97
gccgucaacgccucugcucagcc

SEQ ID NO: 3199553 - RNA, 16 nt, Mycobacterium bovis subsp bovis AF2122/97
gccgucacccccgaua

SEQ ID NO: 3199554 - RNA, 23 nt, Mycobacterium bovis subsp bovis AF2122/97
gccgucacccccgauagcgaccg

SEQ ID NO: 3199555 - RNA, 22 nt, Mycobacterium bovis subsp bovis AF2122/97
gccgucaccgaucgaacagugc

SEQ ID NO: 3199556 - RNA, 18 nt, Mycobacterium bovis subsp bovis AF2122/97
gccgucaccgcccuugcc

SEQ ID NO: 3199557 - RNA, 23 nt, Mycobacterium bovis subsp bovis AF2122/97
gccgucaccgcccuugccgccgg

SEQ ID NO: 3199558 - RNA, 16 nt, Mycobacterium bovis subsp bovis AF2122/97
gccgucaccgccguug

SEQ ID NO: 3199559 - RNA, 21 nt, Mycobacterium bovis subsp bovis AF2122/97
gccgucaccgccguugccgau

SEQ ID NO: 3199560 - RNA, 13 nt, Mycobacterium bovis subsp bovis AF2122/97
gccgucaccgcga

SEQ ID NO: 3199561 - RNA, 14 nt, Mycobacterium bovis subsp bovis AF2122/97
gccgucaccgcgac

SEQ ID NO: 3199562 - RNA, 15 nt, Mycobacterium bovis subsp bovis AF2122/97
gccgucaccgcgacc

SEQ ID NO: 3199563 - RNA, 18 nt, Mycobacterium bovis subsp bovis AF2122/97
gccgucacgcacgccgcg

SEQ ID NO: 3199564 - RNA, 22 nt, Mycobacterium bovis subsp bovis AF2122/97
gccgucacgcacgccgcgugcc

SEQ ID NO: 3199565 - RNA, 20 nt, Mycobacterium bovis subsp bovis AF2122/97
gccgucacggcaguacccca

SEQ ID NO: 3199566 - RNA, 16 nt, Mycobacterium bovis subsp bovis AF2122/97
gccgucagaacaccgg

SEQ ID NO: 3199567 - RNA, 21 nt, Mycobacterium bovis subsp bovis AF2122/97
gccgucagaacaccggccagg

SEQ ID NO: 3199568 - RNA, 15 nt, Mycobacterium bovis subsp bovis AF2122/97
gccgucagcaccgcu

SEQ ID NO: 3199569 - RNA, 16 nt, Mycobacterium bovis subsp bovis AF2122/97
gccgucagcccaggug

SEQ ID NO: 3199570 - RNA, 21 nt, Mycobacterium bovis subsp bovis AF2122/97
gccgucagcggccaagucacc

SEQ ID NO: 3199571 - RNA, 13 nt, Mycobacterium bovis subsp bovis AF2122/97
gccgucagcggcg

SEQ ID NO: 3199572 - RNA, 14 nt, Mycobacterium bovis subsp bovis AF2122/97
gccgucagcggcgg

SEQ ID NO: 3199573 - RNA, 16 nt, Mycobacterium bovis subsp bovis AF2122/97
gccgucagcggcggcc

SEQ ID NO: 3199574 - RNA, 13 nt, Mycobacterium bovis subsp bovis AF2122/97
gccgucagcguca

SEQ ID NO: 3199575 - RNA, 19 nt, Mycobacterium bovis subsp bovis AF2122/97
cuuccgggacuaccacccg

SEQ ID NO: 3199576 - RNA, 15 nt, Mycobacterium bovis subsp bovis AF2122/97
cuuccgguccagcgg

SEQ ID NO: 3199577 - RNA, 17 nt, Mycobacterium bovis subsp bovis AF2122/97
cuuccgguccagcggcc

SEQ ID NO: 3199578 - RNA, 19 nt, Mycobacterium bovis subsp bovis AF2122/97
cuuccgguccagcggccgc

SEQ ID NO: 3199579 - RNA, 20 nt, Mycobacterium bovis subsp bovis AF2122/97
cuuccgguccagcggccgcc

SEQ ID NO: 3199580 - RNA, 19 nt, Mycobacterium bovis subsp bovis AF2122/97
cuuccgguucaucggcaug

SEQ ID NO: 3199581 - RNA, 15 nt, Mycobacterium bovis subsp bovis AF2122/97
cuuccguggcccaac

SEQ ID NO: 3199582 - RNA, 15 nt, Mycobacterium bovis subsp bovis AF2122/97
cuuccuccgacgcga

SEQ ID NO: 3199583 - RNA, 14 nt, Mycobacterium bovis subsp bovis AF2122/97
cuuccucgacgagc

SEQ ID NO: 3199584 - RNA, 14 nt, Mycobacterium bovis subsp bovis AF2122/97
cuuccucgccggaa

SEQ ID NO: 3199585 - RNA, 23 nt, Mycobacterium bovis subsp bovis AF2122/97
cuuccucggcaaaccaagcgcgc

SEQ ID NO: 3199586 - RNA, 16 nt, Mycobacterium bovis subsp bovis AF2122/97
cuuccucggccacccg

SEQ ID NO: 3199587 - RNA, 22 nt, Mycobacterium bovis subsp bovis AF2122/97
cuuccugaggguuuccaagucg

SEQ ID NO: 3199588 - RNA, 16 nt, Mycobacterium bovis subsp bovis AF2122/97
cuuccuggcgggcgcc

SEQ ID NO: 3199589 - RNA, 19 nt, Mycobacterium bovis subsp bovis AF2122/97
cuucgaauagguguguggc

SEQ ID NO: 3199590 - RNA, 18 nt, Mycobacterium bovis subsp bovis AF2122/97
cuucgacaaguccgcgau

SEQ ID NO: 3199591 - RNA, 13 nt, Mycobacterium bovis subsp bovis AF2122/97
cuucgacagcggc

SEQ ID NO: 3199592 - RNA, 14 nt, Mycobacterium bovis subsp bovis AF2122/97
cuucgacagcggcg

SEQ ID NO: 3199593 - RNA, 17 nt, Mycobacterium bovis subsp bovis AF2122/97
cuucgacaggccaccgc

SEQ ID NO: 3199594 - RNA, 22 nt, Mycobacterium bovis subsp bovis AF2122/97
cuucgacaggccaccgcagacg

SEQ ID NO: 3199595 - RNA, 22 nt, Mycobacterium bovis subsp bovis AF2122/97
cuucgaccaucaccacggccgc

SEQ ID NO: 3199596 - RNA, 21 nt, Mycobacterium bovis subsp bovis AF2122/97
cuucgaccgccguggcccgcu

SEQ ID NO: 3199597 - RNA, 16 nt, Mycobacterium bovis subsp bovis AF2122/97
cuucgacgcggcgacc

SEQ ID NO: 3199598 - RNA, 18 nt, Mycobacterium bovis subsp bovis AF2122/97
cuucgacgcggcgaccgu

SEQ ID NO: 3199599 - RNA, 16 nt, Mycobacterium bovis subsp bovis AF2122/97
cuucgacgcuuccugg

SEQ ID NO: 3199600 - RNA, 21 nt, Mycobacterium bovis subsp bovis AF2122/97
cuucgacgcuuccuggguugg

SEQ ID NO: 3199601 - RNA, 14 nt, Mycobacterium bovis subsp bovis AF2122/97
cuucgacggcggcc

SEQ ID NO: 3199602 - RNA, 19 nt, Mycobacterium bovis subsp bovis AF2122/97
cuucgagauugccgagguc

SEQ ID NO: 3199603 - RNA, 14 nt, Mycobacterium bovis subsp bovis AF2122/97
cuucgagccgcaca

SEQ ID NO: 3199604 - RNA, 15 nt, Mycobacterium bovis subsp bovis AF2122/97
cuucgagccggcggc

SEQ ID NO: 3199605 - RNA, 16 nt, Mycobacterium bovis subsp bovis AF2122/97
cuucgagccggcggcc

SEQ ID NO: 3199606 - RNA, 19 nt, Mycobacterium bovis subsp bovis AF2122/97
cuucgagguggcugcgccg

SEQ ID NO: 3199607 - RNA, 18 nt, Mycobacterium bovis subsp bovis AF2122/97
cuucgaguuuggcgacga

SEQ ID NO: 3199608 - RNA, 18 nt, Mycobacterium bovis subsp bovis AF2122/97
cuucgaguuuggugucga

SEQ ID NO: 3199609 - RNA, 14 nt, Mycobacterium bovis subsp bovis AF2122/97
cuucgauaccgacc

SEQ ID NO: 3199610 - RNA, 16 nt, Mycobacterium bovis subsp bovis AF2122/97
cuucgauaccgaccga

SEQ ID NO: 3199611 - RNA, 15 nt, Mycobacterium bovis subsp bovis AF2122/97
cuucgaucagcggca

SEQ ID NO: 3199612 - RNA, 16 nt, Mycobacterium bovis subsp bovis AF2122/97
cuucgaucagcggcag

SEQ ID NO: 3199613 - RNA, 20 nt, Mycobacterium bovis subsp bovis AF2122/97
cuucgaucagcggcaguucc

SEQ ID NO: 3199614 - RNA, 19 nt, Mycobacterium bovis subsp bovis AF2122/97
cuucgaucuccaggcccgg

SEQ ID NO: 3199615 - RNA, 20 nt, Mycobacterium bovis subsp bovis AF2122/97
cuucgaucuccaggcccggc

SEQ ID NO: 3199616 - RNA, 17 nt, Mycobacterium bovis subsp bovis AF2122/97
cuucgauucuggccgga

SEQ ID NO: 3199617 - RNA, 18 nt, Mycobacterium bovis subsp bovis AF2122/97
cuucgauugcgcugcacc

SEQ ID NO: 3199618 - RNA, 22 nt, Mycobacterium bovis subsp bovis AF2122/97
cuucgauugcgcugcaccgggu

SEQ ID NO: 3199619 - RNA, 19 nt, Mycobacterium bovis subsp bovis AF2122/97
cuucgcagcauguggccgc

SEQ ID NO: 3199620 - RNA, 20 nt, Mycobacterium bovis subsp bovis AF2122/97
cuucgcagcauguggccgcc

SEQ ID NO: 3199621 - RNA, 23 nt, Mycobacterium bovis subsp bovis AF2122/97
cuucgcagcgguggucggcgcgc

SEQ ID NO: 3199622 - RNA, 24 nt, Mycobacterium bovis subsp bovis AF2122/97
cuucgcagcgguggucggcgcgcc

SEQ ID NO: 3199623 - RNA, 19 nt, Mycobacterium bovis subsp bovis AF2122/97
cuucgccaacugcggcagg

SEQ ID NO: 3199624 - RNA, 13 nt, Mycobacterium bovis subsp bovis AF2122/97
cuucgccagcgcc

SEQ ID NO: 3199625 - RNA, 15 nt, Mycobacterium bovis subsp bovis AF2122/97
cuucgcccgggccgc

SEQ ID NO: 3199626 - RNA, 16 nt, Mycobacterium bovis subsp bovis AF2122/97
cuucgcccuugccgca

SEQ ID NO: 3199627 - RNA, 17 nt, Mycobacterium bovis subsp bovis AF2122/97
cuucgcccuugccgcag

SEQ ID NO: 3199628 - RNA, 16 nt, Mycobacterium bovis subsp bovis AF2122/97
cuucgccgaagcgccg

SEQ ID NO: 3199629 - RNA, 12 nt, Mycobacterium bovis subsp bovis AF2122/97
cuucgccgcccg

SEQ ID NO: 3199630 - RNA, 15 nt, Mycobacterium bovis subsp bovis AF2122/97
cuucgccgcccgcag

SEQ ID NO: 3199631 - RNA, 20 nt, Mycobacterium bovis subsp bovis AF2122/97
cuucgccgcccgcagggccg

SEQ ID NO: 3199632 - RNA, 13 nt, Mycobacterium bovis subsp bovis AF2122/97
cuucgccgcgcag

SEQ ID NO: 3199633 - RNA, 20 nt, Mycobacterium bovis subsp bovis AF2122/97
cuucgccgcgcagccuucuc

SEQ ID NO: 3199634 - RNA, 13 nt, Mycobacterium bovis subsp bovis AF2122/97
cuucgccggcgcc

SEQ ID NO: 3199635 - RNA, 22 nt, Mycobacterium bovis subsp bovis AF2122/97
cuucgccggcgccagcagaucu

SEQ ID NO: 3199636 - RNA, 23 nt, Mycobacterium bovis subsp bovis AF2122/97
cuucgccggcgccagcagaucuc

SEQ ID NO: 3199637 - RNA, 15 nt, Mycobacterium bovis subsp bovis AF2122/97
cuucgccgucggcga

SEQ ID NO: 3199638 - RNA, 17 nt, Mycobacterium bovis subsp bovis AF2122/97
cuucgcgauguccucga

SEQ ID NO: 3199639 - RNA, 13 nt, Mycobacterium bovis subsp bovis AF2122/97
cuucgcgcagccg

SEQ ID NO: 3199640 - RNA, 20 nt, Mycobacterium bovis subsp bovis AF2122/97
cuucgcgcagccgccgcgcc

SEQ ID NO: 3199641 - RNA, 18 nt, Mycobacterium bovis subsp bovis AF2122/97
cuucgcgcagccggucag

SEQ ID NO: 3199642 - RNA, 21 nt, Mycobacterium bovis subsp bovis AF2122/97
cuucgcgcuguacugccccag

SEQ ID NO: 3199643 - RNA, 19 nt, Mycobacterium bovis subsp bovis AF2122/97
cuucgcggauguccaggag

SEQ ID NO: 3199644 - RNA, 21 nt, Mycobacterium bovis subsp bovis AF2122/97
cuucgcggcgaucgcaugguc

SEQ ID NO: 3199645 - RNA, 17 nt, Mycobacterium bovis subsp bovis AF2122/97
cuucgcggcggucguug

SEQ ID NO: 3199646 - RNA, 14 nt, Mycobacterium bovis subsp bovis AF2122/97
cuucgcggcgguga

SEQ ID NO: 3199647 - RNA, 15 nt, Mycobacterium bovis subsp bovis AF2122/97
cuucgcggugugcgg

SEQ ID NO: 3199648 - RNA, 22 nt, Mycobacterium bovis subsp bovis AF2122/97
cuucgcgucggcgaacagacgc

SEQ ID NO: 3199649 - RNA, 19 nt, Mycobacterium bovis subsp bovis AF2122/97
cuucgcguuggcccgccug

SEQ ID NO: 3199650 - RNA, 21 nt, Mycobacterium bovis subsp bovis AF2122/97
cuucgcuaauacaccuccugc

SEQ ID NO: 3199651 - RNA, 18 nt, Mycobacterium bovis subsp bovis AF2122/97
cuucgcuaccuucuuggc

SEQ ID NO: 3199652 - RNA, 19 nt, Mycobacterium bovis subsp bovis AF2122/97
cuucgcuauggcggcuucg

SEQ ID NO: 3199653 - RNA, 18 nt, Mycobacterium bovis subsp bovis AF2122/97
cuucgcugcggugggcca

SEQ ID NO: 3199654 - RNA, 14 nt, Mycobacterium bovis subsp bovis AF2122/97
cuucgcuggaaacc

SEQ ID NO: 3199655 - RNA, 22 nt, Mycobacterium bovis subsp bovis AF2122/97
cuucgcuuucccgucggcggcg

SEQ ID NO: 3199656 - RNA, 15 nt, Mycobacterium bovis subsp bovis AF2122/97
cuucggacagcagcc

SEQ ID NO: 3199657 - RNA, 19 nt, Mycobacterium bovis subsp bovis AF2122/97
cuucggacagcagccggcg

SEQ ID NO: 3199658 - RNA, 14 nt, Mycobacterium bovis subsp bovis AF2122/97
cuucggaccggcuc

SEQ ID NO: 3199659 - RNA, 16 nt, Mycobacterium bovis subsp bovis AF2122/97
cuucggacgccagcuc

SEQ ID NO: 3199660 - RNA, 14 nt, Mycobacterium bovis subsp bovis AF2122/97
cuucggcaccaccg

SEQ ID NO: 3199661 - RNA, 15 nt, Mycobacterium bovis subsp bovis AF2122/97
cuucggcaccaccgc

SEQ ID NO: 3199662 - RNA, 15 nt, Mycobacterium bovis subsp bovis AF2122/97
cuucggcagaccggc

SEQ ID NO: 3199663 - RNA, 20 nt, Mycobacterium bovis subsp bovis AF2122/97
cuucggcagaccggcaucga

SEQ ID NO: 3199664 - RNA, 16 nt, Mycobacterium bovis subsp bovis AF2122/97
cuucggccagaucacg

SEQ ID NO: 3199665 - RNA, 22 nt, Mycobacterium bovis subsp bovis AF2122/97
cuucggccagcaguagaucgga

SEQ ID NO: 3199666 - RNA, 15 nt, Mycobacterium bovis subsp bovis AF2122/97
cuucggccagcuccc

SEQ ID NO: 3199667 - RNA, 19 nt, Mycobacterium bovis subsp bovis AF2122/97
cuucggccuucuugaggua

SEQ ID NO: 3199668 - RNA, 21 nt, Mycobacterium bovis subsp bovis AF2122/97
cuucggcgaaguugcgcgacg

SEQ ID NO: 3199669 - RNA, 19 nt, Mycobacterium bovis subsp bovis AF2122/97
cuucggcgagcgcaucggc

SEQ ID NO: 3199670 - RNA, 16 nt, Mycobacterium bovis subsp bovis AF2122/97
cuucggcgagcguacc

SEQ ID NO: 3199671 - RNA, 15 nt, Mycobacterium bovis subsp bovis AF2122/97
cuucggcgccgcgcc

SEQ ID NO: 3199672 - RNA, 16 nt, Mycobacterium bovis subsp bovis AF2122/97
cuucggcggacaggcc

SEQ ID NO: 3199673 - RNA, 15 nt, Mycobacterium bovis subsp bovis AF2122/97
cuucggcggucagcg

SEQ ID NO: 3199674 - RNA, 22 nt, Mycobacterium bovis subsp bovis AF2122/97
cuucggcggugcccagcagcgc

SEQ ID NO: 3199675 - RNA, 18 nt, Mycobacterium bovis subsp bovis AF2122/97
cuucggcguccagggcgc

SEQ ID NO: 3199676 - RNA, 12 nt, Mycobacterium bovis subsp bovis AF2122/97
cuucggcuggcg

SEQ ID NO: 3199677 - RNA, 13 nt, Mycobacterium bovis subsp bovis AF2122/97
cuucgggaacgcu

SEQ ID NO: 3199678 - RNA, 19 nt, Mycobacterium bovis subsp bovis AF2122/97
cuucgggaacgcucgucga

SEQ ID NO: 3199679 - RNA, 15 nt, Mycobacterium bovis subsp bovis AF2122/97
cuucgggcagcgcgu

SEQ ID NO: 3199680 - RNA, 17 nt, Mycobacterium bovis subsp bovis AF2122/97
cuucgggcagcgcgugc

SEQ ID NO: 3199681 - RNA, 19 nt, Mycobacterium bovis subsp bovis AF2122/97
cuucgggccgacgggcgca

SEQ ID NO: 3199682 - RNA, 18 nt, Mycobacterium bovis subsp bovis AF2122/97
cuucgggcucguccagca

SEQ ID NO: 3199683 - RNA, 15 nt, Mycobacterium bovis subsp bovis AF2122/97
cuucgggcuggucgg

SEQ ID NO: 3199684 - RNA, 17 nt, Mycobacterium bovis subsp bovis AF2122/97
cuucgggguaaccggcg

SEQ ID NO: 3199685 - RNA, 18 nt, Mycobacterium bovis subsp bovis AF2122/97
cuucgggguaaccggcgg

SEQ ID NO: 3199686 - RNA, 19 nt, Mycobacterium bovis subsp bovis AF2122/97
cuucgggguaaccggcgga

SEQ ID NO: 3199687 - RNA, 18 nt, Mycobacterium bovis subsp bovis AF2122/97
cuucgggguaguugaggc

SEQ ID NO: 3199688 - RNA, 22 nt, Mycobacterium bovis subsp bovis AF2122/97
cuucgggguaguugaggccguc

SEQ ID NO: 3199689 - RNA, 22 nt, Mycobacterium bovis subsp bovis AF2122/97
cuucggggugaaugcaacuccu

SEQ ID NO: 3199690 - RNA, 19 nt, Mycobacterium bovis subsp bovis AF2122/97
cuucggguguucgcgcgcg

SEQ ID NO: 3199691 - RNA, 20 nt, Mycobacterium bovis subsp bovis AF2122/97
cuucgguaggcaggccggcu

SEQ ID NO: 3199692 - RNA, 14 nt, Mycobacterium bovis subsp bovis AF2122/97
cuucggucagggug

SEQ ID NO: 3199693 - RNA, 14 nt, Mycobacterium bovis subsp bovis AF2122/97
cuucggucgcggcc

SEQ ID NO: 3199694 - RNA, 19 nt, Mycobacterium bovis subsp bovis AF2122/97
cuucggugacccgggcggc

SEQ ID NO: 3199695 - RNA, 21 nt, Mycobacterium bovis subsp bovis AF2122/97
cuucggugccgugaucggcgc

SEQ ID NO: 3199696 - RNA, 22 nt, Mycobacterium bovis subsp bovis AF2122/97
cuucggugccgugaucggcgcc

SEQ ID NO: 3199697 - RNA, 22 nt, Mycobacterium bovis subsp bovis AF2122/97
cuucggugguuccggcuggugg

SEQ ID NO: 3199698 - RNA, 16 nt, Mycobacterium bovis subsp bovis AF2122/97
cuucgguguagcccag

SEQ ID NO: 3199699 - RNA, 20 nt, Mycobacterium bovis subsp bovis AF2122/97
cuucggugucgccgaacacc

SEQ ID NO: 3199700 - RNA, 15 nt, Mycobacterium bovis subsp bovis AF2122/97
cuucguaaccacgac

SEQ ID NO: 3199701 - RNA, 15 nt, Mycobacterium bovis subsp bovis AF2122/97
cuucguagcggccgc

SEQ ID NO: 3199702 - RNA, 21 nt, Mycobacterium bovis subsp bovis AF2122/97
cuucgucauggccggccaucg

SEQ ID NO: 3199703 - RNA, 14 nt, Mycobacterium bovis subsp bovis AF2122/97
cuucguccaccgcg

SEQ ID NO: 3199704 - RNA, 15 nt, Mycobacterium bovis subsp bovis AF2122/97
cuucgucgcggccgc

SEQ ID NO: 3199705 - RNA, 12 nt, Mycobacterium bovis subsp bovis AF2122/97
cuucgucggcca

SEQ ID NO: 3199706 - RNA, 15 nt, Mycobacterium bovis subsp bovis AF2122/97
cuucgucggccagca

SEQ ID NO: 3199707 - RNA, 14 nt, Mycobacterium bovis subsp bovis AF2122/97
cuucgucggccggc

SEQ ID NO: 3199708 - RNA, 15 nt, Mycobacterium bovis subsp bovis AF2122/97
cuucgucggccggca

SEQ ID NO: 3199709 - RNA, 21 nt, Mycobacterium bovis subsp bovis AF2122/97
cuucgucggccggcaccccac

SEQ ID NO: 3199710 - RNA, 22 nt, Mycobacterium bovis subsp bovis AF2122/97
cuucgucggccggcaccccacg

SEQ ID NO: 3199711 - RNA, 16 nt, Mycobacterium bovis subsp bovis AF2122/97
cuucgucgguguccuc

SEQ ID NO: 3199712 - RNA, 14 nt, Mycobacterium bovis subsp bovis AF2122/97
cuucgugcaccaca

SEQ ID NO: 3199713 - RNA, 15 nt, Mycobacterium bovis subsp bovis AF2122/97
cuucgugcaccacau

SEQ ID NO: 3199714 - RNA, 15 nt, Mycobacterium bovis subsp bovis AF2122/97
cuucguggccuugac

SEQ ID NO: 3199715 - RNA, 15 nt, Mycobacterium bovis subsp bovis AF2122/97
cuucguugucggcgg

SEQ ID NO: 3199716 - RNA, 21 nt, Mycobacterium bovis subsp bovis AF2122/97
cuucguugucggcggggcgcc

SEQ ID NO: 3199717 - RNA, 16 nt, Mycobacterium bovis subsp bovis AF2122/97
cuucuaugacgaccgu

SEQ ID NO: 3199718 - RNA, 20 nt, Mycobacterium bovis subsp bovis AF2122/97
cuucucagcaccaugcucgg

SEQ ID NO: 3199719 - RNA, 14 nt, Mycobacterium bovis subsp bovis AF2122/97
cuucuccaccaccg

SEQ ID NO: 3199720 - RNA, 20 nt, Mycobacterium bovis subsp bovis AF2122/97
cuucuccaccagcguggacg

SEQ ID NO: 3199721 - RNA, 19 nt, Mycobacterium bovis subsp bovis AF2122/97
cuucuccccgaucagcacc

SEQ ID NO: 3199722 - RNA, 14 nt, Mycobacterium bovis subsp bovis AF2122/97
cuucucgagccgcc

SEQ ID NO: 3199723 - RNA, 15 nt, Mycobacterium bovis subsp bovis AF2122/97
cuucucgagccgccg

SEQ ID NO: 3199724 - RNA, 16 nt, Mycobacterium bovis subsp bovis AF2122/97
cuucucgagccgccgg

SEQ ID NO: 3199725 - RNA, 14 nt, Mycobacterium bovis subsp bovis AF2122/97
cuucucgcggacgg

SEQ ID NO: 3199726 - RNA, 23 nt, Mycobacterium bovis subsp bovis AF2122/97
cuucucgucggugcgcgcggcga

SEQ ID NO: 3199727 - RNA, 16 nt, Mycobacterium bovis subsp bovis AF2122/97
cuucucguucgucggu

SEQ ID NO: 3199728 - RNA, 14 nt, Mycobacterium bovis subsp bovis AF2122/97
cuucucucgggcca

SEQ ID NO: 3199729 - RNA, 19 nt, Mycobacterium bovis subsp bovis AF2122/97
cuucucucgggccagucga

SEQ ID NO: 3199730 - RNA, 19 nt, Mycobacterium bovis subsp bovis AF2122/97
cuucugcacgaacgccugc

SEQ ID NO: 3199731 - RNA, 21 nt, Mycobacterium bovis subsp bovis AF2122/97
cuucugcacgaacgccugcuc

SEQ ID NO: 3199732 - RNA, 14 nt, Mycobacterium bovis subsp bovis AF2122/97
cuucugccaucaac

SEQ ID NO: 3199733 - RNA, 19 nt, Mycobacterium bovis subsp bovis AF2122/97
cuucugccaucaacaggcc

SEQ ID NO: 3199734 - RNA, 14 nt, Mycobacterium bovis subsp bovis AF2122/97
cuucugccugcgca

SEQ ID NO: 3199735 - RNA, 15 nt, Mycobacterium bovis subsp bovis AF2122/97
cuucugccugcgcac

SEQ ID NO: 3199736 - RNA, 18 nt, Mycobacterium bovis subsp bovis AF2122/97
cuucugccuuggccggcu

SEQ ID NO: 3199737 - RNA, 16 nt, Mycobacterium bovis subsp bovis AF2122/97
cuucugcgccacgucg

SEQ ID NO: 3199738 - RNA, 15 nt, Mycobacterium bovis subsp bovis AF2122/97
cuucugcgucugcuc

SEQ ID NO: 3199739 - RNA, 15 nt, Mycobacterium bovis subsp bovis AF2122/97
cuucugguccagcac

SEQ ID NO: 3199740 - RNA, 19 nt, Mycobacterium bovis subsp bovis AF2122/97
cuucuuaccgcgggccgcc

SEQ ID NO: 3199741 - RNA, 13 nt, Mycobacterium bovis subsp bovis AF2122/97
cuucuucuugacc

SEQ ID NO: 3199742 - RNA, 14 nt, Mycobacterium bovis subsp bovis AF2122/97
cuucuugaccacga

SEQ ID NO: 3199743 - RNA, 21 nt, Mycobacterium bovis subsp bovis AF2122/97
cuucuuggcaggugccuucuu

SEQ ID NO: 3199744 - RNA, 22 nt, Mycobacterium bovis subsp bovis AF2122/97
cuucuuggcggccuuugucgcc

SEQ ID NO: 3199745 - RNA, 18 nt, Mycobacterium bovis subsp bovis AF2122/97
cuucuuggcugcacuggc

SEQ ID NO: 3199746 - RNA, 20 nt, Mycobacterium bovis subsp bovis AF2122/97
cuucuuggcugcacuggccc

SEQ ID NO: 3199747 - RNA, 14 nt, Mycobacterium bovis subsp bovis AF2122/97
cuucuuugccggcg

SEQ ID NO: 3199748 - RNA, 13 nt, Mycobacterium bovis subsp bovis AF2122/97
cuugaaacccagg

SEQ ID NO: 3199749 - RNA, 22 nt, Mycobacterium bovis subsp bovis AF2122/97
cuugaaauugagccggcccugc

SEQ ID NO: 3199750 - RNA, 15 nt, Mycobacterium bovis subsp bovis AF2122/97
cuugaaccagcgcgu

SEQ ID NO: 3199751 - RNA, 20 nt, Mycobacterium bovis subsp bovis AF2122/97
cuugaagaaacccugcugcg

SEQ ID NO: 3199752 - RNA, 19 nt, Mycobacterium bovis subsp bovis AF2122/97
cuugacagcuuucuuggcg

SEQ ID NO: 3199753 - RNA, 13 nt, Mycobacterium bovis subsp bovis AF2122/97
cuugaccacagcg

SEQ ID NO: 3199754 - RNA, 17 nt, Mycobacterium bovis subsp bovis AF2122/97
cuugaccccgccgaacg

SEQ ID NO: 3199755 - RNA, 19 nt, Mycobacterium bovis subsp bovis AF2122/97
cuugaccccuggccgccgg

SEQ ID NO: 3199756 - RNA, 21 nt, Mycobacterium bovis subsp bovis AF2122/97
cuugacccuugggcaccaccc

SEQ ID NO: 3199757 - RNA, 14 nt, Mycobacterium bovis subsp bovis AF2122/97
cuugaccgcaccgg

SEQ ID NO: 3199758 - RNA, 12 nt, Mycobacterium bovis subsp bovis AF2122/97
cuugaccgccug

SEQ ID NO: 3199759 - RNA, 14 nt, Mycobacterium bovis subsp bovis AF2122/97
cuugaccgcgguga

SEQ ID NO: 3199760 - RNA, 22 nt, Mycobacterium bovis subsp bovis AF2122/97
cuugaccgcggugacucggccu

SEQ ID NO: 3199761 - RNA, 16 nt, Mycobacterium bovis subsp bovis AF2122/97
cuugaccgcugcccag

SEQ ID NO: 3199762 - RNA, 17 nt, Mycobacterium bovis subsp bovis AF2122/97
cuugaccgcugcccagu

SEQ ID NO: 3199763 - RNA, 18 nt, Mycobacterium bovis subsp bovis AF2122/97
cuugaccguccaccgacg

SEQ ID NO: 3199764 - RNA, 23 nt, Mycobacterium bovis subsp bovis AF2122/97
cuugaccguccaccgacguggcc

SEQ ID NO: 3199765 - RNA, 19 nt, Mycobacterium bovis subsp bovis AF2122/97
cuugaccuauuugcgaccc

SEQ ID NO: 3199766 - RNA, 15 nt, Mycobacterium bovis subsp bovis AF2122/97
cuugacgcggccaca

SEQ ID NO: 3199767 - RNA, 20 nt, Mycobacterium bovis subsp bovis AF2122/97
cuugacggcgccaggcacca

SEQ ID NO: 3199768 - RNA, 20 nt, Mycobacterium bovis subsp bovis AF2122/97
cuugacuccgcgcgcugggc

SEQ ID NO: 3199769 - RNA, 16 nt, Mycobacterium bovis subsp bovis AF2122/97
cuugacugcacaccac

SEQ ID NO: 3199770 - RNA, 20 nt, Mycobacterium bovis subsp bovis AF2122/97
cuugagcaaaauggccaccg

SEQ ID NO: 3199771 - RNA, 18 nt, Mycobacterium bovis subsp bovis AF2122/97
cuugagcaaugacccgcg

SEQ ID NO: 3199772 - RNA, 23 nt, Mycobacterium bovis subsp bovis AF2122/97
cuugagcacacguccggcgauga

SEQ ID NO: 3199773 - RNA, 18 nt, Mycobacterium bovis subsp bovis AF2122/97
cuugagccgcagcaccuc

SEQ ID NO: 3199774 - RNA, 16 nt, Mycobacterium bovis subsp bovis AF2122/97
cuugagccgccccggc

SEQ ID NO: 3199775 - RNA, 20 nt, Mycobacterium bovis subsp bovis AF2122/97
cuugagccgggcaaccagca

SEQ ID NO: 3199776 - RNA, 21 nt, Mycobacterium bovis subsp bovis AF2122/97
cuugagcgcggcuacggucgc

SEQ ID NO: 3199777 - RNA, 16 nt, Mycobacterium bovis subsp bovis AF2122/97
cuugaggcccugcggc

SEQ ID NO: 3199778 - RNA, 14 nt, Mycobacterium bovis subsp bovis AF2122/97
cuugaggucaucgg

SEQ ID NO: 3199779 - RNA, 14 nt, Mycobacterium bovis subsp bovis AF2122/97
cuugaucaccgcgu

SEQ ID NO: 3199780 - RNA, 15 nt, Mycobacterium bovis subsp bovis AF2122/97
cuugaucagccgcca

SEQ ID NO: 3199781 - RNA, 15 nt, Mycobacterium bovis subsp bovis AF2122/97
cuugaucgacggcca

SEQ ID NO: 3199782 - RNA, 15 nt, Mycobacterium bovis subsp bovis AF2122/97
cuugaucgagcaggg

SEQ ID NO: 3199783 - RNA, 20 nt, Mycobacterium bovis subsp bovis AF2122/97
cuugaucucggcgagcaccg

SEQ ID NO: 3199784 - RNA, 23 nt, Mycobacterium bovis subsp bovis AF2122/97
cuugaucugggcugcggccgcga

SEQ ID NO: 3199785 - RNA, 13 nt, Mycobacterium bovis subsp bovis AF2122/97
cuugaugccgcac

SEQ ID NO: 3199786 - RNA, 16 nt, Mycobacterium bovis subsp bovis AF2122/97
cuugauggucuccacc

SEQ ID NO: 3199787 - RNA, 20 nt, Mycobacterium bovis subsp bovis AF2122/97
cuugauggucuccaccaggu

SEQ ID NO: 3199788 - RNA, 19 nt, Mycobacterium bovis subsp bovis AF2122/97
cuugauguaaugcgggcgc

SEQ ID NO: 3199789 - RNA, 15 nt, Mycobacterium bovis subsp bovis AF2122/97
cuugauguucgacgg

SEQ ID NO: 3199790 - RNA, 17 nt, Mycobacterium bovis subsp bovis AF2122/97
cuugcaaggucgcugcu

SEQ ID NO: 3199791 - RNA, 17 nt, Mycobacterium bovis subsp bovis AF2122/97
cuugcaauugcgcggcc

SEQ ID NO: 3199792 - RNA, 12 nt, Mycobacterium bovis subsp bovis AF2122/97
cuugcacaagcu

SEQ ID NO: 3199793 - RNA, 18 nt, Mycobacterium bovis subsp bovis AF2122/97
cuugcacucggcgcccuc

SEQ ID NO: 3199794 - RNA, 12 nt, Mycobacterium bovis subsp bovis AF2122/97
cuugcagcgccc

SEQ ID NO: 3199795 - RNA, 18 nt, Mycobacterium bovis subsp bovis AF2122/97
cuugcaggcgucccagcc

SEQ ID NO: 3199796 - RNA, 22 nt, Mycobacterium bovis subsp bovis AF2122/97
cuugcaguaacuucaccggcuc

SEQ ID NO: 3199797 - RNA, 16 nt, Mycobacterium bovis subsp bovis AF2122/97
cuugcagugccgccgg

SEQ ID NO: 3199798 - RNA, 16 nt, Mycobacterium bovis subsp bovis AF2122/97
cuugcauccggcccac

SEQ ID NO: 3199799 - RNA, 22 nt, Mycobacterium bovis subsp bovis AF2122/97
cuugccaaucgccgucagcacc

SEQ ID NO: 3199800 - RNA, 23 nt, Mycobacterium bovis subsp bovis AF2122/97
cuugccaaucgccgucagcaccg

SEQ ID NO: 3199801 - RNA, 19 nt, Mycobacterium bovis subsp bovis AF2122/97
cuugccaccgccgccggug

SEQ ID NO: 3199802 - RNA, 20 nt, Mycobacterium bovis subsp bovis AF2122/97
cuugccaccgcugccggcac

SEQ ID NO: 3199803 - RNA, 23 nt, Mycobacterium bovis subsp bovis AF2122/97
cuugccaccgguaccgccggcuc

SEQ ID NO: 3199804 - RNA, 15 nt, Mycobacterium bovis subsp bovis AF2122/97
cuugccacuccagga

SEQ ID NO: 3199805 - RNA, 16 nt, Mycobacterium bovis subsp bovis AF2122/97
cuugccacuccaggag

SEQ ID NO: 3199806 - RNA, 12 nt, Mycobacterium bovis subsp bovis AF2122/97
cuugcccacggc

SEQ ID NO: 3199807 - RNA, 19 nt, Mycobacterium bovis subsp bovis AF2122/97
cuugcccacggcgaccacg

SEQ ID NO: 3199808 - RNA, 21 nt, Mycobacterium bovis subsp bovis AF2122/97
cuugcccacggcgaccacgcc

SEQ ID NO: 3199809 - RNA, 14 nt, Mycobacterium bovis subsp bovis AF2122/97
cuugcccagcgaca

SEQ ID NO: 3199810 - RNA, 14 nt, Mycobacterium bovis subsp bovis AF2122/97
cuugccccgccgag

SEQ ID NO: 3199811 - RNA, 20 nt, Mycobacterium bovis subsp bovis AF2122/97
cuugccccgccuuggccacc

SEQ ID NO: 3199812 - RNA, 21 nt, Mycobacterium bovis subsp bovis AF2122/97
cuugccccgccuuggccacca

SEQ ID NO: 3199813 - RNA, 23 nt, Mycobacterium bovis subsp bovis AF2122/97
cuugcccgagcccagccgggcac

SEQ ID NO: 3199814 - RNA, 15 nt, Mycobacterium bovis subsp bovis AF2122/97
cuugcccucaacggc

SEQ ID NO: 3199815 - RNA, 20 nt, Mycobacterium bovis subsp bovis AF2122/97
cuugcccucaacggcggcaa

SEQ ID NO: 3199816 - RNA, 23 nt, Mycobacterium bovis subsp bovis AF2122/97
cuugcccuccggguauggcggcg

SEQ ID NO: 3199817 - RNA, 21 nt, Mycobacterium bovis subsp bovis AF2122/97
cuugcccuucuucgaccgcga

SEQ ID NO: 3199818 - RNA, 19 nt, Mycobacterium bovis subsp bovis AF2122/97
cuugccgaccugcgcgacg

SEQ ID NO: 3199819 - RNA, 16 nt, Mycobacterium bovis subsp bovis AF2122/97
cuugccgagcaacacc

SEQ ID NO: 3199820 - RNA, 17 nt, Mycobacterium bovis subsp bovis AF2122/97
cuugccgauggcggugg

SEQ ID NO: 3199821 - RNA, 14 nt, Mycobacterium bovis subsp bovis AF2122/97
cuugccgcaggccu

SEQ ID NO: 3199822 - RNA, 15 nt, Mycobacterium bovis subsp bovis AF2122/97
cuugccgcaggccug

SEQ ID NO: 3199823 - RNA, 18 nt, Mycobacterium bovis subsp bovis AF2122/97
cuugccgccauuccagcc

SEQ ID NO: 3199824 - RNA, 22 nt, Mycobacterium bovis subsp bovis AF2122/97
cuugccgcccgcuccgccgucg

SEQ ID NO: 3199825 - RNA, 15 nt, Mycobacterium bovis subsp bovis AF2122/97
cuugccgccggcccc

SEQ ID NO: 3199826 - RNA, 19 nt, Mycobacterium bovis subsp bovis AF2122/97
cuugccgccggccccgcca

SEQ ID NO: 3199827 - RNA, 16 nt, Mycobacterium bovis subsp bovis AF2122/97
cuugccgccggcgccg

SEQ ID NO: 3199828 - RNA, 13 nt, Mycobacterium bovis subsp bovis AF2122/97
cuugccgcuggug

SEQ ID NO: 3199829 - RNA, 23 nt, Mycobacterium bovis subsp bovis AF2122/97
cuugccgcugguggcgccauccc

SEQ ID NO: 3199830 - RNA, 22 nt, Mycobacterium bovis subsp bovis AF2122/97
cuugccggugggguugcgcggu

SEQ ID NO: 3199831 - RNA, 23 nt, Mycobacterium bovis subsp bovis AF2122/97
cuugccguagaagcgcuccagcu

SEQ ID NO: 3199832 - RNA, 17 nt, Mycobacterium bovis subsp bovis AF2122/97
cuugccugcgccgaguu

SEQ ID NO: 3199833 - RNA, 18 nt, Mycobacterium bovis subsp bovis AF2122/97
cuugccuuccgacccaac

SEQ ID NO: 3199834 - RNA, 21 nt, Mycobacterium bovis subsp bovis AF2122/97
cuugcgaaacgaauccgccau

SEQ ID NO: 3199835 - RNA, 20 nt, Mycobacterium bovis subsp bovis AF2122/97
cuugcgaccccggcugcgcu

SEQ ID NO: 3199836 - RNA, 15 nt, Mycobacterium bovis subsp bovis AF2122/97
cuugcgaucgccgcu

SEQ ID NO: 3199837 - RNA, 16 nt, Mycobacterium bovis subsp bovis AF2122/97
cuugcgaucgccgcua

SEQ ID NO: 3199838 - RNA, 21 nt, Mycobacterium bovis subsp bovis AF2122/97
cuugcgaucggcacuuagccc

SEQ ID NO: 3199839 - RNA, 18 nt, Mycobacterium bovis subsp bovis AF2122/97
cuugcgcagccgcagccg

SEQ ID NO: 3199840 - RNA, 21 nt, Mycobacterium bovis subsp bovis AF2122/97
cuugcgcccggccugcugguc

SEQ ID NO: 3199841 - RNA, 23 nt, Mycobacterium bovis subsp bovis AF2122/97
cuugcgcccggccugcuggucac

SEQ ID NO: 3199842 - RNA, 14 nt, Mycobacterium bovis subsp bovis AF2122/97
cuugcgccgacugu

SEQ ID NO: 3199843 - RNA, 19 nt, Mycobacterium bovis subsp bovis AF2122/97
cuugcgccgcccaugccuc

SEQ ID NO: 3199844 - RNA, 21 nt, Mycobacterium bovis subsp bovis AF2122/97
cuugcgcgcaggugcugggcg

SEQ ID NO: 3199845 - RNA, 17 nt, Mycobacterium bovis subsp bovis AF2122/97
cuugcgcgccauuggcg

SEQ ID NO: 3199846 - RNA, 22 nt, Mycobacterium bovis subsp bovis AF2122/97
cuugcgcgccauuggcgccgcc

SEQ ID NO: 3199847 - RNA, 11 nt, Mycobacterium bovis subsp bovis AF2122/97
cuugcgcggcu

SEQ ID NO: 3199848 - RNA, 14 nt, Mycobacterium bovis subsp bovis AF2122/97
cuugcggagccgcc

SEQ ID NO: 3199849 - RNA, 22 nt, Mycobacterium bovis subsp bovis AF2122/97
cuugcggcacaacagaauucga

SEQ ID NO: 3199850 - RNA, 22 nt, Mycobacterium bovis subsp bovis AF2122/97
cuugcggcacccagucggcgcc

SEQ ID NO: 3199851 - RNA, 23 nt, Mycobacterium bovis subsp bovis AF2122/97
cuugcggcacccagucggcgccg

SEQ ID NO: 3199852 - RNA, 14 nt, Mycobacterium bovis subsp bovis AF2122/97
cuugcggcagacca

SEQ ID NO: 3199853 - RNA, 22 nt, Mycobacterium bovis subsp bovis AF2122/97
cuugcggccgcugaucaacaga

SEQ ID NO: 3199854 - RNA, 21 nt, Mycobacterium bovis subsp bovis AF2122/97
cuugcggcgugaugucuacca

SEQ ID NO: 3199855 - RNA, 18 nt, Mycobacterium bovis subsp bovis AF2122/97
cuugcgggcagccgcccg

SEQ ID NO: 3199856 - RNA, 15 nt, Mycobacterium bovis subsp bovis AF2122/97
cuugcgggccuggug

SEQ ID NO: 3199857 - RNA, 16 nt, Mycobacterium bovis subsp bovis AF2122/97
cuugcgggcucucggc

SEQ ID NO: 3199858 - RNA, 20 nt, Mycobacterium bovis subsp bovis AF2122/97
cuugcggggauuggugccca

SEQ ID NO: 3199859 - RNA, 19 nt, Mycobacterium bovis subsp bovis AF2122/97
cuugcgguaggcggugacc

SEQ ID NO: 3199860 - RNA, 19 nt, Mycobacterium bovis subsp bovis AF2122/97
cuugcgguccaggccggca

SEQ ID NO: 3199861 - RNA, 17 nt, Mycobacterium bovis subsp bovis AF2122/97
cuugcgucaucggcuca

SEQ ID NO: 3199862 - RNA, 20 nt, Mycobacterium bovis subsp bovis AF2122/97
cuugcguccauccgcagcag

SEQ ID NO: 3199863 - RNA, 19 nt, Mycobacterium bovis subsp bovis AF2122/97
cuugcgucgcggacggugc

SEQ ID NO: 3199864 - RNA, 21 nt, Mycobacterium bovis subsp bovis AF2122/97
cuugcuagcgcaucuuggugc

SEQ ID NO: 3199865 - RNA, 17 nt, Mycobacterium bovis subsp bovis AF2122/97
cuugcucacccgucguc

SEQ ID NO: 3199866 - RNA, 23 nt, Mycobacterium bovis subsp bovis AF2122/97
cuugcucagccggcccugcggcc

SEQ ID NO: 3199867 - RNA, 23 nt, Mycobacterium bovis subsp bovis AF2122/97
cuugcucgacgaucugcagcacu

SEQ ID NO: 3199868 - RNA, 16 nt, Mycobacterium bovis subsp bovis AF2122/97
cuugcucggcgugcuc

SEQ ID NO: 3199869 - RNA, 20 nt, Mycobacterium bovis subsp bovis AF2122/97
cuugcucggcgugcucggcc

SEQ ID NO: 3199870 - RNA, 22 nt, Mycobacterium bovis subsp bovis AF2122/97
cuugcugcacgcucugcgccac

SEQ ID NO: 3199871 - RNA, 13 nt, Mycobacterium bovis subsp bovis AF2122/97
cuugcugcuccuu

SEQ ID NO: 3199872 - RNA, 19 nt, Mycobacterium bovis subsp bovis AF2122/97
cuuggaaagcccgcucgga

SEQ ID NO: 3199873 - RNA, 14 nt, Mycobacterium bovis subsp bovis AF2122/97
cuuggaaggcgcgc

SEQ ID NO: 3199874 - RNA, 20 nt, Mycobacterium bovis subsp bovis AF2122/97
cuuggaaggcgcgcgcccgg

SEQ ID NO: 3199875 - RNA, 12 nt, Mycobacterium bovis subsp bovis AF2122/97
cuuggacagcag

SEQ ID NO: 3199876 - RNA, 14 nt, Mycobacterium bovis subsp bovis AF2122/97
cuuggacagcagca

SEQ ID NO: 3199877 - RNA, 22 nt, Mycobacterium bovis subsp bovis AF2122/97
cuuggaccagcguggggccgcc

SEQ ID NO: 3199878 - RNA, 16 nt, Mycobacterium bovis subsp bovis AF2122/97
cuuggacccugcgccg

SEQ ID NO: 3199879 - RNA, 19 nt, Mycobacterium bovis subsp bovis AF2122/97
cuuggacccugcgccgcca

SEQ ID NO: 3199880 - RNA, 19 nt, Mycobacterium bovis subsp bovis AF2122/97
cuuggacgacccgggccgg

SEQ ID NO: 3199881 - RNA, 19 nt, Mycobacterium bovis subsp bovis AF2122/97
cuuggacgugcgcgccaag

SEQ ID NO: 3199882 - RNA, 23 nt, Mycobacterium bovis subsp bovis AF2122/97
cuuggacgugguguaucgacggc

SEQ ID NO: 3199883 - RNA, 18 nt, Mycobacterium bovis subsp bovis AF2122/97
cuuggacucaucggcgug

SEQ ID NO: 3199884 - RNA, 23 nt, Mycobacterium bovis subsp bovis AF2122/97
cuuggacucaucggcgugcuugc

SEQ ID NO: 3199885 - RNA, 17 nt, Mycobacterium bovis subsp bovis AF2122/97
cuuggacugucccacca

SEQ ID NO: 3199886 - RNA, 22 nt, Mycobacterium bovis subsp bovis AF2122/97
cuuggagaagguuucccgcuua

SEQ ID NO: 3199887 - RNA, 18 nt, Mycobacterium bovis subsp bovis AF2122/97
cuuggagaucgccgccgg

SEQ ID NO: 3199888 - RNA, 16 nt, Mycobacterium bovis subsp bovis AF2122/97
cuuggauccggccgcc

SEQ ID NO: 3199889 - RNA, 18 nt, Mycobacterium bovis subsp bovis AF2122/97
cuuggcaagcacgcgacg

SEQ ID NO: 3199890 - RNA, 20 nt, Mycobacterium bovis subsp bovis AF2122/97
cuuggcaaucaucucccgac

SEQ ID NO: 3199891 - RNA, 22 nt, Mycobacterium bovis subsp bovis AF2122/97
cuuggcagcgguguagccggcg

SEQ ID NO: 3199892 - RNA, 14 nt, Mycobacterium bovis subsp bovis AF2122/97
cuuggcaucgcgag

SEQ ID NO: 3199893 - RNA, 16 nt, Mycobacterium bovis subsp bovis AF2122/97
cuuggcaucgcgagcc

SEQ ID NO: 3199894 - RNA, 21 nt, Mycobacterium bovis subsp bovis AF2122/97
cuuggcaucgcgagccagcug

SEQ ID NO: 3199895 - RNA, 18 nt, Mycobacterium bovis subsp bovis AF2122/97
cuuggcauugaccaccga

SEQ ID NO: 3199896 - RNA, 17 nt, Mycobacterium bovis subsp bovis AF2122/97
cuuggccaccaucgccg

SEQ ID NO: 3199897 - RNA, 20 nt, Mycobacterium bovis subsp bovis AF2122/97
cuuggccaccaucgccgccg

SEQ ID NO: 3199898 - RNA, 14 nt, Mycobacterium bovis subsp bovis AF2122/97
cuuggccaccgccg

SEQ ID NO: 3199899 - RNA, 11 nt, Mycobacterium bovis subsp bovis AF2122/97
cuuggccagca

SEQ ID NO: 3199900 - RNA, 18 nt, Mycobacterium bovis subsp bovis AF2122/97
cuuggccagcagcagcgc

SEQ ID NO: 3199901 - RNA, 14 nt, Mycobacterium bovis subsp bovis AF2122/97
cuuggccagcagcc

SEQ ID NO: 3199902 - RNA, 16 nt, Mycobacterium bovis subsp bovis AF2122/97
cuuggccagcagccgc

SEQ ID NO: 3199903 - RNA, 19 nt, Mycobacterium bovis subsp bovis AF2122/97
cuuggccaggaagucccgg

SEQ ID NO: 3199904 - RNA, 20 nt, Mycobacterium bovis subsp bovis AF2122/97
cuuggccaugcuggucagcg

SEQ ID NO: 3199905 - RNA, 20 nt, Mycobacterium bovis subsp bovis AF2122/97
cuuggcccccgacggugaac

SEQ ID NO: 3199906 - RNA, 14 nt, Mycobacterium bovis subsp bovis AF2122/97
cuuggccgccacuc

SEQ ID NO: 3199907 - RNA, 17 nt, Mycobacterium bovis subsp bovis AF2122/97
cuuggccgccacucgcc

SEQ ID NO: 3199908 - RNA, 22 nt, Mycobacterium bovis subsp bovis AF2122/97
cuuggccgccacucgcccgcug

SEQ ID NO: 3199909 - RNA, 20 nt, Mycobacterium bovis subsp bovis AF2122/97
cuuggccgccccggccgcug

SEQ ID NO: 3199910 - RNA, 12 nt, Mycobacterium bovis subsp bovis AF2122/97
cuuggccgcgca

SEQ ID NO: 3199911 - RNA, 18 nt, Mycobacterium bovis subsp bovis AF2122/97
cuuggccgcgccggucgu

SEQ ID NO: 3199912 - RNA, 18 nt, Mycobacterium bovis subsp bovis AF2122/97
cuuggccgcugccuucuu

SEQ ID NO: 3199913 - RNA, 11 nt, Mycobacterium bovis subsp bovis AF2122/97
cuuggccggca

SEQ ID NO: 3199914 - RNA, 20 nt, Mycobacterium bovis subsp bovis AF2122/97
cuuggccggccccgcccgcg

SEQ ID NO: 3199915 - RNA, 18 nt, Mycobacterium bovis subsp bovis AF2122/97
cuuggccguucggcgccc

SEQ ID NO: 3199916 - RNA, 24 nt, Mycobacterium bovis subsp bovis AF2122/97
cuuggccuagccgcggcaccgccg

SEQ ID NO: 3199917 - RNA, 23 nt, Mycobacterium bovis subsp bovis AF2122/97
cuuggccuaugcugcccggcaac

SEQ ID NO: 3199918 - RNA, 15 nt, Mycobacterium bovis subsp bovis AF2122/97
cuuggccucagccac

SEQ ID NO: 3199919 - RNA, 16 nt, Mycobacterium bovis subsp bovis AF2122/97
cuuggcgaacgccacg

SEQ ID NO: 3199920 - RNA, 14 nt, Mycobacterium bovis subsp bovis AF2122/97
cuuggcgaccaugc

SEQ ID NO: 3199921 - RNA, 21 nt, Mycobacterium bovis subsp bovis AF2122/97
cuuggcgaccuugacccgcaa

SEQ ID NO: 3199922 - RNA, 17 nt, Mycobacterium bovis subsp bovis AF2122/97
cuuggcgauccaggcca

SEQ ID NO: 3199923 - RNA, 20 nt, Mycobacterium bovis subsp bovis AF2122/97
cuuggcgaucggguugaacc

SEQ ID NO: 3199924 - RNA, 16 nt, Mycobacterium bovis subsp bovis AF2122/97
cuuggcgaucucaccu

SEQ ID NO: 3199925 - RNA, 16 nt, Mycobacterium bovis subsp bovis AF2122/97
cuuggcgaucuccagc

SEQ ID NO: 3199926 - RNA, 13 nt, Mycobacterium bovis subsp bovis AF2122/97
cuuggcgccaccg

SEQ ID NO: 3199927 - RNA, 16 nt, Mycobacterium bovis subsp bovis AF2122/97
cuuggcgccaccggcg

SEQ ID NO: 3199928 - RNA, 14 nt, Mycobacterium bovis subsp bovis AF2122/97
cuuggcggccagcg

SEQ ID NO: 3199929 - RNA, 17 nt, Mycobacterium bovis subsp bovis AF2122/97
cuuggcggccuuugucg

SEQ ID NO: 3199930 - RNA, 13 nt, Mycobacterium bovis subsp bovis AF2122/97
cuuggcggcggca

SEQ ID NO: 3199931 - RNA, 17 nt, Mycobacterium bovis subsp bovis AF2122/97
cuuggcgggagccuugg

SEQ ID NO: 3199932 - RNA, 15 nt, Mycobacterium bovis subsp bovis AF2122/97
cuuggcgggaucgag

SEQ ID NO: 3199933 - RNA, 12 nt, Mycobacterium bovis subsp bovis AF2122/97
cuuggcgggcgc

SEQ ID NO: 3199934 - RNA, 12 nt, Mycobacterium bovis subsp bovis AF2122/97
cuuggcgucgau

SEQ ID NO: 3199935 - RNA, 21 nt, Mycobacterium bovis subsp bovis AF2122/97
cuuggcgucgaucagggcccc

SEQ ID NO: 3199936 - RNA, 24 nt, Mycobacterium bovis subsp bovis AF2122/97
cuuggcgugaccuaccuccucggc

SEQ ID NO: 3199937 - RNA, 15 nt, Mycobacterium bovis subsp bovis AF2122/97
cuuggcguugaccag

SEQ ID NO: 3199938 - RNA, 19 nt, Mycobacterium bovis subsp bovis AF2122/97
cuuggcguugaugucggcc

SEQ ID NO: 3199939 - RNA, 22 nt, Mycobacterium bovis subsp bovis AF2122/97
cuuggcugugauguuguucagc

SEQ ID NO: 3199940 - RNA, 23 nt, Mycobacterium bovis subsp bovis AF2122/97
cuuggcuucgacgcuuccugggu

SEQ ID NO: 3199941 - RNA, 16 nt, Mycobacterium bovis subsp bovis AF2122/97
cuugggauuugggcga

SEQ ID NO: 3199942 - RNA, 13 nt, Mycobacterium bovis subsp bovis AF2122/97
cuugggcaccacc

SEQ ID NO: 3199943 - RNA, 16 nt, Mycobacterium bovis subsp bovis AF2122/97
cuugggcagcagcgcg

SEQ ID NO: 3199944 - RNA, 17 nt, Mycobacterium bovis subsp bovis AF2122/97
cuugggcagcagcgcgc

SEQ ID NO: 3199945 - RNA, 13 nt, Mycobacterium bovis subsp bovis AF2122/97
cuugggcagcuug

SEQ ID NO: 3199946 - RNA, 17 nt, Mycobacterium bovis subsp bovis AF2122/97
cuugggccaggcccagc

SEQ ID NO: 3199947 - RNA, 16 nt, Mycobacterium bovis subsp bovis AF2122/97
cuugggccugggccgc

SEQ ID NO: 3199948 - RNA, 21 nt, Mycobacterium bovis subsp bovis AF2122/97
cuugggcgacgcggcgccgcc

SEQ ID NO: 3199949 - RNA, 21 nt, Mycobacterium bovis subsp bovis AF2122/97
cuugggcguacucggcgcgca

SEQ ID NO: 3199950 - RNA, 21 nt, Mycobacterium bovis subsp bovis AF2122/97
cuuggggcguuguugggcgag

SEQ ID NO: 3199951 - RNA, 20 nt, Mycobacterium bovis subsp bovis AF2122/97
cuugggggucaggcguaucc

SEQ ID NO: 3199952 - RNA, 17 nt, Mycobacterium bovis subsp bovis AF2122/97
cuugguagccggccgcu

SEQ ID NO: 3199953 - RNA, 22 nt, Mycobacterium bovis subsp bovis AF2122/97
cuuggucaaaaagcucggcccu

SEQ ID NO: 3199954 - RNA, 14 nt, Mycobacterium bovis subsp bovis AF2122/97
cuuggucaccuucu

SEQ ID NO: 3199955 - RNA, 15 nt, Mycobacterium bovis subsp bovis AF2122/97
cuuggucaccuucuu

SEQ ID NO: 3199956 - RNA, 16 nt, Mycobacterium bovis subsp bovis AF2122/97
cuuggucaccuucuug

SEQ ID NO: 3199957 - RNA, 23 nt, Mycobacterium bovis subsp bovis AF2122/97
cuuggucaggcuggaggugaacu

SEQ ID NO: 3199958 - RNA, 21 nt, Mycobacterium bovis subsp bovis AF2122/97
cuuggucagugugaacugucc

SEQ ID NO: 3199959 - RNA, 17 nt, Mycobacterium bovis subsp bovis AF2122/97
cuugguccugcggucgc

SEQ ID NO: 3199960 - RNA, 16 nt, Mycobacterium bovis subsp bovis AF2122/97
cuuggucgaccgccga

SEQ ID NO: 3199961 - RNA, 18 nt, Mycobacterium bovis subsp bovis AF2122/97
cuuggucgaccgccgaga

SEQ ID NO: 3199962 - RNA, 16 nt, Mycobacterium bovis subsp bovis AF2122/97
cuuggucgccaugucg

SEQ ID NO: 3199963 - RNA, 21 nt, Mycobacterium bovis subsp bovis AF2122/97
cuuggucgcccagccacugac

SEQ ID NO: 3199964 - RNA, 17 nt, Mycobacterium bovis subsp bovis AF2122/97
cuuggucgccgccuucu

SEQ ID NO: 3199965 - RNA, 13 nt, Mycobacterium bovis subsp bovis AF2122/97
cuuggucgccgcu

SEQ ID NO: 3199966 - RNA, 13 nt, Mycobacterium bovis subsp bovis AF2122/97
cuuggucgccggc

SEQ ID NO: 3199967 - RNA, 14 nt, Mycobacterium bovis subsp bovis AF2122/97
cuuggucgccggcg

SEQ ID NO: 3199968 - RNA, 22 nt, Mycobacterium bovis subsp bovis AF2122/97
cuuggucgccggcgucgagccg

SEQ ID NO: 3199969 - RNA, 19 nt, Mycobacterium bovis subsp bovis AF2122/97
cuuggugaaccgcgcggcg

SEQ ID NO: 3199970 - RNA, 23 nt, Mycobacterium bovis subsp bovis AF2122/97
cuuggugaagaucgacacccguu

SEQ ID NO: 3199971 - RNA, 21 nt, Mycobacterium bovis subsp bovis AF2122/97
cuuggugcccaaggcagaccc

SEQ ID NO: 3199972 - RNA, 22 nt, Mycobacterium bovis subsp bovis AF2122/97
cuuggugcgcgucagccgcacc

SEQ ID NO: 3199973 - RNA, 15 nt, Mycobacterium bovis subsp bovis AF2122/97
cuugguggccagcca

SEQ ID NO: 3199974 - RNA, 16 nt, Mycobacterium bovis subsp bovis AF2122/97
cuugguggcguggccc

SEQ ID NO: 3199975 - RNA, 23 nt, Mycobacterium bovis subsp bovis AF2122/97
cuugguggcguggcccucggcga

SEQ ID NO: 3199976 - RNA, 17 nt, Mycobacterium bovis subsp bovis AF2122/97
cuugguggugguacggg

SEQ ID NO: 3199977 - RNA, 19 nt, Mycobacterium bovis subsp bovis AF2122/97
cuuguagcgcaucgccaau

SEQ ID NO: 3199978 - RNA, 18 nt, Mycobacterium bovis subsp bovis AF2122/97
cuugucaaaggugcacug

SEQ ID NO: 3199979 - RNA, 17 nt, Mycobacterium bovis subsp bovis AF2122/97
cuugucagccgcgaccg

SEQ ID NO: 3199980 - RNA, 15 nt, Mycobacterium bovis subsp bovis AF2122/97
cuuguccaggaucgc

SEQ ID NO: 3199981 - RNA, 18 nt, Mycobacterium bovis subsp bovis AF2122/97
cuuguccaucacauccac

SEQ ID NO: 3199982 - RNA, 14 nt, Mycobacterium bovis subsp bovis AF2122/97
cuuguccucacaug

SEQ ID NO: 3199983 - RNA, 15 nt, Mycobacterium bovis subsp bovis AF2122/97
cuugucgaccacgac

SEQ ID NO: 3199984 - RNA, 13 nt, Mycobacterium bovis subsp bovis AF2122/97
cuugucgaggcgc

SEQ ID NO: 3199985 - RNA, 16 nt, Mycobacterium bovis subsp bovis AF2122/97
cuugucgccccaugcg

SEQ ID NO: 3199986 - RNA, 23 nt, Mycobacterium bovis subsp bovis AF2122/97
cuugucgccggcauacaccguga

SEQ ID NO: 3199987 - RNA, 15 nt, Mycobacterium bovis subsp bovis AF2122/97
cuugucgcggugcgg

SEQ ID NO: 3199988 - RNA, 23 nt, Mycobacterium bovis subsp bovis AF2122/97
cuugucgcggugcggcagauacu

SEQ ID NO: 3199989 - RNA, 15 nt, Mycobacterium bovis subsp bovis AF2122/97
cuugucgcguucggc

SEQ ID NO: 3199990 - RNA, 14 nt, Mycobacterium bovis subsp bovis AF2122/97
cuugucggccccgg

SEQ ID NO: 3199991 - RNA, 18 nt, Mycobacterium bovis subsp bovis AF2122/97
cuugucggcgugucgcgu

SEQ ID NO: 3199992 - RNA, 14 nt, Mycobacterium bovis subsp bovis AF2122/97
cuugugcagaucag

SEQ ID NO: 3199993 - RNA, 20 nt, Mycobacterium bovis subsp bovis AF2122/97
cuugugcagaucagcguccc

SEQ ID NO: 3199994 - RNA, 17 nt, Mycobacterium bovis subsp bovis AF2122/97
cuugugccccgagcugc

SEQ ID NO: 3199995 - RNA, 19 nt, Mycobacterium bovis subsp bovis AF2122/97
cuugugccccgagcugccg

SEQ ID NO: 3199996 - RNA, 15 nt, Mycobacterium bovis subsp bovis AF2122/97
cuuguggacccgcca

SEQ ID NO: 3199997 - RNA, 18 nt, Mycobacterium bovis subsp bovis AF2122/97
cuuguggacccgccaggg

SEQ ID NO: 3199998 - RNA, 20 nt, Mycobacterium bovis subsp bovis AF2122/97
cuuguggcacacccgcaccg

SEQ ID NO: 3199999 - RNA, 14 nt, Mycobacterium bovis subsp bovis AF2122/97
cuugugggcgacgg

SEQ ID NO: 3200000 - RNA, 20 nt, Mycobacterium bovis subsp bovis AF2122/97
cuugugggcgacggcgauga

SEQ ID NO: 3200001 - RNA, 14 nt, Mycobacterium bovis subsp bovis AF2122/97
cuuguggucugcca

SEQ ID NO: 3200002 - RNA, 18 nt, Mycobacterium bovis subsp bovis AF2122/97
cuuguggugagcggaauc

SEQ ID NO: 3200003 - RNA, 18 nt, Mycobacterium bovis subsp bovis AF2122/97
cuuguucaucaucugguc

SEQ ID NO: 3200004 - RNA, 13 nt, Mycobacterium bovis subsp bovis AF2122/97
cuuguuccagcgc

SEQ ID NO: 3200005 - RNA, 16 nt, Mycobacterium bovis subsp bovis AF2122/97
cuuguucggacucacu

SEQ ID NO: 3200006 - RNA, 14 nt, Mycobacterium bovis subsp bovis AF2122/97
cuuguugaccacca

SEQ ID NO: 3200007 - RNA, 14 nt, Mycobacterium bovis subsp bovis AF2122/97
cuuguugccgccgg

SEQ ID NO: 3200008 - RNA, 18 nt, Mycobacterium bovis subsp bovis AF2122/97
cuuguugccgccggccau

SEQ ID NO: 3200009 - RNA, 14 nt, Mycobacterium bovis subsp bovis AF2122/97
cuuguugcgcgacg

SEQ ID NO: 3200010 - RNA, 16 nt, Mycobacterium bovis subsp bovis AF2122/97
cuuguuggcgcccggg

SEQ ID NO: 3200011 - RNA, 14 nt, Mycobacterium bovis subsp bovis AF2122/97
cuuguuguggugga

SEQ ID NO: 3200012 - RNA, 18 nt, Mycobacterium bovis subsp bovis AF2122/97
cuuguuugucaccgcagc

SEQ ID NO: 3200013 - RNA, 23 nt, Mycobacterium bovis subsp bovis AF2122/97
cuuuaauccagcgccgaccuccu

SEQ ID NO: 3200014 - RNA, 19 nt, Mycobacterium bovis subsp bovis AF2122/97
cuuuagcgcgugcugcaga

SEQ ID NO: 3200015 - RNA, 17 nt, Mycobacterium bovis subsp bovis AF2122/97
cuuuagugucugcucgc

SEQ ID NO: 3200016 - RNA, 18 nt, Mycobacterium bovis subsp bovis AF2122/97
cuuuagugucugcucgcg

SEQ ID NO: 3200017 - RNA, 14 nt, Mycobacterium bovis subsp bovis AF2122/97
cuuucagcaggaga

SEQ ID NO: 3200018 - RNA, 21 nt, Mycobacterium bovis subsp bovis AF2122/97
cuuucauugacacugugcgcc

SEQ ID NO: 3200019 - RNA, 23 nt, Mycobacterium bovis subsp bovis AF2122/97
cuuuccaauuuagggauaacgac

SEQ ID NO: 3200020 - RNA, 19 nt, Mycobacterium bovis subsp bovis AF2122/97
cuuuccagaguucccgaaa

SEQ ID NO: 3200021 - RNA, 14 nt, Mycobacterium bovis subsp bovis AF2122/97
cuuucccaccuuca

SEQ ID NO: 3200022 - RNA, 20 nt, Mycobacterium bovis subsp bovis AF2122/97
cuuucccgaugacgaagugc

SEQ ID NO: 3200023 - RNA, 19 nt, Mycobacterium bovis subsp bovis AF2122/97
cuuucccguugcugagcgu

SEQ ID NO: 3200024 - RNA, 15 nt, Mycobacterium bovis subsp bovis AF2122/97
cuuuccggccgccug

SEQ ID NO: 3200025 - RNA, 21 nt, Mycobacterium bovis subsp bovis AF2122/97
cuuucgauauagccgccggug

SEQ ID NO: 3200026 - RNA, 19 nt, Mycobacterium bovis subsp bovis AF2122/97
cuuucgcccagucgccgcg

SEQ ID NO: 3200027 - RNA, 20 nt, Mycobacterium bovis subsp bovis AF2122/97
cuuucgcgccgcgaggcacc

SEQ ID NO: 3200028 - RNA, 24 nt, Mycobacterium bovis subsp bovis AF2122/97
cuuucgcgccgcgaggcaccgaca

SEQ ID NO: 3200029 - RNA, 18 nt, Mycobacterium bovis subsp bovis AF2122/97
cuuucggaaaaccgcacc

SEQ ID NO: 3200030 - RNA, 22 nt, Mycobacterium bovis subsp bovis AF2122/97
cuuucggaaaaccgcaccgucc

SEQ ID NO: 3200031 - RNA, 22 nt, Mycobacterium bovis subsp bovis AF2122/97
cuuucguugguuaucccagacu

SEQ ID NO: 3200032 - RNA, 16 nt, Mycobacterium bovis subsp bovis AF2122/97
cuuugacgcccggcac

SEQ ID NO: 3200033 - RNA, 18 nt, Mycobacterium bovis subsp bovis AF2122/97
cuuugacgcccggcaccc

SEQ ID NO: 3200034 - RNA, 20 nt, Mycobacterium bovis subsp bovis AF2122/97
cuuugacgcccggcaccccu

SEQ ID NO: 3200035 - RNA, 17 nt, Mycobacterium bovis subsp bovis AF2122/97
cuuugacgcccucggcg

SEQ ID NO: 3200036 - RNA, 16 nt, Mycobacterium bovis subsp bovis AF2122/97
cuuugacgccgagcac

SEQ ID NO: 3200037 - RNA, 17 nt, Mycobacterium bovis subsp bovis AF2122/97
cuuugagcgcggccacc

SEQ ID NO: 3200038 - RNA, 18 nt, Mycobacterium bovis subsp bovis AF2122/97
cuuugagcgcggccacca

SEQ ID NO: 3200039 - RNA, 16 nt, Mycobacterium bovis subsp bovis AF2122/97
cuuugcacagcggcau

SEQ ID NO: 3200040 - RNA, 13 nt, Mycobacterium bovis subsp bovis AF2122/97
cuuugcccgccgc

SEQ ID NO: 3200041 - RNA, 15 nt, Mycobacterium bovis subsp bovis AF2122/97
cuuugccgccggcac

SEQ ID NO: 3200042 - RNA, 17 nt, Mycobacterium bovis subsp bovis AF2122/97
cuuugccgccggcaccg

SEQ ID NO: 3200043 - RNA, 22 nt, Mycobacterium bovis subsp bovis AF2122/97
cuuugcgaaucggcccgugcca

SEQ ID NO: 3200044 - RNA, 17 nt, Mycobacterium bovis subsp bovis AF2122/97
cuuugcggcgggcaccg

SEQ ID NO: 3200045 - RNA, 14 nt, Mycobacterium bovis subsp bovis AF2122/97
cuuugcguucccau

SEQ ID NO: 3200046 - RNA, 20 nt, Mycobacterium bovis subsp bovis AF2122/97
cuuugcguucccaucccuca

SEQ ID NO: 3200047 - RNA, 14 nt, Mycobacterium bovis subsp bovis AF2122/97
cuuugcuugccgca

SEQ ID NO: 3200048 - RNA, 17 nt, Mycobacterium bovis subsp bovis AF2122/97
cuuugcuugccgcauac

SEQ ID NO: 3200049 - RNA, 13 nt, Mycobacterium bovis subsp bovis AF2122/97
cuuugggcggccc

SEQ ID NO: 3200050 - RNA, 22 nt, Mycobacterium bovis subsp bovis AF2122/97
cuuugggcggcccaccggccac

SEQ ID NO: 3200051 - RNA, 13 nt, Mycobacterium bovis subsp bovis AF2122/97
cuuugggcugccg

SEQ ID NO: 3200052 - RNA, 17 nt, Mycobacterium bovis subsp bovis AF2122/97
cuuuggguccgggcggc

SEQ ID NO: 3200053 - RNA, 23 nt, Mycobacterium bovis subsp bovis AF2122/97
cuuugguuguuggugccagccgg

SEQ ID NO: 3200054 - RNA, 19 nt, Mycobacterium bovis subsp bovis AF2122/97
cuuugucacgcaccgcggu

SEQ ID NO: 3200055 - RNA, 19 nt, Mycobacterium bovis subsp bovis AF2122/97
cuuugucgcggagucugcu

SEQ ID NO: 3200056 - RNA, 15 nt, Mycobacterium bovis subsp bovis AF2122/97
cuuuuacgucugcuc

SEQ ID NO: 3200057 - RNA, 14 nt, Mycobacterium bovis subsp bovis AF2122/97
cuuuugcgucugcu

SEQ ID NO: 3200058 - RNA, 21 nt, Mycobacterium bovis subsp bovis AF2122/97
cuuuugcgucugcucgcgcaa

SEQ ID NO: 3200059 - RNA, 22 nt, Mycobacterium bovis subsp bovis AF2122/97
cuuuuucccggcggcgcgcccg

SEQ ID NO: 3200060 - RNA, 15 nt, Mycobacterium bovis subsp bovis AF2122/97
cuuuuugcgucuguu

SEQ ID NO: 3200061 - RNA, 15 nt, Mycobacterium bovis subsp bovis AF2122/97
gaaaaaccucgacgc

SEQ ID NO: 3200062 - RNA, 20 nt, Mycobacterium bovis subsp bovis AF2122/97
gaaaaagaccgacagcggca

SEQ ID NO: 3200063 - RNA, 13 nt, Mycobacterium bovis subsp bovis AF2122/97
gaaaacaccgcac

SEQ ID NO: 3200064 - RNA, 21 nt, Mycobacterium bovis subsp bovis AF2122/97
gaaaacauguuccacccggug

SEQ ID NO: 3200065 - RNA, 14 nt, Mycobacterium bovis subsp bovis AF2122/97
gaaaacauugcggc

SEQ ID NO: 3200066 - RNA, 20 nt, Mycobacterium bovis subsp bovis AF2122/97
gaaaacccagaucggcgacg

SEQ ID NO: 3200067 - RNA, 23 nt, Mycobacterium bovis subsp bovis AF2122/97
gaaaacccggucggcgaaaggcc

SEQ ID NO: 3200068 - RNA, 21 nt, Mycobacterium bovis subsp bovis AF2122/97
gaaaacccucgcugcggugga

SEQ ID NO: 3200069 - RNA, 21 nt, Mycobacterium bovis subsp bovis AF2122/97
gaaaaccgucgcagaaaccau

SEQ ID NO: 3200070 - RNA, 24 nt, Mycobacterium bovis subsp bovis AF2122/97
gaaaacgaacccacugcccgccga

SEQ ID NO: 3200071 - RNA, 14 nt, Mycobacterium bovis subsp bovis AF2122/97
gaaaacgcccggca

SEQ ID NO: 3200072 - RNA, 16 nt, Mycobacterium bovis subsp bovis AF2122/97
gaaaacggcggcgccg

SEQ ID NO: 3200073 - RNA, 14 nt, Mycobacterium bovis subsp bovis AF2122/97
gaaaagacugcgcc

SEQ ID NO: 3200074 - RNA, 23 nt, Mycobacterium bovis subsp bovis AF2122/97
gaaaagccgugcaccagcgacca

SEQ ID NO: 3200075 - RNA, 22 nt, Mycobacterium bovis subsp bovis AF2122/97
gaaaagccguucgcgucgccga

SEQ ID NO: 3200076 - RNA, 15 nt, Mycobacterium bovis subsp bovis AF2122/97
gaaaagcgccucggu

SEQ ID NO: 3200077 - RNA, 18 nt, Mycobacterium bovis subsp bovis AF2122/97
gaaaagcgccucgguggu

SEQ ID NO: 3200078 - RNA, 15 nt, Mycobacterium bovis subsp bovis AF2122/97
gaaaauaggccgggc

SEQ ID NO: 3200079 - RNA, 21 nt, Mycobacterium bovis subsp bovis AF2122/97
gaaaaucgggucacacuccca

SEQ ID NO: 3200080 - RNA, 20 nt, Mycobacterium bovis subsp bovis AF2122/97
gaaaaugacccacacaccga

SEQ ID NO: 3200081 - RNA, 17 nt, Mycobacterium bovis subsp bovis AF2122/97
gaaaaugauagcggcgc

SEQ ID NO: 3200082 - RNA, 14 nt, Mycobacterium bovis subsp bovis AF2122/97
gaaaaugccgccca

SEQ ID NO: 3200083 - RNA, 22 nt, Mycobacterium bovis subsp bovis AF2122/97
gaaacaacgucgccgcggcggc

SEQ ID NO: 3200084 - RNA, 17 nt, Mycobacterium bovis subsp bovis AF2122/97
gaaacaagcaagcgugu

SEQ ID NO: 3200085 - RNA, 22 nt, Mycobacterium bovis subsp bovis AF2122/97
gaaacaagcaagcguguuguuu

SEQ ID NO: 3200086 - RNA, 18 nt, Mycobacterium bovis subsp bovis AF2122/97
gaaacaccgacgacggcg

SEQ ID NO: 3200087 - RNA, 15 nt, Mycobacterium bovis subsp bovis AF2122/97
gaaacaccggccagc

SEQ ID NO: 3200088 - RNA, 13 nt, Mycobacterium bovis subsp bovis AF2122/97
gaaacaccgucug

SEQ ID NO: 3200089 - RNA, 14 nt, Mycobacterium bovis subsp bovis AF2122/97
gaaacaccgucugg

SEQ ID NO: 3200090 - RNA, 23 nt, Mycobacterium bovis subsp bovis AF2122/97
gaaacagcacccagacgauggcc

SEQ ID NO: 3200091 - RNA, 14 nt, Mycobacterium bovis subsp bovis AF2122/97
gaaacagcauggcg

SEQ ID NO: 3200092 - RNA, 15 nt, Mycobacterium bovis subsp bovis AF2122/97
gaaacagccgcagcg

SEQ ID NO: 3200093 - RNA, 21 nt, Mycobacterium bovis subsp bovis AF2122/97
gaaacagguaagcagccagca

SEQ ID NO: 3200094 - RNA, 22 nt, Mycobacterium bovis subsp bovis AF2122/97
gaaacagguaagcagccagcaa

SEQ ID NO: 3200095 - RNA, 20 nt, Mycobacterium bovis subsp bovis AF2122/97
gaaacagugguuagucggcc

SEQ ID NO: 3200096 - RNA, 13 nt, Mycobacterium bovis subsp bovis AF2122/97
gaaacauccccga

SEQ ID NO: 3200097 - RNA, 23 nt, Mycobacterium bovis subsp bovis AF2122/97
gaaacaucucggcgcagccggug

SEQ ID NO: 3200098 - RNA, 12 nt, Mycobacterium bovis subsp bovis AF2122/97
gaaaccacugga

SEQ ID NO: 3200099 - RNA, 16 nt, Mycobacterium bovis subsp bovis AF2122/97
gaaaccaucgccagcc

SEQ ID NO: 3200100 - RNA, 18 nt, Mycobacterium bovis subsp bovis AF2122/97
gaaaccaucgccagccgg

SEQ ID NO: 3200101 - RNA, 21 nt, Mycobacterium bovis subsp bovis AF2122/97
gaaaccaugccgccgaagccg

SEQ ID NO: 3200102 - RNA, 23 nt, Mycobacterium bovis subsp bovis AF2122/97
gaaaccaugccgccgaagccgcg

SEQ ID NO: 3200103 - RNA, 17 nt, Mycobacterium bovis subsp bovis AF2122/97
gaaacccaugaccuuca

SEQ ID NO: 3200104 - RNA, 17 nt, Mycobacterium bovis subsp bovis AF2122/97
gaaacccaugcaugcgu

SEQ ID NO: 3200105 - RNA, 15 nt, Mycobacterium bovis subsp bovis AF2122/97
gaaacccgccgaacg

SEQ ID NO: 3200106 - RNA, 15 nt, Mycobacterium bovis subsp bovis AF2122/97
gaaacccggccagcu

SEQ ID NO: 3200107 - RNA, 15 nt, Mycobacterium bovis subsp bovis AF2122/97
gaaacccggcgacca

SEQ ID NO: 3200108 - RNA, 14 nt, Mycobacterium bovis subsp bovis AF2122/97
gaaaccgcagcgcg

SEQ ID NO: 3200109 - RNA, 21 nt, Mycobacterium bovis subsp bovis AF2122/97
gaaaccgccccgugggccucg

SEQ ID NO: 3200110 - RNA, 19 nt, Mycobacterium bovis subsp bovis AF2122/97
gaaaccgcugggggcgguc

SEQ ID NO: 3200111 - RNA, 21 nt, Mycobacterium bovis subsp bovis AF2122/97
gaaaccgcugggggcggucgc

SEQ ID NO: 3200112 - RNA, 20 nt, Mycobacterium bovis subsp bovis AF2122/97
gaaaccggaccugaccggug

SEQ ID NO: 3200113 - RNA, 16 nt, Mycobacterium bovis subsp bovis AF2122/97
gaaaccggccagccga

SEQ ID NO: 3200114 - RNA, 19 nt, Mycobacterium bovis subsp bovis AF2122/97
gaaaccggccagccgacgc

SEQ ID NO: 3200115 - RNA, 20 nt, Mycobacterium bovis subsp bovis AF2122/97
gaaaccguggguucacguuc

SEQ ID NO: 3200116 - RNA, 18 nt, Mycobacterium bovis subsp bovis AF2122/97
gaaaccucuucgggugca

SEQ ID NO: 3200117 - RNA, 15 nt, Mycobacterium bovis subsp bovis AF2122/97
gaaacgaauccgcca

SEQ ID NO: 3200118 - RNA, 13 nt, Mycobacterium bovis subsp bovis AF2122/97
gaaacgccaccgu

SEQ ID NO: 3200119 - RNA, 22 nt, Mycobacterium bovis subsp bovis AF2122/97
gaaacgccaggggacccggggc

SEQ ID NO: 3200120 - RNA, 14 nt, Mycobacterium bovis subsp bovis AF2122/97
gaaacgccgaccgc

SEQ ID NO: 3200121 - RNA, 16 nt, Mycobacterium bovis subsp bovis AF2122/97
gaaacgccgagcgcca

SEQ ID NO: 3200122 - RNA, 22 nt, Mycobacterium bovis subsp bovis AF2122/97
gaaacgccgcaauggaccgaac

SEQ ID NO: 3200123 - RNA, 18 nt, Mycobacterium bovis subsp bovis AF2122/97
gaaacgccggguucgccg

SEQ ID NO: 3200124 - RNA, 14 nt, Mycobacterium bovis subsp bovis AF2122/97
gaaacgccgucgcc

SEQ ID NO: 3200125 - RNA, 23 nt, Mycobacterium bovis subsp bovis AF2122/97
gaaacgcguaucccagauacauc

SEQ ID NO: 3200126 - RNA, 16 nt, Mycobacterium bovis subsp bovis AF2122/97
gaaacggaccuccucg

SEQ ID NO: 3200127 - RNA, 15 nt, Mycobacterium bovis subsp bovis AF2122/97
gaaacggagccgagc

SEQ ID NO: 3200128 - RNA, 20 nt, Mycobacterium bovis subsp bovis AF2122/97
gaaacggauuggucgaccga

SEQ ID NO: 3200129 - RNA, 17 nt, Mycobacterium bovis subsp bovis AF2122/97
gaaacguccuugaacgu

SEQ ID NO: 3200130 - RNA, 22 nt, Mycobacterium bovis subsp bovis AF2122/97
gaaacgucugccacgucggcga

SEQ ID NO: 3200131 - RNA, 18 nt, Mycobacterium bovis subsp bovis AF2122/97
gaaacuacucccccgcga

SEQ ID NO: 3200132 - RNA, 16 nt, Mycobacterium bovis subsp bovis AF2122/97
gaaacucaccagcacc

SEQ ID NO: 3200133 - RNA, 17 nt, Mycobacterium bovis subsp bovis AF2122/97
gaaacucaccagcaccc

SEQ ID NO: 3200134 - RNA, 18 nt, Mycobacterium bovis subsp bovis AF2122/97
gaaacucaccagcacccc

SEQ ID NO: 3200135 - RNA, 20 nt, Mycobacterium bovis subsp bovis AF2122/97
gaaacucaccagcaccccga

SEQ ID NO: 3200136 - RNA, 12 nt, Mycobacterium bovis subsp bovis AF2122/97
gaaacugacccg

SEQ ID NO: 3200137 - RNA, 15 nt, Mycobacterium bovis subsp bovis AF2122/97
gaaagacaacccgcu

SEQ ID NO: 3200138 - RNA, 18 nt, Mycobacterium bovis subsp bovis AF2122/97
gaaagacaguggcgcgua

SEQ ID NO: 3200139 - RNA, 14 nt, Mycobacterium bovis subsp bovis AF2122/97
gaaagagccagcgg

SEQ ID NO: 3200140 - RNA, 22 nt, Mycobacterium bovis subsp bovis AF2122/97
gaaagaucgguugaucugucag

SEQ ID NO: 3200141 - RNA, 15 nt, Mycobacterium bovis subsp bovis AF2122/97
gaaagaucucgguca

SEQ ID NO: 3200142 - RNA, 12 nt, Mycobacterium bovis subsp bovis AF2122/97
gaaagccaggcg

SEQ ID NO: 3200143 - RNA, 15 nt, Mycobacterium bovis subsp bovis AF2122/97
gaaagccgcggccga

SEQ ID NO: 3200144 - RNA, 17 nt, Mycobacterium bovis subsp bovis AF2122/97
gaaagccuugccgucga

SEQ ID NO: 3200145 - RNA, 13 nt, Mycobacterium bovis subsp bovis AF2122/97
gaaagcgccgaaa

SEQ ID NO: 3200146 - RNA, 17 nt, Mycobacterium bovis subsp bovis AF2122/97
gaaagcggccgucggga

SEQ ID NO: 3200147 - RNA, 17 nt, Mycobacterium bovis subsp bovis AF2122/97
gaaagcguaaggccgga

SEQ ID NO: 3200148 - RNA, 23 nt, Mycobacterium bovis subsp bovis AF2122/97
gaaagcuaccgaucgccaaggcg

SEQ ID NO: 3200149 - RNA, 14 nt, Mycobacterium bovis subsp bovis AF2122/97
gaaagggccgccgc

SEQ ID NO: 3200150 - RNA, 15 nt, Mycobacterium bovis subsp bovis AF2122/97
gaaagucgcgcgcga

SEQ ID NO: 3200151 - RNA, 17 nt, Mycobacterium bovis subsp bovis AF2122/97
gaaagugccagugcgca

SEQ ID NO: 3200152 - RNA, 21 nt, Mycobacterium bovis subsp bovis AF2122/97
gaaaguguggaauggaccagc

SEQ ID NO: 3200153 - RNA, 15 nt, Mycobacterium bovis subsp bovis AF2122/97
gaaaguuccacgaca

SEQ ID NO: 3200154 - RNA, 21 nt, Mycobacterium bovis subsp bovis AF2122/97
gaaaguuguaucgcagcauca

SEQ ID NO: 3200155 - RNA, 18 nt, Mycobacterium bovis subsp bovis AF2122/97
gaaauacccagcgcagca

SEQ ID NO: 3200156 - RNA, 21 nt, Mycobacterium bovis subsp bovis AF2122/97
gaaauacccagcgcagcagcg

SEQ ID NO: 3200157 - RNA, 15 nt, Mycobacterium bovis subsp bovis AF2122/97
gaaauagcgagcguu

SEQ ID NO: 3200158 - RNA, 17 nt, Mycobacterium bovis subsp bovis AF2122/97
gaaauagcugcggaggg

SEQ ID NO: 3200159 - RNA, 22 nt, Mycobacterium bovis subsp bovis AF2122/97
gaaauaucucggugacgaugaa

SEQ ID NO: 3200160 - RNA, 15 nt, Mycobacterium bovis subsp bovis AF2122/97
gaaauauuggcccgu

SEQ ID NO: 3200161 - RNA, 19 nt, Mycobacterium bovis subsp bovis AF2122/97
gaaaucaccucaccaguca

SEQ ID NO: 3200162 - RNA, 22 nt, Mycobacterium bovis subsp bovis AF2122/97
gaaaucaguucccgaaccccga

SEQ ID NO: 3200163 - RNA, 16 nt, Mycobacterium bovis subsp bovis AF2122/97
gaaauccccugcgcug

SEQ ID NO: 3200164 - RNA, 15 nt, Mycobacterium bovis subsp bovis AF2122/97
gaaauccgagccgcg

SEQ ID NO: 3200165 - RNA, 19 nt, Mycobacterium bovis subsp bovis AF2122/97
gaaauccugguggcagaca

SEQ ID NO: 3200166 - RNA, 17 nt, Mycobacterium bovis subsp bovis AF2122/97
gaaaucgacagcagcgc

SEQ ID NO: 3200167 - RNA, 16 nt, Mycobacterium bovis subsp bovis AF2122/97
gaaaucgcacagcgca

SEQ ID NO: 3200168 - RNA, 17 nt, Mycobacterium bovis subsp bovis AF2122/97
gaaaucgcccugacccg

SEQ ID NO: 3200169 - RNA, 18 nt, Mycobacterium bovis subsp bovis AF2122/97
gaaaucgcccugacccgg

SEQ ID NO: 3200170 - RNA, 20 nt, Mycobacterium bovis subsp bovis AF2122/97
gaaaucgcccugacccggag

SEQ ID NO: 3200171 - RNA, 18 nt, Mycobacterium bovis subsp bovis AF2122/97
gaaaucggccagcuuccc

SEQ ID NO: 3200172 - RNA, 19 nt, Mycobacterium bovis subsp bovis AF2122/97
gaaaucggccagcuucccg

SEQ ID NO: 3200173 - RNA, 22 nt, Mycobacterium bovis subsp bovis AF2122/97
gaaaucggcggcguccagcagc

SEQ ID NO: 3200174 - RNA, 19 nt, Mycobacterium bovis subsp bovis AF2122/97
gaaaucgggaucugcgccg

SEQ ID NO: 3200175 - RNA, 23 nt, Mycobacterium bovis subsp bovis AF2122/97
gaaaucgucggguaccagcaccg

SEQ ID NO: 3200176 - RNA, 12 nt, Mycobacterium bovis subsp bovis AF2122/97
gaaaugacgguc

SEQ ID NO: 3200177 - RNA, 16 nt, Mycobacterium bovis subsp bovis AF2122/97
gaaaugaggucuuugc

SEQ ID NO: 3200178 - RNA, 23 nt, Mycobacterium bovis subsp bovis AF2122/97
gaaauggcgucgccggcaccggc

SEQ ID NO: 3200179 - RNA, 16 nt, Mycobacterium bovis subsp bovis AF2122/97
gaaaugguucgcacac

SEQ ID NO: 3200180 - RNA, 23 nt, Mycobacterium bovis subsp bovis AF2122/97
gaaaugguucgcacaccuccucg

SEQ ID NO: 3200181 - RNA, 21 nt, Mycobacterium bovis subsp bovis AF2122/97
gaaauguuggccguaccggug

SEQ ID NO: 3200182 - RNA, 21 nt, Mycobacterium bovis subsp bovis AF2122/97
gaaauuccggcgcggccggcc

SEQ ID NO: 3200183 - RNA, 16 nt, Mycobacterium bovis subsp bovis AF2122/97
gaaauucucgcccuga

SEQ ID NO: 3200184 - RNA, 14 nt, Mycobacterium bovis subsp bovis AF2122/97
gaaauugagccggc

SEQ ID NO: 3200185 - RNA, 16 nt, Mycobacterium bovis subsp bovis AF2122/97
gaaauugagccggccc

SEQ ID NO: 3200186 - RNA, 19 nt, Mycobacterium bovis subsp bovis AF2122/97
gaaauugagccggcccugc

SEQ ID NO: 3200187 - RNA, 23 nt, Mycobacterium bovis subsp bovis AF2122/97
gaaauugagccggcccugcucgc

SEQ ID NO: 3200188 - RNA, 18 nt, Mycobacterium bovis subsp bovis AF2122/97
gaaauugggcgauucugc

SEQ ID NO: 3200189 - RNA, 14 nt, Mycobacterium bovis subsp bovis AF2122/97
gaacaaaugccggu

SEQ ID NO: 3200190 - RNA, 16 nt, Mycobacterium bovis subsp bovis AF2122/97
gaacaaaugccggugc

SEQ ID NO: 3200191 - RNA, 20 nt, Mycobacterium bovis subsp bovis AF2122/97
gaacaaccacgcacgguggc

SEQ ID NO: 3200192 - RNA, 12 nt, Mycobacterium bovis subsp bovis AF2122/97
gaacaaccagca

SEQ ID NO: 3200193 - RNA, 20 nt, Mycobacterium bovis subsp bovis AF2122/97
gaacaacgcgacgaagcaga

SEQ ID NO: 3200194 - RNA, 16 nt, Mycobacterium bovis subsp bovis AF2122/97
gaacaacggcgcggca

SEQ ID NO: 3200195 - RNA, 19 nt, Mycobacterium bovis subsp bovis AF2122/97
gaacaacggcguaaucggg

SEQ ID NO: 3200196 - RNA, 21 nt, Mycobacterium bovis subsp bovis AF2122/97
gaacaacggcguaaucgggaa

SEQ ID NO: 3200197 - RNA, 16 nt, Mycobacterium bovis subsp bovis AF2122/97
gaacaauucacgcacc

SEQ ID NO: 3200198 - RNA, 16 nt, Mycobacterium bovis subsp bovis AF2122/97
gaacaauuucugcagc

SEQ ID NO: 3200199 - RNA, 16 nt, Mycobacterium bovis subsp bovis AF2122/97
gaacacaccgggcggg

SEQ ID NO: 3200200 - RNA, 18 nt, Mycobacterium bovis subsp bovis AF2122/97
gaacaccaaaucgauguc

SEQ ID NO: 3200201 - RNA, 13 nt, Mycobacterium bovis subsp bovis AF2122/97
gaacaccaccgcc

SEQ ID NO: 3200202 - RNA, 13 nt, Mycobacterium bovis subsp bovis AF2122/97
gaacaccagcagg

SEQ ID NO: 3200203 - RNA, 18 nt, Mycobacterium bovis subsp bovis AF2122/97
gaacaccagcaggaagaa

SEQ ID NO: 3200204 - RNA, 22 nt, Mycobacterium bovis subsp bovis AF2122/97
gaacaccagcaggaagaagccg

SEQ ID NO: 3200205 - RNA, 23 nt, Mycobacterium bovis subsp bovis AF2122/97
gaacaccagcaggaagaagccga

SEQ ID NO: 3200206 - RNA, 15 nt, Mycobacterium bovis subsp bovis AF2122/97
gaacaccagcgcgcc

SEQ ID NO: 3200207 - RNA, 16 nt, Mycobacterium bovis subsp bovis AF2122/97
gaacaccagcgcgccg

SEQ ID NO: 3200208 - RNA, 15 nt, Mycobacterium bovis subsp bovis AF2122/97
gaacaccaugaucag

SEQ ID NO: 3200209 - RNA, 19 nt, Mycobacterium bovis subsp bovis AF2122/97
gaacaccccgggcgccgau

SEQ ID NO: 3200210 - RNA, 15 nt, Mycobacterium bovis subsp bovis AF2122/97
gaacaccgaggcgac

SEQ ID NO: 3200211 - RNA, 18 nt, Mycobacterium bovis subsp bovis AF2122/97
gaacaccgaggcgaccgg

SEQ ID NO: 3200212 - RNA, 16 nt, Mycobacterium bovis subsp bovis AF2122/97
gaacaccgccgcgucg

SEQ ID NO: 3200213 - RNA, 21 nt, Mycobacterium bovis subsp bovis AF2122/97
gaacaccgccgcgucgagcac

SEQ ID NO: 3200214 - RNA, 15 nt, Mycobacterium bovis subsp bovis AF2122/97
gaacaccggccaggc

SEQ ID NO: 3200215 - RNA, 16 nt, Mycobacterium bovis subsp bovis AF2122/97
gaacaccggccaggcc

SEQ ID NO: 3200216 - RNA, 22 nt, Mycobacterium bovis subsp bovis AF2122/97
gaacaccggugaaacgaucgug

SEQ ID NO: 3200217 - RNA, 23 nt, Mycobacterium bovis subsp bovis AF2122/97
gaacaccggugaaacgaucgugc

SEQ ID NO: 3200218 - RNA, 20 nt, Mycobacterium bovis subsp bovis AF2122/97
gaacaccucggcacggaccg

SEQ ID NO: 3200219 - RNA, 18 nt, Mycobacterium bovis subsp bovis AF2122/97
gaacacgaauccggccac

SEQ ID NO: 3200220 - RNA, 13 nt, Mycobacterium bovis subsp bovis AF2122/97
gaacacgagcuca

SEQ ID NO: 3200221 - RNA, 18 nt, Mycobacterium bovis subsp bovis AF2122/97
gaacacgagcucaccugc

SEQ ID NO: 3200222 - RNA, 22 nt, Mycobacterium bovis subsp bovis AF2122/97
gaacacgaugcgcggugcgcgu

SEQ ID NO: 3200223 - RNA, 18 nt, Mycobacterium bovis subsp bovis AF2122/97
gaacacgcacacgaucgc

SEQ ID NO: 3200224 - RNA, 23 nt, Mycobacterium bovis subsp bovis AF2122/97
gaacacggcgucuuccucggcca

SEQ ID NO: 3200225 - RNA, 16 nt, Mycobacterium bovis subsp bovis AF2122/97
gaacacgucgacaccg

SEQ ID NO: 3200226 - RNA, 15 nt, Mycobacterium bovis subsp bovis AF2122/97
gaacacgucgggaug

SEQ ID NO: 3200227 - RNA, 14 nt, Mycobacterium bovis subsp bovis AF2122/97
gaacacguucggcg

SEQ ID NO: 3200228 - RNA, 17 nt, Mycobacterium bovis subsp bovis AF2122/97
gaacacguucggcgucg

SEQ ID NO: 3200229 - RNA, 22 nt, Mycobacterium bovis subsp bovis AF2122/97
gaacacguucggguacccggga

SEQ ID NO: 3200230 - RNA, 12 nt, Mycobacterium bovis subsp bovis AF2122/97
gaacagacgccc

SEQ ID NO: 3200231 - RNA, 22 nt, Mycobacterium bovis subsp bovis AF2122/97
gaacagacggcucagcgugcgc

SEQ ID NO: 3200232 - RNA, 21 nt, Mycobacterium bovis subsp bovis AF2122/97
gaacagcacauaugugcccgg

SEQ ID NO: 3200233 - RNA, 19 nt, Mycobacterium bovis subsp bovis AF2122/97
gaacagcaccgaacccgcc

SEQ ID NO: 3200234 - RNA, 21 nt, Mycobacterium bovis subsp bovis AF2122/97
gaacagcaccgaacccgccac

SEQ ID NO: 3200235 - RNA, 19 nt, Mycobacterium bovis subsp bovis AF2122/97
gaacagcaccgccggcgac

SEQ ID NO: 3200236 - RNA, 14 nt, Mycobacterium bovis subsp bovis AF2122/97
gaacagcaccuccg

SEQ ID NO: 3200237 - RNA, 22 nt, Mycobacterium bovis subsp bovis AF2122/97
gaacagcagcgcacugcccggg

SEQ ID NO: 3200238 - RNA, 15 nt, Mycobacterium bovis subsp bovis AF2122/97
gaacagcagguuggc

SEQ ID NO: 3200239 - RNA, 18 nt, Mycobacterium bovis subsp bovis AF2122/97
gaacagcgaaccgccggc

SEQ ID NO: 3200240 - RNA, 18 nt, Mycobacterium bovis subsp bovis AF2122/97
gaacagcgaaccggcugg

SEQ ID NO: 3200241 - RNA, 16 nt, Mycobacterium bovis subsp bovis AF2122/97
gaacagcgacgccaug

SEQ ID NO: 3200242 - RNA, 22 nt, Mycobacterium bovis subsp bovis AF2122/97
gaacagcgacgccauggucaga

SEQ ID NO: 3200243 - RNA, 21 nt, Mycobacterium bovis subsp bovis AF2122/97
gaacagcgcgucggagccggg

SEQ ID NO: 3200244 - RNA, 23 nt, Mycobacterium bovis subsp bovis AF2122/97
gaacagcgcgucggagccgggca

SEQ ID NO: 3200245 - RNA, 24 nt, Mycobacterium bovis subsp bovis AF2122/97
gaacagcggaucccgccggugugc

SEQ ID NO: 3200246 - RNA, 14 nt, Mycobacterium bovis subsp bovis AF2122/97
gaacagcggcagcu

SEQ ID NO: 3200247 - RNA, 22 nt, Mycobacterium bovis subsp bovis AF2122/97
gaacagcugcccgccagcgccg

SEQ ID NO: 3200248 - RNA, 20 nt, Mycobacterium bovis subsp bovis AF2122/97
gaacagcuucgcgcagccgg

SEQ ID NO: 3200249 - RNA, 14 nt, Mycobacterium bovis subsp bovis AF2122/97
gaacaggaucagcg

SEQ ID NO: 3200250 - RNA, 14 nt, Mycobacterium bovis subsp bovis AF2122/97
gaacaggcgaccgg

SEQ ID NO: 3200251 - RNA, 18 nt, Mycobacterium bovis subsp bovis AF2122/97
gaacagggaggucgccgc

SEQ ID NO: 3200252 - RNA, 22 nt, Mycobacterium bovis subsp bovis AF2122/97
gaacagggaggucgccgcaucg

SEQ ID NO: 3200253 - RNA, 23 nt, Mycobacterium bovis subsp bovis AF2122/97
gaacagggcugcgaugcgguucc

SEQ ID NO: 3200254 - RNA, 14 nt, Mycobacterium bovis subsp bovis AF2122/97
gaacaggguggugg

SEQ ID NO: 3200255 - RNA, 17 nt, Mycobacterium bovis subsp bovis AF2122/97
gaacagggugguggcgg

SEQ ID NO: 3200256 - RNA, 21 nt, Mycobacterium bovis subsp bovis AF2122/97
gaacagguuggccccggcccg

SEQ ID NO: 3200257 - RNA, 20 nt, Mycobacterium bovis subsp bovis AF2122/97
gaacagucgcagccaggcac

SEQ ID NO: 3200258 - RNA, 15 nt, Mycobacterium bovis subsp bovis AF2122/97
gaacagugccucgcg

SEQ ID NO: 3200259 - RNA, 23 nt, Mycobacterium bovis subsp bovis AF2122/97
gaacaguggggguccggcggccg

SEQ ID NO: 3200260 - RNA, 17 nt, Mycobacterium bovis subsp bovis AF2122/97
gaacaguugcacaccgg

SEQ ID NO: 3200261 - RNA, 19 nt, Mycobacterium bovis subsp bovis AF2122/97
gaacaguugcacaccggca

SEQ ID NO: 3200262 - RNA, 22 nt, Mycobacterium bovis subsp bovis AF2122/97
gaacaguugcacaccggcacug

SEQ ID NO: 3200263 - RNA, 20 nt, Mycobacterium bovis subsp bovis AF2122/97
gaacaguugcccgacgccgg

SEQ ID NO: 3200264 - RNA, 20 nt, Mycobacterium bovis subsp bovis AF2122/97
gaacaucaccucgaugccgc

SEQ ID NO: 3200265 - RNA, 14 nt, Mycobacterium bovis subsp bovis AF2122/97
gaacaucgccagcg

SEQ ID NO: 3200266 - RNA, 19 nt, Mycobacterium bovis subsp bovis AF2122/97
gaacaucgccagcgccggc

SEQ ID NO: 3200267 - RNA, 22 nt, Mycobacterium bovis subsp bovis AF2122/97
gaacaucgccagcgccggccag

SEQ ID NO: 3200268 - RNA, 20 nt, Mycobacterium bovis subsp bovis AF2122/97
gaacaugggaugcucaccgg

SEQ ID NO: 3200269 - RNA, 17 nt, Mycobacterium bovis subsp bovis AF2122/97
gaacaugugaccggcga

SEQ ID NO: 3200270 - RNA, 17 nt, Mycobacterium bovis subsp bovis AF2122/97
gaacauugcgcccagcg

SEQ ID NO: 3200271 - RNA, 14 nt, Mycobacterium bovis subsp bovis AF2122/97
gaaccaaucgcacg

SEQ ID NO: 3200272 - RNA, 12 nt, Mycobacterium bovis subsp bovis AF2122/97
gaaccaccaccg

SEQ ID NO: 3200273 - RNA, 17 nt, Mycobacterium bovis subsp bovis AF2122/97
gaaccaccacuucggcg

SEQ ID NO: 3200274 - RNA, 20 nt, Mycobacterium bovis subsp bovis AF2122/97
gaaccaccacuucggcgccg

SEQ ID NO: 3200275 - RNA, 14 nt, Mycobacterium bovis subsp bovis AF2122/97
gaaccaccagcacg

SEQ ID NO: 3200276 - RNA, 15 nt, Mycobacterium bovis subsp bovis AF2122/97
gaaccaccagcacgg

SEQ ID NO: 3200277 - RNA, 18 nt, Mycobacterium bovis subsp bovis AF2122/97
gaaccacccaccggccac

SEQ ID NO: 3200278 - RNA, 21 nt, Mycobacterium bovis subsp bovis AF2122/97
gaaccacccaccggccaccag

SEQ ID NO: 3200279 - RNA, 18 nt, Mycobacterium bovis subsp bovis AF2122/97
gaaccaccggcgccgccg

SEQ ID NO: 3200280 - RNA, 20 nt, Mycobacterium bovis subsp bovis AF2122/97
gaaccaccggcgccgccggc

SEQ ID NO: 3200281 - RNA, 21 nt, Mycobacterium bovis subsp bovis AF2122/97
gaaccaccggcgccgccggca

SEQ ID NO: 3200282 - RNA, 19 nt, Mycobacterium bovis subsp bovis AF2122/97
gaaccaccuguccggugga

SEQ ID NO: 3200283 - RNA, 22 nt, Mycobacterium bovis subsp bovis AF2122/97
gaaccacgcgcccgcaccaccg

SEQ ID NO: 3200284 - RNA, 18 nt, Mycobacterium bovis subsp bovis AF2122/97
gaaccacggcagccaacc

SEQ ID NO: 3200285 - RNA, 11 nt, Mycobacterium bovis subsp bovis AF2122/97
gaaccacggcg

SEQ ID NO: 3200286 - RNA, 17 nt, Mycobacterium bovis subsp bovis AF2122/97
gaaccacggucagcacg

SEQ ID NO: 3200287 - RNA, 22 nt, Mycobacterium bovis subsp bovis AF2122/97
gaaccacuuuccgaggagggcc

SEQ ID NO: 3200288 - RNA, 16 nt, Mycobacterium bovis subsp bovis AF2122/97
gaaccagaguucggcc

SEQ ID NO: 3200289 - RNA, 16 nt, Mycobacterium bovis subsp bovis AF2122/97
gaaccagcggucggcg

SEQ ID NO: 3200290 - RNA, 20 nt, Mycobacterium bovis subsp bovis AF2122/97
gaaccagcggucggcgacca

SEQ ID NO: 3200291 - RNA, 21 nt, Mycobacterium bovis subsp bovis AF2122/97
gaaccagucgaagaagacccg

SEQ ID NO: 3200292 - RNA, 23 nt, Mycobacterium bovis subsp bovis AF2122/97
gaaccaguucgugggucaacguc

SEQ ID NO: 3200293 - RNA, 16 nt, Mycobacterium bovis subsp bovis AF2122/97
gaaccaugaccaccaa

SEQ ID NO: 3200294 - RNA, 16 nt, Mycobacterium bovis subsp bovis AF2122/97
gaacccaccgugccgg

SEQ ID NO: 3200295 - RNA, 17 nt, Mycobacterium bovis subsp bovis AF2122/97
gaacccacgcaugcacg

SEQ ID NO: 3200296 - RNA, 14 nt, Mycobacterium bovis subsp bovis AF2122/97
gaacccacugcccg

SEQ ID NO: 3200297 - RNA, 24 nt, Mycobacterium bovis subsp bovis AF2122/97
gaacccacugcccgccgacgccag

SEQ ID NO: 3200298 - RNA, 19 nt, Mycobacterium bovis subsp bovis AF2122/97
gaacccagcacugggauga

SEQ ID NO: 3200299 - RNA, 12 nt, Mycobacterium bovis subsp bovis AF2122/97
gaacccaggcac

SEQ ID NO: 3200300 - RNA, 13 nt, Mycobacterium bovis subsp bovis AF2122/97
gaacccaggcaca

SEQ ID NO: 3200301 - RNA, 23 nt, Mycobacterium bovis subsp bovis AF2122/97
gaaccccagcuuggcgucgaugc

SEQ ID NO: 3200302 - RNA, 14 nt, Mycobacterium bovis subsp bovis AF2122/97
gaaccccauaauca

SEQ ID NO: 3200303 - RNA, 18 nt, Mycobacterium bovis subsp bovis AF2122/97
gaaccccauaaucacauc

SEQ ID NO: 3200304 - RNA, 15 nt, Mycobacterium bovis subsp bovis AF2122/97
gaacccccagcugca

SEQ ID NO: 3200305 - RNA, 17 nt, Mycobacterium bovis subsp bovis AF2122/97
gaacccccagcugcagg

SEQ ID NO: 3200306 - RNA, 19 nt, Mycobacterium bovis subsp bovis AF2122/97
gaacccccccgugcggugu

SEQ ID NO: 3200307 - RNA, 12 nt, Mycobacterium bovis subsp bovis AF2122/97
gaacccccgccg

SEQ ID NO: 3200308 - RNA, 15 nt, Mycobacterium bovis subsp bovis AF2122/97
gaacccccgccgcgc

SEQ ID NO: 3200309 - RNA, 13 nt, Mycobacterium bovis subsp bovis AF2122/97
gaacccccucgcg

SEQ ID NO: 3200310 - RNA, 23 nt, Mycobacterium bovis subsp bovis AF2122/97
gaaccccgaauagucggcaucgc

SEQ ID NO: 3200311 - RNA, 17 nt, Mycobacterium bovis subsp bovis AF2122/97
gaaccccgaccgcuggu

SEQ ID NO: 3200312 - RNA, 17 nt, Mycobacterium bovis subsp bovis AF2122/97
gaaccccgcgcggugcc

SEQ ID NO: 3200313 - RNA, 19 nt, Mycobacterium bovis subsp bovis AF2122/97
gaaccccgcgcggugcccu

SEQ ID NO: 3200314 - RNA, 16 nt, Mycobacterium bovis subsp bovis AF2122/97
gaacccgauucugguc

SEQ ID NO: 3200315 - RNA, 12 nt, Mycobacterium bovis subsp bovis AF2122/97
gaacccgccggc

SEQ ID NO: 3200316 - RNA, 14 nt, Mycobacterium bovis subsp bovis AF2122/97
gaacccgcuuucgg

SEQ ID NO: 3200317 - RNA, 20 nt, Mycobacterium bovis subsp bovis AF2122/97
gaacccggacaggguggggg

SEQ ID NO: 3200318 - RNA, 16 nt, Mycobacterium bovis subsp bovis AF2122/97
gaacccucagccgcgc

SEQ ID NO: 3200319 - RNA, 19 nt, Mycobacterium bovis subsp bovis AF2122/97
gaaccgaagccucggcaug

SEQ ID NO: 3200320 - RNA, 17 nt, Mycobacterium bovis subsp bovis AF2122/97
gaaccgaaucggcaccg

SEQ ID NO: 3200321 - RNA, 19 nt, Mycobacterium bovis subsp bovis AF2122/97
gaaccgacgcguccggugc

SEQ ID NO: 3200322 - RNA, 21 nt, Mycobacterium bovis subsp bovis AF2122/97
gaaccgacgcguccggugcac

SEQ ID NO: 3200323 - RNA, 19 nt, Mycobacterium bovis subsp bovis AF2122/97
gaaccgauaccucgccauc

SEQ ID NO: 3200324 - RNA, 21 nt, Mycobacterium bovis subsp bovis AF2122/97
gaaccgaucaucauauccgcc

SEQ ID NO: 3200325 - RNA, 22 nt, Mycobacterium bovis subsp bovis AF2122/97
gaaccgcacccugacagcgagc

SEQ ID NO: 3200326 - RNA, 23 nt, Mycobacterium bovis subsp bovis AF2122/97
gaaccgcacccugacagcgagcg

SEQ ID NO: 3200327 - RNA, 16 nt, Mycobacterium bovis subsp bovis AF2122/97
gaaccgcagucaacgc

SEQ ID NO: 3200328 - RNA, 20 nt, Mycobacterium bovis subsp bovis AF2122/97
gaaccgccaacauuggugag

SEQ ID NO: 3200329 - RNA, 18 nt, Mycobacterium bovis subsp bovis AF2122/97
gaaccgccgcugccgcgc

SEQ ID NO: 3200330 - RNA, 22 nt, Mycobacterium bovis subsp bovis AF2122/97
gaaccgccgcugccgcgcggcg

SEQ ID NO: 3200331 - RNA, 17 nt, Mycobacterium bovis subsp bovis AF2122/97
gaaccgccggcaccgcc

SEQ ID NO: 3200332 - RNA, 21 nt, Mycobacterium bovis subsp bovis AF2122/97
gaaccgccggcaccgccgccc

SEQ ID NO: 3200333 - RNA, 20 nt, Mycobacterium bovis subsp bovis AF2122/97
gaaccgcggaucgaccgcca

SEQ ID NO: 3200334 - RNA, 19 nt, Mycobacterium bovis subsp bovis AF2122/97
gaaccgcguuaugccaggc

SEQ ID NO: 3200335 - RNA, 18 nt, Mycobacterium bovis subsp bovis AF2122/97
gaaccgcuccgagcaccg

SEQ ID NO: 3200336 - RNA, 16 nt, Mycobacterium bovis subsp bovis AF2122/97
gaaccgcucgucacgu

SEQ ID NO: 3200337 - RNA, 23 nt, Mycobacterium bovis subsp bovis AF2122/97
gaaccgcugcggguagccgucga

SEQ ID NO: 3200338 - RNA, 22 nt, Mycobacterium bovis subsp bovis AF2122/97
gaaccgcugcuccucgcgguag

SEQ ID NO: 3200339 - RNA, 13 nt, Mycobacterium bovis subsp bovis AF2122/97
gaaccgcugggac

SEQ ID NO: 3200340 - RNA, 17 nt, Mycobacterium bovis subsp bovis AF2122/97
gaaccgcugggacaacg

SEQ ID NO: 3200341 - RNA, 14 nt, Mycobacterium bovis subsp bovis AF2122/97
gaaccggaccuggg

SEQ ID NO: 3200342 - RNA, 14 nt, Mycobacterium bovis subsp bovis AF2122/97
gaaccggcaccagc

SEQ ID NO: 3200343 - RNA, 15 nt, Mycobacterium bovis subsp bovis AF2122/97
gaaccggcaccagcg

SEQ ID NO: 3200344 - RNA, 20 nt, Mycobacterium bovis subsp bovis AF2122/97
gaaccggccaucgaccgucc

SEQ ID NO: 3200345 - RNA, 14 nt, Mycobacterium bovis subsp bovis AF2122/97
gaaccggccgacga

SEQ ID NO: 3200346 - RNA, 22 nt, Mycobacterium bovis subsp bovis AF2122/97
gaaccggcgcauucccuugucg

SEQ ID NO: 3200347 - RNA, 13 nt, Mycobacterium bovis subsp bovis AF2122/97
gaaccggcugggc

SEQ ID NO: 3200348 - RNA, 18 nt, Mycobacterium bovis subsp bovis AF2122/97
gaaccggcugggcgccac

SEQ ID NO: 3200349 - RNA, 13 nt, Mycobacterium bovis subsp bovis AF2122/97
gaaccgggcaaau

SEQ ID NO: 3200350 - RNA, 15 nt, Mycobacterium bovis subsp bovis AF2122/97
gaaccgggcaaauca

SEQ ID NO: 3200351 - RNA, 16 nt, Mycobacterium bovis subsp bovis AF2122/97
gaaccgggcaaaucaa

SEQ ID NO: 3200352 - RNA, 17 nt, Mycobacterium bovis subsp bovis AF2122/97
gaaccgggcaaaucaag

SEQ ID NO: 3200353 - RNA, 20 nt, Mycobacterium bovis subsp bovis AF2122/97
gaaccgggcaaaucaagcac

SEQ ID NO: 3200354 - RNA, 21 nt, Mycobacterium bovis subsp bovis AF2122/97
gaaccgggucacuccggcggc

SEQ ID NO: 3200355 - RNA, 17 nt, Mycobacterium bovis subsp bovis AF2122/97
gaaccgguacaaccccc

SEQ ID NO: 3200356 - RNA, 16 nt, Mycobacterium bovis subsp bovis AF2122/97
gaaccguacgccagau

SEQ ID NO: 3200357 - RNA, 15 nt, Mycobacterium bovis subsp bovis AF2122/97
gaaccguagcgccca

SEQ ID NO: 3200358 - RNA, 13 nt, Mycobacterium bovis subsp bovis AF2122/97
gaaccgucagcgc

SEQ ID NO: 3200359 - RNA, 19 nt, Mycobacterium bovis subsp bovis AF2122/97
gaaccguccaagccggcug

SEQ ID NO: 3200360 - RNA, 21 nt, Mycobacterium bovis subsp bovis AF2122/97
gaaccguccaagccggcugca

SEQ ID NO: 3200361 - RNA, 19 nt, Mycobacterium bovis subsp bovis AF2122/97
gaaccgugcugggcaucac

SEQ ID NO: 3200362 - RNA, 20 nt, Mycobacterium bovis subsp bovis AF2122/97
gaaccguucgcucagggugu

SEQ ID NO: 3200363 - RNA, 13 nt, Mycobacterium bovis subsp bovis AF2122/97
gaaccguucggcg

SEQ ID NO: 3200364 - RNA, 18 nt, Mycobacterium bovis subsp bovis AF2122/97
gaaccguuucgccggcgc

SEQ ID NO: 3200365 - RNA, 19 nt, Mycobacterium bovis subsp bovis AF2122/97
gaaccguuugacgcgcucg

SEQ ID NO: 3200366 - RNA, 19 nt, Mycobacterium bovis subsp bovis AF2122/97
gaaccguuugguggcaccg

SEQ ID NO: 3200367 - RNA, 12 nt, Mycobacterium bovis subsp bovis AF2122/97
gaaccucacagc

SEQ ID NO: 3200368 - RNA, 21 nt, Mycobacterium bovis subsp bovis AF2122/97
gaaccucacagcuugagcaca

SEQ ID NO: 3200369 - RNA, 23 nt, Mycobacterium bovis subsp bovis AF2122/97
gaaccuccucggguucgucaguc

SEQ ID NO: 3200370 - RNA, 12 nt, Mycobacterium bovis subsp bovis AF2122/97
gaaccucgcgua

SEQ ID NO: 3200371 - RNA, 14 nt, Mycobacterium bovis subsp bovis AF2122/97
gaaccucggcggga

SEQ ID NO: 3200372 - RNA, 14 nt, Mycobacterium bovis subsp bovis AF2122/97
gaaccugagcacca

SEQ ID NO: 3200373 - RNA, 15 nt, Mycobacterium bovis subsp bovis AF2122/97
gaaccugauccgcua

SEQ ID NO: 3200374 - RNA, 16 nt, Mycobacterium bovis subsp bovis AF2122/97
gaaccugcggcagcgg

SEQ ID NO: 3200375 - RNA, 19 nt, Mycobacterium bovis subsp bovis AF2122/97
gaaccugcucggccgugca

SEQ ID NO: 3200376 - RNA, 20 nt, Mycobacterium bovis subsp bovis AF2122/97
gaaccugcugggagggacca

SEQ ID NO: 3200377 - RNA, 17 nt, Mycobacterium bovis subsp bovis AF2122/97
gaaccuggcgacgcgac

SEQ ID NO: 3200378 - RNA, 16 nt, Mycobacterium bovis subsp bovis AF2122/97
gaaccuugaccgacca

SEQ ID NO: 3200379 - RNA, 14 nt, Mycobacterium bovis subsp bovis AF2122/97
gaacgaaccgccgc

SEQ ID NO: 3200380 - RNA, 15 nt, Mycobacterium bovis subsp bovis AF2122/97
gaacgaagucgacga

SEQ ID NO: 3200381 - RNA, 17 nt, Mycobacterium bovis subsp bovis AF2122/97
gaacgaagucgacgaac

SEQ ID NO: 3200382 - RNA, 15 nt, Mycobacterium bovis subsp bovis AF2122/97
gaacgacaccgcuug

SEQ ID NO: 3200383 - RNA, 15 nt, Mycobacterium bovis subsp bovis AF2122/97
gaacgacauccggcc

SEQ ID NO: 3200384 - RNA, 14 nt, Mycobacterium bovis subsp bovis AF2122/97
gaacgacgccaccg

SEQ ID NO: 3200385 - RNA, 15 nt, Mycobacterium bovis subsp bovis AF2122/97
gaacgacucgacgua

SEQ ID NO: 3200386 - RNA, 15 nt, Mycobacterium bovis subsp bovis AF2122/97
gaacgagcggccgcg

SEQ ID NO: 3200387 - RNA, 15 nt, Mycobacterium bovis subsp bovis AF2122/97
gaacgaggcgcccag

SEQ ID NO: 3200388 - RNA, 20 nt, Mycobacterium bovis subsp bovis AF2122/97
gaacgaguccaacucggcca

SEQ ID NO: 3200389 - RNA, 21 nt, Mycobacterium bovis subsp bovis AF2122/97
gaacgaguuugauuucgcacg

SEQ ID NO: 3200390 - RNA, 23 nt, Mycobacterium bovis subsp bovis AF2122/97
gaacgaucccgccgaucgaaccg

SEQ ID NO: 3200391 - RNA, 14 nt, Mycobacterium bovis subsp bovis AF2122/97
gaacgaucgaugac

SEQ ID NO: 3200392 - RNA, 15 nt, Mycobacterium bovis subsp bovis AF2122/97
gaacgaugccgccgg

SEQ ID NO: 3200393 - RNA, 22 nt, Mycobacterium bovis subsp bovis AF2122/97
gaacgaugccggcaagccugcg

SEQ ID NO: 3200394 - RNA, 15 nt, Mycobacterium bovis subsp bovis AF2122/97
gaacgcaacgccgau

SEQ ID NO: 3200395 - RNA, 15 nt, Mycobacterium bovis subsp bovis AF2122/97
gaacgcaagcagcgc

SEQ ID NO: 3200396 - RNA, 19 nt, Mycobacterium bovis subsp bovis AF2122/97
gaacgcaagcagcgcgauc

SEQ ID NO: 3200397 - RNA, 13 nt, Mycobacterium bovis subsp bovis AF2122/97
gaacgcaccgaaa

SEQ ID NO: 3200398 - RNA, 14 nt, Mycobacterium bovis subsp bovis AF2122/97
gaacgcaccgaaac

SEQ ID NO: 3200399 - RNA, 19 nt, Mycobacterium bovis subsp bovis AF2122/97
gaacgcaccgaaacgccga

SEQ ID NO: 3200400 - RNA, 20 nt, Mycobacterium bovis subsp bovis AF2122/97
gaacgcacgucgaggcggca

SEQ ID NO: 3200401 - RNA, 23 nt, Mycobacterium bovis subsp bovis AF2122/97
gaacgcacucaucgccggaccgg

SEQ ID NO: 3200402 - RNA, 15 nt, Mycobacterium bovis subsp bovis AF2122/97
gaacgcagccagcgc

SEQ ID NO: 3200403 - RNA, 17 nt, Mycobacterium bovis subsp bovis AF2122/97
gaacgcagccagcgcca

SEQ ID NO: 3200404 - RNA, 14 nt, Mycobacterium bovis subsp bovis AF2122/97
gaacgcaucggucc

SEQ ID NO: 3200405 - RNA, 21 nt, Mycobacterium bovis subsp bovis AF2122/97
gaacgccaccaccuccgcguc

SEQ ID NO: 3200406 - RNA, 14 nt, Mycobacterium bovis subsp bovis AF2122/97
gaacgccacgacgu

SEQ ID NO: 3200407 - RNA, 14 nt, Mycobacterium bovis subsp bovis AF2122/97
gaacgccacggcau

SEQ ID NO: 3200408 - RNA, 21 nt, Mycobacterium bovis subsp bovis AF2122/97
gaacgccacggcaucggccac

SEQ ID NO: 3200409 - RNA, 18 nt, Mycobacterium bovis subsp bovis AF2122/97
gaacgcccgcaggacgcu

SEQ ID NO: 3200410 - RNA, 11 nt, Mycobacterium bovis subsp bovis AF2122/97
gaacgcccgcu

SEQ ID NO: 3200411 - RNA, 14 nt, Mycobacterium bovis subsp bovis AF2122/97
gaacgccgccagca

SEQ ID NO: 3200412 - RNA, 15 nt, Mycobacterium bovis subsp bovis AF2122/97
gaacgccggcaucgc

SEQ ID NO: 3200413 - RNA, 18 nt, Mycobacterium bovis subsp bovis AF2122/97
gaacgccggcaucgcgcg

SEQ ID NO: 3200414 - RNA, 16 nt, Mycobacterium bovis subsp bovis AF2122/97
gaacgccggugcgcug

SEQ ID NO: 3200415 - RNA, 19 nt, Mycobacterium bovis subsp bovis AF2122/97
gaacgccggugcgcuggau

SEQ ID NO: 3200416 - RNA, 13 nt, Mycobacterium bovis subsp bovis AF2122/97
gaacgccgucaga

SEQ ID NO: 3200417 - RNA, 20 nt, Mycobacterium bovis subsp bovis AF2122/97
gaacgccgucagaacaccgg

SEQ ID NO: 3200418 - RNA, 14 nt, Mycobacterium bovis subsp bovis AF2122/97
gaacgccgucgagc

SEQ ID NO: 3200419 - RNA, 16 nt, Mycobacterium bovis subsp bovis AF2122/97
gaacgccgucgagcau

SEQ ID NO: 3200420 - RNA, 16 nt, Mycobacterium bovis subsp bovis AF2122/97
gaacgccucaggggcg

SEQ ID NO: 3200421 - RNA, 19 nt, Mycobacterium bovis subsp bovis AF2122/97
gaacgccucaggggcgccu

SEQ ID NO: 3200422 - RNA, 16 nt, Mycobacterium bovis subsp bovis AF2122/97
gaacgccucgccggcc

SEQ ID NO: 3200423 - RNA, 19 nt, Mycobacterium bovis subsp bovis AF2122/97
gaacgccucgccggccacc

SEQ ID NO: 3200424 - RNA, 20 nt, Mycobacterium bovis subsp bovis AF2122/97
gaacgccucgccggccacca

SEQ ID NO: 3200425 - RNA, 23 nt, Mycobacterium bovis subsp bovis AF2122/97
gaacgccucgccggccaccagcc

SEQ ID NO: 3200426 - RNA, 23 nt, Mycobacterium bovis subsp bovis AF2122/97
gaacgccugcucgucggccaccg

SEQ ID NO: 3200427 - RNA, 21 nt, Mycobacterium bovis subsp bovis AF2122/97
gaacgcgaauaccagaccggc

SEQ ID NO: 3200428 - RNA, 21 nt, Mycobacterium bovis subsp bovis AF2122/97
gaacgcgaaugucgcgcuguu

SEQ ID NO: 3200429 - RNA, 17 nt, Mycobacterium bovis subsp bovis AF2122/97
gaacgcgacagccaccu

SEQ ID NO: 3200430 - RNA, 17 nt, Mycobacterium bovis subsp bovis AF2122/97
gaacgcgagcaacacca

SEQ ID NO: 3200431 - RNA, 18 nt, Mycobacterium bovis subsp bovis AF2122/97
gaacgcgagcaacaccag

SEQ ID NO: 3200432 - RNA, 23 nt, Mycobacterium bovis subsp bovis AF2122/97
gaacgcgagcaacaccagggccu

SEQ ID NO: 3200433 - RNA, 13 nt, Mycobacterium bovis subsp bovis AF2122/97
gaacgcgagcgcu

SEQ ID NO: 3200434 - RNA, 20 nt, Mycobacterium bovis subsp bovis AF2122/97
gaacgcgaggugauugguca

SEQ ID NO: 3200435 - RNA, 15 nt, Mycobacterium bovis subsp bovis AF2122/97
gaacgcgauccgggu

SEQ ID NO: 3200436 - RNA, 16 nt, Mycobacterium bovis subsp bovis AF2122/97
gaacgcgccggucagc

SEQ ID NO: 3200437 - RNA, 18 nt, Mycobacterium bovis subsp bovis AF2122/97
gaacgcgcgcagccgggc

SEQ ID NO: 3200438 - RNA, 22 nt, Mycobacterium bovis subsp bovis AF2122/97
gaacgcgcgcagccgggcaccg

SEQ ID NO: 3200439 - RNA, 13 nt, Mycobacterium bovis subsp bovis AF2122/97
gaacgcgcgcgug

SEQ ID NO: 3200440 - RNA, 14 nt, Mycobacterium bovis subsp bovis AF2122/97
gaacgcggaagccg

SEQ ID NO: 3200441 - RNA, 14 nt, Mycobacterium bovis subsp bovis AF2122/97
gaacgcggacaccg

SEQ ID NO: 3200442 - RNA, 17 nt, Mycobacterium bovis subsp bovis AF2122/97
gaacgcggacaccgcgg

SEQ ID NO: 3200443 - RNA, 15 nt, Mycobacterium bovis subsp bovis AF2122/97
gaacgcggccaccga

SEQ ID NO: 3200444 - RNA, 21 nt, Mycobacterium bovis subsp bovis AF2122/97
gaacgcggccaccgaccgcau

SEQ ID NO: 3200445 - RNA, 19 nt, Mycobacterium bovis subsp bovis AF2122/97
gaacgcggcgaaugccagu

SEQ ID NO: 3200446 - RNA, 23 nt, Mycobacterium bovis subsp bovis AF2122/97
gaacgcggcgucgauaaccuggc

SEQ ID NO: 3200447 - RNA, 16 nt, Mycobacterium bovis subsp bovis AF2122/97
gaacgcguagucgcgg

SEQ ID NO: 3200448 - RNA, 23 nt, Mycobacterium bovis subsp bovis AF2122/97
gaacgcguccagcgcggccuugg

SEQ ID NO: 3200449 - RNA, 14 nt, Mycobacterium bovis subsp bovis AF2122/97
gaacgcgucgccga

SEQ ID NO: 3200450 - RNA, 23 nt, Mycobacterium bovis subsp bovis AF2122/97
gaacgcgucgccgacgccggugg

SEQ ID NO: 3200451 - RNA, 20 nt, Mycobacterium bovis subsp bovis AF2122/97
gaacgcgucguagcgcucgu

SEQ ID NO: 3200452 - RNA, 21 nt, Mycobacterium bovis subsp bovis AF2122/97
gaacgcgucguugucgucgcc

SEQ ID NO: 3200453 - RNA, 20 nt, Mycobacterium bovis subsp bovis AF2122/97
gaacgcguugaccaucacgc

SEQ ID NO: 3200454 - RNA, 22 nt, Mycobacterium bovis subsp bovis AF2122/97
gaacgcuagcgccaaauccggc

SEQ ID NO: 3200455 - RNA, 14 nt, Mycobacterium bovis subsp bovis AF2122/97
gaacgcuccaggcc

SEQ ID NO: 3200456 - RNA, 14 nt, Mycobacterium bovis subsp bovis AF2122/97
gaacgcucgucgac

SEQ ID NO: 3200457 - RNA, 14 nt, Mycobacterium bovis subsp bovis AF2122/97
gaacgcugacgccc

SEQ ID NO: 3200458 - RNA, 20 nt, Mycobacterium bovis subsp bovis AF2122/97
gaacgcugaggaagcggcgg

SEQ ID NO: 3200459 - RNA, 22 nt, Mycobacterium bovis subsp bovis AF2122/97
gaacgcugaggaagcggcggca

SEQ ID NO: 3200460 - RNA, 20 nt, Mycobacterium bovis subsp bovis AF2122/97
gaacgcuguaagcaugccgu

SEQ ID NO: 3200461 - RNA, 16 nt, Mycobacterium bovis subsp bovis AF2122/97
gaacgcuuuccggcgg

SEQ ID NO: 3200462 - RNA, 17 nt, Mycobacterium bovis subsp bovis AF2122/97
gaacgcuuuccggcggu

SEQ ID NO: 3200463 - RNA, 20 nt, Mycobacterium bovis subsp bovis AF2122/97
gaacgcuuuccggcgguggu

SEQ ID NO: 3200464 - RNA, 17 nt, Mycobacterium bovis subsp bovis AF2122/97
gaacggaccucggcggu

SEQ ID NO: 3200465 - RNA, 15 nt, Mycobacterium bovis subsp bovis AF2122/97
gaacggauucccgcc

SEQ ID NO: 3200466 - RNA, 16 nt, Mycobacterium bovis subsp bovis AF2122/97
gaacggauucccgccc

SEQ ID NO: 3200467 - RNA, 15 nt, Mycobacterium bovis subsp bovis AF2122/97
gaacggcaccagcgg

SEQ ID NO: 3200468 - RNA, 19 nt, Mycobacterium bovis subsp bovis AF2122/97
gaacggcaccgcgcccacc

SEQ ID NO: 3200469 - RNA, 14 nt, Mycobacterium bovis subsp bovis AF2122/97
gaacggcagcacgg

SEQ ID NO: 3200470 - RNA, 18 nt, Mycobacterium bovis subsp bovis AF2122/97
gaacggcgcaguuggcac

SEQ ID NO: 3200471 - RNA, 17 nt, Mycobacterium bovis subsp bovis AF2122/97
gaacggcgcgggccacc

SEQ ID NO: 3200472 - RNA, 16 nt, Mycobacterium bovis subsp bovis AF2122/97
gaacggcggcagcggc

SEQ ID NO: 3200473 - RNA, 13 nt, Mycobacterium bovis subsp bovis AF2122/97
gaacggcgggcga

SEQ ID NO: 3200474 - RNA, 22 nt, Mycobacterium bovis subsp bovis AF2122/97
gaacggcucgggaacuucgccg

SEQ ID NO: 3200475 - RNA, 22 nt, Mycobacterium bovis subsp bovis AF2122/97
gaacggcucgggcagcgucacc

SEQ ID NO: 3200476 - RNA, 23 nt, Mycobacterium bovis subsp bovis AF2122/97
gaacggcuugcgauuggcugggu

SEQ ID NO: 3200477 - RNA, 23 nt, Mycobacterium bovis subsp bovis AF2122/97
gaacggcuuggcgucggccggca

SEQ ID NO: 3200478 - RNA, 21 nt, Mycobacterium bovis subsp bovis AF2122/97
gaacgggaucgacccgcccau

SEQ ID NO: 3200479 - RNA, 19 nt, Mycobacterium bovis subsp bovis AF2122/97
gaacgggcuuccgacauga

SEQ ID NO: 3200480 - RNA, 15 nt, Mycobacterium bovis subsp bovis AF2122/97
gaacgguagcacggu

SEQ ID NO: 3200481 - RNA, 12 nt, Mycobacterium bovis subsp bovis AF2122/97
gaacggugccga

SEQ ID NO: 3200482 - RNA, 23 nt, Mycobacterium bovis subsp bovis AF2122/97
gaacgguggcgcggugccggcgg

SEQ ID NO: 3200483 - RNA, 18 nt, Mycobacterium bovis subsp bovis AF2122/97
gaacgguucggccggggc

SEQ ID NO: 3200484 - RNA, 13 nt, Mycobacterium bovis subsp bovis AF2122/97
gaacgguugcucg

SEQ ID NO: 3200485 - RNA, 16 nt, Mycobacterium bovis subsp bovis AF2122/97
gaacguaggguggccg

SEQ ID NO: 3200486 - RNA, 18 nt, Mycobacterium bovis subsp bovis AF2122/97
gaacgucaaacccagcga

SEQ ID NO: 3200487 - RNA, 18 nt, Mycobacterium bovis subsp bovis AF2122/97
gaacgucacguggucggc

SEQ ID NO: 3200488 - RNA, 19 nt, Mycobacterium bovis subsp bovis AF2122/97
gaacgucacguggucggcc

SEQ ID NO: 3200489 - RNA, 21 nt, Mycobacterium bovis subsp bovis AF2122/97
gaacgucacguggucggccac

SEQ ID NO: 3200490 - RNA, 22 nt, Mycobacterium bovis subsp bovis AF2122/97
gaacgucacguggucggccacc

SEQ ID NO: 3200491 - RNA, 20 nt, Mycobacterium bovis subsp bovis AF2122/97
gaacguccagccguggcggc

SEQ ID NO: 3200492 - RNA, 22 nt, Mycobacterium bovis subsp bovis AF2122/97
gaacguccagccguggcggcgg

SEQ ID NO: 3200493 - RNA, 23 nt, Mycobacterium bovis subsp bovis AF2122/97
gaacguccagccguggcggcggg

SEQ ID NO: 3200494 - RNA, 15 nt, Mycobacterium bovis subsp bovis AF2122/97
gaacguccgcgccga

SEQ ID NO: 3200495 - RNA, 16 nt, Mycobacterium bovis subsp bovis AF2122/97
gaacguccgcgccgag

SEQ ID NO: 3200496 - RNA, 20 nt, Mycobacterium bovis subsp bovis AF2122/97
gaacgugaacucacggcggu

SEQ ID NO: 3200497 - RNA, 23 nt, Mycobacterium bovis subsp bovis AF2122/97
gaacgugacccccagcagggugu

SEQ ID NO: 3200498 - RNA, 13 nt, Mycobacterium bovis subsp bovis AF2122/97
gaacgugacgguc

SEQ ID NO: 3200499 - RNA, 20 nt, Mycobacterium bovis subsp bovis AF2122/97
gaacgugaugcggucgcgga

SEQ ID NO: 3200500 - RNA, 23 nt, Mycobacterium bovis subsp bovis AF2122/97
gaacgugaugcggucgcggacaa

SEQ ID NO: 3200501 - RNA, 12 nt, Mycobacterium bovis subsp bovis AF2122/97
gaacgugaugug

SEQ ID NO: 3200502 - RNA, 17 nt, Mycobacterium bovis subsp bovis AF2122/97
gaacgugcaaccacggc

SEQ ID NO: 3200503 - RNA, 23 nt, Mycobacterium bovis subsp bovis AF2122/97
gaacgugcaaccacggcggcauc

SEQ ID NO: 3200504 - RNA, 18 nt, Mycobacterium bovis subsp bovis AF2122/97
gaacgugccccggcggua

SEQ ID NO: 3200505 - RNA, 16 nt, Mycobacterium bovis subsp bovis AF2122/97
gaacgugccuuccucg

SEQ ID NO: 3200506 - RNA, 24 nt, Mycobacterium bovis subsp bovis AF2122/97
gaacgugugggccauguggacggc

SEQ ID NO: 3200507 - RNA, 19 nt, Mycobacterium bovis subsp bovis AF2122/97
gaacuacugcgaucgcgag

SEQ ID NO: 3200508 - RNA, 17 nt, Mycobacterium bovis subsp bovis AF2122/97
gaacucaacaccagcaa

SEQ ID NO: 3200509 - RNA, 18 nt, Mycobacterium bovis subsp bovis AF2122/97
gaacucaacaccagcaag

SEQ ID NO: 3200510 - RNA, 15 nt, Mycobacterium bovis subsp bovis AF2122/97
gaacucaccgccaug

SEQ ID NO: 3200511 - RNA, 20 nt, Mycobacterium bovis subsp bovis AF2122/97
gaacucaucgugguaaccau

SEQ ID NO: 3200512 - RNA, 17 nt, Mycobacterium bovis subsp bovis AF2122/97
gaacuccagcagcccgg

SEQ ID NO: 3200513 - RNA, 14 nt, Mycobacterium bovis subsp bovis AF2122/97
gaacuccaugccgc

SEQ ID NO: 3200514 - RNA, 17 nt, Mycobacterium bovis subsp bovis AF2122/97
gaacuccaugccgcuga

SEQ ID NO: 3200515 - RNA, 13 nt, Mycobacterium bovis subsp bovis AF2122/97
gaacuccgccacc

SEQ ID NO: 3200516 - RNA, 23 nt, Mycobacterium bovis subsp bovis AF2122/97
gaacuccgccaccaucgccucgg

SEQ ID NO: 3200517 - RNA, 22 nt, Mycobacterium bovis subsp bovis AF2122/97
gaacuccgcgauccgcugcgcc

SEQ ID NO: 3200518 - RNA, 12 nt, Mycobacterium bovis subsp bovis AF2122/97
gaacuccgcgga

SEQ ID NO: 3200519 - RNA, 14 nt, Mycobacterium bovis subsp bovis AF2122/97
gaacuccguccgcc

SEQ ID NO: 3200520 - RNA, 22 nt, Mycobacterium bovis subsp bovis AF2122/97
gaacuccucgcugucgaucagc

SEQ ID NO: 3200521 - RNA, 20 nt, Mycobacterium bovis subsp bovis AF2122/97
gaacucgaagaccucgucgc

SEQ ID NO: 3200522 - RNA, 21 nt, Mycobacterium bovis subsp bovis AF2122/97
gaacucgaagaccucgucgcg

SEQ ID NO: 3200523 - RNA, 19 nt, Mycobacterium bovis subsp bovis AF2122/97
gaacucgaccaccgccggc

SEQ ID NO: 3200524 - RNA, 22 nt, Mycobacterium bovis subsp bovis AF2122/97
gaacucgaccaccgccggcccg

SEQ ID NO: 3200525 - RNA, 14 nt, Mycobacterium bovis subsp bovis AF2122/97
gaacucgcccaggg

SEQ ID NO: 3200526 - RNA, 16 nt, Mycobacterium bovis subsp bovis AF2122/97
gaacucgcgggcgacc

SEQ ID NO: 3200527 - RNA, 15 nt, Mycobacterium bovis subsp bovis AF2122/97
gaacucggcccacac

SEQ ID NO: 3200528 - RNA, 15 nt, Mycobacterium bovis subsp bovis AF2122/97
gaacucggcgucgug

SEQ ID NO: 3200529 - RNA, 19 nt, Mycobacterium bovis subsp bovis AF2122/97
gaacucggcgucguggugg

SEQ ID NO: 3200530 - RNA, 14 nt, Mycobacterium bovis subsp bovis AF2122/97
gaacucgucgcugc

SEQ ID NO: 3200531 - RNA, 16 nt, Mycobacterium bovis subsp bovis AF2122/97
gaacucgugauagcgc

SEQ ID NO: 3200532 - RNA, 19 nt, Mycobacterium bovis subsp bovis AF2122/97
gaacucguugaagaauccg

SEQ ID NO: 3200533 - RNA, 22 nt, Mycobacterium bovis subsp bovis AF2122/97
gaacucguugagcagcuggacc

SEQ ID NO: 3200534 - RNA, 17 nt, Mycobacterium bovis subsp bovis AF2122/97
gaacugaaacgcuuggc

SEQ ID NO: 3200535 - RNA, 21 nt, Mycobacterium bovis subsp bovis AF2122/97
gaacugaggauuucauacgcg

SEQ ID NO: 3200536 - RNA, 19 nt, Mycobacterium bovis subsp bovis AF2122/97
gaacugaugaaccacggca

SEQ ID NO: 3200537 - RNA, 23 nt, Mycobacterium bovis subsp bovis AF2122/97
gaacugaugaaccacggcaggca

SEQ ID NO: 3200538 - RNA, 18 nt, Mycobacterium bovis subsp bovis AF2122/97
gaacugcaucauggccgu

SEQ ID NO: 3200539 - RNA, 21 nt, Mycobacterium bovis subsp bovis AF2122/97
gaacugcaugguggcgccgac

SEQ ID NO: 3200540 - RNA, 15 nt, Mycobacterium bovis subsp bovis AF2122/97
gaacugcucgauccg

SEQ ID NO: 3200541 - RNA, 21 nt, Mycobacterium bovis subsp bovis AF2122/97
gaacugcugaugaaacgccgu

SEQ ID NO: 3200542 - RNA, 20 nt, Mycobacterium bovis subsp bovis AF2122/97
gaacuggcggugcagugccu

SEQ ID NO: 3200543 - RNA, 19 nt, Mycobacterium bovis subsp bovis AF2122/97
gaacuggcuguaguccgcu

SEQ ID NO: 3200544 - RNA, 14 nt, Mycobacterium bovis subsp bovis AF2122/97
gaacugggccucag

SEQ ID NO: 3200545 - RNA, 16 nt, Mycobacterium bovis subsp bovis AF2122/97
gaacugggccucagac

SEQ ID NO: 3200546 - RNA, 15 nt, Mycobacterium bovis subsp bovis AF2122/97
gaacugggcgaucga

SEQ ID NO: 3200547 - RNA, 20 nt, Mycobacterium bovis subsp bovis AF2122/97
gaacugggcgaucgacaccg

SEQ ID NO: 3200548 - RNA, 16 nt, Mycobacterium bovis subsp bovis AF2122/97
gaacugggggccggca

SEQ ID NO: 3200549 - RNA, 19 nt, Mycobacterium bovis subsp bovis AF2122/97
gaacugggggccggcacug

SEQ ID NO: 3200550 - RNA, 18 nt, Mycobacterium bovis subsp bovis AF2122/97
gaacugggucggcacggg

SEQ ID NO: 3200551 - RNA, 15 nt, Mycobacterium bovis subsp bovis AF2122/97
gaacuggucgacguc

SEQ ID NO: 3200552 - RNA, 21 nt, Mycobacterium bovis subsp bovis AF2122/97
gaacuggucucggcugagacg

SEQ ID NO: 3200553 - RNA, 18 nt, Mycobacterium bovis subsp bovis AF2122/97
gaacugguuucgcaccgu

SEQ ID NO: 3200554 - RNA, 11 nt, Mycobacterium bovis subsp bovis AF2122/97
gaacuguaggu

SEQ ID NO: 3200555 - RNA, 20 nt, Mycobacterium bovis subsp bovis AF2122/97
gaacuucgauucuggccgga

SEQ ID NO: 3200556 - RNA, 17 nt, Mycobacterium bovis subsp bovis AF2122/97
gaacuucuccaccagcg

SEQ ID NO: 3200557 - RNA, 20 nt, Mycobacterium bovis subsp bovis AF2122/97
gaacuucugguaggcggcca

SEQ ID NO: 3200558 - RNA, 22 nt, Mycobacterium bovis subsp bovis AF2122/97
gaacuugccggugcgcaccagc

SEQ ID NO: 3200559 - RNA, 23 nt, Mycobacterium bovis subsp bovis AF2122/97
gaacuugcggaccuggcggcggu

SEQ ID NO: 3200560 - RNA, 20 nt, Mycobacterium bovis subsp bovis AF2122/97
gaacuugugccgggcgaugc

SEQ ID NO: 3200561 - RNA, 12 nt, Mycobacterium bovis subsp bovis AF2122/97
gaagaaaccgca

SEQ ID NO: 3200562 - RNA, 22 nt, Mycobacterium bovis subsp bovis AF2122/97
gaagaacaguugcccgacgccg

SEQ ID NO: 3200563 - RNA, 16 nt, Mycobacterium bovis subsp bovis AF2122/97
gaagaacgcgucguag

SEQ ID NO: 3200564 - RNA, 17 nt, Mycobacterium bovis subsp bovis AF2122/97
gaagaacucggugcccc

SEQ ID NO: 3200565 - RNA, 22 nt, Mycobacterium bovis subsp bovis AF2122/97
gaagaacucggugcccccaccc

SEQ ID NO: 3200566 - RNA, 16 nt, Mycobacterium bovis subsp bovis AF2122/97
gaagaacuggcugcug

SEQ ID NO: 3200567 - RNA, 18 nt, Mycobacterium bovis subsp bovis AF2122/97
gaagaagaacucggcguc

SEQ ID NO: 3200568 - RNA, 20 nt, Mycobacterium bovis subsp bovis AF2122/97
gaagaagaacucggcgucgu

SEQ ID NO: 3200569 - RNA, 17 nt, Mycobacterium bovis subsp bovis AF2122/97
gaagaagaugaucgcga

SEQ ID NO: 3200570 - RNA, 16 nt, Mycobacterium bovis subsp bovis AF2122/97
gaagaagcccgaagac

SEQ ID NO: 3200571 - RNA, 13 nt, Mycobacterium bovis subsp bovis AF2122/97
gaagaaggcgaga

SEQ ID NO: 3200572 - RNA, 20 nt, Mycobacterium bovis subsp bovis AF2122/97
gaagaaguacaucugccggu

SEQ ID NO: 3200573 - RNA, 15 nt, Mycobacterium bovis subsp bovis AF2122/97
gaagaagugcucaca

SEQ ID NO: 3200574 - RNA, 20 nt, Mycobacterium bovis subsp bovis AF2122/97
gaagaauaaggagaaccaaa

SEQ ID NO: 3200575 - RNA, 12 nt, Mycobacterium bovis subsp bovis AF2122/97
gaagaauccggc

SEQ ID NO: 3200576 - RNA, 23 nt, Mycobacterium bovis subsp bovis AF2122/97
gaagaauccggcccaccggucgc

SEQ ID NO: 3200577 - RNA, 15 nt, Mycobacterium bovis subsp bovis AF2122/97
gaagacaaguggugg

SEQ ID NO: 3200578 - RNA, 15 nt, Mycobacterium bovis subsp bovis AF2122/97
gaagacaccaggccc

SEQ ID NO: 3200579 - RNA, 14 nt, Mycobacterium bovis subsp bovis AF2122/97
gaagaccaccgccc

SEQ ID NO: 3200580 - RNA, 12 nt, Mycobacterium bovis subsp bovis AF2122/97
gaagaccagcaa

SEQ ID NO: 3200581 - RNA, 17 nt, Mycobacterium bovis subsp bovis AF2122/97
gaagaccaggccgguga

SEQ ID NO: 3200582 - RNA, 21 nt, Mycobacterium bovis subsp bovis AF2122/97
gaagaccgccuccaccgccgc

SEQ ID NO: 3200583 - RNA, 23 nt, Mycobacterium bovis subsp bovis AF2122/97
gaagaccucgucgcgucgccaga

SEQ ID NO: 3200584 - RNA, 23 nt, Mycobacterium bovis subsp bovis AF2122/97
gaagaccuggcggugccggcggc

SEQ ID NO: 3200585 - RNA, 13 nt, Mycobacterium bovis subsp bovis AF2122/97
gaagacggugcgg

SEQ ID NO: 3200586 - RNA, 17 nt, Mycobacterium bovis subsp bovis AF2122/97
gaagacgucgggaucgc

SEQ ID NO: 3200587 - RNA, 20 nt, Mycobacterium bovis subsp bovis AF2122/97
gaagacgucgggaucgccau

SEQ ID NO: 3200588 - RNA, 15 nt, Mycobacterium bovis subsp bovis AF2122/97
gaagacgugccggcu

SEQ ID NO: 3200589 - RNA, 17 nt, Mycobacterium bovis subsp bovis AF2122/97
gaagacguuggcgcggu

SEQ ID NO: 3200590 - RNA, 16 nt, Mycobacterium bovis subsp bovis AF2122/97
gaagacucgucaacgg

SEQ ID NO: 3200591 - RNA, 22 nt, Mycobacterium bovis subsp bovis AF2122/97
gaagacuuagcgggugccagcc

SEQ ID NO: 3200592 - RNA, 13 nt, Mycobacterium bovis subsp bovis AF2122/97
gaagagcaccgcg

SEQ ID NO: 3200593 - RNA, 23 nt, Mycobacterium bovis subsp bovis AF2122/97
gaagagcacguugcacagcuugg

SEQ ID NO: 3200594 - RNA, 16 nt, Mycobacterium bovis subsp bovis AF2122/97
gaagagcuccgucgcg

SEQ ID NO: 3200595 - RNA, 18 nt, Mycobacterium bovis subsp bovis AF2122/97
gaagagggcgccgcgcgc

SEQ ID NO: 3200596 - RNA, 17 nt, Mycobacterium bovis subsp bovis AF2122/97
gaagaguccuuaaacgu

SEQ ID NO: 3200597 - RNA, 23 nt, Mycobacterium bovis subsp bovis AF2122/97
gaagaguguccccccgcgcagau

SEQ ID NO: 3200598 - RNA, 15 nt, Mycobacterium bovis subsp bovis AF2122/97
gaagaucaccucccg

SEQ ID NO: 3200599 - RNA, 22 nt, Mycobacterium bovis subsp bovis AF2122/97
gaagaucaccucccgcggcacc

SEQ ID NO: 3200600 - RNA, 18 nt, Mycobacterium bovis subsp bovis AF2122/97
gaagaucgagccgacccg

SEQ ID NO: 3200601 - RNA, 14 nt, Mycobacterium bovis subsp bovis AF2122/97
gaagaucgcugcga

SEQ ID NO: 3200602 - RNA, 22 nt, Mycobacterium bovis subsp bovis AF2122/97
gaagaucggcgcuagccaggga

SEQ ID NO: 3200603 - RNA, 17 nt, Mycobacterium bovis subsp bovis AF2122/97
gaagaucuucaccggcc

SEQ ID NO: 3200604 - RNA, 15 nt, Mycobacterium bovis subsp bovis AF2122/97
gaagaugaucgcgaa

SEQ ID NO: 3200605 - RNA, 17 nt, Mycobacterium bovis subsp bovis AF2122/97
gaagaugauuucgccga

SEQ ID NO: 3200606 - RNA, 13 nt, Mycobacterium bovis subsp bovis AF2122/97
gaagaugcccuuc

SEQ ID NO: 3200607 - RNA, 20 nt, Mycobacterium bovis subsp bovis AF2122/97
gaagaugcccuucgucggca

SEQ ID NO: 3200608 - RNA, 23 nt, Mycobacterium bovis subsp bovis AF2122/97
gaagaugcccuucgucggcauga

SEQ ID NO: 3200609 - RNA, 13 nt, Mycobacterium bovis subsp bovis AF2122/97
gaagaugccugcu

SEQ ID NO: 3200610 - RNA, 21 nt, Mycobacterium bovis subsp bovis AF2122/97
gaagaugccugcuagcagcag

SEQ ID NO: 3200611 - RNA, 22 nt, Mycobacterium bovis subsp bovis AF2122/97
gaagaugccugcuagcagcagc

SEQ ID NO: 3200612 - RNA, 15 nt, Mycobacterium bovis subsp bovis AF2122/97
gaagauggcaccgcc

SEQ ID NO: 3200613 - RNA, 17 nt, Mycobacterium bovis subsp bovis AF2122/97
gaagauggcaccgcccc

SEQ ID NO: 3200614 - RNA, 22 nt, Mycobacterium bovis subsp bovis AF2122/97
gaagauggccagcgcggcgucg

SEQ ID NO: 3200615 - RNA, 20 nt, Mycobacterium bovis subsp bovis AF2122/97
gaagaugucgucaccguggg

SEQ ID NO: 3200616 - RNA, 22 nt, Mycobacterium bovis subsp bovis AF2122/97
gaagaugucuuccugcgccggu

SEQ ID NO: 3200617 - RNA, 17 nt, Mycobacterium bovis subsp bovis AF2122/97
gaagauguugccgccgg

SEQ ID NO: 3200618 - RNA, 14 nt, Mycobacterium bovis subsp bovis AF2122/97
gaagcacgucgucg

SEQ ID NO: 3200619 - RNA, 22 nt, Mycobacterium bovis subsp bovis AF2122/97
gaagcaggugauguucagcgcc

SEQ ID NO: 3200620 - RNA, 18 nt, Mycobacterium bovis subsp bovis AF2122/97
gaagccagaucagccgcc

SEQ ID NO: 3200621 - RNA, 21 nt, Mycobacterium bovis subsp bovis AF2122/97
gaagccagaucagccgccgcc

SEQ ID NO: 3200622 - RNA, 18 nt, Mycobacterium bovis subsp bovis AF2122/97
gaagccagaucgcuagga

SEQ ID NO: 3200623 - RNA, 15 nt, Mycobacterium bovis subsp bovis AF2122/97
gaagcccaccgucug

SEQ ID NO: 3200624 - RNA, 21 nt, Mycobacterium bovis subsp bovis AF2122/97
gaagcccaccgucugcuggcc

SEQ ID NO: 3200625 - RNA, 22 nt, Mycobacterium bovis subsp bovis AF2122/97
gaagcccagcaccaccacccga

SEQ ID NO: 3200626 - RNA, 14 nt, Mycobacterium bovis subsp bovis AF2122/97
gaagcccaggagca

SEQ ID NO: 3200627 - RNA, 18 nt, Mycobacterium bovis subsp bovis AF2122/97
gaagcccccaaaccggcg

SEQ ID NO: 3200628 - RNA, 19 nt, Mycobacterium bovis subsp bovis AF2122/97
gaagccccgguggcaggga

SEQ ID NO: 3200629 - RNA, 20 nt, Mycobacterium bovis subsp bovis AF2122/97
gaagccccgguggcagggaa

SEQ ID NO: 3200630 - RNA, 15 nt, Mycobacterium bovis subsp bovis AF2122/97
gaagccccucaccuc

SEQ ID NO: 3200631 - RNA, 17 nt, Mycobacterium bovis subsp bovis AF2122/97
gaagccccucaccucgg

SEQ ID NO: 3200632 - RNA, 13 nt, Mycobacterium bovis subsp bovis AF2122/97
gaagcccgacugu

SEQ ID NO: 3200633 - RNA, 16 nt, Mycobacterium bovis subsp bovis AF2122/97
gaagcccggccacagg

SEQ ID NO: 3200634 - RNA, 13 nt, Mycobacterium bovis subsp bovis AF2122/97
gaagcccggcggc

SEQ ID NO: 3200635 - RNA, 17 nt, Mycobacterium bovis subsp bovis AF2122/97
gaagcccggggcgcucg

SEQ ID NO: 3200636 - RNA, 19 nt, Mycobacterium bovis subsp bovis AF2122/97
gaagcccggggcgcucgug

SEQ ID NO: 3200637 - RNA, 17 nt, Mycobacterium bovis subsp bovis AF2122/97
gaagcccuuguagcaca

SEQ ID NO: 3200638 - RNA, 22 nt, Mycobacterium bovis subsp bovis AF2122/97
gaagccgaaggggaacgcgccc

SEQ ID NO: 3200639 - RNA, 20 nt, Mycobacterium bovis subsp bovis AF2122/97
gaagccgacauugcugcucg

SEQ ID NO: 3200640 - RNA, 19 nt, Mycobacterium bovis subsp bovis AF2122/97
gaagccgaccucacggcau

SEQ ID NO: 3200641 - RNA, 18 nt, Mycobacterium bovis subsp bovis AF2122/97
gaagccgacgaccagcag

SEQ ID NO: 3200642 - RNA, 12 nt, Mycobacterium bovis subsp bovis AF2122/97
gaagccgacguu

SEQ ID NO: 3200643 - RNA, 13 nt, Mycobacterium bovis subsp bovis AF2122/97
gaagccgagcauc

SEQ ID NO: 3200644 - RNA, 23 nt, Mycobacterium bovis subsp bovis AF2122/97
gaagccgauguccgacgccaccg

SEQ ID NO: 3200645 - RNA, 22 nt, Mycobacterium bovis subsp bovis AF2122/97
gaagccgcaccgcuguugcauc

SEQ ID NO: 3200646 - RNA, 11 nt, Mycobacterium bovis subsp bovis AF2122/97
gaagccgccgg

SEQ ID NO: 3200647 - RNA, 12 nt, Mycobacterium bovis subsp bovis AF2122/97
gaagccgccggg

SEQ ID NO: 3200648 - RNA, 14 nt, Mycobacterium bovis subsp bovis AF2122/97
gaagccgccgggca

SEQ ID NO: 3200649 - RNA, 13 nt, Mycobacterium bovis subsp bovis AF2122/97
gaagccgcgcauc

SEQ ID NO: 3200650 - RNA, 17 nt, Mycobacterium bovis subsp bovis AF2122/97
gaagccgcgcaucuguc

SEQ ID NO: 3200651 - RNA, 12 nt, Mycobacterium bovis subsp bovis AF2122/97
gaagccgcgcug

SEQ ID NO: 3200652 - RNA, 15 nt, Mycobacterium bovis subsp bovis AF2122/97
gaagccggccacuac

SEQ ID NO: 3200653 - RNA, 19 nt, Mycobacterium bovis subsp bovis AF2122/97
gaagccggccacuacggcc

SEQ ID NO: 3200654 - RNA, 23 nt, Mycobacterium bovis subsp bovis AF2122/97
gaagccggccacuacggccuggc

SEQ ID NO: 3200655 - RNA, 14 nt, Mycobacterium bovis subsp bovis AF2122/97
gaagccggcgccgg

SEQ ID NO: 3200656 - RNA, 16 nt, Mycobacterium bovis subsp bovis AF2122/97
gaagccggcgcucgca

SEQ ID NO: 3200657 - RNA, 20 nt, Mycobacterium bovis subsp bovis AF2122/97
gaagccguugacuugugcca

SEQ ID NO: 3200658 - RNA, 18 nt, Mycobacterium bovis subsp bovis AF2122/97
gaagccguuugcgcuggc

SEQ ID NO: 3200659 - RNA, 23 nt, Mycobacterium bovis subsp bovis AF2122/97
gaagccucggcaugcagccccac

SEQ ID NO: 3200660 - RNA, 17 nt, Mycobacterium bovis subsp bovis AF2122/97
gaagccuugcagcgccc

SEQ ID NO: 3200661 - RNA, 19 nt, Mycobacterium bovis subsp bovis AF2122/97
gaagccuugcagcgccccc

SEQ ID NO: 3200662 - RNA, 13 nt, Mycobacterium bovis subsp bovis AF2122/97
gaagcgaccgucg

SEQ ID NO: 3200663 - RNA, 17 nt, Mycobacterium bovis subsp bovis AF2122/97
gaagcgaccgucgucac

SEQ ID NO: 3200664 - RNA, 21 nt, Mycobacterium bovis subsp bovis AF2122/97
gaagcgauccggcugcgggaa

SEQ ID NO: 3200665 - RNA, 22 nt, Mycobacterium bovis subsp bovis AF2122/97
gaagcgaugagggugcucguca

SEQ ID NO: 3200666 - RNA, 15 nt, Mycobacterium bovis subsp bovis AF2122/97
gaagcgaugccgugc

SEQ ID NO: 3200667 - RNA, 20 nt, Mycobacterium bovis subsp bovis AF2122/97
gaagcgaugccgugcugggc

SEQ ID NO: 3200668 - RNA, 17 nt, Mycobacterium bovis subsp bovis AF2122/97
gaagcgccaaacccggc

SEQ ID NO: 3200669 - RNA, 18 nt, Mycobacterium bovis subsp bovis AF2122/97
gaagcgcgguuucggcga

SEQ ID NO: 3200670 - RNA, 17 nt, Mycobacterium bovis subsp bovis AF2122/97
gaagcgcguccaaccaa

SEQ ID NO: 3200671 - RNA, 15 nt, Mycobacterium bovis subsp bovis AF2122/97
gaagcgcuccagcug

SEQ ID NO: 3200672 - RNA, 13 nt, Mycobacterium bovis subsp bovis AF2122/97
gaagcgcucggca

SEQ ID NO: 3200673 - RNA, 16 nt, Mycobacterium bovis subsp bovis AF2122/97
gaagcgcucggcagcc

SEQ ID NO: 3200674 - RNA, 17 nt, Mycobacterium bovis subsp bovis AF2122/97
gaagcgcucggcagccg

SEQ ID NO: 3200675 - RNA, 15 nt, Mycobacterium bovis subsp bovis AF2122/97
gaagcggccaccgcc

SEQ ID NO: 3200676 - RNA, 19 nt, Mycobacterium bovis subsp bovis AF2122/97
gaagcggcgacuacccagc

SEQ ID NO: 3200677 - RNA, 19 nt, Mycobacterium bovis subsp bovis AF2122/97
gaagcgggaaggcucacca

SEQ ID NO: 3200678 - RNA, 19 nt, Mycobacterium bovis subsp bovis AF2122/97
gaagcgggcgaugccgaug

SEQ ID NO: 3200679 - RNA, 17 nt, Mycobacterium bovis subsp bovis AF2122/97
gaagcgggcgugcucgg

SEQ ID NO: 3200680 - RNA, 20 nt, Mycobacterium bovis subsp bovis AF2122/97
gaagcgggcuugagcgccga

SEQ ID NO: 3200681 - RNA, 17 nt, Mycobacterium bovis subsp bovis AF2122/97
gaagcgggugccaucgg

SEQ ID NO: 3200682 - RNA, 18 nt, Mycobacterium bovis subsp bovis AF2122/97
gaagcggugacccacucg

SEQ ID NO: 3200683 - RNA, 16 nt, Mycobacterium bovis subsp bovis AF2122/97
gaagcgguguugccgg

SEQ ID NO: 3200684 - RNA, 15 nt, Mycobacterium bovis subsp bovis AF2122/97
gaagcgucgggucgc

SEQ ID NO: 3200685 - RNA, 14 nt, Mycobacterium bovis subsp bovis AF2122/97
gaagcgucguugcu

SEQ ID NO: 3200686 - RNA, 17 nt, Mycobacterium bovis subsp bovis AF2122/97
gaagcgucguugcucgg

SEQ ID NO: 3200687 - RNA, 20 nt, Mycobacterium bovis subsp bovis AF2122/97
gaagcgucuggucagccgcg

SEQ ID NO: 3200688 - RNA, 21 nt, Mycobacterium bovis subsp bovis AF2122/97
gaagcgucuggucagccgcgg

SEQ ID NO: 3200689 - RNA, 17 nt, Mycobacterium bovis subsp bovis AF2122/97
gaagcgugcgccgacuu

SEQ ID NO: 3200690 - RNA, 16 nt, Mycobacterium bovis subsp bovis AF2122/97
gaagcgugcggucguu

SEQ ID NO: 3200691 - RNA, 19 nt, Mycobacterium bovis subsp bovis AF2122/97
gaagcguugcacugcuggu

SEQ ID NO: 3200692 - RNA, 16 nt, Mycobacterium bovis subsp bovis AF2122/97
gaagcguugucgccca

SEQ ID NO: 3200693 - RNA, 17 nt, Mycobacterium bovis subsp bovis AF2122/97
gaagcguugucgcccac

SEQ ID NO: 3200694 - RNA, 14 nt, Mycobacterium bovis subsp bovis AF2122/97
gaagcuagagccag

SEQ ID NO: 3200695 - RNA, 22 nt, Mycobacterium bovis subsp bovis AF2122/97
gaagcucaucaccggcgcaccg

SEQ ID NO: 3200696 - RNA, 17 nt, Mycobacterium bovis subsp bovis AF2122/97
gaagcucgaccgcccgg

SEQ ID NO: 3200697 - RNA, 15 nt, Mycobacterium bovis subsp bovis AF2122/97
gaagcugaccagaca

SEQ ID NO: 3200698 - RNA, 20 nt, Mycobacterium bovis subsp bovis AF2122/97
gaagcugagcaccugagccu

SEQ ID NO: 3200699 - RNA, 23 nt, Mycobacterium bovis subsp bovis AF2122/97
gaagcugcgggucucgcugggaa

SEQ ID NO: 3200700 - RNA, 16 nt, Mycobacterium bovis subsp bovis AF2122/97
gaagcugcugcugcuu

SEQ ID NO: 3200701 - RNA, 23 nt, Mycobacterium bovis subsp bovis AF2122/97
gaagcuggcacgcagagccaaca

SEQ ID NO: 3200702 - RNA, 14 nt, Mycobacterium bovis subsp bovis AF2122/97
gaagcuggccaccg

SEQ ID NO: 3200703 - RNA, 17 nt, Mycobacterium bovis subsp bovis AF2122/97
gaagcuggccaccgcau

SEQ ID NO: 3200704 - RNA, 16 nt, Mycobacterium bovis subsp bovis AF2122/97
gaagcuggcgugcagc

SEQ ID NO: 3200705 - RNA, 21 nt, Mycobacterium bovis subsp bovis AF2122/97
gaagcuguaggcgaccagaua

SEQ ID NO: 3200706 - RNA, 20 nt, Mycobacterium bovis subsp bovis AF2122/97
gaagcugugccuucgccucg

SEQ ID NO: 3200707 - RNA, 19 nt, Mycobacterium bovis subsp bovis AF2122/97
gaagcuuaggugugguucc

SEQ ID NO: 3200708 - RNA, 22 nt, Mycobacterium bovis subsp bovis AF2122/97
gaaggaaccgggcaaaucaagc

SEQ ID NO: 3200709 - RNA, 17 nt, Mycobacterium bovis subsp bovis AF2122/97
gaaggacggcagccacc

SEQ ID NO: 3200710 - RNA, 20 nt, Mycobacterium bovis subsp bovis AF2122/97
gaaggagaucccccaggcga

SEQ ID NO: 3200711 - RNA, 23 nt, Mycobacterium bovis subsp bovis AF2122/97
gaaggagaucccccaggcgaaca

SEQ ID NO: 3200712 - RNA, 22 nt, Mycobacterium bovis subsp bovis AF2122/97
gaaggaugcggccccaugcgcc

SEQ ID NO: 3200713 - RNA, 13 nt, Mycobacterium bovis subsp bovis AF2122/97
gaaggauugcgcg

SEQ ID NO: 3200714 - RNA, 22 nt, Mycobacterium bovis subsp bovis AF2122/97
gaaggauuuggagcuuuuugcg

SEQ ID NO: 3200715 - RNA, 23 nt, Mycobacterium bovis subsp bovis AF2122/97
gaaggauuuggagcuuuuugcgu

SEQ ID NO: 3200716 - RNA, 15 nt, Mycobacterium bovis subsp bovis AF2122/97
gaaggcaaacaccag

SEQ ID NO: 3200717 - RNA, 23 nt, Mycobacterium bovis subsp bovis AF2122/97
gaaggcaccgaaaaacaccagcg

SEQ ID NO: 3200718 - RNA, 19 nt, Mycobacterium bovis subsp bovis AF2122/97
gaaggcauugcccacaaag

SEQ ID NO: 3200719 - RNA, 19 nt, Mycobacterium bovis subsp bovis AF2122/97
gaaggccagcgcgcccgcg

SEQ ID NO: 3200720 - RNA, 18 nt, Mycobacterium bovis subsp bovis AF2122/97
gaaggccccgccgguggc

SEQ ID NO: 3200721 - RNA, 14 nt, Mycobacterium bovis subsp bovis AF2122/97
gaaggcccgcuguu

SEQ ID NO: 3200722 - RNA, 15 nt, Mycobacterium bovis subsp bovis AF2122/97
gaaggccgcaccgcc

SEQ ID NO: 3200723 - RNA, 17 nt, Mycobacterium bovis subsp bovis AF2122/97
gaaggccgcaccgccac

SEQ ID NO: 3200724 - RNA, 18 nt, Mycobacterium bovis subsp bovis AF2122/97
gaaggccgcaccgccacc

SEQ ID NO: 3200725 - RNA, 19 nt, Mycobacterium bovis subsp bovis AF2122/97
gaaggccgcaccgccaccc

SEQ ID NO: 3200726 - RNA, 17 nt, Mycobacterium bovis subsp bovis AF2122/97
gaaggccgcgcgcaggg

SEQ ID NO: 3200727 - RNA, 13 nt, Mycobacterium bovis subsp bovis AF2122/97
gaaggcgacauca

SEQ ID NO: 3200728 - RNA, 22 nt, Mycobacterium bovis subsp bovis AF2122/97
gaaggcgacaucaccaccgacc

SEQ ID NO: 3200729 - RNA, 13 nt, Mycobacterium bovis subsp bovis AF2122/97
gaaggcgacccgc

SEQ ID NO: 3200730 - RNA, 18 nt, Mycobacterium bovis subsp bovis AF2122/97
gaaggcgacccgcugggu

SEQ ID NO: 3200731 - RNA, 16 nt, Mycobacterium bovis subsp bovis AF2122/97
gaaggcgcgcgcccgg

SEQ ID NO: 3200732 - RNA, 18 nt, Mycobacterium bovis subsp bovis AF2122/97
gaaggcgcgggcgacguc

SEQ ID NO: 3200733 - RNA, 17 nt, Mycobacterium bovis subsp bovis AF2122/97
gaaggcggccaggugca

SEQ ID NO: 3200734 - RNA, 15 nt, Mycobacterium bovis subsp bovis AF2122/97
gaaggcggcgauacc

SEQ ID NO: 3200735 - RNA, 19 nt, Mycobacterium bovis subsp bovis AF2122/97
gaaggcggcgauacccauc

SEQ ID NO: 3200736 - RNA, 15 nt, Mycobacterium bovis subsp bovis AF2122/97
gaaggcggcuccacc

SEQ ID NO: 3200737 - RNA, 13 nt, Mycobacterium bovis subsp bovis AF2122/97
gaaggcugucagu

SEQ ID NO: 3200738 - RNA, 13 nt, Mycobacterium bovis subsp bovis AF2122/97
gaaggcuugucgg

SEQ ID NO: 3200739 - RNA, 21 nt, Mycobacterium bovis subsp bovis AF2122/97
gaaggggcucagcgguggcgu

SEQ ID NO: 3200740 - RNA, 19 nt, Mycobacterium bovis subsp bovis AF2122/97
gaaggggugcccggcggcc

SEQ ID NO: 3200741 - RNA, 16 nt, Mycobacterium bovis subsp bovis AF2122/97
gaaggguauccgugug

SEQ ID NO: 3200742 - RNA, 16 nt, Mycobacterium bovis subsp bovis AF2122/97
gaaggucagcagggcc

SEQ ID NO: 3200743 - RNA, 23 nt, Mycobacterium bovis subsp bovis AF2122/97
gaaggucgaaucgcugccgccga

SEQ ID NO: 3200744 - RNA, 17 nt, Mycobacterium bovis subsp bovis AF2122/97
gaaggucuggccugccc

SEQ ID NO: 3200745 - RNA, 16 nt, Mycobacterium bovis subsp bovis AF2122/97
gaaggugaaucgacug

SEQ ID NO: 3200746 - RNA, 12 nt, Mycobacterium bovis subsp bovis AF2122/97
gaaggugacgac

SEQ ID NO: 3200747 - RNA, 14 nt, Mycobacterium bovis subsp bovis AF2122/97
gaaggugacgacga

SEQ ID NO: 3200748 - RNA, 13 nt, Mycobacterium bovis subsp bovis AF2122/97
gaaggugacgauc

SEQ ID NO: 3200749 - RNA, 14 nt, Mycobacterium bovis subsp bovis AF2122/97
gaaggugccggcgu

SEQ ID NO: 3200750 - RNA, 17 nt, Mycobacterium bovis subsp bovis AF2122/97
gaaggugcugcgcgggu

SEQ ID NO: 3200751 - RNA, 18 nt, Mycobacterium bovis subsp bovis AF2122/97
gaagguggcgaacccggu

SEQ ID NO: 3200752 - RNA, 21 nt, Mycobacterium bovis subsp bovis AF2122/97
gaaggugggauugaagcuggc

SEQ ID NO: 3200753 - RNA, 18 nt, Mycobacterium bovis subsp bovis AF2122/97
gaagguguuggugcgggg

SEQ ID NO: 3200754 - RNA, 14 nt, Mycobacterium bovis subsp bovis AF2122/97
gaagguuucccgcu

SEQ ID NO: 3200755 - RNA, 15 nt, Mycobacterium bovis subsp bovis AF2122/97
gaaguacacggcggc

SEQ ID NO: 3200756 - RNA, 16 nt, Mycobacterium bovis subsp bovis AF2122/97
gaaguacgacgacccg

SEQ ID NO: 3200757 - RNA, 20 nt, Mycobacterium bovis subsp bovis AF2122/97
gaaguacgcgacgggccgcg

SEQ ID NO: 3200758 - RNA, 21 nt, Mycobacterium bovis subsp bovis AF2122/97
gaaguacgcgacgggccgcga

SEQ ID NO: 3200759 - RNA, 21 nt, Mycobacterium bovis subsp bovis AF2122/97
gaaguacuccacccaggccga

SEQ ID NO: 3200760 - RNA, 15 nt, Mycobacterium bovis subsp bovis AF2122/97
gaaguacuccauggc

SEQ ID NO: 3200761 - RNA, 18 nt, Mycobacterium bovis subsp bovis AF2122/97
gaaguacuggccgccgcg

SEQ ID NO: 3200762 - RNA, 23 nt, Mycobacterium bovis subsp bovis AF2122/97
gaaguacuggccgccgcgcaccg

SEQ ID NO: 3200763 - RNA, 14 nt, Mycobacterium bovis subsp bovis AF2122/97
gaaguaggcggcga

SEQ ID NO: 3200764 - RNA, 17 nt, Mycobacterium bovis subsp bovis AF2122/97
gaaguaggcggcgacgc

SEQ ID NO: 3200765 - RNA, 15 nt, Mycobacterium bovis subsp bovis AF2122/97
gaaguagugcucgca

SEQ ID NO: 3200766 - RNA, 16 nt, Mycobacterium bovis subsp bovis AF2122/97
gaagucacgcacccgg

SEQ ID NO: 3200767 - RNA, 23 nt, Mycobacterium bovis subsp bovis AF2122/97
gaaguccaccacgacgucgguga

SEQ ID NO: 3200768 - RNA, 17 nt, Mycobacterium bovis subsp bovis AF2122/97
gaaguccacgcaccacg

SEQ ID NO: 3200769 - RNA, 14 nt, Mycobacterium bovis subsp bovis AF2122/97
gaaguccagcuggc

SEQ ID NO: 3200770 - RNA, 15 nt, Mycobacterium bovis subsp bovis AF2122/97
gaaguccagcuggcc

SEQ ID NO: 3200771 - RNA, 16 nt, Mycobacterium bovis subsp bovis AF2122/97
gaaguccagcuggccg

SEQ ID NO: 3200772 - RNA, 19 nt, Mycobacterium bovis subsp bovis AF2122/97
gaaguccagcuggccgggu

SEQ ID NO: 3200773 - RNA, 23 nt, Mycobacterium bovis subsp bovis AF2122/97
gaagucccgggcaccgucggaac

SEQ ID NO: 3200774 - RNA, 16 nt, Mycobacterium bovis subsp bovis AF2122/97
gaaguccuccacgcug

SEQ ID NO: 3200775 - RNA, 19 nt, Mycobacterium bovis subsp bovis AF2122/97
gaaguccuccacgcuggcg

SEQ ID NO: 3200776 - RNA, 14 nt, Mycobacterium bovis subsp bovis AF2122/97
gaaguccucggcgg

SEQ ID NO: 3200777 - RNA, 14 nt, Mycobacterium bovis subsp bovis AF2122/97
gaagucgaucgccg

SEQ ID NO: 3200778 - RNA, 15 nt, Mycobacterium bovis subsp bovis AF2122/97
gaagucgcagcgagg

SEQ ID NO: 3200779 - RNA, 12 nt, Mycobacterium bovis subsp bovis AF2122/97
gaagucgcccag

SEQ ID NO: 3200780 - RNA, 18 nt, Mycobacterium bovis subsp bovis AF2122/97
gaagucgcugaagccguc

SEQ ID NO: 3200781 - RNA, 19 nt, Mycobacterium bovis subsp bovis AF2122/97
gaagucgucgaggucacgc

SEQ ID NO: 3200782 - RNA, 14 nt, Mycobacterium bovis subsp bovis AF2122/97
gaagucgucggcca

SEQ ID NO: 3200783 - RNA, 15 nt, Mycobacterium bovis subsp bovis AF2122/97
gaagucgucggccau

SEQ ID NO: 3200784 - RNA, 13 nt, Mycobacterium bovis subsp bovis AF2122/97
gaagucucgcggc

SEQ ID NO: 3200785 - RNA, 21 nt, Mycobacterium bovis subsp bovis AF2122/97
gaagucucgcggcccgagaag

SEQ ID NO: 3200786 - RNA, 23 nt, Mycobacterium bovis subsp bovis AF2122/97
gaagucuuucucccccaucgcau

SEQ ID NO: 3200787 - RNA, 17 nt, Mycobacterium bovis subsp bovis AF2122/97
gaagugacccgaaccgc

SEQ ID NO: 3200788 - RNA, 21 nt, Mycobacterium bovis subsp bovis AF2122/97
gaagugagcucggcugcucga

SEQ ID NO: 3200789 - RNA, 15 nt, Mycobacterium bovis subsp bovis AF2122/97
gaagugcgcgcugga

SEQ ID NO: 3200790 - RNA, 20 nt, Mycobacterium bovis subsp bovis AF2122/97
gaagugcggugagauggcgg

SEQ ID NO: 3200791 - RNA, 20 nt, Mycobacterium bovis subsp bovis AF2122/97
gaagugcucacauccgguca

SEQ ID NO: 3200792 - RNA, 17 nt, Mycobacterium bovis subsp bovis AF2122/97
gaagugcuugggccgcu

SEQ ID NO: 3200793 - RNA, 18 nt, Mycobacterium bovis subsp bovis AF2122/97
gaaguggcgucagugcag

SEQ ID NO: 3200794 - RNA, 22 nt, Mycobacterium bovis subsp bovis AF2122/97
gaagugggcguuggcggcaagg

SEQ ID NO: 3200795 - RNA, 17 nt, Mycobacterium bovis subsp bovis AF2122/97
gaagugucgcugcaacc

SEQ ID NO: 3200796 - RNA, 23 nt, Mycobacterium bovis subsp bovis AF2122/97
gaagugugauuccgggucggcga

SEQ ID NO: 3200797 - RNA, 22 nt, Mycobacterium bovis subsp bovis AF2122/97
gaaguucggguagccgggaacg

SEQ ID NO: 3200798 - RNA, 21 nt, Mycobacterium bovis subsp bovis AF2122/97
gaaguucgucgguugccacgc

SEQ ID NO: 3200799 - RNA, 22 nt, Mycobacterium bovis subsp bovis AF2122/97
gaaguucgucgguugccacgcc

SEQ ID NO: 3200800 - RNA, 16 nt, Mycobacterium bovis subsp bovis AF2122/97
gaaguucucggugcgc

SEQ ID NO: 3200801 - RNA, 14 nt, Mycobacterium bovis subsp bovis AF2122/97
gaaguuggcguggu

SEQ ID NO: 3200802 - RNA, 14 nt, Mycobacterium bovis subsp bovis AF2122/97
gaaguuggcugagc

SEQ ID NO: 3200803 - RNA, 18 nt, Mycobacterium bovis subsp bovis AF2122/97
gaaguuggcugagcagcg

SEQ ID NO: 3200804 - RNA, 23 nt, Mycobacterium bovis subsp bovis AF2122/97
gaaguuggugacauagaccucgc

SEQ ID NO: 3200805 - RNA, 22 nt, Mycobacterium bovis subsp bovis AF2122/97
gaaguugugcgcacucuuuccu

SEQ ID NO: 3200806 - RNA, 16 nt, Mycobacterium bovis subsp bovis AF2122/97
gaaguuuuggaagccc

SEQ ID NO: 3200807 - RNA, 16 nt, Mycobacterium bovis subsp bovis AF2122/97
gaauacaccugcugga

SEQ ID NO: 3200808 - RNA, 21 nt, Mycobacterium bovis subsp bovis AF2122/97
gaauacaccugcuggaagccg

SEQ ID NO: 3200809 - RNA, 23 nt, Mycobacterium bovis subsp bovis AF2122/97
gaauacagcuugaucgccgaggc

SEQ ID NO: 3200810 - RNA, 19 nt, Mycobacterium bovis subsp bovis AF2122/97
gaauaccacaccgugacca

SEQ ID NO: 3200811 - RNA, 13 nt, Mycobacterium bovis subsp bovis AF2122/97
gaauacccgcggg

SEQ ID NO: 3200812 - RNA, 22 nt, Mycobacterium bovis subsp bovis AF2122/97
gaauacccgcggggaaucaccc

SEQ ID NO: 3200813 - RNA, 19 nt, Mycobacterium bovis subsp bovis AF2122/97
gaauaccgguggcagccug

SEQ ID NO: 3200814 - RNA, 16 nt, Mycobacterium bovis subsp bovis AF2122/97
gaauacgaccgucgcg

SEQ ID NO: 3200815 - RNA, 17 nt, Mycobacterium bovis subsp bovis AF2122/97
gaauacgaggacgacga

SEQ ID NO: 3200816 - RNA, 23 nt, Mycobacterium bovis subsp bovis AF2122/97
gaauacgcgccgccggcucgccg

SEQ ID NO: 3200817 - RNA, 23 nt, Mycobacterium bovis subsp bovis AF2122/97
gaauacgcguugugcccgccggc

SEQ ID NO: 3200818 - RNA, 17 nt, Mycobacterium bovis subsp bovis AF2122/97
gaauauggcggccgggu

SEQ ID NO: 3200819 - RNA, 18 nt, Mycobacterium bovis subsp bovis AF2122/97
gaaucacccacucgccga

SEQ ID NO: 3200820 - RNA, 15 nt, Mycobacterium bovis subsp bovis AF2122/97
gaaucaccccggcgg

SEQ ID NO: 3200821 - RNA, 19 nt, Mycobacterium bovis subsp bovis AF2122/97
gaaucacccgcgagaucgg

SEQ ID NO: 3200822 - RNA, 13 nt, Mycobacterium bovis subsp bovis AF2122/97
gaaucaccggcaa

SEQ ID NO: 3200823 - RNA, 20 nt, Mycobacterium bovis subsp bovis AF2122/97
gaaucacguggaccacggcg

SEQ ID NO: 3200824 - RNA, 19 nt, Mycobacterium bovis subsp bovis AF2122/97
gaaucagcaccccauggcc

SEQ ID NO: 3200825 - RNA, 12 nt, Mycobacterium bovis subsp bovis AF2122/97
gaaucagcacgg

SEQ ID NO: 3200826 - RNA, 18 nt, Mycobacterium bovis subsp bovis AF2122/97
gaaucagcagcagcguga

SEQ ID NO: 3200827 - RNA, 22 nt, Mycobacterium bovis subsp bovis AF2122/97
gaaucagcagcagcgugaccac

SEQ ID NO: 3200828 - RNA, 15 nt, Mycobacterium bovis subsp bovis AF2122/97
gaaucaggcucgccg

SEQ ID NO: 3200829 - RNA, 16 nt, Mycobacterium bovis subsp bovis AF2122/97
gaaucaggcucgccga

SEQ ID NO: 3200830 - RNA, 22 nt, Mycobacterium bovis subsp bovis AF2122/97
gaaucagggucugcgccgccgg

SEQ ID NO: 3200831 - RNA, 21 nt, Mycobacterium bovis subsp bovis AF2122/97
gaauccaccagccgguagccg

SEQ ID NO: 3200832 - RNA, 18 nt, Mycobacterium bovis subsp bovis AF2122/97
gaauccagaccaugcgca

SEQ ID NO: 3200833 - RNA, 14 nt, Mycobacterium bovis subsp bovis AF2122/97
gaauccagccgcgc

SEQ ID NO: 3200834 - RNA, 20 nt, Mycobacterium bovis subsp bovis AF2122/97
gaauccaggccguacucgau

SEQ ID NO: 3200835 - RNA, 13 nt, Mycobacterium bovis subsp bovis AF2122/97
gaauccagguggu

SEQ ID NO: 3200836 - RNA, 13 nt, Mycobacterium bovis subsp bovis AF2122/97
gaaucccaucggg

SEQ ID NO: 3200837 - RNA, 15 nt, Mycobacterium bovis subsp bovis AF2122/97
gaauccccccugucg

SEQ ID NO: 3200838 - RNA, 19 nt, Mycobacterium bovis subsp bovis AF2122/97
gaauccccccugucgccga

SEQ ID NO: 3200839 - RNA, 20 nt, Mycobacterium bovis subsp bovis AF2122/97
gaaucccccggacggcaggc

SEQ ID NO: 3200840 - RNA, 23 nt, Mycobacterium bovis subsp bovis AF2122/97
gaaucccccggacggcaggcugg

SEQ ID NO: 3200841 - RNA, 14 nt, Mycobacterium bovis subsp bovis AF2122/97
gaauccccgcggcg

SEQ ID NO: 3200842 - RNA, 15 nt, Mycobacterium bovis subsp bovis AF2122/97
gaauccccgcggcgg

SEQ ID NO: 3200843 - RNA, 16 nt, Mycobacterium bovis subsp bovis AF2122/97
gaauccccgcggcggu

SEQ ID NO: 3200844 - RNA, 21 nt, Mycobacterium bovis subsp bovis AF2122/97
gaaucccgagucugcgagcag

SEQ ID NO: 3200845 - RNA, 15 nt, Mycobacterium bovis subsp bovis AF2122/97
gaaucccgcgaugcg

SEQ ID NO: 3200846 - RNA, 15 nt, Mycobacterium bovis subsp bovis AF2122/97
gaaucccgcgcccgg

SEQ ID NO: 3200847 - RNA, 23 nt, Mycobacterium bovis subsp bovis AF2122/97
gaaucccguauugauacugcccg

SEQ ID NO: 3200848 - RNA, 16 nt, Mycobacterium bovis subsp bovis AF2122/97
gaaucccucggccgca

SEQ ID NO: 3200849 - RNA, 17 nt, Mycobacterium bovis subsp bovis AF2122/97
gaauccgacgucgacga

SEQ ID NO: 3200850 - RNA, 23 nt, Mycobacterium bovis subsp bovis AF2122/97
gaauccgaucaccucggcgacgu

SEQ ID NO: 3200851 - RNA, 21 nt, Mycobacterium bovis subsp bovis AF2122/97
gaauccggaguuuaagacgcc

SEQ ID NO: 3200852 - RNA, 20 nt, Mycobacterium bovis subsp bovis AF2122/97
gaauccggcaaccaccggcc

SEQ ID NO: 3200853 - RNA, 20 nt, Mycobacterium bovis subsp bovis AF2122/97
gaauccggcccacuucccag

SEQ ID NO: 3200854 - RNA, 15 nt, Mycobacterium bovis subsp bovis AF2122/97
gaauccgggaagccg

SEQ ID NO: 3200855 - RNA, 15 nt, Mycobacterium bovis subsp bovis AF2122/97
gaauccguucgacga

SEQ ID NO: 3200856 - RNA, 13 nt, Mycobacterium bovis subsp bovis AF2122/97
gaaucgaagcccg

SEQ ID NO: 3200857 - RNA, 18 nt, Mycobacterium bovis subsp bovis AF2122/97
gaaucgaagcccggcggc

SEQ ID NO: 3200858 - RNA, 15 nt, Mycobacterium bovis subsp bovis AF2122/97
gaaucgaagcggcug

SEQ ID NO: 3200859 - RNA, 19 nt, Mycobacterium bovis subsp bovis AF2122/97
gaaucgacaccgcccgacc

SEQ ID NO: 3200860 - RNA, 16 nt, Mycobacterium bovis subsp bovis AF2122/97
gaaucgacuccggaug

SEQ ID NO: 3200861 - RNA, 14 nt, Mycobacterium bovis subsp bovis AF2122/97
gaaucgagacggcc

SEQ ID NO: 3200862 - RNA, 16 nt, Mycobacterium bovis subsp bovis AF2122/97
gaaucgagacggccac

SEQ ID NO: 3200863 - RNA, 16 nt, Mycobacterium bovis subsp bovis AF2122/97
gaaucgagcaccgcaa

SEQ ID NO: 3200864 - RNA, 21 nt, Mycobacterium bovis subsp bovis AF2122/97
gaaucgcacgaaaucagcccg

SEQ ID NO: 3200865 - RNA, 16 nt, Mycobacterium bovis subsp bovis AF2122/97
gaaucgcacgacgcga

SEQ ID NO: 3200866 - RNA, 15 nt, Mycobacterium bovis subsp bovis AF2122/97
gaaucgcaucggcgg

SEQ ID NO: 3200867 - RNA, 15 nt, Mycobacterium bovis subsp bovis AF2122/97
gaaucgcccaucgca

SEQ ID NO: 3200868 - RNA, 18 nt, Mycobacterium bovis subsp bovis AF2122/97
gaaucgcccaucgcaagc

SEQ ID NO: 3200869 - RNA, 20 nt, Mycobacterium bovis subsp bovis AF2122/97
gaaucgcccauuucggcacg

SEQ ID NO: 3200870 - RNA, 18 nt, Mycobacterium bovis subsp bovis AF2122/97
gaaucgccugcgacagca

SEQ ID NO: 3200871 - RNA, 16 nt, Mycobacterium bovis subsp bovis AF2122/97
gaaucgcgcuucaggc

SEQ ID NO: 3200872 - RNA, 17 nt, Mycobacterium bovis subsp bovis AF2122/97
gaaucgcggagccagga

SEQ ID NO: 3200873 - RNA, 21 nt, Mycobacterium bovis subsp bovis AF2122/97
gaaucgcgucgagcgccggcc

SEQ ID NO: 3200874 - RNA, 16 nt, Mycobacterium bovis subsp bovis AF2122/97
gaaucgcugccgccga

SEQ ID NO: 3200875 - RNA, 13 nt, Mycobacterium bovis subsp bovis AF2122/97
gaaucgcugguga

SEQ ID NO: 3200876 - RNA, 14 nt, Mycobacterium bovis subsp bovis AF2122/97
gaaucggaccgacc

SEQ ID NO: 3200877 - RNA, 16 nt, Mycobacterium bovis subsp bovis AF2122/97
gaaucggagccgucga

SEQ ID NO: 3200878 - RNA, 19 nt, Mycobacterium bovis subsp bovis AF2122/97
gaaucggcggaugaugcaa

SEQ ID NO: 3200879 - RNA, 13 nt, Mycobacterium bovis subsp bovis AF2122/97
gaaucggcggcgg

SEQ ID NO: 3200880 - RNA, 21 nt, Mycobacterium bovis subsp bovis AF2122/97
gaaucgggcaaagucgguguc

SEQ ID NO: 3200881 - RNA, 14 nt, Mycobacterium bovis subsp bovis AF2122/97
gaaucgggucagca

SEQ ID NO: 3200882 - RNA, 20 nt, Mycobacterium bovis subsp bovis AF2122/97
gaaucgguuucgaccugcgg

SEQ ID NO: 3200883 - RNA, 17 nt, Mycobacterium bovis subsp bovis AF2122/97
gaaucgugcggcgaccg

SEQ ID NO: 3200884 - RNA, 13 nt, Mycobacterium bovis subsp bovis AF2122/97
gaaucuccgcgcg

SEQ ID NO: 3200885 - RNA, 13 nt, Mycobacterium bovis subsp bovis AF2122/97
gaaucucgccccc

SEQ ID NO: 3200886 - RNA, 22 nt, Mycobacterium bovis subsp bovis AF2122/97
gaaucugaaaaagcaucaaagc

SEQ ID NO: 3200887 - RNA, 14 nt, Mycobacterium bovis subsp bovis AF2122/97
gaaucugacgacgc

SEQ ID NO: 3200888 - RNA, 17 nt, Mycobacterium bovis subsp bovis AF2122/97
gaaucugccggccggcg

SEQ ID NO: 3200889 - RNA, 17 nt, Mycobacterium bovis subsp bovis AF2122/97
gaaucuucugagacugc

SEQ ID NO: 3200890 - RNA, 23 nt, Mycobacterium bovis subsp bovis AF2122/97
gaaucuuguuguucgccaccgca

SEQ ID NO: 3200891 - RNA, 20 nt, Mycobacterium bovis subsp bovis AF2122/97
gaaugaagcccucgucggga

SEQ ID NO: 3200892 - RNA, 19 nt, Mycobacterium bovis subsp bovis AF2122/97
gaaugaccuugcccugcgu

SEQ ID NO: 3200893 - RNA, 20 nt, Mycobacterium bovis subsp bovis AF2122/97
gaaugaccuugcccugcgug

SEQ ID NO: 3200894 - RNA, 18 nt, Mycobacterium bovis subsp bovis AF2122/97
gaaugacgauccagccca

SEQ ID NO: 3200895 - RNA, 15 nt, Mycobacterium bovis subsp bovis AF2122/97
gaaugaucggcgucc

SEQ ID NO: 3200896 - RNA, 17 nt, Mycobacterium bovis subsp bovis AF2122/97
gaaugaucggcguccuu

SEQ ID NO: 3200897 - RNA, 21 nt, Mycobacterium bovis subsp bovis AF2122/97
gaaugaucgucccgcggcgcg

SEQ ID NO: 3200898 - RNA, 19 nt, Mycobacterium bovis subsp bovis AF2122/97
gaaugaucguuccgauccg

SEQ ID NO: 3200899 - RNA, 16 nt, Mycobacterium bovis subsp bovis AF2122/97
gaaugcaacuccucga

SEQ ID NO: 3200900 - RNA, 17 nt, Mycobacterium bovis subsp bovis AF2122/97
gaaugccaccucgacgc

SEQ ID NO: 3200901 - RNA, 18 nt, Mycobacterium bovis subsp bovis AF2122/97
gaaugcccgggcccgucg

SEQ ID NO: 3200902 - RNA, 12 nt, Mycobacterium bovis subsp bovis AF2122/97
gaaugccgccga

SEQ ID NO: 3200903 - RNA, 12 nt, Mycobacterium bovis subsp bovis AF2122/97
gaaugccgcggg

SEQ ID NO: 3200904 - RNA, 17 nt, Mycobacterium bovis subsp bovis AF2122/97
gaaugccgcggggauca

SEQ ID NO: 3200905 - RNA, 20 nt, Mycobacterium bovis subsp bovis AF2122/97
gaaugccgcggggaucagcg

SEQ ID NO: 3200906 - RNA, 17 nt, Mycobacterium bovis subsp bovis AF2122/97
gaaugccuggcccgucg

SEQ ID NO: 3200907 - RNA, 21 nt, Mycobacterium bovis subsp bovis AF2122/97
gaaugccuggcccgucggcgu

SEQ ID NO: 3200908 - RNA, 14 nt, Mycobacterium bovis subsp bovis AF2122/97
gaaugcgccgucgg

SEQ ID NO: 3200909 - RNA, 20 nt, Mycobacterium bovis subsp bovis AF2122/97
gaaugcgguccucgaucggu

SEQ ID NO: 3200910 - RNA, 21 nt, Mycobacterium bovis subsp bovis AF2122/97
gaaugcggugaguccgcugag

SEQ ID NO: 3200911 - RNA, 22 nt, Mycobacterium bovis subsp bovis AF2122/97
gaaugcugacggugcaggacca

SEQ ID NO: 3200912 - RNA, 16 nt, Mycobacterium bovis subsp bovis AF2122/97
gaaugcugggcccgcc

SEQ ID NO: 3200913 - RNA, 18 nt, Mycobacterium bovis subsp bovis AF2122/97
gaaugcugggcccgccag

SEQ ID NO: 3200914 - RNA, 16 nt, Mycobacterium bovis subsp bovis AF2122/97
gaaugcuggggccugg

SEQ ID NO: 3200915 - RNA, 14 nt, Mycobacterium bovis subsp bovis AF2122/97
gaauggaccagcgc

SEQ ID NO: 3200916 - RNA, 16 nt, Mycobacterium bovis subsp bovis AF2122/97
gaauggaccagcgccc

SEQ ID NO: 3200917 - RNA, 19 nt, Mycobacterium bovis subsp bovis AF2122/97
gaauggaccagcgccccgg

SEQ ID NO: 3200918 - RNA, 16 nt, Mycobacterium bovis subsp bovis AF2122/97
gaauggaggccgccga

SEQ ID NO: 3200919 - RNA, 16 nt, Mycobacterium bovis subsp bovis AF2122/97
gaauggcagcacgacc

SEQ ID NO: 3200920 - RNA, 16 nt, Mycobacterium bovis subsp bovis AF2122/97
gaauggcccuugcucg

SEQ ID NO: 3200921 - RNA, 22 nt, Mycobacterium bovis subsp bovis AF2122/97
gaauggccgaaccguucggcga

SEQ ID NO: 3200922 - RNA, 15 nt, Mycobacterium bovis subsp bovis AF2122/97
gaauggccgccgcag

SEQ ID NO: 3200923 - RNA, 16 nt, Mycobacterium bovis subsp bovis AF2122/97
gaauggccgccgcagc

SEQ ID NO: 3200924 - RNA, 17 nt, Mycobacterium bovis subsp bovis AF2122/97
gaauggccgccgcagcu

SEQ ID NO: 3200925 - RNA, 13 nt, Mycobacterium bovis subsp bovis AF2122/97
gaauggcgccggc

SEQ ID NO: 3200926 - RNA, 18 nt, Mycobacterium bovis subsp bovis AF2122/97
gaauggcucacgcuccgc

SEQ ID NO: 3200927 - RNA, 12 nt, Mycobacterium bovis subsp bovis AF2122/97
gaauggucagcg

SEQ ID NO: 3200928 - RNA, 18 nt, Mycobacterium bovis subsp bovis AF2122/97
gaauguaguccagcucgc

SEQ ID NO: 3200929 - RNA, 20 nt, Mycobacterium bovis subsp bovis AF2122/97
gaauguaguccagcucgcug

SEQ ID NO: 3200930 - RNA, 21 nt, Mycobacterium bovis subsp bovis AF2122/97
gaaugucaccccgcccagcgu

SEQ ID NO: 3200931 - RNA, 15 nt, Mycobacterium bovis subsp bovis AF2122/97
gaauguccggcaucg

SEQ ID NO: 3200932 - RNA, 13 nt, Mycobacterium bovis subsp bovis AF2122/97
gaaugucgcgcug

SEQ ID NO: 3200933 - RNA, 23 nt, Mycobacterium bovis subsp bovis AF2122/97
gaaugucgcgcuguuguggaaca

SEQ ID NO: 3200934 - RNA, 18 nt, Mycobacterium bovis subsp bovis AF2122/97
gaaugucuccaguagccg

SEQ ID NO: 3200935 - RNA, 22 nt, Mycobacterium bovis subsp bovis AF2122/97
gaaugucuccaguagccggugc

SEQ ID NO: 3200936 - RNA, 16 nt, Mycobacterium bovis subsp bovis AF2122/97
gaauguugccgccgcg

SEQ ID NO: 3200937 - RNA, 17 nt, Mycobacterium bovis subsp bovis AF2122/97
gaauguugccgccgcgg

SEQ ID NO: 3200938 - RNA, 14 nt, Mycobacterium bovis subsp bovis AF2122/97
gaauguuucggcga

SEQ ID NO: 3200939 - RNA, 19 nt, Mycobacterium bovis subsp bovis AF2122/97
gaauuaaagccaccagaau

SEQ ID NO: 3200940 - RNA, 23 nt, Mycobacterium bovis subsp bovis AF2122/97
gaauuaguuucguccccagaccg

SEQ ID NO: 3200941 - RNA, 14 nt, Mycobacterium bovis subsp bovis AF2122/97
gaauucaccacucc

SEQ ID NO: 3200942 - RNA, 20 nt, Mycobacterium bovis subsp bovis AF2122/97
gaauucauccauuucauuca

SEQ ID NO: 3200943 - RNA, 14 nt, Mycobacterium bovis subsp bovis AF2122/97
gaauucaugccggu

SEQ ID NO: 3200944 - RNA, 15 nt, Mycobacterium bovis subsp bovis AF2122/97
gaauuccgccugcuc

SEQ ID NO: 3200945 - RNA, 16 nt, Mycobacterium bovis subsp bovis AF2122/97
gaauuccgcuaccgca

SEQ ID NO: 3200946 - RNA, 14 nt, Mycobacterium bovis subsp bovis AF2122/97
gaauuccuuccugg

SEQ ID NO: 3200947 - RNA, 19 nt, Mycobacterium bovis subsp bovis AF2122/97
gaauucgccauagcgggcg

SEQ ID NO: 3200948 - RNA, 14 nt, Mycobacterium bovis subsp bovis AF2122/97
gaauucggccggcg

SEQ ID NO: 3200949 - RNA, 16 nt, Mycobacterium bovis subsp bovis AF2122/97
gaauucggccggcgcg

SEQ ID NO: 3200950 - RNA, 18 nt, Mycobacterium bovis subsp bovis AF2122/97
gaauucggccggcgcggc

SEQ ID NO: 3200951 - RNA, 13 nt, Mycobacterium bovis subsp bovis AF2122/97
gaauucggcgucg

SEQ ID NO: 3200952 - RNA, 23 nt, Mycobacterium bovis subsp bovis AF2122/97
gaauucggcgucguggcuuccgg

SEQ ID NO: 3200953 - RNA, 20 nt, Mycobacterium bovis subsp bovis AF2122/97
gaauugccgggcgcacgccc

SEQ ID NO: 3200954 - RNA, 13 nt, Mycobacterium bovis subsp bovis AF2122/97
gaauugcgcgccc

SEQ ID NO: 3200955 - RNA, 15 nt, Mycobacterium bovis subsp bovis AF2122/97
gaauugcguucgccg

SEQ ID NO: 3200956 - RNA, 22 nt, Mycobacterium bovis subsp bovis AF2122/97
gaauuuggugaagccguagacg

SEQ ID NO: 3200957 - RNA, 16 nt, Mycobacterium bovis subsp bovis AF2122/97
gaauuuggugaaguga

SEQ ID NO: 3200958 - RNA, 14 nt, Mycobacterium bovis subsp bovis AF2122/97
gaauuugucggcga

SEQ ID NO: 3200959 - RNA, 17 nt, Mycobacterium bovis subsp bovis AF2122/97
gaauuugucggcgaagc

SEQ ID NO: 3200960 - RNA, 16 nt, Mycobacterium bovis subsp bovis AF2122/97
gacaaaaucagcagcc

SEQ ID NO: 3200961 - RNA, 18 nt, Mycobacterium bovis subsp bovis AF2122/97
gacaaaaucagcagcccc

SEQ ID NO: 3200962 - RNA, 21 nt, Mycobacterium bovis subsp bovis AF2122/97
gacaaaaucagcagcccccgc

SEQ ID NO: 3200963 - RNA, 13 nt, Mycobacterium bovis subsp bovis AF2122/97
gacaaaccacaga

SEQ ID NO: 3200964 - RNA, 23 nt, Mycobacterium bovis subsp bovis AF2122/97
gacaaacggcgacccagcgguau

SEQ ID NO: 3200965 - RNA, 15 nt, Mycobacterium bovis subsp bovis AF2122/97
gacaaagaagugguc

SEQ ID NO: 3200966 - RNA, 20 nt, Mycobacterium bovis subsp bovis AF2122/97
gacaaagacgccgucggcgc

SEQ ID NO: 3200967 - RNA, 16 nt, Mycobacterium bovis subsp bovis AF2122/97
gacaaagccacgcaga

SEQ ID NO: 3200968 - RNA, 20 nt, Mycobacterium bovis subsp bovis AF2122/97
gacaaagccgaacgacagca

SEQ ID NO: 3200969 - RNA, 14 nt, Mycobacterium bovis subsp bovis AF2122/97
gacaaagccgucga

SEQ ID NO: 3200970 - RNA, 14 nt, Mycobacterium bovis subsp bovis AF2122/97
gacaaagccgucgc

SEQ ID NO: 3200971 - RNA, 16 nt, Mycobacterium bovis subsp bovis AF2122/97
gacaaagccgucgcga

SEQ ID NO: 3200972 - RNA, 21 nt, Mycobacterium bovis subsp bovis AF2122/97
gacaaagcugcucgucggcgc

SEQ ID NO: 3200973 - RNA, 17 nt, Mycobacterium bovis subsp bovis AF2122/97
gacaaaucggucgacga

SEQ ID NO: 3200974 - RNA, 14 nt, Mycobacterium bovis subsp bovis AF2122/97
gacaacaaacccgg

SEQ ID NO: 3200975 - RNA, 15 nt, Mycobacterium bovis subsp bovis AF2122/97
gacaacaaacccggc

SEQ ID NO: 3200976 - RNA, 19 nt, Mycobacterium bovis subsp bovis AF2122/97
gacaacaaacccggccucg

SEQ ID NO: 3200977 - RNA, 13 nt, Mycobacterium bovis subsp bovis AF2122/97
gacaacaccacgg

SEQ ID NO: 3200978 - RNA, 20 nt, Mycobacterium bovis subsp bovis AF2122/97
gacaacaccacggugccgac

SEQ ID NO: 3200979 - RNA, 23 nt, Mycobacterium bovis subsp bovis AF2122/97
gacaacaccacggugccgacgau

SEQ ID NO: 3200980 - RNA, 14 nt, Mycobacterium bovis subsp bovis AF2122/97
gacaacacggcgaa

SEQ ID NO: 3200981 - RNA, 18 nt, Mycobacterium bovis subsp bovis AF2122/97
gacaacagagucaccgcg

SEQ ID NO: 3200982 - RNA, 19 nt, Mycobacterium bovis subsp bovis AF2122/97
gacaacagagucaccgcgc

SEQ ID NO: 3200983 - RNA, 23 nt, Mycobacterium bovis subsp bovis AF2122/97
gacaacagagucaccgcgcuggu

SEQ ID NO: 3200984 - RNA, 17 nt, Mycobacterium bovis subsp bovis AF2122/97
gacaacagccgcucgca

SEQ ID NO: 3200985 - RNA, 13 nt, Mycobacterium bovis subsp bovis AF2122/97
gacaacagcuugg

SEQ ID NO: 3200986 - RNA, 14 nt, Mycobacterium bovis subsp bovis AF2122/97
gacaacagcuugga

SEQ ID NO: 3200987 - RNA, 16 nt, Mycobacterium bovis subsp bovis AF2122/97
gacaacaggccgucga

SEQ ID NO: 3200988 - RNA, 17 nt, Mycobacterium bovis subsp bovis AF2122/97
gacaaccccgccaggau

SEQ ID NO: 3200989 - RNA, 22 nt, Mycobacterium bovis subsp bovis AF2122/97
gacaacccguaggguggccgac

SEQ ID NO: 3200990 - RNA, 15 nt, Mycobacterium bovis subsp bovis AF2122/97
gacaaccgagcugac

SEQ ID NO: 3200991 - RNA, 11 nt, Mycobacterium bovis subsp bovis AF2122/97
gacaaccuggg

SEQ ID NO: 3200992 - RNA, 15 nt, Mycobacterium bovis subsp bovis AF2122/97
gacaaccuggggcca

SEQ ID NO: 3200993 - RNA, 17 nt, Mycobacterium bovis subsp bovis AF2122/97
gacaacgacgucgccga

SEQ ID NO: 3200994 - RNA, 20 nt, Mycobacterium bovis subsp bovis AF2122/97
gacaacgaucgcgcgagcga

SEQ ID NO: 3200995 - RNA, 22 nt, Mycobacterium bovis subsp bovis AF2122/97
gacaacgaugucacccucccgc

SEQ ID NO: 3200996 - RNA, 14 nt, Mycobacterium bovis subsp bovis AF2122/97
gacaacgccgucga

SEQ ID NO: 3200997 - RNA, 15 nt, Mycobacterium bovis subsp bovis AF2122/97
gacaacgccgucgau

SEQ ID NO: 3200998 - RNA, 20 nt, Mycobacterium bovis subsp bovis AF2122/97
gacaacgccuuguuggcgcc

SEQ ID NO: 3200999 - RNA, 17 nt, Mycobacterium bovis subsp bovis AF2122/97
gacaacgugccgaacgc

SEQ ID NO: 3201000 - RNA, 17 nt, Mycobacterium bovis subsp bovis AF2122/97
gacaacucgcguggcac

SEQ ID NO: 3201001 - RNA, 16 nt, Mycobacterium bovis subsp bovis AF2122/97
gacaacugcccgauga

SEQ ID NO: 3201002 - RNA, 14 nt, Mycobacterium bovis subsp bovis AF2122/97
gacaagaccggcgg

SEQ ID NO: 3201003 - RNA, 15 nt, Mycobacterium bovis subsp bovis AF2122/97
gacaagaccggcggg

SEQ ID NO: 3201004 - RNA, 20 nt, Mycobacterium bovis subsp bovis AF2122/97
gacaagccuuaccccgcagc

SEQ ID NO: 3201005 - RNA, 23 nt, Mycobacterium bovis subsp bovis AF2122/97
gacaagcgauuuggcgucgccga

SEQ ID NO: 3201006 - RNA, 13 nt, Mycobacterium bovis subsp bovis AF2122/97
gacaagcggcccg

SEQ ID NO: 3201007 - RNA, 16 nt, Mycobacterium bovis subsp bovis AF2122/97
gacaagcugucggcga

SEQ ID NO: 3201008 - RNA, 18 nt, Mycobacterium bovis subsp bovis AF2122/97
gacaagcugucggcgacc

SEQ ID NO: 3201009 - RNA, 21 nt, Mycobacterium bovis subsp bovis AF2122/97
gacaaggauggucgccugcgg

SEQ ID NO: 3201010 - RNA, 22 nt, Mycobacterium bovis subsp bovis AF2122/97
gacaaggccgauguacugugcc

SEQ ID NO: 3201011 - RNA, 16 nt, Mycobacterium bovis subsp bovis AF2122/97
gacaaggcgauugucg

SEQ ID NO: 3201012 - RNA, 18 nt, Mycobacterium bovis subsp bovis AF2122/97
gacaaggguucaggucgg

SEQ ID NO: 3201013 - RNA, 14 nt, Mycobacterium bovis subsp bovis AF2122/97
gacaaggugcgcug

SEQ ID NO: 3201014 - RNA, 16 nt, Mycobacterium bovis subsp bovis AF2122/97
gacaaggugcgcuggg

SEQ ID NO: 3201015 - RNA, 15 nt, Mycobacterium bovis subsp bovis AF2122/97
gacaagucggcaccg

SEQ ID NO: 3201016 - RNA, 16 nt, Mycobacterium bovis subsp bovis AF2122/97
gacaagucggcaccgg

SEQ ID NO: 3201017 - RNA, 18 nt, Mycobacterium bovis subsp bovis AF2122/97
gacaagucggcaccggug

SEQ ID NO: 3201018 - RNA, 16 nt, Mycobacterium bovis subsp bovis AF2122/97
gacaagucggcgcugg

SEQ ID NO: 3201019 - RNA, 17 nt, Mycobacterium bovis subsp bovis AF2122/97
gacaagucggcgcuggc

SEQ ID NO: 3201020 - RNA, 19 nt, Mycobacterium bovis subsp bovis AF2122/97
gacaagucggcgcuggccg

SEQ ID NO: 3201021 - RNA, 14 nt, Mycobacterium bovis subsp bovis AF2122/97
gacaagugcccggc

SEQ ID NO: 3201022 - RNA, 15 nt, Mycobacterium bovis subsp bovis AF2122/97
gacaagugcccggcc

SEQ ID NO: 3201023 - RNA, 15 nt, Mycobacterium bovis subsp bovis AF2122/97
gacaagugccggcgc

SEQ ID NO: 3201024 - RNA, 20 nt, Mycobacterium bovis subsp bovis AF2122/97
gacaagugccggcgcggagu

SEQ ID NO: 3201025 - RNA, 16 nt, Mycobacterium bovis subsp bovis AF2122/97
gacaaguggugcccuu

SEQ ID NO: 3201026 - RNA, 23 nt, Mycobacterium bovis subsp bovis AF2122/97
gacaaguucgguagcgaucgugc

SEQ ID NO: 3201027 - RNA, 14 nt, Mycobacterium bovis subsp bovis AF2122/97
gacaauacgugcga

SEQ ID NO: 3201028 - RNA, 14 nt, Mycobacterium bovis subsp bovis AF2122/97
gacaaucucggccg

SEQ ID NO: 3201029 - RNA, 21 nt, Mycobacterium bovis subsp bovis AF2122/97
gacaaucucggcguugccgcc

SEQ ID NO: 3201030 - RNA, 23 nt, Mycobacterium bovis subsp bovis AF2122/97
gacaaucucggcguugccgccgu

SEQ ID NO: 3201031 - RNA, 15 nt, Mycobacterium bovis subsp bovis AF2122/97
gacaauggacaccaa

SEQ ID NO: 3201032 - RNA, 17 nt, Mycobacterium bovis subsp bovis AF2122/97
gacaauggacaccaacc

SEQ ID NO: 3201033 - RNA, 18 nt, Mycobacterium bovis subsp bovis AF2122/97
gacaauggcgccagccga

SEQ ID NO: 3201034 - RNA, 14 nt, Mycobacterium bovis subsp bovis AF2122/97
gacaaugucggcga

SEQ ID NO: 3201035 - RNA, 19 nt, Mycobacterium bovis subsp bovis AF2122/97
gacaaugucggcgaugcgu

SEQ ID NO: 3201036 - RNA, 15 nt, Mycobacterium bovis subsp bovis AF2122/97
gacacaacaccggcg

SEQ ID NO: 3201037 - RNA, 14 nt, Mycobacterium bovis subsp bovis AF2122/97
gacacacaggcggc

SEQ ID NO: 3201038 - RNA, 14 nt, Mycobacterium bovis subsp bovis AF2122/97
gacacacgccgccg

SEQ ID NO: 3201039 - RNA, 19 nt, Mycobacterium bovis subsp bovis AF2122/97
gacacacgccgccgguguc

SEQ ID NO: 3201040 - RNA, 22 nt, Mycobacterium bovis subsp bovis AF2122/97
gacacagaaucgcacgaaauca

SEQ ID NO: 3201041 - RNA, 19 nt, Mycobacterium bovis subsp bovis AF2122/97
gacacagcaccguccucgg

SEQ ID NO: 3201042 - RNA, 14 nt, Mycobacterium bovis subsp bovis AF2122/97
gacacagcggcggg

SEQ ID NO: 3201043 - RNA, 21 nt, Mycobacterium bovis subsp bovis AF2122/97
gacacauaagcccccgccacg

SEQ ID NO: 3201044 - RNA, 13 nt, Mycobacterium bovis subsp bovis AF2122/97
gacacauugacca

SEQ ID NO: 3201045 - RNA, 16 nt, Mycobacterium bovis subsp bovis AF2122/97
gacacauugaccaggu

SEQ ID NO: 3201046 - RNA, 13 nt, Mycobacterium bovis subsp bovis AF2122/97
gacaccaacaccg

SEQ ID NO: 3201047 - RNA, 16 nt, Mycobacterium bovis subsp bovis AF2122/97
gacaccaacaccggug

SEQ ID NO: 3201048 - RNA, 15 nt, Mycobacterium bovis subsp bovis AF2122/97
gacaccaacccaccc

SEQ ID NO: 3201049 - RNA, 23 nt, Mycobacterium bovis subsp bovis AF2122/97
gacaccaacccaccccccagcgc

SEQ ID NO: 3201050 - RNA, 23 nt, Mycobacterium bovis subsp bovis AF2122/97
gacaccaccagguccaccccgcc

SEQ ID NO: 3201051 - RNA, 14 nt, Mycobacterium bovis subsp bovis AF2122/97
gacaccaccgcccg

SEQ ID NO: 3201052 - RNA, 15 nt, Mycobacterium bovis subsp bovis AF2122/97
gacaccaccgcccgc

SEQ ID NO: 3201053 - RNA, 13 nt, Mycobacterium bovis subsp bovis AF2122/97
gacaccaccggcg

SEQ ID NO: 3201054 - RNA, 16 nt, Mycobacterium bovis subsp bovis AF2122/97
gacaccaccggcgccg

SEQ ID NO: 3201055 - RNA, 17 nt, Mycobacterium bovis subsp bovis AF2122/97
gacaccaccggcgccgc

SEQ ID NO: 3201056 - RNA, 14 nt, Mycobacterium bovis subsp bovis AF2122/97
gacaccaccucguc

SEQ ID NO: 3201057 - RNA, 15 nt, Mycobacterium bovis subsp bovis AF2122/97
gacaccagcgugugg

SEQ ID NO: 3201058 - RNA, 13 nt, Mycobacterium bovis subsp bovis AF2122/97
gacaccagcucga

SEQ ID NO: 3201059 - RNA, 22 nt, Mycobacterium bovis subsp bovis AF2122/97
gacaccaggaugccuaccgugc

SEQ ID NO: 3201060 - RNA, 16 nt, Mycobacterium bovis subsp bovis AF2122/97
gacaccauaggccgac

SEQ ID NO: 3201061 - RNA, 18 nt, Mycobacterium bovis subsp bovis AF2122/97
gacaccauaggccgacgg

SEQ ID NO: 3201062 - RNA, 17 nt, Mycobacterium bovis subsp bovis AF2122/97
gacaccaucuccgccgu

SEQ ID NO: 3201063 - RNA, 23 nt, Mycobacterium bovis subsp bovis AF2122/97
gacaccauuggccuaggacaccg

SEQ ID NO: 3201064 - RNA, 16 nt, Mycobacterium bovis subsp bovis AF2122/97
gacacccagccgcagc

SEQ ID NO: 3201065 - RNA, 17 nt, Mycobacterium bovis subsp bovis AF2122/97
gacacccagccgcagcc

SEQ ID NO: 3201066 - RNA, 15 nt, Mycobacterium bovis subsp bovis AF2122/97
gacaccccgcacgga

SEQ ID NO: 3201067 - RNA, 15 nt, Mycobacterium bovis subsp bovis AF2122/97
gacaccccggaaucc

SEQ ID NO: 3201068 - RNA, 19 nt, Mycobacterium bovis subsp bovis AF2122/97
gacacccgagggccugacg

SEQ ID NO: 3201069 - RNA, 16 nt, Mycobacterium bovis subsp bovis AF2122/97
gacacccgcagcugug

SEQ ID NO: 3201070 - RNA, 14 nt, Mycobacterium bovis subsp bovis AF2122/97
gacacccgcauggc

SEQ ID NO: 3201071 - RNA, 15 nt, Mycobacterium bovis subsp bovis AF2122/97
gacacccgccaggcc

SEQ ID NO: 3201072 - RNA, 12 nt, Mycobacterium bovis subsp bovis AF2122/97
gacacccgggcc

SEQ ID NO: 3201073 - RNA, 21 nt, Mycobacterium bovis subsp bovis AF2122/97
gacacccguaagcggaugucc

SEQ ID NO: 3201074 - RNA, 14 nt, Mycobacterium bovis subsp bovis AF2122/97
gacacccucgggca

SEQ ID NO: 3201075 - RNA, 16 nt, Mycobacterium bovis subsp bovis AF2122/97
gacacccucgggcaac

SEQ ID NO: 3201076 - RNA, 21 nt, Mycobacterium bovis subsp bovis AF2122/97
gacacccugggugccggcagc

SEQ ID NO: 3201077 - RNA, 20 nt, Mycobacterium bovis subsp bovis AF2122/97
gacaccgaaccgccgcugcc

SEQ ID NO: 3201078 - RNA, 22 nt, Mycobacterium bovis subsp bovis AF2122/97
gacaccgaaccgccgcugccgc

SEQ ID NO: 3201079 - RNA, 23 nt, Mycobacterium bovis subsp bovis AF2122/97
gacaccgaaccgccgcugccgcg

SEQ ID NO: 3201080 - RNA, 15 nt, Mycobacterium bovis subsp bovis AF2122/97
gacaccgaccggguc

SEQ ID NO: 3201081 - RNA, 22 nt, Mycobacterium bovis subsp bovis AF2122/97
gacaccgaccgggucgcaaccg

SEQ ID NO: 3201082 - RNA, 18 nt, Mycobacterium bovis subsp bovis AF2122/97
gacaccgaggaccucguc

SEQ ID NO: 3201083 - RNA, 17 nt, Mycobacterium bovis subsp bovis AF2122/97
gacaccgauccggccgc

SEQ ID NO: 3201084 - RNA, 21 nt, Mycobacterium bovis subsp bovis AF2122/97
gacaccgauccggccgccgau

SEQ ID NO: 3201085 - RNA, 18 nt, Mycobacterium bovis subsp bovis AF2122/97
gacaccgcaacgcgugcg

SEQ ID NO: 3201086 - RNA, 14 nt, Mycobacterium bovis subsp bovis AF2122/97
gacaccgcagcggg

SEQ ID NO: 3201087 - RNA, 15 nt, Mycobacterium bovis subsp bovis AF2122/97
gacaccgccaccacg

SEQ ID NO: 3201088 - RNA, 22 nt, Mycobacterium bovis subsp bovis AF2122/97
gacaccgccaccacgccgucga

SEQ ID NO: 3201089 - RNA, 18 nt, Mycobacterium bovis subsp bovis AF2122/97
gacaccgccccgccgcga

SEQ ID NO: 3201090 - RNA, 12 nt, Mycobacterium bovis subsp bovis AF2122/97
gacaccgcccga

SEQ ID NO: 3201091 - RNA, 13 nt, Mycobacterium bovis subsp bovis AF2122/97
gacaccgcccgac

SEQ ID NO: 3201092 - RNA, 18 nt, Mycobacterium bovis subsp bovis AF2122/97
gacaccgcgaucaccacc

SEQ ID NO: 3201093 - RNA, 20 nt, Mycobacterium bovis subsp bovis AF2122/97
gacaccgcgaucaccaccgg

SEQ ID NO: 3201094 - RNA, 17 nt, Mycobacterium bovis subsp bovis AF2122/97
gacaccgcggacccgca

SEQ ID NO: 3201095 - RNA, 20 nt, Mycobacterium bovis subsp bovis AF2122/97
gacaccgcggacccgcagcu

SEQ ID NO: 3201096 - RNA, 19 nt, Mycobacterium bovis subsp bovis AF2122/97
gacaccgcggcgaucugcg

SEQ ID NO: 3201097 - RNA, 16 nt, Mycobacterium bovis subsp bovis AF2122/97
gacaccgcggugcccc

SEQ ID NO: 3201098 - RNA, 18 nt, Mycobacterium bovis subsp bovis AF2122/97
gacaccgcggugccccgg

SEQ ID NO: 3201099 - RNA, 19 nt, Mycobacterium bovis subsp bovis AF2122/97
gacaccgcggugccccgga

SEQ ID NO: 3201100 - RNA, 13 nt, Mycobacterium bovis subsp bovis AF2122/97
gacaccgcuugug

SEQ ID NO: 3201101 - RNA, 13 nt, Mycobacterium bovis subsp bovis AF2122/97
gacaccggcacca

SEQ ID NO: 3201102 - RNA, 13 nt, Mycobacterium bovis subsp bovis AF2122/97
gacaccggccacc

SEQ ID NO: 3201103 - RNA, 14 nt, Mycobacterium bovis subsp bovis AF2122/97
gacaccggccgcga

SEQ ID NO: 3201104 - RNA, 15 nt, Mycobacterium bovis subsp bovis AF2122/97
gacaccggccugcgc

SEQ ID NO: 3201105 - RNA, 13 nt, Mycobacterium bovis subsp bovis AF2122/97
gacaccggcggca

SEQ ID NO: 3201106 - RNA, 16 nt, Mycobacterium bovis subsp bovis AF2122/97
gacaccggcggcaucg

SEQ ID NO: 3201107 - RNA, 15 nt, Mycobacterium bovis subsp bovis AF2122/97
gacaccggucggcag

SEQ ID NO: 3201108 - RNA, 17 nt, Mycobacterium bovis subsp bovis AF2122/97
gacaccggucggcagcu

SEQ ID NO: 3201109 - RNA, 22 nt, Mycobacterium bovis subsp bovis AF2122/97
gacaccggugcgaccaacacgg

SEQ ID NO: 3201110 - RNA, 17 nt, Mycobacterium bovis subsp bovis AF2122/97
gacaccgucaugccguu

SEQ ID NO: 3201111 - RNA, 17 nt, Mycobacterium bovis subsp bovis AF2122/97
gacaccguccagcagcu

SEQ ID NO: 3201112 - RNA, 13 nt, Mycobacterium bovis subsp bovis AF2122/97
gacaccgugaccg

SEQ ID NO: 3201113 - RNA, 20 nt, Mycobacterium bovis subsp bovis AF2122/97
gacaccgugaccgccgcgcc

SEQ ID NO: 3201114 - RNA, 23 nt, Mycobacterium bovis subsp bovis AF2122/97
gacaccguggaucggcagcccgg

SEQ ID NO: 3201115 - RNA, 18 nt, Mycobacterium bovis subsp bovis AF2122/97
gacaccgugucgccggcg

SEQ ID NO: 3201116 - RNA, 19 nt, Mycobacterium bovis subsp bovis AF2122/97
gacaccgugucgccggcga

SEQ ID NO: 3201117 - RNA, 14 nt, Mycobacterium bovis subsp bovis AF2122/97
gacaccuaccgaga

SEQ ID NO: 3201118 - RNA, 15 nt, Mycobacterium bovis subsp bovis AF2122/97
gacaccuaccgagau

SEQ ID NO: 3201119 - RNA, 18 nt, Mycobacterium bovis subsp bovis AF2122/97
gacaccuaccgagaucac

SEQ ID NO: 3201120 - RNA, 22 nt, Mycobacterium bovis subsp bovis AF2122/97
gacaccuccgucagcgccgcgc

SEQ ID NO: 3201121 - RNA, 23 nt, Mycobacterium bovis subsp bovis AF2122/97
gacaccuccgucagcgccgcgcg

SEQ ID NO: 3201122 - RNA, 15 nt, Mycobacterium bovis subsp bovis AF2122/97
gacaccucgggcgcc

SEQ ID NO: 3201123 - RNA, 19 nt, Mycobacterium bovis subsp bovis AF2122/97
gacaccugucguccucgcu

SEQ ID NO: 3201124 - RNA, 21 nt, Mycobacterium bovis subsp bovis AF2122/97
gacaccuugcguccguagcga

SEQ ID NO: 3201125 - RNA, 16 nt, Mycobacterium bovis subsp bovis AF2122/97
gacacgagucgccaga

SEQ ID NO: 3201126 - RNA, 13 nt, Mycobacterium bovis subsp bovis AF2122/97
gacacgaucaguc

SEQ ID NO: 3201127 - RNA, 18 nt, Mycobacterium bovis subsp bovis AF2122/97
gacacgaucgcgucggcu

SEQ ID NO: 3201128 - RNA, 17 nt, Mycobacterium bovis subsp bovis AF2122/97
gacacgaugcccggcau

SEQ ID NO: 3201129 - RNA, 16 nt, Mycobacterium bovis subsp bovis AF2122/97
gacacgccagccgugc

SEQ ID NO: 3201130 - RNA, 23 nt, Mycobacterium bovis subsp bovis AF2122/97
gacacgccaggugaugccgccgu

SEQ ID NO: 3201131 - RNA, 13 nt, Mycobacterium bovis subsp bovis AF2122/97
gacacgccgaacg

SEQ ID NO: 3201132 - RNA, 22 nt, Mycobacterium bovis subsp bovis AF2122/97
gacacgccgaacgugcgguggc

SEQ ID NO: 3201133 - RNA, 12 nt, Mycobacterium bovis subsp bovis AF2122/97
gacacgccgaug

SEQ ID NO: 3201134 - RNA, 15 nt, Mycobacterium bovis subsp bovis AF2122/97
gacacgccgauucgc

SEQ ID NO: 3201135 - RNA, 20 nt, Mycobacterium bovis subsp bovis AF2122/97
gacacgccgugcgugcgggg

SEQ ID NO: 3201136 - RNA, 13 nt, Mycobacterium bovis subsp bovis AF2122/97
gacacggcgcugc

SEQ ID NO: 3201137 - RNA, 13 nt, Mycobacterium bovis subsp bovis AF2122/97
gacacggcucgcc

SEQ ID NO: 3201138 - RNA, 17 nt, Mycobacterium bovis subsp bovis AF2122/97
gacacgucuaucggcga

SEQ ID NO: 3201139 - RNA, 19 nt, Mycobacterium bovis subsp bovis AF2122/97
gacacgucuaucggcgaac

SEQ ID NO: 3201140 - RNA, 15 nt, Mycobacterium bovis subsp bovis AF2122/97
gacacgugcaucugu

SEQ ID NO: 3201141 - RNA, 23 nt, Mycobacterium bovis subsp bovis AF2122/97
gacacguugacccaucucgucgu

SEQ ID NO: 3201142 - RNA, 24 nt, Mycobacterium bovis subsp bovis AF2122/97
gacacguugacccaucucgucguc

SEQ ID NO: 3201143 - RNA, 15 nt, Mycobacterium bovis subsp bovis AF2122/97
gacacguuggcggau

SEQ ID NO: 3201144 - RNA, 19 nt, Mycobacterium bovis subsp bovis AF2122/97
gacacguuguucaccgacg

SEQ ID NO: 3201145 - RNA, 20 nt, Mycobacterium bovis subsp bovis AF2122/97
gacacuaaagcccucgacac

SEQ ID NO: 3201146 - RNA, 20 nt, Mycobacterium bovis subsp bovis AF2122/97
gacacucaaccugaaccggc

SEQ ID NO: 3201147 - RNA, 20 nt, Mycobacterium bovis subsp bovis AF2122/97
gacacugccuuaaccgagcc

SEQ ID NO: 3201148 - RNA, 23 nt, Mycobacterium bovis subsp bovis AF2122/97
gacacugcgaaggaccagagcuc

SEQ ID NO: 3201149 - RNA, 17 nt, Mycobacterium bovis subsp bovis AF2122/97
gacacuggucgcggcgc

SEQ ID NO: 3201150 - RNA, 19 nt, Mycobacterium bovis subsp bovis AF2122/97
gacacuggucgcggcgcug

SEQ ID NO: 3201151 - RNA, 20 nt, Mycobacterium bovis subsp bovis AF2122/97
gacacuggucgcggcgcugg

SEQ ID NO: 3201152 - RNA, 14 nt, Mycobacterium bovis subsp bovis AF2122/97
gacacugugcgccu

SEQ ID NO: 3201153 - RNA, 18 nt, Mycobacterium bovis subsp bovis AF2122/97
gacacugugcgccugcgu

SEQ ID NO: 3201154 - RNA, 19 nt, Mycobacterium bovis subsp bovis AF2122/97
gacagacagcaccgccggu

SEQ ID NO: 3201155 - RNA, 19 nt, Mycobacterium bovis subsp bovis AF2122/97
gacagacaucgcgacgauc

SEQ ID NO: 3201156 - RNA, 21 nt, Mycobacterium bovis subsp bovis AF2122/97
gacagaccgggcccggcgaac

SEQ ID NO: 3201157 - RNA, 19 nt, Mycobacterium bovis subsp bovis AF2122/97
gacagagcggguucgacgu

SEQ ID NO: 3201158 - RNA, 23 nt, Mycobacterium bovis subsp bovis AF2122/97
gacagauagacuagccgauccag

SEQ ID NO: 3201159 - RNA, 17 nt, Mycobacterium bovis subsp bovis AF2122/97
gacagaucaacgcgaac

SEQ ID NO: 3201160 - RNA, 13 nt, Mycobacterium bovis subsp bovis AF2122/97
gacagaugcaucc

SEQ ID NO: 3201161 - RNA, 15 nt, Mycobacterium bovis subsp bovis AF2122/97
gacagaugcauccag

SEQ ID NO: 3201162 - RNA, 16 nt, Mycobacterium bovis subsp bovis AF2122/97
gacagauggcggccga

SEQ ID NO: 3201163 - RNA, 22 nt, Mycobacterium bovis subsp bovis AF2122/97
gacagauggucggucgcuucag

SEQ ID NO: 3201164 - RNA, 20 nt, Mycobacterium bovis subsp bovis AF2122/97
gacagcacccaaugccaccg

SEQ ID NO: 3201165 - RNA, 18 nt, Mycobacterium bovis subsp bovis AF2122/97
gacagcacccggccaccg

SEQ ID NO: 3201166 - RNA, 20 nt, Mycobacterium bovis subsp bovis AF2122/97
gacagcacccggccaccgga

SEQ ID NO: 3201167 - RNA, 14 nt, Mycobacterium bovis subsp bovis AF2122/97
gacagcaccgccgg

SEQ ID NO: 3201168 - RNA, 15 nt, Mycobacterium bovis subsp bovis AF2122/97
gacagcaccgccggu

SEQ ID NO: 3201169 - RNA, 13 nt, Mycobacterium bovis subsp bovis AF2122/97
gacagcagccgcc

SEQ ID NO: 3201170 - RNA, 14 nt, Mycobacterium bovis subsp bovis AF2122/97
gacagcagccgccg

SEQ ID NO: 3201171 - RNA, 15 nt, Mycobacterium bovis subsp bovis AF2122/97
gacagcagccggcgu

SEQ ID NO: 3201172 - RNA, 18 nt, Mycobacterium bovis subsp bovis AF2122/97
gacagcagccggugccgg

SEQ ID NO: 3201173 - RNA, 13 nt, Mycobacterium bovis subsp bovis AF2122/97
gacagcagcgcca

SEQ ID NO: 3201174 - RNA, 16 nt, Mycobacterium bovis subsp bovis AF2122/97
gacagcagcgccaccc

SEQ ID NO: 3201175 - RNA, 17 nt, Mycobacterium bovis subsp bovis AF2122/97
gacagcagcgccacccg

SEQ ID NO: 3201176 - RNA, 17 nt, Mycobacterium bovis subsp bovis AF2122/97
gacagcaguuucaccuu

SEQ ID NO: 3201177 - RNA, 19 nt, Mycobacterium bovis subsp bovis AF2122/97
gacagcaucacgcccacga

SEQ ID NO: 3201178 - RNA, 17 nt, Mycobacterium bovis subsp bovis AF2122/97
gacagccaccucgacgg

SEQ ID NO: 3201179 - RNA, 13 nt, Mycobacterium bovis subsp bovis AF2122/97
gacagccacgcac

SEQ ID NO: 3201180 - RNA, 19 nt, Mycobacterium bovis subsp bovis AF2122/97
gacagccaguguugcagug

SEQ ID NO: 3201181 - RNA, 17 nt, Mycobacterium bovis subsp bovis AF2122/97
gacagccccaucaccac

SEQ ID NO: 3201182 - RNA, 19 nt, Mycobacterium bovis subsp bovis AF2122/97
gacagccccaucaccaccg

SEQ ID NO: 3201183 - RNA, 20 nt, Mycobacterium bovis subsp bovis AF2122/97
gacagccccaucaccaccgg

SEQ ID NO: 3201184 - RNA, 23 nt, Mycobacterium bovis subsp bovis AF2122/97
gacagccccaucaccaccggcac

SEQ ID NO: 3201185 - RNA, 14 nt, Mycobacterium bovis subsp bovis AF2122/97
gacagccccgccgc

SEQ ID NO: 3201186 - RNA, 15 nt, Mycobacterium bovis subsp bovis AF2122/97
gacagccccgccgcc

SEQ ID NO: 3201187 - RNA, 19 nt, Mycobacterium bovis subsp bovis AF2122/97
gacagccccgccgcccucc

SEQ ID NO: 3201188 - RNA, 15 nt, Mycobacterium bovis subsp bovis AF2122/97
gacagccccgcggcc

SEQ ID NO: 3201189 - RNA, 16 nt, Mycobacterium bovis subsp bovis AF2122/97
gacagccccgcggcca

SEQ ID NO: 3201190 - RNA, 17 nt, Mycobacterium bovis subsp bovis AF2122/97
gacagccccgcggccag

SEQ ID NO: 3201191 - RNA, 18 nt, Mycobacterium bovis subsp bovis AF2122/97
gacagcccgaacgaggcg

SEQ ID NO: 3201192 - RNA, 14 nt, Mycobacterium bovis subsp bovis AF2122/97
gacagcccgccggc

SEQ ID NO: 3201193 - RNA, 18 nt, Mycobacterium bovis subsp bovis AF2122/97
gacagcccgccggcgugu

SEQ ID NO: 3201194 - RNA, 14 nt, Mycobacterium bovis subsp bovis AF2122/97
gacagccguggcgc

SEQ ID NO: 3201195 - RNA, 18 nt, Mycobacterium bovis subsp bovis AF2122/97
gacagccugcgccacaau

SEQ ID NO: 3201196 - RNA, 17 nt, Mycobacterium bovis subsp bovis AF2122/97
gacagcgaaggcgccga

SEQ ID NO: 3201197 - RNA, 19 nt, Mycobacterium bovis subsp bovis AF2122/97
gacagcgaaggcgccgaac

SEQ ID NO: 3201198 - RNA, 20 nt, Mycobacterium bovis subsp bovis AF2122/97
gacagcgaaggcgccgaaca

SEQ ID NO: 3201199 - RNA, 21 nt, Mycobacterium bovis subsp bovis AF2122/97
gacagcgacggucccggcacg

SEQ ID NO: 3201200 - RNA, 20 nt, Mycobacterium bovis subsp bovis AF2122/97
gacagcgccaugcccucggc

SEQ ID NO: 3201201 - RNA, 12 nt, Mycobacterium bovis subsp bovis AF2122/97
gacagcgcggcg

SEQ ID NO: 3201202 - RNA, 13 nt, Mycobacterium bovis subsp bovis AF2122/97
gacagcgcugggc

SEQ ID NO: 3201203 - RNA, 14 nt, Mycobacterium bovis subsp bovis AF2122/97
gacagcgcugggcc

SEQ ID NO: 3201204 - RNA, 13 nt, Mycobacterium bovis subsp bovis AF2122/97
gacagcggcaccg

SEQ ID NO: 3201205 - RNA, 14 nt, Mycobacterium bovis subsp bovis AF2122/97
gacagcggcaccgg

SEQ ID NO: 3201206 - RNA, 17 nt, Mycobacterium bovis subsp bovis AF2122/97
gacagcggcaccggggu

SEQ ID NO: 3201207 - RNA, 22 nt, Mycobacterium bovis subsp bovis AF2122/97
gacagcgucucgccgggaaaca

SEQ ID NO: 3201208 - RNA, 20 nt, Mycobacterium bovis subsp bovis AF2122/97
gacagcuaucccaggggcac

SEQ ID NO: 3201209 - RNA, 22 nt, Mycobacterium bovis subsp bovis AF2122/97
gacagcuaucccaggggcaccg

SEQ ID NO: 3201210 - RNA, 18 nt, Mycobacterium bovis subsp bovis AF2122/97
gacagcugcacacagagg

SEQ ID NO: 3201211 - RNA, 23 nt, Mycobacterium bovis subsp bovis AF2122/97
gacagcugcacacagaggucggu

SEQ ID NO: 3201212 - RNA, 17 nt, Mycobacterium bovis subsp bovis AF2122/97
gacagcugguugugcug

SEQ ID NO: 3201213 - RNA, 21 nt, Mycobacterium bovis subsp bovis AF2122/97
gacagcugguugugcugggga

SEQ ID NO: 3201214 - RNA, 13 nt, Mycobacterium bovis subsp bovis AF2122/97
gacagcuuggccg

SEQ ID NO: 3201215 - RNA, 17 nt, Mycobacterium bovis subsp bovis AF2122/97
gacagcuuucuuggcgg

SEQ ID NO: 3201216 - RNA, 19 nt, Mycobacterium bovis subsp bovis AF2122/97
gacagcuuucuuggcgggc

SEQ ID NO: 3201217 - RNA, 16 nt, Mycobacterium bovis subsp bovis AF2122/97
gacaggacgucggcga

SEQ ID NO: 3201218 - RNA, 19 nt, Mycobacterium bovis subsp bovis AF2122/97
gacaggccaccgcagacgc

SEQ ID NO: 3201219 - RNA, 17 nt, Mycobacterium bovis subsp bovis AF2122/97
gacaggcccgguggcgg

SEQ ID NO: 3201220 - RNA, 20 nt, Mycobacterium bovis subsp bovis AF2122/97
gacaggcccgguggcggcuc

SEQ ID NO: 3201221 - RNA, 13 nt, Mycobacterium bovis subsp bovis AF2122/97
gacaggccgagca

SEQ ID NO: 3201222 - RNA, 17 nt, Mycobacterium bovis subsp bovis AF2122/97
gacaggccggccaccag

SEQ ID NO: 3201223 - RNA, 20 nt, Mycobacterium bovis subsp bovis AF2122/97
gacaggccggccaccagucc

SEQ ID NO: 3201224 - RNA, 15 nt, Mycobacterium bovis subsp bovis AF2122/97
gacaggcgcccacaa

SEQ ID NO: 3201225 - RNA, 12 nt, Mycobacterium bovis subsp bovis AF2122/97
gacaggcggcgg

SEQ ID NO: 3201226 - RNA, 14 nt, Mycobacterium bovis subsp bovis AF2122/97
gacaggcggcggcc

SEQ ID NO: 3201227 - RNA, 15 nt, Mycobacterium bovis subsp bovis AF2122/97
gacaggcggcggccu

SEQ ID NO: 3201228 - RNA, 21 nt, Mycobacterium bovis subsp bovis AF2122/97
gacaggcuugacugcacacca

SEQ ID NO: 3201229 - RNA, 22 nt, Mycobacterium bovis subsp bovis AF2122/97
gacaggcuugacugcacaccac

SEQ ID NO: 3201230 - RNA, 23 nt, Mycobacterium bovis subsp bovis AF2122/97
gacaggcuugacugcacaccacc

SEQ ID NO: 3201231 - RNA, 13 nt, Mycobacterium bovis subsp bovis AF2122/97
gacagggccgcuc

SEQ ID NO: 3201232 - RNA, 16 nt, Mycobacterium bovis subsp bovis AF2122/97
gacagggccgcucgcc

SEQ ID NO: 3201233 - RNA, 13 nt, Mycobacterium bovis subsp bovis AF2122/97
gacagggcggcga

SEQ ID NO: 3201234 - RNA, 21 nt, Mycobacterium bovis subsp bovis AF2122/97
gacagggugcgcuugcggccg

SEQ ID NO: 3201235 - RNA, 14 nt, Mycobacterium bovis subsp bovis AF2122/97
gacagggugggggc

SEQ ID NO: 3201236 - RNA, 17 nt, Mycobacterium bovis subsp bovis AF2122/97
gacagggugggggcauc

SEQ ID NO: 3201237 - RNA, 20 nt, Mycobacterium bovis subsp bovis AF2122/97
gacagguagucgccggucag

SEQ ID NO: 3201238 - RNA, 23 nt, Mycobacterium bovis subsp bovis AF2122/97
gacaggucgcccaacaccgcgcc

SEQ ID NO: 3201239 - RNA, 12 nt, Mycobacterium bovis subsp bovis AF2122/97
gacaggucggca

SEQ ID NO: 3201240 - RNA, 15 nt, Mycobacterium bovis subsp bovis AF2122/97
gacaggucgggcagc

SEQ ID NO: 3201241 - RNA, 22 nt, Mycobacterium bovis subsp bovis AF2122/97
gacaggugccagaccagggcag

SEQ ID NO: 3201242 - RNA, 18 nt, Mycobacterium bovis subsp bovis AF2122/97
gacaggugcuaggaggag

SEQ ID NO: 3201243 - RNA, 13 nt, Mycobacterium bovis subsp bovis AF2122/97
gacagguguugga

SEQ ID NO: 3201244 - RNA, 16 nt, Mycobacterium bovis subsp bovis AF2122/97
gacagucaacagggcc

SEQ ID NO: 3201245 - RNA, 21 nt, Mycobacterium bovis subsp bovis AF2122/97
gacagucaacagggccaggac

SEQ ID NO: 3201246 - RNA, 15 nt, Mycobacterium bovis subsp bovis AF2122/97
gacaguccgcgccgg

SEQ ID NO: 3201247 - RNA, 16 nt, Mycobacterium bovis subsp bovis AF2122/97
gacaguccgcgccggc

SEQ ID NO: 3201248 - RNA, 14 nt, Mycobacterium bovis subsp bovis AF2122/97
gacagugcugccuu

SEQ ID NO: 3201249 - RNA, 23 nt, Mycobacterium bovis subsp bovis AF2122/97
gacagugcugccuugggaccgcg

SEQ ID NO: 3201250 - RNA, 21 nt, Mycobacterium bovis subsp bovis AF2122/97
gacagugugaagaccaccgcc

SEQ ID NO: 3201251 - RNA, 17 nt, Mycobacterium bovis subsp bovis AF2122/97
gacaguuacgcuggcac

SEQ ID NO: 3201252 - RNA, 14 nt, Mycobacterium bovis subsp bovis AF2122/97
gacaguucccggcc

SEQ ID NO: 3201253 - RNA, 20 nt, Mycobacterium bovis subsp bovis AF2122/97
gacaguucgcgccguggcgu

SEQ ID NO: 3201254 - RNA, 16 nt, Mycobacterium bovis subsp bovis AF2122/97
gacaguugcgccagcg

SEQ ID NO: 3201255 - RNA, 19 nt, Mycobacterium bovis subsp bovis AF2122/97
gacauacagcgggcgcugu

SEQ ID NO: 3201256 - RNA, 18 nt, Mycobacterium bovis subsp bovis AF2122/97
gacauacccgaucaaugc

SEQ ID NO: 3201257 - RNA, 17 nt, Mycobacterium bovis subsp bovis AF2122/97
gacauaguuggcgcccg

SEQ ID NO: 3201258 - RNA, 13 nt, Mycobacterium bovis subsp bovis AF2122/97
gacaucaccaccg

SEQ ID NO: 3201259 - RNA, 18 nt, Mycobacterium bovis subsp bovis AF2122/97
gacaucaccaccgaccug

SEQ ID NO: 3201260 - RNA, 12 nt, Mycobacterium bovis subsp bovis AF2122/97
gacaucaccgaa

SEQ ID NO: 3201261 - RNA, 13 nt, Mycobacterium bovis subsp bovis AF2122/97
gacaucaccgaac

SEQ ID NO: 3201262 - RNA, 18 nt, Mycobacterium bovis subsp bovis AF2122/97
gacaucaccgaacggcga

SEQ ID NO: 3201263 - RNA, 20 nt, Mycobacterium bovis subsp bovis AF2122/97
gacaucacgaaggcguucgc

SEQ ID NO: 3201264 - RNA, 22 nt, Mycobacterium bovis subsp bovis AF2122/97
gacauccacaccgcggcggcgc

SEQ ID NO: 3201265 - RNA, 19 nt, Mycobacterium bovis subsp bovis AF2122/97
gacauccagaucggauugc

SEQ ID NO: 3201266 - RNA, 21 nt, Mycobacterium bovis subsp bovis AF2122/97
gacaucccugacgaaggucuc

SEQ ID NO: 3201267 - RNA, 19 nt, Mycobacterium bovis subsp bovis AF2122/97
gacauccgcuuacgggugu

SEQ ID NO: 3201268 - RNA, 20 nt, Mycobacterium bovis subsp bovis AF2122/97
gacauccgcuuacggguguc

SEQ ID NO: 3201269 - RNA, 14 nt, Mycobacterium bovis subsp bovis AF2122/97
gacauccggcgccg

SEQ ID NO: 3201270 - RNA, 18 nt, Mycobacterium bovis subsp bovis AF2122/97
gacauccgggccgagcgc

SEQ ID NO: 3201271 - RNA, 17 nt, Mycobacterium bovis subsp bovis AF2122/97
gacauccuugacgcggc

SEQ ID NO: 3201272 - RNA, 19 nt, Mycobacterium bovis subsp bovis AF2122/97
gacauccuugacgcggcca

SEQ ID NO: 3201273 - RNA, 20 nt, Mycobacterium bovis subsp bovis AF2122/97
gacauccuugacgcggccac

SEQ ID NO: 3201274 - RNA, 13 nt, Mycobacterium bovis subsp bovis AF2122/97
gacaucggagauc

SEQ ID NO: 3201275 - RNA, 22 nt, Mycobacterium bovis subsp bovis AF2122/97
gacaucggcccgaucaccaucc

SEQ ID NO: 3201276 - RNA, 14 nt, Mycobacterium bovis subsp bovis AF2122/97
gacaucggccggcg

SEQ ID NO: 3201277 - RNA, 13 nt, Mycobacterium bovis subsp bovis AF2122/97
gacaucggcggcc

SEQ ID NO: 3201278 - RNA, 15 nt, Mycobacterium bovis subsp bovis AF2122/97
gacaucgggccgccg

SEQ ID NO: 3201279 - RNA, 16 nt, Mycobacterium bovis subsp bovis AF2122/97
gacaucgggccgccga

SEQ ID NO: 3201280 - RNA, 18 nt, Mycobacterium bovis subsp bovis AF2122/97
gacaucgggccgccgagc

SEQ ID NO: 3201281 - RNA, 15 nt, Mycobacterium bovis subsp bovis AF2122/97
gacaucgggcggcac

SEQ ID NO: 3201282 - RNA, 17 nt, Mycobacterium bovis subsp bovis AF2122/97
gacaucgggcggcaccg

SEQ ID NO: 3201283 - RNA, 21 nt, Mycobacterium bovis subsp bovis AF2122/97
gacaucggucagcauggggua

SEQ ID NO: 3201284 - RNA, 19 nt, Mycobacterium bovis subsp bovis AF2122/97
gacaucggucagcgggcac

SEQ ID NO: 3201285 - RNA, 21 nt, Mycobacterium bovis subsp bovis AF2122/97
gacaucgguggcggccuccga

SEQ ID NO: 3201286 - RNA, 17 nt, Mycobacterium bovis subsp bovis AF2122/97
gacaucguaggccggca

SEQ ID NO: 3201287 - RNA, 14 nt, Mycobacterium bovis subsp bovis AF2122/97
gacaucgucgacga

SEQ ID NO: 3201288 - RNA, 15 nt, Mycobacterium bovis subsp bovis AF2122/97
gacaucgucgccagg

SEQ ID NO: 3201289 - RNA, 16 nt, Mycobacterium bovis subsp bovis AF2122/97
gacaugacagccccgc

SEQ ID NO: 3201290 - RNA, 14 nt, Mycobacterium bovis subsp bovis AF2122/97
gacaugagcgccac

SEQ ID NO: 3201291 - RNA, 19 nt, Mycobacterium bovis subsp bovis AF2122/97
gacaugagcgccacgccga

SEQ ID NO: 3201292 - RNA, 21 nt, Mycobacterium bovis subsp bovis AF2122/97
gacaugagcgccacgccgagg

SEQ ID NO: 3201293 - RNA, 19 nt, Mycobacterium bovis subsp bovis AF2122/97
gacaugcaggaauggguga

SEQ ID NO: 3201294 - RNA, 21 nt, Mycobacterium bovis subsp bovis AF2122/97
gacaugcaggugaugagugcg

SEQ ID NO: 3201295 - RNA, 20 nt, Mycobacterium bovis subsp bovis AF2122/97
gacaugccauaugggggaaa

SEQ ID NO: 3201296 - RNA, 13 nt, Mycobacterium bovis subsp bovis AF2122/97
gacaugcgcacca

SEQ ID NO: 3201297 - RNA, 18 nt, Mycobacterium bovis subsp bovis AF2122/97
gacaugcgcaccaugggu

SEQ ID NO: 3201298 - RNA, 16 nt, Mycobacterium bovis subsp bovis AF2122/97
gacaugguccgaccag

SEQ ID NO: 3201299 - RNA, 17 nt, Mycobacterium bovis subsp bovis AF2122/97
gacaugucaggccguca

SEQ ID NO: 3201300 - RNA, 15 nt, Mycobacterium bovis subsp bovis AF2122/97
gacaugucgcugccg

SEQ ID NO: 3201301 - RNA, 18 nt, Mycobacterium bovis subsp bovis AF2122/97
gacauugacgaggcgagc

SEQ ID NO: 3201302 - RNA, 17 nt, Mycobacterium bovis subsp bovis AF2122/97
gacauugcgagcgccuu

SEQ ID NO: 3201303 - RNA, 17 nt, Mycobacterium bovis subsp bovis AF2122/97
gacauuggagacgacga

SEQ ID NO: 3201304 - RNA, 15 nt, Mycobacterium bovis subsp bovis AF2122/97
gacauuuccaccacg

SEQ ID NO: 3201305 - RNA, 17 nt, Mycobacterium bovis subsp bovis AF2122/97
gaccaacacgucgagca

SEQ ID NO: 3201306 - RNA, 22 nt, Mycobacterium bovis subsp bovis AF2122/97
gaccaacacgucgagcagccgc

SEQ ID NO: 3201307 - RNA, 21 nt, Mycobacterium bovis subsp bovis AF2122/97
gaccaacauguugucgucgcc

SEQ ID NO: 3201308 - RNA, 23 nt, Mycobacterium bovis subsp bovis AF2122/97
gaccaacauguugucgucgccgc

SEQ ID NO: 3201309 - RNA, 16 nt, Mycobacterium bovis subsp bovis AF2122/97
gaccaacccucgccgg

SEQ ID NO: 3201310 - RNA, 14 nt, Mycobacterium bovis subsp bovis AF2122/97
gaccaacgccaacg

SEQ ID NO: 3201311 - RNA, 16 nt, Mycobacterium bovis subsp bovis AF2122/97
gaccaacggugcucgu

SEQ ID NO: 3201312 - RNA, 23 nt, Mycobacterium bovis subsp bovis AF2122/97
gaccaacgucgacuucagcggcc

SEQ ID NO: 3201313 - RNA, 16 nt, Mycobacterium bovis subsp bovis AF2122/97
gaccaacgucgcuccg

SEQ ID NO: 3201314 - RNA, 15 nt, Mycobacterium bovis subsp bovis AF2122/97
gaccaagguguccag

SEQ ID NO: 3201315 - RNA, 17 nt, Mycobacterium bovis subsp bovis AF2122/97
gaccaagguguccagca

SEQ ID NO: 3201316 - RNA, 22 nt, Mycobacterium bovis subsp bovis AF2122/97
gaccaagucaugcccacgcugc

SEQ ID NO: 3201317 - RNA, 22 nt, Mycobacterium bovis subsp bovis AF2122/97
gaccaaugcgucgaugcgcugc

SEQ ID NO: 3201318 - RNA, 17 nt, Mycobacterium bovis subsp bovis AF2122/97
gaccaaugcguugacgu

SEQ ID NO: 3201319 - RNA, 23 nt, Mycobacterium bovis subsp bovis AF2122/97
gaccaaugucagugccccgcccg

SEQ ID NO: 3201320 - RNA, 21 nt, Mycobacterium bovis subsp bovis AF2122/97
gaccaauucgaccgcgcggau

SEQ ID NO: 3201321 - RNA, 16 nt, Mycobacterium bovis subsp bovis AF2122/97
gaccaauucgcaaucg

SEQ ID NO: 3201322 - RNA, 17 nt, Mycobacterium bovis subsp bovis AF2122/97
gaccaauuggucgaguc

SEQ ID NO: 3201323 - RNA, 20 nt, Mycobacterium bovis subsp bovis AF2122/97
gaccacaaccgugagcacca

SEQ ID NO: 3201324 - RNA, 22 nt, Mycobacterium bovis subsp bovis AF2122/97
gaccacaaccgugagcaccagc

SEQ ID NO: 3201325 - RNA, 23 nt, Mycobacterium bovis subsp bovis AF2122/97
gaccacaaccgugagcaccagca

SEQ ID NO: 3201326 - RNA, 15 nt, Mycobacterium bovis subsp bovis AF2122/97
gaccacaacgccucg

SEQ ID NO: 3201327 - RNA, 17 nt, Mycobacterium bovis subsp bovis AF2122/97
gaccacaccacgauggc

SEQ ID NO: 3201328 - RNA, 15 nt, Mycobacterium bovis subsp bovis AF2122/97
gaccacaccgucacc

SEQ ID NO: 3201329 - RNA, 14 nt, Mycobacterium bovis subsp bovis AF2122/97
gaccacagaaccgg

SEQ ID NO: 3201330 - RNA, 17 nt, Mycobacterium bovis subsp bovis AF2122/97
gaccacagccgcgccga

SEQ ID NO: 3201331 - RNA, 22 nt, Mycobacterium bovis subsp bovis AF2122/97
gaccacauuccgcagucccgaa

SEQ ID NO: 3201332 - RNA, 11 nt, Mycobacterium bovis subsp bovis AF2122/97
gaccaccacca

SEQ ID NO: 3201333 - RNA, 14 nt, Mycobacterium bovis subsp bovis AF2122/97
gaccaccaccaacg

SEQ ID NO: 3201334 - RNA, 13 nt, Mycobacterium bovis subsp bovis AF2122/97
gaccaccaccgag

SEQ ID NO: 3201335 - RNA, 18 nt, Mycobacterium bovis subsp bovis AF2122/97
gaccaccaccgccgccga

SEQ ID NO: 3201336 - RNA, 20 nt, Mycobacterium bovis subsp bovis AF2122/97
gaccaccacuaggucgccgg

SEQ ID NO: 3201337 - RNA, 21 nt, Mycobacterium bovis subsp bovis AF2122/97
gaccaccacuaggucgccggc

SEQ ID NO: 3201338 - RNA, 22 nt, Mycobacterium bovis subsp bovis AF2122/97
gaccaccagcgcuccagcaccc

SEQ ID NO: 3201339 - RNA, 13 nt, Mycobacterium bovis subsp bovis AF2122/97
gaccaccagugag

SEQ ID NO: 3201340 - RNA, 14 nt, Mycobacterium bovis subsp bovis AF2122/97
gaccaccccggcca

SEQ ID NO: 3201341 - RNA, 16 nt, Mycobacterium bovis subsp bovis AF2122/97
gaccacccggcgcgaa

SEQ ID NO: 3201342 - RNA, 21 nt, Mycobacterium bovis subsp bovis AF2122/97
gaccacccgguccugcucgca

SEQ ID NO: 3201343 - RNA, 24 nt, Mycobacterium bovis subsp bovis AF2122/97
gaccaccgaaauacccagcgcagc

SEQ ID NO: 3201344 - RNA, 21 nt, Mycobacterium bovis subsp bovis AF2122/97
gaccaccgccgaagcugcggg

SEQ ID NO: 3201345 - RNA, 22 nt, Mycobacterium bovis subsp bovis AF2122/97
gaccaccgccgacaggccggcc

SEQ ID NO: 3201346 - RNA, 12 nt, Mycobacterium bovis subsp bovis AF2122/97
gaccaccgccgg

SEQ ID NO: 3201347 - RNA, 15 nt, Mycobacterium bovis subsp bovis AF2122/97
gaccaccgccggccc

SEQ ID NO: 3201348 - RNA, 20 nt, Mycobacterium bovis subsp bovis AF2122/97
gaccaccgcgucgggccgca

SEQ ID NO: 3201349 - RNA, 14 nt, Mycobacterium bovis subsp bovis AF2122/97
gaccaccgcucgcc

SEQ ID NO: 3201350 - RNA, 22 nt, Mycobacterium bovis subsp bovis AF2122/97
gaccaccggaauuugcgucgug

SEQ ID NO: 3201351 - RNA, 20 nt, Mycobacterium bovis subsp bovis AF2122/97
gaccaccggaucgccgucgg

SEQ ID NO: 3201352 - RNA, 21 nt, Mycobacterium bovis subsp bovis AF2122/97
gaccaccggaucgccgucggc

SEQ ID NO: 3201353 - RNA, 12 nt, Mycobacterium bovis subsp bovis AF2122/97
gaccaccgggua

SEQ ID NO: 3201354 - RNA, 18 nt, Mycobacterium bovis subsp bovis AF2122/97
gaccaccggguagccggc

SEQ ID NO: 3201355 - RNA, 16 nt, Mycobacterium bovis subsp bovis AF2122/97
gaccaccgugaccgag

SEQ ID NO: 3201356 - RNA, 20 nt, Mycobacterium bovis subsp bovis AF2122/97
gaccaccucagcugcggacu

SEQ ID NO: 3201357 - RNA, 14 nt, Mycobacterium bovis subsp bovis AF2122/97
gaccaccuggucgc

SEQ ID NO: 3201358 - RNA, 12 nt, Mycobacterium bovis subsp bovis AF2122/97
gaccaccugguu

SEQ ID NO: 3201359 - RNA, 20 nt, Mycobacterium bovis subsp bovis AF2122/97
gaccaccuucugacgcggcc

SEQ ID NO: 3201360 - RNA, 22 nt, Mycobacterium bovis subsp bovis AF2122/97
gaccaccuucugacgcggccgg

SEQ ID NO: 3201361 - RNA, 22 nt, Mycobacterium bovis subsp bovis AF2122/97
gaccacgaacgcgcgcagccgg

SEQ ID NO: 3201362 - RNA, 23 nt, Mycobacterium bovis subsp bovis AF2122/97
gaccacgaacgcgcgcagccggg

SEQ ID NO: 3201363 - RNA, 17 nt, Mycobacterium bovis subsp bovis AF2122/97
gaccacgaauggggcca

SEQ ID NO: 3201364 - RNA, 15 nt, Mycobacterium bovis subsp bovis AF2122/97
gaccacgaccgucuc

SEQ ID NO: 3201365 - RNA, 23 nt, Mycobacterium bovis subsp bovis AF2122/97
gaccacgacguucgacgacagca

SEQ ID NO: 3201366 - RNA, 21 nt, Mycobacterium bovis subsp bovis AF2122/97
gaccacgcaagggaauccgaa

SEQ ID NO: 3201367 - RNA, 12 nt, Mycobacterium bovis subsp bovis AF2122/97
gaccacgcaccg

SEQ ID NO: 3201368 - RNA, 15 nt, Mycobacterium bovis subsp bovis AF2122/97
gaccacgcaccgccc

SEQ ID NO: 3201369 - RNA, 12 nt, Mycobacterium bovis subsp bovis AF2122/97
gaccacgccgac

SEQ ID NO: 3201370 - RNA, 13 nt, Mycobacterium bovis subsp bovis AF2122/97
gaccacgccgccg

SEQ ID NO: 3201371 - RNA, 14 nt, Mycobacterium bovis subsp bovis AF2122/97
gaccacgccgccgg

SEQ ID NO: 3201372 - RNA, 19 nt, Mycobacterium bovis subsp bovis AF2122/97
gaccacgcgagggcauccg

SEQ ID NO: 3201373 - RNA, 13 nt, Mycobacterium bovis subsp bovis AF2122/97
gaccacggcaccg

SEQ ID NO: 3201374 - RNA, 13 nt, Mycobacterium bovis subsp bovis AF2122/97
gaccacggcguug

SEQ ID NO: 3201375 - RNA, 23 nt, Mycobacterium bovis subsp bovis AF2122/97
gaccacgggaugcaugucuugug

SEQ ID NO: 3201376 - RNA, 23 nt, Mycobacterium bovis subsp bovis AF2122/97
gaccacgguagacaagucggcgc

SEQ ID NO: 3201377 - RNA, 18 nt, Mycobacterium bovis subsp bovis AF2122/97
gaccacggucugccacga

SEQ ID NO: 3201378 - RNA, 15 nt, Mycobacterium bovis subsp bovis AF2122/97
gaccacgucgagguc

SEQ ID NO: 3201379 - RNA, 16 nt, Mycobacterium bovis subsp bovis AF2122/97
gaccacuccacgcagc

SEQ ID NO: 3201380 - RNA, 19 nt, Mycobacterium bovis subsp bovis AF2122/97
gaccacuccacgcagcccg

SEQ ID NO: 3201381 - RNA, 21 nt, Mycobacterium bovis subsp bovis AF2122/97
gaccacucgccgcgacugcac

SEQ ID NO: 3201382 - RNA, 16 nt, Mycobacterium bovis subsp bovis AF2122/97
gaccacucgccggcgg

SEQ ID NO: 3201383 - RNA, 21 nt, Mycobacterium bovis subsp bovis AF2122/97
gaccacucgccggcggacgcc

SEQ ID NO: 3201384 - RNA, 22 nt, Mycobacterium bovis subsp bovis AF2122/97
gaccacucgccggcggacgccc

SEQ ID NO: 3201385 - RNA, 15 nt, Mycobacterium bovis subsp bovis AF2122/97
gaccacugaucggca

SEQ ID NO: 3201386 - RNA, 16 nt, Mycobacterium bovis subsp bovis AF2122/97
gaccacugaucggcau

SEQ ID NO: 3201387 - RNA, 22 nt, Mycobacterium bovis subsp bovis AF2122/97
gaccacuguuggugccgccacc

SEQ ID NO: 3201388 - RNA, 23 nt, Mycobacterium bovis subsp bovis AF2122/97
gaccacuguuggugccgccacca

SEQ ID NO: 3201389 - RNA, 21 nt, Mycobacterium bovis subsp bovis AF2122/97
gaccacuuagcuggcgggggu

SEQ ID NO: 3201390 - RNA, 16 nt, Mycobacterium bovis subsp bovis AF2122/97
gaccacuucgauggcg

SEQ ID NO: 3201391 - RNA, 17 nt, Mycobacterium bovis subsp bovis AF2122/97
gaccacuucgauggcgc

SEQ ID NO: 3201392 - RNA, 19 nt, Mycobacterium bovis subsp bovis AF2122/97
gaccacuugcagcacaacg

SEQ ID NO: 3201393 - RNA, 20 nt, Mycobacterium bovis subsp bovis AF2122/97
gaccacuugcagcacaacgu

SEQ ID NO: 3201394 - RNA, 16 nt, Mycobacterium bovis subsp bovis AF2122/97
gaccagaaccuggagc

SEQ ID NO: 3201395 - RNA, 16 nt, Mycobacterium bovis subsp bovis AF2122/97
gaccagaacucgugau

SEQ ID NO: 3201396 - RNA, 16 nt, Mycobacterium bovis subsp bovis AF2122/97
gaccagaaucucgccg

SEQ ID NO: 3201397 - RNA, 17 nt, Mycobacterium bovis subsp bovis AF2122/97
gaccagaaucucgccgg

SEQ ID NO: 3201398 - RNA, 19 nt, Mycobacterium bovis subsp bovis AF2122/97
gaccagagccaacgaugau

SEQ ID NO: 3201399 - RNA, 15 nt, Mycobacterium bovis subsp bovis AF2122/97
gaccagagccgcgag

SEQ ID NO: 3201400 - RNA, 13 nt, Mycobacterium bovis subsp bovis AF2122/97
gaccagagcucga

SEQ ID NO: 3201401 - RNA, 14 nt, Mycobacterium bovis subsp bovis AF2122/97
gaccagagcuucgc

SEQ ID NO: 3201402 - RNA, 18 nt, Mycobacterium bovis subsp bovis AF2122/97
gaccagagcuucgccgcg

SEQ ID NO: 3201403 - RNA, 19 nt, Mycobacterium bovis subsp bovis AF2122/97
gaccagagcuucgccgcgc

SEQ ID NO: 3201404 - RNA, 20 nt, Mycobacterium bovis subsp bovis AF2122/97
gaccagaggcgugucgacuc

SEQ ID NO: 3201405 - RNA, 14 nt, Mycobacterium bovis subsp bovis AF2122/97
gaccagcaaccacc

SEQ ID NO: 3201406 - RNA, 21 nt, Mycobacterium bovis subsp bovis AF2122/97
gaccagcaaccaccccagggc

SEQ ID NO: 3201407 - RNA, 23 nt, Mycobacterium bovis subsp bovis AF2122/97
gaccagcaaccaccccagggcaa

SEQ ID NO: 3201408 - RNA, 12 nt, Mycobacterium bovis subsp bovis AF2122/97
gaccagcaacga

SEQ ID NO: 3201409 - RNA, 14 nt, Mycobacterium bovis subsp bovis AF2122/97
gaccagcacaccgg

SEQ ID NO: 3201410 - RNA, 15 nt, Mycobacterium bovis subsp bovis AF2122/97
gaccagcaccagaac

SEQ ID NO: 3201411 - RNA, 16 nt, Mycobacterium bovis subsp bovis AF2122/97
gaccagcacccgcucg

SEQ ID NO: 3201412 - RNA, 13 nt, Mycobacterium bovis subsp bovis AF2122/97
gaccagcaccgcc

SEQ ID NO: 3201413 - RNA, 20 nt, Mycobacterium bovis subsp bovis AF2122/97
gaccagcaccgccgcgccgg

SEQ ID NO: 3201414 - RNA, 14 nt, Mycobacterium bovis subsp bovis AF2122/97
gaccagcagaucca

SEQ ID NO: 3201415 - RNA, 21 nt, Mycobacterium bovis subsp bovis AF2122/97
gaccagcaggcccuggccacc

SEQ ID NO: 3201416 - RNA, 22 nt, Mycobacterium bovis subsp bovis AF2122/97
gaccagcaggcccuggccaccc

SEQ ID NO: 3201417 - RNA, 14 nt, Mycobacterium bovis subsp bovis AF2122/97
gaccagcaggccgg

SEQ ID NO: 3201418 - RNA, 16 nt, Mycobacterium bovis subsp bovis AF2122/97
gaccagcaggccgggc

SEQ ID NO: 3201419 - RNA, 12 nt, Mycobacterium bovis subsp bovis AF2122/97
gaccagccccgc

SEQ ID NO: 3201420 - RNA, 14 nt, Mycobacterium bovis subsp bovis AF2122/97
gaccagccgagcga

SEQ ID NO: 3201421 - RNA, 19 nt, Mycobacterium bovis subsp bovis AF2122/97
gaccagccgaucaucaccg

SEQ ID NO: 3201422 - RNA, 22 nt, Mycobacterium bovis subsp bovis AF2122/97
gaccagccgaucaucaccggca

SEQ ID NO: 3201423 - RNA, 20 nt, Mycobacterium bovis subsp bovis AF2122/97
gaccagcgaaaauucggucu

SEQ ID NO: 3201424 - RNA, 19 nt, Mycobacterium bovis subsp bovis AF2122/97
gaccagcgccccggcgcgu

SEQ ID NO: 3201425 - RNA, 14 nt, Mycobacterium bovis subsp bovis AF2122/97
gaccagcgcuagcg

SEQ ID NO: 3201426 - RNA, 11 nt, Mycobacterium bovis subsp bovis AF2122/97
gaccagcggcg

SEQ ID NO: 3201427 - RNA, 14 nt, Mycobacterium bovis subsp bovis AF2122/97
gaccagcggcggcg

SEQ ID NO: 3201428 - RNA, 13 nt, Mycobacterium bovis subsp bovis AF2122/97
gaccagcugccgg

SEQ ID NO: 3201429 - RNA, 19 nt, Mycobacterium bovis subsp bovis AF2122/97
gaccagcuggccguacucg

SEQ ID NO: 3201430 - RNA, 15 nt, Mycobacterium bovis subsp bovis AF2122/97
gaccagcuucggcug

SEQ ID NO: 3201431 - RNA, 16 nt, Mycobacterium bovis subsp bovis AF2122/97
gaccagcuucggcugg

SEQ ID NO: 3201432 - RNA, 22 nt, Mycobacterium bovis subsp bovis AF2122/97
gaccaggaaugucuccaguagc

SEQ ID NO: 3201433 - RNA, 14 nt, Mycobacterium bovis subsp bovis AF2122/97
gaccaggccaacgg

SEQ ID NO: 3201434 - RNA, 20 nt, Mycobacterium bovis subsp bovis AF2122/97
gaccaggccacugccgacca

SEQ ID NO: 3201435 - RNA, 16 nt, Mycobacterium bovis subsp bovis AF2122/97
gaccaggccgcgcgca

SEQ ID NO: 3201436 - RNA, 19 nt, Mycobacterium bovis subsp bovis AF2122/97
gaccaggccgcgcgcaccg

SEQ ID NO: 3201437 - RNA, 15 nt, Mycobacterium bovis subsp bovis AF2122/97
gaccaggccggcccg

SEQ ID NO: 3201438 - RNA, 17 nt, Mycobacterium bovis subsp bovis AF2122/97
gaccaggccggcccgca

SEQ ID NO: 3201439 - RNA, 20 nt, Mycobacterium bovis subsp bovis AF2122/97
gaccaggccggcccgcaacg

SEQ ID NO: 3201440 - RNA, 14 nt, Mycobacterium bovis subsp bovis AF2122/97
gaccaggccgguga

SEQ ID NO: 3201441 - RNA, 12 nt, Mycobacterium bovis subsp bovis AF2122/97
gaccaggcgcgg

SEQ ID NO: 3201442 - RNA, 14 nt, Mycobacterium bovis subsp bovis AF2122/97
gaccaggcgcggcg

SEQ ID NO: 3201443 - RNA, 17 nt, Mycobacterium bovis subsp bovis AF2122/97
gaccaggcgcggcgaca

SEQ ID NO: 3201444 - RNA, 17 nt, Mycobacterium bovis subsp bovis AF2122/97
gaccaggcggcgcgggu

SEQ ID NO: 3201445 - RNA, 18 nt, Mycobacterium bovis subsp bovis AF2122/97
gaccaggcggcgcggguc

SEQ ID NO: 3201446 - RNA, 21 nt, Mycobacterium bovis subsp bovis AF2122/97
gaccaggcuccggccggccag

SEQ ID NO: 3201447 - RNA, 19 nt, Mycobacterium bovis subsp bovis AF2122/97
gaccagggcagcggccagg

SEQ ID NO: 3201448 - RNA, 23 nt, Mycobacterium bovis subsp bovis AF2122/97
gaccagggcagcggccagggcac

SEQ ID NO: 3201449 - RNA, 14 nt, Mycobacterium bovis subsp bovis AF2122/97
gaccagggccgccg

SEQ ID NO: 3201450 - RNA, 15 nt, Mycobacterium bovis subsp bovis AF2122/97
gaccagggccgccgc

SEQ ID NO: 3201451 - RNA, 16 nt, Mycobacterium bovis subsp bovis AF2122/97
gaccagguagaccagg

SEQ ID NO: 3201452 - RNA, 22 nt, Mycobacterium bovis subsp bovis AF2122/97
gaccagguagaccaggugcagc

SEQ ID NO: 3201453 - RNA, 14 nt, Mycobacterium bovis subsp bovis AF2122/97
gaccaggucugcgg

SEQ ID NO: 3201454 - RNA, 17 nt, Mycobacterium bovis subsp bovis AF2122/97
gaccaggugcagcacca

SEQ ID NO: 3201455 - RNA, 21 nt, Mycobacterium bovis subsp bovis AF2122/97
gaccagucucguggcgcuggg

SEQ ID NO: 3201456 - RNA, 18 nt, Mycobacterium bovis subsp bovis AF2122/97
gaccagugaccgcagucc

SEQ ID NO: 3201457 - RNA, 13 nt, Mycobacterium bovis subsp bovis AF2122/97
gaccagugcggug

SEQ ID NO: 3201458 - RNA, 19 nt, Mycobacterium bovis subsp bovis AF2122/97
gaccagugguggccgaacg

SEQ ID NO: 3201459 - RNA, 14 nt, Mycobacterium bovis subsp bovis AF2122/97
gaccaguucggugu

SEQ ID NO: 3201460 - RNA, 21 nt, Mycobacterium bovis subsp bovis AF2122/97
gaccauacuaauggcgccacc

SEQ ID NO: 3201461 - RNA, 22 nt, Mycobacterium bovis subsp bovis AF2122/97
gaccauagccugcgccgacccg

SEQ ID NO: 3201462 - RNA, 15 nt, Mycobacterium bovis subsp bovis AF2122/97
gaccauagucgccgu

SEQ ID NO: 3201463 - RNA, 19 nt, Mycobacterium bovis subsp bovis AF2122/97
gaccauagucgccgucgug

SEQ ID NO: 3201464 - RNA, 21 nt, Mycobacterium bovis subsp bovis AF2122/97
gaccauauuggcgcggccgaa

SEQ ID NO: 3201465 - RNA, 13 nt, Mycobacterium bovis subsp bovis AF2122/97
gaccaucacaccc

SEQ ID NO: 3201466 - RNA, 16 nt, Mycobacterium bovis subsp bovis AF2122/97
gaccaucacacccauc

SEQ ID NO: 3201467 - RNA, 18 nt, Mycobacterium bovis subsp bovis AF2122/97
gaccaucaccacggccgc

SEQ ID NO: 3201468 - RNA, 20 nt, Mycobacterium bovis subsp bovis AF2122/97
gaccaucaccacggccgccg

SEQ ID NO: 3201469 - RNA, 21 nt, Mycobacterium bovis subsp bovis AF2122/97
gaccaucaccacggccgccga

SEQ ID NO: 3201470 - RNA, 13 nt, Mycobacterium bovis subsp bovis AF2122/97
gaccaucccgccg

SEQ ID NO: 3201471 - RNA, 16 nt, Mycobacterium bovis subsp bovis AF2122/97
gaccaucccgccgauc

SEQ ID NO: 3201472 - RNA, 21 nt, Mycobacterium bovis subsp bovis AF2122/97
gaccauccgaguugucgccgg

SEQ ID NO: 3201473 - RNA, 15 nt, Mycobacterium bovis subsp bovis AF2122/97
gaccaucgccaggcc

SEQ ID NO: 3201474 - RNA, 20 nt, Mycobacterium bovis subsp bovis AF2122/97
gaccaucgcgacggcaagca

SEQ ID NO: 3201475 - RNA, 15 nt, Mycobacterium bovis subsp bovis AF2122/97
gaccaucuccggugu

SEQ ID NO: 3201476 - RNA, 15 nt, Mycobacterium bovis subsp bovis AF2122/97
gaccaucucgacguc

SEQ ID NO: 3201477 - RNA, 22 nt, Mycobacterium bovis subsp bovis AF2122/97
gaccaucugcuguggaucgaca

SEQ ID NO: 3201478 - RNA, 13 nt, Mycobacterium bovis subsp bovis AF2122/97
gaccaugaagaac

SEQ ID NO: 3201479 - RNA, 22 nt, Mycobacterium bovis subsp bovis AF2122/97
gaccaugagccggcgccgccgu

SEQ ID NO: 3201480 - RNA, 17 nt, Mycobacterium bovis subsp bovis AF2122/97
gaccaugaugaccggca

SEQ ID NO: 3201481 - RNA, 18 nt, Mycobacterium bovis subsp bovis AF2122/97
gaccaugaugaccggcaa

SEQ ID NO: 3201482 - RNA, 11 nt, Mycobacterium bovis subsp bovis AF2122/97
gaccaugccga

SEQ ID NO: 3201483 - RNA, 14 nt, Mycobacterium bovis subsp bovis AF2122/97
gaccaugcgaccgg

SEQ ID NO: 3201484 - RNA, 18 nt, Mycobacterium bovis subsp bovis AF2122/97
gaccaugcgaccggcaac

SEQ ID NO: 3201485 - RNA, 20 nt, Mycobacterium bovis subsp bovis AF2122/97
gaccaugcgaccggcaacgc

SEQ ID NO: 3201486 - RNA, 12 nt, Mycobacterium bovis subsp bovis AF2122/97
gacccaaagcac

SEQ ID NO: 3201487 - RNA, 15 nt, Mycobacterium bovis subsp bovis AF2122/97
gacccaacgaccacc

SEQ ID NO: 3201488 - RNA, 18 nt, Mycobacterium bovis subsp bovis AF2122/97
gacccaacgaccaccacc

SEQ ID NO: 3201489 - RNA, 19 nt, Mycobacterium bovis subsp bovis AF2122/97
gacccaacgaccaccacca

SEQ ID NO: 3201490 - RNA, 15 nt, Mycobacterium bovis subsp bovis AF2122/97
gacccaacgcagauc

SEQ ID NO: 3201491 - RNA, 17 nt, Mycobacterium bovis subsp bovis AF2122/97
gacccaagucgccgagg

SEQ ID NO: 3201492 - RNA, 20 nt, Mycobacterium bovis subsp bovis AF2122/97
gacccaauguggucacccgc

SEQ ID NO: 3201493 - RNA, 23 nt, Mycobacterium bovis subsp bovis AF2122/97
gacccacagucgccggccggccc

SEQ ID NO: 3201494 - RNA, 18 nt, Mycobacterium bovis subsp bovis AF2122/97
gacccacaucaggucggc

SEQ ID NO: 3201495 - RNA, 19 nt, Mycobacterium bovis subsp bovis AF2122/97
gacccacaucaggucggcg

SEQ ID NO: 3201496 - RNA, 17 nt, Mycobacterium bovis subsp bovis AF2122/97
gacccacauuccguagc

SEQ ID NO: 3201497 - RNA, 23 nt, Mycobacterium bovis subsp bovis AF2122/97
gacccacauuccguagccggcgg

SEQ ID NO: 3201498 - RNA, 20 nt, Mycobacterium bovis subsp bovis AF2122/97
gacccaccaauccacagauu

SEQ ID NO: 3201499 - RNA, 16 nt, Mycobacterium bovis subsp bovis AF2122/97
gacccaccaccgcaac

SEQ ID NO: 3201500 - RNA, 18 nt, Mycobacterium bovis subsp bovis AF2122/97
gacccaccgccccggcgg

SEQ ID NO: 3201501 - RNA, 20 nt, Mycobacterium bovis subsp bovis AF2122/97
gacccaccgccccggcggcg

SEQ ID NO: 3201502 - RNA, 22 nt, Mycobacterium bovis subsp bovis AF2122/97
gacccaccgccccggcggcggc

SEQ ID NO: 3201503 - RNA, 14 nt, Mycobacterium bovis subsp bovis AF2122/97
gacccaccgucacc

SEQ ID NO: 3201504 - RNA, 20 nt, Mycobacterium bovis subsp bovis AF2122/97
gacccaccgucacccccgau

SEQ ID NO: 3201505 - RNA, 18 nt, Mycobacterium bovis subsp bovis AF2122/97
gacccacgagagcgcugu

SEQ ID NO: 3201506 - RNA, 19 nt, Mycobacterium bovis subsp bovis AF2122/97
gacccacgauggcaaacgc

SEQ ID NO: 3201507 - RNA, 15 nt, Mycobacterium bovis subsp bovis AF2122/97
gacccagaccggcuc

SEQ ID NO: 3201508 - RNA, 21 nt, Mycobacterium bovis subsp bovis AF2122/97
gacccagccagcagcggcgag

SEQ ID NO: 3201509 - RNA, 22 nt, Mycobacterium bovis subsp bovis AF2122/97
gacccagccagcagcggcgagc

SEQ ID NO: 3201510 - RNA, 23 nt, Mycobacterium bovis subsp bovis AF2122/97
gacccagccagcagcggcgagcc

SEQ ID NO: 3201511 - RNA, 15 nt, Mycobacterium bovis subsp bovis AF2122/97
gacccagcgcggcaa

SEQ ID NO: 3201512 - RNA, 15 nt, Mycobacterium bovis subsp bovis AF2122/97
gacccagcggcgguc

SEQ ID NO: 3201513 - RNA, 18 nt, Mycobacterium bovis subsp bovis AF2122/97
gacccagcggcggucuuu

SEQ ID NO: 3201514 - RNA, 18 nt, Mycobacterium bovis subsp bovis AF2122/97
gacccagcucgucgacgu

SEQ ID NO: 3201515 - RNA, 12 nt, Mycobacterium bovis subsp bovis AF2122/97
gacccauacgaa

SEQ ID NO: 3201516 - RNA, 18 nt, Mycobacterium bovis subsp bovis AF2122/97
gacccaucaccagcggcu

SEQ ID NO: 3201517 - RNA, 21 nt, Mycobacterium bovis subsp bovis AF2122/97
gacccaucaccagcggcugca

SEQ ID NO: 3201518 - RNA, 18 nt, Mycobacterium bovis subsp bovis AF2122/97
gacccaucaugguccggg

SEQ ID NO: 3201519 - RNA, 13 nt, Mycobacterium bovis subsp bovis AF2122/97
gacccaucgccag

SEQ ID NO: 3201520 - RNA, 17 nt, Mycobacterium bovis subsp bovis AF2122/97
gacccauucucggccgg

SEQ ID NO: 3201521 - RNA, 20 nt, Mycobacterium bovis subsp bovis AF2122/97
gacccauucucggccggcgg

SEQ ID NO: 3201522 - RNA, 22 nt, Mycobacterium bovis subsp bovis AF2122/97
gaccccacacgccgaacgugca

SEQ ID NO: 3201523 - RNA, 14 nt, Mycobacterium bovis subsp bovis AF2122/97
gacccccagcaggg

SEQ ID NO: 3201524 - RNA, 13 nt, Mycobacterium bovis subsp bovis AF2122/97
gacccccagcgcc

SEQ ID NO: 3201525 - RNA, 21 nt, Mycobacterium bovis subsp bovis AF2122/97
gacccccgaucaggccgacgu

SEQ ID NO: 3201526 - RNA, 17 nt, Mycobacterium bovis subsp bovis AF2122/97
gacccccugccacagcg

SEQ ID NO: 3201527 - RNA, 19 nt, Mycobacterium bovis subsp bovis AF2122/97
gacccccugccacagcgac

SEQ ID NO: 3201528 - RNA, 19 nt, Mycobacterium bovis subsp bovis AF2122/97
gaccccgaacauccgccgc

SEQ ID NO: 3201529 - RNA, 21 nt, Mycobacterium bovis subsp bovis AF2122/97
gaccccgaacauccgccgccc

SEQ ID NO: 3201530 - RNA, 22 nt, Mycobacterium bovis subsp bovis AF2122/97
gaccccgaagaugaccucggcg

SEQ ID NO: 3201531 - RNA, 13 nt, Mycobacterium bovis subsp bovis AF2122/97
gaccccgacggca

SEQ ID NO: 3201532 - RNA, 17 nt, Mycobacterium bovis subsp bovis AF2122/97
gaccccgacggcaaugc

SEQ ID NO: 3201533 - RNA, 14 nt, Mycobacterium bovis subsp bovis AF2122/97
gaccccgccagccg

SEQ ID NO: 3201534 - RNA, 15 nt, Mycobacterium bovis subsp bovis AF2122/97
gaccccgccgaacgg

SEQ ID NO: 3201535 - RNA, 19 nt, Mycobacterium bovis subsp bovis AF2122/97
gaccccgcgcuggacaacg

SEQ ID NO: 3201536 - RNA, 23 nt, Mycobacterium bovis subsp bovis AF2122/97
gaccccgcuuuuucccggcggcg

SEQ ID NO: 3201537 - RNA, 15 nt, Mycobacterium bovis subsp bovis AF2122/97
gaccccggcagcgcc

SEQ ID NO: 3201538 - RNA, 21 nt, Mycobacterium bovis subsp bovis AF2122/97
gaccccggcagcgcccuugga

SEQ ID NO: 3201539 - RNA, 13 nt, Mycobacterium bovis subsp bovis AF2122/97
gaccccggcggua

SEQ ID NO: 3201540 - RNA, 16 nt, Mycobacterium bovis subsp bovis AF2122/97
gaccccggcgguaccg

SEQ ID NO: 3201541 - RNA, 19 nt, Mycobacterium bovis subsp bovis AF2122/97
gaccccggcguugccgccg

SEQ ID NO: 3201542 - RNA, 20 nt, Mycobacterium bovis subsp bovis AF2122/97
gaccccggcguugccgccgu

SEQ ID NO: 3201543 - RNA, 22 nt, Mycobacterium bovis subsp bovis AF2122/97
gaccccggcguugccgccguug

SEQ ID NO: 3201544 - RNA, 13 nt, Mycobacterium bovis subsp bovis AF2122/97
gaccccggugguc

SEQ ID NO: 3201545 - RNA, 16 nt, Mycobacterium bovis subsp bovis AF2122/97
gaccccguaggcgccg

SEQ ID NO: 3201546 - RNA, 16 nt, Mycobacterium bovis subsp bovis AF2122/97
gaccccgucagcgggc

SEQ ID NO: 3201547 - RNA, 12 nt, Mycobacterium bovis subsp bovis AF2122/97
gaccccgucgac

SEQ ID NO: 3201548 - RNA, 14 nt, Mycobacterium bovis subsp bovis AF2122/97
gacccgaagccgac

SEQ ID NO: 3201549 - RNA, 15 nt, Mycobacterium bovis subsp bovis AF2122/97
gacccgaagccgacc

SEQ ID NO: 3201550 - RNA, 19 nt, Mycobacterium bovis subsp bovis AF2122/97
gacccgaagccgaccgggu

SEQ ID NO: 3201551 - RNA, 18 nt, Mycobacterium bovis subsp bovis AF2122/97
gacccgaauccaccagcu

SEQ ID NO: 3201552 - RNA, 22 nt, Mycobacterium bovis subsp bovis AF2122/97
gacccgaauccaccagcuggug

SEQ ID NO: 3201553 - RNA, 17 nt, Mycobacterium bovis subsp bovis AF2122/97
gacccgacagccgcugc

SEQ ID NO: 3201554 - RNA, 19 nt, Mycobacterium bovis subsp bovis AF2122/97
gacccgacaugguccgacc

SEQ ID NO: 3201555 - RNA, 22 nt, Mycobacterium bovis subsp bovis AF2122/97
gacccgacaugguccgaccagc

SEQ ID NO: 3201556 - RNA, 15 nt, Mycobacterium bovis subsp bovis AF2122/97
gacccgaccgucguc

SEQ ID NO: 3201557 - RNA, 22 nt, Mycobacterium bovis subsp bovis AF2122/97
gacccgacgaugccggcccgca

SEQ ID NO: 3201558 - RNA, 14 nt, Mycobacterium bovis subsp bovis AF2122/97
gacccgacguagcc

SEQ ID NO: 3201559 - RNA, 16 nt, Mycobacterium bovis subsp bovis AF2122/97
gacccgagaucaccgg

SEQ ID NO: 3201560 - RNA, 20 nt, Mycobacterium bovis subsp bovis AF2122/97
gacccgagcgcucgaucacg

SEQ ID NO: 3201561 - RNA, 12 nt, Mycobacterium bovis subsp bovis AF2122/97
gacccgaugcgu

SEQ ID NO: 3201562 - RNA, 18 nt, Mycobacterium bovis subsp bovis AF2122/97
gacccgaugcgucucgcg

SEQ ID NO: 3201563 - RNA, 20 nt, Mycobacterium bovis subsp bovis AF2122/97
gacccgcaauuccggugauc

SEQ ID NO: 3201564 - RNA, 16 nt, Mycobacterium bovis subsp bovis AF2122/97
gacccgcagaccgcca

SEQ ID NO: 3201565 - RNA, 17 nt, Mycobacterium bovis subsp bovis AF2122/97
gacccgcauccacgucg

SEQ ID NO: 3201566 - RNA, 16 nt, Mycobacterium bovis subsp bovis AF2122/97
gacccgcccaggcguc

SEQ ID NO: 3201567 - RNA, 18 nt, Mycobacterium bovis subsp bovis AF2122/97
gacccgcccuugccgccg

SEQ ID NO: 3201568 - RNA, 19 nt, Mycobacterium bovis subsp bovis AF2122/97
gacccgcccuugccgccga

SEQ ID NO: 3201569 - RNA, 22 nt, Mycobacterium bovis subsp bovis AF2122/97
gacccgcccuugccgccgaggg

SEQ ID NO: 3201570 - RNA, 13 nt, Mycobacterium bovis subsp bovis AF2122/97
gacccgccgacgc

SEQ ID NO: 3201571 - RNA, 18 nt, Mycobacterium bovis subsp bovis AF2122/97
gacccgccgacgccgccg

SEQ ID NO: 3201572 - RNA, 14 nt, Mycobacterium bovis subsp bovis AF2122/97
gacccgccgcccca

SEQ ID NO: 3201573 - RNA, 15 nt, Mycobacterium bovis subsp bovis AF2122/97
gacccgccgccccac

SEQ ID NO: 3201574 - RNA, 13 nt, Mycobacterium bovis subsp bovis AF2122/97
gacccgccgcgcc

SEQ ID NO: 3201575 - RNA, 16 nt, Mycobacterium bovis subsp bovis AF2122/97
gacccgccgcgcccgg

SEQ ID NO: 3201576 - RNA, 17 nt, Mycobacterium bovis subsp bovis AF2122/97
gacccgccgcgcccggc

SEQ ID NO: 3201577 - RNA, 20 nt, Mycobacterium bovis subsp bovis AF2122/97
gacccgccgcgcccggcgca

SEQ ID NO: 3201578 - RNA, 21 nt, Mycobacterium bovis subsp bovis AF2122/97
gacccgccgcgcccggcgcaa

SEQ ID NO: 3201579 - RNA, 21 nt, Mycobacterium bovis subsp bovis AF2122/97
gacccgccgcggacaccagga

SEQ ID NO: 3201580 - RNA, 19 nt, Mycobacterium bovis subsp bovis AF2122/97
gacccgccggguccgccgg

SEQ ID NO: 3201581 - RNA, 14 nt, Mycobacterium bovis subsp bovis AF2122/97
gacccgcgcgccgg

SEQ ID NO: 3201582 - RNA, 19 nt, Mycobacterium bovis subsp bovis AF2122/97
gacccgcgcgccggcgacc

SEQ ID NO: 3201583 - RNA, 13 nt, Mycobacterium bovis subsp bovis AF2122/97
gacccgcggcggg

SEQ ID NO: 3201584 - RNA, 12 nt, Mycobacterium bovis subsp bovis AF2122/97
gacccgcgguag

SEQ ID NO: 3201585 - RNA, 16 nt, Mycobacterium bovis subsp bovis AF2122/97
gacccgcuacgacggu

SEQ ID NO: 3201586 - RNA, 14 nt, Mycobacterium bovis subsp bovis AF2122/97
gacccgcucgcggc

SEQ ID NO: 3201587 - RNA, 14 nt, Mycobacterium bovis subsp bovis AF2122/97
gacccgcugggccg

SEQ ID NO: 3201588 - RNA, 19 nt, Mycobacterium bovis subsp bovis AF2122/97
gacccgcugggccgcaucg

SEQ ID NO: 3201589 - RNA, 22 nt, Mycobacterium bovis subsp bovis AF2122/97
gacccgcuggucgaugccuucg

SEQ ID NO: 3201590 - RNA, 17 nt, Mycobacterium bovis subsp bovis AF2122/97
gacccggaccuucggcg

SEQ ID NO: 3201591 - RNA, 20 nt, Mycobacterium bovis subsp bovis AF2122/97
gacccggaccuucggcggug

SEQ ID NO: 3201592 - RNA, 21 nt, Mycobacterium bovis subsp bovis AF2122/97
gacccggaccuucggcggugc

SEQ ID NO: 3201593 - RNA, 22 nt, Mycobacterium bovis subsp bovis AF2122/97
gacccggagccgccaggugcuc

SEQ ID NO: 3201594 - RNA, 21 nt, Mycobacterium bovis subsp bovis AF2122/97
gacccggauaucgaccaccgg

SEQ ID NO: 3201595 - RNA, 20 nt, Mycobacterium bovis subsp bovis AF2122/97
gacccggcagcccggcggcc

SEQ ID NO: 3201596 - RNA, 12 nt, Mycobacterium bovis subsp bovis AF2122/97
gacccggccagc

SEQ ID NO: 3201597 - RNA, 15 nt, Mycobacterium bovis subsp bovis AF2122/97
gacccggccagcggc

SEQ ID NO: 3201598 - RNA, 16 nt, Mycobacterium bovis subsp bovis AF2122/97
gacccggccagcggca

SEQ ID NO: 3201599 - RNA, 14 nt, Mycobacterium bovis subsp bovis AF2122/97
gacccggccggccc

SEQ ID NO: 3201600 - RNA, 22 nt, Mycobacterium bovis subsp bovis AF2122/97
gacccggcgaugcagccgggaa

SEQ ID NO: 3201601 - RNA, 16 nt, Mycobacterium bovis subsp bovis AF2122/97
gacccggcgccgucga

SEQ ID NO: 3201602 - RNA, 16 nt, Mycobacterium bovis subsp bovis AF2122/97
gacccggcggugccgu

SEQ ID NO: 3201603 - RNA, 14 nt, Mycobacterium bovis subsp bovis AF2122/97
gacccgggaaggaa

SEQ ID NO: 3201604 - RNA, 20 nt, Mycobacterium bovis subsp bovis AF2122/97
gacccgggaaggaaccgggc

SEQ ID NO: 3201605 - RNA, 22 nt, Mycobacterium bovis subsp bovis AF2122/97
gacccgggaaggaaccgggcaa

SEQ ID NO: 3201606 - RNA, 23 nt, Mycobacterium bovis subsp bovis AF2122/97
gacccgggaaggaaccgggcaaa

SEQ ID NO: 3201607 - RNA, 14 nt, Mycobacterium bovis subsp bovis AF2122/97
gacccgggccgcgg

SEQ ID NO: 3201608 - RNA, 15 nt, Mycobacterium bovis subsp bovis AF2122/97
gacccgggccgcggc

SEQ ID NO: 3201609 - RNA, 16 nt, Mycobacterium bovis subsp bovis AF2122/97
gacccgggccgcggcg

SEQ ID NO: 3201610 - RNA, 19 nt, Mycobacterium bovis subsp bovis AF2122/97
gacccgggccgcggcggcc

SEQ ID NO: 3201611 - RNA, 21 nt, Mycobacterium bovis subsp bovis AF2122/97
gacccgggccgcggcggccag

SEQ ID NO: 3201612 - RNA, 12 nt, Mycobacterium bovis subsp bovis AF2122/97
gacccgggccgg

SEQ ID NO: 3201613 - RNA, 20 nt, Mycobacterium bovis subsp bovis AF2122/97
gacccgggcgagcgcggccu

SEQ ID NO: 3201614 - RNA, 21 nt, Mycobacterium bovis subsp bovis AF2122/97
gacccggggacgcccgugcgg

SEQ ID NO: 3201615 - RNA, 12 nt, Mycobacterium bovis subsp bovis AF2122/97
gacccggggccg

SEQ ID NO: 3201616 - RNA, 15 nt, Mycobacterium bovis subsp bovis AF2122/97
gacccggggccguug

SEQ ID NO: 3201617 - RNA, 18 nt, Mycobacterium bovis subsp bovis AF2122/97
gacccgggggcgcccggg

SEQ ID NO: 3201618 - RNA, 15 nt, Mycobacterium bovis subsp bovis AF2122/97
gacccgggucggcac

SEQ ID NO: 3201619 - RNA, 16 nt, Mycobacterium bovis subsp bovis AF2122/97
gacccgggucggcacg

SEQ ID NO: 3201620 - RNA, 17 nt, Mycobacterium bovis subsp bovis AF2122/97
gacccgggucggcacga

SEQ ID NO: 3201621 - RNA, 20 nt, Mycobacterium bovis subsp bovis AF2122/97
gacccgggucggcacgaccc

SEQ ID NO: 3201622 - RNA, 21 nt, Mycobacterium bovis subsp bovis AF2122/97
gacccgguccacgccaggagc

SEQ ID NO: 3201623 - RNA, 14 nt, Mycobacterium bovis subsp bovis AF2122/97
gacccggugacccg

SEQ ID NO: 3201624 - RNA, 16 nt, Mycobacterium bovis subsp bovis AF2122/97
gacccguaccagcccg

SEQ ID NO: 3201625 - RNA, 20 nt, Mycobacterium bovis subsp bovis AF2122/97
gacccguacccacgacgggc

SEQ ID NO: 3201626 - RNA, 22 nt, Mycobacterium bovis subsp bovis AF2122/97
gacccguccaacuacgccagcc

SEQ ID NO: 3201627 - RNA, 19 nt, Mycobacterium bovis subsp bovis AF2122/97
gacccgucccacgugugcg

SEQ ID NO: 3201628 - RNA, 15 nt, Mycobacterium bovis subsp bovis AF2122/97
gacccgucccccgca

SEQ ID NO: 3201629 - RNA, 17 nt, Mycobacterium bovis subsp bovis AF2122/97
gacccgucccccgcacg

SEQ ID NO: 3201630 - RNA, 17 nt, Mycobacterium bovis subsp bovis AF2122/97
gacccgugcacgaucgc

SEQ ID NO: 3201631 - RNA, 18 nt, Mycobacterium bovis subsp bovis AF2122/97
gacccgugcacgaucgcg

SEQ ID NO: 3201632 - RNA, 19 nt, Mycobacterium bovis subsp bovis AF2122/97
gacccguuccacgccggca

SEQ ID NO: 3201633 - RNA, 23 nt, Mycobacterium bovis subsp bovis AF2122/97
gacccguuccacgccggcaucgu

SEQ ID NO: 3201634 - RNA, 17 nt, Mycobacterium bovis subsp bovis AF2122/97
gacccguucgccgucgg

SEQ ID NO: 3201635 - RNA, 19 nt, Mycobacterium bovis subsp bovis AF2122/97
gacccuacuuccucgacga

SEQ ID NO: 3201636 - RNA, 22 nt, Mycobacterium bovis subsp bovis AF2122/97
gacccuacuuccucgacgagca

SEQ ID NO: 3201637 - RNA, 21 nt, Mycobacterium bovis subsp bovis AF2122/97
gacccuagauaugcacccgca

SEQ ID NO: 3201638 - RNA, 22 nt, Mycobacterium bovis subsp bovis AF2122/97
gacccuagauaugcacccgcac

SEQ ID NO: 3201639 - RNA, 21 nt, Mycobacterium bovis subsp bovis AF2122/97
gacccucaagggcaaccgccc

SEQ ID NO: 3201640 - RNA, 16 nt, Mycobacterium bovis subsp bovis AF2122/97
gacccuccagcacgcc

SEQ ID NO: 3201641 - RNA, 18 nt, Mycobacterium bovis subsp bovis AF2122/97
gacccuccagcacgccgu

SEQ ID NO: 3201642 - RNA, 16 nt, Mycobacterium bovis subsp bovis AF2122/97
gacccugaucgugaac

SEQ ID NO: 3201643 - RNA, 14 nt, Mycobacterium bovis subsp bovis AF2122/97
gacccugauggggc

SEQ ID NO: 3201644 - RNA, 16 nt, Mycobacterium bovis subsp bovis AF2122/97
gacccugcccagcacc

SEQ ID NO: 3201645 - RNA, 19 nt, Mycobacterium bovis subsp bovis AF2122/97
gacccugcccagcaccccc

SEQ ID NO: 3201646 - RNA, 19 nt, Mycobacterium bovis subsp bovis AF2122/97
gacccugggguccagcguc

SEQ ID NO: 3201647 - RNA, 20 nt, Mycobacterium bovis subsp bovis AF2122/97
gacccugggguugcaucaug

SEQ ID NO: 3201648 - RNA, 21 nt, Mycobacterium bovis subsp bovis AF2122/97
gacccugguggugcggauguc

SEQ ID NO: 3201649 - RNA, 14 nt, Mycobacterium bovis subsp bovis AF2122/97
gacccuuccgccgc

SEQ ID NO: 3201650 - RNA, 22 nt, Mycobacterium bovis subsp bovis AF2122/97
gaccgaaaacacaugccgcagg

SEQ ID NO: 3201651 - RNA, 13 nt, Mycobacterium bovis subsp bovis AF2122/97
gaccgaaagccgc

SEQ ID NO: 3201652 - RNA, 15 nt, Mycobacterium bovis subsp bovis AF2122/97
gaccgaaagccgcac

SEQ ID NO: 3201653 - RNA, 16 nt, Mycobacterium bovis subsp bovis AF2122/97
gaccgaaagccgcacc

SEQ ID NO: 3201654 - RNA, 17 nt, Mycobacterium bovis subsp bovis AF2122/97
gaccgaaagccgcacca

SEQ ID NO: 3201655 - RNA, 17 nt, Mycobacterium bovis subsp bovis AF2122/97
gaccgaacagcaccgaa

SEQ ID NO: 3201656 - RNA, 17 nt, Mycobacterium bovis subsp bovis AF2122/97
gaccgaacagcggcagc

SEQ ID NO: 3201657 - RNA, 13 nt, Mycobacterium bovis subsp bovis AF2122/97
gaccgaaccguca

SEQ ID NO: 3201658 - RNA, 21 nt, Mycobacterium bovis subsp bovis AF2122/97
gaccgaaccuggucuugacuc

SEQ ID NO: 3201659 - RNA, 14 nt, Mycobacterium bovis subsp bovis AF2122/97
gaccgaacgacucg

SEQ ID NO: 3201660 - RNA, 14 nt, Mycobacterium bovis subsp bovis AF2122/97
gaccgaagaagccc

SEQ ID NO: 3201661 - RNA, 15 nt, Mycobacterium bovis subsp bovis AF2122/97
gaccgaagaagcccg

SEQ ID NO: 3201662 - RNA, 17 nt, Mycobacterium bovis subsp bovis AF2122/97
gaccgaagaagcccgac

SEQ ID NO: 3201663 - RNA, 17 nt, Mycobacterium bovis subsp bovis AF2122/97
gaccgaagaccuccucg

SEQ ID NO: 3201664 - RNA, 16 nt, Mycobacterium bovis subsp bovis AF2122/97
gaccgaagagcgcgcg

SEQ ID NO: 3201665 - RNA, 21 nt, Mycobacterium bovis subsp bovis AF2122/97
gaccgaagagcuccgucgcgg

SEQ ID NO: 3201666 - RNA, 16 nt, Mycobacterium bovis subsp bovis AF2122/97
gaccgaaucagcacgg

SEQ ID NO: 3201667 - RNA, 21 nt, Mycobacterium bovis subsp bovis AF2122/97
gaccgaaucagcacggugugc

SEQ ID NO: 3201668 - RNA, 21 nt, Mycobacterium bovis subsp bovis AF2122/97
gaccgaaucgggucggccgcu

SEQ ID NO: 3201669 - RNA, 22 nt, Mycobacterium bovis subsp bovis AF2122/97
gaccgaaucgggucggccgcug

SEQ ID NO: 3201670 - RNA, 14 nt, Mycobacterium bovis subsp bovis AF2122/97
gaccgaauggccgc

SEQ ID NO: 3201671 - RNA, 16 nt, Mycobacterium bovis subsp bovis AF2122/97
gaccgaauggccgccg

SEQ ID NO: 3201672 - RNA, 13 nt, Mycobacterium bovis subsp bovis AF2122/97
gaccgacaccacc

SEQ ID NO: 3201673 - RNA, 14 nt, Mycobacterium bovis subsp bovis AF2122/97
gaccgacaccacca

SEQ ID NO: 3201674 - RNA, 15 nt, Mycobacterium bovis subsp bovis AF2122/97
gaccgacagcggcac

SEQ ID NO: 3201675 - RNA, 16 nt, Mycobacterium bovis subsp bovis AF2122/97
gaccgacagcggcacc

SEQ ID NO: 3201676 - RNA, 19 nt, Mycobacterium bovis subsp bovis AF2122/97
gaccgacagcggcaccggg

SEQ ID NO: 3201677 - RNA, 14 nt, Mycobacterium bovis subsp bovis AF2122/97
gaccgaccacgcga

SEQ ID NO: 3201678 - RNA, 19 nt, Mycobacterium bovis subsp bovis AF2122/97
gaccgacccggaccugggc

SEQ ID NO: 3201679 - RNA, 16 nt, Mycobacterium bovis subsp bovis AF2122/97
gaccgaccgcauggug

SEQ ID NO: 3201680 - RNA, 18 nt, Mycobacterium bovis subsp bovis AF2122/97
gaccgaccgcaugguggu

SEQ ID NO: 3201681 - RNA, 14 nt, Mycobacterium bovis subsp bovis AF2122/97
gaccgaccucggcg

SEQ ID NO: 3201682 - RNA, 18 nt, Mycobacterium bovis subsp bovis AF2122/97
gaccgaccucggcgaccg

SEQ ID NO: 3201683 - RNA, 12 nt, Mycobacterium bovis subsp bovis AF2122/97
gaccgaccuggu

SEQ ID NO: 3201684 - RNA, 18 nt, Mycobacterium bovis subsp bovis AF2122/97
gaccgacgccggugucgg

SEQ ID NO: 3201685 - RNA, 18 nt, Mycobacterium bovis subsp bovis AF2122/97
gaccgacgccgucgagca

SEQ ID NO: 3201686 - RNA, 13 nt, Mycobacterium bovis subsp bovis AF2122/97
gaccgacgucgcc

SEQ ID NO: 3201687 - RNA, 15 nt, Mycobacterium bovis subsp bovis AF2122/97
gaccgacgucgccca

SEQ ID NO: 3201688 - RNA, 20 nt, Mycobacterium bovis subsp bovis AF2122/97
gaccgagaagcccaccgucu

SEQ ID NO: 3201689 - RNA, 21 nt, Mycobacterium bovis subsp bovis AF2122/97
gaccgagcaacaccccugggu

SEQ ID NO: 3201690 - RNA, 17 nt, Mycobacterium bovis subsp bovis AF2122/97
gaccgagcccgauggug

SEQ ID NO: 3201691 - RNA, 17 nt, Mycobacterium bovis subsp bovis AF2122/97
gaccgagccgaucugcu

SEQ ID NO: 3201692 - RNA, 18 nt, Mycobacterium bovis subsp bovis AF2122/97
gaccgagcuuccaaaccc

SEQ ID NO: 3201693 - RNA, 20 nt, Mycobacterium bovis subsp bovis AF2122/97
gaccgagcuuccaaacccgg

SEQ ID NO: 3201694 - RNA, 13 nt, Mycobacterium bovis subsp bovis AF2122/97
gaccgauaacacc

SEQ ID NO: 3201695 - RNA, 15 nt, Mycobacterium bovis subsp bovis AF2122/97
gaccgauagcuggcc

SEQ ID NO: 3201696 - RNA, 13 nt, Mycobacterium bovis subsp bovis AF2122/97
gaccgaucggcag

SEQ ID NO: 3201697 - RNA, 19 nt, Mycobacterium bovis subsp bovis AF2122/97
gaccgaucggcaggccgcu

SEQ ID NO: 3201698 - RNA, 20 nt, Mycobacterium bovis subsp bovis AF2122/97
gaccgaucggcaggccgcuu

SEQ ID NO: 3201699 - RNA, 20 nt, Mycobacterium bovis subsp bovis AF2122/97
gaccgaucggcgcgucgauc

SEQ ID NO: 3201700 - RNA, 19 nt, Mycobacterium bovis subsp bovis AF2122/97
gaccgaucuuggccaccgc

SEQ ID NO: 3201701 - RNA, 18 nt, Mycobacterium bovis subsp bovis AF2122/97
gaccgaugacgaucggcg

SEQ ID NO: 3201702 - RNA, 16 nt, Mycobacterium bovis subsp bovis AF2122/97
gaccgauugucggcaa

SEQ ID NO: 3201703 - RNA, 15 nt, Mycobacterium bovis subsp bovis AF2122/97
gaccgcaccggccgc

SEQ ID NO: 3201704 - RNA, 16 nt, Mycobacterium bovis subsp bovis AF2122/97
gaccgcaccggccgcu

SEQ ID NO: 3201705 - RNA, 16 nt, Mycobacterium bovis subsp bovis AF2122/97
gaccgcacgaccagcu

SEQ ID NO: 3201706 - RNA, 17 nt, Mycobacterium bovis subsp bovis AF2122/97
gaccgcacuugaucgac

SEQ ID NO: 3201707 - RNA, 23 nt, Mycobacterium bovis subsp bovis AF2122/97
gaccgcacuugaucgacggccau

SEQ ID NO: 3201708 - RNA, 18 nt, Mycobacterium bovis subsp bovis AF2122/97
gaccgcagcgacgggaaa

SEQ ID NO: 3201709 - RNA, 15 nt, Mycobacterium bovis subsp bovis AF2122/97
gaccgcagcuggggc

SEQ ID NO: 3201710 - RNA, 16 nt, Mycobacterium bovis subsp bovis AF2122/97
gaccgcagggaccggu

SEQ ID NO: 3201711 - RNA, 16 nt, Mycobacterium bovis subsp bovis AF2122/97
gaccgcagucgcuggg

SEQ ID NO: 3201712 - RNA, 22 nt, Mycobacterium bovis subsp bovis AF2122/97
gaccgcagucgcuggguggcgg

SEQ ID NO: 3201713 - RNA, 23 nt, Mycobacterium bovis subsp bovis AF2122/97
gaccgcaucggcagccacguaga

SEQ ID NO: 3201714 - RNA, 16 nt, Mycobacterium bovis subsp bovis AF2122/97
gaccgcaucgucgagc

SEQ ID NO: 3201715 - RNA, 18 nt, Mycobacterium bovis subsp bovis AF2122/97
gaccgcaucgucgagcca

SEQ ID NO: 3201716 - RNA, 18 nt, Mycobacterium bovis subsp bovis AF2122/97
gaccgcaugaucgcaccg

SEQ ID NO: 3201717 - RNA, 21 nt, Mycobacterium bovis subsp bovis AF2122/97
gaccgcaugaucgcaccgagg

SEQ ID NO: 3201718 - RNA, 22 nt, Mycobacterium bovis subsp bovis AF2122/97
gaccgcaugaucgcaccgaggu

SEQ ID NO: 3201719 - RNA, 18 nt, Mycobacterium bovis subsp bovis AF2122/97
gaccgccacacggggccg

SEQ ID NO: 3201720 - RNA, 23 nt, Mycobacterium bovis subsp bovis AF2122/97
gaccgccacacggggccgccagc

SEQ ID NO: 3201721 - RNA, 16 nt, Mycobacterium bovis subsp bovis AF2122/97
gaccgccaccccgcuu

SEQ ID NO: 3201722 - RNA, 19 nt, Mycobacterium bovis subsp bovis AF2122/97
gaccgccaccccgcuugga

SEQ ID NO: 3201723 - RNA, 13 nt, Mycobacterium bovis subsp bovis AF2122/97
gaccgccaccccu

SEQ ID NO: 3201724 - RNA, 14 nt, Mycobacterium bovis subsp bovis AF2122/97
gaccgccaccgcca

SEQ ID NO: 3201725 - RNA, 16 nt, Mycobacterium bovis subsp bovis AF2122/97
gaccgccaccgccagc

SEQ ID NO: 3201726 - RNA, 22 nt, Mycobacterium bovis subsp bovis AF2122/97
gaccgccaccgccagcgucgac

SEQ ID NO: 3201727 - RNA, 16 nt, Mycobacterium bovis subsp bovis AF2122/97
gaccgccaccggcuga

SEQ ID NO: 3201728 - RNA, 12 nt, Mycobacterium bovis subsp bovis AF2122/97
gaccgccaccgu

SEQ ID NO: 3201729 - RNA, 19 nt, Mycobacterium bovis subsp bovis AF2122/97
gaccgccaccuuggcguug

SEQ ID NO: 3201730 - RNA, 14 nt, Mycobacterium bovis subsp bovis AF2122/97
gaccgccagcagca

SEQ ID NO: 3201731 - RNA, 15 nt, Mycobacterium bovis subsp bovis AF2122/97
gaccgccagcccggu

SEQ ID NO: 3201732 - RNA, 15 nt, Mycobacterium bovis subsp bovis AF2122/97
gaccgccagccgcga

SEQ ID NO: 3201733 - RNA, 16 nt, Mycobacterium bovis subsp bovis AF2122/97
gaccgccagccgcgag

SEQ ID NO: 3201734 - RNA, 22 nt, Mycobacterium bovis subsp bovis AF2122/97
gaccgccagcggccgcuccacc

SEQ ID NO: 3201735 - RNA, 18 nt, Mycobacterium bovis subsp bovis AF2122/97
gaccgccaucgccaacac

SEQ ID NO: 3201736 - RNA, 20 nt, Mycobacterium bovis subsp bovis AF2122/97
gaccgccaucgccaacacca

SEQ ID NO: 3201737 - RNA, 22 nt, Mycobacterium bovis subsp bovis AF2122/97
gaccgccaucgccaacaccaac

SEQ ID NO: 3201738 - RNA, 20 nt, Mycobacterium bovis subsp bovis AF2122/97
gaccgccccggccaggacau

SEQ ID NO: 3201739 - RNA, 15 nt, Mycobacterium bovis subsp bovis AF2122/97
gaccgcccgugccgu

SEQ ID NO: 3201740 - RNA, 22 nt, Mycobacterium bovis subsp bovis AF2122/97
gaccgcccgugccgucgcccuu

SEQ ID NO: 3201741 - RNA, 20 nt, Mycobacterium bovis subsp bovis AF2122/97
gaccgcccuagcgagcggca

SEQ ID NO: 3201742 - RNA, 23 nt, Mycobacterium bovis subsp bovis AF2122/97
gaccgcccuagcgagcggcacca

SEQ ID NO: 3201743 - RNA, 23 nt, Mycobacterium bovis subsp bovis AF2122/97
gaccgccgauacuucaucggcac

SEQ ID NO: 3201744 - RNA, 17 nt, Mycobacterium bovis subsp bovis AF2122/97
gaccgccgaucggccac

SEQ ID NO: 3201745 - RNA, 21 nt, Mycobacterium bovis subsp bovis AF2122/97
gaccgccgaugcccgacaccg

SEQ ID NO: 3201746 - RNA, 12 nt, Mycobacterium bovis subsp bovis AF2122/97
gaccgccgccga

SEQ ID NO: 3201747 - RNA, 12 nt, Mycobacterium bovis subsp bovis AF2122/97
gaccgccgccgg

SEQ ID NO: 3201748 - RNA, 13 nt, Mycobacterium bovis subsp bovis AF2122/97
gaccgccgccgga

SEQ ID NO: 3201749 - RNA, 18 nt, Mycobacterium bovis subsp bovis AF2122/97
gaccgccgccggaucgcc

SEQ ID NO: 3201750 - RNA, 23 nt, Mycobacterium bovis subsp bovis AF2122/97
gaccgccgccggaucgccgguga

SEQ ID NO: 3201751 - RNA, 15 nt, Mycobacterium bovis subsp bovis AF2122/97
gaccgccgcgccggc

SEQ ID NO: 3201752 - RNA, 16 nt, Mycobacterium bovis subsp bovis AF2122/97
gaccgccgcgccggca

SEQ ID NO: 3201753 - RNA, 18 nt, Mycobacterium bovis subsp bovis AF2122/97
gaccgccgcuaccccagc

SEQ ID NO: 3201754 - RNA, 21 nt, Mycobacterium bovis subsp bovis AF2122/97
gaccgccgcugccgccgagcu

SEQ ID NO: 3201755 - RNA, 13 nt, Mycobacterium bovis subsp bovis AF2122/97
gaccgccgcuggg

SEQ ID NO: 3201756 - RNA, 19 nt, Mycobacterium bovis subsp bovis AF2122/97
gaccgccgcuggguccccu

SEQ ID NO: 3201757 - RNA, 17 nt, Mycobacterium bovis subsp bovis AF2122/97
gaccgccguggcccgcu

SEQ ID NO: 3201758 - RNA, 14 nt, Mycobacterium bovis subsp bovis AF2122/97
gaccgccuccaccg

SEQ ID NO: 3201759 - RNA, 16 nt, Mycobacterium bovis subsp bovis AF2122/97
gaccgccuccaccgcc

SEQ ID NO: 3201760 - RNA, 20 nt, Mycobacterium bovis subsp bovis AF2122/97
gaccgccuccaccgccgcgc

SEQ ID NO: 3201761 - RNA, 21 nt, Mycobacterium bovis subsp bovis AF2122/97
gaccgccuccaccgccgcgcg

SEQ ID NO: 3201762 - RNA, 13 nt, Mycobacterium bovis subsp bovis AF2122/97
gaccgccuccucg

SEQ ID NO: 3201763 - RNA, 14 nt, Mycobacterium bovis subsp bovis AF2122/97
gaccgccucgucga

SEQ ID NO: 3201764 - RNA, 19 nt, Mycobacterium bovis subsp bovis AF2122/97
gaccgccucgucgaugccu

SEQ ID NO: 3201765 - RNA, 13 nt, Mycobacterium bovis subsp bovis AF2122/97
gaccgcgacccgg

SEQ ID NO: 3201766 - RNA, 14 nt, Mycobacterium bovis subsp bovis AF2122/97
gaccgcgacccggc

SEQ ID NO: 3201767 - RNA, 21 nt, Mycobacterium bovis subsp bovis AF2122/97
gaccgcgacggcgccggcauc

SEQ ID NO: 3201768 - RNA, 23 nt, Mycobacterium bovis subsp bovis AF2122/97
gaccgcgacggcgccggcaucgg

SEQ ID NO: 3201769 - RNA, 15 nt, Mycobacterium bovis subsp bovis AF2122/97
gaccgcgagcagcac

SEQ ID NO: 3201770 - RNA, 19 nt, Mycobacterium bovis subsp bovis AF2122/97
gaccgcgagggccagcaag

SEQ ID NO: 3201771 - RNA, 15 nt, Mycobacterium bovis subsp bovis AF2122/97
gaccgcgaucgccga

SEQ ID NO: 3201772 - RNA, 16 nt, Mycobacterium bovis subsp bovis AF2122/97
gaccgcgaucgccgac

SEQ ID NO: 3201773 - RNA, 18 nt, Mycobacterium bovis subsp bovis AF2122/97
gaccgcgaucgccgacgc

SEQ ID NO: 3201774 - RNA, 13 nt, Mycobacterium bovis subsp bovis AF2122/97
gaccgcgauggug

SEQ ID NO: 3201775 - RNA, 22 nt, Mycobacterium bovis subsp bovis AF2122/97
gaccgcgaugucacggaugugc

SEQ ID NO: 3201776 - RNA, 18 nt, Mycobacterium bovis subsp bovis AF2122/97
gaccgcgcaacaccucgu

SEQ ID NO: 3201777 - RNA, 19 nt, Mycobacterium bovis subsp bovis AF2122/97
gaccgcgcacggcuggcgu

SEQ ID NO: 3201778 - RNA, 21 nt, Mycobacterium bovis subsp bovis AF2122/97
gaccgcgccaacuccgaucca

SEQ ID NO: 3201779 - RNA, 17 nt, Mycobacterium bovis subsp bovis AF2122/97
gaccgcgcccagaccga

SEQ ID NO: 3201780 - RNA, 23 nt, Mycobacterium bovis subsp bovis AF2122/97
gaccgcgcccagaccgacccgca

SEQ ID NO: 3201781 - RNA, 15 nt, Mycobacterium bovis subsp bovis AF2122/97
gaccgcgcccgcggg

SEQ ID NO: 3201782 - RNA, 13 nt, Mycobacterium bovis subsp bovis AF2122/97
gaccgcgccgauc

SEQ ID NO: 3201783 - RNA, 14 nt, Mycobacterium bovis subsp bovis AF2122/97
gaccgcgccgauca

SEQ ID NO: 3201784 - RNA, 20 nt, Mycobacterium bovis subsp bovis AF2122/97
gaccgcgccgaucaccaccg

SEQ ID NO: 3201785 - RNA, 14 nt, Mycobacterium bovis subsp bovis AF2122/97
gaccgcgccggaca

SEQ ID NO: 3201786 - RNA, 18 nt, Mycobacterium bovis subsp bovis AF2122/97
gaccgcgccggacagcgc

SEQ ID NO: 3201787 - RNA, 20 nt, Mycobacterium bovis subsp bovis AF2122/97
gaccgcgccggacagcgcau

SEQ ID NO: 3201788 - RNA, 13 nt, Mycobacterium bovis subsp bovis AF2122/97
gaccgcgcucacc

SEQ ID NO: 3201789 - RNA, 17 nt, Mycobacterium bovis subsp bovis AF2122/97
gaccgcggccccgccgu

SEQ ID NO: 3201790 - RNA, 13 nt, Mycobacterium bovis subsp bovis AF2122/97
gaccgcggcccgg

SEQ ID NO: 3201791 - RNA, 22 nt, Mycobacterium bovis subsp bovis AF2122/97
gaccgcggcccggacgucggcg

SEQ ID NO: 3201792 - RNA, 23 nt, Mycobacterium bovis subsp bovis AF2122/97
gaccgcggcccggacgucggcgg

SEQ ID NO: 3201793 - RNA, 15 nt, Mycobacterium bovis subsp bovis AF2122/97
gaccgcggccggccg

SEQ ID NO: 3201794 - RNA, 14 nt, Mycobacterium bovis subsp bovis AF2122/97
gaccgcggccuugg

SEQ ID NO: 3201795 - RNA, 21 nt, Mycobacterium bovis subsp bovis AF2122/97
gaccgcggccuuggcggccgc

SEQ ID NO: 3201796 - RNA, 17 nt, Mycobacterium bovis subsp bovis AF2122/97
gaccgcggcgcguccgg

SEQ ID NO: 3201797 - RNA, 16 nt, Mycobacterium bovis subsp bovis AF2122/97
gaccgcggcggccgaa

SEQ ID NO: 3201798 - RNA, 19 nt, Mycobacterium bovis subsp bovis AF2122/97
gaccgcggcggccgaaaac

SEQ ID NO: 3201799 - RNA, 22 nt, Mycobacterium bovis subsp bovis AF2122/97
gaccgcggcugucacgccugcc

SEQ ID NO: 3201800 - RNA, 23 nt, Mycobacterium bovis subsp bovis AF2122/97
gaccgcggcugucacgccugcca

SEQ ID NO: 3201801 - RNA, 15 nt, Mycobacterium bovis subsp bovis AF2122/97
gaccgcgggucgugc

SEQ ID NO: 3201802 - RNA, 20 nt, Mycobacterium bovis subsp bovis AF2122/97
gaccgcgggucgugccagca

SEQ ID NO: 3201803 - RNA, 22 nt, Mycobacterium bovis subsp bovis AF2122/97
gaccgcgggucgugccagcagc

SEQ ID NO: 3201804 - RNA, 23 nt, Mycobacterium bovis subsp bovis AF2122/97
gaccgcgggucgugccagcagca

SEQ ID NO: 3201805 - RNA, 16 nt, Mycobacterium bovis subsp bovis AF2122/97
gaccgcggucugcgcg

SEQ ID NO: 3201806 - RNA, 19 nt, Mycobacterium bovis subsp bovis AF2122/97
gaccgcggucuucuucacc

SEQ ID NO: 3201807 - RNA, 20 nt, Mycobacterium bovis subsp bovis AF2122/97
gaccgcggucuucuucaccg

SEQ ID NO: 3201808 - RNA, 15 nt, Mycobacterium bovis subsp bovis AF2122/97
gaccgcggugacccg

SEQ ID NO: 3201809 - RNA, 19 nt, Mycobacterium bovis subsp bovis AF2122/97
gaccgcguaaaggccuugg

SEQ ID NO: 3201810 - RNA, 16 nt, Mycobacterium bovis subsp bovis AF2122/97
gaccgcguagaccagu

SEQ ID NO: 3201811 - RNA, 16 nt, Mycobacterium bovis subsp bovis AF2122/97
gaccgcgucggcggcc

SEQ ID NO: 3201812 - RNA, 23 nt, Mycobacterium bovis subsp bovis AF2122/97
gaccgcguuuugcaggcccgagu

SEQ ID NO: 3201813 - RNA, 15 nt, Mycobacterium bovis subsp bovis AF2122/97
gaccgcuaccagcug

SEQ ID NO: 3201814 - RNA, 19 nt, Mycobacterium bovis subsp bovis AF2122/97
gaccgcuaccagcugggcg

SEQ ID NO: 3201815 - RNA, 23 nt, Mycobacterium bovis subsp bovis AF2122/97
gaccgcuaccagcugggcgacca

SEQ ID NO: 3201816 - RNA, 19 nt, Mycobacterium bovis subsp bovis AF2122/97
gaccgcuaugaugccgccg

SEQ ID NO: 3201817 - RNA, 21 nt, Mycobacterium bovis subsp bovis AF2122/97
gaccgcuaugaugccgccggu

SEQ ID NO: 3201818 - RNA, 15 nt, Mycobacterium bovis subsp bovis AF2122/97
gaccgcucgaugucc

SEQ ID NO: 3201819 - RNA, 15 nt, Mycobacterium bovis subsp bovis AF2122/97
gaccgcucggaguug

SEQ ID NO: 3201820 - RNA, 16 nt, Mycobacterium bovis subsp bovis AF2122/97
gaccgcucgucgccgg

SEQ ID NO: 3201821 - RNA, 18 nt, Mycobacterium bovis subsp bovis AF2122/97
gaccgcucgucgccggug

SEQ ID NO: 3201822 - RNA, 20 nt, Mycobacterium bovis subsp bovis AF2122/97
gaccgcucgucgccgguggc

SEQ ID NO: 3201823 - RNA, 17 nt, Mycobacterium bovis subsp bovis AF2122/97
gaccgcucugcggccac

SEQ ID NO: 3201824 - RNA, 15 nt, Mycobacterium bovis subsp bovis AF2122/97
gaccgcugccgacgc

SEQ ID NO: 3201825 - RNA, 12 nt, Mycobacterium bovis subsp bovis AF2122/97
gaccgcugccug

SEQ ID NO: 3201826 - RNA, 17 nt, Mycobacterium bovis subsp bovis AF2122/97
gaccgcugccugccgcg

SEQ ID NO: 3201827 - RNA, 14 nt, Mycobacterium bovis subsp bovis AF2122/97
gaccgcuugcccgc

SEQ ID NO: 3201828 - RNA, 13 nt, Mycobacterium bovis subsp bovis AF2122/97
gaccggaaaccac

SEQ ID NO: 3201829 - RNA, 14 nt, Mycobacterium bovis subsp bovis AF2122/97
gaccggaaaccaca

SEQ ID NO: 3201830 - RNA, 22 nt, Mycobacterium bovis subsp bovis AF2122/97
gaccggacacuccugcacacag

SEQ ID NO: 3201831 - RNA, 18 nt, Mycobacterium bovis subsp bovis AF2122/97
gaccggaguucagugcgc

SEQ ID NO: 3201832 - RNA, 23 nt, Mycobacterium bovis subsp bovis AF2122/97
gaccggaguucagugcgcgugcc

SEQ ID NO: 3201833 - RNA, 19 nt, Mycobacterium bovis subsp bovis AF2122/97
gaccggaucugacggcgcc

SEQ ID NO: 3201834 - RNA, 20 nt, Mycobacterium bovis subsp bovis AF2122/97
gaccggaucugacggcgccg

SEQ ID NO: 3201835 - RNA, 20 nt, Mycobacterium bovis subsp bovis AF2122/97
gaccggcacccgcggcgaac

SEQ ID NO: 3201836 - RNA, 14 nt, Mycobacterium bovis subsp bovis AF2122/97
gaccggcaggccgg

SEQ ID NO: 3201837 - RNA, 16 nt, Mycobacterium bovis subsp bovis AF2122/97
gaccggcaggccggcg

SEQ ID NO: 3201838 - RNA, 12 nt, Mycobacterium bovis subsp bovis AF2122/97
gaccggcaucga

SEQ ID NO: 3201839 - RNA, 21 nt, Mycobacterium bovis subsp bovis AF2122/97
gaccggcaucgaucaacacca

SEQ ID NO: 3201840 - RNA, 19 nt, Mycobacterium bovis subsp bovis AF2122/97
gaccggccaacgccgccgc

SEQ ID NO: 3201841 - RNA, 20 nt, Mycobacterium bovis subsp bovis AF2122/97
gaccggccaacgccgccgca

SEQ ID NO: 3201842 - RNA, 16 nt, Mycobacterium bovis subsp bovis AF2122/97
gaccggccacgaccuc

SEQ ID NO: 3201843 - RNA, 21 nt, Mycobacterium bovis subsp bovis AF2122/97
gaccggcccgcauccgcaccg

SEQ ID NO: 3201844 - RNA, 15 nt, Mycobacterium bovis subsp bovis AF2122/97
gaccggccggccgcg

SEQ ID NO: 3201845 - RNA, 16 nt, Mycobacterium bovis subsp bovis AF2122/97
gaccggccugcgacga

SEQ ID NO: 3201846 - RNA, 19 nt, Mycobacterium bovis subsp bovis AF2122/97
gaccggccugcgacgagcc

SEQ ID NO: 3201847 - RNA, 16 nt, Mycobacterium bovis subsp bovis AF2122/97
gaccggcgggaugcgc

SEQ ID NO: 3201848 - RNA, 19 nt, Mycobacterium bovis subsp bovis AF2122/97
gaccggcgggaugcgcgcc

SEQ ID NO: 3201849 - RNA, 13 nt, Mycobacterium bovis subsp bovis AF2122/97
gaccggcgggcag

SEQ ID NO: 3201850 - RNA, 21 nt, Mycobacterium bovis subsp bovis AF2122/97
gaccggcgggcagauggugaa

SEQ ID NO: 3201851 - RNA, 20 nt, Mycobacterium bovis subsp bovis AF2122/97
gaccggcguaaccggcagcg

SEQ ID NO: 3201852 - RNA, 22 nt, Mycobacterium bovis subsp bovis AF2122/97
gaccggcguaaccggcagcggu

SEQ ID NO: 3201853 - RNA, 15 nt, Mycobacterium bovis subsp bovis AF2122/97
gaccggcuaccggcg

SEQ ID NO: 3201854 - RNA, 21 nt, Mycobacterium bovis subsp bovis AF2122/97
gaccggcucacguaaccagug

SEQ ID NO: 3201855 - RNA, 12 nt, Mycobacterium bovis subsp bovis AF2122/97
gaccggcuccgg

SEQ ID NO: 3201856 - RNA, 19 nt, Mycobacterium bovis subsp bovis AF2122/97
gaccggcuccgguaggcga

SEQ ID NO: 3201857 - RNA, 21 nt, Mycobacterium bovis subsp bovis AF2122/97
gaccggcuccgguaggcgaga

SEQ ID NO: 3201858 - RNA, 15 nt, Mycobacterium bovis subsp bovis AF2122/97
gaccggcucgccggc

SEQ ID NO: 3201859 - RNA, 16 nt, Mycobacterium bovis subsp bovis AF2122/97
gaccggcucggcggug

SEQ ID NO: 3201860 - RNA, 19 nt, Mycobacterium bovis subsp bovis AF2122/97
gaccggcucgucgggcaga

SEQ ID NO: 3201861 - RNA, 22 nt, Mycobacterium bovis subsp bovis AF2122/97
gaccggcuuccccagcaguucg

SEQ ID NO: 3201862 - RNA, 16 nt, Mycobacterium bovis subsp bovis AF2122/97
gaccggcuugccgccg

SEQ ID NO: 3201863 - RNA, 17 nt, Mycobacterium bovis subsp bovis AF2122/97
gaccggcuugccgccgu

SEQ ID NO: 3201864 - RNA, 17 nt, Mycobacterium bovis subsp bovis AF2122/97
gaccgggaacagggugg

SEQ ID NO: 3201865 - RNA, 20 nt, Mycobacterium bovis subsp bovis AF2122/97
gaccgggaacaggguggugg

SEQ ID NO: 3201866 - RNA, 15 nt, Mycobacterium bovis subsp bovis AF2122/97
gaccgggaggcggcg

SEQ ID NO: 3201867 - RNA, 22 nt, Mycobacterium bovis subsp bovis AF2122/97
gaccgggaggcggcgccgcacc

SEQ ID NO: 3201868 - RNA, 15 nt, Mycobacterium bovis subsp bovis AF2122/97
gaccgggaucggcuc

SEQ ID NO: 3201869 - RNA, 17 nt, Mycobacterium bovis subsp bovis AF2122/97
gaccgggaucgucaggc

SEQ ID NO: 3201870 - RNA, 15 nt, Mycobacterium bovis subsp bovis AF2122/97
gaccgggcaacggcg

SEQ ID NO: 3201871 - RNA, 20 nt, Mycobacterium bovis subsp bovis AF2122/97
gaccgggcaguuuguucgcg

SEQ ID NO: 3201872 - RNA, 15 nt, Mycobacterium bovis subsp bovis AF2122/97
gaccgggcccggcga

SEQ ID NO: 3201873 - RNA, 18 nt, Mycobacterium bovis subsp bovis AF2122/97
gaccgggcccggcgaaca

SEQ ID NO: 3201874 - RNA, 18 nt, Mycobacterium bovis subsp bovis AF2122/97
gaccgggcucuggccagu

SEQ ID NO: 3201875 - RNA, 14 nt, Mycobacterium bovis subsp bovis AF2122/97
gaccgggcuggcca

SEQ ID NO: 3201876 - RNA, 16 nt, Mycobacterium bovis subsp bovis AF2122/97
gaccgggcuggccagc

SEQ ID NO: 3201877 - RNA, 19 nt, Mycobacterium bovis subsp bovis AF2122/97
gaccggggacagcccuucg

SEQ ID NO: 3201878 - RNA, 21 nt, Mycobacterium bovis subsp bovis AF2122/97
gaccggggcgcccggccaggu

SEQ ID NO: 3201879 - RNA, 19 nt, Mycobacterium bovis subsp bovis AF2122/97
gaccggggucggccugcgg

SEQ ID NO: 3201880 - RNA, 23 nt, Mycobacterium bovis subsp bovis AF2122/97
gaccgggucgaucaccgacaccg

SEQ ID NO: 3201881 - RNA, 15 nt, Mycobacterium bovis subsp bovis AF2122/97
gaccgggucgaugac

SEQ ID NO: 3201882 - RNA, 17 nt, Mycobacterium bovis subsp bovis AF2122/97
gaccgggucgaugacgc

SEQ ID NO: 3201883 - RNA, 19 nt, Mycobacterium bovis subsp bovis AF2122/97
gaccgggucgaugacgccg

SEQ ID NO: 3201884 - RNA, 18 nt, Mycobacterium bovis subsp bovis AF2122/97
gaccgggucgcaaccgcc

SEQ ID NO: 3201885 - RNA, 14 nt, Mycobacterium bovis subsp bovis AF2122/97
gaccgggucgccga

SEQ ID NO: 3201886 - RNA, 22 nt, Mycobacterium bovis subsp bovis AF2122/97
gaccgggugggucguucaccga

SEQ ID NO: 3201887 - RNA, 24 nt, Mycobacterium bovis subsp bovis AF2122/97
gaccgggugggucguucaccgauc

SEQ ID NO: 3201888 - RNA, 17 nt, Mycobacterium bovis subsp bovis AF2122/97
gaccgguacccguagca

SEQ ID NO: 3201889 - RNA, 18 nt, Mycobacterium bovis subsp bovis AF2122/97
gaccgguaggcaccgauc

SEQ ID NO: 3201890 - RNA, 22 nt, Mycobacterium bovis subsp bovis AF2122/97
gaccgguaggcaccgaucggug

SEQ ID NO: 3201891 - RNA, 16 nt, Mycobacterium bovis subsp bovis AF2122/97
gaccggucacccgugc

SEQ ID NO: 3201892 - RNA, 18 nt, Mycobacterium bovis subsp bovis AF2122/97
gaccggucacccgugcuu

SEQ ID NO: 3201893 - RNA, 13 nt, Mycobacterium bovis subsp bovis AF2122/97
gaccgguccagcc

SEQ ID NO: 3201894 - RNA, 19 nt, Mycobacterium bovis subsp bovis AF2122/97
gaccgguccagccaacggg

SEQ ID NO: 3201895 - RNA, 13 nt, Mycobacterium bovis subsp bovis AF2122/97
gaccgguccccgg

SEQ ID NO: 3201896 - RNA, 12 nt, Mycobacterium bovis subsp bovis AF2122/97
gaccggucgaca

SEQ ID NO: 3201897 - RNA, 23 nt, Mycobacterium bovis subsp bovis AF2122/97
gaccggucgacagcgaaggcgcc

SEQ ID NO: 3201898 - RNA, 16 nt, Mycobacterium bovis subsp bovis AF2122/97
gaccggugccagcagu

SEQ ID NO: 3201899 - RNA, 17 nt, Mycobacterium bovis subsp bovis AF2122/97
gaccggugccugcaacg

SEQ ID NO: 3201900 - RNA, 16 nt, Mycobacterium bovis subsp bovis AF2122/97
gaccggugcugucgac

SEQ ID NO: 3201901 - RNA, 19 nt, Mycobacterium bovis subsp bovis AF2122/97
gaccggugcugucgacguc

SEQ ID NO: 3201902 - RNA, 23 nt, Mycobacterium bovis subsp bovis AF2122/97
gaccggugcugucgacgucggca

SEQ ID NO: 3201903 - RNA, 17 nt, Mycobacterium bovis subsp bovis AF2122/97
gaccgguggcaccggcg

SEQ ID NO: 3201904 - RNA, 15 nt, Mycobacterium bovis subsp bovis AF2122/97
gaccgguggccaucg

SEQ ID NO: 3201905 - RNA, 12 nt, Mycobacterium bovis subsp bovis AF2122/97
gaccgguguggc

SEQ ID NO: 3201906 - RNA, 18 nt, Mycobacterium bovis subsp bovis AF2122/97
gaccgguucccgggcagc

SEQ ID NO: 3201907 - RNA, 20 nt, Mycobacterium bovis subsp bovis AF2122/97
gaccgguuucuucggccagc

SEQ ID NO: 3201908 - RNA, 15 nt, Mycobacterium bovis subsp bovis AF2122/97
gaccguagcggccgg

SEQ ID NO: 3201909 - RNA, 16 nt, Mycobacterium bovis subsp bovis AF2122/97
gaccguauugaccagc

SEQ ID NO: 3201910 - RNA, 17 nt, Mycobacterium bovis subsp bovis AF2122/97
gaccguauugaccagcg

SEQ ID NO: 3201911 - RNA, 21 nt, Mycobacterium bovis subsp bovis AF2122/97
gaccguauugaccagcggggu

SEQ ID NO: 3201912 - RNA, 18 nt, Mycobacterium bovis subsp bovis AF2122/97
gaccgucacaagucgaca

SEQ ID NO: 3201913 - RNA, 20 nt, Mycobacterium bovis subsp bovis AF2122/97
gaccgucacaagucgacacg

SEQ ID NO: 3201914 - RNA, 13 nt, Mycobacterium bovis subsp bovis AF2122/97
gaccgucaccgga

SEQ ID NO: 3201915 - RNA, 12 nt, Mycobacterium bovis subsp bovis AF2122/97
gaccgucagccc

SEQ ID NO: 3201916 - RNA, 15 nt, Mycobacterium bovis subsp bovis AF2122/97
gaccguccaccgacg

SEQ ID NO: 3201917 - RNA, 23 nt, Mycobacterium bovis subsp bovis AF2122/97
gaccguccaccgacguggccagc

SEQ ID NO: 3201918 - RNA, 14 nt, Mycobacterium bovis subsp bovis AF2122/97
gaccguccagcaac

SEQ ID NO: 3201919 - RNA, 16 nt, Mycobacterium bovis subsp bovis AF2122/97
gaccgucccagcgccg

SEQ ID NO: 3201920 - RNA, 18 nt, Mycobacterium bovis subsp bovis AF2122/97
gaccgucccagcgccgca

SEQ ID NO: 3201921 - RNA, 20 nt, Mycobacterium bovis subsp bovis AF2122/97
gaccgucccggccucgaugu

SEQ ID NO: 3201922 - RNA, 23 nt, Mycobacterium bovis subsp bovis AF2122/97
gaccgucccggccucgaugucgc

SEQ ID NO: 3201923 - RNA, 13 nt, Mycobacterium bovis subsp bovis AF2122/97
gaccguccgacgg

SEQ ID NO: 3201924 - RNA, 20 nt, Mycobacterium bovis subsp bovis AF2122/97
gaccgucgauccgucggcgg

SEQ ID NO: 3201925 - RNA, 20 nt, Mycobacterium bovis subsp bovis AF2122/97
gaccgucgauuucgacgacc

SEQ ID NO: 3201926 - RNA, 22 nt, Mycobacterium bovis subsp bovis AF2122/97
gaccgucgauuucgacgaccac

SEQ ID NO: 3201927 - RNA, 13 nt, Mycobacterium bovis subsp bovis AF2122/97
gaccgucgcaccc

SEQ ID NO: 3201928 - RNA, 14 nt, Mycobacterium bovis subsp bovis AF2122/97
gaccgucgccggug

SEQ ID NO: 3201929 - RNA, 22 nt, Mycobacterium bovis subsp bovis AF2122/97
gaccgucgccggugacgacguc

SEQ ID NO: 3201930 - RNA, 18 nt, Mycobacterium bovis subsp bovis AF2122/97
gaccgucgcgcugccggc

SEQ ID NO: 3201931 - RNA, 20 nt, Mycobacterium bovis subsp bovis AF2122/97
gaccgucggcuccaggucca

SEQ ID NO: 3201932 - RNA, 14 nt, Mycobacterium bovis subsp bovis AF2122/97
gaccgucgucaccg

SEQ ID NO: 3201933 - RNA, 17 nt, Mycobacterium bovis subsp bovis AF2122/97
gaccgucgucaccgcga

SEQ ID NO: 3201934 - RNA, 15 nt, Mycobacterium bovis subsp bovis AF2122/97
gaccgucguggcggu

SEQ ID NO: 3201935 - RNA, 16 nt, Mycobacterium bovis subsp bovis AF2122/97
gaccgucucgguggug

SEQ ID NO: 3201936 - RNA, 17 nt, Mycobacterium bovis subsp bovis AF2122/97
gaccgucugcgacccgg

SEQ ID NO: 3201937 - RNA, 21 nt, Mycobacterium bovis subsp bovis AF2122/97
gaccgucuggaguucgucacc

SEQ ID NO: 3201938 - RNA, 22 nt, Mycobacterium bovis subsp bovis AF2122/97
gaccgucuuuggugccgagcag

SEQ ID NO: 3201939 - RNA, 17 nt, Mycobacterium bovis subsp bovis AF2122/97
gaccgugaacggcucgg

SEQ ID NO: 3201940 - RNA, 21 nt, Mycobacterium bovis subsp bovis AF2122/97
gaccgugacguaucgccgcgg

SEQ ID NO: 3201941 - RNA, 14 nt, Mycobacterium bovis subsp bovis AF2122/97
gaccgugaucagcg

SEQ ID NO: 3201942 - RNA, 15 nt, Mycobacterium bovis subsp bovis AF2122/97
gaccgugaucagcgc

SEQ ID NO: 3201943 - RNA, 21 nt, Mycobacterium bovis subsp bovis AF2122/97
gaccgugaucagcgcguagcc

SEQ ID NO: 3201944 - RNA, 16 nt, Mycobacterium bovis subsp bovis AF2122/97
gaccgugccgucggcg

SEQ ID NO: 3201945 - RNA, 17 nt, Mycobacterium bovis subsp bovis AF2122/97
gaccgugccgucggcgu

SEQ ID NO: 3201946 - RNA, 19 nt, Mycobacterium bovis subsp bovis AF2122/97
gaccgugccgucggcgugc

SEQ ID NO: 3201947 - RNA, 22 nt, Mycobacterium bovis subsp bovis AF2122/97
gaccgugccgucggcgugcagc

SEQ ID NO: 3201948 - RNA, 18 nt, Mycobacterium bovis subsp bovis AF2122/97
gaccgugcgucgauggcg

SEQ ID NO: 3201949 - RNA, 18 nt, Mycobacterium bovis subsp bovis AF2122/97
gaccgugcugggcgccgc

SEQ ID NO: 3201950 - RNA, 21 nt, Mycobacterium bovis subsp bovis AF2122/97
gaccguggcgccggucgccgg

SEQ ID NO: 3201951 - RNA, 14 nt, Mycobacterium bovis subsp bovis AF2122/97
gaccguggcggccu

SEQ ID NO: 3201952 - RNA, 16 nt, Mycobacterium bovis subsp bovis AF2122/97
gaccguggcggccucc

SEQ ID NO: 3201953 - RNA, 15 nt, Mycobacterium bovis subsp bovis AF2122/97
gaccguggcggggaa

SEQ ID NO: 3201954 - RNA, 22 nt, Mycobacterium bovis subsp bovis AF2122/97
gaccguggcugcgcucgcccgc

SEQ ID NO: 3201955 - RNA, 21 nt, Mycobacterium bovis subsp bovis AF2122/97
gaccguggucggagguggggu

SEQ ID NO: 3201956 - RNA, 18 nt, Mycobacterium bovis subsp bovis AF2122/97
gaccgugucaccgccggg

SEQ ID NO: 3201957 - RNA, 17 nt, Mycobacterium bovis subsp bovis AF2122/97
gaccguugccgucggug

SEQ ID NO: 3201958 - RNA, 16 nt, Mycobacterium bovis subsp bovis AF2122/97
gaccuagcaccgcgcc

SEQ ID NO: 3201959 - RNA, 18 nt, Mycobacterium bovis subsp bovis AF2122/97
gaccuagcaccgcgccga

SEQ ID NO: 3201960 - RNA, 21 nt, Mycobacterium bovis subsp bovis AF2122/97
gaccuagcagggugccggcgc

SEQ ID NO: 3201961 - RNA, 15 nt, Mycobacterium bovis subsp bovis AF2122/97
gaccuagucaccuug

SEQ ID NO: 3201962 - RNA, 15 nt, Mycobacterium bovis subsp bovis AF2122/97
gaccuaucagaacuu

SEQ ID NO: 3201963 - RNA, 19 nt, Mycobacterium bovis subsp bovis AF2122/97
gaccuauuggucgcucgcg

SEQ ID NO: 3201964 - RNA, 18 nt, Mycobacterium bovis subsp bovis AF2122/97
gaccucaauuggcucggc

SEQ ID NO: 3201965 - RNA, 21 nt, Mycobacterium bovis subsp bovis AF2122/97
gaccucaauuggcucggcguc

SEQ ID NO: 3201966 - RNA, 16 nt, Mycobacterium bovis subsp bovis AF2122/97
gaccucacgggcgccg

SEQ ID NO: 3201967 - RNA, 14 nt, Mycobacterium bovis subsp bovis AF2122/97
gaccuccaccaaug

SEQ ID NO: 3201968 - RNA, 15 nt, Mycobacterium bovis subsp bovis AF2122/97
gaccuccacgcgcca

SEQ ID NO: 3201969 - RNA, 16 nt, Mycobacterium bovis subsp bovis AF2122/97
gaccucccacccccgg

SEQ ID NO: 3201970 - RNA, 19 nt, Mycobacterium bovis subsp bovis AF2122/97
gaccuccggaaucgcccgg

SEQ ID NO: 3201971 - RNA, 20 nt, Mycobacterium bovis subsp bovis AF2122/97
gaccuccggaaucgcccggg

SEQ ID NO: 3201972 - RNA, 22 nt, Mycobacterium bovis subsp bovis AF2122/97
gaccuccggauaacccagcggc

SEQ ID NO: 3201973 - RNA, 23 nt, Mycobacterium bovis subsp bovis AF2122/97
gaccuccggauaacccagcggcg

SEQ ID NO: 3201974 - RNA, 22 nt, Mycobacterium bovis subsp bovis AF2122/97
gaccuccucgaccagagccgcg

SEQ ID NO: 3201975 - RNA, 17 nt, Mycobacterium bovis subsp bovis AF2122/97
gaccucgaagcccagca

SEQ ID NO: 3201976 - RNA, 20 nt, Mycobacterium bovis subsp bovis AF2122/97
gaccucgaagcccagcacca

SEQ ID NO: 3201977 - RNA, 23 nt, Mycobacterium bovis subsp bovis AF2122/97
gaccucgaccuggaugggcucga

SEQ ID NO: 3201978 - RNA, 11 nt, Mycobacterium bovis subsp bovis AF2122/97
gaccucgacgu

SEQ ID NO: 3201979 - RNA, 16 nt, Mycobacterium bovis subsp bovis AF2122/97
gaccucgacguugggc

SEQ ID NO: 3201980 - RNA, 16 nt, Mycobacterium bovis subsp bovis AF2122/97
gaccucgccgcgcgug

SEQ ID NO: 3201981 - RNA, 17 nt, Mycobacterium bovis subsp bovis AF2122/97
gaccucgccgcgcguga

SEQ ID NO: 3201982 - RNA, 22 nt, Mycobacterium bovis subsp bovis AF2122/97
gaccucgccgcgcgugacagug

SEQ ID NO: 3201983 - RNA, 13 nt, Mycobacterium bovis subsp bovis AF2122/97
gaccucgccggug

SEQ ID NO: 3201984 - RNA, 14 nt, Mycobacterium bovis subsp bovis AF2122/97
gaccucgccgguga

SEQ ID NO: 3201985 - RNA, 18 nt, Mycobacterium bovis subsp bovis AF2122/97
gaccucgcggcgcugguu

SEQ ID NO: 3201986 - RNA, 19 nt, Mycobacterium bovis subsp bovis AF2122/97
gaccucgcgggcgaucggc

SEQ ID NO: 3201987 - RNA, 11 nt, Mycobacterium bovis subsp bovis AF2122/97
gaccucggcga

SEQ ID NO: 3201988 - RNA, 13 nt, Mycobacterium bovis subsp bovis AF2122/97
gaccucggcgauc

SEQ ID NO: 3201989 - RNA, 17 nt, Mycobacterium bovis subsp bovis AF2122/97
gaccucggcgaugucgc

SEQ ID NO: 3201990 - RNA, 18 nt, Mycobacterium bovis subsp bovis AF2122/97
gaccucggcgaugucgcg

SEQ ID NO: 3201991 - RNA, 15 nt, Mycobacterium bovis subsp bovis AF2122/97
gaccucggcggcggc

SEQ ID NO: 3201992 - RNA, 17 nt, Mycobacterium bovis subsp bovis AF2122/97
gaccucggcggcggcac

SEQ ID NO: 3201993 - RNA, 14 nt, Mycobacterium bovis subsp bovis AF2122/97
gaccucggcgguca

SEQ ID NO: 3201994 - RNA, 19 nt, Mycobacterium bovis subsp bovis AF2122/97
gaccucggcgugucugccc

SEQ ID NO: 3201995 - RNA, 16 nt, Mycobacterium bovis subsp bovis AF2122/97
gaccucgggaucggcg

SEQ ID NO: 3201996 - RNA, 20 nt, Mycobacterium bovis subsp bovis AF2122/97
gaccucgucaaucaccaccg

SEQ ID NO: 3201997 - RNA, 22 nt, Mycobacterium bovis subsp bovis AF2122/97
gaccucgucaaucaccaccgcc

SEQ ID NO: 3201998 - RNA, 22 nt, Mycobacterium bovis subsp bovis AF2122/97
gaccucgucaccggucagcgac

SEQ ID NO: 3201999 - RNA, 16 nt, Mycobacterium bovis subsp bovis AF2122/97
gaccucgucgaccggg

SEQ ID NO: 3202000 - RNA, 16 nt, Mycobacterium bovis subsp bovis AF2122/97
gaccucgucgcgucgc

SEQ ID NO: 3202001 - RNA, 20 nt, Mycobacterium bovis subsp bovis AF2122/97
gaccucgucgcgucgccaga

SEQ ID NO: 3202002 - RNA, 20 nt, Mycobacterium bovis subsp bovis AF2122/97
gaccucgucggccgacaccg

SEQ ID NO: 3202003 - RNA, 16 nt, Mycobacterium bovis subsp bovis AF2122/97
gaccucguucgucacc

SEQ ID NO: 3202004 - RNA, 19 nt, Mycobacterium bovis subsp bovis AF2122/97
gaccucucugcgccaggcg

SEQ ID NO: 3202005 - RNA, 20 nt, Mycobacterium bovis subsp bovis AF2122/97
gaccucucugcgccaggcgg

SEQ ID NO: 3202006 - RNA, 14 nt, Mycobacterium bovis subsp bovis AF2122/97
gaccugaccggugg

SEQ ID NO: 3202007 - RNA, 18 nt, Mycobacterium bovis subsp bovis AF2122/97
gaccugaccgguggccau

SEQ ID NO: 3202008 - RNA, 15 nt, Mycobacterium bovis subsp bovis AF2122/97
gaccugacuggucag

SEQ ID NO: 3202009 - RNA, 21 nt, Mycobacterium bovis subsp bovis AF2122/97
gaccugaggcaccucggccuu

SEQ ID NO: 3202010 - RNA, 21 nt, Mycobacterium bovis subsp bovis AF2122/97
gaccugauccggccgguuggc

SEQ ID NO: 3202011 - RNA, 24 nt, Mycobacterium bovis subsp bovis AF2122/97
gaccugaucgaguuccgcaucggc

SEQ ID NO: 3202012 - RNA, 21 nt, Mycobacterium bovis subsp bovis AF2122/97
gaccugaugagcucaccgggg

SEQ ID NO: 3202013 - RNA, 20 nt, Mycobacterium bovis subsp bovis AF2122/97
gaccugauggcgcugcaccg

SEQ ID NO: 3202014 - RNA, 14 nt, Mycobacterium bovis subsp bovis AF2122/97
gaccugcaagacgc

SEQ ID NO: 3202015 - RNA, 11 nt, Mycobacterium bovis subsp bovis AF2122/97
gaccugcagcg

SEQ ID NO: 3202016 - RNA, 21 nt, Mycobacterium bovis subsp bovis AF2122/97
gaccugcagcgcauccgguuu

SEQ ID NO: 3202017 - RNA, 14 nt, Mycobacterium bovis subsp bovis AF2122/97
gaccugcgccggug

SEQ ID NO: 3202018 - RNA, 13 nt, Mycobacterium bovis subsp bovis AF2122/97
gaccugcgggauc

SEQ ID NO: 3202019 - RNA, 16 nt, Mycobacterium bovis subsp bovis AF2122/97
gaccugcgggaucgcc

SEQ ID NO: 3202020 - RNA, 19 nt, Mycobacterium bovis subsp bovis AF2122/97
gaccugcucauccaccucg

SEQ ID NO: 3202021 - RNA, 13 nt, Mycobacterium bovis subsp bovis AF2122/97
gaccugcuggcgc

SEQ ID NO: 3202022 - RNA, 22 nt, Mycobacterium bovis subsp bovis AF2122/97
gaccuggacaaccucgucgauc

SEQ ID NO: 3202023 - RNA, 17 nt, Mycobacterium bovis subsp bovis AF2122/97
gaccuggacgcggccaa

SEQ ID NO: 3202024 - RNA, 17 nt, Mycobacterium bovis subsp bovis AF2122/97
gaccuggaugggcucga

SEQ ID NO: 3202025 - RNA, 11 nt, Mycobacterium bovis subsp bovis AF2122/97
gaccuggccac

SEQ ID NO: 3202026 - RNA, 12 nt, Mycobacterium bovis subsp bovis AF2122/97
gaccuggccacg

SEQ ID NO: 3202027 - RNA, 13 nt, Mycobacterium bovis subsp bovis AF2122/97
gaccuggccgccc

SEQ ID NO: 3202028 - RNA, 15 nt, Mycobacterium bovis subsp bovis AF2122/97
gaccuggccgcccgc

SEQ ID NO: 3202029 - RNA, 14 nt, Mycobacterium bovis subsp bovis AF2122/97
gaccuggccgucgc

SEQ ID NO: 3202030 - RNA, 17 nt, Mycobacterium bovis subsp bovis AF2122/97
gaccuggccgucgcugg

SEQ ID NO: 3202031 - RNA, 18 nt, Mycobacterium bovis subsp bovis AF2122/97
gaccuggccgucgcuggu

SEQ ID NO: 3202032 - RNA, 19 nt, Mycobacterium bovis subsp bovis AF2122/97
gaccuggccgucgcuggug

SEQ ID NO: 3202033 - RNA, 13 nt, Mycobacterium bovis subsp bovis AF2122/97
gaccuggcggcgg

SEQ ID NO: 3202034 - RNA, 13 nt, Mycobacterium bovis subsp bovis AF2122/97
gaccugggacagu

SEQ ID NO: 3202035 - RNA, 21 nt, Mycobacterium bovis subsp bovis AF2122/97
gaccugggcgacuaccggcuc

SEQ ID NO: 3202036 - RNA, 13 nt, Mycobacterium bovis subsp bovis AF2122/97
gaccugggcgccc

SEQ ID NO: 3202037 - RNA, 16 nt, Mycobacterium bovis subsp bovis AF2122/97
gaccuggguggcgucg

SEQ ID NO: 3202038 - RNA, 18 nt, Mycobacterium bovis subsp bovis AF2122/97
gaccugguucccgacguc

SEQ ID NO: 3202039 - RNA, 16 nt, Mycobacterium bovis subsp bovis AF2122/97
gaccugguugaccucg

SEQ ID NO: 3202040 - RNA, 18 nt, Mycobacterium bovis subsp bovis AF2122/97
gaccuguagaucagcagc

SEQ ID NO: 3202041 - RNA, 16 nt, Mycobacterium bovis subsp bovis AF2122/97
gaccuguaugccgcgg

SEQ ID NO: 3202042 - RNA, 13 nt, Mycobacterium bovis subsp bovis AF2122/97
gaccuguccggca

SEQ ID NO: 3202043 - RNA, 13 nt, Mycobacterium bovis subsp bovis AF2122/97
gaccuguccggua

SEQ ID NO: 3202044 - RNA, 16 nt, Mycobacterium bovis subsp bovis AF2122/97
gaccuucaccuggaag

SEQ ID NO: 3202045 - RNA, 15 nt, Mycobacterium bovis subsp bovis AF2122/97
gaccuucaugccgga

SEQ ID NO: 3202046 - RNA, 23 nt, Mycobacterium bovis subsp bovis AF2122/97
gaccuucaugccggacugcgauc

SEQ ID NO: 3202047 - RNA, 19 nt, Mycobacterium bovis subsp bovis AF2122/97
gaccuucgaguagggccau

SEQ ID NO: 3202048 - RNA, 20 nt, Mycobacterium bovis subsp bovis AF2122/97
gaccuucgcuauggcggcuu

SEQ ID NO: 3202049 - RNA, 19 nt, Mycobacterium bovis subsp bovis AF2122/97
gaccuucucgaugcugacg

SEQ ID NO: 3202050 - RNA, 19 nt, Mycobacterium bovis subsp bovis AF2122/97
gaccuucucgucggccagu

SEQ ID NO: 3202051 - RNA, 21 nt, Mycobacterium bovis subsp bovis AF2122/97
gaccuucucgucggccagugc

SEQ ID NO: 3202052 - RNA, 16 nt, Mycobacterium bovis subsp bovis AF2122/97
gaccuugacccgcaag

SEQ ID NO: 3202053 - RNA, 19 nt, Mycobacterium bovis subsp bovis AF2122/97
gaccuugaucgagcagggu

SEQ ID NO: 3202054 - RNA, 23 nt, Mycobacterium bovis subsp bovis AF2122/97
gaccuugaucgagcagggugacc

SEQ ID NO: 3202055 - RNA, 14 nt, Mycobacterium bovis subsp bovis AF2122/97
gaccuugcccugcg

SEQ ID NO: 3202056 - RNA, 22 nt, Mycobacterium bovis subsp bovis AF2122/97
gaccuuuucccgcaggcucacc

SEQ ID NO: 3202057 - RNA, 15 nt, Mycobacterium bovis subsp bovis AF2122/97
gacgaaacccgaaau

SEQ ID NO: 3202058 - RNA, 11 nt, Mycobacterium bovis subsp bovis AF2122/97
gacgaaacucu

SEQ ID NO: 3202059 - RNA, 18 nt, Mycobacterium bovis subsp bovis AF2122/97
gacgaaacucucccgguu

SEQ ID NO: 3202060 - RNA, 13 nt, Mycobacterium bovis subsp bovis AF2122/97
gacgaaauccgcc

SEQ ID NO: 3202061 - RNA, 14 nt, Mycobacterium bovis subsp bovis AF2122/97
gacgaaauccgccg

SEQ ID NO: 3202062 - RNA, 18 nt, Mycobacterium bovis subsp bovis AF2122/97
gacgaaauccgccgggcg

SEQ ID NO: 3202063 - RNA, 16 nt, Mycobacterium bovis subsp bovis AF2122/97
gacgaaaucggcggcg

SEQ ID NO: 3202064 - RNA, 22 nt, Mycobacterium bovis subsp bovis AF2122/97
gacgaaaucggcggcguccagc

SEQ ID NO: 3202065 - RNA, 18 nt, Mycobacterium bovis subsp bovis AF2122/97
gacgaacaacgcgacgaa

SEQ ID NO: 3202066 - RNA, 14 nt, Mycobacterium bovis subsp bovis AF2122/97
gacgaacacaccgg

SEQ ID NO: 3202067 - RNA, 14 nt, Mycobacterium bovis subsp bovis AF2122/97
gacgaacaccagcg

SEQ ID NO: 3202068 - RNA, 23 nt, Mycobacterium bovis subsp bovis AF2122/97
gacgaacaccccgggcgccgauc

SEQ ID NO: 3202069 - RNA, 14 nt, Mycobacterium bovis subsp bovis AF2122/97
gacgaacaccucgg

SEQ ID NO: 3202070 - RNA, 19 nt, Mycobacterium bovis subsp bovis AF2122/97
gacgaacccaccgugccgg

SEQ ID NO: 3202071 - RNA, 18 nt, Mycobacterium bovis subsp bovis AF2122/97
gacgaacccgacaauggc

SEQ ID NO: 3202072 - RNA, 20 nt, Mycobacterium bovis subsp bovis AF2122/97
gacgaaccgccgacggcgcc

SEQ ID NO: 3202073 - RNA, 19 nt, Mycobacterium bovis subsp bovis AF2122/97
gacgaaccggaucaucgcc

SEQ ID NO: 3202074 - RNA, 15 nt, Mycobacterium bovis subsp bovis AF2122/97
gacgaacgaaccgcc

SEQ ID NO: 3202075 - RNA, 22 nt, Mycobacterium bovis subsp bovis AF2122/97
gacgaacgacggggcaaaggag

SEQ ID NO: 3202076 - RNA, 13 nt, Mycobacterium bovis subsp bovis AF2122/97
gacgaacgccguc

SEQ ID NO: 3202077 - RNA, 14 nt, Mycobacterium bovis subsp bovis AF2122/97
gacgaacgcgccgg

SEQ ID NO: 3202078 - RNA, 15 nt, Mycobacterium bovis subsp bovis AF2122/97
gacgaacucgccguc

SEQ ID NO: 3202079 - RNA, 14 nt, Mycobacterium bovis subsp bovis AF2122/97
gacgaacugcagcc

SEQ ID NO: 3202080 - RNA, 14 nt, Mycobacterium bovis subsp bovis AF2122/97
gacgaacuggucuc

SEQ ID NO: 3202081 - RNA, 23 nt, Mycobacterium bovis subsp bovis AF2122/97
gacgaagaucgcgugccacagca

SEQ ID NO: 3202082 - RNA, 22 nt, Mycobacterium bovis subsp bovis AF2122/97
gacgaagaucuucaccggccgg

SEQ ID NO: 3202083 - RNA, 22 nt, Mycobacterium bovis subsp bovis AF2122/97
gacgaaggauucgaagccgagc

SEQ ID NO: 3202084 - RNA, 14 nt, Mycobacterium bovis subsp bovis AF2122/97
gacgaaggcgacgg

SEQ ID NO: 3202085 - RNA, 17 nt, Mycobacterium bovis subsp bovis AF2122/97
gacgaaggucuccggca

SEQ ID NO: 3202086 - RNA, 18 nt, Mycobacterium bovis subsp bovis AF2122/97
gacgaauccacuggucaa

SEQ ID NO: 3202087 - RNA, 12 nt, Mycobacterium bovis subsp bovis AF2122/97
gacgaaucccgc

SEQ ID NO: 3202088 - RNA, 22 nt, Mycobacterium bovis subsp bovis AF2122/97
gacgaaucccgcgcccggccgg

SEQ ID NO: 3202089 - RNA, 15 nt, Mycobacterium bovis subsp bovis AF2122/97
gacgaauuggcccga

SEQ ID NO: 3202090 - RNA, 17 nt, Mycobacterium bovis subsp bovis AF2122/97
gacgaauugguugcccu

SEQ ID NO: 3202091 - RNA, 15 nt, Mycobacterium bovis subsp bovis AF2122/97
gacgacaaacggcga

SEQ ID NO: 3202092 - RNA, 20 nt, Mycobacterium bovis subsp bovis AF2122/97
gacgacaaacggcgacccag

SEQ ID NO: 3202093 - RNA, 17 nt, Mycobacterium bovis subsp bovis AF2122/97
gacgacaaccggccaga

SEQ ID NO: 3202094 - RNA, 23 nt, Mycobacterium bovis subsp bovis AF2122/97
gacgacaaccggccagauggugg

SEQ ID NO: 3202095 - RNA, 21 nt, Mycobacterium bovis subsp bovis AF2122/97
gacgacaagugcccggccaac

SEQ ID NO: 3202096 - RNA, 15 nt, Mycobacterium bovis subsp bovis AF2122/97
gacgacaaucgggac

SEQ ID NO: 3202097 - RNA, 16 nt, Mycobacterium bovis subsp bovis AF2122/97
gacgacaucugcccag

SEQ ID NO: 3202098 - RNA, 17 nt, Mycobacterium bovis subsp bovis AF2122/97
gacgacauugggcgcgg

SEQ ID NO: 3202099 - RNA, 19 nt, Mycobacterium bovis subsp bovis AF2122/97
gacgacauuggugcugaca

SEQ ID NO: 3202100 - RNA, 14 nt, Mycobacterium bovis subsp bovis AF2122/97
gacgaccacgucga

SEQ ID NO: 3202101 - RNA, 13 nt, Mycobacterium bovis subsp bovis AF2122/97
gacgaccagcaga

SEQ ID NO: 3202102 - RNA, 15 nt, Mycobacterium bovis subsp bovis AF2122/97
gacgaccagcagauc

SEQ ID NO: 3202103 - RNA, 22 nt, Mycobacterium bovis subsp bovis AF2122/97
gacgaccagcagauccaggcgu

SEQ ID NO: 3202104 - RNA, 16 nt, Mycobacterium bovis subsp bovis AF2122/97
gacgaccagccccgcu

SEQ ID NO: 3202105 - RNA, 20 nt, Mycobacterium bovis subsp bovis AF2122/97
gacgaccccggugagcucuu

SEQ ID NO: 3202106 - RNA, 17 nt, Mycobacterium bovis subsp bovis AF2122/97
gacgacccgggucggca

SEQ ID NO: 3202107 - RNA, 18 nt, Mycobacterium bovis subsp bovis AF2122/97
gacgacccgggucggcac

SEQ ID NO: 3202108 - RNA, 20 nt, Mycobacterium bovis subsp bovis AF2122/97
gacgacccgguuguguuggg

SEQ ID NO: 3202109 - RNA, 20 nt, Mycobacterium bovis subsp bovis AF2122/97
gacgaccgcauugaacagcg

SEQ ID NO: 3202110 - RNA, 16 nt, Mycobacterium bovis subsp bovis AF2122/97
gacgaccgcgcggcac

SEQ ID NO: 3202111 - RNA, 17 nt, Mycobacterium bovis subsp bovis AF2122/97
gacgaccgcgcggcacu

SEQ ID NO: 3202112 - RNA, 18 nt, Mycobacterium bovis subsp bovis AF2122/97
gacgaccggcuaccggcg

SEQ ID NO: 3202113 - RNA, 22 nt, Mycobacterium bovis subsp bovis AF2122/97
gacgaccgucacaagucgacac

SEQ ID NO: 3202114 - RNA, 14 nt, Mycobacterium bovis subsp bovis AF2122/97
gacgaccgucggcu

SEQ ID NO: 3202115 - RNA, 15 nt, Mycobacterium bovis subsp bovis AF2122/97
gacgaccgucggcuc

SEQ ID NO: 3202116 - RNA, 14 nt, Mycobacterium bovis subsp bovis AF2122/97
gacgaccgugcugg

SEQ ID NO: 3202117 - RNA, 23 nt, Mycobacterium bovis subsp bovis AF2122/97
gacgaccgugcugggcgccgcgc

SEQ ID NO: 3202118 - RNA, 18 nt, Mycobacterium bovis subsp bovis AF2122/97
gacgaccuccucgaugac

SEQ ID NO: 3202119 - RNA, 23 nt, Mycobacterium bovis subsp bovis AF2122/97
gacgaccuugguguggggcggcu

SEQ ID NO: 3202120 - RNA, 12 nt, Mycobacterium bovis subsp bovis AF2122/97
gacgacgaccgg

SEQ ID NO: 3202121 - RNA, 13 nt, Mycobacterium bovis subsp bovis AF2122/97
gacgacgaccggc

SEQ ID NO: 3202122 - RNA, 16 nt, Mycobacterium bovis subsp bovis AF2122/97
gacgacgagggccagc

SEQ ID NO: 3202123 - RNA, 12 nt, Mycobacterium bovis subsp bovis AF2122/97
gacgacgaucgc

SEQ ID NO: 3202124 - RNA, 19 nt, Mycobacterium bovis subsp bovis AF2122/97
gacgacgaugaugccgucg

SEQ ID NO: 3202125 - RNA, 11 nt, Mycobacterium bovis subsp bovis AF2122/97
gacgacgccaa

SEQ ID NO: 3202126 - RNA, 19 nt, Mycobacterium bovis subsp bovis AF2122/97
gacgacgccaaugccgcgg

SEQ ID NO: 3202127 - RNA, 14 nt, Mycobacterium bovis subsp bovis AF2122/97
gacgacgccgacga

SEQ ID NO: 3202128 - RNA, 15 nt, Mycobacterium bovis subsp bovis AF2122/97
gacgacgccgacgau

SEQ ID NO: 3202129 - RNA, 13 nt, Mycobacterium bovis subsp bovis AF2122/97
gacgacgccgucg

SEQ ID NO: 3202130 - RNA, 15 nt, Mycobacterium bovis subsp bovis AF2122/97
gacgacggcaccgau

SEQ ID NO: 3202131 - RNA, 22 nt, Mycobacterium bovis subsp bovis AF2122/97
gacgacggcauuucagcgcgcc

SEQ ID NO: 3202132 - RNA, 14 nt, Mycobacterium bovis subsp bovis AF2122/97
gacgacgggcgcca

SEQ ID NO: 3202133 - RNA, 18 nt, Mycobacterium bovis subsp bovis AF2122/97
gacgacgggcgccaacgg

SEQ ID NO: 3202134 - RNA, 19 nt, Mycobacterium bovis subsp bovis AF2122/97
gacgacggguuggcgucgc

SEQ ID NO: 3202135 - RNA, 19 nt, Mycobacterium bovis subsp bovis AF2122/97
gacgacguccucgacgauc

SEQ ID NO: 3202136 - RNA, 17 nt, Mycobacterium bovis subsp bovis AF2122/97
gacgacgucgccgccgc

SEQ ID NO: 3202137 - RNA, 19 nt, Mycobacterium bovis subsp bovis AF2122/97
gacgacgucgccgccgcgg

SEQ ID NO: 3202138 - RNA, 16 nt, Mycobacterium bovis subsp bovis AF2122/97
gacgacgucgcgcauc

SEQ ID NO: 3202139 - RNA, 16 nt, Mycobacterium bovis subsp bovis AF2122/97
gacgacgucgggggcu

SEQ ID NO: 3202140 - RNA, 16 nt, Mycobacterium bovis subsp bovis AF2122/97
gacgacguggcugcgu

SEQ ID NO: 3202141 - RNA, 18 nt, Mycobacterium bovis subsp bovis AF2122/97
gacgacuggaaggcgggc

SEQ ID NO: 3202142 - RNA, 20 nt, Mycobacterium bovis subsp bovis AF2122/97
gacgacuggaaggcgggcag

SEQ ID NO: 3202143 - RNA, 18 nt, Mycobacterium bovis subsp bovis AF2122/97
gacgacugggcgcccaag

SEQ ID NO: 3202144 - RNA, 16 nt, Mycobacterium bovis subsp bovis AF2122/97
gacgagaagacaccgc

SEQ ID NO: 3202145 - RNA, 16 nt, Mycobacterium bovis subsp bovis AF2122/97
gacgagacgaaccgcc

SEQ ID NO: 3202146 - RNA, 19 nt, Mycobacterium bovis subsp bovis AF2122/97
gacgagauacggccaccag

SEQ ID NO: 3202147 - RNA, 20 nt, Mycobacterium bovis subsp bovis AF2122/97
gacgagauacggccaccagg

SEQ ID NO: 3202148 - RNA, 19 nt, Mycobacterium bovis subsp bovis AF2122/97
gacgagaucugcgaugggg

SEQ ID NO: 3202149 - RNA, 22 nt, Mycobacterium bovis subsp bovis AF2122/97
gacgagauugccgggccgccga

SEQ ID NO: 3202150 - RNA, 23 nt, Mycobacterium bovis subsp bovis AF2122/97
gacgagauugccgggccgccgag

SEQ ID NO: 3202151 - RNA, 19 nt, Mycobacterium bovis subsp bovis AF2122/97
gacgagcacaugcucgacg

SEQ ID NO: 3202152 - RNA, 14 nt, Mycobacterium bovis subsp bovis AF2122/97
gacgagcaccgcgc

SEQ ID NO: 3202153 - RNA, 19 nt, Mycobacterium bovis subsp bovis AF2122/97
gacgagcaccgcgccgcgc

SEQ ID NO: 3202154 - RNA, 14 nt, Mycobacterium bovis subsp bovis AF2122/97
gacgagcacgccga

SEQ ID NO: 3202155 - RNA, 16 nt, Mycobacterium bovis subsp bovis AF2122/97
gacgagcacgccgacc

SEQ ID NO: 3202156 - RNA, 23 nt, Mycobacterium bovis subsp bovis AF2122/97
gacgagcagcuagcccggcagca

SEQ ID NO: 3202157 - RNA, 19 nt, Mycobacterium bovis subsp bovis AF2122/97
gacgagcaucuucgcgcag

SEQ ID NO: 3202158 - RNA, 12 nt, Mycobacterium bovis subsp bovis AF2122/97
gacgagccacca

SEQ ID NO: 3202159 - RNA, 12 nt, Mycobacterium bovis subsp bovis AF2122/97
gacgagccacgg

SEQ ID NO: 3202160 - RNA, 20 nt, Mycobacterium bovis subsp bovis AF2122/97
gacgagccacggcuucgccg

SEQ ID NO: 3202161 - RNA, 17 nt, Mycobacterium bovis subsp bovis AF2122/97
gacgagccagaggugga

SEQ ID NO: 3202162 - RNA, 16 nt, Mycobacterium bovis subsp bovis AF2122/97
gacgagccgagccucg

SEQ ID NO: 3202163 - RNA, 17 nt, Mycobacterium bovis subsp bovis AF2122/97
gacgagccgagccucgc

SEQ ID NO: 3202164 - RNA, 22 nt, Mycobacterium bovis subsp bovis AF2122/97
gacgagccgcggucggcgugca

SEQ ID NO: 3202165 - RNA, 19 nt, Mycobacterium bovis subsp bovis AF2122/97
gacgagcgucagauccggc

SEQ ID NO: 3202166 - RNA, 15 nt, Mycobacterium bovis subsp bovis AF2122/97
gacgaggaugucgau

SEQ ID NO: 3202167 - RNA, 19 nt, Mycobacterium bovis subsp bovis AF2122/97
gacgaggaugucgaugacc

SEQ ID NO: 3202168 - RNA, 18 nt, Mycobacterium bovis subsp bovis AF2122/97
gacgaggcgagcggccag

SEQ ID NO: 3202169 - RNA, 23 nt, Mycobacterium bovis subsp bovis AF2122/97
gacgagucgccgcgggcagcgaa

SEQ ID NO: 3202170 - RNA, 13 nt, Mycobacterium bovis subsp bovis AF2122/97
gacgagucggcgg

SEQ ID NO: 3202171 - RNA, 15 nt, Mycobacterium bovis subsp bovis AF2122/97
gacgagucggcgggc

SEQ ID NO: 3202172 - RNA, 21 nt, Mycobacterium bovis subsp bovis AF2122/97
gacgagugguccggcggccgg

SEQ ID NO: 3202173 - RNA, 16 nt, Mycobacterium bovis subsp bovis AF2122/97
gacgaguucgcugacc

SEQ ID NO: 3202174 - RNA, 21 nt, Mycobacterium bovis subsp bovis AF2122/97
gacgaucaacggaacaucguc

SEQ ID NO: 3202175 - RNA, 16 nt, Mycobacterium bovis subsp bovis AF2122/97
gacgaucaagccuucg

SEQ ID NO: 3202176 - RNA, 14 nt, Mycobacterium bovis subsp bovis AF2122/97
gacgaucaagcugg

SEQ ID NO: 3202177 - RNA, 14 nt, Mycobacterium bovis subsp bovis AF2122/97
gacgaucagcacgu

SEQ ID NO: 3202178 - RNA, 16 nt, Mycobacterium bovis subsp bovis AF2122/97
gacgaucaggccgucg

SEQ ID NO: 3202179 - RNA, 20 nt, Mycobacterium bovis subsp bovis AF2122/97
gacgaucaggccgucgccgg

SEQ ID NO: 3202180 - RNA, 23 nt, Mycobacterium bovis subsp bovis AF2122/97
gacgaucaggccgucgccggagu

SEQ ID NO: 3202181 - RNA, 18 nt, Mycobacterium bovis subsp bovis AF2122/97
gacgaucaggucgccgag

SEQ ID NO: 3202182 - RNA, 20 nt, Mycobacterium bovis subsp bovis AF2122/97
gacgaucaggucgccgagac

SEQ ID NO: 3202183 - RNA, 20 nt, Mycobacterium bovis subsp bovis AF2122/97
gacgaucauauggccgccga

SEQ ID NO: 3202184 - RNA, 17 nt, Mycobacterium bovis subsp bovis AF2122/97
gacgauccacggcgaug

SEQ ID NO: 3202185 - RNA, 14 nt, Mycobacterium bovis subsp bovis AF2122/97
gacgaucgacagcc

SEQ ID NO: 3202186 - RNA, 12 nt, Mycobacterium bovis subsp bovis AF2122/97
gacgaucgacgc

SEQ ID NO: 3202187 - RNA, 16 nt, Mycobacterium bovis subsp bovis AF2122/97
gacgaucgacgccgcc

SEQ ID NO: 3202188 - RNA, 12 nt, Mycobacterium bovis subsp bovis AF2122/97
gacgaucgccag

SEQ ID NO: 3202189 - RNA, 19 nt, Mycobacterium bovis subsp bovis AF2122/97
gacgaucgcggcgggcccg

SEQ ID NO: 3202190 - RNA, 23 nt, Mycobacterium bovis subsp bovis AF2122/97
gacgaucgcgucgggcucggcga

SEQ ID NO: 3202191 - RNA, 14 nt, Mycobacterium bovis subsp bovis AF2122/97
gacgaucggcggcg

SEQ ID NO: 3202192 - RNA, 15 nt, Mycobacterium bovis subsp bovis AF2122/97
gacgaucggcggcgc

SEQ ID NO: 3202193 - RNA, 18 nt, Mycobacterium bovis subsp bovis AF2122/97
gacgaucguagccguagc

SEQ ID NO: 3202194 - RNA, 23 nt, Mycobacterium bovis subsp bovis AF2122/97
gacgaucuccacccgccggccgu

SEQ ID NO: 3202195 - RNA, 16 nt, Mycobacterium bovis subsp bovis AF2122/97
gacgaucuccgccaac

SEQ ID NO: 3202196 - RNA, 18 nt, Mycobacterium bovis subsp bovis AF2122/97
gacgaucucgccgccagc

SEQ ID NO: 3202197 - RNA, 20 nt, Mycobacterium bovis subsp bovis AF2122/97
gacgaucucgccggcgaaga

SEQ ID NO: 3202198 - RNA, 23 nt, Mycobacterium bovis subsp bovis AF2122/97
gacgaucugcagcacucgguguc

SEQ ID NO: 3202199 - RNA, 16 nt, Mycobacterium bovis subsp bovis AF2122/97
gacgaugaaccgggca

SEQ ID NO: 3202200 - RNA, 19 nt, Mycobacterium bovis subsp bovis AF2122/97
gacgaugaaccgggcagca

SEQ ID NO: 3202201 - RNA, 21 nt, Mycobacterium bovis subsp bovis AF2122/97
gacgaugacagacaucgcgac

SEQ ID NO: 3202202 - RNA, 23 nt, Mycobacterium bovis subsp bovis AF2122/97
gacgaugacagacaucgcgacga

SEQ ID NO: 3202203 - RNA, 16 nt, Mycobacterium bovis subsp bovis AF2122/97
gacgaugaugccgucg

SEQ ID NO: 3202204 - RNA, 21 nt, Mycobacterium bovis subsp bovis AF2122/97
gacgaugaugccgucgucguc

SEQ ID NO: 3202205 - RNA, 13 nt, Mycobacterium bovis subsp bovis AF2122/97
gacgaugccccgg

SEQ ID NO: 3202206 - RNA, 16 nt, Mycobacterium bovis subsp bovis AF2122/97
gacgaugccgccgaag

SEQ ID NO: 3202207 - RNA, 17 nt, Mycobacterium bovis subsp bovis AF2122/97
gacgaugccucggcggc

SEQ ID NO: 3202208 - RNA, 21 nt, Mycobacterium bovis subsp bovis AF2122/97
gacgaugccucggcggccucg

SEQ ID NO: 3202209 - RNA, 20 nt, Mycobacterium bovis subsp bovis AF2122/97
gacgaugcggucaacgcuga

SEQ ID NO: 3202210 - RNA, 23 nt, Mycobacterium bovis subsp bovis AF2122/97
gacgaugcggucaacgcugacgu

SEQ ID NO: 3202211 - RNA, 21 nt, Mycobacterium bovis subsp bovis AF2122/97
gacgaugcggucgacgggcuc

SEQ ID NO: 3202212 - RNA, 14 nt, Mycobacterium bovis subsp bovis AF2122/97
gacgauggccgccg

SEQ ID NO: 3202213 - RNA, 20 nt, Mycobacterium bovis subsp bovis AF2122/97
gacgauggccgccgcgagga

SEQ ID NO: 3202214 - RNA, 17 nt, Mycobacterium bovis subsp bovis AF2122/97
gacgauggcgucggcca

SEQ ID NO: 3202215 - RNA, 14 nt, Mycobacterium bovis subsp bovis AF2122/97
gacgauuaccagcg

SEQ ID NO: 3202216 - RNA, 22 nt, Mycobacterium bovis subsp bovis AF2122/97
gacgauuaccagcggcaccgcg

SEQ ID NO: 3202217 - RNA, 21 nt, Mycobacterium bovis subsp bovis AF2122/97
gacgauuccgcgcgggaaacg

SEQ ID NO: 3202218 - RNA, 14 nt, Mycobacterium bovis subsp bovis AF2122/97
gacgauucggcggc

SEQ ID NO: 3202219 - RNA, 15 nt, Mycobacterium bovis subsp bovis AF2122/97
gacgauucucgaguc

SEQ ID NO: 3202220 - RNA, 14 nt, Mycobacterium bovis subsp bovis AF2122/97
gacgauugccacca

SEQ ID NO: 3202221 - RNA, 17 nt, Mycobacterium bovis subsp bovis AF2122/97
gacgcaaaagcccccua

SEQ ID NO: 3202222 - RNA, 19 nt, Mycobacterium bovis subsp bovis AF2122/97
gacgcaaaagcuccuaaau

SEQ ID NO: 3202223 - RNA, 20 nt, Mycobacterium bovis subsp bovis AF2122/97
gacgcaaaaucgcccgaaaa

SEQ ID NO: 3202224 - RNA, 14 nt, Mycobacterium bovis subsp bovis AF2122/97
gacgcaaagcagcg

SEQ ID NO: 3202225 - RNA, 23 nt, Mycobacterium bovis subsp bovis AF2122/97
gacgcaacaucggaugaccagug

SEQ ID NO: 3202226 - RNA, 15 nt, Mycobacterium bovis subsp bovis AF2122/97
gacgcacagcagcac

SEQ ID NO: 3202227 - RNA, 18 nt, Mycobacterium bovis subsp bovis AF2122/97
gacgcacagcagcaccgc

SEQ ID NO: 3202228 - RNA, 20 nt, Mycobacterium bovis subsp bovis AF2122/97
gacgcaccuauggucaaccg

SEQ ID NO: 3202229 - RNA, 22 nt, Mycobacterium bovis subsp bovis AF2122/97
gacgcaccuauggucaaccgcg

SEQ ID NO: 3202230 - RNA, 23 nt, Mycobacterium bovis subsp bovis AF2122/97
gacgcaccuauggucaaccgcgc

SEQ ID NO: 3202231 - RNA, 19 nt, Mycobacterium bovis subsp bovis AF2122/97
gacgcacgacugugcgccg

SEQ ID NO: 3202232 - RNA, 14 nt, Mycobacterium bovis subsp bovis AF2122/97
gacgcacgauccgc

SEQ ID NO: 3202233 - RNA, 15 nt, Mycobacterium bovis subsp bovis AF2122/97
gacgcacgauccgca

SEQ ID NO: 3202234 - RNA, 15 nt, Mycobacterium bovis subsp bovis AF2122/97
gacgcacggccaccg

SEQ ID NO: 3202235 - RNA, 16 nt, Mycobacterium bovis subsp bovis AF2122/97
gacgcacggccaccgc

SEQ ID NO: 3202236 - RNA, 17 nt, Mycobacterium bovis subsp bovis AF2122/97
gacgcacggccaccgcg

SEQ ID NO: 3202237 - RNA, 16 nt, Mycobacterium bovis subsp bovis AF2122/97
gacgcacugccccgca

SEQ ID NO: 3202238 - RNA, 18 nt, Mycobacterium bovis subsp bovis AF2122/97
gacgcacugccccgcauc

SEQ ID NO: 3202239 - RNA, 19 nt, Mycobacterium bovis subsp bovis AF2122/97
gacgcacugccccgcaucg

SEQ ID NO: 3202240 - RNA, 13 nt, Mycobacterium bovis subsp bovis AF2122/97
gacgcagaagccc

SEQ ID NO: 3202241 - RNA, 17 nt, Mycobacterium bovis subsp bovis AF2122/97
gacgcagaagcccccaa

SEQ ID NO: 3202242 - RNA, 15 nt, Mycobacterium bovis subsp bovis AF2122/97
gacgcagaaucgcac

SEQ ID NO: 3202243 - RNA, 21 nt, Mycobacterium bovis subsp bovis AF2122/97
gacgcagaaucgcacgcgaaa

SEQ ID NO: 3202244 - RNA, 16 nt, Mycobacterium bovis subsp bovis AF2122/97
gacgcagagucaacag

SEQ ID NO: 3202245 - RNA, 21 nt, Mycobacterium bovis subsp bovis AF2122/97
gacgcagagucgcacugcgcc

SEQ ID NO: 3202246 - RNA, 24 nt, Mycobacterium bovis subsp bovis AF2122/97
gacgcagagucgcacugcgccggc

SEQ ID NO: 3202247 - RNA, 12 nt, Mycobacterium bovis subsp bovis AF2122/97
gacgcagcccgc

SEQ ID NO: 3202248 - RNA, 12 nt, Mycobacterium bovis subsp bovis AF2122/97
gacgcagcucgu

SEQ ID NO: 3202249 - RNA, 18 nt, Mycobacterium bovis subsp bovis AF2122/97
gacgcagcuugcccgacg

SEQ ID NO: 3202250 - RNA, 21 nt, Mycobacterium bovis subsp bovis AF2122/97
gacgcagcuugcccgacggcg

SEQ ID NO: 3202251 - RNA, 20 nt, Mycobacterium bovis subsp bovis AF2122/97
gacgcaggaucacacuggcc

SEQ ID NO: 3202252 - RNA, 21 nt, Mycobacterium bovis subsp bovis AF2122/97
gacgcaggaucacacuggccu

SEQ ID NO: 3202253 - RNA, 16 nt, Mycobacterium bovis subsp bovis AF2122/97
gacgcagugcccgauc

SEQ ID NO: 3202254 - RNA, 17 nt, Mycobacterium bovis subsp bovis AF2122/97
gacgcauaagcccccgc

SEQ ID NO: 3202255 - RNA, 17 nt, Mycobacterium bovis subsp bovis AF2122/97
gacgcaugggucauggc

SEQ ID NO: 3202256 - RNA, 21 nt, Mycobacterium bovis subsp bovis AF2122/97
gacgcaugucgggccaggcga

SEQ ID NO: 3202257 - RNA, 19 nt, Mycobacterium bovis subsp bovis AF2122/97
gacgccaacgugacgccgg

SEQ ID NO: 3202258 - RNA, 16 nt, Mycobacterium bovis subsp bovis AF2122/97
gacgccaaugccgcgg

SEQ ID NO: 3202259 - RNA, 21 nt, Mycobacterium bovis subsp bovis AF2122/97
gacgccaaugccgcggaggcg

SEQ ID NO: 3202260 - RNA, 18 nt, Mycobacterium bovis subsp bovis AF2122/97
gacgccaccgccaccacc

SEQ ID NO: 3202261 - RNA, 21 nt, Mycobacterium bovis subsp bovis AF2122/97
gacgccaccgccaccacccag

SEQ ID NO: 3202262 - RNA, 12 nt, Mycobacterium bovis subsp bovis AF2122/97
gacgccaccgcg

SEQ ID NO: 3202263 - RNA, 20 nt, Mycobacterium bovis subsp bovis AF2122/97
gacgccaccugacgugcggc

SEQ ID NO: 3202264 - RNA, 17 nt, Mycobacterium bovis subsp bovis AF2122/97
gacgccacgaccgccga

SEQ ID NO: 3202265 - RNA, 22 nt, Mycobacterium bovis subsp bovis AF2122/97
gacgccacgcgucuucggucgc

SEQ ID NO: 3202266 - RNA, 12 nt, Mycobacterium bovis subsp bovis AF2122/97
gacgccagaacg

SEQ ID NO: 3202267 - RNA, 19 nt, Mycobacterium bovis subsp bovis AF2122/97
gacgccagcaaugcccgca

SEQ ID NO: 3202268 - RNA, 20 nt, Mycobacterium bovis subsp bovis AF2122/97
gacgccagcaaugcccgcac

SEQ ID NO: 3202269 - RNA, 21 nt, Mycobacterium bovis subsp bovis AF2122/97
gacgccagcaaugcccgcacc

SEQ ID NO: 3202270 - RNA, 22 nt, Mycobacterium bovis subsp bovis AF2122/97
gacgccagcaaugcccgcaccg

SEQ ID NO: 3202271 - RNA, 15 nt, Mycobacterium bovis subsp bovis AF2122/97
gacgccagccuggcc

SEQ ID NO: 3202272 - RNA, 13 nt, Mycobacterium bovis subsp bovis AF2122/97
gacgccagcugcc

SEQ ID NO: 3202273 - RNA, 14 nt, Mycobacterium bovis subsp bovis AF2122/97
gacgccagcugccc

SEQ ID NO: 3202274 - RNA, 23 nt, Mycobacterium bovis subsp bovis AF2122/97
gacgccaguugcguuguccacca

SEQ ID NO: 3202275 - RNA, 19 nt, Mycobacterium bovis subsp bovis AF2122/97
gacgccaucugcuggcugg

SEQ ID NO: 3202276 - RNA, 20 nt, Mycobacterium bovis subsp bovis AF2122/97
gacgccaucugcuggcuggg

SEQ ID NO: 3202277 - RNA, 21 nt, Mycobacterium bovis subsp bovis AF2122/97
gacgccaucugcuggcuggga

SEQ ID NO: 3202278 - RNA, 14 nt, Mycobacterium bovis subsp bovis AF2122/97
gacgccaugagcgc

SEQ ID NO: 3202279 - RNA, 15 nt, Mycobacterium bovis subsp bovis AF2122/97
gacgccaugcccgca

SEQ ID NO: 3202280 - RNA, 22 nt, Mycobacterium bovis subsp bovis AF2122/97
gacgcccacaugcucagggcag

SEQ ID NO: 3202281 - RNA, 18 nt, Mycobacterium bovis subsp bovis AF2122/97
gacgcccaggcauggccu

SEQ ID NO: 3202282 - RNA, 16 nt, Mycobacterium bovis subsp bovis AF2122/97
gacgcccagggcgucg

SEQ ID NO: 3202283 - RNA, 23 nt, Mycobacterium bovis subsp bovis AF2122/97
gacgccccauucguaucccgcaa

SEQ ID NO: 3202284 - RNA, 14 nt, Mycobacterium bovis subsp bovis AF2122/97
gacgccccgaucgg

SEQ ID NO: 3202285 - RNA, 17 nt, Mycobacterium bovis subsp bovis AF2122/97
gacgccccgaucggcca

SEQ ID NO: 3202286 - RNA, 19 nt, Mycobacterium bovis subsp bovis AF2122/97
gacgccccgaucggccacc

SEQ ID NO: 3202287 - RNA, 13 nt, Mycobacterium bovis subsp bovis AF2122/97
gacgcccgccacc

SEQ ID NO: 3202288 - RNA, 14 nt, Mycobacterium bovis subsp bovis AF2122/97
gacgcccgccaccg

SEQ ID NO: 3202289 - RNA, 13 nt, Mycobacterium bovis subsp bovis AF2122/97
gacgcccgcccgc

SEQ ID NO: 3202290 - RNA, 16 nt, Mycobacterium bovis subsp bovis AF2122/97
gacgcccgcccgcacg

SEQ ID NO: 3202291 - RNA, 16 nt, Mycobacterium bovis subsp bovis AF2122/97
gacgcccgcuccgcgg

SEQ ID NO: 3202292 - RNA, 17 nt, Mycobacterium bovis subsp bovis AF2122/97
gacgcccggcgcaccau

SEQ ID NO: 3202293 - RNA, 16 nt, Mycobacterium bovis subsp bovis AF2122/97
gacgcccgugcggcuc

SEQ ID NO: 3202294 - RNA, 14 nt, Mycobacterium bovis subsp bovis AF2122/97
gacgcccucggcga

SEQ ID NO: 3202295 - RNA, 20 nt, Mycobacterium bovis subsp bovis AF2122/97
gacgcccucggcgaccuggc

SEQ ID NO: 3202296 - RNA, 22 nt, Mycobacterium bovis subsp bovis AF2122/97
gacgccgaaaaugccgcccagc

SEQ ID NO: 3202297 - RNA, 23 nt, Mycobacterium bovis subsp bovis AF2122/97
gacgccgaaaaugccgcccagcg

SEQ ID NO: 3202298 - RNA, 17 nt, Mycobacterium bovis subsp bovis AF2122/97
gacgccgaacgcgaggu

SEQ ID NO: 3202299 - RNA, 18 nt, Mycobacterium bovis subsp bovis AF2122/97
gacgccgagcugguugac

SEQ ID NO: 3202300 - RNA, 19 nt, Mycobacterium bovis subsp bovis AF2122/97
gacgccgaucgcggcggcc

SEQ ID NO: 3202301 - RNA, 17 nt, Mycobacterium bovis subsp bovis AF2122/97
gacgccgaugugcucgg

SEQ ID NO: 3202302 - RNA, 13 nt, Mycobacterium bovis subsp bovis AF2122/97
gacgccgccaccc

SEQ ID NO: 3202303 - RNA, 15 nt, Mycobacterium bovis subsp bovis AF2122/97
gacgccgccacccgg

SEQ ID NO: 3202304 - RNA, 14 nt, Mycobacterium bovis subsp bovis AF2122/97
gacgccgccagcac

SEQ ID NO: 3202305 - RNA, 16 nt, Mycobacterium bovis subsp bovis AF2122/97
gacgccgccgcugccg

SEQ ID NO: 3202306 - RNA, 12 nt, Mycobacterium bovis subsp bovis AF2122/97
gacgccgccggc

SEQ ID NO: 3202307 - RNA, 13 nt, Mycobacterium bovis subsp bovis AF2122/97
gacgccgccggca

SEQ ID NO: 3202308 - RNA, 16 nt, Mycobacterium bovis subsp bovis AF2122/97
gacgccgccggcaccg

SEQ ID NO: 3202309 - RNA, 14 nt, Mycobacterium bovis subsp bovis AF2122/97
gacgccgccggccc

SEQ ID NO: 3202310 - RNA, 16 nt, Mycobacterium bovis subsp bovis AF2122/97
gacgccgccggcgcca

SEQ ID NO: 3202311 - RNA, 19 nt, Mycobacterium bovis subsp bovis AF2122/97
gacgccgccggcgccaccg

SEQ ID NO: 3202312 - RNA, 20 nt, Mycobacterium bovis subsp bovis AF2122/97
gacgccgccggcgccaccgu

SEQ ID NO: 3202313 - RNA, 11 nt, Mycobacterium bovis subsp bovis AF2122/97
gacgccgccgu

SEQ ID NO: 3202314 - RNA, 15 nt, Mycobacterium bovis subsp bovis AF2122/97
gacgccgcgcagccg

SEQ ID NO: 3202315 - RNA, 23 nt, Mycobacterium bovis subsp bovis AF2122/97
gacgccgcgccgcagagcaccgc

SEQ ID NO: 3202316 - RNA, 15 nt, Mycobacterium bovis subsp bovis AF2122/97
gacgccgcggcgccg

SEQ ID NO: 3202317 - RNA, 15 nt, Mycobacterium bovis subsp bovis AF2122/97
gacgccgcggucgug

SEQ ID NO: 3202318 - RNA, 15 nt, Mycobacterium bovis subsp bovis AF2122/97
gacgccgcucccgca

SEQ ID NO: 3202319 - RNA, 16 nt, Mycobacterium bovis subsp bovis AF2122/97
gacgccgcucccgcac

SEQ ID NO: 3202320 - RNA, 21 nt, Mycobacterium bovis subsp bovis AF2122/97
gacgccgcucccgcacaagcc

SEQ ID NO: 3202321 - RNA, 23 nt, Mycobacterium bovis subsp bovis AF2122/97
gacgccgcuggagaucacgccga

SEQ ID NO: 3202322 - RNA, 15 nt, Mycobacterium bovis subsp bovis AF2122/97
gacgccggccagcgg

SEQ ID NO: 3202323 - RNA, 18 nt, Mycobacterium bovis subsp bovis AF2122/97
gacgccggccagcggcca

SEQ ID NO: 3202324 - RNA, 13 nt, Mycobacterium bovis subsp bovis AF2122/97
gacgccggccagu

SEQ ID NO: 3202325 - RNA, 14 nt, Mycobacterium bovis subsp bovis AF2122/97
gacgccggccuggc

SEQ ID NO: 3202326 - RNA, 15 nt, Mycobacterium bovis subsp bovis AF2122/97
gacgccggccuggcc

SEQ ID NO: 3202327 - RNA, 19 nt, Mycobacterium bovis subsp bovis AF2122/97
gacgccggccuggccgcca

SEQ ID NO: 3202328 - RNA, 21 nt, Mycobacterium bovis subsp bovis AF2122/97
gacgccggccuggccgccaga

SEQ ID NO: 3202329 - RNA, 14 nt, Mycobacterium bovis subsp bovis AF2122/97
gacgccggcgccgc

SEQ ID NO: 3202330 - RNA, 19 nt, Mycobacterium bovis subsp bovis AF2122/97
gacgccgguccccgccggc

SEQ ID NO: 3202331 - RNA, 12 nt, Mycobacterium bovis subsp bovis AF2122/97
gacgccgguggc

SEQ ID NO: 3202332 - RNA, 21 nt, Mycobacterium bovis subsp bovis AF2122/97
gacgccgguggcagagccgcc

SEQ ID NO: 3202333 - RNA, 23 nt, Mycobacterium bovis subsp bovis AF2122/97
gacgccgguggcagagccgccgu

SEQ ID NO: 3202334 - RNA, 18 nt, Mycobacterium bovis subsp bovis AF2122/97
gacgccguagccggccgg

SEQ ID NO: 3202335 - RNA, 21 nt, Mycobacterium bovis subsp bovis AF2122/97
gacgccguagccggccggccc

SEQ ID NO: 3202336 - RNA, 15 nt, Mycobacterium bovis subsp bovis AF2122/97
gacgccguaucggcg

SEQ ID NO: 3202337 - RNA, 12 nt, Mycobacterium bovis subsp bovis AF2122/97
gacgccgucagc

SEQ ID NO: 3202338 - RNA, 24 nt, Mycobacterium bovis subsp bovis AF2122/97
gacgccgucaugcccaucuccaac

SEQ ID NO: 3202339 - RNA, 16 nt, Mycobacterium bovis subsp bovis AF2122/97
gacgccgucgacgucg

SEQ ID NO: 3202340 - RNA, 17 nt, Mycobacterium bovis subsp bovis AF2122/97
gacgccgucgacgucga

SEQ ID NO: 3202341 - RNA, 23 nt, Mycobacterium bovis subsp bovis AF2122/97
gacgccgucgacgucgauggugc

SEQ ID NO: 3202342 - RNA, 20 nt, Mycobacterium bovis subsp bovis AF2122/97
gacgccgucggacaccgcau

SEQ ID NO: 3202343 - RNA, 21 nt, Mycobacterium bovis subsp bovis AF2122/97
gacgccgucggcgccggcauc

SEQ ID NO: 3202344 - RNA, 19 nt, Mycobacterium bovis subsp bovis AF2122/97
gacgccgucggcgcgcacc

SEQ ID NO: 3202345 - RNA, 15 nt, Mycobacterium bovis subsp bovis AF2122/97
gacgccguugccacc

SEQ ID NO: 3202346 - RNA, 16 nt, Mycobacterium bovis subsp bovis AF2122/97
gacgccguugccaccg

SEQ ID NO: 3202347 - RNA, 17 nt, Mycobacterium bovis subsp bovis AF2122/97
gacgccguugccaccgu

SEQ ID NO: 3202348 - RNA, 15 nt, Mycobacterium bovis subsp bovis AF2122/97
gacgccguugccgcc

SEQ ID NO: 3202349 - RNA, 17 nt, Mycobacterium bovis subsp bovis AF2122/97
gacgccguugccgccgu

SEQ ID NO: 3202350 - RNA, 19 nt, Mycobacterium bovis subsp bovis AF2122/97
gacgccuuccagcccgagc

SEQ ID NO: 3202351 - RNA, 17 nt, Mycobacterium bovis subsp bovis AF2122/97
gacgccuugaucggcga

SEQ ID NO: 3202352 - RNA, 15 nt, Mycobacterium bovis subsp bovis AF2122/97
gacgcgaaauccccc

SEQ ID NO: 3202353 - RNA, 21 nt, Mycobacterium bovis subsp bovis AF2122/97
gacgcgaaaucccccgacacg

SEQ ID NO: 3202354 - RNA, 16 nt, Mycobacterium bovis subsp bovis AF2122/97
gacgcgaacgcggcca

SEQ ID NO: 3202355 - RNA, 21 nt, Mycobacterium bovis subsp bovis AF2122/97
gacgcgacacacgccgccggu

SEQ ID NO: 3202356 - RNA, 22 nt, Mycobacterium bovis subsp bovis AF2122/97
gacgcgacacacgccgccggug

SEQ ID NO: 3202357 - RNA, 15 nt, Mycobacterium bovis subsp bovis AF2122/97
gacgcgacacgccga

SEQ ID NO: 3202358 - RNA, 14 nt, Mycobacterium bovis subsp bovis AF2122/97
gacgcgacgagccg

SEQ ID NO: 3202359 - RNA, 18 nt, Mycobacterium bovis subsp bovis AF2122/97
gacgcgaucuguccgcga

SEQ ID NO: 3202360 - RNA, 17 nt, Mycobacterium bovis subsp bovis AF2122/97
gacgcgaugaccgcacc

SEQ ID NO: 3202361 - RNA, 18 nt, Mycobacterium bovis subsp bovis AF2122/97
gacgcgaugaccgcaccg

SEQ ID NO: 3202362 - RNA, 19 nt, Mycobacterium bovis subsp bovis AF2122/97
gacgcgcaacgccgccagc

SEQ ID NO: 3202363 - RNA, 20 nt, Mycobacterium bovis subsp bovis AF2122/97
gacgcgcaacgccgccagcc

SEQ ID NO: 3202364 - RNA, 18 nt, Mycobacterium bovis subsp bovis AF2122/97
gacgcgcagcaucggcga

SEQ ID NO: 3202365 - RNA, 24 nt, Mycobacterium bovis subsp bovis AF2122/97
gacgcgcaggaagccggcgugcuc

SEQ ID NO: 3202366 - RNA, 15 nt, Mycobacterium bovis subsp bovis AF2122/97
gacgcgcaucgcacg

SEQ ID NO: 3202367 - RNA, 16 nt, Mycobacterium bovis subsp bovis AF2122/97
gacgcgcaugccccga

SEQ ID NO: 3202368 - RNA, 20 nt, Mycobacterium bovis subsp bovis AF2122/97
gacgcgcaugccccgaccgc

SEQ ID NO: 3202369 - RNA, 16 nt, Mycobacterium bovis subsp bovis AF2122/97
gacgcgcauucgccgg

SEQ ID NO: 3202370 - RNA, 22 nt, Mycobacterium bovis subsp bovis AF2122/97
gacgcgcauucgccgggcggca

SEQ ID NO: 3202371 - RNA, 13 nt, Mycobacterium bovis subsp bovis AF2122/97
gacgcgcccgacg

SEQ ID NO: 3202372 - RNA, 15 nt, Mycobacterium bovis subsp bovis AF2122/97
gacgcgccggcgugc

SEQ ID NO: 3202373 - RNA, 12 nt, Mycobacterium bovis subsp bovis AF2122/97
gacgcgccgguu

SEQ ID NO: 3202374 - RNA, 20 nt, Mycobacterium bovis subsp bovis AF2122/97
gacgcgccguaacagccggc

SEQ ID NO: 3202375 - RNA, 17 nt, Mycobacterium bovis subsp bovis AF2122/97
gacgcgcgagaacaccc

SEQ ID NO: 3202376 - RNA, 15 nt, Mycobacterium bovis subsp bovis AF2122/97
gacgcgcgcgaugga

SEQ ID NO: 3202377 - RNA, 22 nt, Mycobacterium bovis subsp bovis AF2122/97
gacgcgcgcuugggguugggcg

SEQ ID NO: 3202378 - RNA, 15 nt, Mycobacterium bovis subsp bovis AF2122/97
gacgcgcggauggcc

SEQ ID NO: 3202379 - RNA, 19 nt, Mycobacterium bovis subsp bovis AF2122/97
gacgcgcggauggccucgg

SEQ ID NO: 3202380 - RNA, 18 nt, Mycobacterium bovis subsp bovis AF2122/97
gacgcgcggauuucgccg

SEQ ID NO: 3202381 - RNA, 13 nt, Mycobacterium bovis subsp bovis AF2122/97
gacgcgcggccag

SEQ ID NO: 3202382 - RNA, 15 nt, Mycobacterium bovis subsp bovis AF2122/97
gacgcgcggccagcc

SEQ ID NO: 3202383 - RNA, 12 nt, Mycobacterium bovis subsp bovis AF2122/97
gacgcgcucgcg

SEQ ID NO: 3202384 - RNA, 13 nt, Mycobacterium bovis subsp bovis AF2122/97
gacgcgcucgcgc

SEQ ID NO: 3202385 - RNA, 12 nt, Mycobacterium bovis subsp bovis AF2122/97
gacgcgcucggc

SEQ ID NO: 3202386 - RNA, 19 nt, Mycobacterium bovis subsp bovis AF2122/97
gacgcggaaucgcaccgug

SEQ ID NO: 3202387 - RNA, 22 nt, Mycobacterium bovis subsp bovis AF2122/97
gacgcggaaucgcaucggcggg

SEQ ID NO: 3202388 - RNA, 15 nt, Mycobacterium bovis subsp bovis AF2122/97
gacgcggcaggccgg

SEQ ID NO: 3202389 - RNA, 16 nt, Mycobacterium bovis subsp bovis AF2122/97
gacgcggcaggccggu

SEQ ID NO: 3202390 - RNA, 22 nt, Mycobacterium bovis subsp bovis AF2122/97
gacgcggccaaauaacgcggga

SEQ ID NO: 3202391 - RNA, 20 nt, Mycobacterium bovis subsp bovis AF2122/97
gacgcggccaauggccgcgg

SEQ ID NO: 3202392 - RNA, 21 nt, Mycobacterium bovis subsp bovis AF2122/97
gacgcggccacauaccaccac

SEQ ID NO: 3202393 - RNA, 12 nt, Mycobacterium bovis subsp bovis AF2122/97
gacgcggccgag

SEQ ID NO: 3202394 - RNA, 16 nt, Mycobacterium bovis subsp bovis AF2122/97
gacgcggcgaccgucg

SEQ ID NO: 3202395 - RNA, 17 nt, Mycobacterium bovis subsp bovis AF2122/97
gacgcggcgaccgucga

SEQ ID NO: 3202396 - RNA, 14 nt, Mycobacterium bovis subsp bovis AF2122/97
gacgcggcgccgcc

SEQ ID NO: 3202397 - RNA, 22 nt, Mycobacterium bovis subsp bovis AF2122/97
gacgcggcgccgccaucaacaa

SEQ ID NO: 3202398 - RNA, 14 nt, Mycobacterium bovis subsp bovis AF2122/97
gacgcgggccgacc

SEQ ID NO: 3202399 - RNA, 15 nt, Mycobacterium bovis subsp bovis AF2122/97
gacgcgggccgacca

SEQ ID NO: 3202400 - RNA, 15 nt, Mycobacterium bovis subsp bovis AF2122/97
gacgcgggccgcgaa

SEQ ID NO: 3202401 - RNA, 17 nt, Mycobacterium bovis subsp bovis AF2122/97
gacgcgggccgcgaaac

SEQ ID NO: 3202402 - RNA, 19 nt, Mycobacterium bovis subsp bovis AF2122/97
gacgcgggcuaucgguuca

SEQ ID NO: 3202403 - RNA, 19 nt, Mycobacterium bovis subsp bovis AF2122/97
gacgcggggcucaaccccg

SEQ ID NO: 3202404 - RNA, 16 nt, Mycobacterium bovis subsp bovis AF2122/97
gacgcggucggcggcc

SEQ ID NO: 3202405 - RNA, 18 nt, Mycobacterium bovis subsp bovis AF2122/97
gacgcggucggcggccgc

SEQ ID NO: 3202406 - RNA, 17 nt, Mycobacterium bovis subsp bovis AF2122/97
gacgcguccggugcacc

SEQ ID NO: 3202407 - RNA, 14 nt, Mycobacterium bovis subsp bovis AF2122/97
gacgcgucgccggc

SEQ ID NO: 3202408 - RNA, 15 nt, Mycobacterium bovis subsp bovis AF2122/97
gacgcgucggcgacg

SEQ ID NO: 3202409 - RNA, 18 nt, Mycobacterium bovis subsp bovis AF2122/97
gacgcgucguggucggcg

SEQ ID NO: 3202410 - RNA, 16 nt, Mycobacterium bovis subsp bovis AF2122/97
gacgcgugucugggac

SEQ ID NO: 3202411 - RNA, 20 nt, Mycobacterium bovis subsp bovis AF2122/97
gacgcguucaacaccgccga

SEQ ID NO: 3202412 - RNA, 22 nt, Mycobacterium bovis subsp bovis AF2122/97
gacgcguucaacaccgccgacc

SEQ ID NO: 3202413 - RNA, 16 nt, Mycobacterium bovis subsp bovis AF2122/97
gacgcguugcucgaaa

SEQ ID NO: 3202414 - RNA, 21 nt, Mycobacterium bovis subsp bovis AF2122/97
gacgcguuucgucgaccgcgc

SEQ ID NO: 3202415 - RNA, 20 nt, Mycobacterium bovis subsp bovis AF2122/97
gacgcuaaagcccccgcacg

SEQ ID NO: 3202416 - RNA, 18 nt, Mycobacterium bovis subsp bovis AF2122/97
gacgcuaacgucgaucuc

SEQ ID NO: 3202417 - RNA, 17 nt, Mycobacterium bovis subsp bovis AF2122/97
gacgcuaaguccccgcu

SEQ ID NO: 3202418 - RNA, 14 nt, Mycobacterium bovis subsp bovis AF2122/97
gacgcuaccgccgg

SEQ ID NO: 3202419 - RNA, 15 nt, Mycobacterium bovis subsp bovis AF2122/97
gacgcuaccgccgga

SEQ ID NO: 3202420 - RNA, 19 nt, Mycobacterium bovis subsp bovis AF2122/97
gacgcuaggacggcugccg

SEQ ID NO: 3202421 - RNA, 24 nt, Mycobacterium bovis subsp bovis AF2122/97
gacgcuccgggaauggcgaccacc

SEQ ID NO: 3202422 - RNA, 19 nt, Mycobacterium bovis subsp bovis AF2122/97
gacgcucgccgagcagaca

SEQ ID NO: 3202423 - RNA, 23 nt, Mycobacterium bovis subsp bovis AF2122/97
gacgcucggcuauggguucgcgg

SEQ ID NO: 3202424 - RNA, 14 nt, Mycobacterium bovis subsp bovis AF2122/97
gacgcucggucgcc

SEQ ID NO: 3202425 - RNA, 16 nt, Mycobacterium bovis subsp bovis AF2122/97
gacgcucggucgccac

SEQ ID NO: 3202426 - RNA, 19 nt, Mycobacterium bovis subsp bovis AF2122/97
gacgcucggucgccaccgc

SEQ ID NO: 3202427 - RNA, 20 nt, Mycobacterium bovis subsp bovis AF2122/97
gacgcucggucgccaccgcc

SEQ ID NO: 3202428 - RNA, 23 nt, Mycobacterium bovis subsp bovis AF2122/97
gacgcucggucgccaccgccggc

SEQ ID NO: 3202429 - RNA, 22 nt, Mycobacterium bovis subsp bovis AF2122/97
gacgcugcccaaaagcgcggca

SEQ ID NO: 3202430 - RNA, 14 nt, Mycobacterium bovis subsp bovis AF2122/97
gacgcugccgguca

SEQ ID NO: 3202431 - RNA, 22 nt, Mycobacterium bovis subsp bovis AF2122/97
gacgcugccgguguaggccucg

SEQ ID NO: 3202432 - RNA, 16 nt, Mycobacterium bovis subsp bovis AF2122/97
gacgcugggcgguagc

SEQ ID NO: 3202433 - RNA, 15 nt, Mycobacterium bovis subsp bovis AF2122/97
gacgcuggucggcgg

SEQ ID NO: 3202434 - RNA, 16 nt, Mycobacterium bovis subsp bovis AF2122/97
gacgcuggucggcggc

SEQ ID NO: 3202435 - RNA, 17 nt, Mycobacterium bovis subsp bovis AF2122/97
gacgcuggucggcggcu

SEQ ID NO: 3202436 - RNA, 17 nt, Mycobacterium bovis subsp bovis AF2122/97
gacgcuguccaggucug

SEQ ID NO: 3202437 - RNA, 16 nt, Mycobacterium bovis subsp bovis AF2122/97
gacgcuguggcucgac

SEQ ID NO: 3202438 - RNA, 17 nt, Mycobacterium bovis subsp bovis AF2122/97
gacgcuguggcucgacg

SEQ ID NO: 3202439 - RNA, 22 nt, Mycobacterium bovis subsp bovis AF2122/97
gacgcugugggcuuugccgucg

SEQ ID NO: 3202440 - RNA, 19 nt, Mycobacterium bovis subsp bovis AF2122/97
gacggaaucgucggcgcgg

SEQ ID NO: 3202441 - RNA, 19 nt, Mycobacterium bovis subsp bovis AF2122/97
gacggaaugucagccgguu

SEQ ID NO: 3202442 - RNA, 14 nt, Mycobacterium bovis subsp bovis AF2122/97
gacggacucccucg

SEQ ID NO: 3202443 - RNA, 16 nt, Mycobacterium bovis subsp bovis AF2122/97
gacggacuucccgcgc

SEQ ID NO: 3202444 - RNA, 17 nt, Mycobacterium bovis subsp bovis AF2122/97
gacggacuucccgcgcg

SEQ ID NO: 3202445 - RNA, 14 nt, Mycobacterium bovis subsp bovis AF2122/97
gacggagcccaaaa

SEQ ID NO: 3202446 - RNA, 17 nt, Mycobacterium bovis subsp bovis AF2122/97
gacggaguucgacgucg

SEQ ID NO: 3202447 - RNA, 17 nt, Mycobacterium bovis subsp bovis AF2122/97
gacggaucgcccugaca

SEQ ID NO: 3202448 - RNA, 14 nt, Mycobacterium bovis subsp bovis AF2122/97
gacggaucgucgug

SEQ ID NO: 3202449 - RNA, 22 nt, Mycobacterium bovis subsp bovis AF2122/97
gacggaucgucgugcacggcgg

SEQ ID NO: 3202450 - RNA, 11 nt, Mycobacterium bovis subsp bovis AF2122/97
gacggaucugg

SEQ ID NO: 3202451 - RNA, 21 nt, Mycobacterium bovis subsp bovis AF2122/97
gacggauuacaugucacaccc

SEQ ID NO: 3202452 - RNA, 20 nt, Mycobacterium bovis subsp bovis AF2122/97
gacggcaaaccaguuggcga

SEQ ID NO: 3202453 - RNA, 17 nt, Mycobacterium bovis subsp bovis AF2122/97
gacggcaaacgacauca

SEQ ID NO: 3202454 - RNA, 20 nt, Mycobacterium bovis subsp bovis AF2122/97
gacggcaaaggauucgcgcg

SEQ ID NO: 3202455 - RNA, 21 nt, Mycobacterium bovis subsp bovis AF2122/97
gacggcaagccauucacgagc

SEQ ID NO: 3202456 - RNA, 16 nt, Mycobacterium bovis subsp bovis AF2122/97
gacggcacccccgacg

SEQ ID NO: 3202457 - RNA, 16 nt, Mycobacterium bovis subsp bovis AF2122/97
gacggcacccgacucg

SEQ ID NO: 3202458 - RNA, 21 nt, Mycobacterium bovis subsp bovis AF2122/97
gacggcacccgacucgucggc

SEQ ID NO: 3202459 - RNA, 22 nt, Mycobacterium bovis subsp bovis AF2122/97
gacggcacccgacucgucggcc

SEQ ID NO: 3202460 - RNA, 13 nt, Mycobacterium bovis subsp bovis AF2122/97
gacggcaccggcc

SEQ ID NO: 3202461 - RNA, 14 nt, Mycobacterium bovis subsp bovis AF2122/97
gacggcagaccaug

SEQ ID NO: 3202462 - RNA, 16 nt, Mycobacterium bovis subsp bovis AF2122/97
gacggcagccaccagc

SEQ ID NO: 3202463 - RNA, 18 nt, Mycobacterium bovis subsp bovis AF2122/97
gacggcagccaccagcga

SEQ ID NO: 3202464 - RNA, 19 nt, Mycobacterium bovis subsp bovis AF2122/97
gacggcagccaccagcgac

SEQ ID NO: 3202465 - RNA, 14 nt, Mycobacterium bovis subsp bovis AF2122/97
gacggcagccagcc

SEQ ID NO: 3202466 - RNA, 19 nt, Mycobacterium bovis subsp bovis AF2122/97
gacggcagccagccaccgg

SEQ ID NO: 3202467 - RNA, 14 nt, Mycobacterium bovis subsp bovis AF2122/97
gacggcagccgggc

SEQ ID NO: 3202468 - RNA, 15 nt, Mycobacterium bovis subsp bovis AF2122/97
gacggcagccgggcg

SEQ ID NO: 3202469 - RNA, 18 nt, Mycobacterium bovis subsp bovis AF2122/97
gacggcagccgggcggca

SEQ ID NO: 3202470 - RNA, 20 nt, Mycobacterium bovis subsp bovis AF2122/97
gacggcagccgggcggcagc

SEQ ID NO: 3202471 - RNA, 15 nt, Mycobacterium bovis subsp bovis AF2122/97
gacggcaggaaugau

SEQ ID NO: 3202472 - RNA, 21 nt, Mycobacterium bovis subsp bovis AF2122/97
gacggcaggcucgggcaaggc

SEQ ID NO: 3202473 - RNA, 20 nt, Mycobacterium bovis subsp bovis AF2122/97
gacggcauguaccgaccgcg

SEQ ID NO: 3202474 - RNA, 18 nt, Mycobacterium bovis subsp bovis AF2122/97
gacggccaagaucggcgc

SEQ ID NO: 3202475 - RNA, 17 nt, Mycobacterium bovis subsp bovis AF2122/97
gacggccaccccgucgg

SEQ ID NO: 3202476 - RNA, 18 nt, Mycobacterium bovis subsp bovis AF2122/97
gacggccaccccgucggg

SEQ ID NO: 3202477 - RNA, 12 nt, Mycobacterium bovis subsp bovis AF2122/97
gacggccaccgg

SEQ ID NO: 3202478 - RNA, 13 nt, Mycobacterium bovis subsp bovis AF2122/97
gacggccaccggg

SEQ ID NO: 3202479 - RNA, 21 nt, Mycobacterium bovis subsp bovis AF2122/97
gacggccacgguggagcgcgc

SEQ ID NO: 3202480 - RNA, 14 nt, Mycobacterium bovis subsp bovis AF2122/97
gacggccagcagga

SEQ ID NO: 3202481 - RNA, 13 nt, Mycobacterium bovis subsp bovis AF2122/97
gacggccagccca

SEQ ID NO: 3202482 - RNA, 15 nt, Mycobacterium bovis subsp bovis AF2122/97
gacggccagcccagc

SEQ ID NO: 3202483 - RNA, 15 nt, Mycobacterium bovis subsp bovis AF2122/97
gacggccaggugcag

SEQ ID NO: 3202484 - RNA, 21 nt, Mycobacterium bovis subsp bovis AF2122/97
gacggccaguugguagccgcc

SEQ ID NO: 3202485 - RNA, 22 nt, Mycobacterium bovis subsp bovis AF2122/97
gacggccaguugguagccgccc

SEQ ID NO: 3202486 - RNA, 23 nt, Mycobacterium bovis subsp bovis AF2122/97
gacggccaguugguagccgcccu

SEQ ID NO: 3202487 - RNA, 15 nt, Mycobacterium bovis subsp bovis AF2122/97
gacggccauauccaa

SEQ ID NO: 3202488 - RNA, 17 nt, Mycobacterium bovis subsp bovis AF2122/97
gacggccaucgccagcc

SEQ ID NO: 3202489 - RNA, 15 nt, Mycobacterium bovis subsp bovis AF2122/97
gacggcccgccgucc

SEQ ID NO: 3202490 - RNA, 22 nt, Mycobacterium bovis subsp bovis AF2122/97
gacggcccgccguccggcgccc

SEQ ID NO: 3202491 - RNA, 18 nt, Mycobacterium bovis subsp bovis AF2122/97
gacggccgacaacccggc

SEQ ID NO: 3202492 - RNA, 21 nt, Mycobacterium bovis subsp bovis AF2122/97
gacggccgacaacccggccgg

SEQ ID NO: 3202493 - RNA, 14 nt, Mycobacterium bovis subsp bovis AF2122/97
gacggccgccagca

SEQ ID NO: 3202494 - RNA, 18 nt, Mycobacterium bovis subsp bovis AF2122/97
gacggccgccagcagcuu

SEQ ID NO: 3202495 - RNA, 14 nt, Mycobacterium bovis subsp bovis AF2122/97
gacggccgcucggg

SEQ ID NO: 3202496 - RNA, 19 nt, Mycobacterium bovis subsp bovis AF2122/97
gacggccgcucgggccagc

SEQ ID NO: 3202497 - RNA, 15 nt, Mycobacterium bovis subsp bovis AF2122/97
gacggccggcaagca

SEQ ID NO: 3202498 - RNA, 11 nt, Mycobacterium bovis subsp bovis AF2122/97
gacggccggcc

SEQ ID NO: 3202499 - RNA, 16 nt, Mycobacterium bovis subsp bovis AF2122/97
gacggccggccgcggu

SEQ ID NO: 3202500 - RNA, 23 nt, Mycobacterium bovis subsp bovis AF2122/97
gacggccggcggucgggcccggc

SEQ ID NO: 3202501 - RNA, 20 nt, Mycobacterium bovis subsp bovis AF2122/97
gacggccguggaaagccggc

SEQ ID NO: 3202502 - RNA, 19 nt, Mycobacterium bovis subsp bovis AF2122/97
gacggccugcgagucgcgc

SEQ ID NO: 3202503 - RNA, 22 nt, Mycobacterium bovis subsp bovis AF2122/97
gacggccugcgagucgcgcuug

SEQ ID NO: 3202504 - RNA, 18 nt, Mycobacterium bovis subsp bovis AF2122/97
gacggccuggggcagccg

SEQ ID NO: 3202505 - RNA, 21 nt, Mycobacterium bovis subsp bovis AF2122/97
gacggccuggggcagccgggc

SEQ ID NO: 3202506 - RNA, 15 nt, Mycobacterium bovis subsp bovis AF2122/97
gacggccuuggcgac

SEQ ID NO: 3202507 - RNA, 19 nt, Mycobacterium bovis subsp bovis AF2122/97
gacggccuuggcgacgucg

SEQ ID NO: 3202508 - RNA, 20 nt, Mycobacterium bovis subsp bovis AF2122/97
gacggcgaaaucgacagcag

SEQ ID NO: 3202509 - RNA, 23 nt, Mycobacterium bovis subsp bovis AF2122/97
gacggcgaaaucgacagcagcgc

SEQ ID NO: 3202510 - RNA, 16 nt, Mycobacterium bovis subsp bovis AF2122/97
gacggcgaacccgccg

SEQ ID NO: 3202511 - RNA, 19 nt, Mycobacterium bovis subsp bovis AF2122/97
gacggcgaacccgccgaug

SEQ ID NO: 3202512 - RNA, 21 nt, Mycobacterium bovis subsp bovis AF2122/97
gacggcgaaucgguggucgau

SEQ ID NO: 3202513 - RNA, 19 nt, Mycobacterium bovis subsp bovis AF2122/97
gacggcgaccaccgcggcu

SEQ ID NO: 3202514 - RNA, 19 nt, Mycobacterium bovis subsp bovis AF2122/97
gacggcgacgacaucugcc

SEQ ID NO: 3202515 - RNA, 21 nt, Mycobacterium bovis subsp bovis AF2122/97
gacggcgacgugaaugguggu

SEQ ID NO: 3202516 - RNA, 13 nt, Mycobacterium bovis subsp bovis AF2122/97
gacggcgccaggc

SEQ ID NO: 3202517 - RNA, 15 nt, Mycobacterium bovis subsp bovis AF2122/97
gacggcgcccauagc

SEQ ID NO: 3202518 - RNA, 17 nt, Mycobacterium bovis subsp bovis AF2122/97
gacggcgcccgcccgag

SEQ ID NO: 3202519 - RNA, 23 nt, Mycobacterium bovis subsp bovis AF2122/97
gacggcgccgcccacggggcgug

SEQ ID NO: 3202520 - RNA, 12 nt, Mycobacterium bovis subsp bovis AF2122/97
gacggcgccguc

SEQ ID NO: 3202521 - RNA, 13 nt, Mycobacterium bovis subsp bovis AF2122/97
gacggcgcucggc

SEQ ID NO: 3202522 - RNA, 14 nt, Mycobacterium bovis subsp bovis AF2122/97
gacggcgcucggcg

SEQ ID NO: 3202523 - RNA, 16 nt, Mycobacterium bovis subsp bovis AF2122/97
gacggcgcucggcgag

SEQ ID NO: 3202524 - RNA, 16 nt, Mycobacterium bovis subsp bovis AF2122/97
gacggcggagucgcgc

SEQ ID NO: 3202525 - RNA, 19 nt, Mycobacterium bovis subsp bovis AF2122/97
gacggcggauaaccggcau

SEQ ID NO: 3202526 - RNA, 15 nt, Mycobacterium bovis subsp bovis AF2122/97
gacggcggcaacggc

SEQ ID NO: 3202527 - RNA, 18 nt, Mycobacterium bovis subsp bovis AF2122/97
gacggcggcaagggcggc

SEQ ID NO: 3202528 - RNA, 18 nt, Mycobacterium bovis subsp bovis AF2122/97
gacggcggcacgggcggc

SEQ ID NO: 3202529 - RNA, 19 nt, Mycobacterium bovis subsp bovis AF2122/97
gacggcggcacgggcggcc

SEQ ID NO: 3202530 - RNA, 21 nt, Mycobacterium bovis subsp bovis AF2122/97
gacggcggcacgggcggccau

SEQ ID NO: 3202531 - RNA, 24 nt, Mycobacterium bovis subsp bovis AF2122/97
gacggcggcacgggcggccauggc

SEQ ID NO: 3202532 - RNA, 15 nt, Mycobacterium bovis subsp bovis AF2122/97
gacggcggccgccac

SEQ ID NO: 3202533 - RNA, 14 nt, Mycobacterium bovis subsp bovis AF2122/97
gacggcggccgcga

SEQ ID NO: 3202534 - RNA, 20 nt, Mycobacterium bovis subsp bovis AF2122/97
gacggcggccgcgauggcgu

SEQ ID NO: 3202535 - RNA, 20 nt, Mycobacterium bovis subsp bovis AF2122/97
gacggcggccuucggccggc

SEQ ID NO: 3202536 - RNA, 12 nt, Mycobacterium bovis subsp bovis AF2122/97
gacggcggcgag

SEQ ID NO: 3202537 - RNA, 13 nt, Mycobacterium bovis subsp bovis AF2122/97
gacggcgggccgc

SEQ ID NO: 3202538 - RNA, 22 nt, Mycobacterium bovis subsp bovis AF2122/97
gacggcgggcgaucuuggcgac

SEQ ID NO: 3202539 - RNA, 17 nt, Mycobacterium bovis subsp bovis AF2122/97
gacggcgguaccgccgc

SEQ ID NO: 3202540 - RNA, 12 nt, Mycobacterium bovis subsp bovis AF2122/97
gacggcgucgac

SEQ ID NO: 3202541 - RNA, 16 nt, Mycobacterium bovis subsp bovis AF2122/97
gacggcgucgaccucg

SEQ ID NO: 3202542 - RNA, 16 nt, Mycobacterium bovis subsp bovis AF2122/97
gacggcguugauccgc

SEQ ID NO: 3202543 - RNA, 15 nt, Mycobacterium bovis subsp bovis AF2122/97
gacggcguugccgga

SEQ ID NO: 3202544 - RNA, 17 nt, Mycobacterium bovis subsp bovis AF2122/97
gacggcguugucgacga

SEQ ID NO: 3202545 - RNA, 21 nt, Mycobacterium bovis subsp bovis AF2122/97
gacggcuagcugaugccuggu

SEQ ID NO: 3202546 - RNA, 23 nt, Mycobacterium bovis subsp bovis AF2122/97
gacggcuccuccgguaucggcga

SEQ ID NO: 3202547 - RNA, 15 nt, Mycobacterium bovis subsp bovis AF2122/97
gacggcugccacgcg

SEQ ID NO: 3202548 - RNA, 18 nt, Mycobacterium bovis subsp bovis AF2122/97
gacggcugccgucagccg

SEQ ID NO: 3202549 - RNA, 16 nt, Mycobacterium bovis subsp bovis AF2122/97
gacggcuuccaacucg

SEQ ID NO: 3202550 - RNA, 22 nt, Mycobacterium bovis subsp bovis AF2122/97
gacggcuuccaacucggcggcc

SEQ ID NO: 3202551 - RNA, 21 nt, Mycobacterium bovis subsp bovis AF2122/97
gacggcuucggcagccgcaua

SEQ ID NO: 3202552 - RNA, 20 nt, Mycobacterium bovis subsp bovis AF2122/97
gacgggaaacuccgcggcgc

SEQ ID NO: 3202553 - RNA, 21 nt, Mycobacterium bovis subsp bovis AF2122/97
gacgggaaacuccgcggcgcg

SEQ ID NO: 3202554 - RNA, 20 nt, Mycobacterium bovis subsp bovis AF2122/97
gacgggaaccagcggucggc

SEQ ID NO: 3202555 - RNA, 15 nt, Mycobacterium bovis subsp bovis AF2122/97
gacgggacaacccgu

SEQ ID NO: 3202556 - RNA, 22 nt, Mycobacterium bovis subsp bovis AF2122/97
gacgggacgcaugcgugacccg

SEQ ID NO: 3202557 - RNA, 16 nt, Mycobacterium bovis subsp bovis AF2122/97
gacgggauagacgacc

SEQ ID NO: 3202558 - RNA, 17 nt, Mycobacterium bovis subsp bovis AF2122/97
gacgggauagccguucg

SEQ ID NO: 3202559 - RNA, 19 nt, Mycobacterium bovis subsp bovis AF2122/97
gacgggauagccguucggc

SEQ ID NO: 3202560 - RNA, 18 nt, Mycobacterium bovis subsp bovis AF2122/97
gacgggauauccggucgc

SEQ ID NO: 3202561 - RNA, 17 nt, Mycobacterium bovis subsp bovis AF2122/97
gacgggaucgcccaggc

SEQ ID NO: 3202562 - RNA, 13 nt, Mycobacterium bovis subsp bovis AF2122/97
gacgggcacccga

SEQ ID NO: 3202563 - RNA, 15 nt, Mycobacterium bovis subsp bovis AF2122/97
gacgggcacgcggcg

SEQ ID NO: 3202564 - RNA, 16 nt, Mycobacterium bovis subsp bovis AF2122/97
gacgggcacgcggcga

SEQ ID NO: 3202565 - RNA, 17 nt, Mycobacterium bovis subsp bovis AF2122/97
gacgggcacgcggcgau

SEQ ID NO: 3202566 - RNA, 20 nt, Mycobacterium bovis subsp bovis AF2122/97
gacgggcagaggcuggcgca

SEQ ID NO: 3202567 - RNA, 13 nt, Mycobacterium bovis subsp bovis AF2122/97
gacgggccgcgaa

SEQ ID NO: 3202568 - RNA, 17 nt, Mycobacterium bovis subsp bovis AF2122/97
gacgggccgucgccguc

SEQ ID NO: 3202569 - RNA, 17 nt, Mycobacterium bovis subsp bovis AF2122/97
gacgggcgcgucggcgu

SEQ ID NO: 3202570 - RNA, 13 nt, Mycobacterium bovis subsp bovis AF2122/97
gacgggcucggca

SEQ ID NO: 3202571 - RNA, 20 nt, Mycobacterium bovis subsp bovis AF2122/97
gacggggcgagcaugccguu

SEQ ID NO: 3202572 - RNA, 21 nt, Mycobacterium bovis subsp bovis AF2122/97
gacggggcgagcaugccguug

SEQ ID NO: 3202573 - RNA, 15 nt, Mycobacterium bovis subsp bovis AF2122/97
gacggggcggucggc

SEQ ID NO: 3202574 - RNA, 18 nt, Mycobacterium bovis subsp bovis AF2122/97
gacggggcggucggccgg

SEQ ID NO: 3202575 - RNA, 19 nt, Mycobacterium bovis subsp bovis AF2122/97
gacggggcugaccgccacc

SEQ ID NO: 3202576 - RNA, 19 nt, Mycobacterium bovis subsp bovis AF2122/97
gacggggucgcccggggcg

SEQ ID NO: 3202577 - RNA, 20 nt, Mycobacterium bovis subsp bovis AF2122/97
gacggggucgcccggggcgc

SEQ ID NO: 3202578 - RNA, 15 nt, Mycobacterium bovis subsp bovis AF2122/97
gacgggguugaccgc

SEQ ID NO: 3202579 - RNA, 19 nt, Mycobacterium bovis subsp bovis AF2122/97
gacgggguugaccgccacc

SEQ ID NO: 3202580 - RNA, 20 nt, Mycobacterium bovis subsp bovis AF2122/97
gacgggguugaccgccaccc

SEQ ID NO: 3202581 - RNA, 23 nt, Mycobacterium bovis subsp bovis AF2122/97
gacgggguugaccgccaccccgg

SEQ ID NO: 3202582 - RNA, 22 nt, Mycobacterium bovis subsp bovis AF2122/97
gacggguagcguacucccccga

SEQ ID NO: 3202583 - RNA, 14 nt, Mycobacterium bovis subsp bovis AF2122/97
gacgggucgccgcc

SEQ ID NO: 3202584 - RNA, 17 nt, Mycobacterium bovis subsp bovis AF2122/97
gacgggucgccgccauc

SEQ ID NO: 3202585 - RNA, 21 nt, Mycobacterium bovis subsp bovis AF2122/97
gacgggucggcagaauguucu

SEQ ID NO: 3202586 - RNA, 15 nt, Mycobacterium bovis subsp bovis AF2122/97
gacgggucggcgccg

SEQ ID NO: 3202587 - RNA, 19 nt, Mycobacterium bovis subsp bovis AF2122/97
gacgggucggcgccgagca

SEQ ID NO: 3202588 - RNA, 23 nt, Mycobacterium bovis subsp bovis AF2122/97
gacgggucggcgccgagcagccc

SEQ ID NO: 3202589 - RNA, 23 nt, Mycobacterium bovis subsp bovis AF2122/97
gacgggucguaggacaccaccgu

SEQ ID NO: 3202590 - RNA, 12 nt, Mycobacterium bovis subsp bovis AF2122/97
gacgggugcgcg

SEQ ID NO: 3202591 - RNA, 13 nt, Mycobacterium bovis subsp bovis AF2122/97
gacgggugcgcgg

SEQ ID NO: 3202592 - RNA, 18 nt, Mycobacterium bovis subsp bovis AF2122/97
gacgggugcgggccgaac

SEQ ID NO: 3202593 - RNA, 19 nt, Mycobacterium bovis subsp bovis AF2122/97
gacgggugcgggccgaaca

SEQ ID NO: 3202594 - RNA, 13 nt, Mycobacterium bovis subsp bovis AF2122/97
gacgguacgccag

SEQ ID NO: 3202595 - RNA, 16 nt, Mycobacterium bovis subsp bovis AF2122/97
gacgguacgccagucg

SEQ ID NO: 3202596 - RNA, 19 nt, Mycobacterium bovis subsp bovis AF2122/97
gacggucaaaugaauggug

SEQ ID NO: 3202597 - RNA, 19 nt, Mycobacterium bovis subsp bovis AF2122/97
gacggucaccggcgcaccg

SEQ ID NO: 3202598 - RNA, 14 nt, Mycobacterium bovis subsp bovis AF2122/97
gacggucacggugg

SEQ ID NO: 3202599 - RNA, 12 nt, Mycobacterium bovis subsp bovis AF2122/97
gacggucagccg

SEQ ID NO: 3202600 - RNA, 14 nt, Mycobacterium bovis subsp bovis AF2122/97
gacggucagccgcg

SEQ ID NO: 3202601 - RNA, 14 nt, Mycobacterium bovis subsp bovis AF2122/97
gacggucauccggc

SEQ ID NO: 3202602 - RNA, 23 nt, Mycobacterium bovis subsp bovis AF2122/97
gacggucauccggccgucggcgg

SEQ ID NO: 3202603 - RNA, 15 nt, Mycobacterium bovis subsp bovis AF2122/97
gacggucccggcacg

SEQ ID NO: 3202604 - RNA, 20 nt, Mycobacterium bovis subsp bovis AF2122/97
gacgguccgcuacggcgucc

SEQ ID NO: 3202605 - RNA, 18 nt, Mycobacterium bovis subsp bovis AF2122/97
gacgguccguucgcgccg

SEQ ID NO: 3202606 - RNA, 15 nt, Mycobacterium bovis subsp bovis AF2122/97
gacggucgcucggca

SEQ ID NO: 3202607 - RNA, 17 nt, Mycobacterium bovis subsp bovis AF2122/97
gacggucggcggaaaca

SEQ ID NO: 3202608 - RNA, 17 nt, Mycobacterium bovis subsp bovis AF2122/97
gacggucgucgaucacg

SEQ ID NO: 3202609 - RNA, 22 nt, Mycobacterium bovis subsp bovis AF2122/97
gacggucuggcccgcgacaucg

SEQ ID NO: 3202610 - RNA, 18 nt, Mycobacterium bovis subsp bovis AF2122/97
gacggugaauucacgaug

SEQ ID NO: 3202611 - RNA, 15 nt, Mycobacterium bovis subsp bovis AF2122/97
gacggugaccgggag

SEQ ID NO: 3202612 - RNA, 23 nt, Mycobacterium bovis subsp bovis AF2122/97
gacggugaugggggagccgguga

SEQ ID NO: 3202613 - RNA, 15 nt, Mycobacterium bovis subsp bovis AF2122/97
gacggugcaggacca

SEQ ID NO: 3202614 - RNA, 20 nt, Mycobacterium bovis subsp bovis AF2122/97
gacggugcaggaccagaacu

SEQ ID NO: 3202615 - RNA, 13 nt, Mycobacterium bovis subsp bovis AF2122/97
gacggugccaccg

SEQ ID NO: 3202616 - RNA, 14 nt, Mycobacterium bovis subsp bovis AF2122/97
gacggugccaccgc

SEQ ID NO: 3202617 - RNA, 16 nt, Mycobacterium bovis subsp bovis AF2122/97
gacggugccgaccgcg

SEQ ID NO: 3202618 - RNA, 18 nt, Mycobacterium bovis subsp bovis AF2122/97
gacggugccgaccgcguu

SEQ ID NO: 3202619 - RNA, 17 nt, Mycobacterium bovis subsp bovis AF2122/97
gacggugccgguuuucg

SEQ ID NO: 3202620 - RNA, 13 nt, Mycobacterium bovis subsp bovis AF2122/97
gacggugccgucg

SEQ ID NO: 3202621 - RNA, 15 nt, Mycobacterium bovis subsp bovis AF2122/97
gacggugccgucggu

SEQ ID NO: 3202622 - RNA, 23 nt, Mycobacterium bovis subsp bovis AF2122/97
gacggugccgucggugccgcgga

SEQ ID NO: 3202623 - RNA, 22 nt, Mycobacterium bovis subsp bovis AF2122/97
gacggugcgggcuaggcggcgu

SEQ ID NO: 3202624 - RNA, 14 nt, Mycobacterium bovis subsp bovis AF2122/97
gacggugcggucag

SEQ ID NO: 3202625 - RNA, 17 nt, Mycobacterium bovis subsp bovis AF2122/97
gacgguggggauggcgc

SEQ ID NO: 3202626 - RNA, 19 nt, Mycobacterium bovis subsp bovis AF2122/97
gacgguggggucgccgucg

SEQ ID NO: 3202627 - RNA, 20 nt, Mycobacterium bovis subsp bovis AF2122/97
gacgguggggucgccgucga

SEQ ID NO: 3202628 - RNA, 22 nt, Mycobacterium bovis subsp bovis AF2122/97
gacgguggggucgccgucgaac

SEQ ID NO: 3202629 - RNA, 11 nt, Mycobacterium bovis subsp bovis AF2122/97
gacggugguga

SEQ ID NO: 3202630 - RNA, 17 nt, Mycobacterium bovis subsp bovis AF2122/97
gacgguggugaucacgu

SEQ ID NO: 3202631 - RNA, 17 nt, Mycobacterium bovis subsp bovis AF2122/97
gacgguguagccgccgg

SEQ ID NO: 3202632 - RNA, 12 nt, Mycobacterium bovis subsp bovis AF2122/97
gacgguguuggu

SEQ ID NO: 3202633 - RNA, 18 nt, Mycobacterium bovis subsp bovis AF2122/97
gacgguguuggugaccgg

SEQ ID NO: 3202634 - RNA, 15 nt, Mycobacterium bovis subsp bovis AF2122/97
gacgguguugguggc

SEQ ID NO: 3202635 - RNA, 19 nt, Mycobacterium bovis subsp bovis AF2122/97
gacgguguugguggccggg

SEQ ID NO: 3202636 - RNA, 20 nt, Mycobacterium bovis subsp bovis AF2122/97
gacgguguugguggcggggu

SEQ ID NO: 3202637 - RNA, 13 nt, Mycobacterium bovis subsp bovis AF2122/97
gacgguugagaug

SEQ ID NO: 3202638 - RNA, 15 nt, Mycobacterium bovis subsp bovis AF2122/97
gacgguugccccggc

SEQ ID NO: 3202639 - RNA, 18 nt, Mycobacterium bovis subsp bovis AF2122/97
gacgguugguccgccguc

SEQ ID NO: 3202640 - RNA, 22 nt, Mycobacterium bovis subsp bovis AF2122/97
gacgguugguccgccgucgacc

SEQ ID NO: 3202641 - RNA, 14 nt, Mycobacterium bovis subsp bovis AF2122/97
gacgguuucgacca

SEQ ID NO: 3202642 - RNA, 17 nt, Mycobacterium bovis subsp bovis AF2122/97
gacgguuucgaccacca

SEQ ID NO: 3202643 - RNA, 20 nt, Mycobacterium bovis subsp bovis AF2122/97
gacgguuugcagcgggauca

SEQ ID NO: 3202644 - RNA, 17 nt, Mycobacterium bovis subsp bovis AF2122/97
gacguaaugcgcugccg

SEQ ID NO: 3202645 - RNA, 17 nt, Mycobacterium bovis subsp bovis AF2122/97
gacguaccacggcgauc

SEQ ID NO: 3202646 - RNA, 21 nt, Mycobacterium bovis subsp bovis AF2122/97
gacguacggggucgccggcac

SEQ ID NO: 3202647 - RNA, 14 nt, Mycobacterium bovis subsp bovis AF2122/97
gacguacugggcga

SEQ ID NO: 3202648 - RNA, 20 nt, Mycobacterium bovis subsp bovis AF2122/97
gacguagaagucgaucgccg

SEQ ID NO: 3202649 - RNA, 20 nt, Mycobacterium bovis subsp bovis AF2122/97
gacguagaaugcgccgucgg

SEQ ID NO: 3202650 - RNA, 20 nt, Mycobacterium bovis subsp bovis AF2122/97
gacguagaccacgccgguga

SEQ ID NO: 3202651 - RNA, 16 nt, Mycobacterium bovis subsp bovis AF2122/97
gacguagacgacgucg

SEQ ID NO: 3202652 - RNA, 17 nt, Mycobacterium bovis subsp bovis AF2122/97
gacguagacgacgucgg

SEQ ID NO: 3202653 - RNA, 18 nt, Mycobacterium bovis subsp bovis AF2122/97
gacguagacgacgucggc

SEQ ID NO: 3202654 - RNA, 20 nt, Mycobacterium bovis subsp bovis AF2122/97
gacguagauguugccgcccg

SEQ ID NO: 3202655 - RNA, 19 nt, Mycobacterium bovis subsp bovis AF2122/97
gacguagauguugccgccu

SEQ ID NO: 3202656 - RNA, 17 nt, Mycobacterium bovis subsp bovis AF2122/97
gacguaggacugccagc

SEQ ID NO: 3202657 - RNA, 19 nt, Mycobacterium bovis subsp bovis AF2122/97
gacguaggcaccccggugc

SEQ ID NO: 3202658 - RNA, 20 nt, Mycobacterium bovis subsp bovis AF2122/97
gacguaggcgcugaagauca

SEQ ID NO: 3202659 - RNA, 14 nt, Mycobacterium bovis subsp bovis AF2122/97
gacguaggcggcgg

SEQ ID NO: 3202660 - RNA, 16 nt, Mycobacterium bovis subsp bovis AF2122/97
gacguaggcggcggcc

SEQ ID NO: 3202661 - RNA, 16 nt, Mycobacterium bovis subsp bovis AF2122/97
gacguagggcagcgcc

SEQ ID NO: 3202662 - RNA, 18 nt, Mycobacterium bovis subsp bovis AF2122/97
gacguagggcagcgccag

SEQ ID NO: 3202663 - RNA, 15 nt, Mycobacterium bovis subsp bovis AF2122/97
gacguagucgcgcac

SEQ ID NO: 3202664 - RNA, 21 nt, Mycobacterium bovis subsp bovis AF2122/97
gacguaguugccggcuucggc

SEQ ID NO: 3202665 - RNA, 16 nt, Mycobacterium bovis subsp bovis AF2122/97
gacguauagaccaggu

SEQ ID NO: 3202666 - RNA, 19 nt, Mycobacterium bovis subsp bovis AF2122/97
gacguaucgccgcgggcga

SEQ ID NO: 3202667 - RNA, 18 nt, Mycobacterium bovis subsp bovis AF2122/97
gacguauucguuggggcu

SEQ ID NO: 3202668 - RNA, 15 nt, Mycobacterium bovis subsp bovis AF2122/97
gacguauuggcgcag

SEQ ID NO: 3202669 - RNA, 23 nt, Mycobacterium bovis subsp bovis AF2122/97
gacgucaaacgcaaagacagcgc

SEQ ID NO: 3202670 - RNA, 19 nt, Mycobacterium bovis subsp bovis AF2122/97
gacgucacguucggcgcaa

SEQ ID NO: 3202671 - RNA, 15 nt, Mycobacterium bovis subsp bovis AF2122/97
gacgucagcaccauc

SEQ ID NO: 3202672 - RNA, 13 nt, Mycobacterium bovis subsp bovis AF2122/97
gacgucaggcagc

SEQ ID NO: 3202673 - RNA, 18 nt, Mycobacterium bovis subsp bovis AF2122/97
gacgucaggcagcuccgc

SEQ ID NO: 3202674 - RNA, 13 nt, Mycobacterium bovis subsp bovis AF2122/97
gacgucaggcuga

SEQ ID NO: 3202675 - RNA, 15 nt, Mycobacterium bovis subsp bovis AF2122/97
gacgucaucgccgac

SEQ ID NO: 3202676 - RNA, 13 nt, Mycobacterium bovis subsp bovis AF2122/97
gacguccaacagc

SEQ ID NO: 3202677 - RNA, 15 nt, Mycobacterium bovis subsp bovis AF2122/97
gacguccaacagcgc

SEQ ID NO: 3202678 - RNA, 13 nt, Mycobacterium bovis subsp bovis AF2122/97
gacguccaccagc

SEQ ID NO: 3202679 - RNA, 19 nt, Mycobacterium bovis subsp bovis AF2122/97
gacguccaucccggcgccg

SEQ ID NO: 3202680 - RNA, 20 nt, Mycobacterium bovis subsp bovis AF2122/97
gacguccaucccggcgccgc

SEQ ID NO: 3202681 - RNA, 22 nt, Mycobacterium bovis subsp bovis AF2122/97
gacguccgcggucgcagcagac

SEQ ID NO: 3202682 - RNA, 14 nt, Mycobacterium bovis subsp bovis AF2122/97
gacguccucgacga

SEQ ID NO: 3202683 - RNA, 20 nt, Mycobacterium bovis subsp bovis AF2122/97
gacguccucgacgaucagca

SEQ ID NO: 3202684 - RNA, 18 nt, Mycobacterium bovis subsp bovis AF2122/97
gacguccuucgcugguau

SEQ ID NO: 3202685 - RNA, 19 nt, Mycobacterium bovis subsp bovis AF2122/97
gacgucgacaacgaucgcg

SEQ ID NO: 3202686 - RNA, 20 nt, Mycobacterium bovis subsp bovis AF2122/97
gacgucgacaacgaucgcgc

SEQ ID NO: 3202687 - RNA, 23 nt, Mycobacterium bovis subsp bovis AF2122/97
gacgucgaccacugcccgggguc

SEQ ID NO: 3202688 - RNA, 23 nt, Mycobacterium bovis subsp bovis AF2122/97
gacgucgacgccggccagcggcc

SEQ ID NO: 3202689 - RNA, 14 nt, Mycobacterium bovis subsp bovis AF2122/97
gacgucgacggcga

SEQ ID NO: 3202690 - RNA, 20 nt, Mycobacterium bovis subsp bovis AF2122/97
gacgucgacggcgauggcgc

SEQ ID NO: 3202691 - RNA, 15 nt, Mycobacterium bovis subsp bovis AF2122/97
gacgucgagcagcgc

SEQ ID NO: 3202692 - RNA, 18 nt, Mycobacterium bovis subsp bovis AF2122/97
gacgucgagcagcgccac

SEQ ID NO: 3202693 - RNA, 23 nt, Mycobacterium bovis subsp bovis AF2122/97
gacgucgauggugcggcccaacc

SEQ ID NO: 3202694 - RNA, 22 nt, Mycobacterium bovis subsp bovis AF2122/97
gacgucgauuucggcgaccggc

SEQ ID NO: 3202695 - RNA, 20 nt, Mycobacterium bovis subsp bovis AF2122/97
gacgucgccaagaccagaag

SEQ ID NO: 3202696 - RNA, 12 nt, Mycobacterium bovis subsp bovis AF2122/97
gacgucgccgac

SEQ ID NO: 3202697 - RNA, 14 nt, Mycobacterium bovis subsp bovis AF2122/97
gacgucggaccagc

SEQ ID NO: 3202698 - RNA, 14 nt, Mycobacterium bovis subsp bovis AF2122/97
gacgucggcaucgg

SEQ ID NO: 3202699 - RNA, 16 nt, Mycobacterium bovis subsp bovis AF2122/97
gacgucggccgcaucg

SEQ ID NO: 3202700 - RNA, 13 nt, Mycobacterium bovis subsp bovis AF2122/97
gacgucggcgagc

SEQ ID NO: 3202701 - RNA, 22 nt, Mycobacterium bovis subsp bovis AF2122/97
gacgucggcgagcucggccccg

SEQ ID NO: 3202702 - RNA, 15 nt, Mycobacterium bovis subsp bovis AF2122/97
gacgucggcggccgu

SEQ ID NO: 3202703 - RNA, 15 nt, Mycobacterium bovis subsp bovis AF2122/97
gacgucggcuucacc

SEQ ID NO: 3202704 - RNA, 13 nt, Mycobacterium bovis subsp bovis AF2122/97
gacgucgggaucg

SEQ ID NO: 3202705 - RNA, 20 nt, Mycobacterium bovis subsp bovis AF2122/97
gacgucggugaacgcgucgu

SEQ ID NO: 3202706 - RNA, 16 nt, Mycobacterium bovis subsp bovis AF2122/97
gacgucggugaccucg

SEQ ID NO: 3202707 - RNA, 20 nt, Mycobacterium bovis subsp bovis AF2122/97
gacgucggugaccucggcga

SEQ ID NO: 3202708 - RNA, 23 nt, Mycobacterium bovis subsp bovis AF2122/97
gacgucguagacaccuucgacgu

SEQ ID NO: 3202709 - RNA, 23 nt, Mycobacterium bovis subsp bovis AF2122/97
gacgucgucgaauccugccgcac

SEQ ID NO: 3202710 - RNA, 19 nt, Mycobacterium bovis subsp bovis AF2122/97
gacgucgucgccgccgaaa

SEQ ID NO: 3202711 - RNA, 19 nt, Mycobacterium bovis subsp bovis AF2122/97
gacgucgucgucgacggcc

SEQ ID NO: 3202712 - RNA, 20 nt, Mycobacterium bovis subsp bovis AF2122/97
gacgucguucuuugucggga

SEQ ID NO: 3202713 - RNA, 22 nt, Mycobacterium bovis subsp bovis AF2122/97
gacgucguucuuugucgggauc

SEQ ID NO: 3202714 - RNA, 19 nt, Mycobacterium bovis subsp bovis AF2122/97
gacgucguugccguccacc

SEQ ID NO: 3202715 - RNA, 20 nt, Mycobacterium bovis subsp bovis AF2122/97
gacgucucgcaugcucacga

SEQ ID NO: 3202716 - RNA, 15 nt, Mycobacterium bovis subsp bovis AF2122/97
gacgucugccaggcg

SEQ ID NO: 3202717 - RNA, 23 nt, Mycobacterium bovis subsp bovis AF2122/97
gacgucuucgggcucguccagca

SEQ ID NO: 3202718 - RNA, 19 nt, Mycobacterium bovis subsp bovis AF2122/97
gacgucuuggaacacggcc

SEQ ID NO: 3202719 - RNA, 22 nt, Mycobacterium bovis subsp bovis AF2122/97
gacgucuuggaacacggccgga

SEQ ID NO: 3202720 - RNA, 17 nt, Mycobacterium bovis subsp bovis AF2122/97
gacgucuuugacgaacu

SEQ ID NO: 3202721 - RNA, 23 nt, Mycobacterium bovis subsp bovis AF2122/97
gacgucuuugacgaacuggucuc

SEQ ID NO: 3202722 - RNA, 19 nt, Mycobacterium bovis subsp bovis AF2122/97
gacgugaagaugcccuucg

SEQ ID NO: 3202723 - RNA, 14 nt, Mycobacterium bovis subsp bovis AF2122/97
gacgugaagcagac

SEQ ID NO: 3202724 - RNA, 17 nt, Mycobacterium bovis subsp bovis AF2122/97
gacgugaaugguggugu

SEQ ID NO: 3202725 - RNA, 13 nt, Mycobacterium bovis subsp bovis AF2122/97
gacgugaccagcu

SEQ ID NO: 3202726 - RNA, 18 nt, Mycobacterium bovis subsp bovis AF2122/97
gacgugaccagcuucggc

SEQ ID NO: 3202727 - RNA, 23 nt, Mycobacterium bovis subsp bovis AF2122/97
gacgugaccagcuucggcuggcg

SEQ ID NO: 3202728 - RNA, 17 nt, Mycobacterium bovis subsp bovis AF2122/97
gacgugacgucguggcg

SEQ ID NO: 3202729 - RNA, 22 nt, Mycobacterium bovis subsp bovis AF2122/97
gacgugacgucguggcgcucgg

SEQ ID NO: 3202730 - RNA, 23 nt, Mycobacterium bovis subsp bovis AF2122/97
gacgugacgucguggcgcucggc

SEQ ID NO: 3202731 - RNA, 22 nt, Mycobacterium bovis subsp bovis AF2122/97
gacgugagggucaugucgauca

SEQ ID NO: 3202732 - RNA, 19 nt, Mycobacterium bovis subsp bovis AF2122/97
gacgugaguuucaccacuc

SEQ ID NO: 3202733 - RNA, 21 nt, Mycobacterium bovis subsp bovis AF2122/97
gacgugaguuucaccacucgg

SEQ ID NO: 3202734 - RNA, 20 nt, Mycobacterium bovis subsp bovis AF2122/97
gacgugaucgcgguccaaca

SEQ ID NO: 3202735 - RNA, 12 nt, Mycobacterium bovis subsp bovis AF2122/97
gacgugcagccg

SEQ ID NO: 3202736 - RNA, 16 nt, Mycobacterium bovis subsp bovis AF2122/97
gacgugcagccgcagg

SEQ ID NO: 3202737 - RNA, 17 nt, Mycobacterium bovis subsp bovis AF2122/97
gacgugcaggaacaccc

SEQ ID NO: 3202738 - RNA, 17 nt, Mycobacterium bovis subsp bovis AF2122/97
gacgugccggucccccc

SEQ ID NO: 3202739 - RNA, 19 nt, Mycobacterium bovis subsp bovis AF2122/97
gacgugccgguccccccgu

SEQ ID NO: 3202740 - RNA, 14 nt, Mycobacterium bovis subsp bovis AF2122/97
gacgugcgcgccaa

SEQ ID NO: 3202741 - RNA, 17 nt, Mycobacterium bovis subsp bovis AF2122/97
gacgugcggcgcggcga

SEQ ID NO: 3202742 - RNA, 17 nt, Mycobacterium bovis subsp bovis AF2122/97
gacgugcgucggcccgg

SEQ ID NO: 3202743 - RNA, 16 nt, Mycobacterium bovis subsp bovis AF2122/97
gacguggccagcccgc

SEQ ID NO: 3202744 - RNA, 15 nt, Mycobacterium bovis subsp bovis AF2122/97
gacguggcgccgaca

SEQ ID NO: 3202745 - RNA, 17 nt, Mycobacterium bovis subsp bovis AF2122/97
gacguggcugcguucgc

SEQ ID NO: 3202746 - RNA, 14 nt, Mycobacterium bovis subsp bovis AF2122/97
gacguggcuugagu

SEQ ID NO: 3202747 - RNA, 16 nt, Mycobacterium bovis subsp bovis AF2122/97
gacgugggcgcuggug

SEQ ID NO: 3202748 - RNA, 20 nt, Mycobacterium bovis subsp bovis AF2122/97
gacgugguagccggcgacac

SEQ ID NO: 3202749 - RNA, 20 nt, Mycobacterium bovis subsp bovis AF2122/97
gacguggugggcuuggcugu

SEQ ID NO: 3202750 - RNA, 23 nt, Mycobacterium bovis subsp bovis AF2122/97
gacguggugggcuuggcuguggu

SEQ ID NO: 3202751 - RNA, 22 nt, Mycobacterium bovis subsp bovis AF2122/97
gacgugucaucacggucagccg

SEQ ID NO: 3202752 - RNA, 21 nt, Mycobacterium bovis subsp bovis AF2122/97
gacguuagcauugaguucggc

SEQ ID NO: 3202753 - RNA, 19 nt, Mycobacterium bovis subsp bovis AF2122/97
gacguuaucgguucgcucg

SEQ ID NO: 3202754 - RNA, 21 nt, Mycobacterium bovis subsp bovis AF2122/97
gacguuaucgguucgcucggg

SEQ ID NO: 3202755 - RNA, 13 nt, Mycobacterium bovis subsp bovis AF2122/97
gacguugcagccg

SEQ ID NO: 3202756 - RNA, 15 nt, Mycobacterium bovis subsp bovis AF2122/97
gacguugcagccggc

SEQ ID NO: 3202757 - RNA, 17 nt, Mycobacterium bovis subsp bovis AF2122/97
gacguugcagccggcau

SEQ ID NO: 3202758 - RNA, 12 nt, Mycobacterium bovis subsp bovis AF2122/97
gacguugccaac

SEQ ID NO: 3202759 - RNA, 21 nt, Mycobacterium bovis subsp bovis AF2122/97
gacguugccgaagccggaugc

SEQ ID NO: 3202760 - RNA, 15 nt, Mycobacterium bovis subsp bovis AF2122/97
gacguugccucgcga

SEQ ID NO: 3202761 - RNA, 11 nt, Mycobacterium bovis subsp bovis AF2122/97
gacguugcgua

SEQ ID NO: 3202762 - RNA, 20 nt, Mycobacterium bovis subsp bovis AF2122/97
gacguuggcgugcaccgcau

SEQ ID NO: 3202763 - RNA, 21 nt, Mycobacterium bovis subsp bovis AF2122/97
gacguugguugcguccgccga

SEQ ID NO: 3202764 - RNA, 20 nt, Mycobacterium bovis subsp bovis AF2122/97
gacguuguagauucccgaga

SEQ ID NO: 3202765 - RNA, 21 nt, Mycobacterium bovis subsp bovis AF2122/97
gacguuguccaccgccaccac

SEQ ID NO: 3202766 - RNA, 17 nt, Mycobacterium bovis subsp bovis AF2122/97
gacguugugccuuagcu

SEQ ID NO: 3202767 - RNA, 22 nt, Mycobacterium bovis subsp bovis AF2122/97
gacguugugccuuagcugccau

SEQ ID NO: 3202768 - RNA, 14 nt, Mycobacterium bovis subsp bovis AF2122/97
gacguuucagccgg

SEQ ID NO: 3202769 - RNA, 15 nt, Mycobacterium bovis subsp bovis AF2122/97
gacguuucagccggg

SEQ ID NO: 3202770 - RNA, 24 nt, Mycobacterium bovis subsp bovis AF2122/97
gacguuucagccgggugccacaac

SEQ ID NO: 3202771 - RNA, 23 nt, Mycobacterium bovis subsp bovis AF2122/97
gacuaaccacuguuucugagcgc

SEQ ID NO: 3202772 - RNA, 14 nt, Mycobacterium bovis subsp bovis AF2122/97
gacuaccacccgca

SEQ ID NO: 3202773 - RNA, 13 nt, Mycobacterium bovis subsp bovis AF2122/97
gacuaccaccgcg

SEQ ID NO: 3202774 - RNA, 15 nt, Mycobacterium bovis subsp bovis AF2122/97
gacuacccagccagc

SEQ ID NO: 3202775 - RNA, 16 nt, Mycobacterium bovis subsp bovis AF2122/97
gacuacccagccagcc

SEQ ID NO: 3202776 - RNA, 21 nt, Mycobacterium bovis subsp bovis AF2122/97
gacuacccagccagccgcgaa

SEQ ID NO: 3202777 - RNA, 13 nt, Mycobacterium bovis subsp bovis AF2122/97
gacuaccgagacg

SEQ ID NO: 3202778 - RNA, 15 nt, Mycobacterium bovis subsp bovis AF2122/97
gacuaccgccggcgg

SEQ ID NO: 3202779 - RNA, 16 nt, Mycobacterium bovis subsp bovis AF2122/97
gacuaccgccggcggc

SEQ ID NO: 3202780 - RNA, 19 nt, Mycobacterium bovis subsp bovis AF2122/97
gacuaccgccggcggcggc

SEQ ID NO: 3202781 - RNA, 22 nt, Mycobacterium bovis subsp bovis AF2122/97
gacuaccgccggcggcggccgc

SEQ ID NO: 3202782 - RNA, 16 nt, Mycobacterium bovis subsp bovis AF2122/97
gacuacggccucgcug

SEQ ID NO: 3202783 - RNA, 15 nt, Mycobacterium bovis subsp bovis AF2122/97
gacuagacgccgccg

SEQ ID NO: 3202784 - RNA, 18 nt, Mycobacterium bovis subsp bovis AF2122/97
gacuagcuggggucaaag

SEQ ID NO: 3202785 - RNA, 20 nt, Mycobacterium bovis subsp bovis AF2122/97
gacuaguccgagggcgucgc

SEQ ID NO: 3202786 - RNA, 15 nt, Mycobacterium bovis subsp bovis AF2122/97
gacuaucggccgccg

SEQ ID NO: 3202787 - RNA, 18 nt, Mycobacterium bovis subsp bovis AF2122/97
gacuaucggccgccggau

SEQ ID NO: 3202788 - RNA, 15 nt, Mycobacterium bovis subsp bovis AF2122/97
gacucacccacccgc

SEQ ID NO: 3202789 - RNA, 21 nt, Mycobacterium bovis subsp bovis AF2122/97
gacucaccgugaaccgcccgc

SEQ ID NO: 3202790 - RNA, 18 nt, Mycobacterium bovis subsp bovis AF2122/97
gacucaggucggugcggu

SEQ ID NO: 3202791 - RNA, 22 nt, Mycobacterium bovis subsp bovis AF2122/97
gacucaggucggugcggucauc

SEQ ID NO: 3202792 - RNA, 18 nt, Mycobacterium bovis subsp bovis AF2122/97
gacucaucaccgauggca

SEQ ID NO: 3202793 - RNA, 13 nt, Mycobacterium bovis subsp bovis AF2122/97
gacucaucggccg

SEQ ID NO: 3202794 - RNA, 14 nt, Mycobacterium bovis subsp bovis AF2122/97
gacucaucggccgc

SEQ ID NO: 3202795 - RNA, 21 nt, Mycobacterium bovis subsp bovis AF2122/97
gacucaucggccgcggucggc

SEQ ID NO: 3202796 - RNA, 20 nt, Mycobacterium bovis subsp bovis AF2122/97
gacucaucggcgugcuugcc

SEQ ID NO: 3202797 - RNA, 22 nt, Mycobacterium bovis subsp bovis AF2122/97
gacucaugccgagcgaccgucc

SEQ ID NO: 3202798 - RNA, 20 nt, Mycobacterium bovis subsp bovis AF2122/97
gacuccaaagccgugccagc

SEQ ID NO: 3202799 - RNA, 21 nt, Mycobacterium bovis subsp bovis AF2122/97
gacuccaccccacccagcgac

SEQ ID NO: 3202800 - RNA, 18 nt, Mycobacterium bovis subsp bovis AF2122/97
gacuccagcaaggccagc

SEQ ID NO: 3202801 - RNA, 22 nt, Mycobacterium bovis subsp bovis AF2122/97
gacuccagcaaggccagcacgg

SEQ ID NO: 3202802 - RNA, 23 nt, Mycobacterium bovis subsp bovis AF2122/97
gacuccagcaaggccagcacggc

SEQ ID NO: 3202803 - RNA, 15 nt, Mycobacterium bovis subsp bovis AF2122/97
gacuccagcaccagc

SEQ ID NO: 3202804 - RNA, 16 nt, Mycobacterium bovis subsp bovis AF2122/97
gacuccagcaccagca

SEQ ID NO: 3202805 - RNA, 19 nt, Mycobacterium bovis subsp bovis AF2122/97
gacuccagcaccagcacgg

SEQ ID NO: 3202806 - RNA, 14 nt, Mycobacterium bovis subsp bovis AF2122/97
gacuccagcgcccg

SEQ ID NO: 3202807 - RNA, 17 nt, Mycobacterium bovis subsp bovis AF2122/97
gacuccagcgcccgguc

SEQ ID NO: 3202808 - RNA, 22 nt, Mycobacterium bovis subsp bovis AF2122/97
gacucccaaaugucguaggccg

SEQ ID NO: 3202809 - RNA, 16 nt, Mycobacterium bovis subsp bovis AF2122/97
gacucccccggcuccg

SEQ ID NO: 3202810 - RNA, 18 nt, Mycobacterium bovis subsp bovis AF2122/97
gacucccccggcuccgca

SEQ ID NO: 3202811 - RNA, 20 nt, Mycobacterium bovis subsp bovis AF2122/97
gacucccucgaucacggcgg

SEQ ID NO: 3202812 - RNA, 21 nt, Mycobacterium bovis subsp bovis AF2122/97
gacucccucgaucacggcggc

SEQ ID NO: 3202813 - RNA, 14 nt, Mycobacterium bovis subsp bovis AF2122/97
gacuccgcgcgcug

SEQ ID NO: 3202814 - RNA, 23 nt, Mycobacterium bovis subsp bovis AF2122/97
gacuccggcaagcacaccgccag

SEQ ID NO: 3202815 - RNA, 13 nt, Mycobacterium bovis subsp bovis AF2122/97
gacuccggcaggc

SEQ ID NO: 3202816 - RNA, 18 nt, Mycobacterium bovis subsp bovis AF2122/97
gacuccggccgcacgccg

SEQ ID NO: 3202817 - RNA, 22 nt, Mycobacterium bovis subsp bovis AF2122/97
gacuccggccggccuagccgau

SEQ ID NO: 3202818 - RNA, 16 nt, Mycobacterium bovis subsp bovis AF2122/97
gacuccguaccggguu

SEQ ID NO: 3202819 - RNA, 16 nt, Mycobacterium bovis subsp bovis AF2122/97
gacuccucucucuugg

SEQ ID NO: 3202820 - RNA, 12 nt, Mycobacterium bovis subsp bovis AF2122/97
gacuccugcggc

SEQ ID NO: 3202821 - RNA, 13 nt, Mycobacterium bovis subsp bovis AF2122/97
gacuccugcggca

SEQ ID NO: 3202822 - RNA, 19 nt, Mycobacterium bovis subsp bovis AF2122/97
gacuccugugcggagccgc

SEQ ID NO: 3202823 - RNA, 17 nt, Mycobacterium bovis subsp bovis AF2122/97
gacucgacaaggccgau

SEQ ID NO: 3202824 - RNA, 20 nt, Mycobacterium bovis subsp bovis AF2122/97
gacucgaccgcgacggcaaa

SEQ ID NO: 3202825 - RNA, 23 nt, Mycobacterium bovis subsp bovis AF2122/97
gacucgacguaagugugcccugc

SEQ ID NO: 3202826 - RNA, 14 nt, Mycobacterium bovis subsp bovis AF2122/97
gacucgagagcgau

SEQ ID NO: 3202827 - RNA, 22 nt, Mycobacterium bovis subsp bovis AF2122/97
gacucgagagggaucacgccac

SEQ ID NO: 3202828 - RNA, 18 nt, Mycobacterium bovis subsp bovis AF2122/97
gacucgaggaccugcucg

SEQ ID NO: 3202829 - RNA, 19 nt, Mycobacterium bovis subsp bovis AF2122/97
gacucgauaugcagcucgc

SEQ ID NO: 3202830 - RNA, 20 nt, Mycobacterium bovis subsp bovis AF2122/97
gacucgccacauuucaccac

SEQ ID NO: 3202831 - RNA, 22 nt, Mycobacterium bovis subsp bovis AF2122/97
gacucgccacauuucaccaccg

SEQ ID NO: 3202832 - RNA, 13 nt, Mycobacterium bovis subsp bovis AF2122/97
gacucgccaccgc

SEQ ID NO: 3202833 - RNA, 18 nt, Mycobacterium bovis subsp bovis AF2122/97
gacucgccaccgcggcga

SEQ ID NO: 3202834 - RNA, 19 nt, Mycobacterium bovis subsp bovis AF2122/97
gacucgccaccgcggcgau

SEQ ID NO: 3202835 - RNA, 13 nt, Mycobacterium bovis subsp bovis AF2122/97
gacucgccggcga

SEQ ID NO: 3202836 - RNA, 21 nt, Mycobacterium bovis subsp bovis AF2122/97
gacucgccggcgaauccgcac

SEQ ID NO: 3202837 - RNA, 15 nt, Mycobacterium bovis subsp bovis AF2122/97
gacucgcggucgaca

SEQ ID NO: 3202838 - RNA, 19 nt, Mycobacterium bovis subsp bovis AF2122/97
gacucggaauucggcgucg

SEQ ID NO: 3202839 - RNA, 16 nt, Mycobacterium bovis subsp bovis AF2122/97
gacucggacgcgccgg

SEQ ID NO: 3202840 - RNA, 18 nt, Mycobacterium bovis subsp bovis AF2122/97
gacucggacgcgccggcg

SEQ ID NO: 3202841 - RNA, 17 nt, Mycobacterium bovis subsp bovis AF2122/97
gacucggcaccgcggcc

SEQ ID NO: 3202842 - RNA, 22 nt, Mycobacterium bovis subsp bovis AF2122/97
gacucggcaccgcggccgcgga

SEQ ID NO: 3202843 - RNA, 21 nt, Mycobacterium bovis subsp bovis AF2122/97
gacucggcaccuggauccacc

SEQ ID NO: 3202844 - RNA, 16 nt, Mycobacterium bovis subsp bovis AF2122/97
gacucggccgacgaga

SEQ ID NO: 3202845 - RNA, 15 nt, Mycobacterium bovis subsp bovis AF2122/97
gacucggccgcacca

SEQ ID NO: 3202846 - RNA, 17 nt, Mycobacterium bovis subsp bovis AF2122/97
gacucggccgcaccagc

SEQ ID NO: 3202847 - RNA, 12 nt, Mycobacterium bovis subsp bovis AF2122/97
gacucggccucc

SEQ ID NO: 3202848 - RNA, 13 nt, Mycobacterium bovis subsp bovis AF2122/97
gacucggccuccg

SEQ ID NO: 3202849 - RNA, 13 nt, Mycobacterium bovis subsp bovis AF2122/97
gacucggcggaag

SEQ ID NO: 3202850 - RNA, 21 nt, Mycobacterium bovis subsp bovis AF2122/97
gacucgggcgcugaugcgcug

SEQ ID NO: 3202851 - RNA, 21 nt, Mycobacterium bovis subsp bovis AF2122/97
gacucggucucauagugcagg

SEQ ID NO: 3202852 - RNA, 14 nt, Mycobacterium bovis subsp bovis AF2122/97
gacucgucgaugcg

SEQ ID NO: 3202853 - RNA, 20 nt, Mycobacterium bovis subsp bovis AF2122/97
gacucgucgcaucaccaggg

SEQ ID NO: 3202854 - RNA, 16 nt, Mycobacterium bovis subsp bovis AF2122/97
gacucguggcgccacg

SEQ ID NO: 3202855 - RNA, 17 nt, Mycobacterium bovis subsp bovis AF2122/97
gacucguggcgccacgg

SEQ ID NO: 3202856 - RNA, 22 nt, Mycobacterium bovis subsp bovis AF2122/97
gacucguggcgccacggcagcg

SEQ ID NO: 3202857 - RNA, 22 nt, Mycobacterium bovis subsp bovis AF2122/97
gacucgugucugccucggggcc

SEQ ID NO: 3202858 - RNA, 15 nt, Mycobacterium bovis subsp bovis AF2122/97
gacucugcguccacc

SEQ ID NO: 3202859 - RNA, 22 nt, Mycobacterium bovis subsp bovis AF2122/97
gacucugcgucugcucaccagc

SEQ ID NO: 3202860 - RNA, 16 nt, Mycobacterium bovis subsp bovis AF2122/97
gacucuucagcuaccu

SEQ ID NO: 3202861 - RNA, 19 nt, Mycobacterium bovis subsp bovis AF2122/97
gacugaaucgaccggaacu

SEQ ID NO: 3202862 - RNA, 16 nt, Mycobacterium bovis subsp bovis AF2122/97
gacugacaacggccac

SEQ ID NO: 3202863 - RNA, 20 nt, Mycobacterium bovis subsp bovis AF2122/97
gacugaccgucugcgacccg

SEQ ID NO: 3202864 - RNA, 14 nt, Mycobacterium bovis subsp bovis AF2122/97
gacugacgucgaag

SEQ ID NO: 3202865 - RNA, 20 nt, Mycobacterium bovis subsp bovis AF2122/97
gacugacuuugggucggcga

SEQ ID NO: 3202866 - RNA, 21 nt, Mycobacterium bovis subsp bovis AF2122/97
gacugaucaagugccagcgug

SEQ ID NO: 3202867 - RNA, 17 nt, Mycobacterium bovis subsp bovis AF2122/97
gacugaucugugggugg

SEQ ID NO: 3202868 - RNA, 22 nt, Mycobacterium bovis subsp bovis AF2122/97
gacugaucugugggugguugug

SEQ ID NO: 3202869 - RNA, 18 nt, Mycobacterium bovis subsp bovis AF2122/97
gacugcaacucuucccau

SEQ ID NO: 3202870 - RNA, 17 nt, Mycobacterium bovis subsp bovis AF2122/97
gacugcacaccaccgcc

SEQ ID NO: 3202871 - RNA, 21 nt, Mycobacterium bovis subsp bovis AF2122/97
gacugcacaccaccgccgaac

SEQ ID NO: 3202872 - RNA, 22 nt, Mycobacterium bovis subsp bovis AF2122/97
gacugcacuugaaauugagccg

SEQ ID NO: 3202873 - RNA, 20 nt, Mycobacterium bovis subsp bovis AF2122/97
gacugcagaaacagccgcag

SEQ ID NO: 3202874 - RNA, 21 nt, Mycobacterium bovis subsp bovis AF2122/97
gacugcagaaacagccgcagc

SEQ ID NO: 3202875 - RNA, 14 nt, Mycobacterium bovis subsp bovis AF2122/97
gacugcagcccugc

SEQ ID NO: 3202876 - RNA, 16 nt, Mycobacterium bovis subsp bovis AF2122/97
gacugcagcccugcgc

SEQ ID NO: 3202877 - RNA, 18 nt, Mycobacterium bovis subsp bovis AF2122/97
gacugcagcccugcgcag

SEQ ID NO: 3202878 - RNA, 22 nt, Mycobacterium bovis subsp bovis AF2122/97
gacugcagcccugcgcagccgc

SEQ ID NO: 3202879 - RNA, 14 nt, Mycobacterium bovis subsp bovis AF2122/97
gacugcagcgcggc

SEQ ID NO: 3202880 - RNA, 15 nt, Mycobacterium bovis subsp bovis AF2122/97
gacugcagcgcggug

SEQ ID NO: 3202881 - RNA, 14 nt, Mycobacterium bovis subsp bovis AF2122/97
gacugcagcggcgc

SEQ ID NO: 3202882 - RNA, 15 nt, Mycobacterium bovis subsp bovis AF2122/97
gacugcagcggcgca

SEQ ID NO: 3202883 - RNA, 14 nt, Mycobacterium bovis subsp bovis AF2122/97
gacugccagcgccg

SEQ ID NO: 3202884 - RNA, 15 nt, Mycobacterium bovis subsp bovis AF2122/97
gacugcccgauggcu

SEQ ID NO: 3202885 - RNA, 18 nt, Mycobacterium bovis subsp bovis AF2122/97
gacugcgaaaauccgugc

SEQ ID NO: 3202886 - RNA, 16 nt, Mycobacterium bovis subsp bovis AF2122/97
gacugcgaaugcuggg

SEQ ID NO: 3202887 - RNA, 17 nt, Mycobacterium bovis subsp bovis AF2122/97
gacugcgaaugcugggc

SEQ ID NO: 3202888 - RNA, 19 nt, Mycobacterium bovis subsp bovis AF2122/97
gacugcgaccgguucggcg

SEQ ID NO: 3202889 - RNA, 13 nt, Mycobacterium bovis subsp bovis AF2122/97
gacugcgccaccg

SEQ ID NO: 3202890 - RNA, 22 nt, Mycobacterium bovis subsp bovis AF2122/97
gacugcgcccauagcugccggc

SEQ ID NO: 3202891 - RNA, 16 nt, Mycobacterium bovis subsp bovis AF2122/97
gacugcgccgccggcg

SEQ ID NO: 3202892 - RNA, 17 nt, Mycobacterium bovis subsp bovis AF2122/97
gacugcgccgccggcgc

SEQ ID NO: 3202893 - RNA, 22 nt, Mycobacterium bovis subsp bovis AF2122/97
gacugcgccgggugaggcggug

SEQ ID NO: 3202894 - RNA, 14 nt, Mycobacterium bovis subsp bovis AF2122/97
gacugcgcggcacu

SEQ ID NO: 3202895 - RNA, 13 nt, Mycobacterium bovis subsp bovis AF2122/97
gacugcgcggcuu

SEQ ID NO: 3202896 - RNA, 17 nt, Mycobacterium bovis subsp bovis AF2122/97
gacugcgcuacaucaga

SEQ ID NO: 3202897 - RNA, 13 nt, Mycobacterium bovis subsp bovis AF2122/97
gacugcggaagcc

SEQ ID NO: 3202898 - RNA, 14 nt, Mycobacterium bovis subsp bovis AF2122/97
gacugcggaagcca

SEQ ID NO: 3202899 - RNA, 16 nt, Mycobacterium bovis subsp bovis AF2122/97
gacugcggaagccacc

SEQ ID NO: 3202900 - RNA, 17 nt, Mycobacterium bovis subsp bovis AF2122/97
gacugcggaagccaccg

SEQ ID NO: 3202901 - RNA, 15 nt, Mycobacterium bovis subsp bovis AF2122/97
gacugcggcccgacc

SEQ ID NO: 3202902 - RNA, 19 nt, Mycobacterium bovis subsp bovis AF2122/97
gacugcggcccgacccggc

SEQ ID NO: 3202903 - RNA, 17 nt, Mycobacterium bovis subsp bovis AF2122/97
gacugcgucggcggcuu

SEQ ID NO: 3202904 - RNA, 17 nt, Mycobacterium bovis subsp bovis AF2122/97
gacugcgugccgcaccg

SEQ ID NO: 3202905 - RNA, 18 nt, Mycobacterium bovis subsp bovis AF2122/97
gacugcguuccgaucggc

SEQ ID NO: 3202906 - RNA, 16 nt, Mycobacterium bovis subsp bovis AF2122/97
gacuggaaggcgggca

SEQ ID NO: 3202907 - RNA, 15 nt, Mycobacterium bovis subsp bovis AF2122/97
gacuggaccgcggug

SEQ ID NO: 3202908 - RNA, 20 nt, Mycobacterium bovis subsp bovis AF2122/97
gacuggaccgcggugacccg

SEQ ID NO: 3202909 - RNA, 20 nt, Mycobacterium bovis subsp bovis AF2122/97
gacuggcauccgccccgccc

SEQ ID NO: 3202910 - RNA, 19 nt, Mycobacterium bovis subsp bovis AF2122/97
gacuggccgcccggcgagc

SEQ ID NO: 3202911 - RNA, 20 nt, Mycobacterium bovis subsp bovis AF2122/97
gacuggccgcccggcgagca

SEQ ID NO: 3202912 - RNA, 23 nt, Mycobacterium bovis subsp bovis AF2122/97
gacuggccgcccggcgagcaggg

SEQ ID NO: 3202913 - RNA, 20 nt, Mycobacterium bovis subsp bovis AF2122/97
gacuggcgugaacguucuuc

SEQ ID NO: 3202914 - RNA, 16 nt, Mycobacterium bovis subsp bovis AF2122/97
gacugggcaaacccgg

SEQ ID NO: 3202915 - RNA, 17 nt, Mycobacterium bovis subsp bovis AF2122/97
gacuggggcgccaccac

SEQ ID NO: 3202916 - RNA, 18 nt, Mycobacterium bovis subsp bovis AF2122/97
gacuggggcgccaccacc

SEQ ID NO: 3202917 - RNA, 21 nt, Mycobacterium bovis subsp bovis AF2122/97
gacuggguggugcucaccucc

SEQ ID NO: 3202918 - RNA, 12 nt, Mycobacterium bovis subsp bovis AF2122/97
gacugguggcgc

SEQ ID NO: 3202919 - RNA, 21 nt, Mycobacterium bovis subsp bovis AF2122/97
gacugucuggucggcuacggc

SEQ ID NO: 3202920 - RNA, 20 nt, Mycobacterium bovis subsp bovis AF2122/97
gacugugaaucugacgacgc

SEQ ID NO: 3202921 - RNA, 21 nt, Mycobacterium bovis subsp bovis AF2122/97
gacugugaaucugacgacgcg

SEQ ID NO: 3202922 - RNA, 15 nt, Mycobacterium bovis subsp bovis AF2122/97
gacugugcgccgcag

SEQ ID NO: 3202923 - RNA, 17 nt, Mycobacterium bovis subsp bovis AF2122/97
gacugugcgccgcagcc

SEQ ID NO: 3202924 - RNA, 16 nt, Mycobacterium bovis subsp bovis AF2122/97
gacuguggcgccgccg

SEQ ID NO: 3202925 - RNA, 17 nt, Mycobacterium bovis subsp bovis AF2122/97
gacuguggcgccgccgg

SEQ ID NO: 3202926 - RNA, 18 nt, Mycobacterium bovis subsp bovis AF2122/97
gacuguggcgccgccggc

SEQ ID NO: 3202927 - RNA, 21 nt, Mycobacterium bovis subsp bovis AF2122/97
gacugugggggcgcaccgagc

SEQ ID NO: 3202928 - RNA, 15 nt, Mycobacterium bovis subsp bovis AF2122/97
gacuuauccggccag

SEQ ID NO: 3202929 - RNA, 20 nt, Mycobacterium bovis subsp bovis AF2122/97
gacuucacucguugaccggc

SEQ ID NO: 3202930 - RNA, 14 nt, Mycobacterium bovis subsp bovis AF2122/97
gacuucagcaggcc

SEQ ID NO: 3202931 - RNA, 18 nt, Mycobacterium bovis subsp bovis AF2122/97
gacuucagcaggcccagc

SEQ ID NO: 3202932 - RNA, 17 nt, Mycobacterium bovis subsp bovis AF2122/97
gacuucagcauggugga

SEQ ID NO: 3202933 - RNA, 18 nt, Mycobacterium bovis subsp bovis AF2122/97
gacuuccgcgucgccggc

SEQ ID NO: 3202934 - RNA, 16 nt, Mycobacterium bovis subsp bovis AF2122/97
gacuucgacgcggcga

SEQ ID NO: 3202935 - RNA, 21 nt, Mycobacterium bovis subsp bovis AF2122/97
gacuucgauggugugcccgca

SEQ ID NO: 3202936 - RNA, 16 nt, Mycobacterium bovis subsp bovis AF2122/97
gacuucgccgcccgca

SEQ ID NO: 3202937 - RNA, 22 nt, Mycobacterium bovis subsp bovis AF2122/97
gacuucggaaaggucggccugc

SEQ ID NO: 3202938 - RNA, 20 nt, Mycobacterium bovis subsp bovis AF2122/97
gacuucgggaacgcucgucg

SEQ ID NO: 3202939 - RNA, 17 nt, Mycobacterium bovis subsp bovis AF2122/97
gacuucggggucaccgg

SEQ ID NO: 3202940 - RNA, 23 nt, Mycobacterium bovis subsp bovis AF2122/97
gacuucggugagcagggcggcga

SEQ ID NO: 3202941 - RNA, 14 nt, Mycobacterium bovis subsp bovis AF2122/97
gacuucgguggcgg

SEQ ID NO: 3202942 - RNA, 22 nt, Mycobacterium bovis subsp bovis AF2122/97
gacuucgguggcgggcuugccg

SEQ ID NO: 3202943 - RNA, 22 nt, Mycobacterium bovis subsp bovis AF2122/97
gacuucgucaaccaccaggagc

SEQ ID NO: 3202944 - RNA, 15 nt, Mycobacterium bovis subsp bovis AF2122/97
gacuucuucgacgcg

SEQ ID NO: 3202945 - RNA, 14 nt, Mycobacterium bovis subsp bovis AF2122/97
gacuugagcggcuu

SEQ ID NO: 3202946 - RNA, 20 nt, Mycobacterium bovis subsp bovis AF2122/97
gacuugcacgucggcugccg

SEQ ID NO: 3202947 - RNA, 15 nt, Mycobacterium bovis subsp bovis AF2122/97
gacuugcgcgcggca

SEQ ID NO: 3202948 - RNA, 21 nt, Mycobacterium bovis subsp bovis AF2122/97
gacuugcugcuccuucucgcg

SEQ ID NO: 3202949 - RNA, 14 nt, Mycobacterium bovis subsp bovis AF2122/97
gacuugcuggcccg

SEQ ID NO: 3202950 - RNA, 15 nt, Mycobacterium bovis subsp bovis AF2122/97
gacuugcuggcccgc

SEQ ID NO: 3202951 - RNA, 16 nt, Mycobacterium bovis subsp bovis AF2122/97
gacuuggcaucgcgag

SEQ ID NO: 3202952 - RNA, 14 nt, Mycobacterium bovis subsp bovis AF2122/97
gacuuggccagcag

SEQ ID NO: 3202953 - RNA, 17 nt, Mycobacterium bovis subsp bovis AF2122/97
gacuuggccagcagccg

SEQ ID NO: 3202954 - RNA, 16 nt, Mycobacterium bovis subsp bovis AF2122/97
gacuuggccaugcugg

SEQ ID NO: 3202955 - RNA, 16 nt, Mycobacterium bovis subsp bovis AF2122/97
gacuuggugauccgag

SEQ ID NO: 3202956 - RNA, 22 nt, Mycobacterium bovis subsp bovis AF2122/97
gacuugguuucgaugaagacgu

SEQ ID NO: 3202957 - RNA, 18 nt, Mycobacterium bovis subsp bovis AF2122/97
gacuuguccaucacaucc

SEQ ID NO: 3202958 - RNA, 19 nt, Mycobacterium bovis subsp bovis AF2122/97
gacuuguccaucacaucca

SEQ ID NO: 3202959 - RNA, 19 nt, Mycobacterium bovis subsp bovis AF2122/97
gacuugugacggucgucga

SEQ ID NO: 3202960 - RNA, 17 nt, Mycobacterium bovis subsp bovis AF2122/97
gacuugugccacuucuu

SEQ ID NO: 3202961 - RNA, 19 nt, Mycobacterium bovis subsp bovis AF2122/97
gacuuucgcccagucgccg

SEQ ID NO: 3202962 - RNA, 18 nt, Mycobacterium bovis subsp bovis AF2122/97
gacuuugggucggcgaug

SEQ ID NO: 3202963 - RNA, 17 nt, Mycobacterium bovis subsp bovis AF2122/97
gagaaaacggcggcgcc

SEQ ID NO: 3202964 - RNA, 22 nt, Mycobacterium bovis subsp bovis AF2122/97
gagaaaccgcgaacaaccugcc

SEQ ID NO: 3202965 - RNA, 13 nt, Mycobacterium bovis subsp bovis AF2122/97
gagaaagugcagu

SEQ ID NO: 3202966 - RNA, 20 nt, Mycobacterium bovis subsp bovis AF2122/97
gagaacaacgggauccgcgc

SEQ ID NO: 3202967 - RNA, 20 nt, Mycobacterium bovis subsp bovis AF2122/97
gagaacacauccgcuugcgg

SEQ ID NO: 3202968 - RNA, 16 nt, Mycobacterium bovis subsp bovis AF2122/97
gagaacacccgugccu

SEQ ID NO: 3202969 - RNA, 16 nt, Mycobacterium bovis subsp bovis AF2122/97
gagaacgcccgaguga

SEQ ID NO: 3202970 - RNA, 19 nt, Mycobacterium bovis subsp bovis AF2122/97
gagaacgcccgagugacca

SEQ ID NO: 3202971 - RNA, 19 nt, Mycobacterium bovis subsp bovis AF2122/97
gagaacgcccgcaggacgc

SEQ ID NO: 3202972 - RNA, 18 nt, Mycobacterium bovis subsp bovis AF2122/97
gagaacgcccgcugcaga

SEQ ID NO: 3202973 - RNA, 14 nt, Mycobacterium bovis subsp bovis AF2122/97
gagaacggcgggcg

SEQ ID NO: 3202974 - RNA, 19 nt, Mycobacterium bovis subsp bovis AF2122/97
gagaacuccgggaccaggc

SEQ ID NO: 3202975 - RNA, 12 nt, Mycobacterium bovis subsp bovis AF2122/97
gagaagacaccg

SEQ ID NO: 3202976 - RNA, 18 nt, Mycobacterium bovis subsp bovis AF2122/97
gagaagcaugauuggcuc

SEQ ID NO: 3202977 - RNA, 20 nt, Mycobacterium bovis subsp bovis AF2122/97
gagaagcaugauuggcucgg

SEQ ID NO: 3202978 - RNA, 13 nt, Mycobacterium bovis subsp bovis AF2122/97
gagaaggcgacca

SEQ ID NO: 3202979 - RNA, 19 nt, Mycobacterium bovis subsp bovis AF2122/97
gagaaggcggcgucgagca

SEQ ID NO: 3202980 - RNA, 19 nt, Mycobacterium bovis subsp bovis AF2122/97
gagaaggugcugcgcgggu

SEQ ID NO: 3202981 - RNA, 14 nt, Mycobacterium bovis subsp bovis AF2122/97
gagaaguccgggcc

SEQ ID NO: 3202982 - RNA, 17 nt, Mycobacterium bovis subsp bovis AF2122/97
gagaagucgcagcgagg

SEQ ID NO: 3202983 - RNA, 18 nt, Mycobacterium bovis subsp bovis AF2122/97
gagaagucgcagcgagga

SEQ ID NO: 3202984 - RNA, 15 nt, Mycobacterium bovis subsp bovis AF2122/97
gagaagucucgcggc

SEQ ID NO: 3202985 - RNA, 23 nt, Mycobacterium bovis subsp bovis AF2122/97
gagaaguuagccaccuuggacac

SEQ ID NO: 3202986 - RNA, 18 nt, Mycobacterium bovis subsp bovis AF2122/97
gagaauuccccagccgca

SEQ ID NO: 3202987 - RNA, 16 nt, Mycobacterium bovis subsp bovis AF2122/97
gagacaaaggugccga

SEQ ID NO: 3202988 - RNA, 23 nt, Mycobacterium bovis subsp bovis AF2122/97
gagacacccgccaggccgcgcga

SEQ ID NO: 3202989 - RNA, 21 nt, Mycobacterium bovis subsp bovis AF2122/97
gagacagcgccaugcccucgg

SEQ ID NO: 3202990 - RNA, 13 nt, Mycobacterium bovis subsp bovis AF2122/97
gagacaugccggc

SEQ ID NO: 3202991 - RNA, 14 nt, Mycobacterium bovis subsp bovis AF2122/97
gagacaugccggcg

SEQ ID NO: 3202992 - RNA, 23 nt, Mycobacterium bovis subsp bovis AF2122/97
gagacaugucgcugccgccgccg

SEQ ID NO: 3202993 - RNA, 15 nt, Mycobacterium bovis subsp bovis AF2122/97
gagaccacgcgcguc

SEQ ID NO: 3202994 - RNA, 17 nt, Mycobacterium bovis subsp bovis AF2122/97
gagaccacgcgcgucgg

SEQ ID NO: 3202995 - RNA, 23 nt, Mycobacterium bovis subsp bovis AF2122/97
gagaccagguucucggucgguac

SEQ ID NO: 3202996 - RNA, 16 nt, Mycobacterium bovis subsp bovis AF2122/97
gagaccccgcgcgcuu

SEQ ID NO: 3202997 - RNA, 23 nt, Mycobacterium bovis subsp bovis AF2122/97
gagaccgccgcugccgccgagcu

SEQ ID NO: 3202998 - RNA, 19 nt, Mycobacterium bovis subsp bovis AF2122/97
gagaccgccucgucgaugc

SEQ ID NO: 3202999 - RNA, 17 nt, Mycobacterium bovis subsp bovis AF2122/97
gagaccgcggccggccg

SEQ ID NO: 3203000 - RNA, 14 nt, Mycobacterium bovis subsp bovis AF2122/97
gagaccggccgggu

SEQ ID NO: 3203001 - RNA, 17 nt, Mycobacterium bovis subsp bovis AF2122/97
gagaccgggcaacggcg

SEQ ID NO: 3203002 - RNA, 21 nt, Mycobacterium bovis subsp bovis AF2122/97
gagaccucgucgucgaaguug

SEQ ID NO: 3203003 - RNA, 15 nt, Mycobacterium bovis subsp bovis AF2122/97
gagaccugucgguac

SEQ ID NO: 3203004 - RNA, 21 nt, Mycobacterium bovis subsp bovis AF2122/97
gagaccugucgguaccgccca

SEQ ID NO: 3203005 - RNA, 15 nt, Mycobacterium bovis subsp bovis AF2122/97
gagacgaaaagccgc

SEQ ID NO: 3203006 - RNA, 18 nt, Mycobacterium bovis subsp bovis AF2122/97
gagacgaaaagccgcguc

SEQ ID NO: 3203007 - RNA, 22 nt, Mycobacterium bovis subsp bovis AF2122/97
gagacgaaaagccgcgucgcga

SEQ ID NO: 3203008 - RNA, 23 nt, Mycobacterium bovis subsp bovis AF2122/97
gagacgaaaagccgcgucgcgau

SEQ ID NO: 3203009 - RNA, 15 nt, Mycobacterium bovis subsp bovis AF2122/97
gagacgaaccgccga

SEQ ID NO: 3203010 - RNA, 21 nt, Mycobacterium bovis subsp bovis AF2122/97
gagacgaaccgccgacggcgc

SEQ ID NO: 3203011 - RNA, 23 nt, Mycobacterium bovis subsp bovis AF2122/97
gagacgaccuccucgaugaccgg

SEQ ID NO: 3203012 - RNA, 17 nt, Mycobacterium bovis subsp bovis AF2122/97
gagacgacgaccggcua

SEQ ID NO: 3203013 - RNA, 12 nt, Mycobacterium bovis subsp bovis AF2122/97
gagacgaucauc

SEQ ID NO: 3203014 - RNA, 19 nt, Mycobacterium bovis subsp bovis AF2122/97
gagacgaucaucucgucgu

SEQ ID NO: 3203015 - RNA, 22 nt, Mycobacterium bovis subsp bovis AF2122/97
gagacgaucaucucgucgucgc

SEQ ID NO: 3203016 - RNA, 14 nt, Mycobacterium bovis subsp bovis AF2122/97
gagacgaucgccag

SEQ ID NO: 3203017 - RNA, 21 nt, Mycobacterium bovis subsp bovis AF2122/97
gagacgcaugucgggccaggc

SEQ ID NO: 3203018 - RNA, 22 nt, Mycobacterium bovis subsp bovis AF2122/97
gagacgccgucgacgucgaugg

SEQ ID NO: 3203019 - RNA, 15 nt, Mycobacterium bovis subsp bovis AF2122/97
gagacgcugcgcgcc

SEQ ID NO: 3203020 - RNA, 12 nt, Mycobacterium bovis subsp bovis AF2122/97
gagacggcgucg

SEQ ID NO: 3203021 - RNA, 13 nt, Mycobacterium bovis subsp bovis AF2122/97
gagacgucgccgc

SEQ ID NO: 3203022 - RNA, 24 nt, Mycobacterium bovis subsp bovis AF2122/97
gagacgucuucgggcucguccagc

SEQ ID NO: 3203023 - RNA, 20 nt, Mycobacterium bovis subsp bovis AF2122/97
gagacuccagcaaggccagc

SEQ ID NO: 3203024 - RNA, 19 nt, Mycobacterium bovis subsp bovis AF2122/97
gagacugguugcggaucga

SEQ ID NO: 3203025 - RNA, 18 nt, Mycobacterium bovis subsp bovis AF2122/97
gagacuucgacgcggcga

SEQ ID NO: 3203026 - RNA, 19 nt, Mycobacterium bovis subsp bovis AF2122/97
gagacuucgguguagccca

SEQ ID NO: 3203027 - RNA, 16 nt, Mycobacterium bovis subsp bovis AF2122/97
gagacuucuucgacgc

SEQ ID NO: 3203028 - RNA, 21 nt, Mycobacterium bovis subsp bovis AF2122/97
gagagaguaucgacccgauga

SEQ ID NO: 3203029 - RNA, 16 nt, Mycobacterium bovis subsp bovis AF2122/97
gagagaguucgcaugc

SEQ ID NO: 3203030 - RNA, 16 nt, Mycobacterium bovis subsp bovis AF2122/97
gagagcaccgcucggu

SEQ ID NO: 3203031 - RNA, 13 nt, Mycobacterium bovis subsp bovis AF2122/97
gagagcagccagc

SEQ ID NO: 3203032 - RNA, 14 nt, Mycobacterium bovis subsp bovis AF2122/97
gagagcagccagcc

SEQ ID NO: 3203033 - RNA, 17 nt, Mycobacterium bovis subsp bovis AF2122/97
gagagcaugguccagca

SEQ ID NO: 3203034 - RNA, 17 nt, Mycobacterium bovis subsp bovis AF2122/97
gagagccaaaggcggcu

SEQ ID NO: 3203035 - RNA, 18 nt, Mycobacterium bovis subsp bovis AF2122/97
gagagccccgaccagcag

SEQ ID NO: 3203036 - RNA, 19 nt, Mycobacterium bovis subsp bovis AF2122/97
gagagccccgaccagcaga

SEQ ID NO: 3203037 - RNA, 20 nt, Mycobacterium bovis subsp bovis AF2122/97
gagagccccgaccagcagac

SEQ ID NO: 3203038 - RNA, 14 nt, Mycobacterium bovis subsp bovis AF2122/97
gagagccucggcca

SEQ ID NO: 3203039 - RNA, 14 nt, Mycobacterium bovis subsp bovis AF2122/97
gagagccugcucgc

SEQ ID NO: 3203040 - RNA, 21 nt, Mycobacterium bovis subsp bovis AF2122/97
gagaggccaagauggcgcgcu

SEQ ID NO: 3203041 - RNA, 15 nt, Mycobacterium bovis subsp bovis AF2122/97
gagaggugcugcacc

SEQ ID NO: 3203042 - RNA, 15 nt, Mycobacterium bovis subsp bovis AF2122/97
gagaguaggaccucg

SEQ ID NO: 3203043 - RNA, 15 nt, Mycobacterium bovis subsp bovis AF2122/97
gagaguaucgacccg

SEQ ID NO: 3203044 - RNA, 22 nt, Mycobacterium bovis subsp bovis AF2122/97
gagaguggccucguccagcucg

SEQ ID NO: 3203045 - RNA, 20 nt, Mycobacterium bovis subsp bovis AF2122/97
gagauagcaacgaagccggc

SEQ ID NO: 3203046 - RNA, 22 nt, Mycobacterium bovis subsp bovis AF2122/97
gagauagcaacgaagccggcgc

SEQ ID NO: 3203047 - RNA, 17 nt, Mycobacterium bovis subsp bovis AF2122/97
gagauagccgacgucgc

SEQ ID NO: 3203048 - RNA, 17 nt, Mycobacterium bovis subsp bovis AF2122/97
gagaucaccgccaccac

SEQ ID NO: 3203049 - RNA, 18 nt, Mycobacterium bovis subsp bovis AF2122/97
gagaucagcaugcccucg

SEQ ID NO: 3203050 - RNA, 16 nt, Mycobacterium bovis subsp bovis AF2122/97
gagaucagucugggcg

SEQ ID NO: 3203051 - RNA, 22 nt, Mycobacterium bovis subsp bovis AF2122/97
gagaucaugaggugagcugcgg

SEQ ID NO: 3203052 - RNA, 16 nt, Mycobacterium bovis subsp bovis AF2122/97
gagaucauggcgagcg

SEQ ID NO: 3203053 - RNA, 17 nt, Mycobacterium bovis subsp bovis AF2122/97
gagauccacgccagagc

SEQ ID NO: 3203054 - RNA, 20 nt, Mycobacterium bovis subsp bovis AF2122/97
gagauccagcgccuugucua

SEQ ID NO: 3203055 - RNA, 21 nt, Mycobacterium bovis subsp bovis AF2122/97
gagauccugguaaggccggcc

SEQ ID NO: 3203056 - RNA, 11 nt, Mycobacterium bovis subsp bovis AF2122/97
gagaucgcccg

SEQ ID NO: 3203057 - RNA, 12 nt, Mycobacterium bovis subsp bovis AF2122/97
gagaucgcccga

SEQ ID NO: 3203058 - RNA, 13 nt, Mycobacterium bovis subsp bovis AF2122/97
gagaucgccgccg

SEQ ID NO: 3203059 - RNA, 16 nt, Mycobacterium bovis subsp bovis AF2122/97
gagaucgccgccggcg

SEQ ID NO: 3203060 - RNA, 23 nt, Mycobacterium bovis subsp bovis AF2122/97
gagaucgccgccggcgccaucgg

SEQ ID NO: 3203061 - RNA, 14 nt, Mycobacterium bovis subsp bovis AF2122/97
gagaucgcggcgac

SEQ ID NO: 3203062 - RNA, 18 nt, Mycobacterium bovis subsp bovis AF2122/97
gagaucgcggcgacccgg

SEQ ID NO: 3203063 - RNA, 20 nt, Mycobacterium bovis subsp bovis AF2122/97
gagaucgcggcgacccgguc

SEQ ID NO: 3203064 - RNA, 14 nt, Mycobacterium bovis subsp bovis AF2122/97
gagaucgcuucccg

SEQ ID NO: 3203065 - RNA, 19 nt, Mycobacterium bovis subsp bovis AF2122/97
gagaucguagggacgccga

SEQ ID NO: 3203066 - RNA, 19 nt, Mycobacterium bovis subsp bovis AF2122/97
gagaucgucgacccaccau

SEQ ID NO: 3203067 - RNA, 17 nt, Mycobacterium bovis subsp bovis AF2122/97
gagaucgucgcgaccuu

SEQ ID NO: 3203068 - RNA, 18 nt, Mycobacterium bovis subsp bovis AF2122/97
gagaucgucgcguaguga

SEQ ID NO: 3203069 - RNA, 20 nt, Mycobacterium bovis subsp bovis AF2122/97
gagaucucacgugcccgcgc

SEQ ID NO: 3203070 - RNA, 21 nt, Mycobacterium bovis subsp bovis AF2122/97
gagaucucacgugcccgcgcg

SEQ ID NO: 3203071 - RNA, 14 nt, Mycobacterium bovis subsp bovis AF2122/97
gagaucucugagcg

SEQ ID NO: 3203072 - RNA, 21 nt, Mycobacterium bovis subsp bovis AF2122/97
gagaucucugagcgggcgggc

SEQ ID NO: 3203073 - RNA, 14 nt, Mycobacterium bovis subsp bovis AF2122/97
gagaucugcgaugg

SEQ ID NO: 3203074 - RNA, 20 nt, Mycobacterium bovis subsp bovis AF2122/97
gagaugauugccaagcgggu

SEQ ID NO: 3203075 - RNA, 20 nt, Mycobacterium bovis subsp bovis AF2122/97
gagaugccgcgaucgugcag

SEQ ID NO: 3203076 - RNA, 22 nt, Mycobacterium bovis subsp bovis AF2122/97
gagaugccgcgaucgugcaggu

SEQ ID NO: 3203077 - RNA, 17 nt, Mycobacterium bovis subsp bovis AF2122/97
gagaugcuggucggcga

SEQ ID NO: 3203078 - RNA, 15 nt, Mycobacterium bovis subsp bovis AF2122/97
gagauggucgggcgg

SEQ ID NO: 3203079 - RNA, 20 nt, Mycobacterium bovis subsp bovis AF2122/97
gagauggucgggcggcgucg

SEQ ID NO: 3203080 - RNA, 20 nt, Mycobacterium bovis subsp bovis AF2122/97
gagauucggagucaccagca

SEQ ID NO: 3203081 - RNA, 19 nt, Mycobacterium bovis subsp bovis AF2122/97
gagauugccgggccgccga

SEQ ID NO: 3203082 - RNA, 15 nt, Mycobacterium bovis subsp bovis AF2122/97
gagauugcugugacu

SEQ ID NO: 3203083 - RNA, 15 nt, Mycobacterium bovis subsp bovis AF2122/97
gagauugggcuggga

SEQ ID NO: 3203084 - RNA, 15 nt, Mycobacterium bovis subsp bovis AF2122/97
gagcaaaauggccac

SEQ ID NO: 3203085 - RNA, 17 nt, Mycobacterium bovis subsp bovis AF2122/97
gagcaaaauggccaccg

SEQ ID NO: 3203086 - RNA, 18 nt, Mycobacterium bovis subsp bovis AF2122/97
gagcaaaauggccaccgg

SEQ ID NO: 3203087 - RNA, 22 nt, Mycobacterium bovis subsp bovis AF2122/97
gagcaaaccagauugccgagcc

SEQ ID NO: 3203088 - RNA, 17 nt, Mycobacterium bovis subsp bovis AF2122/97
gagcaacgccacgccga

SEQ ID NO: 3203089 - RNA, 21 nt, Mycobacterium bovis subsp bovis AF2122/97
gagcaacgcgaccaucucgac

SEQ ID NO: 3203090 - RNA, 24 nt, Mycobacterium bovis subsp bovis AF2122/97
gagcaacgcgaccaucucgacguc

SEQ ID NO: 3203091 - RNA, 14 nt, Mycobacterium bovis subsp bovis AF2122/97
gagcaacggcggca

SEQ ID NO: 3203092 - RNA, 23 nt, Mycobacterium bovis subsp bovis AF2122/97
gagcaacggcggcaggccggcca

SEQ ID NO: 3203093 - RNA, 15 nt, Mycobacterium bovis subsp bovis AF2122/97
gagcaacucguccag

SEQ ID NO: 3203094 - RNA, 14 nt, Mycobacterium bovis subsp bovis AF2122/97
gagcaaguccugca

SEQ ID NO: 3203095 - RNA, 15 nt, Mycobacterium bovis subsp bovis AF2122/97
gagcaauuccucagc

SEQ ID NO: 3203096 - RNA, 18 nt, Mycobacterium bovis subsp bovis AF2122/97
gagcacaagauccgccac

SEQ ID NO: 3203097 - RNA, 20 nt, Mycobacterium bovis subsp bovis AF2122/97
gagcacaccgacagcaccca

SEQ ID NO: 3203098 - RNA, 22 nt, Mycobacterium bovis subsp bovis AF2122/97
gagcacacguccggcgaugacc

SEQ ID NO: 3203099 - RNA, 19 nt, Mycobacterium bovis subsp bovis AF2122/97
gagcacacuccuagccaac

SEQ ID NO: 3203100 - RNA, 22 nt, Mycobacterium bovis subsp bovis AF2122/97
gagcacaugcucgacgcccgcc

SEQ ID NO: 3203101 - RNA, 21 nt, Mycobacterium bovis subsp bovis AF2122/97
gagcaccacccgggccucggc

SEQ ID NO: 3203102 - RNA, 22 nt, Mycobacterium bovis subsp bovis AF2122/97
gagcaccccagggguugcggag

SEQ ID NO: 3203103 - RNA, 17 nt, Mycobacterium bovis subsp bovis AF2122/97
gagcaccccgacguucg

SEQ ID NO: 3203104 - RNA, 15 nt, Mycobacterium bovis subsp bovis AF2122/97
gagcacccgcugguc

SEQ ID NO: 3203105 - RNA, 18 nt, Mycobacterium bovis subsp bovis AF2122/97
gagcacccggggggccuc

SEQ ID NO: 3203106 - RNA, 17 nt, Mycobacterium bovis subsp bovis AF2122/97
gagcaccgacaccggcc

SEQ ID NO: 3203107 - RNA, 21 nt, Mycobacterium bovis subsp bovis AF2122/97
gagcaccgacaccggccgcga

SEQ ID NO: 3203108 - RNA, 22 nt, Mycobacterium bovis subsp bovis AF2122/97
gagcaccgacaccggccgcgac

SEQ ID NO: 3203109 - RNA, 23 nt, Mycobacterium bovis subsp bovis AF2122/97
gagcaccgacaccggccgcgacg

SEQ ID NO: 3203110 - RNA, 22 nt, Mycobacterium bovis subsp bovis AF2122/97
gagcaccgacuucagcaacgca

SEQ ID NO: 3203111 - RNA, 22 nt, Mycobacterium bovis subsp bovis AF2122/97
gagcaccgcgaacagcacauau

SEQ ID NO: 3203112 - RNA, 15 nt, Mycobacterium bovis subsp bovis AF2122/97
gagcaccgcgcccuu

SEQ ID NO: 3203113 - RNA, 13 nt, Mycobacterium bovis subsp bovis AF2122/97
gagcaccgcucgg

SEQ ID NO: 3203114 - RNA, 20 nt, Mycobacterium bovis subsp bovis AF2122/97
gagcaccgcucgguccagcc

SEQ ID NO: 3203115 - RNA, 21 nt, Mycobacterium bovis subsp bovis AF2122/97
gagcaccggauacagccacgc

SEQ ID NO: 3203116 - RNA, 22 nt, Mycobacterium bovis subsp bovis AF2122/97
gagcaccgggcucagacuuucg

SEQ ID NO: 3203117 - RNA, 19 nt, Mycobacterium bovis subsp bovis AF2122/97
gagcaccucgaagugcagg

SEQ ID NO: 3203118 - RNA, 13 nt, Mycobacterium bovis subsp bovis AF2122/97
gagcaccucggcc

SEQ ID NO: 3203119 - RNA, 15 nt, Mycobacterium bovis subsp bovis AF2122/97
gagcaccucggccuc

SEQ ID NO: 3203120 - RNA, 11 nt, Mycobacterium bovis subsp bovis AF2122/97
gagcaccugac

SEQ ID NO: 3203121 - RNA, 15 nt, Mycobacterium bovis subsp bovis AF2122/97
gagcaccugggcgcg

SEQ ID NO: 3203122 - RNA, 19 nt, Mycobacterium bovis subsp bovis AF2122/97
gagcaccuuggggugggcg

SEQ ID NO: 3203123 - RNA, 23 nt, Mycobacterium bovis subsp bovis AF2122/97
gagcacgccaacguugcgccagc

SEQ ID NO: 3203124 - RNA, 14 nt, Mycobacterium bovis subsp bovis AF2122/97
gagcacgccgagcc

SEQ ID NO: 3203125 - RNA, 19 nt, Mycobacterium bovis subsp bovis AF2122/97
gagcacgccgagcccgccg

SEQ ID NO: 3203126 - RNA, 20 nt, Mycobacterium bovis subsp bovis AF2122/97
gagcacgcgcggcgucgugg

SEQ ID NO: 3203127 - RNA, 14 nt, Mycobacterium bovis subsp bovis AF2122/97
gagcacgcugcugc

SEQ ID NO: 3203128 - RNA, 19 nt, Mycobacterium bovis subsp bovis AF2122/97
gagcacgcugcugcgggug

SEQ ID NO: 3203129 - RNA, 13 nt, Mycobacterium bovis subsp bovis AF2122/97
gagcacggcgcgg

SEQ ID NO: 3203130 - RNA, 20 nt, Mycobacterium bovis subsp bovis AF2122/97
gagcacggugagccgguggc

SEQ ID NO: 3203131 - RNA, 12 nt, Mycobacterium bovis subsp bovis AF2122/97
gagcacgucggg

SEQ ID NO: 3203132 - RNA, 21 nt, Mycobacterium bovis subsp bovis AF2122/97
gagcacgucggggugccggcu

SEQ ID NO: 3203133 - RNA, 15 nt, Mycobacterium bovis subsp bovis AF2122/97
gagcacuaccccaca

SEQ ID NO: 3203134 - RNA, 14 nt, Mycobacterium bovis subsp bovis AF2122/97
gagcacucggccac

SEQ ID NO: 3203135 - RNA, 19 nt, Mycobacterium bovis subsp bovis AF2122/97
gagcacucggccacgacga

SEQ ID NO: 3203136 - RNA, 19 nt, Mycobacterium bovis subsp bovis AF2122/97
gagcacugggcuggccagc

SEQ ID NO: 3203137 - RNA, 16 nt, Mycobacterium bovis subsp bovis AF2122/97
gagcagaaacaacguc

SEQ ID NO: 3203138 - RNA, 17 nt, Mycobacterium bovis subsp bovis AF2122/97
gagcagaaggccagcga

SEQ ID NO: 3203139 - RNA, 22 nt, Mycobacterium bovis subsp bovis AF2122/97
gagcagaaggccagcgaaucgc

SEQ ID NO: 3203140 - RNA, 18 nt, Mycobacterium bovis subsp bovis AF2122/97
gagcagacacagaaucgc

SEQ ID NO: 3203141 - RNA, 23 nt, Mycobacterium bovis subsp bovis AF2122/97
gagcagacgcaaaagccaccgca

SEQ ID NO: 3203142 - RNA, 19 nt, Mycobacterium bovis subsp bovis AF2122/97
gagcagacgcaaaagcccc

SEQ ID NO: 3203143 - RNA, 18 nt, Mycobacterium bovis subsp bovis AF2122/97
gagcagacgcaaaauccc

SEQ ID NO: 3203144 - RNA, 19 nt, Mycobacterium bovis subsp bovis AF2122/97
gagcagacgcaaaaucccc

SEQ ID NO: 3203145 - RNA, 21 nt, Mycobacterium bovis subsp bovis AF2122/97
gagcagacgcaaaaucgcacg

SEQ ID NO: 3203146 - RNA, 13 nt, Mycobacterium bovis subsp bovis AF2122/97
gagcagacgcaga

SEQ ID NO: 3203147 - RNA, 18 nt, Mycobacterium bovis subsp bovis AF2122/97
gagcagacgcagaagccc

SEQ ID NO: 3203148 - RNA, 18 nt, Mycobacterium bovis subsp bovis AF2122/97
gagcagacgcagaaucgc

SEQ ID NO: 3203149 - RNA, 24 nt, Mycobacterium bovis subsp bovis AF2122/97
gagcagacgcagaaucgcacgcgg

SEQ ID NO: 3203150 - RNA, 21 nt, Mycobacterium bovis subsp bovis AF2122/97
gagcagacgcagaaucgcaug

SEQ ID NO: 3203151 - RNA, 20 nt, Mycobacterium bovis subsp bovis AF2122/97
gagcagacgcagaaucgccu

SEQ ID NO: 3203152 - RNA, 17 nt, Mycobacterium bovis subsp bovis AF2122/97
gagcagacgcauaagcc

SEQ ID NO: 3203153 - RNA, 19 nt, Mycobacterium bovis subsp bovis AF2122/97
gagcagacgcauaagcccc

SEQ ID NO: 3203154 - RNA, 15 nt, Mycobacterium bovis subsp bovis AF2122/97
gagcagacgccgcgu

SEQ ID NO: 3203155 - RNA, 13 nt, Mycobacterium bovis subsp bovis AF2122/97
gagcagacgcgga

SEQ ID NO: 3203156 - RNA, 14 nt, Mycobacterium bovis subsp bovis AF2122/97
gagcagacguaaaa

SEQ ID NO: 3203157 - RNA, 19 nt, Mycobacterium bovis subsp bovis AF2122/97
gagcagacguaaaagcccc

SEQ ID NO: 3203158 - RNA, 21 nt, Mycobacterium bovis subsp bovis AF2122/97
gagcagacguaaaagcccccg

SEQ ID NO: 3203159 - RNA, 14 nt, Mycobacterium bovis subsp bovis AF2122/97
gagcagacugcccu

SEQ ID NO: 3203160 - RNA, 17 nt, Mycobacterium bovis subsp bovis AF2122/97
gagcagagaacuccgcc

SEQ ID NO: 3203161 - RNA, 22 nt, Mycobacterium bovis subsp bovis AF2122/97
gagcagagaacuccgccaccau

SEQ ID NO: 3203162 - RNA, 20 nt, Mycobacterium bovis subsp bovis AF2122/97
gagcagaucuuccgagcacu

SEQ ID NO: 3203163 - RNA, 12 nt, Mycobacterium bovis subsp bovis AF2122/97
gagcagcaagcc

SEQ ID NO: 3203164 - RNA, 17 nt, Mycobacterium bovis subsp bovis AF2122/97
gagcagcaagccgccgg

SEQ ID NO: 3203165 - RNA, 12 nt, Mycobacterium bovis subsp bovis AF2122/97
gagcagcaaucc

SEQ ID NO: 3203166 - RNA, 13 nt, Mycobacterium bovis subsp bovis AF2122/97
gagcagcacagca

SEQ ID NO: 3203167 - RNA, 22 nt, Mycobacterium bovis subsp bovis AF2122/97
gagcagcaccacccgcaccuca

SEQ ID NO: 3203168 - RNA, 12 nt, Mycobacterium bovis subsp bovis AF2122/97
gagcagcagcgg

SEQ ID NO: 3203169 - RNA, 16 nt, Mycobacterium bovis subsp bovis AF2122/97
gagcagcagcgggcug

SEQ ID NO: 3203170 - RNA, 14 nt, Mycobacterium bovis subsp bovis AF2122/97
gagcagccgaaccg

SEQ ID NO: 3203171 - RNA, 23 nt, Mycobacterium bovis subsp bovis AF2122/97
gagcagccgaaccggcaccagcg

SEQ ID NO: 3203172 - RNA, 22 nt, Mycobacterium bovis subsp bovis AF2122/97
gagcagcgcgccguucgccugg

SEQ ID NO: 3203173 - RNA, 18 nt, Mycobacterium bovis subsp bovis AF2122/97
gagcagcgcggccagagc

SEQ ID NO: 3203174 - RNA, 19 nt, Mycobacterium bovis subsp bovis AF2122/97
gagcagcgcggccagagcc

SEQ ID NO: 3203175 - RNA, 17 nt, Mycobacterium bovis subsp bovis AF2122/97
gagcagcgugggaagag

SEQ ID NO: 3203176 - RNA, 18 nt, Mycobacterium bovis subsp bovis AF2122/97
gagcagcuagcccggcag

SEQ ID NO: 3203177 - RNA, 13 nt, Mycobacterium bovis subsp bovis AF2122/97
gagcaggccgccc

SEQ ID NO: 3203178 - RNA, 16 nt, Mycobacterium bovis subsp bovis AF2122/97
gagcaggcgcaccagg

SEQ ID NO: 3203179 - RNA, 20 nt, Mycobacterium bovis subsp bovis AF2122/97
gagcaggcuggcguugggcg

SEQ ID NO: 3203180 - RNA, 14 nt, Mycobacterium bovis subsp bovis AF2122/97
gagcagggccggca

SEQ ID NO: 3203181 - RNA, 16 nt, Mycobacterium bovis subsp bovis AF2122/97
gagcagggccggcacc

SEQ ID NO: 3203182 - RNA, 14 nt, Mycobacterium bovis subsp bovis AF2122/97
gagcagggcggcga

SEQ ID NO: 3203183 - RNA, 17 nt, Mycobacterium bovis subsp bovis AF2122/97
gagcagggcucguccau

SEQ ID NO: 3203184 - RNA, 21 nt, Mycobacterium bovis subsp bovis AF2122/97
gagcagggcucguccaucagc

SEQ ID NO: 3203185 - RNA, 19 nt, Mycobacterium bovis subsp bovis AF2122/97
gagcagggugaccaggauc

SEQ ID NO: 3203186 - RNA, 20 nt, Mycobacterium bovis subsp bovis AF2122/97
gagcagguaggcgcgauaca

SEQ ID NO: 3203187 - RNA, 19 nt, Mycobacterium bovis subsp bovis AF2122/97
gagcagguguugcacgagc

SEQ ID NO: 3203188 - RNA, 17 nt, Mycobacterium bovis subsp bovis AF2122/97
gagcagucgcaaaagcc

SEQ ID NO: 3203189 - RNA, 18 nt, Mycobacterium bovis subsp bovis AF2122/97
gagcagucgcaaaagccc

SEQ ID NO: 3203190 - RNA, 20 nt, Mycobacterium bovis subsp bovis AF2122/97
gagcagucgcaaaagccccc

SEQ ID NO: 3203191 - RNA, 21 nt, Mycobacterium bovis subsp bovis AF2122/97
gagcagucgcaaaagccccca

SEQ ID NO: 3203192 - RNA, 16 nt, Mycobacterium bovis subsp bovis AF2122/97
gagcagugccgugcgg

SEQ ID NO: 3203193 - RNA, 16 nt, Mycobacterium bovis subsp bovis AF2122/97
gagcaguggccgccgg

SEQ ID NO: 3203194 - RNA, 18 nt, Mycobacterium bovis subsp bovis AF2122/97
gagcaguggccgccgggc

SEQ ID NO: 3203195 - RNA, 18 nt, Mycobacterium bovis subsp bovis AF2122/97
gagcaguuccagcucgcg

SEQ ID NO: 3203196 - RNA, 22 nt, Mycobacterium bovis subsp bovis AF2122/97
gagcaguucucggucccgccgg

SEQ ID NO: 3203197 - RNA, 24 nt, Mycobacterium bovis subsp bovis AF2122/97
gagcauaccgccgcugccaugcgg

SEQ ID NO: 3203198 - RNA, 19 nt, Mycobacterium bovis subsp bovis AF2122/97
gagcaucgauucgaugucc

SEQ ID NO: 3203199 - RNA, 15 nt, Mycobacterium bovis subsp bovis AF2122/97
gagcaucucgacauc

SEQ ID NO: 3203200 - RNA, 13 nt, Mycobacterium bovis subsp bovis AF2122/97
gagcaucuggggu

SEQ ID NO: 3203201 - RNA, 14 nt, Mycobacterium bovis subsp bovis AF2122/97
gagcaugcccagcg

SEQ ID NO: 3203202 - RNA, 17 nt, Mycobacterium bovis subsp bovis AF2122/97
gagcaugcccagcgaau

SEQ ID NO: 3203203 - RNA, 15 nt, Mycobacterium bovis subsp bovis AF2122/97
gagcaugccgcccgc

SEQ ID NO: 3203204 - RNA, 21 nt, Mycobacterium bovis subsp bovis AF2122/97
gagcaugcgauacacggcggc

SEQ ID NO: 3203205 - RNA, 22 nt, Mycobacterium bovis subsp bovis AF2122/97
gagcaugcgauacacggcggcg

SEQ ID NO: 3203206 - RNA, 17 nt, Mycobacterium bovis subsp bovis AF2122/97
gagcauggcuagggcga

SEQ ID NO: 3203207 - RNA, 15 nt, Mycobacterium bovis subsp bovis AF2122/97
gagcaugguccagca

SEQ ID NO: 3203208 - RNA, 18 nt, Mycobacterium bovis subsp bovis AF2122/97
gagcaugguccagcacau

SEQ ID NO: 3203209 - RNA, 18 nt, Mycobacterium bovis subsp bovis AF2122/97
gagccaaacuacccgccc

SEQ ID NO: 3203210 - RNA, 17 nt, Mycobacterium bovis subsp bovis AF2122/97
gagccaaaggcggcuug

SEQ ID NO: 3203211 - RNA, 17 nt, Mycobacterium bovis subsp bovis AF2122/97
gagccaacgcgcagagc

SEQ ID NO: 3203212 - RNA, 18 nt, Mycobacterium bovis subsp bovis AF2122/97
gagccacaaaggcgccgg

SEQ ID NO: 3203213 - RNA, 16 nt, Mycobacterium bovis subsp bovis AF2122/97
gagccaccaacaccgc

SEQ ID NO: 3203214 - RNA, 18 nt, Mycobacterium bovis subsp bovis AF2122/97
gagccaccaccgccgacc

SEQ ID NO: 3203215 - RNA, 12 nt, Mycobacterium bovis subsp bovis AF2122/97
gagccaccggcg

SEQ ID NO: 3203216 - RNA, 18 nt, Mycobacterium bovis subsp bovis AF2122/97
gagccacggcuucgccgc

SEQ ID NO: 3203217 - RNA, 19 nt, Mycobacterium bovis subsp bovis AF2122/97
gagccacggcuucgccgcg

SEQ ID NO: 3203218 - RNA, 20 nt, Mycobacterium bovis subsp bovis AF2122/97
gagccacggcuucgccgcgg

SEQ ID NO: 3203219 - RNA, 14 nt, Mycobacterium bovis subsp bovis AF2122/97
gagccacguucgcg

SEQ ID NO: 3203220 - RNA, 15 nt, Mycobacterium bovis subsp bovis AF2122/97
gagccacucggcccg

SEQ ID NO: 3203221 - RNA, 18 nt, Mycobacterium bovis subsp bovis AF2122/97
gagccacucggcccggca

SEQ ID NO: 3203222 - RNA, 20 nt, Mycobacterium bovis subsp bovis AF2122/97
gagccacugcggcauggcag

SEQ ID NO: 3203223 - RNA, 17 nt, Mycobacterium bovis subsp bovis AF2122/97
gagccagaucggauugc

SEQ ID NO: 3203224 - RNA, 18 nt, Mycobacterium bovis subsp bovis AF2122/97
gagccagcacccgcagcc

SEQ ID NO: 3203225 - RNA, 14 nt, Mycobacterium bovis subsp bovis AF2122/97
gagccagcggagca

SEQ ID NO: 3203226 - RNA, 13 nt, Mycobacterium bovis subsp bovis AF2122/97
gagccagcggcac

SEQ ID NO: 3203227 - RNA, 15 nt, Mycobacterium bovis subsp bovis AF2122/97
gagccagcggcacug

SEQ ID NO: 3203228 - RNA, 16 nt, Mycobacterium bovis subsp bovis AF2122/97
gagccagcuugcgcaa

SEQ ID NO: 3203229 - RNA, 15 nt, Mycobacterium bovis subsp bovis AF2122/97
gagccaggacgacgc

SEQ ID NO: 3203230 - RNA, 10 nt, Mycobacterium bovis subsp bovis AF2122/97
gagccaggga

SEQ ID NO: 3203231 - RNA, 16 nt, Mycobacterium bovis subsp bovis AF2122/97
gagccaugccgcucgg

SEQ ID NO: 3203232 - RNA, 18 nt, Mycobacterium bovis subsp bovis AF2122/97
gagccaugccgcucggca

SEQ ID NO: 3203233 - RNA, 16 nt, Mycobacterium bovis subsp bovis AF2122/97
gagccauguccuugga

SEQ ID NO: 3203234 - RNA, 15 nt, Mycobacterium bovis subsp bovis AF2122/97
gagcccaauccgcaa

SEQ ID NO: 3203235 - RNA, 23 nt, Mycobacterium bovis subsp bovis AF2122/97
gagcccaauccgcaacagcucgg

SEQ ID NO: 3203236 - RNA, 13 nt, Mycobacterium bovis subsp bovis AF2122/97
gagcccaccuggg

SEQ ID NO: 3203237 - RNA, 20 nt, Mycobacterium bovis subsp bovis AF2122/97
gagcccaccuggggccgcac

SEQ ID NO: 3203238 - RNA, 13 nt, Mycobacterium bovis subsp bovis AF2122/97
gagcccagccgcg

SEQ ID NO: 3203239 - RNA, 13 nt, Mycobacterium bovis subsp bovis AF2122/97
gagcccagcgccu

SEQ ID NO: 3203240 - RNA, 17 nt, Mycobacterium bovis subsp bovis AF2122/97
gagccccgaccagcaga

SEQ ID NO: 3203241 - RNA, 15 nt, Mycobacterium bovis subsp bovis AF2122/97
gagccccgacugcug

SEQ ID NO: 3203242 - RNA, 14 nt, Mycobacterium bovis subsp bovis AF2122/97
gagccccggcaagc

SEQ ID NO: 3203243 - RNA, 20 nt, Mycobacterium bovis subsp bovis AF2122/97
gagccccugucaacgccgcg

SEQ ID NO: 3203244 - RNA, 18 nt, Mycobacterium bovis subsp bovis AF2122/97
gagcccgaaccaccgcgu

SEQ ID NO: 3203245 - RNA, 13 nt, Mycobacterium bovis subsp bovis AF2122/97
gagcccgagcucg

SEQ ID NO: 3203246 - RNA, 16 nt, Mycobacterium bovis subsp bovis AF2122/97
gagcccgagcucgccg

SEQ ID NO: 3203247 - RNA, 22 nt, Mycobacterium bovis subsp bovis AF2122/97
gagcccgaugguggugccgacc

SEQ ID NO: 3203248 - RNA, 12 nt, Mycobacterium bovis subsp bovis AF2122/97
gagcccgccgcg

SEQ ID NO: 3203249 - RNA, 13 nt, Mycobacterium bovis subsp bovis AF2122/97
gagcccgccgcga

SEQ ID NO: 3203250 - RNA, 13 nt, Mycobacterium bovis subsp bovis AF2122/97
gagcccgccgggu

SEQ ID NO: 3203251 - RNA, 13 nt, Mycobacterium bovis subsp bovis AF2122/97
gagcccggcggcc

SEQ ID NO: 3203252 - RNA, 14 nt, Mycobacterium bovis subsp bovis AF2122/97
gagcccggcggccc

SEQ ID NO: 3203253 - RNA, 22 nt, Mycobacterium bovis subsp bovis AF2122/97
gagcccggcggcccgauagauc

SEQ ID NO: 3203254 - RNA, 19 nt, Mycobacterium bovis subsp bovis AF2122/97
gagcccgggccugaaccac

SEQ ID NO: 3203255 - RNA, 13 nt, Mycobacterium bovis subsp bovis AF2122/97
gagcccgucagcu

SEQ ID NO: 3203256 - RNA, 19 nt, Mycobacterium bovis subsp bovis AF2122/97
gagcccgucagcuccccgu

SEQ ID NO: 3203257 - RNA, 15 nt, Mycobacterium bovis subsp bovis AF2122/97
gagcccuccagggcc

SEQ ID NO: 3203258 - RNA, 16 nt, Mycobacterium bovis subsp bovis AF2122/97
gagcccugcgccucgg

SEQ ID NO: 3203259 - RNA, 19 nt, Mycobacterium bovis subsp bovis AF2122/97
gagccgaaguugaugucgc

SEQ ID NO: 3203260 - RNA, 16 nt, Mycobacterium bovis subsp bovis AF2122/97
gagccgacccgcccga

SEQ ID NO: 3203261 - RNA, 16 nt, Mycobacterium bovis subsp bovis AF2122/97
gagccgaccggcggca

SEQ ID NO: 3203262 - RNA, 16 nt, Mycobacterium bovis subsp bovis AF2122/97
gagccgacgugcggcg

SEQ ID NO: 3203263 - RNA, 18 nt, Mycobacterium bovis subsp bovis AF2122/97
gagccgagccagcuccgg

SEQ ID NO: 3203264 - RNA, 21 nt, Mycobacterium bovis subsp bovis AF2122/97
gagccgagccagcuccggcgc

SEQ ID NO: 3203265 - RNA, 16 nt, Mycobacterium bovis subsp bovis AF2122/97
gagccgagccucgcuc

SEQ ID NO: 3203266 - RNA, 21 nt, Mycobacterium bovis subsp bovis AF2122/97
gagccgaggaauacucucgcg

SEQ ID NO: 3203267 - RNA, 19 nt, Mycobacterium bovis subsp bovis AF2122/97
gagccgauauaccagggca

SEQ ID NO: 3203268 - RNA, 13 nt, Mycobacterium bovis subsp bovis AF2122/97
gagccgaucaccg

SEQ ID NO: 3203269 - RNA, 21 nt, Mycobacterium bovis subsp bovis AF2122/97
gagccgaucaccgccggggcu

SEQ ID NO: 3203270 - RNA, 15 nt, Mycobacterium bovis subsp bovis AF2122/97
gagccgaucgcccgc

SEQ ID NO: 3203271 - RNA, 15 nt, Mycobacterium bovis subsp bovis AF2122/97
gagcgcaaucgacca

SEQ ID NO: 3203272 - RNA, 14 nt, Mycobacterium bovis subsp bovis AF2122/97
gagcgcaccacggc

SEQ ID NO: 3203273 - RNA, 16 nt, Mycobacterium bovis subsp bovis AF2122/97
gagcgcacucaccuug

SEQ ID NO: 3203274 - RNA, 19 nt, Mycobacterium bovis subsp bovis AF2122/97
gagcgcagcuugaucccau

SEQ ID NO: 3203275 - RNA, 16 nt, Mycobacterium bovis subsp bovis AF2122/97
gagcgcaucggccaac

SEQ ID NO: 3203276 - RNA, 18 nt, Mycobacterium bovis subsp bovis AF2122/97
gagcgcaucggccaacac

SEQ ID NO: 3203277 - RNA, 13 nt, Mycobacterium bovis subsp bovis AF2122/97
gagcgccagcgcc

SEQ ID NO: 3203278 - RNA, 12 nt, Mycobacterium bovis subsp bovis AF2122/97
gagcgccaggcc

SEQ ID NO: 3203279 - RNA, 17 nt, Mycobacterium bovis subsp bovis AF2122/97
gagcgccaggccgcaca

SEQ ID NO: 3203280 - RNA, 20 nt, Mycobacterium bovis subsp bovis AF2122/97
gagcgccaggccgcacagca

SEQ ID NO: 3203281 - RNA, 16 nt, Mycobacterium bovis subsp bovis AF2122/97
gagcgccaggucagcu

SEQ ID NO: 3203282 - RNA, 19 nt, Mycobacterium bovis subsp bovis AF2122/97
gagcgcccgucguaggugg

SEQ ID NO: 3203283 - RNA, 23 nt, Mycobacterium bovis subsp bovis AF2122/97
gagcgcccgucguagguggccgg

SEQ ID NO: 3203284 - RNA, 12 nt, Mycobacterium bovis subsp bovis AF2122/97
gagcgccgagcu

SEQ ID NO: 3203285 - RNA, 17 nt, Mycobacterium bovis subsp bovis AF2122/97
gagcgccgagcucggcg

SEQ ID NO: 3203286 - RNA, 18 nt, Mycobacterium bovis subsp bovis AF2122/97
gagcgccgagcucggcgc

SEQ ID NO: 3203287 - RNA, 21 nt, Mycobacterium bovis subsp bovis AF2122/97
gagcgccgcggcggauggcgu

SEQ ID NO: 3203288 - RNA, 20 nt, Mycobacterium bovis subsp bovis AF2122/97
gagcgccggccgcgggucgc

SEQ ID NO: 3203289 - RNA, 18 nt, Mycobacterium bovis subsp bovis AF2122/97
gagcgccuuuggcgguga

SEQ ID NO: 3203290 - RNA, 18 nt, Mycobacterium bovis subsp bovis AF2122/97
gagcgcgaugaccucggc

SEQ ID NO: 3203291 - RNA, 14 nt, Mycobacterium bovis subsp bovis AF2122/97
gagcgcgcagcagu

SEQ ID NO: 3203292 - RNA, 12 nt, Mycobacterium bovis subsp bovis AF2122/97
gagcgcgccacu

SEQ ID NO: 3203293 - RNA, 19 nt, Mycobacterium bovis subsp bovis AF2122/97
gagcgcgcccaaccuggga

SEQ ID NO: 3203294 - RNA, 19 nt, Mycobacterium bovis subsp bovis AF2122/97
gagcgcgccgaaggccgcc

SEQ ID NO: 3203295 - RNA, 20 nt, Mycobacterium bovis subsp bovis AF2122/97
gagcgcgccuaugggccugc

SEQ ID NO: 3203296 - RNA, 18 nt, Mycobacterium bovis subsp bovis AF2122/97
gagcgcgccucgcccagc

SEQ ID NO: 3203297 - RNA, 17 nt, Mycobacterium bovis subsp bovis AF2122/97
gagcgcgcguagcgggg

SEQ ID NO: 3203298 - RNA, 19 nt, Mycobacterium bovis subsp bovis AF2122/97
gagcgcgcguagcggggga

SEQ ID NO: 3203299 - RNA, 11 nt, Mycobacterium bovis subsp bovis AF2122/97
gagcgcggcca

SEQ ID NO: 3203300 - RNA, 14 nt, Mycobacterium bovis subsp bovis AF2122/97
gagcgcggccacca

SEQ ID NO: 3203301 - RNA, 23 nt, Mycobacterium bovis subsp bovis AF2122/97
gagcgcggccaccagaucgcaca

SEQ ID NO: 3203302 - RNA, 13 nt, Mycobacterium bovis subsp bovis AF2122/97
gagcgcggcgaca

SEQ ID NO: 3203303 - RNA, 13 nt, Mycobacterium bovis subsp bovis AF2122/97
gagcgcggcggcg

SEQ ID NO: 3203304 - RNA, 15 nt, Mycobacterium bovis subsp bovis AF2122/97
gagcgcggcggcgga

SEQ ID NO: 3203305 - RNA, 17 nt, Mycobacterium bovis subsp bovis AF2122/97
gagcgcggcggcggagg

SEQ ID NO: 3203306 - RNA, 22 nt, Mycobacterium bovis subsp bovis AF2122/97
gagcgcgggauguaccccggcc

SEQ ID NO: 3203307 - RNA, 18 nt, Mycobacterium bovis subsp bovis AF2122/97
gagcgcggugccgccacc

SEQ ID NO: 3203308 - RNA, 21 nt, Mycobacterium bovis subsp bovis AF2122/97
gagcgcgucgcgggauugcgc

SEQ ID NO: 3203309 - RNA, 14 nt, Mycobacterium bovis subsp bovis AF2122/97
gagcgcgucgguca

SEQ ID NO: 3203310 - RNA, 20 nt, Mycobacterium bovis subsp bovis AF2122/97
gagcgcucgaucacggcggg

SEQ ID NO: 3203311 - RNA, 14 nt, Mycobacterium bovis subsp bovis AF2122/97
gagcgcucgggcaa

SEQ ID NO: 3203312 - RNA, 14 nt, Mycobacterium bovis subsp bovis AF2122/97
gagcgcugcucccg

SEQ ID NO: 3203313 - RNA, 23 nt, Mycobacterium bovis subsp bovis AF2122/97
gagcgcugcucccgaaaagcgcc

SEQ ID NO: 3203314 - RNA, 19 nt, Mycobacterium bovis subsp bovis AF2122/97
gagcgcuucgucgccgaac

SEQ ID NO: 3203315 - RNA, 22 nt, Mycobacterium bovis subsp bovis AF2122/97
gagcggaauggaggccgccgag

SEQ ID NO: 3203316 - RNA, 14 nt, Mycobacterium bovis subsp bovis AF2122/97
gagcggaauggcgc

SEQ ID NO: 3203317 - RNA, 18 nt, Mycobacterium bovis subsp bovis AF2122/97
gagcggaauggcgccggc

SEQ ID NO: 3203318 - RNA, 13 nt, Mycobacterium bovis subsp bovis AF2122/97
gagcggaccaccg

SEQ ID NO: 3203319 - RNA, 22 nt, Mycobacterium bovis subsp bovis AF2122/97
gagcggacucgagucugcgcag

SEQ ID NO: 3203320 - RNA, 16 nt, Mycobacterium bovis subsp bovis AF2122/97
gagcggagccgccgac

SEQ ID NO: 3203321 - RNA, 21 nt, Mycobacterium bovis subsp bovis AF2122/97
gagcggagccgccgacucggc

SEQ ID NO: 3203322 - RNA, 14 nt, Mycobacterium bovis subsp bovis AF2122/97
gagcggagccggcg

SEQ ID NO: 3203323 - RNA, 20 nt, Mycobacterium bovis subsp bovis AF2122/97
gagcggauagcggcaaagcc

SEQ ID NO: 3203324 - RNA, 18 nt, Mycobacterium bovis subsp bovis AF2122/97
gagcggauccgugucgca

SEQ ID NO: 3203325 - RNA, 13 nt, Mycobacterium bovis subsp bovis AF2122/97
gagcggcaccaga

SEQ ID NO: 3203326 - RNA, 17 nt, Mycobacterium bovis subsp bovis AF2122/97
gagcggcacgcacgcgg

SEQ ID NO: 3203327 - RNA, 22 nt, Mycobacterium bovis subsp bovis AF2122/97
gagcggcaucggucaccgcggc

SEQ ID NO: 3203328 - RNA, 15 nt, Mycobacterium bovis subsp bovis AF2122/97
gagcggccaggucgg

SEQ ID NO: 3203329 - RNA, 22 nt, Mycobacterium bovis subsp bovis AF2122/97
gagcggccaggucggucauccg

SEQ ID NO: 3203330 - RNA, 19 nt, Mycobacterium bovis subsp bovis AF2122/97
gagcggcccuucaccagcc

SEQ ID NO: 3203331 - RNA, 13 nt, Mycobacterium bovis subsp bovis AF2122/97
gagcggccgccgc

SEQ ID NO: 3203332 - RNA, 12 nt, Mycobacterium bovis subsp bovis AF2122/97
gagcggccgcgc

SEQ ID NO: 3203333 - RNA, 17 nt, Mycobacterium bovis subsp bovis AF2122/97
gagcggccggcaugcug

SEQ ID NO: 3203334 - RNA, 12 nt, Mycobacterium bovis subsp bovis AF2122/97
gagcggccucgg

SEQ ID NO: 3203335 - RNA, 13 nt, Mycobacterium bovis subsp bovis AF2122/97
gagcggcgcggca

SEQ ID NO: 3203336 - RNA, 14 nt, Mycobacterium bovis subsp bovis AF2122/97
gagcggcgcggggg

SEQ ID NO: 3203337 - RNA, 17 nt, Mycobacterium bovis subsp bovis AF2122/97
gagcggcgcgggggugg

SEQ ID NO: 3203338 - RNA, 12 nt, Mycobacterium bovis subsp bovis AF2122/97
gagcggcugcgg

SEQ ID NO: 3203339 - RNA, 15 nt, Mycobacterium bovis subsp bovis AF2122/97
gagcggcugcggcaa

SEQ ID NO: 3203340 - RNA, 21 nt, Mycobacterium bovis subsp bovis AF2122/97
gagcggcuugggauuugggcg

SEQ ID NO: 3203341 - RNA, 13 nt, Mycobacterium bovis subsp bovis AF2122/97
gagcgggaucggg

SEQ ID NO: 3203342 - RNA, 19 nt, Mycobacterium bovis subsp bovis AF2122/97
gagcgggaucgggcccucc

SEQ ID NO: 3203343 - RNA, 21 nt, Mycobacterium bovis subsp bovis AF2122/97
gagcgggauucuggcgcagcu

SEQ ID NO: 3203344 - RNA, 15 nt, Mycobacterium bovis subsp bovis AF2122/97
gagcgggccaacucg

SEQ ID NO: 3203345 - RNA, 14 nt, Mycobacterium bovis subsp bovis AF2122/97
gagcgggccagcac

SEQ ID NO: 3203346 - RNA, 13 nt, Mycobacterium bovis subsp bovis AF2122/97
gagcgggugcauu

SEQ ID NO: 3203347 - RNA, 14 nt, Mycobacterium bovis subsp bovis AF2122/97
gagcgggugcgggc

SEQ ID NO: 3203348 - RNA, 23 nt, Mycobacterium bovis subsp bovis AF2122/97
gagcgguaaaucgcgaagcggac

SEQ ID NO: 3203349 - RNA, 18 nt, Mycobacterium bovis subsp bovis AF2122/97
gagcggucagcgucgauc

SEQ ID NO: 3203350 - RNA, 12 nt, Mycobacterium bovis subsp bovis AF2122/97
gagcggugccga

SEQ ID NO: 3203351 - RNA, 15 nt, Mycobacterium bovis subsp bovis AF2122/97
gagcggugccggcgu

SEQ ID NO: 3203352 - RNA, 19 nt, Mycobacterium bovis subsp bovis AF2122/97
gagcgguugccauccguca

SEQ ID NO: 3203353 - RNA, 15 nt, Mycobacterium bovis subsp bovis AF2122/97
gagcgguugccuucu

SEQ ID NO: 3203354 - RNA, 17 nt, Mycobacterium bovis subsp bovis AF2122/97
gagcguaacgguaaccg

SEQ ID NO: 3203355 - RNA, 18 nt, Mycobacterium bovis subsp bovis AF2122/97
gagcguaaugcugcugca

SEQ ID NO: 3203356 - RNA, 13 nt, Mycobacterium bovis subsp bovis AF2122/97
gagcguaggccag

SEQ ID NO: 3203357 - RNA, 14 nt, Mycobacterium bovis subsp bovis AF2122/97
gagcguaggccagc

SEQ ID NO: 3203358 - RNA, 16 nt, Mycobacterium bovis subsp bovis AF2122/97
gaggaccugcucgggc

SEQ ID NO: 3203359 - RNA, 13 nt, Mycobacterium bovis subsp bovis AF2122/97
gaggacgacgauc

SEQ ID NO: 3203360 - RNA, 12 nt, Mycobacterium bovis subsp bovis AF2122/97
gaggacgagguu

SEQ ID NO: 3203361 - RNA, 14 nt, Mycobacterium bovis subsp bovis AF2122/97
gaggacgccggcgc

SEQ ID NO: 3203362 - RNA, 16 nt, Mycobacterium bovis subsp bovis AF2122/97
gaggacgccggcgccg

SEQ ID NO: 3203363 - RNA, 19 nt, Mycobacterium bovis subsp bovis AF2122/97
gaggacgccggcgccgcca

SEQ ID NO: 3203364 - RNA, 21 nt, Mycobacterium bovis subsp bovis AF2122/97
gaggacgccggcgccgccauu

SEQ ID NO: 3203365 - RNA, 13 nt, Mycobacterium bovis subsp bovis AF2122/97
gaggacgcugauc

SEQ ID NO: 3203366 - RNA, 18 nt, Mycobacterium bovis subsp bovis AF2122/97
gaggacggcuugagccgc

SEQ ID NO: 3203367 - RNA, 22 nt, Mycobacterium bovis subsp bovis AF2122/97
gaggacuggaaagcagcagcgg

SEQ ID NO: 3203368 - RNA, 12 nt, Mycobacterium bovis subsp bovis AF2122/97
gaggacuugcac

SEQ ID NO: 3203369 - RNA, 19 nt, Mycobacterium bovis subsp bovis AF2122/97
gaggacuugcacgucggcu

SEQ ID NO: 3203370 - RNA, 14 nt, Mycobacterium bovis subsp bovis AF2122/97
gaggaggcggucga

SEQ ID NO: 3203371 - RNA, 15 nt, Mycobacterium bovis subsp bovis AF2122/97
gaggagggccgcgau

SEQ ID NO: 3203372 - RNA, 16 nt, Mycobacterium bovis subsp bovis AF2122/97
gaggagggccgcgauc

SEQ ID NO: 3203373 - RNA, 21 nt, Mycobacterium bovis subsp bovis AF2122/97
gaggaucauguccaucgcgcg

SEQ ID NO: 3203374 - RNA, 17 nt, Mycobacterium bovis subsp bovis AF2122/97
gaggaucccgcugcacg

SEQ ID NO: 3203375 - RNA, 17 nt, Mycobacterium bovis subsp bovis AF2122/97
gaggauccgcaccacgc

SEQ ID NO: 3203376 - RNA, 19 nt, Mycobacterium bovis subsp bovis AF2122/97
gaggauccgcaccacgccc

SEQ ID NO: 3203377 - RNA, 18 nt, Mycobacterium bovis subsp bovis AF2122/97
gaggauccgcugcggccc

SEQ ID NO: 3203378 - RNA, 14 nt, Mycobacterium bovis subsp bovis AF2122/97
gaggaucucggcgu

SEQ ID NO: 3203379 - RNA, 14 nt, Mycobacterium bovis subsp bovis AF2122/97
gaggaugccgaacc

SEQ ID NO: 3203380 - RNA, 17 nt, Mycobacterium bovis subsp bovis AF2122/97
gaggaugccgaaccgcg

SEQ ID NO: 3203381 - RNA, 22 nt, Mycobacterium bovis subsp bovis AF2122/97
gaggcaagcaaccggugcgcau

SEQ ID NO: 3203382 - RNA, 17 nt, Mycobacterium bovis subsp bovis AF2122/97
gaggcacaaucaccgcc

SEQ ID NO: 3203383 - RNA, 19 nt, Mycobacterium bovis subsp bovis AF2122/97
gaggcacaaucaccgccgc

SEQ ID NO: 3203384 - RNA, 21 nt, Mycobacterium bovis subsp bovis AF2122/97
gaggcacaaucaccgccgcga

SEQ ID NO: 3203385 - RNA, 15 nt, Mycobacterium bovis subsp bovis AF2122/97
gaggcaccgacaucg

SEQ ID NO: 3203386 - RNA, 14 nt, Mycobacterium bovis subsp bovis AF2122/97
gaggcacgucgaaa

SEQ ID NO: 3203387 - RNA, 21 nt, Mycobacterium bovis subsp bovis AF2122/97
gaggcacuuaccgagccguca

SEQ ID NO: 3203388 - RNA, 17 nt, Mycobacterium bovis subsp bovis AF2122/97
gaggcagcgcgaggcuc

SEQ ID NO: 3203389 - RNA, 16 nt, Mycobacterium bovis subsp bovis AF2122/97
gaggcagcgucgucga

SEQ ID NO: 3203390 - RNA, 17 nt, Mycobacterium bovis subsp bovis AF2122/97
gaggcagcgucgucgac

SEQ ID NO: 3203391 - RNA, 17 nt, Mycobacterium bovis subsp bovis AF2122/97
gaggcaggccucggcgc

SEQ ID NO: 3203392 - RNA, 19 nt, Mycobacterium bovis subsp bovis AF2122/97
gaggcaggccucggcgccg

SEQ ID NO: 3203393 - RNA, 20 nt, Mycobacterium bovis subsp bovis AF2122/97
gaggcaggccucggcgccgc

SEQ ID NO: 3203394 - RNA, 23 nt, Mycobacterium bovis subsp bovis AF2122/97
gaggccaaacgccaucauggccg

SEQ ID NO: 3203395 - RNA, 16 nt, Mycobacterium bovis subsp bovis AF2122/97
gaggccaaccacagcc

SEQ ID NO: 3203396 - RNA, 15 nt, Mycobacterium bovis subsp bovis AF2122/97
gaggccaacccugcg

SEQ ID NO: 3203397 - RNA, 13 nt, Mycobacterium bovis subsp bovis AF2122/97
gaggccaccgcga

SEQ ID NO: 3203398 - RNA, 20 nt, Mycobacterium bovis subsp bovis AF2122/97
gaggccacgccagcucgccg

SEQ ID NO: 3203399 - RNA, 19 nt, Mycobacterium bovis subsp bovis AF2122/97
gaggccacggggauuggcg

SEQ ID NO: 3203400 - RNA, 13 nt, Mycobacterium bovis subsp bovis AF2122/97
gaggccaucaucc

SEQ ID NO: 3203401 - RNA, 19 nt, Mycobacterium bovis subsp bovis AF2122/97
gaggccauguugccgugga

SEQ ID NO: 3203402 - RNA, 14 nt, Mycobacterium bovis subsp bovis AF2122/97
gaggccccccgcgc

SEQ ID NO: 3203403 - RNA, 12 nt, Mycobacterium bovis subsp bovis AF2122/97
gaggcccgaaau

SEQ ID NO: 3203404 - RNA, 13 nt, Mycobacterium bovis subsp bovis AF2122/97
gaggcccgggugc

SEQ ID NO: 3203405 - RNA, 23 nt, Mycobacterium bovis subsp bovis AF2122/97
gaggcccgucacaaugcccaggc

SEQ ID NO: 3203406 - RNA, 18 nt, Mycobacterium bovis subsp bovis AF2122/97
gaggcccugcggccacgg

SEQ ID NO: 3203407 - RNA, 14 nt, Mycobacterium bovis subsp bovis AF2122/97
gaggccgaccagca

SEQ ID NO: 3203408 - RNA, 18 nt, Mycobacterium bovis subsp bovis AF2122/97
gaggccgaccagcacacc

SEQ ID NO: 3203409 - RNA, 13 nt, Mycobacterium bovis subsp bovis AF2122/97
gaggccgaccucg

SEQ ID NO: 3203410 - RNA, 22 nt, Mycobacterium bovis subsp bovis AF2122/97
gaggccgaccucguucgucacc

SEQ ID NO: 3203411 - RNA, 15 nt, Mycobacterium bovis subsp bovis AF2122/97
gaggccgcacgucga

SEQ ID NO: 3203412 - RNA, 12 nt, Mycobacterium bovis subsp bovis AF2122/97
gaggccgccauc

SEQ ID NO: 3203413 - RNA, 17 nt, Mycobacterium bovis subsp bovis AF2122/97
gaggccgccaucgccgc

SEQ ID NO: 3203414 - RNA, 24 nt, Mycobacterium bovis subsp bovis AF2122/97
gaggccgccaucgccgccaaccac

SEQ ID NO: 3203415 - RNA, 13 nt, Mycobacterium bovis subsp bovis AF2122/97
gaggccgccgagg

SEQ ID NO: 3203416 - RNA, 13 nt, Mycobacterium bovis subsp bovis AF2122/97
gaggccgccgcgc

SEQ ID NO: 3203417 - RNA, 13 nt, Mycobacterium bovis subsp bovis AF2122/97
gaggccgccguug

SEQ ID NO: 3203418 - RNA, 15 nt, Mycobacterium bovis subsp bovis AF2122/97
gaggccgcugccagg

SEQ ID NO: 3203419 - RNA, 19 nt, Mycobacterium bovis subsp bovis AF2122/97
gaggccggcgggcucgccc

SEQ ID NO: 3203420 - RNA, 11 nt, Mycobacterium bovis subsp bovis AF2122/97
gaggccgguga

SEQ ID NO: 3203421 - RNA, 18 nt, Mycobacterium bovis subsp bovis AF2122/97
gaggccggugaacgguag

SEQ ID NO: 3203422 - RNA, 18 nt, Mycobacterium bovis subsp bovis AF2122/97
gaggccgucgaacgguag

SEQ ID NO: 3203423 - RNA, 16 nt, Mycobacterium bovis subsp bovis AF2122/97
gaggccuaccaggcgc

SEQ ID NO: 3203424 - RNA, 17 nt, Mycobacterium bovis subsp bovis AF2122/97
gaggccuaccaggcgcg

SEQ ID NO: 3203425 - RNA, 20 nt, Mycobacterium bovis subsp bovis AF2122/97
gaggccuaccaggcgcggcc

SEQ ID NO: 3203426 - RNA, 16 nt, Mycobacterium bovis subsp bovis AF2122/97
gaggccuucgccgacu

SEQ ID NO: 3203427 - RNA, 17 nt, Mycobacterium bovis subsp bovis AF2122/97
gaggcgaaaaacaccua

SEQ ID NO: 3203428 - RNA, 15 nt, Mycobacterium bovis subsp bovis AF2122/97
gaggcgaccccggcc

SEQ ID NO: 3203429 - RNA, 14 nt, Mycobacterium bovis subsp bovis AF2122/97
gaggcgaucaccgc

SEQ ID NO: 3203430 - RNA, 19 nt, Mycobacterium bovis subsp bovis AF2122/97
gaggcgaucaccgcgccgg

SEQ ID NO: 3203431 - RNA, 14 nt, Mycobacterium bovis subsp bovis AF2122/97
gaggcgaucugcua

SEQ ID NO: 3203432 - RNA, 12 nt, Mycobacterium bovis subsp bovis AF2122/97
gaggcgcccaac

SEQ ID NO: 3203433 - RNA, 13 nt, Mycobacterium bovis subsp bovis AF2122/97
gaggcgcucucgu

SEQ ID NO: 3203434 - RNA, 14 nt, Mycobacterium bovis subsp bovis AF2122/97
gaggcgcuggcccg

SEQ ID NO: 3203435 - RNA, 15 nt, Mycobacterium bovis subsp bovis AF2122/97
gaggcgcuucgccac

SEQ ID NO: 3203436 - RNA, 15 nt, Mycobacterium bovis subsp bovis AF2122/97
gaggcggcgacgacc

SEQ ID NO: 3203437 - RNA, 20 nt, Mycobacterium bovis subsp bovis AF2122/97
gaggcggcgacgaccgucgg

SEQ ID NO: 3203438 - RNA, 19 nt, Mycobacterium bovis subsp bovis AF2122/97
gaggcggcgccgcacccac

SEQ ID NO: 3203439 - RNA, 13 nt, Mycobacterium bovis subsp bovis AF2122/97
gaggcggcgccug

SEQ ID NO: 3203440 - RNA, 15 nt, Mycobacterium bovis subsp bovis AF2122/97
gaggcgggucgccgc

SEQ ID NO: 3203441 - RNA, 24 nt, Mycobacterium bovis subsp bovis AF2122/97
gaggcggucgaucauggcggcagc

SEQ ID NO: 3203442 - RNA, 21 nt, Mycobacterium bovis subsp bovis AF2122/97
gaggcggugacgaagccgacc

SEQ ID NO: 3203443 - RNA, 23 nt, Mycobacterium bovis subsp bovis AF2122/97
gaggcgucaccccggucccgccg

SEQ ID NO: 3203444 - RNA, 13 nt, Mycobacterium bovis subsp bovis AF2122/97
gaggcgucggcaa

SEQ ID NO: 3203445 - RNA, 22 nt, Mycobacterium bovis subsp bovis AF2122/97
gaggugccgcgcagcugccgca

SEQ ID NO: 3203446 - RNA, 13 nt, Mycobacterium bovis subsp bovis AF2122/97
gaggugccggcgc

SEQ ID NO: 3203447 - RNA, 15 nt, Mycobacterium bovis subsp bovis AF2122/97
gaggugccggcgcca

SEQ ID NO: 3203448 - RNA, 20 nt, Mycobacterium bovis subsp bovis AF2122/97
gaggugccggggccccaugc

SEQ ID NO: 3203449 - RNA, 22 nt, Mycobacterium bovis subsp bovis AF2122/97
gaggugccuguugcgaccaucc

SEQ ID NO: 3203450 - RNA, 18 nt, Mycobacterium bovis subsp bovis AF2122/97
gaggugcgccgcgggcug

SEQ ID NO: 3203451 - RNA, 15 nt, Mycobacterium bovis subsp bovis AF2122/97
gagguggacaaaucg

SEQ ID NO: 3203452 - RNA, 19 nt, Mycobacterium bovis subsp bovis AF2122/97
gagguggccgcgcaggggc

SEQ ID NO: 3203453 - RNA, 17 nt, Mycobacterium bovis subsp bovis AF2122/97
gagguggcgcggggccg

SEQ ID NO: 3203454 - RNA, 15 nt, Mycobacterium bovis subsp bovis AF2122/97
gagguggcugcgccg

SEQ ID NO: 3203455 - RNA, 16 nt, Mycobacterium bovis subsp bovis AF2122/97
gagguggggcaggauc

SEQ ID NO: 3203456 - RNA, 15 nt, Mycobacterium bovis subsp bovis AF2122/97
gaggugggguggugg

SEQ ID NO: 3203457 - RNA, 16 nt, Mycobacterium bovis subsp bovis AF2122/97
gagguggggugguggu

SEQ ID NO: 3203458 - RNA, 16 nt, Mycobacterium bovis subsp bovis AF2122/97
gagguggucacgcagu

SEQ ID NO: 3203459 - RNA, 19 nt, Mycobacterium bovis subsp bovis AF2122/97
gaggugugccgacccuacu

SEQ ID NO: 3203460 - RNA, 17 nt, Mycobacterium bovis subsp bovis AF2122/97
gagguucagccugagca

SEQ ID NO: 3203461 - RNA, 15 nt, Mycobacterium bovis subsp bovis AF2122/97
gagguucgccgucgg

SEQ ID NO: 3203462 - RNA, 16 nt, Mycobacterium bovis subsp bovis AF2122/97
gagguuggagcgccag

SEQ ID NO: 3203463 - RNA, 20 nt, Mycobacterium bovis subsp bovis AF2122/97
gagguuguuggagaugucga

SEQ ID NO: 3203464 - RNA, 23 nt, Mycobacterium bovis subsp bovis AF2122/97
gaguaaacaaacccaacaccagc

SEQ ID NO: 3203465 - RNA, 19 nt, Mycobacterium bovis subsp bovis AF2122/97
gaguaagcgaacagcggca

SEQ ID NO: 3203466 - RNA, 16 nt, Mycobacterium bovis subsp bovis AF2122/97
gaguacaggcgcagcg

SEQ ID NO: 3203467 - RNA, 18 nt, Mycobacterium bovis subsp bovis AF2122/97
gaguaccaauccaggcca

SEQ ID NO: 3203468 - RNA, 18 nt, Mycobacterium bovis subsp bovis AF2122/97
gaguaccggccagccgcg

SEQ ID NO: 3203469 - RNA, 17 nt, Mycobacterium bovis subsp bovis AF2122/97
gaguacggccugccgcu

SEQ ID NO: 3203470 - RNA, 19 nt, Mycobacterium bovis subsp bovis AF2122/97
gaguagaucccaccaccgg

SEQ ID NO: 3203471 - RNA, 22 nt, Mycobacterium bovis subsp bovis AF2122/97
gaguagccgcuaggaucggaug

SEQ ID NO: 3203472 - RNA, 19 nt, Mycobacterium bovis subsp bovis AF2122/97
gaguagccguagccgccgu

SEQ ID NO: 3203473 - RNA, 15 nt, Mycobacterium bovis subsp bovis AF2122/97
gaguaggugugcggg

SEQ ID NO: 3203474 - RNA, 18 nt, Mycobacterium bovis subsp bovis AF2122/97
gaguagucgcuggccaga

SEQ ID NO: 3203475 - RNA, 22 nt, Mycobacterium bovis subsp bovis AF2122/97
gaguagugcggugucacaacgc

SEQ ID NO: 3203476 - RNA, 13 nt, Mycobacterium bovis subsp bovis AF2122/97
gaguagugguggg

SEQ ID NO: 3203477 - RNA, 21 nt, Mycobacterium bovis subsp bovis AF2122/97
gaguaguucgucgacgucggc

SEQ ID NO: 3203478 - RNA, 15 nt, Mycobacterium bovis subsp bovis AF2122/97
gaguauuggucggug

SEQ ID NO: 3203479 - RNA, 16 nt, Mycobacterium bovis subsp bovis AF2122/97
gagucaccagcaacag

SEQ ID NO: 3203480 - RNA, 17 nt, Mycobacterium bovis subsp bovis AF2122/97
gagucaccagcaacagc

SEQ ID NO: 3203481 - RNA, 18 nt, Mycobacterium bovis subsp bovis AF2122/97
gaguccaacucggccaac

SEQ ID NO: 3203482 - RNA, 18 nt, Mycobacterium bovis subsp bovis AF2122/97
gaguccacaaguaccgca

SEQ ID NO: 3203483 - RNA, 22 nt, Mycobacterium bovis subsp bovis AF2122/97
gaguccacaaguaccgcaucga

SEQ ID NO: 3203484 - RNA, 17 nt, Mycobacterium bovis subsp bovis AF2122/97
gaguccagccggcgcgc

SEQ ID NO: 3203485 - RNA, 16 nt, Mycobacterium bovis subsp bovis AF2122/97
gaguccaggccggcag

SEQ ID NO: 3203486 - RNA, 17 nt, Mycobacterium bovis subsp bovis AF2122/97
gaguccaggccggcagc

SEQ ID NO: 3203487 - RNA, 19 nt, Mycobacterium bovis subsp bovis AF2122/97
gaguccaggcugaucccga

SEQ ID NO: 3203488 - RNA, 21 nt, Mycobacterium bovis subsp bovis AF2122/97
gaguccccaggugggcagcag

SEQ ID NO: 3203489 - RNA, 23 nt, Mycobacterium bovis subsp bovis AF2122/97
gaguccccaggugggcagcaggc

SEQ ID NO: 3203490 - RNA, 22 nt, Mycobacterium bovis subsp bovis AF2122/97
gagucccgucacucaccccaac

SEQ ID NO: 3203491 - RNA, 18 nt, Mycobacterium bovis subsp bovis AF2122/97
gaguccgacaguccgcgc

SEQ ID NO: 3203492 - RNA, 20 nt, Mycobacterium bovis subsp bovis AF2122/97
gaguccgauuuugugagcca

SEQ ID NO: 3203493 - RNA, 23 nt, Mycobacterium bovis subsp bovis AF2122/97
gaguccggcucauccgacgggau

SEQ ID NO: 3203494 - RNA, 18 nt, Mycobacterium bovis subsp bovis AF2122/97
gaguccgguagcuguggu

SEQ ID NO: 3203495 - RNA, 20 nt, Mycobacterium bovis subsp bovis AF2122/97
gaguccgguagcuguggugg

SEQ ID NO: 3203496 - RNA, 21 nt, Mycobacterium bovis subsp bovis AF2122/97
gaguccgguagcugugguggu

SEQ ID NO: 3203497 - RNA, 16 nt, Mycobacterium bovis subsp bovis AF2122/97
gaguccgucgacaccg

SEQ ID NO: 3203498 - RNA, 18 nt, Mycobacterium bovis subsp bovis AF2122/97
gagucgaaaacagcgauc

SEQ ID NO: 3203499 - RNA, 16 nt, Mycobacterium bovis subsp bovis AF2122/97
gagucgaaugucccgg

SEQ ID NO: 3203500 - RNA, 16 nt, Mycobacterium bovis subsp bovis AF2122/97
gagucgacccugccca

SEQ ID NO: 3203501 - RNA, 19 nt, Mycobacterium bovis subsp bovis AF2122/97
gagucgacccugcccagca

SEQ ID NO: 3203502 - RNA, 20 nt, Mycobacterium bovis subsp bovis AF2122/97
gagucgacccugcccagcac

SEQ ID NO: 3203503 - RNA, 21 nt, Mycobacterium bovis subsp bovis AF2122/97
gagucgacccugcccagcacc

SEQ ID NO: 3203504 - RNA, 15 nt, Mycobacterium bovis subsp bovis AF2122/97
gagucgacggccagu

SEQ ID NO: 3203505 - RNA, 12 nt, Mycobacterium bovis subsp bovis AF2122/97
gagucgaucagc

SEQ ID NO: 3203506 - RNA, 24 nt, Mycobacterium bovis subsp bovis AF2122/97
gagucgaugaccccgguggucugg

SEQ ID NO: 3203507 - RNA, 22 nt, Mycobacterium bovis subsp bovis AF2122/97
gagucgauugccaccgagauca

SEQ ID NO: 3203508 - RNA, 14 nt, Mycobacterium bovis subsp bovis AF2122/97
gagucgcacguggg

SEQ ID NO: 3203509 - RNA, 15 nt, Mycobacterium bovis subsp bovis AF2122/97
gagucgcacgugggc

SEQ ID NO: 3203510 - RNA, 14 nt, Mycobacterium bovis subsp bovis AF2122/97
gagucgcacugcgc

SEQ ID NO: 3203511 - RNA, 13 nt, Mycobacterium bovis subsp bovis AF2122/97
gagucgcagcacg

SEQ ID NO: 3203512 - RNA, 21 nt, Mycobacterium bovis subsp bovis AF2122/97
gagucgccgaggacgccggcg

SEQ ID NO: 3203513 - RNA, 22 nt, Mycobacterium bovis subsp bovis AF2122/97
gagucgccgaggacgccggcgc

SEQ ID NO: 3203514 - RNA, 17 nt, Mycobacterium bovis subsp bovis AF2122/97
gagucgcgcagggcgac

SEQ ID NO: 3203515 - RNA, 12 nt, Mycobacterium bovis subsp bovis AF2122/97
gagucggcgucg

SEQ ID NO: 3203516 - RNA, 14 nt, Mycobacterium bovis subsp bovis AF2122/97
gagucgggcuccgu

SEQ ID NO: 3203517 - RNA, 14 nt, Mycobacterium bovis subsp bovis AF2122/97
gagucgugccgccg

SEQ ID NO: 3203518 - RNA, 17 nt, Mycobacterium bovis subsp bovis AF2122/97
gagucgugccgccgcau

SEQ ID NO: 3203519 - RNA, 23 nt, Mycobacterium bovis subsp bovis AF2122/97
gagucgugccgccgcaugguggg

SEQ ID NO: 3203520 - RNA, 15 nt, Mycobacterium bovis subsp bovis AF2122/97
gagucucgucgggua

SEQ ID NO: 3203521 - RNA, 22 nt, Mycobacterium bovis subsp bovis AF2122/97
gagucucgucggguaccacgcu

SEQ ID NO: 3203522 - RNA, 19 nt, Mycobacterium bovis subsp bovis AF2122/97
gagucugauggccucgcga

SEQ ID NO: 3203523 - RNA, 17 nt, Mycobacterium bovis subsp bovis AF2122/97
gagucuucaacgucgag

SEQ ID NO: 3203524 - RNA, 21 nt, Mycobacterium bovis subsp bovis AF2122/97
gagucuucggcgacaggccga

SEQ ID NO: 3203525 - RNA, 16 nt, Mycobacterium bovis subsp bovis AF2122/97
gagugaccacgcugcu

SEQ ID NO: 3203526 - RNA, 14 nt, Mycobacterium bovis subsp bovis AF2122/97
gagugaggcgcugg

SEQ ID NO: 3203527 - RNA, 15 nt, Mycobacterium bovis subsp bovis AF2122/97
gagugaggcgcuggc

SEQ ID NO: 3203528 - RNA, 12 nt, Mycobacterium bovis subsp bovis AF2122/97
gagugcagcacg

SEQ ID NO: 3203529 - RNA, 17 nt, Mycobacterium bovis subsp bovis AF2122/97
gagugcagcacgaucca

SEQ ID NO: 3203530 - RNA, 23 nt, Mycobacterium bovis subsp bovis AF2122/97
gagugcauguccgaccucugcgu

SEQ ID NO: 3203531 - RNA, 20 nt, Mycobacterium bovis subsp bovis AF2122/97
gauacccagcgggucgcggg

SEQ ID NO: 3203532 - RNA, 19 nt, Mycobacterium bovis subsp bovis AF2122/97
gauacccgcggcagcacga

SEQ ID NO: 3203533 - RNA, 19 nt, Mycobacterium bovis subsp bovis AF2122/97
gauaccgaccaucgggacg

SEQ ID NO: 3203534 - RNA, 18 nt, Mycobacterium bovis subsp bovis AF2122/97
gauaccgacgcgcucggc

SEQ ID NO: 3203535 - RNA, 15 nt, Mycobacterium bovis subsp bovis AF2122/97
gauaccgcaccaaag

SEQ ID NO: 3203536 - RNA, 12 nt, Mycobacterium bovis subsp bovis AF2122/97
gauaccgccggc

SEQ ID NO: 3203537 - RNA, 14 nt, Mycobacterium bovis subsp bovis AF2122/97
gauaccgccggccc

SEQ ID NO: 3203538 - RNA, 17 nt, Mycobacterium bovis subsp bovis AF2122/97
gauaccggcggcgagcg

SEQ ID NO: 3203539 - RNA, 22 nt, Mycobacterium bovis subsp bovis AF2122/97
gauaccggcggcgagcggccuc

SEQ ID NO: 3203540 - RNA, 23 nt, Mycobacterium bovis subsp bovis AF2122/97
gauaccggcggcgagcggccucc

SEQ ID NO: 3203541 - RNA, 16 nt, Mycobacterium bovis subsp bovis AF2122/97
gauaccggcgugcagu

SEQ ID NO: 3203542 - RNA, 15 nt, Mycobacterium bovis subsp bovis AF2122/97
gauaccuagccccug

SEQ ID NO: 3203543 - RNA, 20 nt, Mycobacterium bovis subsp bovis AF2122/97
gauaccugggacaggacgac

SEQ ID NO: 3203544 - RNA, 13 nt, Mycobacterium bovis subsp bovis AF2122/97
gauacgagcugua

SEQ ID NO: 3203545 - RNA, 15 nt, Mycobacterium bovis subsp bovis AF2122/97
gauacgccaccggca

SEQ ID NO: 3203546 - RNA, 18 nt, Mycobacterium bovis subsp bovis AF2122/97
gauacggccaccaggugc

SEQ ID NO: 3203547 - RNA, 17 nt, Mycobacterium bovis subsp bovis AF2122/97
gauacggugcgacgauc

SEQ ID NO: 3203548 - RNA, 19 nt, Mycobacterium bovis subsp bovis AF2122/97
gauacuaaacaggccgcca

SEQ ID NO: 3203549 - RNA, 22 nt, Mycobacterium bovis subsp bovis AF2122/97
gauacucgucgucggcaggcag

SEQ ID NO: 3203550 - RNA, 16 nt, Mycobacterium bovis subsp bovis AF2122/97
gauacuguucugcugg

SEQ ID NO: 3203551 - RNA, 23 nt, Mycobacterium bovis subsp bovis AF2122/97
gauagacccugggguccagcguc

SEQ ID NO: 3203552 - RNA, 20 nt, Mycobacterium bovis subsp bovis AF2122/97
gauagacguuguugaaggcu

SEQ ID NO: 3203553 - RNA, 16 nt, Mycobacterium bovis subsp bovis AF2122/97
gauagacuagccgauc

SEQ ID NO: 3203554 - RNA, 23 nt, Mycobacterium bovis subsp bovis AF2122/97
gauagacuagccgauccagcagg

SEQ ID NO: 3203555 - RNA, 20 nt, Mycobacterium bovis subsp bovis AF2122/97
gauagaugcgugcggcagug

SEQ ID NO: 3203556 - RNA, 22 nt, Mycobacterium bovis subsp bovis AF2122/97
gauagcaacggugcucuucgau

SEQ ID NO: 3203557 - RNA, 21 nt, Mycobacterium bovis subsp bovis AF2122/97
gauagcauccgcccgagccgg

SEQ ID NO: 3203558 - RNA, 15 nt, Mycobacterium bovis subsp bovis AF2122/97
gauagcaucugauga

SEQ ID NO: 3203559 - RNA, 21 nt, Mycobacterium bovis subsp bovis AF2122/97
gauagcccagauagagcuggu

SEQ ID NO: 3203560 - RNA, 22 nt, Mycobacterium bovis subsp bovis AF2122/97
gauagcccagauagagcuggug

SEQ ID NO: 3203561 - RNA, 14 nt, Mycobacterium bovis subsp bovis AF2122/97
gauagcccgccacc

SEQ ID NO: 3203562 - RNA, 18 nt, Mycobacterium bovis subsp bovis AF2122/97
gauagccgaccagguaga

SEQ ID NO: 3203563 - RNA, 17 nt, Mycobacterium bovis subsp bovis AF2122/97
gauagccucggcggcgc

SEQ ID NO: 3203564 - RNA, 21 nt, Mycobacterium bovis subsp bovis AF2122/97
gauagcggcaaagccggguga

SEQ ID NO: 3203565 - RNA, 13 nt, Mycobacterium bovis subsp bovis AF2122/97
gauagcggcgccu

SEQ ID NO: 3203566 - RNA, 16 nt, Mycobacterium bovis subsp bovis AF2122/97
gauagcggugccguca

SEQ ID NO: 3203567 - RNA, 22 nt, Mycobacterium bovis subsp bovis AF2122/97
gauagcgucgucccagcgcggu

SEQ ID NO: 3203568 - RNA, 22 nt, Mycobacterium bovis subsp bovis AF2122/97
gauaggaccacgggaugcaugu

SEQ ID NO: 3203569 - RNA, 18 nt, Mycobacterium bovis subsp bovis AF2122/97
gauaggccgcgcggcggc

SEQ ID NO: 3203570 - RNA, 18 nt, Mycobacterium bovis subsp bovis AF2122/97
gauagggauggcgauggc

SEQ ID NO: 3203571 - RNA, 18 nt, Mycobacterium bovis subsp bovis AF2122/97
gauaggucgggcaugacg

SEQ ID NO: 3203572 - RNA, 15 nt, Mycobacterium bovis subsp bovis AF2122/97
gauaggugcucgcga

SEQ ID NO: 3203573 - RNA, 18 nt, Mycobacterium bovis subsp bovis AF2122/97
gauagguggucuuggcgg

SEQ ID NO: 3203574 - RNA, 18 nt, Mycobacterium bovis subsp bovis AF2122/97
gauagguuccaccgggcg

SEQ ID NO: 3203575 - RNA, 17 nt, Mycobacterium bovis subsp bovis AF2122/97
gauagucauucgcuccg

SEQ ID NO: 3203576 - RNA, 17 nt, Mycobacterium bovis subsp bovis AF2122/97
gauaguggcgcgcggcg

SEQ ID NO: 3203577 - RNA, 19 nt, Mycobacterium bovis subsp bovis AF2122/97
gauaguucuggcccgcagc

SEQ ID NO: 3203578 - RNA, 16 nt, Mycobacterium bovis subsp bovis AF2122/97
gauaguuuucggccgc

SEQ ID NO: 3203579 - RNA, 17 nt, Mycobacterium bovis subsp bovis AF2122/97
gauaguuuucggccgcc

SEQ ID NO: 3203580 - RNA, 12 nt, Mycobacterium bovis subsp bovis AF2122/97
gauaucacgacg

SEQ ID NO: 3203581 - RNA, 13 nt, Mycobacterium bovis subsp bovis AF2122/97
gauauccggucgc

SEQ ID NO: 3203582 - RNA, 21 nt, Mycobacterium bovis subsp bovis AF2122/97
gauauccgugaauggcagcac

SEQ ID NO: 3203583 - RNA, 16 nt, Mycobacterium bovis subsp bovis AF2122/97
gauauccuuugccgcc

SEQ ID NO: 3203584 - RNA, 18 nt, Mycobacterium bovis subsp bovis AF2122/97
gauauccuuugccgccga

SEQ ID NO: 3203585 - RNA, 16 nt, Mycobacterium bovis subsp bovis AF2122/97
gauaucgaugcggcga

SEQ ID NO: 3203586 - RNA, 23 nt, Mycobacterium bovis subsp bovis AF2122/97
gauaucggcccccaagcucugcg

SEQ ID NO: 3203587 - RNA, 19 nt, Mycobacterium bovis subsp bovis AF2122/97
gauaucggcggcuuggccg

SEQ ID NO: 3203588 - RNA, 20 nt, Mycobacterium bovis subsp bovis AF2122/97
gauaucgggcucagcggcga

SEQ ID NO: 3203589 - RNA, 23 nt, Mycobacterium bovis subsp bovis AF2122/97
gauaucgggcucagcggcgaccg

SEQ ID NO: 3203590 - RNA, 20 nt, Mycobacterium bovis subsp bovis AF2122/97
gauaucggugaccguggcgg

SEQ ID NO: 3203591 - RNA, 15 nt, Mycobacterium bovis subsp bovis AF2122/97
gauaucgucggugca

SEQ ID NO: 3203592 - RNA, 21 nt, Mycobacterium bovis subsp bovis AF2122/97
gauaucguuggcgaccaccgc

SEQ ID NO: 3203593 - RNA, 13 nt, Mycobacterium bovis subsp bovis AF2122/97
gauaugcacccgc

SEQ ID NO: 3203594 - RNA, 16 nt, Mycobacterium bovis subsp bovis AF2122/97
gauauggaccgccgcc

SEQ ID NO: 3203595 - RNA, 22 nt, Mycobacterium bovis subsp bovis AF2122/97
gauauugggauacucgucgucg

SEQ ID NO: 3203596 - RNA, 21 nt, Mycobacterium bovis subsp bovis AF2122/97
gaucaaaaaccacgcgucgcu

SEQ ID NO: 3203597 - RNA, 16 nt, Mycobacterium bovis subsp bovis AF2122/97
gaucaaaccggcggcg

SEQ ID NO: 3203598 - RNA, 19 nt, Mycobacterium bovis subsp bovis AF2122/97
gaucaaaccggcggcgacg

SEQ ID NO: 3203599 - RNA, 16 nt, Mycobacterium bovis subsp bovis AF2122/97
gaucaaacuaccgaac

SEQ ID NO: 3203600 - RNA, 22 nt, Mycobacterium bovis subsp bovis AF2122/97
gaucaacaccaacgacagcgac

SEQ ID NO: 3203601 - RNA, 23 nt, Mycobacterium bovis subsp bovis AF2122/97
gaucaacaccaacgacagcgacg

SEQ ID NO: 3203602 - RNA, 19 nt, Mycobacterium bovis subsp bovis AF2122/97
gaucaacaugccggucauc

SEQ ID NO: 3203603 - RNA, 23 nt, Mycobacterium bovis subsp bovis AF2122/97
gaucaaccccacacccgggacga

SEQ ID NO: 3203604 - RNA, 12 nt, Mycobacterium bovis subsp bovis AF2122/97
gaucaacccggc

SEQ ID NO: 3203605 - RNA, 22 nt, Mycobacterium bovis subsp bovis AF2122/97
gaucaacccggccuucuccauc

SEQ ID NO: 3203606 - RNA, 13 nt, Mycobacterium bovis subsp bovis AF2122/97
gaucaacccgguc

SEQ ID NO: 3203607 - RNA, 21 nt, Mycobacterium bovis subsp bovis AF2122/97
gaucaacccgguccagccggu

SEQ ID NO: 3203608 - RNA, 17 nt, Mycobacterium bovis subsp bovis AF2122/97
gaucaaccgggucagcc

SEQ ID NO: 3203609 - RNA, 14 nt, Mycobacterium bovis subsp bovis AF2122/97
gaucaacgcgucgc

SEQ ID NO: 3203610 - RNA, 19 nt, Mycobacterium bovis subsp bovis AF2122/97
gaucaacggaacaucguca

SEQ ID NO: 3203611 - RNA, 13 nt, Mycobacterium bovis subsp bovis AF2122/97
gaucaacgugcgc

SEQ ID NO: 3203612 - RNA, 16 nt, Mycobacterium bovis subsp bovis AF2122/97
gaucaacucgggcagc

SEQ ID NO: 3203613 - RNA, 22 nt, Mycobacterium bovis subsp bovis AF2122/97
gaucaacucgggcagcgcggcc

SEQ ID NO: 3203614 - RNA, 16 nt, Mycobacterium bovis subsp bovis AF2122/97
gaucaacucgugcggg

SEQ ID NO: 3203615 - RNA, 18 nt, Mycobacterium bovis subsp bovis AF2122/97
gaucaacucgugcgggca

SEQ ID NO: 3203616 - RNA, 19 nt, Mycobacterium bovis subsp bovis AF2122/97
gaucaacucgugcgggcag

SEQ ID NO: 3203617 - RNA, 21 nt, Mycobacterium bovis subsp bovis AF2122/97
gaucagaugcggcccgggcuc

SEQ ID NO: 3203618 - RNA, 20 nt, Mycobacterium bovis subsp bovis AF2122/97
gaucagaugggauaccccuc

SEQ ID NO: 3203619 - RNA, 17 nt, Mycobacterium bovis subsp bovis AF2122/97
gaucagcaacucggcca

SEQ ID NO: 3203620 - RNA, 20 nt, Mycobacterium bovis subsp bovis AF2122/97
gaucagcaccgacagcccga

SEQ ID NO: 3203621 - RNA, 23 nt, Mycobacterium bovis subsp bovis AF2122/97
gaucagcaccgacagcccgaacg

SEQ ID NO: 3203622 - RNA, 20 nt, Mycobacterium bovis subsp bovis AF2122/97
gaucagcaccgugacagcgg

SEQ ID NO: 3203623 - RNA, 21 nt, Mycobacterium bovis subsp bovis AF2122/97
gaucagcaccgugacagcggc

SEQ ID NO: 3203624 - RNA, 13 nt, Mycobacterium bovis subsp bovis AF2122/97
gaucagcagcaga

SEQ ID NO: 3203625 - RNA, 14 nt, Mycobacterium bovis subsp bovis AF2122/97
gaucagcagccgcc

SEQ ID NO: 3203626 - RNA, 18 nt, Mycobacterium bovis subsp bovis AF2122/97
gaucagcagccgccgaug

SEQ ID NO: 3203627 - RNA, 12 nt, Mycobacterium bovis subsp bovis AF2122/97
gaucagcagcgg

SEQ ID NO: 3203628 - RNA, 14 nt, Mycobacterium bovis subsp bovis AF2122/97
gaucagcagcggcg

SEQ ID NO: 3203629 - RNA, 12 nt, Mycobacterium bovis subsp bovis AF2122/97
gaucagcagcgu

SEQ ID NO: 3203630 - RNA, 18 nt, Mycobacterium bovis subsp bovis AF2122/97
gaucagcagcuguuggcg

SEQ ID NO: 3203631 - RNA, 15 nt, Mycobacterium bovis subsp bovis AF2122/97
gaucagcaggaucgg

SEQ ID NO: 3203632 - RNA, 17 nt, Mycobacterium bovis subsp bovis AF2122/97
gaucagcaggaucggca

SEQ ID NO: 3203633 - RNA, 20 nt, Mycobacterium bovis subsp bovis AF2122/97
gaucagcaggaucggcagca

SEQ ID NO: 3203634 - RNA, 22 nt, Mycobacterium bovis subsp bovis AF2122/97
gaucagcaugccuucggccaac

SEQ ID NO: 3203635 - RNA, 13 nt, Mycobacterium bovis subsp bovis AF2122/97
gaucagcaugguc

SEQ ID NO: 3203636 - RNA, 19 nt, Mycobacterium bovis subsp bovis AF2122/97
gaucagcaugguccacagc

SEQ ID NO: 3203637 - RNA, 23 nt, Mycobacterium bovis subsp bovis AF2122/97
gaucagccagaccaacaugaacg

SEQ ID NO: 3203638 - RNA, 15 nt, Mycobacterium bovis subsp bovis AF2122/97
gaucagcccgcgcag

SEQ ID NO: 3203639 - RNA, 23 nt, Mycobacterium bovis subsp bovis AF2122/97
gaucagccgccaaccgcaggccg

SEQ ID NO: 3203640 - RNA, 13 nt, Mycobacterium bovis subsp bovis AF2122/97
gaucagccgccgc

SEQ ID NO: 3203641 - RNA, 14 nt, Mycobacterium bovis subsp bovis AF2122/97
gaucagccgccgcc

SEQ ID NO: 3203642 - RNA, 14 nt, Mycobacterium bovis subsp bovis AF2122/97
gaucagccggcagc

SEQ ID NO: 3203643 - RNA, 21 nt, Mycobacterium bovis subsp bovis AF2122/97
gaucagccguggcagucgcac

SEQ ID NO: 3203644 - RNA, 17 nt, Mycobacterium bovis subsp bovis AF2122/97
gaucagcgaaccaccgg

SEQ ID NO: 3203645 - RNA, 22 nt, Mycobacterium bovis subsp bovis AF2122/97
gaucagcgaaccaccggcgccg

SEQ ID NO: 3203646 - RNA, 19 nt, Mycobacterium bovis subsp bovis AF2122/97
gaucagcgacuugcuggcg

SEQ ID NO: 3203647 - RNA, 22 nt, Mycobacterium bovis subsp bovis AF2122/97
gaucagcgaggaauuccgcuac

SEQ ID NO: 3203648 - RNA, 18 nt, Mycobacterium bovis subsp bovis AF2122/97
gaucagcgaguagccgcu

SEQ ID NO: 3203649 - RNA, 20 nt, Mycobacterium bovis subsp bovis AF2122/97
gaucagcgcaucgccgcugg

SEQ ID NO: 3203650 - RNA, 11 nt, Mycobacterium bovis subsp bovis AF2122/97
gaucagcgccg

SEQ ID NO: 3203651 - RNA, 22 nt, Mycobacterium bovis subsp bovis AF2122/97
gaucagcgccguggcgcggucg

SEQ ID NO: 3203652 - RNA, 15 nt, Mycobacterium bovis subsp bovis AF2122/97
gaucagcgcgcacac

SEQ ID NO: 3203653 - RNA, 15 nt, Mycobacterium bovis subsp bovis AF2122/97
gaucagcgcggcgcc

SEQ ID NO: 3203654 - RNA, 16 nt, Mycobacterium bovis subsp bovis AF2122/97
gaucagcggcagcacc

SEQ ID NO: 3203655 - RNA, 19 nt, Mycobacterium bovis subsp bovis AF2122/97
gaucagcguauuggacgcu

SEQ ID NO: 3203656 - RNA, 18 nt, Mycobacterium bovis subsp bovis AF2122/97
gaucagcgucccggucgc

SEQ ID NO: 3203657 - RNA, 20 nt, Mycobacterium bovis subsp bovis AF2122/97
gaucagcgugaucugcaggg

SEQ ID NO: 3203658 - RNA, 19 nt, Mycobacterium bovis subsp bovis AF2122/97
gaucagcgugucgccgaua

SEQ ID NO: 3203659 - RNA, 22 nt, Mycobacterium bovis subsp bovis AF2122/97
gaucagcucgcgcacgucgacg

SEQ ID NO: 3203660 - RNA, 19 nt, Mycobacterium bovis subsp bovis AF2122/97
gaucagcuugggcagcagc

SEQ ID NO: 3203661 - RNA, 21 nt, Mycobacterium bovis subsp bovis AF2122/97
gaucagcuugggcagcagcgc

SEQ ID NO: 3203662 - RNA, 23 nt, Mycobacterium bovis subsp bovis AF2122/97
gaucagcuugggcagcagcgcgc

SEQ ID NO: 3203663 - RNA, 23 nt, Mycobacterium bovis subsp bovis AF2122/97
gaucagcuugugggcgacggcga

SEQ ID NO: 3203664 - RNA, 14 nt, Mycobacterium bovis subsp bovis AF2122/97
gaucaggacgcgau

SEQ ID NO: 3203665 - RNA, 17 nt, Mycobacterium bovis subsp bovis AF2122/97
gaucaggccgaugacga

SEQ ID NO: 3203666 - RNA, 17 nt, Mycobacterium bovis subsp bovis AF2122/97
gaucaggccgucgccgg

SEQ ID NO: 3203667 - RNA, 22 nt, Mycobacterium bovis subsp bovis AF2122/97
gaucaggccguguacgugcucg

SEQ ID NO: 3203668 - RNA, 19 nt, Mycobacterium bovis subsp bovis AF2122/97
gaucaggccuugggauagg

SEQ ID NO: 3203669 - RNA, 24 nt, Mycobacterium bovis subsp bovis AF2122/97
gaucaggcgcucgaaggccgcacu

SEQ ID NO: 3203670 - RNA, 14 nt, Mycobacterium bovis subsp bovis AF2122/97
gaucaggcugggca

SEQ ID NO: 3203671 - RNA, 14 nt, Mycobacterium bovis subsp bovis AF2122/97
gaucagggcucgcu

SEQ ID NO: 3203672 - RNA, 19 nt, Mycobacterium bovis subsp bovis AF2122/97
gaucagggcucgcucgccg

SEQ ID NO: 3203673 - RNA, 16 nt, Mycobacterium bovis subsp bovis AF2122/97
gaucaggggcccaccc

SEQ ID NO: 3203674 - RNA, 19 nt, Mycobacterium bovis subsp bovis AF2122/97
gaucagggucagcgccgcg

SEQ ID NO: 3203675 - RNA, 15 nt, Mycobacterium bovis subsp bovis AF2122/97
gaucaggguggcgcg

SEQ ID NO: 3203676 - RNA, 17 nt, Mycobacterium bovis subsp bovis AF2122/97
gaucaggguggcgcggu

SEQ ID NO: 3203677 - RNA, 17 nt, Mycobacterium bovis subsp bovis AF2122/97
gaucaggucgucacgcc

SEQ ID NO: 3203678 - RNA, 17 nt, Mycobacterium bovis subsp bovis AF2122/97
gaucaggucuggcgcgg

SEQ ID NO: 3203679 - RNA, 19 nt, Mycobacterium bovis subsp bovis AF2122/97
gaucaggucuggcgcggag

SEQ ID NO: 3203680 - RNA, 15 nt, Mycobacterium bovis subsp bovis AF2122/97
gaucaggucuucgau

SEQ ID NO: 3203681 - RNA, 20 nt, Mycobacterium bovis subsp bovis AF2122/97
gaucaggucuucgauggcca

SEQ ID NO: 3203682 - RNA, 13 nt, Mycobacterium bovis subsp bovis AF2122/97
gaucagguuggcg

SEQ ID NO: 3203683 - RNA, 14 nt, Mycobacterium bovis subsp bovis AF2122/97
gaucaguccggcgu

SEQ ID NO: 3203684 - RNA, 22 nt, Mycobacterium bovis subsp bovis AF2122/97
gaucagucgugggcugugcggg

SEQ ID NO: 3203685 - RNA, 19 nt, Mycobacterium bovis subsp bovis AF2122/97
gaucagucugggcgaucgc

SEQ ID NO: 3203686 - RNA, 17 nt, Mycobacterium bovis subsp bovis AF2122/97
gaucaguucguggcugg

SEQ ID NO: 3203687 - RNA, 18 nt, Mycobacterium bovis subsp bovis AF2122/97
gaucaguucguggcuggc

SEQ ID NO: 3203688 - RNA, 17 nt, Mycobacterium bovis subsp bovis AF2122/97
gaucaucauauccgccc

SEQ ID NO: 3203689 - RNA, 16 nt, Mycobacterium bovis subsp bovis AF2122/97
gaucaucaugucggcg

SEQ ID NO: 3203690 - RNA, 17 nt, Mycobacterium bovis subsp bovis AF2122/97
gaucaucaugucggcgc

SEQ ID NO: 3203691 - RNA, 16 nt, Mycobacterium bovis subsp bovis AF2122/97
gaucaucccgaccagc

SEQ ID NO: 3203692 - RNA, 19 nt, Mycobacterium bovis subsp bovis AF2122/97
gaucaucgccgcggccagg

SEQ ID NO: 3203693 - RNA, 15 nt, Mycobacterium bovis subsp bovis AF2122/97
gaucaucuggcuggu

SEQ ID NO: 3203694 - RNA, 19 nt, Mycobacterium bovis subsp bovis AF2122/97
gaucaugaacgcaagcagc

SEQ ID NO: 3203695 - RNA, 17 nt, Mycobacterium bovis subsp bovis AF2122/97
gaucaugaccaucugcu

SEQ ID NO: 3203696 - RNA, 18 nt, Mycobacterium bovis subsp bovis AF2122/97
gaucaugacgagccgagc

SEQ ID NO: 3203697 - RNA, 19 nt, Mycobacterium bovis subsp bovis AF2122/97
gaucaugccggcgaacucg

SEQ ID NO: 3203698 - RNA, 16 nt, Mycobacterium bovis subsp bovis AF2122/97
gaucauggcggcagca

SEQ ID NO: 3203699 - RNA, 22 nt, Mycobacterium bovis subsp bovis AF2122/97
gaucauguccaucgcgcggcug

SEQ ID NO: 3203700 - RNA, 14 nt, Mycobacterium bovis subsp bovis AF2122/97
gaucauguucggcc

SEQ ID NO: 3203701 - RNA, 17 nt, Mycobacterium bovis subsp bovis AF2122/97
gaucauugcacccaccc

SEQ ID NO: 3203702 - RNA, 17 nt, Mycobacterium bovis subsp bovis AF2122/97
gauccaaguacgcuccg

SEQ ID NO: 3203703 - RNA, 18 nt, Mycobacterium bovis subsp bovis AF2122/97
gauccgcugggccgggga

SEQ ID NO: 3203704 - RNA, 19 nt, Mycobacterium bovis subsp bovis AF2122/97
gauccggaucccaccaccg

SEQ ID NO: 3203705 - RNA, 20 nt, Mycobacterium bovis subsp bovis AF2122/97
gauccggaucccaccaccgc

SEQ ID NO: 3203706 - RNA, 17 nt, Mycobacterium bovis subsp bovis AF2122/97
gauccggcagcagccgg

SEQ ID NO: 3203707 - RNA, 20 nt, Mycobacterium bovis subsp bovis AF2122/97
gauccggcagcagccggcgg

SEQ ID NO: 3203708 - RNA, 14 nt, Mycobacterium bovis subsp bovis AF2122/97
gauccggccaccac

SEQ ID NO: 3203709 - RNA, 16 nt, Mycobacterium bovis subsp bovis AF2122/97
gauccggccaccacgu

SEQ ID NO: 3203710 - RNA, 23 nt, Mycobacterium bovis subsp bovis AF2122/97
gauccggccgccaacuucaccac

SEQ ID NO: 3203711 - RNA, 20 nt, Mycobacterium bovis subsp bovis AF2122/97
gauccggccgguuggccagc

SEQ ID NO: 3203712 - RNA, 13 nt, Mycobacterium bovis subsp bovis AF2122/97
gauccggcggcag

SEQ ID NO: 3203713 - RNA, 17 nt, Mycobacterium bovis subsp bovis AF2122/97
gauccggcggcagguag

SEQ ID NO: 3203714 - RNA, 14 nt, Mycobacterium bovis subsp bovis AF2122/97
gauccggcugcggg

SEQ ID NO: 3203715 - RNA, 14 nt, Mycobacterium bovis subsp bovis AF2122/97
gauccgggcgccga

SEQ ID NO: 3203716 - RNA, 19 nt, Mycobacterium bovis subsp bovis AF2122/97
gauccggguggcgucaccg

SEQ ID NO: 3203717 - RNA, 18 nt, Mycobacterium bovis subsp bovis AF2122/97
gauccggucggccaggcc

SEQ ID NO: 3203718 - RNA, 20 nt, Mycobacterium bovis subsp bovis AF2122/97
gauccggucguagcuuccgg

SEQ ID NO: 3203719 - RNA, 21 nt, Mycobacterium bovis subsp bovis AF2122/97
gauccgucgcguugagcgcag

SEQ ID NO: 3203720 - RNA, 14 nt, Mycobacterium bovis subsp bovis AF2122/97
gauccgucggcgga

SEQ ID NO: 3203721 - RNA, 15 nt, Mycobacterium bovis subsp bovis AF2122/97
gauccgugucgcaga

SEQ ID NO: 3203722 - RNA, 17 nt, Mycobacterium bovis subsp bovis AF2122/97
gauccgugucgcagauc

SEQ ID NO: 3203723 - RNA, 20 nt, Mycobacterium bovis subsp bovis AF2122/97
gauccucgacuucggcggga

SEQ ID NO: 3203724 - RNA, 15 nt, Mycobacterium bovis subsp bovis AF2122/97
gauccucgcccgcac

SEQ ID NO: 3203725 - RNA, 17 nt, Mycobacterium bovis subsp bovis AF2122/97
gauccucgcccgcacca

SEQ ID NO: 3203726 - RNA, 22 nt, Mycobacterium bovis subsp bovis AF2122/97
gauccucgucgagguccucguc

SEQ ID NO: 3203727 - RNA, 15 nt, Mycobacterium bovis subsp bovis AF2122/97
gauccugaccagcca

SEQ ID NO: 3203728 - RNA, 17 nt, Mycobacterium bovis subsp bovis AF2122/97
gauccuggccacuccca

SEQ ID NO: 3203729 - RNA, 16 nt, Mycobacterium bovis subsp bovis AF2122/97
gauccuggccgguggu

SEQ ID NO: 3203730 - RNA, 17 nt, Mycobacterium bovis subsp bovis AF2122/97
gauccuuaucgcucucg

SEQ ID NO: 3203731 - RNA, 19 nt, Mycobacterium bovis subsp bovis AF2122/97
gaucgaacgcagccagcgc

SEQ ID NO: 3203732 - RNA, 20 nt, Mycobacterium bovis subsp bovis AF2122/97
gaucgaagaaacggcgucga

SEQ ID NO: 3203733 - RNA, 20 nt, Mycobacterium bovis subsp bovis AF2122/97
gaucgaauacccgcggggaa

SEQ ID NO: 3203734 - RNA, 22 nt, Mycobacterium bovis subsp bovis AF2122/97
gaucgaauugcguucgccgccc

SEQ ID NO: 3203735 - RNA, 14 nt, Mycobacterium bovis subsp bovis AF2122/97
gaucgacacccgcu

SEQ ID NO: 3203736 - RNA, 19 nt, Mycobacterium bovis subsp bovis AF2122/97
gaucgacacccgcucggcc

SEQ ID NO: 3203737 - RNA, 14 nt, Mycobacterium bovis subsp bovis AF2122/97
gaucgacaccgacg

SEQ ID NO: 3203738 - RNA, 23 nt, Mycobacterium bovis subsp bovis AF2122/97
gaucgacaccgacgcggucggcg

SEQ ID NO: 3203739 - RNA, 16 nt, Mycobacterium bovis subsp bovis AF2122/97
gaucgacaccgagcca

SEQ ID NO: 3203740 - RNA, 20 nt, Mycobacterium bovis subsp bovis AF2122/97
gaucgacaccgagccacgac

SEQ ID NO: 3203741 - RNA, 23 nt, Mycobacterium bovis subsp bovis AF2122/97
gaucgacaccgugaccgccgcgc

SEQ ID NO: 3203742 - RNA, 19 nt, Mycobacterium bovis subsp bovis AF2122/97
gaucgacagccccgcggcc

SEQ ID NO: 3203743 - RNA, 21 nt, Mycobacterium bovis subsp bovis AF2122/97
gaucgacagccccgcggccag

SEQ ID NO: 3203744 - RNA, 23 nt, Mycobacterium bovis subsp bovis AF2122/97
gaucgacagccccgcggccagca

SEQ ID NO: 3203745 - RNA, 18 nt, Mycobacterium bovis subsp bovis AF2122/97
gaucgacaguugcgccag

SEQ ID NO: 3203746 - RNA, 21 nt, Mycobacterium bovis subsp bovis AF2122/97
gaucgacauaguuggcgcccg

SEQ ID NO: 3203747 - RNA, 18 nt, Mycobacterium bovis subsp bovis AF2122/97
gaucgacaucaccaccgc

SEQ ID NO: 3203748 - RNA, 21 nt, Mycobacterium bovis subsp bovis AF2122/97
gaucgacaucaccaccgccgg

SEQ ID NO: 3203749 - RNA, 15 nt, Mycobacterium bovis subsp bovis AF2122/97
gaucgacaucguugg

SEQ ID NO: 3203750 - RNA, 18 nt, Mycobacterium bovis subsp bovis AF2122/97
gaucgaccaauucgaccg

SEQ ID NO: 3203751 - RNA, 21 nt, Mycobacterium bovis subsp bovis AF2122/97
gaucgaccaauucgaccgcgc

SEQ ID NO: 3203752 - RNA, 16 nt, Mycobacterium bovis subsp bovis AF2122/97
gaucgaccauggucga

SEQ ID NO: 3203753 - RNA, 13 nt, Mycobacterium bovis subsp bovis AF2122/97
gaucgacccgccc

SEQ ID NO: 3203754 - RNA, 13 nt, Mycobacterium bovis subsp bovis AF2122/97
gaucgacccgguc

SEQ ID NO: 3203755 - RNA, 17 nt, Mycobacterium bovis subsp bovis AF2122/97
gaucgacccggucgacg

SEQ ID NO: 3203756 - RNA, 22 nt, Mycobacterium bovis subsp bovis AF2122/97
gaucgacgacuuggauggccga

SEQ ID NO: 3203757 - RNA, 15 nt, Mycobacterium bovis subsp bovis AF2122/97
gaucgacgccgccac

SEQ ID NO: 3203758 - RNA, 23 nt, Mycobacterium bovis subsp bovis AF2122/97
gaucgacgccgccacccggcggg

SEQ ID NO: 3203759 - RNA, 15 nt, Mycobacterium bovis subsp bovis AF2122/97
gaucgacgcucggcu

SEQ ID NO: 3203760 - RNA, 12 nt, Mycobacterium bovis subsp bovis AF2122/97
gaucgacggcca

SEQ ID NO: 3203761 - RNA, 14 nt, Mycobacterium bovis subsp bovis AF2122/97
gaucgacggccagc

SEQ ID NO: 3203762 - RNA, 12 nt, Mycobacterium bovis subsp bovis AF2122/97
gaucgacggugu

SEQ ID NO: 3203763 - RNA, 22 nt, Mycobacterium bovis subsp bovis AF2122/97
gaucgacguucgggucgagccg

SEQ ID NO: 3203764 - RNA, 16 nt, Mycobacterium bovis subsp bovis AF2122/97
gaucgagaaccgugac

SEQ ID NO: 3203765 - RNA, 14 nt, Mycobacterium bovis subsp bovis AF2122/97
gaucgagacuucuu

SEQ ID NO: 3203766 - RNA, 17 nt, Mycobacterium bovis subsp bovis AF2122/97
gaucgagagccgaccgg

SEQ ID NO: 3203767 - RNA, 15 nt, Mycobacterium bovis subsp bovis AF2122/97
gaucgagcaggccgc

SEQ ID NO: 3203768 - RNA, 20 nt, Mycobacterium bovis subsp bovis AF2122/97
gaucgagcaggccgcccagc

SEQ ID NO: 3203769 - RNA, 13 nt, Mycobacterium bovis subsp bovis AF2122/97
gaucgagcagggu

SEQ ID NO: 3203770 - RNA, 20 nt, Mycobacterium bovis subsp bovis AF2122/97
gaucgagcagggugaccagg

SEQ ID NO: 3203771 - RNA, 22 nt, Mycobacterium bovis subsp bovis AF2122/97
gaucgagcaguuccagcucgcg

SEQ ID NO: 3203772 - RNA, 16 nt, Mycobacterium bovis subsp bovis AF2122/97
gaucgaggcggcgguc

SEQ ID NO: 3203773 - RNA, 17 nt, Mycobacterium bovis subsp bovis AF2122/97
gaucgaggcggcggucg

SEQ ID NO: 3203774 - RNA, 19 nt, Mycobacterium bovis subsp bovis AF2122/97
gaucgagggggacgcugau

SEQ ID NO: 3203775 - RNA, 17 nt, Mycobacterium bovis subsp bovis AF2122/97
gaucgaguuccgcaucg

SEQ ID NO: 3203776 - RNA, 22 nt, Mycobacterium bovis subsp bovis AF2122/97
gaucgaucagcaacucggccac

SEQ ID NO: 3203777 - RNA, 15 nt, Mycobacterium bovis subsp bovis AF2122/97
gaucgaucguagcuc

SEQ ID NO: 3203778 - RNA, 16 nt, Mycobacterium bovis subsp bovis AF2122/97
gaucgaucugcgggcg

SEQ ID NO: 3203779 - RNA, 21 nt, Mycobacterium bovis subsp bovis AF2122/97
gaucgauuccgccgcacucgg

SEQ ID NO: 3203780 - RNA, 17 nt, Mycobacterium bovis subsp bovis AF2122/97
gaucgauuccgcucguu

SEQ ID NO: 3203781 - RNA, 16 nt, Mycobacterium bovis subsp bovis AF2122/97
gaucgauucgucgcgg

SEQ ID NO: 3203782 - RNA, 19 nt, Mycobacterium bovis subsp bovis AF2122/97
gaucgauucgucgcggauc

SEQ ID NO: 3203783 - RNA, 21 nt, Mycobacterium bovis subsp bovis AF2122/97
gaucgauuuggaucggcugcg

SEQ ID NO: 3203784 - RNA, 22 nt, Mycobacterium bovis subsp bovis AF2122/97
gaucgcaagcgcggcgaagccg

SEQ ID NO: 3203785 - RNA, 16 nt, Mycobacterium bovis subsp bovis AF2122/97
gaucgcacaccaacac

SEQ ID NO: 3203786 - RNA, 13 nt, Mycobacterium bovis subsp bovis AF2122/97
gaucgcagcgcca

SEQ ID NO: 3203787 - RNA, 19 nt, Mycobacterium bovis subsp bovis AF2122/97
gaucgcagggaucaccccg

SEQ ID NO: 3203788 - RNA, 19 nt, Mycobacterium bovis subsp bovis AF2122/97
gaucgcagugagcagccgg

SEQ ID NO: 3203789 - RNA, 23 nt, Mycobacterium bovis subsp bovis AF2122/97
gaucgcugccagcggccgggcgg

SEQ ID NO: 3203790 - RNA, 14 nt, Mycobacterium bovis subsp bovis AF2122/97
gaucgcuggcgacc

SEQ ID NO: 3203791 - RNA, 16 nt, Mycobacterium bovis subsp bovis AF2122/97
gaucgcuuccucguag

SEQ ID NO: 3203792 - RNA, 13 nt, Mycobacterium bovis subsp bovis AF2122/97
gaucgcuugcccc

SEQ ID NO: 3203793 - RNA, 19 nt, Mycobacterium bovis subsp bovis AF2122/97
gaucgcuugccccgccgag

SEQ ID NO: 3203794 - RNA, 21 nt, Mycobacterium bovis subsp bovis AF2122/97
gaucggacucggaauucggcg

SEQ ID NO: 3203795 - RNA, 19 nt, Mycobacterium bovis subsp bovis AF2122/97
gaucggaucgaaguccaca

SEQ ID NO: 3203796 - RNA, 16 nt, Mycobacterium bovis subsp bovis AF2122/97
gaucggaucggcaccc

SEQ ID NO: 3203797 - RNA, 14 nt, Mycobacterium bovis subsp bovis AF2122/97
gaucggauggcggc

SEQ ID NO: 3203798 - RNA, 18 nt, Mycobacterium bovis subsp bovis AF2122/97
gaucggauggugugucgg

SEQ ID NO: 3203799 - RNA, 20 nt, Mycobacterium bovis subsp bovis AF2122/97
gaucggauugccuccgggua

SEQ ID NO: 3203800 - RNA, 17 nt, Mycobacterium bovis subsp bovis AF2122/97
gaucggcaaaccgucgg

SEQ ID NO: 3203801 - RNA, 19 nt, Mycobacterium bovis subsp bovis AF2122/97
gaucggcaacccgcaccag

SEQ ID NO: 3203802 - RNA, 22 nt, Mycobacterium bovis subsp bovis AF2122/97
gaucggcaccccacgccugccg

SEQ ID NO: 3203803 - RNA, 22 nt, Mycobacterium bovis subsp bovis AF2122/97
gaucggcacgcgcaguuuggcg

SEQ ID NO: 3203804 - RNA, 19 nt, Mycobacterium bovis subsp bovis AF2122/97
gaucggcacuagcgagccg

SEQ ID NO: 3203805 - RNA, 19 nt, Mycobacterium bovis subsp bovis AF2122/97
gaucggcacuuagcccgau

SEQ ID NO: 3203806 - RNA, 17 nt, Mycobacterium bovis subsp bovis AF2122/97
gaucggcagccagggcg

SEQ ID NO: 3203807 - RNA, 24 nt, Mycobacterium bovis subsp bovis AF2122/97
gaucggcaggguggccagcaggcg

SEQ ID NO: 3203808 - RNA, 22 nt, Mycobacterium bovis subsp bovis AF2122/97
gaucggcagucccagcgccgca

SEQ ID NO: 3203809 - RNA, 23 nt, Mycobacterium bovis subsp bovis AF2122/97
gaucggcagucccagcgccgcac

SEQ ID NO: 3203810 - RNA, 20 nt, Mycobacterium bovis subsp bovis AF2122/97
gaucggcauguucagcccga

SEQ ID NO: 3203811 - RNA, 20 nt, Mycobacterium bovis subsp bovis AF2122/97
gaucggccacgucccagaga

SEQ ID NO: 3203812 - RNA, 20 nt, Mycobacterium bovis subsp bovis AF2122/97
gaucggccauucgggaugcg

SEQ ID NO: 3203813 - RNA, 21 nt, Mycobacterium bovis subsp bovis AF2122/97
gaucggccgccgaauuggcgg

SEQ ID NO: 3203814 - RNA, 22 nt, Mycobacterium bovis subsp bovis AF2122/97
gaucggccgccgaauuggcgga

SEQ ID NO: 3203815 - RNA, 13 nt, Mycobacterium bovis subsp bovis AF2122/97
gaucggccggaua

SEQ ID NO: 3203816 - RNA, 23 nt, Mycobacterium bovis subsp bovis AF2122/97
gaucggccgguauuucggcgacu

SEQ ID NO: 3203817 - RNA, 21 nt, Mycobacterium bovis subsp bovis AF2122/97
gaucggccugcagcgaugacg

SEQ ID NO: 3203818 - RNA, 22 nt, Mycobacterium bovis subsp bovis AF2122/97
gaucggccuguccaccgaugcc

SEQ ID NO: 3203819 - RNA, 23 nt, Mycobacterium bovis subsp bovis AF2122/97
gaucggccuguccaccgaugcca

SEQ ID NO: 3203820 - RNA, 19 nt, Mycobacterium bovis subsp bovis AF2122/97
gaucggcgaggucccggcc

SEQ ID NO: 3203821 - RNA, 22 nt, Mycobacterium bovis subsp bovis AF2122/97
gaucggcgauccgacgaccucg

SEQ ID NO: 3203822 - RNA, 14 nt, Mycobacterium bovis subsp bovis AF2122/97
gaucggcgcggccg

SEQ ID NO: 3203823 - RNA, 14 nt, Mycobacterium bovis subsp bovis AF2122/97
gaucggcgcgucga

SEQ ID NO: 3203824 - RNA, 15 nt, Mycobacterium bovis subsp bovis AF2122/97
gaucggcgcuagcca

SEQ ID NO: 3203825 - RNA, 18 nt, Mycobacterium bovis subsp bovis AF2122/97
gaucggcggaccgcagcg

SEQ ID NO: 3203826 - RNA, 21 nt, Mycobacterium bovis subsp bovis AF2122/97
gaucggcggaccgcagcguga

SEQ ID NO: 3203827 - RNA, 12 nt, Mycobacterium bovis subsp bovis AF2122/97
gaucggcggaua

SEQ ID NO: 3203828 - RNA, 14 nt, Mycobacterium bovis subsp bovis AF2122/97
gaucggcggccgcg

SEQ ID NO: 3203829 - RNA, 16 nt, Mycobacterium bovis subsp bovis AF2122/97
gaucggcggccgcgac

SEQ ID NO: 3203830 - RNA, 19 nt, Mycobacterium bovis subsp bovis AF2122/97
gaucggcggccgcgaccag

SEQ ID NO: 3203831 - RNA, 13 nt, Mycobacterium bovis subsp bovis AF2122/97
gaucggcggccgg

SEQ ID NO: 3203832 - RNA, 15 nt, Mycobacterium bovis subsp bovis AF2122/97
gaucggcggccggca

SEQ ID NO: 3203833 - RNA, 16 nt, Mycobacterium bovis subsp bovis AF2122/97
gaucggcgucacgagc

SEQ ID NO: 3203834 - RNA, 11 nt, Mycobacterium bovis subsp bovis AF2122/97
gaucggcgucc

SEQ ID NO: 3203835 - RNA, 21 nt, Mycobacterium bovis subsp bovis AF2122/97
gaucggcguuagucgaucacg

SEQ ID NO: 3203836 - RNA, 19 nt, Mycobacterium bovis subsp bovis AF2122/97
gaucggcuaccuaacccgc

SEQ ID NO: 3203837 - RNA, 20 nt, Mycobacterium bovis subsp bovis AF2122/97
gaucggcuaccuaacccgcg

SEQ ID NO: 3203838 - RNA, 12 nt, Mycobacterium bovis subsp bovis AF2122/97
gaucggcucacg

SEQ ID NO: 3203839 - RNA, 13 nt, Mycobacterium bovis subsp bovis AF2122/97
gaucggcucacga

SEQ ID NO: 3203840 - RNA, 14 nt, Mycobacterium bovis subsp bovis AF2122/97
gaucggcuccgccg

SEQ ID NO: 3203841 - RNA, 13 nt, Mycobacterium bovis subsp bovis AF2122/97
gaucggcucgcca

SEQ ID NO: 3203842 - RNA, 13 nt, Mycobacterium bovis subsp bovis AF2122/97
gaucggcugcgcg

SEQ ID NO: 3203843 - RNA, 16 nt, Mycobacterium bovis subsp bovis AF2122/97
gaucggcugcgcgcuc

SEQ ID NO: 3203844 - RNA, 19 nt, Mycobacterium bovis subsp bovis AF2122/97
gaucggcuucuucuucuug

SEQ ID NO: 3203845 - RNA, 21 nt, Mycobacterium bovis subsp bovis AF2122/97
gaucggcuugccugcgccgag

SEQ ID NO: 3203846 - RNA, 20 nt, Mycobacterium bovis subsp bovis AF2122/97
gaucggcuugggaaacccgg

SEQ ID NO: 3203847 - RNA, 22 nt, Mycobacterium bovis subsp bovis AF2122/97
gaucggcuugggaaacccggcc

SEQ ID NO: 3203848 - RNA, 15 nt, Mycobacterium bovis subsp bovis AF2122/97
gaucgggcaccccga

SEQ ID NO: 3203849 - RNA, 18 nt, Mycobacterium bovis subsp bovis AF2122/97
gaucgggcccagcagcgc

SEQ ID NO: 3203850 - RNA, 21 nt, Mycobacterium bovis subsp bovis AF2122/97
gaucgggcccuccggcgcagc

SEQ ID NO: 3203851 - RNA, 15 nt, Mycobacterium bovis subsp bovis AF2122/97
gaucgggccggccgc

SEQ ID NO: 3203852 - RNA, 22 nt, Mycobacterium bovis subsp bovis AF2122/97
gaucgggccggcgcggucucgg

SEQ ID NO: 3203853 - RNA, 21 nt, Mycobacterium bovis subsp bovis AF2122/97
gaucggggaagccugcgggcc

SEQ ID NO: 3203854 - RNA, 16 nt, Mycobacterium bovis subsp bovis AF2122/97
gaucgggucguuggcg

SEQ ID NO: 3203855 - RNA, 17 nt, Mycobacterium bovis subsp bovis AF2122/97
gaucgggucguuggcgg

SEQ ID NO: 3203856 - RNA, 21 nt, Mycobacterium bovis subsp bovis AF2122/97
gaucgggucguuggcggcggu

SEQ ID NO: 3203857 - RNA, 16 nt, Mycobacterium bovis subsp bovis AF2122/97
gaucggguggcggguc

SEQ ID NO: 3203858 - RNA, 13 nt, Mycobacterium bovis subsp bovis AF2122/97
gaucgguccggcg

SEQ ID NO: 3203859 - RNA, 18 nt, Mycobacterium bovis subsp bovis AF2122/97
gaucggucggcaccaggu

SEQ ID NO: 3203860 - RNA, 22 nt, Mycobacterium bovis subsp bovis AF2122/97
gaucggugccagcacuccaccg

SEQ ID NO: 3203861 - RNA, 14 nt, Mycobacterium bovis subsp bovis AF2122/97
gaucggugccggcc

SEQ ID NO: 3203862 - RNA, 19 nt, Mycobacterium bovis subsp bovis AF2122/97
gaucggugcgaucaggcug

SEQ ID NO: 3203863 - RNA, 14 nt, Mycobacterium bovis subsp bovis AF2122/97
gaucgguggcggca

SEQ ID NO: 3203864 - RNA, 17 nt, Mycobacterium bovis subsp bovis AF2122/97
gaucgguggcggcacgc

SEQ ID NO: 3203865 - RNA, 18 nt, Mycobacterium bovis subsp bovis AF2122/97
gaucgguucgggacgcga

SEQ ID NO: 3203866 - RNA, 21 nt, Mycobacterium bovis subsp bovis AF2122/97
gaucgguuucugcggccccga

SEQ ID NO: 3203867 - RNA, 15 nt, Mycobacterium bovis subsp bovis AF2122/97
gaucguaggacucgg

SEQ ID NO: 3203868 - RNA, 17 nt, Mycobacterium bovis subsp bovis AF2122/97
gaucguaggacucggcg

SEQ ID NO: 3203869 - RNA, 19 nt, Mycobacterium bovis subsp bovis AF2122/97
gaucguaggacucggcgga

SEQ ID NO: 3203870 - RNA, 19 nt, Mycobacterium bovis subsp bovis AF2122/97
gaucguagggacgccgagc

SEQ ID NO: 3203871 - RNA, 22 nt, Mycobacterium bovis subsp bovis AF2122/97
gaucguagguacgcagggucug

SEQ ID NO: 3203872 - RNA, 16 nt, Mycobacterium bovis subsp bovis AF2122/97
gaucgucaacgacgac

SEQ ID NO: 3203873 - RNA, 15 nt, Mycobacterium bovis subsp bovis AF2122/97
gaucgucaagccggg

SEQ ID NO: 3203874 - RNA, 15 nt, Mycobacterium bovis subsp bovis AF2122/97
gaucgucacucccga

SEQ ID NO: 3203875 - RNA, 19 nt, Mycobacterium bovis subsp bovis AF2122/97
gaucugagggcucgguggc

SEQ ID NO: 3203876 - RNA, 18 nt, Mycobacterium bovis subsp bovis AF2122/97
gaucugaucggcgcggcc

SEQ ID NO: 3203877 - RNA, 15 nt, Mycobacterium bovis subsp bovis AF2122/97
gaucugccaccgcgg

SEQ ID NO: 3203878 - RNA, 14 nt, Mycobacterium bovis subsp bovis AF2122/97
gaucugcccccgcc

SEQ ID NO: 3203879 - RNA, 16 nt, Mycobacterium bovis subsp bovis AF2122/97
gaucugcccggugauc

SEQ ID NO: 3203880 - RNA, 13 nt, Mycobacterium bovis subsp bovis AF2122/97
gaucugccucucg

SEQ ID NO: 3203881 - RNA, 17 nt, Mycobacterium bovis subsp bovis AF2122/97
gaucugcgccaggggca

SEQ ID NO: 3203882 - RNA, 18 nt, Mycobacterium bovis subsp bovis AF2122/97
gaucugcgccgcgcgcgg

SEQ ID NO: 3203883 - RNA, 17 nt, Mycobacterium bovis subsp bovis AF2122/97
gaucugcggaggcgacc

SEQ ID NO: 3203884 - RNA, 14 nt, Mycobacterium bovis subsp bovis AF2122/97
gaucugcggcgccc

SEQ ID NO: 3203885 - RNA, 16 nt, Mycobacterium bovis subsp bovis AF2122/97
gaucugcggcgcccgg

SEQ ID NO: 3203886 - RNA, 16 nt, Mycobacterium bovis subsp bovis AF2122/97
gaucugcuccgcagca

SEQ ID NO: 3203887 - RNA, 22 nt, Mycobacterium bovis subsp bovis AF2122/97
gaucugcuccucggucagcggg

SEQ ID NO: 3203888 - RNA, 16 nt, Mycobacterium bovis subsp bovis AF2122/97
gaucugcucgccgagc

SEQ ID NO: 3203889 - RNA, 22 nt, Mycobacterium bovis subsp bovis AF2122/97
gaucugcucguagcggcggcgc

SEQ ID NO: 3203890 - RNA, 16 nt, Mycobacterium bovis subsp bovis AF2122/97
gaucugcugggcaaga

SEQ ID NO: 3203891 - RNA, 20 nt, Mycobacterium bovis subsp bovis AF2122/97
gaucugcugugucguacccg

SEQ ID NO: 3203892 - RNA, 16 nt, Mycobacterium bovis subsp bovis AF2122/97
gaucugcuuggugacc

SEQ ID NO: 3203893 - RNA, 14 nt, Mycobacterium bovis subsp bovis AF2122/97
gaucuggcagccga

SEQ ID NO: 3203894 - RNA, 20 nt, Mycobacterium bovis subsp bovis AF2122/97
gaucuggcggauggccgccu

SEQ ID NO: 3203895 - RNA, 21 nt, Mycobacterium bovis subsp bovis AF2122/97
gaucuggcguagugcucgccg

SEQ ID NO: 3203896 - RNA, 16 nt, Mycobacterium bovis subsp bovis AF2122/97
gaucuggcguucagcg

SEQ ID NO: 3203897 - RNA, 21 nt, Mycobacterium bovis subsp bovis AF2122/97
gaucuggcguucagcggccag

SEQ ID NO: 3203898 - RNA, 14 nt, Mycobacterium bovis subsp bovis AF2122/97
gaucugggcgguga

SEQ ID NO: 3203899 - RNA, 17 nt, Mycobacterium bovis subsp bovis AF2122/97
gaucugggcugcggccg

SEQ ID NO: 3203900 - RNA, 22 nt, Mycobacterium bovis subsp bovis AF2122/97
gaucugggcuuucgcgugcggc

SEQ ID NO: 3203901 - RNA, 18 nt, Mycobacterium bovis subsp bovis AF2122/97
gaucugggugccgguguu

SEQ ID NO: 3203902 - RNA, 17 nt, Mycobacterium bovis subsp bovis AF2122/97
gaucuggucggcggccu

SEQ ID NO: 3203903 - RNA, 17 nt, Mycobacterium bovis subsp bovis AF2122/97
gaucuggugggugcggc

SEQ ID NO: 3203904 - RNA, 17 nt, Mycobacterium bovis subsp bovis AF2122/97
gaucugucagcgcggcg

SEQ ID NO: 3203905 - RNA, 21 nt, Mycobacterium bovis subsp bovis AF2122/97
gaucugucagcgcggcgcgca

SEQ ID NO: 3203906 - RNA, 17 nt, Mycobacterium bovis subsp bovis AF2122/97
gaucugucgcgccggug

SEQ ID NO: 3203907 - RNA, 14 nt, Mycobacterium bovis subsp bovis AF2122/97
gaucuuaggcacuc

SEQ ID NO: 3203908 - RNA, 21 nt, Mycobacterium bovis subsp bovis AF2122/97
gaucuuccccucggccgcccg

SEQ ID NO: 3203909 - RNA, 20 nt, Mycobacterium bovis subsp bovis AF2122/97
gaucuucgacaggccaccgc

SEQ ID NO: 3203910 - RNA, 19 nt, Mycobacterium bovis subsp bovis AF2122/97
gaucuucgagccggcggcc

SEQ ID NO: 3203911 - RNA, 17 nt, Mycobacterium bovis subsp bovis AF2122/97
gaucuucgagcgcauca

SEQ ID NO: 3203912 - RNA, 23 nt, Mycobacterium bovis subsp bovis AF2122/97
gaucuucgcgcuguacugcccca

SEQ ID NO: 3203913 - RNA, 13 nt, Mycobacterium bovis subsp bovis AF2122/97
gaucuucggccgc

SEQ ID NO: 3203914 - RNA, 14 nt, Mycobacterium bovis subsp bovis AF2122/97
gaucuucggccgca

SEQ ID NO: 3203915 - RNA, 16 nt, Mycobacterium bovis subsp bovis AF2122/97
gaucuucugccuuggc

SEQ ID NO: 3203916 - RNA, 21 nt, Mycobacterium bovis subsp bovis AF2122/97
gaucuucugccuuggccggcu

SEQ ID NO: 3203917 - RNA, 17 nt, Mycobacterium bovis subsp bovis AF2122/97
gaucuugacgaaaucca

SEQ ID NO: 3203918 - RNA, 19 nt, Mycobacterium bovis subsp bovis AF2122/97
gaucuugcagugcgccagc

SEQ ID NO: 3203919 - RNA, 20 nt, Mycobacterium bovis subsp bovis AF2122/97
gaucuugccacuccaggagc

SEQ ID NO: 3203920 - RNA, 12 nt, Mycobacterium bovis subsp bovis AF2122/97
gaucuugccgcc

SEQ ID NO: 3203921 - RNA, 13 nt, Mycobacterium bovis subsp bovis AF2122/97
gaucuugccgccc

SEQ ID NO: 3203922 - RNA, 14 nt, Mycobacterium bovis subsp bovis AF2122/97
gaucuugccgcccu

SEQ ID NO: 3203923 - RNA, 14 nt, Mycobacterium bovis subsp bovis AF2122/97
gaucuugccgcugg

SEQ ID NO: 3203924 - RNA, 16 nt, Mycobacterium bovis subsp bovis AF2122/97
gaucuugccgcuggug

SEQ ID NO: 3203925 - RNA, 20 nt, Mycobacterium bovis subsp bovis AF2122/97
gaucuugccgcuggugguga

SEQ ID NO: 3203926 - RNA, 15 nt, Mycobacterium bovis subsp bovis AF2122/97
gaucuugcgacgccc

SEQ ID NO: 3203927 - RNA, 11 nt, Mycobacterium bovis subsp bovis AF2122/97
gaucuuggcca

SEQ ID NO: 3203928 - RNA, 13 nt, Mycobacterium bovis subsp bovis AF2122/97
gaucuuggccacc

SEQ ID NO: 3203929 - RNA, 16 nt, Mycobacterium bovis subsp bovis AF2122/97
gaucuuggccaccgcc

SEQ ID NO: 3203930 - RNA, 20 nt, Mycobacterium bovis subsp bovis AF2122/97
gaucuuggccagcagcgcgg

SEQ ID NO: 3203931 - RNA, 17 nt, Mycobacterium bovis subsp bovis AF2122/97
gaucuuggcgcccgccg

SEQ ID NO: 3203932 - RNA, 22 nt, Mycobacterium bovis subsp bovis AF2122/97
gaucuugucgagcagcucgcac

SEQ ID NO: 3203933 - RNA, 18 nt, Mycobacterium bovis subsp bovis AF2122/97
gaucuugucgcguucggc

SEQ ID NO: 3203934 - RNA, 16 nt, Mycobacterium bovis subsp bovis AF2122/97
gaucuugugccaggcg

SEQ ID NO: 3203935 - RNA, 13 nt, Mycobacterium bovis subsp bovis AF2122/97
gaugaaacgccgu

SEQ ID NO: 3203936 - RNA, 16 nt, Mycobacterium bovis subsp bovis AF2122/97
gaugaacaccggcgcc

SEQ ID NO: 3203937 - RNA, 17 nt, Mycobacterium bovis subsp bovis AF2122/97
gaugaacagacgcccga

SEQ ID NO: 3203938 - RNA, 14 nt, Mycobacterium bovis subsp bovis AF2122/97
gaugaacagcgacg

SEQ ID NO: 3203939 - RNA, 20 nt, Mycobacterium bovis subsp bovis AF2122/97
gaugaaccacggcaggcagg

SEQ ID NO: 3203940 - RNA, 16 nt, Mycobacterium bovis subsp bovis AF2122/97
gaugaacucggcgauc

SEQ ID NO: 3203941 - RNA, 14 nt, Mycobacterium bovis subsp bovis AF2122/97
gaugaagcgcgguu

SEQ ID NO: 3203942 - RNA, 17 nt, Mycobacterium bovis subsp bovis AF2122/97
gaugaauucgcuugcag

SEQ ID NO: 3203943 - RNA, 18 nt, Mycobacterium bovis subsp bovis AF2122/97
gaugacaccgaccggguc

SEQ ID NO: 3203944 - RNA, 19 nt, Mycobacterium bovis subsp bovis AF2122/97
gaugacagacaucgcgacg

SEQ ID NO: 3203945 - RNA, 21 nt, Mycobacterium bovis subsp bovis AF2122/97
gaugacaggcuuggcaugcgg

SEQ ID NO: 3203946 - RNA, 16 nt, Mycobacterium bovis subsp bovis AF2122/97
gaugacaucaccgacc

SEQ ID NO: 3203947 - RNA, 21 nt, Mycobacterium bovis subsp bovis AF2122/97
gaugacauccuugacgcggcc

SEQ ID NO: 3203948 - RNA, 13 nt, Mycobacterium bovis subsp bovis AF2122/97
gaugaccacgccg

SEQ ID NO: 3203949 - RNA, 16 nt, Mycobacterium bovis subsp bovis AF2122/97
gaugaccacgccgacg

SEQ ID NO: 3203950 - RNA, 17 nt, Mycobacterium bovis subsp bovis AF2122/97
gaugaccagggucugcu

SEQ ID NO: 3203951 - RNA, 19 nt, Mycobacterium bovis subsp bovis AF2122/97
gaugaccagggucugcuca

SEQ ID NO: 3203952 - RNA, 19 nt, Mycobacterium bovis subsp bovis AF2122/97
gaugaccaggucggucagg

SEQ ID NO: 3203953 - RNA, 16 nt, Mycobacterium bovis subsp bovis AF2122/97
gaugaccagugaucag

SEQ ID NO: 3203954 - RNA, 13 nt, Mycobacterium bovis subsp bovis AF2122/97
gaugaccgccauc

SEQ ID NO: 3203955 - RNA, 21 nt, Mycobacterium bovis subsp bovis AF2122/97
gaugaccgccaucgccaacac

SEQ ID NO: 3203956 - RNA, 14 nt, Mycobacterium bovis subsp bovis AF2122/97
gaugaccgccgccg

SEQ ID NO: 3203957 - RNA, 19 nt, Mycobacterium bovis subsp bovis AF2122/97
gaugaccgccuugggcaga

SEQ ID NO: 3203958 - RNA, 12 nt, Mycobacterium bovis subsp bovis AF2122/97
gaugaccgcgcg

SEQ ID NO: 3203959 - RNA, 20 nt, Mycobacterium bovis subsp bovis AF2122/97
gaugaccgcguagagcagca

SEQ ID NO: 3203960 - RNA, 16 nt, Mycobacterium bovis subsp bovis AF2122/97
gaugaccgcucgugca

SEQ ID NO: 3203961 - RNA, 14 nt, Mycobacterium bovis subsp bovis AF2122/97
gaugaccucggcga

SEQ ID NO: 3203962 - RNA, 20 nt, Mycobacterium bovis subsp bovis AF2122/97
gaugccccuucaaagcggcc

SEQ ID NO: 3203963 - RNA, 14 nt, Mycobacterium bovis subsp bovis AF2122/97
gaugcccgcaacgc

SEQ ID NO: 3203964 - RNA, 15 nt, Mycobacterium bovis subsp bovis AF2122/97
gaugcccggcaucgc

SEQ ID NO: 3203965 - RNA, 21 nt, Mycobacterium bovis subsp bovis AF2122/97
gaugcccgguuucuucuucaa

SEQ ID NO: 3203966 - RNA, 17 nt, Mycobacterium bovis subsp bovis AF2122/97
gaugcccguagacgccg

SEQ ID NO: 3203967 - RNA, 19 nt, Mycobacterium bovis subsp bovis AF2122/97
gaugcccuccucgaccgcg

SEQ ID NO: 3203968 - RNA, 20 nt, Mycobacterium bovis subsp bovis AF2122/97
gaugcccuccucgaccgcgg

SEQ ID NO: 3203969 - RNA, 16 nt, Mycobacterium bovis subsp bovis AF2122/97
gaugcccucgauggcc

SEQ ID NO: 3203970 - RNA, 22 nt, Mycobacterium bovis subsp bovis AF2122/97
gaugcccuggggguggcagcgc

SEQ ID NO: 3203971 - RNA, 17 nt, Mycobacterium bovis subsp bovis AF2122/97
gaugccgaaccgcugcg

SEQ ID NO: 3203972 - RNA, 22 nt, Mycobacterium bovis subsp bovis AF2122/97
gaugccgacgaacgaaccgccg

SEQ ID NO: 3203973 - RNA, 17 nt, Mycobacterium bovis subsp bovis AF2122/97
gaugccgaggaucgcgc

SEQ ID NO: 3203974 - RNA, 18 nt, Mycobacterium bovis subsp bovis AF2122/97
gaugccgaggaucgcgcc

SEQ ID NO: 3203975 - RNA, 13 nt, Mycobacterium bovis subsp bovis AF2122/97
gaugccgaugacc

SEQ ID NO: 3203976 - RNA, 22 nt, Mycobacterium bovis subsp bovis AF2122/97
gaugccgaugcgacgcagaccg

SEQ ID NO: 3203977 - RNA, 20 nt, Mycobacterium bovis subsp bovis AF2122/97
gaugccgccgaagaggagaa

SEQ ID NO: 3203978 - RNA, 12 nt, Mycobacterium bovis subsp bovis AF2122/97
gaugccgccggc

SEQ ID NO: 3203979 - RNA, 19 nt, Mycobacterium bovis subsp bovis AF2122/97
gaugccgcgcagcgcggcg

SEQ ID NO: 3203980 - RNA, 12 nt, Mycobacterium bovis subsp bovis AF2122/97
gaugccgcggcu

SEQ ID NO: 3203981 - RNA, 24 nt, Mycobacterium bovis subsp bovis AF2122/97
gaugccggacgccaugcccgcacg

SEQ ID NO: 3203982 - RNA, 13 nt, Mycobacterium bovis subsp bovis AF2122/97
gaugccggcgagc

SEQ ID NO: 3203983 - RNA, 16 nt, Mycobacterium bovis subsp bovis AF2122/97
gaugccggcgagggcc

SEQ ID NO: 3203984 - RNA, 17 nt, Mycobacterium bovis subsp bovis AF2122/97
gaugccggcgagggcca

SEQ ID NO: 3203985 - RNA, 18 nt, Mycobacterium bovis subsp bovis AF2122/97
gaugccggcugccgcacc

SEQ ID NO: 3203986 - RNA, 14 nt, Mycobacterium bovis subsp bovis AF2122/97
gaugccggcuggcg

SEQ ID NO: 3203987 - RNA, 13 nt, Mycobacterium bovis subsp bovis AF2122/97
gaugccgggucgc

SEQ ID NO: 3203988 - RNA, 16 nt, Mycobacterium bovis subsp bovis AF2122/97
gaugccggucggcguc

SEQ ID NO: 3203989 - RNA, 17 nt, Mycobacterium bovis subsp bovis AF2122/97
gaugccggucggcgucg

SEQ ID NO: 3203990 - RNA, 12 nt, Mycobacterium bovis subsp bovis AF2122/97
gaugccguaggc

SEQ ID NO: 3203991 - RNA, 15 nt, Mycobacterium bovis subsp bovis AF2122/97
gaugccguaggcggc

SEQ ID NO: 3203992 - RNA, 18 nt, Mycobacterium bovis subsp bovis AF2122/97
gaugccguaggcggccag

SEQ ID NO: 3203993 - RNA, 17 nt, Mycobacterium bovis subsp bovis AF2122/97
gaugccgugcccggugc

SEQ ID NO: 3203994 - RNA, 18 nt, Mycobacterium bovis subsp bovis AF2122/97
gaugccguguucagcacc

SEQ ID NO: 3203995 - RNA, 22 nt, Mycobacterium bovis subsp bovis AF2122/97
gaugccguguucgauagcggcg

SEQ ID NO: 3203996 - RNA, 21 nt, Mycobacterium bovis subsp bovis AF2122/97
gaugccguucaugccauggau

SEQ ID NO: 3203997 - RNA, 16 nt, Mycobacterium bovis subsp bovis AF2122/97
gaugccguuggcgugc

SEQ ID NO: 3203998 - RNA, 22 nt, Mycobacterium bovis subsp bovis AF2122/97
gaugccuagugguucgaaccgu

SEQ ID NO: 3203999 - RNA, 15 nt, Mycobacterium bovis subsp bovis AF2122/97
gaugccucggcggcc

SEQ ID NO: 3204000 - RNA, 22 nt, Mycobacterium bovis subsp bovis AF2122/97
gaugccucggcggccucgcugc

SEQ ID NO: 3204001 - RNA, 15 nt, Mycobacterium bovis subsp bovis AF2122/97
gaugccuggucgcgg

SEQ ID NO: 3204002 - RNA, 19 nt, Mycobacterium bovis subsp bovis AF2122/97
gaugccuucguagcggccg

SEQ ID NO: 3204003 - RNA, 16 nt, Mycobacterium bovis subsp bovis AF2122/97
gaugcgaaacaucucg

SEQ ID NO: 3204004 - RNA, 16 nt, Mycobacterium bovis subsp bovis AF2122/97
gaugcgaaaguggugg

SEQ ID NO: 3204005 - RNA, 18 nt, Mycobacterium bovis subsp bovis AF2122/97
gaugcgacagcgcugggc

SEQ ID NO: 3204006 - RNA, 22 nt, Mycobacterium bovis subsp bovis AF2122/97
gaugcgacccgcagaccgccac

SEQ ID NO: 3204007 - RNA, 13 nt, Mycobacterium bovis subsp bovis AF2122/97
gaugcgaccgccg

SEQ ID NO: 3204008 - RNA, 13 nt, Mycobacterium bovis subsp bovis AF2122/97
gaugcgacgaacc

SEQ ID NO: 3204009 - RNA, 14 nt, Mycobacterium bovis subsp bovis AF2122/97
gaugcgauaacccg

SEQ ID NO: 3204010 - RNA, 14 nt, Mycobacterium bovis subsp bovis AF2122/97
gaugcgaucgacga

SEQ ID NO: 3204011 - RNA, 16 nt, Mycobacterium bovis subsp bovis AF2122/97
gaugcgaucgucacgc

SEQ ID NO: 3204012 - RNA, 21 nt, Mycobacterium bovis subsp bovis AF2122/97
gaugcgauggccgacgcugcu

SEQ ID NO: 3204013 - RNA, 22 nt, Mycobacterium bovis subsp bovis AF2122/97
gaugcgauggccgacgcugcug

SEQ ID NO: 3204014 - RNA, 15 nt, Mycobacterium bovis subsp bovis AF2122/97
gaugcgcaacaccuc

SEQ ID NO: 3204015 - RNA, 22 nt, Mycobacterium bovis subsp bovis AF2122/97
gaugcgcaacuucuucagcagc

SEQ ID NO: 3204016 - RNA, 14 nt, Mycobacterium bovis subsp bovis AF2122/97
gaugcgcaccagca

SEQ ID NO: 3204017 - RNA, 17 nt, Mycobacterium bovis subsp bovis AF2122/97
gaugcgcaccagcggcu

SEQ ID NO: 3204018 - RNA, 18 nt, Mycobacterium bovis subsp bovis AF2122/97
gaugcgcaccagcggcug

SEQ ID NO: 3204019 - RNA, 23 nt, Mycobacterium bovis subsp bovis AF2122/97
gaugcgcacucccggcucggcca

SEQ ID NO: 3204020 - RNA, 14 nt, Mycobacterium bovis subsp bovis AF2122/97
gaugcgcagcccgu

SEQ ID NO: 3204021 - RNA, 20 nt, Mycobacterium bovis subsp bovis AF2122/97
gaugcgcagugcaccgcguc

SEQ ID NO: 3204022 - RNA, 21 nt, Mycobacterium bovis subsp bovis AF2122/97
gaugcgcagugcaccgcgucg

SEQ ID NO: 3204023 - RNA, 15 nt, Mycobacterium bovis subsp bovis AF2122/97
gaugcgccaccggcg

SEQ ID NO: 3204024 - RNA, 16 nt, Mycobacterium bovis subsp bovis AF2122/97
gaugcgccaggcugaa

SEQ ID NO: 3204025 - RNA, 17 nt, Mycobacterium bovis subsp bovis AF2122/97
gaugcgccaggcugaag

SEQ ID NO: 3204026 - RNA, 13 nt, Mycobacterium bovis subsp bovis AF2122/97
gaugcgcccggcg

SEQ ID NO: 3204027 - RNA, 16 nt, Mycobacterium bovis subsp bovis AF2122/97
gaugcgcccggcgugg

SEQ ID NO: 3204028 - RNA, 12 nt, Mycobacterium bovis subsp bovis AF2122/97
gaugcgccgcac

SEQ ID NO: 3204029 - RNA, 13 nt, Mycobacterium bovis subsp bovis AF2122/97
gaugcgcgccccg

SEQ ID NO: 3204030 - RNA, 15 nt, Mycobacterium bovis subsp bovis AF2122/97
gaugcgcgcccgacg

SEQ ID NO: 3204031 - RNA, 13 nt, Mycobacterium bovis subsp bovis AF2122/97
gaugcgcgccggc

SEQ ID NO: 3204032 - RNA, 21 nt, Mycobacterium bovis subsp bovis AF2122/97
gaugcgcgcggcgcgaucguc

SEQ ID NO: 3204033 - RNA, 21 nt, Mycobacterium bovis subsp bovis AF2122/97
gaugcgcguuacccaucgcca

SEQ ID NO: 3204034 - RNA, 14 nt, Mycobacterium bovis subsp bovis AF2122/97
gaugcgcuaggugc

SEQ ID NO: 3204035 - RNA, 16 nt, Mycobacterium bovis subsp bovis AF2122/97
gaugcgcucggccugc

SEQ ID NO: 3204036 - RNA, 20 nt, Mycobacterium bovis subsp bovis AF2122/97
gaugcgcugcucacgcagca

SEQ ID NO: 3204037 - RNA, 23 nt, Mycobacterium bovis subsp bovis AF2122/97
gaugcgcuuccaucgccacuguu

SEQ ID NO: 3204038 - RNA, 17 nt, Mycobacterium bovis subsp bovis AF2122/97
gaugcggaacgccgagc

SEQ ID NO: 3204039 - RNA, 15 nt, Mycobacterium bovis subsp bovis AF2122/97
gaugcggaccacacc

SEQ ID NO: 3204040 - RNA, 21 nt, Mycobacterium bovis subsp bovis AF2122/97
gaugcggaugucgucgaccag

SEQ ID NO: 3204041 - RNA, 22 nt, Mycobacterium bovis subsp bovis AF2122/97
gaugcggccaugaaaaucggca

SEQ ID NO: 3204042 - RNA, 22 nt, Mycobacterium bovis subsp bovis AF2122/97
gaugcggccccaugcgccagcg

SEQ ID NO: 3204043 - RNA, 14 nt, Mycobacterium bovis subsp bovis AF2122/97
gaugcggccggcgc

SEQ ID NO: 3204044 - RNA, 14 nt, Mycobacterium bovis subsp bovis AF2122/97
gaugcggcgaccac

SEQ ID NO: 3204045 - RNA, 16 nt, Mycobacterium bovis subsp bovis AF2122/97
gaugcggcgaccaccg

SEQ ID NO: 3204046 - RNA, 16 nt, Mycobacterium bovis subsp bovis AF2122/97
gaugcggcgcagcgac

SEQ ID NO: 3204047 - RNA, 17 nt, Mycobacterium bovis subsp bovis AF2122/97
gaugcggcgcagcgacg

SEQ ID NO: 3204048 - RNA, 18 nt, Mycobacterium bovis subsp bovis AF2122/97
gaugcgggccgccaggcg

SEQ ID NO: 3204049 - RNA, 15 nt, Mycobacterium bovis subsp bovis AF2122/97
gauggcggccaccag

SEQ ID NO: 3204050 - RNA, 20 nt, Mycobacterium bovis subsp bovis AF2122/97
gauggcggccaccagcgccu

SEQ ID NO: 3204051 - RNA, 14 nt, Mycobacterium bovis subsp bovis AF2122/97
gauggcggccaccg

SEQ ID NO: 3204052 - RNA, 13 nt, Mycobacterium bovis subsp bovis AF2122/97
gauggcggccgag

SEQ ID NO: 3204053 - RNA, 12 nt, Mycobacterium bovis subsp bovis AF2122/97
gauggcggcgcg

SEQ ID NO: 3204054 - RNA, 15 nt, Mycobacterium bovis subsp bovis AF2122/97
gauggcggcgcguuc

SEQ ID NO: 3204055 - RNA, 12 nt, Mycobacterium bovis subsp bovis AF2122/97
gauggcgguggc

SEQ ID NO: 3204056 - RNA, 19 nt, Mycobacterium bovis subsp bovis AF2122/97
gauggcgguggugccgcgg

SEQ ID NO: 3204057 - RNA, 23 nt, Mycobacterium bovis subsp bovis AF2122/97
gauggcgguggugccgcggccac

SEQ ID NO: 3204058 - RNA, 16 nt, Mycobacterium bovis subsp bovis AF2122/97
gauggcguccaucucg

SEQ ID NO: 3204059 - RNA, 14 nt, Mycobacterium bovis subsp bovis AF2122/97
gauggcgucgacca

SEQ ID NO: 3204060 - RNA, 13 nt, Mycobacterium bovis subsp bovis AF2122/97
gauggcgucgccg

SEQ ID NO: 3204061 - RNA, 16 nt, Mycobacterium bovis subsp bovis AF2122/97
gauggcgucgccggcc

SEQ ID NO: 3204062 - RNA, 12 nt, Mycobacterium bovis subsp bovis AF2122/97
gauggcgucggc

SEQ ID NO: 3204063 - RNA, 16 nt, Mycobacterium bovis subsp bovis AF2122/97
gauggcgucggccagg

SEQ ID NO: 3204064 - RNA, 17 nt, Mycobacterium bovis subsp bovis AF2122/97
gauggcgucggccagga

SEQ ID NO: 3204065 - RNA, 22 nt, Mycobacterium bovis subsp bovis AF2122/97
gauggcgucggugaaugccguc

SEQ ID NO: 3204066 - RNA, 21 nt, Mycobacterium bovis subsp bovis AF2122/97
gauggcucaccagcuccucgu

SEQ ID NO: 3204067 - RNA, 23 nt, Mycobacterium bovis subsp bovis AF2122/97
gauggcucacccaggcgccgaug

SEQ ID NO: 3204068 - RNA, 23 nt, Mycobacterium bovis subsp bovis AF2122/97
gauggcuccggccgcguuggggu

SEQ ID NO: 3204069 - RNA, 12 nt, Mycobacterium bovis subsp bovis AF2122/97
gauggcucgccg

SEQ ID NO: 3204070 - RNA, 13 nt, Mycobacterium bovis subsp bovis AF2122/97
gauggcucgccga

SEQ ID NO: 3204071 - RNA, 19 nt, Mycobacterium bovis subsp bovis AF2122/97
gauggcuggccagcacgcc

SEQ ID NO: 3204072 - RNA, 17 nt, Mycobacterium bovis subsp bovis AF2122/97
gauggcuuggaccagcg

SEQ ID NO: 3204073 - RNA, 13 nt, Mycobacterium bovis subsp bovis AF2122/97
gaugggaaccgaa

SEQ ID NO: 3204074 - RNA, 22 nt, Mycobacterium bovis subsp bovis AF2122/97
gaugggaaccgaaucggcaccg

SEQ ID NO: 3204075 - RNA, 13 nt, Mycobacterium bovis subsp bovis AF2122/97
gaugggaaucagu

SEQ ID NO: 3204076 - RNA, 23 nt, Mycobacterium bovis subsp bovis AF2122/97
gaugggaccuugaucgagcaggg

SEQ ID NO: 3204077 - RNA, 15 nt, Mycobacterium bovis subsp bovis AF2122/97
gaugggagcccggcg

SEQ ID NO: 3204078 - RNA, 20 nt, Mycobacterium bovis subsp bovis AF2122/97
gaugggauaccccuccgauc

SEQ ID NO: 3204079 - RNA, 13 nt, Mycobacterium bovis subsp bovis AF2122/97
gaugggcagccgc

SEQ ID NO: 3204080 - RNA, 15 nt, Mycobacterium bovis subsp bovis AF2122/97
gaugggcagccgccc

SEQ ID NO: 3204081 - RNA, 19 nt, Mycobacterium bovis subsp bovis AF2122/97
gaugggcagccgcccgccc

SEQ ID NO: 3204082 - RNA, 15 nt, Mycobacterium bovis subsp bovis AF2122/97
gaugggcaugguggu

SEQ ID NO: 3204083 - RNA, 18 nt, Mycobacterium bovis subsp bovis AF2122/97
gaugggcccagcggccgc

SEQ ID NO: 3204084 - RNA, 15 nt, Mycobacterium bovis subsp bovis AF2122/97
gaugggccuccaccg

SEQ ID NO: 3204085 - RNA, 20 nt, Mycobacterium bovis subsp bovis AF2122/97
gaugggcgucgaagaccgcc

SEQ ID NO: 3204086 - RNA, 14 nt, Mycobacterium bovis subsp bovis AF2122/97
gaugggcucgacgu

SEQ ID NO: 3204087 - RNA, 22 nt, Mycobacterium bovis subsp bovis AF2122/97
gaugggcugaggaacgccggca

SEQ ID NO: 3204088 - RNA, 23 nt, Mycobacterium bovis subsp bovis AF2122/97
gauggggaacggguagugcacgg

SEQ ID NO: 3204089 - RNA, 16 nt, Mycobacterium bovis subsp bovis AF2122/97
gauggggacggcggcg

SEQ ID NO: 3204090 - RNA, 22 nt, Mycobacterium bovis subsp bovis AF2122/97
gaugggguuaggaguggccggg

SEQ ID NO: 3204091 - RNA, 18 nt, Mycobacterium bovis subsp bovis AF2122/97
gauggguacccgaucacu

SEQ ID NO: 3204092 - RNA, 15 nt, Mycobacterium bovis subsp bovis AF2122/97
gaugggucaggccga

SEQ ID NO: 3204093 - RNA, 16 nt, Mycobacterium bovis subsp bovis AF2122/97
gaugguacccgcgccg

SEQ ID NO: 3204094 - RNA, 19 nt, Mycobacterium bovis subsp bovis AF2122/97
gaugguacccgcgccgcgc

SEQ ID NO: 3204095 - RNA, 16 nt, Mycobacterium bovis subsp bovis AF2122/97
gaugguaccgccacug

SEQ ID NO: 3204096 - RNA, 23 nt, Mycobacterium bovis subsp bovis AF2122/97
gaugguaccgccacuggcgcuga

SEQ ID NO: 3204097 - RNA, 14 nt, Mycobacterium bovis subsp bovis AF2122/97
gaugguacucaggu

SEQ ID NO: 3204098 - RNA, 17 nt, Mycobacterium bovis subsp bovis AF2122/97
gaugguagucgcgaccg

SEQ ID NO: 3204099 - RNA, 16 nt, Mycobacterium bovis subsp bovis AF2122/97
gauggucaaugccggc

SEQ ID NO: 3204100 - RNA, 18 nt, Mycobacterium bovis subsp bovis AF2122/97
gauggucaaugccggccg

SEQ ID NO: 3204101 - RNA, 18 nt, Mycobacterium bovis subsp bovis AF2122/97
gauggucaaugcgcuggc

SEQ ID NO: 3204102 - RNA, 19 nt, Mycobacterium bovis subsp bovis AF2122/97
gauggucaaugcgcuggcg

SEQ ID NO: 3204103 - RNA, 22 nt, Mycobacterium bovis subsp bovis AF2122/97
gauggucaaugcgcuggcgccg

SEQ ID NO: 3204104 - RNA, 17 nt, Mycobacterium bovis subsp bovis AF2122/97
gauggucaccgucugca

SEQ ID NO: 3204105 - RNA, 22 nt, Mycobacterium bovis subsp bovis AF2122/97
gauggucacugugacgccgggc

SEQ ID NO: 3204106 - RNA, 17 nt, Mycobacterium bovis subsp bovis AF2122/97
gauggucggccacgcgc

SEQ ID NO: 3204107 - RNA, 14 nt, Mycobacterium bovis subsp bovis AF2122/97
gauggucgggcggc

SEQ ID NO: 3204108 - RNA, 15 nt, Mycobacterium bovis subsp bovis AF2122/97
gauggucuccaccag

SEQ ID NO: 3204109 - RNA, 23 nt, Mycobacterium bovis subsp bovis AF2122/97
gauggucucccggcugaugccug

SEQ ID NO: 3204110 - RNA, 15 nt, Mycobacterium bovis subsp bovis AF2122/97
gauggugaccagcag

SEQ ID NO: 3204111 - RNA, 17 nt, Mycobacterium bovis subsp bovis AF2122/97
gauggugaccagcaggc

SEQ ID NO: 3204112 - RNA, 23 nt, Mycobacterium bovis subsp bovis AF2122/97
gauggugaugggggagccgguga

SEQ ID NO: 3204113 - RNA, 14 nt, Mycobacterium bovis subsp bovis AF2122/97
gauggugccgaacc

SEQ ID NO: 3204114 - RNA, 14 nt, Mycobacterium bovis subsp bovis AF2122/97
gauggugccgaccc

SEQ ID NO: 3204115 - RNA, 21 nt, Mycobacterium bovis subsp bovis AF2122/97
gauggugccgacccgccgcgc

SEQ ID NO: 3204116 - RNA, 19 nt, Mycobacterium bovis subsp bovis AF2122/97
gauggugcgcccgccggcg

SEQ ID NO: 3204117 - RNA, 15 nt, Mycobacterium bovis subsp bovis AF2122/97
gauggugcgccgggc

SEQ ID NO: 3204118 - RNA, 16 nt, Mycobacterium bovis subsp bovis AF2122/97
gauggugcggcccaac

SEQ ID NO: 3204119 - RNA, 21 nt, Mycobacterium bovis subsp bovis AF2122/97
gauggugcucaaggcuucggc

SEQ ID NO: 3204120 - RNA, 15 nt, Mycobacterium bovis subsp bovis AF2122/97
gaugguggcaacggg

SEQ ID NO: 3204121 - RNA, 21 nt, Mycobacterium bovis subsp bovis AF2122/97
gaugguggccgccaccuccca

SEQ ID NO: 3204122 - RNA, 23 nt, Mycobacterium bovis subsp bovis AF2122/97
gaugguggcgaucaucggccccg

SEQ ID NO: 3204123 - RNA, 22 nt, Mycobacterium bovis subsp bovis AF2122/97
gaugguggcgguuccggccggc

SEQ ID NO: 3204124 - RNA, 14 nt, Mycobacterium bovis subsp bovis AF2122/97
gaugguggucacca

SEQ ID NO: 3204125 - RNA, 16 nt, Mycobacterium bovis subsp bovis AF2122/97
gaugguggucaccacc

SEQ ID NO: 3204126 - RNA, 17 nt, Mycobacterium bovis subsp bovis AF2122/97
gaugguggucaccacca

SEQ ID NO: 3204127 - RNA, 20 nt, Mycobacterium bovis subsp bovis AF2122/97
gaugguggugccaaccuggg

SEQ ID NO: 3204128 - RNA, 21 nt, Mycobacterium bovis subsp bovis AF2122/97
gaugguggugccaaccugggc

SEQ ID NO: 3204129 - RNA, 17 nt, Mycobacterium bovis subsp bovis AF2122/97
gaugguggugccgaccu

SEQ ID NO: 3204130 - RNA, 17 nt, Mycobacterium bovis subsp bovis AF2122/97
gaugguguacacgucgc

SEQ ID NO: 3204131 - RNA, 17 nt, Mycobacterium bovis subsp bovis AF2122/97
gaugguguacugcugcu

SEQ ID NO: 3204132 - RNA, 19 nt, Mycobacterium bovis subsp bovis AF2122/97
gaugguguacugcugcuug

SEQ ID NO: 3204133 - RNA, 23 nt, Mycobacterium bovis subsp bovis AF2122/97
gaugguguacugcugcuugagcu

SEQ ID NO: 3204134 - RNA, 17 nt, Mycobacterium bovis subsp bovis AF2122/97
gaugguguccucgucga

SEQ ID NO: 3204135 - RNA, 16 nt, Mycobacterium bovis subsp bovis AF2122/97
gauguugaccggcucg

SEQ ID NO: 3204136 - RNA, 13 nt, Mycobacterium bovis subsp bovis AF2122/97
gauguugccgccg

SEQ ID NO: 3204137 - RNA, 17 nt, Mycobacterium bovis subsp bovis AF2122/97
gauguugccggaguuga

SEQ ID NO: 3204138 - RNA, 22 nt, Mycobacterium bovis subsp bovis AF2122/97
gauguugugccgaucggccaac

SEQ ID NO: 3204139 - RNA, 21 nt, Mycobacterium bovis subsp bovis AF2122/97
gauguuuuccccgcccuugcc

SEQ ID NO: 3204140 - RNA, 15 nt, Mycobacterium bovis subsp bovis AF2122/97
gauuaccagcggcac

SEQ ID NO: 3204141 - RNA, 17 nt, Mycobacterium bovis subsp bovis AF2122/97
gauuaccgaagcccgac

SEQ ID NO: 3204142 - RNA, 19 nt, Mycobacterium bovis subsp bovis AF2122/97
gauuaccggcacgccggcg

SEQ ID NO: 3204143 - RNA, 21 nt, Mycobacterium bovis subsp bovis AF2122/97
gauuacggccagugucagcac

SEQ ID NO: 3204144 - RNA, 17 nt, Mycobacterium bovis subsp bovis AF2122/97
gauuacggugaucgccg

SEQ ID NO: 3204145 - RNA, 21 nt, Mycobacterium bovis subsp bovis AF2122/97
gauuaucgcgcgcaaccgcuc

SEQ ID NO: 3204146 - RNA, 16 nt, Mycobacterium bovis subsp bovis AF2122/97
gauuauucgcgguagc

SEQ ID NO: 3204147 - RNA, 18 nt, Mycobacterium bovis subsp bovis AF2122/97
gauuauucgcgguagccg

SEQ ID NO: 3204148 - RNA, 17 nt, Mycobacterium bovis subsp bovis AF2122/97
gauucacgcaccggcgc

SEQ ID NO: 3204149 - RNA, 23 nt, Mycobacterium bovis subsp bovis AF2122/97
gauucagccgguggucugcgcgg

SEQ ID NO: 3204150 - RNA, 20 nt, Mycobacterium bovis subsp bovis AF2122/97
gauuccaauugggcgaugcg

SEQ ID NO: 3204151 - RNA, 14 nt, Mycobacterium bovis subsp bovis AF2122/97
gauuccaccgccga

SEQ ID NO: 3204152 - RNA, 19 nt, Mycobacterium bovis subsp bovis AF2122/97
gauuccaccgccgacgccc

SEQ ID NO: 3204153 - RNA, 23 nt, Mycobacterium bovis subsp bovis AF2122/97
gauuccagcagccugcgccgcgc

SEQ ID NO: 3204154 - RNA, 13 nt, Mycobacterium bovis subsp bovis AF2122/97
gauuccaugcgac

SEQ ID NO: 3204155 - RNA, 13 nt, Mycobacterium bovis subsp bovis AF2122/97
gauucccagucca

SEQ ID NO: 3204156 - RNA, 15 nt, Mycobacterium bovis subsp bovis AF2122/97
gauuccccguccuuu

SEQ ID NO: 3204157 - RNA, 14 nt, Mycobacterium bovis subsp bovis AF2122/97
gauucccgcccagc

SEQ ID NO: 3204158 - RNA, 18 nt, Mycobacterium bovis subsp bovis AF2122/97
gauucccggcgcgguggc

SEQ ID NO: 3204159 - RNA, 13 nt, Mycobacterium bovis subsp bovis AF2122/97
gauuccgccgcac

SEQ ID NO: 3204160 - RNA, 22 nt, Mycobacterium bovis subsp bovis AF2122/97
gauuccgcgcguccgucggcga

SEQ ID NO: 3204161 - RNA, 18 nt, Mycobacterium bovis subsp bovis AF2122/97
gauuccggcggccacgcc

SEQ ID NO: 3204162 - RNA, 23 nt, Mycobacterium bovis subsp bovis AF2122/97
gauuccggcggccacgccggcgu

SEQ ID NO: 3204163 - RNA, 14 nt, Mycobacterium bovis subsp bovis AF2122/97
gauuccggcucguc

SEQ ID NO: 3204164 - RNA, 19 nt, Mycobacterium bovis subsp bovis AF2122/97
gauuccgggugcgaucgca

SEQ ID NO: 3204165 - RNA, 20 nt, Mycobacterium bovis subsp bovis AF2122/97
gauuccuugaugccuuccga

SEQ ID NO: 3204166 - RNA, 14 nt, Mycobacterium bovis subsp bovis AF2122/97
gauucgaagccgag

SEQ ID NO: 3204167 - RNA, 22 nt, Mycobacterium bovis subsp bovis AF2122/97
gauucgaagccgagcuccucca

SEQ ID NO: 3204168 - RNA, 14 nt, Mycobacterium bovis subsp bovis AF2122/97
gauucgaaggcacc

SEQ ID NO: 3204169 - RNA, 18 nt, Mycobacterium bovis subsp bovis AF2122/97
gauucgaucaggccuugg

SEQ ID NO: 3204170 - RNA, 17 nt, Mycobacterium bovis subsp bovis AF2122/97
gauucgcccgggcguug

SEQ ID NO: 3204171 - RNA, 12 nt, Mycobacterium bovis subsp bovis AF2122/97
gauucgccgccc

SEQ ID NO: 3204172 - RNA, 18 nt, Mycobacterium bovis subsp bovis AF2122/97
gauucgccuagcgagcgc

SEQ ID NO: 3204173 - RNA, 16 nt, Mycobacterium bovis subsp bovis AF2122/97
gauucgcgcagcgcga

SEQ ID NO: 3204174 - RNA, 13 nt, Mycobacterium bovis subsp bovis AF2122/97
gauucgcggcagc

SEQ ID NO: 3204175 - RNA, 18 nt, Mycobacterium bovis subsp bovis AF2122/97
gauucgcggcagccggcg

SEQ ID NO: 3204176 - RNA, 19 nt, Mycobacterium bovis subsp bovis AF2122/97
gauucgcggcagccggcgg

SEQ ID NO: 3204177 - RNA, 18 nt, Mycobacterium bovis subsp bovis AF2122/97
gauucggagucaccagca

SEQ ID NO: 3204178 - RNA, 14 nt, Mycobacterium bovis subsp bovis AF2122/97
gauucggcacgccg

SEQ ID NO: 3204179 - RNA, 17 nt, Mycobacterium bovis subsp bovis AF2122/97
gauucggcacgccgggc

SEQ ID NO: 3204180 - RNA, 16 nt, Mycobacterium bovis subsp bovis AF2122/97
gauucggcagcggcgc

SEQ ID NO: 3204181 - RNA, 12 nt, Mycobacterium bovis subsp bovis AF2122/97
gauucggccagc

SEQ ID NO: 3204182 - RNA, 15 nt, Mycobacterium bovis subsp bovis AF2122/97
gauucggccgccgac

SEQ ID NO: 3204183 - RNA, 18 nt, Mycobacterium bovis subsp bovis AF2122/97
gauucggccugagcggcc

SEQ ID NO: 3204184 - RNA, 13 nt, Mycobacterium bovis subsp bovis AF2122/97
gauucggcgacga

SEQ ID NO: 3204185 - RNA, 16 nt, Mycobacterium bovis subsp bovis AF2122/97
gauucggcugccaccg

SEQ ID NO: 3204186 - RNA, 18 nt, Mycobacterium bovis subsp bovis AF2122/97
gauucgggaggcaaccca

SEQ ID NO: 3204187 - RNA, 18 nt, Mycobacterium bovis subsp bovis AF2122/97
gauucgggcgccgcagcg

SEQ ID NO: 3204188 - RNA, 17 nt, Mycobacterium bovis subsp bovis AF2122/97
gauucgggcuucuccau

SEQ ID NO: 3204189 - RNA, 20 nt, Mycobacterium bovis subsp bovis AF2122/97
gauucgguuagcgcggccag

SEQ ID NO: 3204190 - RNA, 18 nt, Mycobacterium bovis subsp bovis AF2122/97
gauucgucgcggaucagc

SEQ ID NO: 3204191 - RNA, 15 nt, Mycobacterium bovis subsp bovis AF2122/97
gauucgugucggugc

SEQ ID NO: 3204192 - RNA, 18 nt, Mycobacterium bovis subsp bovis AF2122/97
gauucguugucgagcacg

SEQ ID NO: 3204193 - RNA, 16 nt, Mycobacterium bovis subsp bovis AF2122/97
gauucugacgaccggc

SEQ ID NO: 3204194 - RNA, 17 nt, Mycobacterium bovis subsp bovis AF2122/97
gauucugauaucgucgg

SEQ ID NO: 3204195 - RNA, 20 nt, Mycobacterium bovis subsp bovis AF2122/97
gauucugcguccugcucgcg

SEQ ID NO: 3204196 - RNA, 16 nt, Mycobacterium bovis subsp bovis AF2122/97
gauucugcgucugcuc

SEQ ID NO: 3204197 - RNA, 17 nt, Mycobacterium bovis subsp bovis AF2122/97
gauucugcgucugcucg

SEQ ID NO: 3204198 - RNA, 20 nt, Mycobacterium bovis subsp bovis AF2122/97
gauucugcgucugcucgccg

SEQ ID NO: 3204199 - RNA, 19 nt, Mycobacterium bovis subsp bovis AF2122/97
gauucugcgucugcucgcg

SEQ ID NO: 3204200 - RNA, 20 nt, Mycobacterium bovis subsp bovis AF2122/97
gauucugcgucugcucgcgc

SEQ ID NO: 3204201 - RNA, 14 nt, Mycobacterium bovis subsp bovis AF2122/97
gauucuggccggau

SEQ ID NO: 3204202 - RNA, 20 nt, Mycobacterium bovis subsp bovis AF2122/97
gauucugugucugcucgcgc

SEQ ID NO: 3204203 - RNA, 20 nt, Mycobacterium bovis subsp bovis AF2122/97
gauucugugucugcucggcg

SEQ ID NO: 3204204 - RNA, 15 nt, Mycobacterium bovis subsp bovis AF2122/97
gauugaccgcggccg

SEQ ID NO: 3204205 - RNA, 14 nt, Mycobacterium bovis subsp bovis AF2122/97
gauugaccugcugg

SEQ ID NO: 3204206 - RNA, 20 nt, Mycobacterium bovis subsp bovis AF2122/97
gauugaccugcuggcgcacg

SEQ ID NO: 3204207 - RNA, 21 nt, Mycobacterium bovis subsp bovis AF2122/97
gauugaggcuggucugcaggc

SEQ ID NO: 3204208 - RNA, 14 nt, Mycobacterium bovis subsp bovis AF2122/97
gauugaguucggcg

SEQ ID NO: 3204209 - RNA, 20 nt, Mycobacterium bovis subsp bovis AF2122/97
gauugaguucggcggccagg

SEQ ID NO: 3204210 - RNA, 15 nt, Mycobacterium bovis subsp bovis AF2122/97
gauugccaccgagau

SEQ ID NO: 3204211 - RNA, 18 nt, Mycobacterium bovis subsp bovis AF2122/97
gauugccaggaccgcgcc

SEQ ID NO: 3204212 - RNA, 23 nt, Mycobacterium bovis subsp bovis AF2122/97
gauugccgagaacaccggccaac

SEQ ID NO: 3204213 - RNA, 16 nt, Mycobacterium bovis subsp bovis AF2122/97
gauugccgucgguggu

SEQ ID NO: 3204214 - RNA, 20 nt, Mycobacterium bovis subsp bovis AF2122/97
gauugccgucgugaucggcg

SEQ ID NO: 3204215 - RNA, 20 nt, Mycobacterium bovis subsp bovis AF2122/97
gauugccuccggguacggcg

SEQ ID NO: 3204216 - RNA, 15 nt, Mycobacterium bovis subsp bovis AF2122/97
gauugcgaagggcac

SEQ ID NO: 3204217 - RNA, 13 nt, Mycobacterium bovis subsp bovis AF2122/97
gauugcgcacacc

SEQ ID NO: 3204218 - RNA, 14 nt, Mycobacterium bovis subsp bovis AF2122/97
gauugcgcacaccc

SEQ ID NO: 3204219 - RNA, 23 nt, Mycobacterium bovis subsp bovis AF2122/97
gauugcgccaggagcgcggcccg

SEQ ID NO: 3204220 - RNA, 19 nt, Mycobacterium bovis subsp bovis AF2122/97
gauugcgcgggcaucgucg

SEQ ID NO: 3204221 - RNA, 20 nt, Mycobacterium bovis subsp bovis AF2122/97
gauugcggcacggaugcgau

SEQ ID NO: 3204222 - RNA, 19 nt, Mycobacterium bovis subsp bovis AF2122/97
gcaacaacgucugcagccu

SEQ ID NO: 3204223 - RNA, 13 nt, Mycobacterium bovis subsp bovis AF2122/97
gcaacacaccgaa

SEQ ID NO: 3204224 - RNA, 14 nt, Mycobacterium bovis subsp bovis AF2122/97
gcaacacaccgaac

SEQ ID NO: 3204225 - RNA, 13 nt, Mycobacterium bovis subsp bovis AF2122/97
gcaacacaccgcg

SEQ ID NO: 3204226 - RNA, 22 nt, Mycobacterium bovis subsp bovis AF2122/97
gcaacacaccgcggaaggccag

SEQ ID NO: 3204227 - RNA, 12 nt, Mycobacterium bovis subsp bovis AF2122/97
gcaacacagcug

SEQ ID NO: 3204228 - RNA, 12 nt, Mycobacterium bovis subsp bovis AF2122/97
gcaacaccaccu

SEQ ID NO: 3204229 - RNA, 16 nt, Mycobacterium bovis subsp bovis AF2122/97
gcaacaccaccucgac

SEQ ID NO: 3204230 - RNA, 20 nt, Mycobacterium bovis subsp bovis AF2122/97
gcaacaccagggccuccacc

SEQ ID NO: 3204231 - RNA, 21 nt, Mycobacterium bovis subsp bovis AF2122/97
gcaacaccaucagcgacaagu

SEQ ID NO: 3204232 - RNA, 16 nt, Mycobacterium bovis subsp bovis AF2122/97
gcaacaccccgagccg

SEQ ID NO: 3204233 - RNA, 13 nt, Mycobacterium bovis subsp bovis AF2122/97
gcaacaccgcacc

SEQ ID NO: 3204234 - RNA, 14 nt, Mycobacterium bovis subsp bovis AF2122/97
gcaacaccgcaccg

SEQ ID NO: 3204235 - RNA, 16 nt, Mycobacterium bovis subsp bovis AF2122/97
gcaacaccgcaccggc

SEQ ID NO: 3204236 - RNA, 15 nt, Mycobacterium bovis subsp bovis AF2122/97
gcaacaccucgucgg

SEQ ID NO: 3204237 - RNA, 17 nt, Mycobacterium bovis subsp bovis AF2122/97
gcaacaccucgucggcu

SEQ ID NO: 3204238 - RNA, 12 nt, Mycobacterium bovis subsp bovis AF2122/97
gcaacagcacca

SEQ ID NO: 3204239 - RNA, 15 nt, Mycobacterium bovis subsp bovis AF2122/97
gcaacagcaccagug

SEQ ID NO: 3204240 - RNA, 14 nt, Mycobacterium bovis subsp bovis AF2122/97
gcaacagcgagcgg

SEQ ID NO: 3204241 - RNA, 12 nt, Mycobacterium bovis subsp bovis AF2122/97
gcaacagcucgg

SEQ ID NO: 3204242 - RNA, 23 nt, Mycobacterium bovis subsp bovis AF2122/97
gcaacaggccaacuuggcggcca

SEQ ID NO: 3204243 - RNA, 16 nt, Mycobacterium bovis subsp bovis AF2122/97
gcaacaggcccacggc

SEQ ID NO: 3204244 - RNA, 17 nt, Mycobacterium bovis subsp bovis AF2122/97
gcaacaggcccacggcg

SEQ ID NO: 3204245 - RNA, 14 nt, Mycobacterium bovis subsp bovis AF2122/97
gcaacaucagcagg

SEQ ID NO: 3204246 - RNA, 20 nt, Mycobacterium bovis subsp bovis AF2122/97
gcaacauccccaugucggug

SEQ ID NO: 3204247 - RNA, 16 nt, Mycobacterium bovis subsp bovis AF2122/97
gcaacaucggaugacc

SEQ ID NO: 3204248 - RNA, 18 nt, Mycobacterium bovis subsp bovis AF2122/97
gcaacaucgggucgcugc

SEQ ID NO: 3204249 - RNA, 22 nt, Mycobacterium bovis subsp bovis AF2122/97
gcaacaucggguucuucaacuc

SEQ ID NO: 3204250 - RNA, 20 nt, Mycobacterium bovis subsp bovis AF2122/97
gcaacaucuugccgucggcc

SEQ ID NO: 3204251 - RNA, 16 nt, Mycobacterium bovis subsp bovis AF2122/97
gcaacauuuucgcccg

SEQ ID NO: 3204252 - RNA, 21 nt, Mycobacterium bovis subsp bovis AF2122/97
gcaacauuuucgcccgcuccg

SEQ ID NO: 3204253 - RNA, 23 nt, Mycobacterium bovis subsp bovis AF2122/97
gcaaccaaagcgacgagcagcaa

SEQ ID NO: 3204254 - RNA, 22 nt, Mycobacterium bovis subsp bovis AF2122/97
gcaaccaaccgcgcgagccucg

SEQ ID NO: 3204255 - RNA, 21 nt, Mycobacterium bovis subsp bovis AF2122/97
gcaaccaauaggugucgacgc

SEQ ID NO: 3204256 - RNA, 22 nt, Mycobacterium bovis subsp bovis AF2122/97
gcaaccaauaggugucgacgcg

SEQ ID NO: 3204257 - RNA, 16 nt, Mycobacterium bovis subsp bovis AF2122/97
gcaaccaccggccgcg

SEQ ID NO: 3204258 - RNA, 15 nt, Mycobacterium bovis subsp bovis AF2122/97
gcaaccaccucgugg

SEQ ID NO: 3204259 - RNA, 19 nt, Mycobacterium bovis subsp bovis AF2122/97
gcaaccaccucgugggcca

SEQ ID NO: 3204260 - RNA, 18 nt, Mycobacterium bovis subsp bovis AF2122/97
gcaaccacgccccgaucg

SEQ ID NO: 3204261 - RNA, 19 nt, Mycobacterium bovis subsp bovis AF2122/97
gcaaccacgccccgaucgg

SEQ ID NO: 3204262 - RNA, 17 nt, Mycobacterium bovis subsp bovis AF2122/97
gcaaccacguccgcaac

SEQ ID NO: 3204263 - RNA, 12 nt, Mycobacterium bovis subsp bovis AF2122/97
gcaaccagcagc

SEQ ID NO: 3204264 - RNA, 14 nt, Mycobacterium bovis subsp bovis AF2122/97
gcaaccagcgagcc

SEQ ID NO: 3204265 - RNA, 19 nt, Mycobacterium bovis subsp bovis AF2122/97
gcaaccagcgagcccagcu

SEQ ID NO: 3204266 - RNA, 23 nt, Mycobacterium bovis subsp bovis AF2122/97
gcaaccaggaugguugcgacggc

SEQ ID NO: 3204267 - RNA, 17 nt, Mycobacterium bovis subsp bovis AF2122/97
gcaaccauggcggcucc

SEQ ID NO: 3204268 - RNA, 16 nt, Mycobacterium bovis subsp bovis AF2122/97
gcaacccacacgcccu

SEQ ID NO: 3204269 - RNA, 19 nt, Mycobacterium bovis subsp bovis AF2122/97
gcaacccacacgcccucga

SEQ ID NO: 3204270 - RNA, 14 nt, Mycobacterium bovis subsp bovis AF2122/97
gcaacccgccguug

SEQ ID NO: 3204271 - RNA, 16 nt, Mycobacterium bovis subsp bovis AF2122/97
gcaacccggacgaacg

SEQ ID NO: 3204272 - RNA, 20 nt, Mycobacterium bovis subsp bovis AF2122/97
gcaacccggccuggagcagc

SEQ ID NO: 3204273 - RNA, 13 nt, Mycobacterium bovis subsp bovis AF2122/97
gcaacccugccgc

SEQ ID NO: 3204274 - RNA, 16 nt, Mycobacterium bovis subsp bovis AF2122/97
gcaacccugccgcgau

SEQ ID NO: 3204275 - RNA, 22 nt, Mycobacterium bovis subsp bovis AF2122/97
gcaaccgacacugggaucccga

SEQ ID NO: 3204276 - RNA, 19 nt, Mycobacterium bovis subsp bovis AF2122/97
gcaaccgacucgacaaggc

SEQ ID NO: 3204277 - RNA, 12 nt, Mycobacterium bovis subsp bovis AF2122/97
gcaaccgcaccg

SEQ ID NO: 3204278 - RNA, 13 nt, Mycobacterium bovis subsp bovis AF2122/97
gcaaccgccgcca

SEQ ID NO: 3204279 - RNA, 21 nt, Mycobacterium bovis subsp bovis AF2122/97
gcaaccgccgccaccagggcg

SEQ ID NO: 3204280 - RNA, 15 nt, Mycobacterium bovis subsp bovis AF2122/97
gcaaccgccgccauu

SEQ ID NO: 3204281 - RNA, 20 nt, Mycobacterium bovis subsp bovis AF2122/97
gcaaccgccggugccgauga

SEQ ID NO: 3204282 - RNA, 23 nt, Mycobacterium bovis subsp bovis AF2122/97
gcaaccgcgcuuggagcgggucc

SEQ ID NO: 3204283 - RNA, 15 nt, Mycobacterium bovis subsp bovis AF2122/97
gcaaccgcggccccg

SEQ ID NO: 3204284 - RNA, 18 nt, Mycobacterium bovis subsp bovis AF2122/97
gcaaccggagaucccggu

SEQ ID NO: 3204285 - RNA, 17 nt, Mycobacterium bovis subsp bovis AF2122/97
gcaaccggcgaucgguu

SEQ ID NO: 3204286 - RNA, 15 nt, Mycobacterium bovis subsp bovis AF2122/97
gcaaccggcgugucg

SEQ ID NO: 3204287 - RNA, 18 nt, Mycobacterium bovis subsp bovis AF2122/97
gcaaccgggaggccaccg

SEQ ID NO: 3204288 - RNA, 17 nt, Mycobacterium bovis subsp bovis AF2122/97
gcaaccgguaucgccgc

SEQ ID NO: 3204289 - RNA, 14 nt, Mycobacterium bovis subsp bovis AF2122/97
gcaaccgguggaug

SEQ ID NO: 3204290 - RNA, 20 nt, Mycobacterium bovis subsp bovis AF2122/97
gcaaccgucccaaugcaaca

SEQ ID NO: 3204291 - RNA, 20 nt, Mycobacterium bovis subsp bovis AF2122/97
gcaaccgugccgcaucaccc

SEQ ID NO: 3204292 - RNA, 20 nt, Mycobacterium bovis subsp bovis AF2122/97
gcaaccuaaauugccgggcc

SEQ ID NO: 3204293 - RNA, 15 nt, Mycobacterium bovis subsp bovis AF2122/97
gcaaccucaugcacg

SEQ ID NO: 3204294 - RNA, 16 nt, Mycobacterium bovis subsp bovis AF2122/97
gcaaccucaugcacgc

SEQ ID NO: 3204295 - RNA, 21 nt, Mycobacterium bovis subsp bovis AF2122/97
gcaaccugaauccagaccaug

SEQ ID NO: 3204296 - RNA, 14 nt, Mycobacterium bovis subsp bovis AF2122/97
gcaaccugccgggc

SEQ ID NO: 3204297 - RNA, 22 nt, Mycobacterium bovis subsp bovis AF2122/97
gcaaccuggacugcagcgccuc

SEQ ID NO: 3204298 - RNA, 16 nt, Mycobacterium bovis subsp bovis AF2122/97
gcaaccuuuggccgcu

SEQ ID NO: 3204299 - RNA, 19 nt, Mycobacterium bovis subsp bovis AF2122/97
gcaacgaagagggcgccgc

SEQ ID NO: 3204300 - RNA, 21 nt, Mycobacterium bovis subsp bovis AF2122/97
gcaacgaagagggcgccgcgc

SEQ ID NO: 3204301 - RNA, 14 nt, Mycobacterium bovis subsp bovis AF2122/97
gcaacgaagccggc

SEQ ID NO: 3204302 - RNA, 15 nt, Mycobacterium bovis subsp bovis AF2122/97
gcaacgaagccggcg

SEQ ID NO: 3204303 - RNA, 16 nt, Mycobacterium bovis subsp bovis AF2122/97
gcaacgaagccggcgc

SEQ ID NO: 3204304 - RNA, 20 nt, Mycobacterium bovis subsp bovis AF2122/97
gcaacgaagccggcgccggc

SEQ ID NO: 3204305 - RNA, 17 nt, Mycobacterium bovis subsp bovis AF2122/97
gcaacgacccgccgccc

SEQ ID NO: 3204306 - RNA, 19 nt, Mycobacterium bovis subsp bovis AF2122/97
gcaacgacgucgucgccgc

SEQ ID NO: 3204307 - RNA, 22 nt, Mycobacterium bovis subsp bovis AF2122/97
gcaacgacgucgucgccgccga

SEQ ID NO: 3204308 - RNA, 19 nt, Mycobacterium bovis subsp bovis AF2122/97
gcaacgacuuucaucgcga

SEQ ID NO: 3204309 - RNA, 14 nt, Mycobacterium bovis subsp bovis AF2122/97
gcaagcacaccgcc

SEQ ID NO: 3204310 - RNA, 15 nt, Mycobacterium bovis subsp bovis AF2122/97
gcaagcacaccgcca

SEQ ID NO: 3204311 - RNA, 15 nt, Mycobacterium bovis subsp bovis AF2122/97
gcaagcacggcgucg

SEQ ID NO: 3204312 - RNA, 19 nt, Mycobacterium bovis subsp bovis AF2122/97
gcaagcacgguggccgagc

SEQ ID NO: 3204313 - RNA, 21 nt, Mycobacterium bovis subsp bovis AF2122/97
gcaagcacgguggccgagccg

SEQ ID NO: 3204314 - RNA, 13 nt, Mycobacterium bovis subsp bovis AF2122/97
gcaagcagcgcga

SEQ ID NO: 3204315 - RNA, 20 nt, Mycobacterium bovis subsp bovis AF2122/97
gcaagccaaccagcccggcc

SEQ ID NO: 3204316 - RNA, 19 nt, Mycobacterium bovis subsp bovis AF2122/97
gcaagccacgccggucgcg

SEQ ID NO: 3204317 - RNA, 22 nt, Mycobacterium bovis subsp bovis AF2122/97
gcaagccauucacgagccgcuc

SEQ ID NO: 3204318 - RNA, 20 nt, Mycobacterium bovis subsp bovis AF2122/97
gcaagcccaaaaagaccgcc

SEQ ID NO: 3204319 - RNA, 22 nt, Mycobacterium bovis subsp bovis AF2122/97
gcaagcccaaaaagaccgccgc

SEQ ID NO: 3204320 - RNA, 15 nt, Mycobacterium bovis subsp bovis AF2122/97
gcaagccgaacaccg

SEQ ID NO: 3204321 - RNA, 21 nt, Mycobacterium bovis subsp bovis AF2122/97
gcaagccgaacaccgucagcg

SEQ ID NO: 3204322 - RNA, 15 nt, Mycobacterium bovis subsp bovis AF2122/97
gcaagccgacaucgg

SEQ ID NO: 3204323 - RNA, 21 nt, Mycobacterium bovis subsp bovis AF2122/97
gcaagccgacaucggcggccc

SEQ ID NO: 3204324 - RNA, 15 nt, Mycobacterium bovis subsp bovis AF2122/97
gcaagccgccggugc

SEQ ID NO: 3204325 - RNA, 18 nt, Mycobacterium bovis subsp bovis AF2122/97
gcaagccuaaaaccccga

SEQ ID NO: 3204326 - RNA, 16 nt, Mycobacterium bovis subsp bovis AF2122/97
gcaagccucgugguga

SEQ ID NO: 3204327 - RNA, 17 nt, Mycobacterium bovis subsp bovis AF2122/97
gcaagccugcgcuguuc

SEQ ID NO: 3204328 - RNA, 19 nt, Mycobacterium bovis subsp bovis AF2122/97
gcaagcgcagacacgaccc

SEQ ID NO: 3204329 - RNA, 15 nt, Mycobacterium bovis subsp bovis AF2122/97
gcaagcgccgcgcuu

SEQ ID NO: 3204330 - RNA, 16 nt, Mycobacterium bovis subsp bovis AF2122/97
gcaagcgccgcgcuug

SEQ ID NO: 3204331 - RNA, 14 nt, Mycobacterium bovis subsp bovis AF2122/97
gcaagcggacccga

SEQ ID NO: 3204332 - RNA, 16 nt, Mycobacterium bovis subsp bovis AF2122/97
gcaagcggacccgacc

SEQ ID NO: 3204333 - RNA, 21 nt, Mycobacterium bovis subsp bovis AF2122/97
gcaagcggacccgaccgucgu

SEQ ID NO: 3204334 - RNA, 12 nt, Mycobacterium bovis subsp bovis AF2122/97
gcaagcggaugu

SEQ ID NO: 3204335 - RNA, 22 nt, Mycobacterium bovis subsp bovis AF2122/97
gcaagcuccaguagucggccga

SEQ ID NO: 3204336 - RNA, 13 nt, Mycobacterium bovis subsp bovis AF2122/97
gcaagcugaccgc

SEQ ID NO: 3204337 - RNA, 14 nt, Mycobacterium bovis subsp bovis AF2122/97
gcaagcugaccgcc

SEQ ID NO: 3204338 - RNA, 18 nt, Mycobacterium bovis subsp bovis AF2122/97
gcaagcugagucgugaca

SEQ ID NO: 3204339 - RNA, 21 nt, Mycobacterium bovis subsp bovis AF2122/97
gcaagcugagucgugacaacc

SEQ ID NO: 3204340 - RNA, 14 nt, Mycobacterium bovis subsp bovis AF2122/97
gcaagcugguaggu

SEQ ID NO: 3204341 - RNA, 16 nt, Mycobacterium bovis subsp bovis AF2122/97
gcaagcugucgucgcc

SEQ ID NO: 3204342 - RNA, 22 nt, Mycobacterium bovis subsp bovis AF2122/97
gcaaggaaaagccuggccguug

SEQ ID NO: 3204343 - RNA, 14 nt, Mycobacterium bovis subsp bovis AF2122/97
gcaaggaauuccgg

SEQ ID NO: 3204344 - RNA, 17 nt, Mycobacterium bovis subsp bovis AF2122/97
gcaaggacaagccgcug

SEQ ID NO: 3204345 - RNA, 16 nt, Mycobacterium bovis subsp bovis AF2122/97
gcaaggacguggcgcu

SEQ ID NO: 3204346 - RNA, 21 nt, Mycobacterium bovis subsp bovis AF2122/97
gcaaggcauccaacgcggcgc

SEQ ID NO: 3204347 - RNA, 14 nt, Mycobacterium bovis subsp bovis AF2122/97
gcaaggcauucgag

SEQ ID NO: 3204348 - RNA, 12 nt, Mycobacterium bovis subsp bovis AF2122/97
gcaaggcccgca

SEQ ID NO: 3204349 - RNA, 20 nt, Mycobacterium bovis subsp bovis AF2122/97
gcaaggcccgcaccgcugac

SEQ ID NO: 3204350 - RNA, 21 nt, Mycobacterium bovis subsp bovis AF2122/97
gcaaggcgccgauaccggcgg

SEQ ID NO: 3204351 - RNA, 22 nt, Mycobacterium bovis subsp bovis AF2122/97
gcaaggcgccgcagggccgcgc

SEQ ID NO: 3204352 - RNA, 15 nt, Mycobacterium bovis subsp bovis AF2122/97
gcaaggcggcggcca

SEQ ID NO: 3204353 - RNA, 15 nt, Mycobacterium bovis subsp bovis AF2122/97
gcaagggcggcaacg

SEQ ID NO: 3204354 - RNA, 17 nt, Mycobacterium bovis subsp bovis AF2122/97
gcaagggcggcaacggg

SEQ ID NO: 3204355 - RNA, 14 nt, Mycobacterium bovis subsp bovis AF2122/97
gcaaggggcgucgc

SEQ ID NO: 3204356 - RNA, 17 nt, Mycobacterium bovis subsp bovis AF2122/97
gcaaggguuugcgggcg

SEQ ID NO: 3204357 - RNA, 14 nt, Mycobacterium bovis subsp bovis AF2122/97
gcaaggucaacggg

SEQ ID NO: 3204358 - RNA, 13 nt, Mycobacterium bovis subsp bovis AF2122/97
gcaaggucgcugc

SEQ ID NO: 3204359 - RNA, 12 nt, Mycobacterium bovis subsp bovis AF2122/97
gcaagguggcau

SEQ ID NO: 3204360 - RNA, 21 nt, Mycobacterium bovis subsp bovis AF2122/97
gcaagucaaacgccgucacgg

SEQ ID NO: 3204361 - RNA, 14 nt, Mycobacterium bovis subsp bovis AF2122/97
gcaagucaacaccg

SEQ ID NO: 3204362 - RNA, 19 nt, Mycobacterium bovis subsp bovis AF2122/97
gcaagucaacaccgcggcc

SEQ ID NO: 3204363 - RNA, 12 nt, Mycobacterium bovis subsp bovis AF2122/97
gcaaguccaccg

SEQ ID NO: 3204364 - RNA, 15 nt, Mycobacterium bovis subsp bovis AF2122/97
gcaaguccugcagcu

SEQ ID NO: 3204365 - RNA, 14 nt, Mycobacterium bovis subsp bovis AF2122/97
gcaagucgaacgga

SEQ ID NO: 3204366 - RNA, 19 nt, Mycobacterium bovis subsp bovis AF2122/97
gcaagucgacgccgcagcg

SEQ ID NO: 3204367 - RNA, 20 nt, Mycobacterium bovis subsp bovis AF2122/97
gcaagucgagauagaccuug

SEQ ID NO: 3204368 - RNA, 16 nt, Mycobacterium bovis subsp bovis AF2122/97
gcaagucgauggagaa

SEQ ID NO: 3204369 - RNA, 19 nt, Mycobacterium bovis subsp bovis AF2122/97
gcaagugggugccggcacc

SEQ ID NO: 3204370 - RNA, 20 nt, Mycobacterium bovis subsp bovis AF2122/97
gcaagugggugccggcaccc

SEQ ID NO: 3204371 - RNA, 22 nt, Mycobacterium bovis subsp bovis AF2122/97
gcaagugucuccggcaacagca

SEQ ID NO: 3204372 - RNA, 18 nt, Mycobacterium bovis subsp bovis AF2122/97
gcaaguucugcgcucccg

SEQ ID NO: 3204373 - RNA, 18 nt, Mycobacterium bovis subsp bovis AF2122/97
gcaaguugagcagcuugg

SEQ ID NO: 3204374 - RNA, 22 nt, Mycobacterium bovis subsp bovis AF2122/97
gcaauacacguugccgaucccg

SEQ ID NO: 3204375 - RNA, 14 nt, Mycobacterium bovis subsp bovis AF2122/97
gcaauacccgccgc

SEQ ID NO: 3204376 - RNA, 15 nt, Mycobacterium bovis subsp bovis AF2122/97
gcaauacccgccgcg

SEQ ID NO: 3204377 - RNA, 14 nt, Mycobacterium bovis subsp bovis AF2122/97
gcaauaccgccagc

SEQ ID NO: 3204378 - RNA, 21 nt, Mycobacterium bovis subsp bovis AF2122/97
gcaauaccgccagcgccaccg

SEQ ID NO: 3204379 - RNA, 16 nt, Mycobacterium bovis subsp bovis AF2122/97
gcaauaccggcaucga

SEQ ID NO: 3204380 - RNA, 19 nt, Mycobacterium bovis subsp bovis AF2122/97
gcaauaccugagcgcgcgc

SEQ ID NO: 3204381 - RNA, 18 nt, Mycobacterium bovis subsp bovis AF2122/97
gcaauacggcggcgccgc

SEQ ID NO: 3204382 - RNA, 20 nt, Mycobacterium bovis subsp bovis AF2122/97
gcaauacggcggcgccgccc

SEQ ID NO: 3204383 - RNA, 22 nt, Mycobacterium bovis subsp bovis AF2122/97
gcaauacggcggcgccgcccaa

SEQ ID NO: 3204384 - RNA, 18 nt, Mycobacterium bovis subsp bovis AF2122/97
gcaauacguagucgccga

SEQ ID NO: 3204385 - RNA, 19 nt, Mycobacterium bovis subsp bovis AF2122/97
gcaauacguagucgccgau

SEQ ID NO: 3204386 - RNA, 15 nt, Mycobacterium bovis subsp bovis AF2122/97
gcaauagcugcgcga

SEQ ID NO: 3204387 - RNA, 21 nt, Mycobacterium bovis subsp bovis AF2122/97
gcaauauccgggagugcgccg

SEQ ID NO: 3204388 - RNA, 21 nt, Mycobacterium bovis subsp bovis AF2122/97
gcaauaucuuuagcgcgugcu

SEQ ID NO: 3204389 - RNA, 14 nt, Mycobacterium bovis subsp bovis AF2122/97
gcaauaugccacag

SEQ ID NO: 3204390 - RNA, 15 nt, Mycobacterium bovis subsp bovis AF2122/97
gcaauaugccacaga

SEQ ID NO: 3204391 - RNA, 20 nt, Mycobacterium bovis subsp bovis AF2122/97
gcaaucaacgucacccccuu

SEQ ID NO: 3204392 - RNA, 21 nt, Mycobacterium bovis subsp bovis AF2122/97
gcaaucacaucaaagucggcg

SEQ ID NO: 3204393 - RNA, 14 nt, Mycobacterium bovis subsp bovis AF2122/97
gcaaucaccgccgg

SEQ ID NO: 3204394 - RNA, 18 nt, Mycobacterium bovis subsp bovis AF2122/97
gcaaucaccgccggcggc

SEQ ID NO: 3204395 - RNA, 13 nt, Mycobacterium bovis subsp bovis AF2122/97
gcaaucagcuggu

SEQ ID NO: 3204396 - RNA, 18 nt, Mycobacterium bovis subsp bovis AF2122/97
gcacaccgacagcaccca

SEQ ID NO: 3204397 - RNA, 17 nt, Mycobacterium bovis subsp bovis AF2122/97
gcacaccgacgccgcca

SEQ ID NO: 3204398 - RNA, 17 nt, Mycobacterium bovis subsp bovis AF2122/97
gcacaccgcaccugggc

SEQ ID NO: 3204399 - RNA, 14 nt, Mycobacterium bovis subsp bovis AF2122/97
gcacaccgccagcg

SEQ ID NO: 3204400 - RNA, 17 nt, Mycobacterium bovis subsp bovis AF2122/97
gcacaccgccagcggca

SEQ ID NO: 3204401 - RNA, 13 nt, Mycobacterium bovis subsp bovis AF2122/97
gcacaccgcccgc

SEQ ID NO: 3204402 - RNA, 18 nt, Mycobacterium bovis subsp bovis AF2122/97
gcacaccggcacugccca

SEQ ID NO: 3204403 - RNA, 23 nt, Mycobacterium bovis subsp bovis AF2122/97
gcacaccggcacugcccagcaga

SEQ ID NO: 3204404 - RNA, 21 nt, Mycobacterium bovis subsp bovis AF2122/97
gcacaccgggcaccagucgcc

SEQ ID NO: 3204405 - RNA, 13 nt, Mycobacterium bovis subsp bovis AF2122/97
gcacaccggugga

SEQ ID NO: 3204406 - RNA, 22 nt, Mycobacterium bovis subsp bovis AF2122/97
gcacaccgguggacccggcggu

SEQ ID NO: 3204407 - RNA, 12 nt, Mycobacterium bovis subsp bovis AF2122/97
gcacaccgucgc

SEQ ID NO: 3204408 - RNA, 14 nt, Mycobacterium bovis subsp bovis AF2122/97
gcacaccgucgcac

SEQ ID NO: 3204409 - RNA, 17 nt, Mycobacterium bovis subsp bovis AF2122/97
gcacaccgucgcaccca

SEQ ID NO: 3204410 - RNA, 22 nt, Mycobacterium bovis subsp bovis AF2122/97
gcacaccgucgcgcucgcacca

SEQ ID NO: 3204411 - RNA, 13 nt, Mycobacterium bovis subsp bovis AF2122/97
gcacaccgucguc

SEQ ID NO: 3204412 - RNA, 14 nt, Mycobacterium bovis subsp bovis AF2122/97
gcacaccgucgucg

SEQ ID NO: 3204413 - RNA, 17 nt, Mycobacterium bovis subsp bovis AF2122/97
gcacaccuccucgaccg

SEQ ID NO: 3204414 - RNA, 18 nt, Mycobacterium bovis subsp bovis AF2122/97
gcacaccugcgcggcgug

SEQ ID NO: 3204415 - RNA, 15 nt, Mycobacterium bovis subsp bovis AF2122/97
gcacacgccuaccgc

SEQ ID NO: 3204416 - RNA, 16 nt, Mycobacterium bovis subsp bovis AF2122/97
gcacacgcgugcacca

SEQ ID NO: 3204417 - RNA, 22 nt, Mycobacterium bovis subsp bovis AF2122/97
gcacacgcuuguacaagucgac

SEQ ID NO: 3204418 - RNA, 14 nt, Mycobacterium bovis subsp bovis AF2122/97
gcacacggccuugc

SEQ ID NO: 3204419 - RNA, 18 nt, Mycobacterium bovis subsp bovis AF2122/97
gcacacggcuaccccgca

SEQ ID NO: 3204420 - RNA, 13 nt, Mycobacterium bovis subsp bovis AF2122/97
gcacacguccggc

SEQ ID NO: 3204421 - RNA, 15 nt, Mycobacterium bovis subsp bovis AF2122/97
gcacacguccggcga

SEQ ID NO: 3204422 - RNA, 16 nt, Mycobacterium bovis subsp bovis AF2122/97
gcacacguccggcgau

SEQ ID NO: 3204423 - RNA, 20 nt, Mycobacterium bovis subsp bovis AF2122/97
gcacacuaccgccgcgaccg

SEQ ID NO: 3204424 - RNA, 15 nt, Mycobacterium bovis subsp bovis AF2122/97
gcacacuccugcacc

SEQ ID NO: 3204425 - RNA, 16 nt, Mycobacterium bovis subsp bovis AF2122/97
gcacacugaccccgcc

SEQ ID NO: 3204426 - RNA, 19 nt, Mycobacterium bovis subsp bovis AF2122/97
gcacacuggccacaaucgc

SEQ ID NO: 3204427 - RNA, 17 nt, Mycobacterium bovis subsp bovis AF2122/97
gcacagcaccacaucga

SEQ ID NO: 3204428 - RNA, 16 nt, Mycobacterium bovis subsp bovis AF2122/97
gcacagcaccacgugc

SEQ ID NO: 3204429 - RNA, 19 nt, Mycobacterium bovis subsp bovis AF2122/97
gcacagcaccacgugcgag

SEQ ID NO: 3204430 - RNA, 14 nt, Mycobacterium bovis subsp bovis AF2122/97
gcacagcagcaacg

SEQ ID NO: 3204431 - RNA, 19 nt, Mycobacterium bovis subsp bovis AF2122/97
gcacagcagcaacgcggug

SEQ ID NO: 3204432 - RNA, 15 nt, Mycobacterium bovis subsp bovis AF2122/97
gcacagcagcaccgc

SEQ ID NO: 3204433 - RNA, 16 nt, Mycobacterium bovis subsp bovis AF2122/97
gcacagcagcaccgcg

SEQ ID NO: 3204434 - RNA, 18 nt, Mycobacterium bovis subsp bovis AF2122/97
gcacagcagcaccgcgac

SEQ ID NO: 3204435 - RNA, 16 nt, Mycobacterium bovis subsp bovis AF2122/97
gcacagcaugauccgc

SEQ ID NO: 3204436 - RNA, 14 nt, Mycobacterium bovis subsp bovis AF2122/97
gcacagccauggug

SEQ ID NO: 3204437 - RNA, 17 nt, Mycobacterium bovis subsp bovis AF2122/97
gcacagccauggugggc

SEQ ID NO: 3204438 - RNA, 14 nt, Mycobacterium bovis subsp bovis AF2122/97
gcacagcccggcga

SEQ ID NO: 3204439 - RNA, 15 nt, Mycobacterium bovis subsp bovis AF2122/97
gcacagcccggcgac

SEQ ID NO: 3204440 - RNA, 16 nt, Mycobacterium bovis subsp bovis AF2122/97
gcacagcccggcgacg

SEQ ID NO: 3204441 - RNA, 21 nt, Mycobacterium bovis subsp bovis AF2122/97
gcacagcccggcgacgacccg

SEQ ID NO: 3204442 - RNA, 14 nt, Mycobacterium bovis subsp bovis AF2122/97
gcacagcccggcua

SEQ ID NO: 3204443 - RNA, 15 nt, Mycobacterium bovis subsp bovis AF2122/97
gcacagcgacgagau

SEQ ID NO: 3204444 - RNA, 13 nt, Mycobacterium bovis subsp bovis AF2122/97
gcacagcgcagcc

SEQ ID NO: 3204445 - RNA, 15 nt, Mycobacterium bovis subsp bovis AF2122/97
gcacagcgcagccug

SEQ ID NO: 3204446 - RNA, 14 nt, Mycobacterium bovis subsp bovis AF2122/97
gcacagcggcaucg

SEQ ID NO: 3204447 - RNA, 23 nt, Mycobacterium bovis subsp bovis AF2122/97
gcacagcuugcaauugcgcggcc

SEQ ID NO: 3204448 - RNA, 22 nt, Mycobacterium bovis subsp bovis AF2122/97
gcacaggaagcccauccccgcu

SEQ ID NO: 3204449 - RNA, 17 nt, Mycobacterium bovis subsp bovis AF2122/97
gcacaggaucacccacu

SEQ ID NO: 3204450 - RNA, 19 nt, Mycobacterium bovis subsp bovis AF2122/97
gcacaggaucacccacucg

SEQ ID NO: 3204451 - RNA, 21 nt, Mycobacterium bovis subsp bovis AF2122/97
gcacaggcauuuucacugugc

SEQ ID NO: 3204452 - RNA, 15 nt, Mycobacterium bovis subsp bovis AF2122/97
gcacaggcggccagc

SEQ ID NO: 3204453 - RNA, 18 nt, Mycobacterium bovis subsp bovis AF2122/97
gcacaggcggccagcauc

SEQ ID NO: 3204454 - RNA, 15 nt, Mycobacterium bovis subsp bovis AF2122/97
gcacaggucagcgcu

SEQ ID NO: 3204455 - RNA, 19 nt, Mycobacterium bovis subsp bovis AF2122/97
gcacaggucagcgcugcca

SEQ ID NO: 3204456 - RNA, 22 nt, Mycobacterium bovis subsp bovis AF2122/97
gcacaggucagcgcugccaccg

SEQ ID NO: 3204457 - RNA, 23 nt, Mycobacterium bovis subsp bovis AF2122/97
gcacaggucagcgcugccaccgc

SEQ ID NO: 3204458 - RNA, 18 nt, Mycobacterium bovis subsp bovis AF2122/97
gcacaggugccaaacgcc

SEQ ID NO: 3204459 - RNA, 23 nt, Mycobacterium bovis subsp bovis AF2122/97
gcacaggugccaaacgccgcccg

SEQ ID NO: 3204460 - RNA, 14 nt, Mycobacterium bovis subsp bovis AF2122/97
gcacaguccgcgaa

SEQ ID NO: 3204461 - RNA, 14 nt, Mycobacterium bovis subsp bovis AF2122/97
gcacagugcggccc

SEQ ID NO: 3204462 - RNA, 15 nt, Mycobacterium bovis subsp bovis AF2122/97
gcacagugcggcccc

SEQ ID NO: 3204463 - RNA, 17 nt, Mycobacterium bovis subsp bovis AF2122/97
gcacagugcggccccga

SEQ ID NO: 3204464 - RNA, 20 nt, Mycobacterium bovis subsp bovis AF2122/97
gcacauacgauuucgacgac

SEQ ID NO: 3204465 - RNA, 15 nt, Mycobacterium bovis subsp bovis AF2122/97
gcacauaguccgagc

SEQ ID NO: 3204466 - RNA, 18 nt, Mycobacterium bovis subsp bovis AF2122/97
gcacauaugugcccggcg

SEQ ID NO: 3204467 - RNA, 21 nt, Mycobacterium bovis subsp bovis AF2122/97
gcacaucaugggcgcugccaa

SEQ ID NO: 3204468 - RNA, 14 nt, Mycobacterium bovis subsp bovis AF2122/97
gcacauccugcagc

SEQ ID NO: 3204469 - RNA, 15 nt, Mycobacterium bovis subsp bovis AF2122/97
gcacauccugcagcu

SEQ ID NO: 3204470 - RNA, 18 nt, Mycobacterium bovis subsp bovis AF2122/97
gcacauccugcagcucgg

SEQ ID NO: 3204471 - RNA, 17 nt, Mycobacterium bovis subsp bovis AF2122/97
gcacaucgccggagucg

SEQ ID NO: 3204472 - RNA, 19 nt, Mycobacterium bovis subsp bovis AF2122/97
gcacaucgccggagucgac

SEQ ID NO: 3204473 - RNA, 22 nt, Mycobacterium bovis subsp bovis AF2122/97
gcacaucugcgggacgucgucg

SEQ ID NO: 3204474 - RNA, 18 nt, Mycobacterium bovis subsp bovis AF2122/97
gcacaugcgcguccagcu

SEQ ID NO: 3204475 - RNA, 17 nt, Mycobacterium bovis subsp bovis AF2122/97
gcacaugcugccgcugc

SEQ ID NO: 3204476 - RNA, 13 nt, Mycobacterium bovis subsp bovis AF2122/97
gcacauucagcgc

SEQ ID NO: 3204477 - RNA, 19 nt, Mycobacterium bovis subsp bovis AF2122/97
gcaccaaaugccccgaacc

SEQ ID NO: 3204478 - RNA, 13 nt, Mycobacterium bovis subsp bovis AF2122/97
gcaccaaccaccg

SEQ ID NO: 3204479 - RNA, 16 nt, Mycobacterium bovis subsp bovis AF2122/97
gcaccaaccaccgacu

SEQ ID NO: 3204480 - RNA, 16 nt, Mycobacterium bovis subsp bovis AF2122/97
gcaccaaccugagcau

SEQ ID NO: 3204481 - RNA, 13 nt, Mycobacterium bovis subsp bovis AF2122/97
gcaccaacgccac

SEQ ID NO: 3204482 - RNA, 14 nt, Mycobacterium bovis subsp bovis AF2122/97
gcaccaacgccacc

SEQ ID NO: 3204483 - RNA, 12 nt, Mycobacterium bovis subsp bovis AF2122/97
gcaccaggcggc

SEQ ID NO: 3204484 - RNA, 18 nt, Mycobacterium bovis subsp bovis AF2122/97
gcaccagggagccguuca

SEQ ID NO: 3204485 - RNA, 18 nt, Mycobacterium bovis subsp bovis AF2122/97
gcaccagggccucgaccg

SEQ ID NO: 3204486 - RNA, 15 nt, Mycobacterium bovis subsp bovis AF2122/97
gcaccagggcgcaac

SEQ ID NO: 3204487 - RNA, 21 nt, Mycobacterium bovis subsp bovis AF2122/97
gcaccagggcgcaacggauca

SEQ ID NO: 3204488 - RNA, 15 nt, Mycobacterium bovis subsp bovis AF2122/97
gcaccaggggcgcgu

SEQ ID NO: 3204489 - RNA, 23 nt, Mycobacterium bovis subsp bovis AF2122/97
gcaccaggggcgcgucauggcga

SEQ ID NO: 3204490 - RNA, 20 nt, Mycobacterium bovis subsp bovis AF2122/97
gcaccagguugcaaccuugg

SEQ ID NO: 3204491 - RNA, 18 nt, Mycobacterium bovis subsp bovis AF2122/97
gcaccagguugccgaggu

SEQ ID NO: 3204492 - RNA, 17 nt, Mycobacterium bovis subsp bovis AF2122/97
gcaccaguccagcgggc

SEQ ID NO: 3204493 - RNA, 13 nt, Mycobacterium bovis subsp bovis AF2122/97
gcaccagucgccc

SEQ ID NO: 3204494 - RNA, 15 nt, Mycobacterium bovis subsp bovis AF2122/97
gcaccagucgucgcg

SEQ ID NO: 3204495 - RNA, 21 nt, Mycobacterium bovis subsp bovis AF2122/97
gcaccagucgucgcgcucgac

SEQ ID NO: 3204496 - RNA, 20 nt, Mycobacterium bovis subsp bovis AF2122/97
gcaccaguguggcgaugacc

SEQ ID NO: 3204497 - RNA, 21 nt, Mycobacterium bovis subsp bovis AF2122/97
gcaccaguuugugccgccgcg

SEQ ID NO: 3204498 - RNA, 18 nt, Mycobacterium bovis subsp bovis AF2122/97
gcaccauacucaccgacg

SEQ ID NO: 3204499 - RNA, 22 nt, Mycobacterium bovis subsp bovis AF2122/97
gcaccauacucaccgacgcgcc

SEQ ID NO: 3204500 - RNA, 14 nt, Mycobacterium bovis subsp bovis AF2122/97
gcaccauccggucc

SEQ ID NO: 3204501 - RNA, 20 nt, Mycobacterium bovis subsp bovis AF2122/97
gcaccauccggucccgccgu

SEQ ID NO: 3204502 - RNA, 20 nt, Mycobacterium bovis subsp bovis AF2122/97
gcaccaucgcggccgcuggg

SEQ ID NO: 3204503 - RNA, 13 nt, Mycobacterium bovis subsp bovis AF2122/97
gcaccaucggcga

SEQ ID NO: 3204504 - RNA, 14 nt, Mycobacterium bovis subsp bovis AF2122/97
gcaccaucggcgag

SEQ ID NO: 3204505 - RNA, 22 nt, Mycobacterium bovis subsp bovis AF2122/97
gcaccaucgguaucgagggcag

SEQ ID NO: 3204506 - RNA, 23 nt, Mycobacterium bovis subsp bovis AF2122/97
gcaccaucgguaucgagggcagc

SEQ ID NO: 3204507 - RNA, 16 nt, Mycobacterium bovis subsp bovis AF2122/97
gcaccauguacaggcu

SEQ ID NO: 3204508 - RNA, 12 nt, Mycobacterium bovis subsp bovis AF2122/97
gcacccaaccag

SEQ ID NO: 3204509 - RNA, 14 nt, Mycobacterium bovis subsp bovis AF2122/97
gcacccaacccggc

SEQ ID NO: 3204510 - RNA, 16 nt, Mycobacterium bovis subsp bovis AF2122/97
gcacccaacccggcgg

SEQ ID NO: 3204511 - RNA, 17 nt, Mycobacterium bovis subsp bovis AF2122/97
gcacccaacccggcggc

SEQ ID NO: 3204512 - RNA, 18 nt, Mycobacterium bovis subsp bovis AF2122/97
gcacccaacuccaucagc

SEQ ID NO: 3204513 - RNA, 23 nt, Mycobacterium bovis subsp bovis AF2122/97
gcacccaauacacccaacucaug

SEQ ID NO: 3204514 - RNA, 15 nt, Mycobacterium bovis subsp bovis AF2122/97
gcacccaaugccacc

SEQ ID NO: 3204515 - RNA, 17 nt, Mycobacterium bovis subsp bovis AF2122/97
gcacccaaugccaccgc

SEQ ID NO: 3204516 - RNA, 23 nt, Mycobacterium bovis subsp bovis AF2122/97
gcacccaaugccaccgcggccgc

SEQ ID NO: 3204517 - RNA, 15 nt, Mycobacterium bovis subsp bovis AF2122/97
gcacccacaucagcc

SEQ ID NO: 3204518 - RNA, 17 nt, Mycobacterium bovis subsp bovis AF2122/97
gcacccacaucagccgc

SEQ ID NO: 3204519 - RNA, 15 nt, Mycobacterium bovis subsp bovis AF2122/97
gcacccaccacacca

SEQ ID NO: 3204520 - RNA, 17 nt, Mycobacterium bovis subsp bovis AF2122/97
gcacccaccacaccaag

SEQ ID NO: 3204521 - RNA, 18 nt, Mycobacterium bovis subsp bovis AF2122/97
gcacccaccagugcaucg

SEQ ID NO: 3204522 - RNA, 14 nt, Mycobacterium bovis subsp bovis AF2122/97
gcacccaccgaacc

SEQ ID NO: 3204523 - RNA, 15 nt, Mycobacterium bovis subsp bovis AF2122/97
gcacccacgccggug

SEQ ID NO: 3204524 - RNA, 24 nt, Mycobacterium bovis subsp bovis AF2122/97
gcacccacgccgguggcacggccc

SEQ ID NO: 3204525 - RNA, 19 nt, Mycobacterium bovis subsp bovis AF2122/97
gcacccacuuuucgguggc

SEQ ID NO: 3204526 - RNA, 12 nt, Mycobacterium bovis subsp bovis AF2122/97
gcacccagaccg

SEQ ID NO: 3204527 - RNA, 19 nt, Mycobacterium bovis subsp bovis AF2122/97
gcacccagacgauggccag

SEQ ID NO: 3204528 - RNA, 14 nt, Mycobacterium bovis subsp bovis AF2122/97
gcacccagccgugc

SEQ ID NO: 3204529 - RNA, 15 nt, Mycobacterium bovis subsp bovis AF2122/97
gcacccagccgugcc

SEQ ID NO: 3204530 - RNA, 17 nt, Mycobacterium bovis subsp bovis AF2122/97
gcacccagccgugccca

SEQ ID NO: 3204531 - RNA, 16 nt, Mycobacterium bovis subsp bovis AF2122/97
gcacccaggugucgcu

SEQ ID NO: 3204532 - RNA, 15 nt, Mycobacterium bovis subsp bovis AF2122/97
gcacccagucggcgc

SEQ ID NO: 3204533 - RNA, 16 nt, Mycobacterium bovis subsp bovis AF2122/97
gcacccagucggcgcc

SEQ ID NO: 3204534 - RNA, 17 nt, Mycobacterium bovis subsp bovis AF2122/97
gcacccagucggcgccg

SEQ ID NO: 3204535 - RNA, 14 nt, Mycobacterium bovis subsp bovis AF2122/97
gcacccauacggca

SEQ ID NO: 3204536 - RNA, 20 nt, Mycobacterium bovis subsp bovis AF2122/97
gcaccccauacucggcggcu

SEQ ID NO: 3204537 - RNA, 23 nt, Mycobacterium bovis subsp bovis AF2122/97
gcaccccauacucggcggcuucg

SEQ ID NO: 3204538 - RNA, 15 nt, Mycobacterium bovis subsp bovis AF2122/97
gcaccccauggccac

SEQ ID NO: 3204539 - RNA, 16 nt, Mycobacterium bovis subsp bovis AF2122/97
gcaccccauggccacc

SEQ ID NO: 3204540 - RNA, 23 nt, Mycobacterium bovis subsp bovis AF2122/97
gcaccccauggccaccgaacgcg

SEQ ID NO: 3204541 - RNA, 15 nt, Mycobacterium bovis subsp bovis AF2122/97
gcacccccgucgcca

SEQ ID NO: 3204542 - RNA, 13 nt, Mycobacterium bovis subsp bovis AF2122/97
gcacccccugcac

SEQ ID NO: 3204543 - RNA, 15 nt, Mycobacterium bovis subsp bovis AF2122/97
gcacccccugcaccg

SEQ ID NO: 3204544 - RNA, 14 nt, Mycobacterium bovis subsp bovis AF2122/97
gcaccccgaccacc

SEQ ID NO: 3204545 - RNA, 20 nt, Mycobacterium bovis subsp bovis AF2122/97
gcaccccgaccaccagagcg

SEQ ID NO: 3204546 - RNA, 16 nt, Mycobacterium bovis subsp bovis AF2122/97
gcaccccgaucuggcg

SEQ ID NO: 3204547 - RNA, 12 nt, Mycobacterium bovis subsp bovis AF2122/97
gcaccccgcggu

SEQ ID NO: 3204548 - RNA, 14 nt, Mycobacterium bovis subsp bovis AF2122/97
gcaccccgcuugcg

SEQ ID NO: 3204549 - RNA, 21 nt, Mycobacterium bovis subsp bovis AF2122/97
gcaccccgcuugcgcggcuug

SEQ ID NO: 3204550 - RNA, 14 nt, Mycobacterium bovis subsp bovis AF2122/97
gcaccccggccgcg

SEQ ID NO: 3204551 - RNA, 15 nt, Mycobacterium bovis subsp bovis AF2122/97
gcaccccggccgcgc

SEQ ID NO: 3204552 - RNA, 15 nt, Mycobacterium bovis subsp bovis AF2122/97
gcaccccggcggcgu

SEQ ID NO: 3204553 - RNA, 16 nt, Mycobacterium bovis subsp bovis AF2122/97
gcaccccggcggcguc

SEQ ID NO: 3204554 - RNA, 17 nt, Mycobacterium bovis subsp bovis AF2122/97
gcaccccggcggcgucc

SEQ ID NO: 3204555 - RNA, 20 nt, Mycobacterium bovis subsp bovis AF2122/97
gcaccccuuugacgccgagc

SEQ ID NO: 3204556 - RNA, 20 nt, Mycobacterium bovis subsp bovis AF2122/97
gcacccgaauagccagcguc

SEQ ID NO: 3204557 - RNA, 22 nt, Mycobacterium bovis subsp bovis AF2122/97
gcacccgaauuugucggcgaag

SEQ ID NO: 3204558 - RNA, 23 nt, Mycobacterium bovis subsp bovis AF2122/97
gcacccgaauuugucggcgaagc

SEQ ID NO: 3204559 - RNA, 24 nt, Mycobacterium bovis subsp bovis AF2122/97
gcacccgacccgaugcgucucgcg

SEQ ID NO: 3204560 - RNA, 22 nt, Mycobacterium bovis subsp bovis AF2122/97
gcacccgacucgucggccuggu

SEQ ID NO: 3204561 - RNA, 15 nt, Mycobacterium bovis subsp bovis AF2122/97
gcacccgagccgcac

SEQ ID NO: 3204562 - RNA, 16 nt, Mycobacterium bovis subsp bovis AF2122/97
gcacccgagccgcaca

SEQ ID NO: 3204563 - RNA, 19 nt, Mycobacterium bovis subsp bovis AF2122/97
gcacccgaguuauagaagc

SEQ ID NO: 3204564 - RNA, 21 nt, Mycobacterium bovis subsp bovis AF2122/97
gcacccgaguuauagaagccg

SEQ ID NO: 3204565 - RNA, 22 nt, Mycobacterium bovis subsp bovis AF2122/97
gcacccgaguuauagaagccga

SEQ ID NO: 3204566 - RNA, 23 nt, Mycobacterium bovis subsp bovis AF2122/97
gcacccgauaguucuggcccgca

SEQ ID NO: 3204567 - RNA, 12 nt, Mycobacterium bovis subsp bovis AF2122/97
gcacccgcaccg

SEQ ID NO: 3204568 - RNA, 16 nt, Mycobacterium bovis subsp bovis AF2122/97
gcacccgcaccgguga

SEQ ID NO: 3204569 - RNA, 20 nt, Mycobacterium bovis subsp bovis AF2122/97
gcaccgaccugagucggcau

SEQ ID NO: 3204570 - RNA, 21 nt, Mycobacterium bovis subsp bovis AF2122/97
gcaccgacgucggcuucaccu

SEQ ID NO: 3204571 - RNA, 22 nt, Mycobacterium bovis subsp bovis AF2122/97
gcaccgacugcugucaccgcaa

SEQ ID NO: 3204572 - RNA, 18 nt, Mycobacterium bovis subsp bovis AF2122/97
gcaccgacuucagcaacg

SEQ ID NO: 3204573 - RNA, 18 nt, Mycobacterium bovis subsp bovis AF2122/97
gcaccgagaaagugcagu

SEQ ID NO: 3204574 - RNA, 17 nt, Mycobacterium bovis subsp bovis AF2122/97
gcaccgagcugagcggc

SEQ ID NO: 3204575 - RNA, 18 nt, Mycobacterium bovis subsp bovis AF2122/97
gcaccgagcugagcggcc

SEQ ID NO: 3204576 - RNA, 19 nt, Mycobacterium bovis subsp bovis AF2122/97
gcaccgagcugagcggcca

SEQ ID NO: 3204577 - RNA, 15 nt, Mycobacterium bovis subsp bovis AF2122/97
gcaccgaggccgccg

SEQ ID NO: 3204578 - RNA, 17 nt, Mycobacterium bovis subsp bovis AF2122/97
gcaccgaggccgccgag

SEQ ID NO: 3204579 - RNA, 14 nt, Mycobacterium bovis subsp bovis AF2122/97
gcaccgaucaacgg

SEQ ID NO: 3204580 - RNA, 21 nt, Mycobacterium bovis subsp bovis AF2122/97
gcaccgaucggugccggccug

SEQ ID NO: 3204581 - RNA, 12 nt, Mycobacterium bovis subsp bovis AF2122/97
gcaccgaugccg

SEQ ID NO: 3204582 - RNA, 15 nt, Mycobacterium bovis subsp bovis AF2122/97
gcaccgaugccgaag

SEQ ID NO: 3204583 - RNA, 19 nt, Mycobacterium bovis subsp bovis AF2122/97
gcaccgaugccgaagcccc

SEQ ID NO: 3204584 - RNA, 21 nt, Mycobacterium bovis subsp bovis AF2122/97
gcaccgaugccgaagcccccg

SEQ ID NO: 3204585 - RNA, 22 nt, Mycobacterium bovis subsp bovis AF2122/97
gcaccgaugccgaagcccccga

SEQ ID NO: 3204586 - RNA, 23 nt, Mycobacterium bovis subsp bovis AF2122/97
gcaccgaugccgaagcccccgac

SEQ ID NO: 3204587 - RNA, 22 nt, Mycobacterium bovis subsp bovis AF2122/97
gcaccgaugccuugaccgcggu

SEQ ID NO: 3204588 - RNA, 15 nt, Mycobacterium bovis subsp bovis AF2122/97
gcaccgaugcugacg

SEQ ID NO: 3204589 - RNA, 18 nt, Mycobacterium bovis subsp bovis AF2122/97
gcaccgaugcugacgaug

SEQ ID NO: 3204590 - RNA, 15 nt, Mycobacterium bovis subsp bovis AF2122/97
gcaccgauggcgcac

SEQ ID NO: 3204591 - RNA, 17 nt, Mycobacterium bovis subsp bovis AF2122/97
gcaccgauggcgcaccg

SEQ ID NO: 3204592 - RNA, 20 nt, Mycobacterium bovis subsp bovis AF2122/97
gcaccgauggcgcaccggcg

SEQ ID NO: 3204593 - RNA, 20 nt, Mycobacterium bovis subsp bovis AF2122/97
gcaccgauuccagcggaagc

SEQ ID NO: 3204594 - RNA, 14 nt, Mycobacterium bovis subsp bovis AF2122/97
gcaccgcacggagg

SEQ ID NO: 3204595 - RNA, 15 nt, Mycobacterium bovis subsp bovis AF2122/97
gcaccgcagcgacca

SEQ ID NO: 3204596 - RNA, 17 nt, Mycobacterium bovis subsp bovis AF2122/97
gcaccgcagcgaccacc

SEQ ID NO: 3204597 - RNA, 22 nt, Mycobacterium bovis subsp bovis AF2122/97
gcaccgcauaacgcgaacccgc

SEQ ID NO: 3204598 - RNA, 23 nt, Mycobacterium bovis subsp bovis AF2122/97
gcaccgcauaacgcgaacccgcg

SEQ ID NO: 3204599 - RNA, 17 nt, Mycobacterium bovis subsp bovis AF2122/97
gcaccgccacccugacc

SEQ ID NO: 3204600 - RNA, 22 nt, Mycobacterium bovis subsp bovis AF2122/97
gcaccgccacccugaccaacau

SEQ ID NO: 3204601 - RNA, 14 nt, Mycobacterium bovis subsp bovis AF2122/97
gcaccgccagccac

SEQ ID NO: 3204602 - RNA, 15 nt, Mycobacterium bovis subsp bovis AF2122/97
gcaccgccagccacc

SEQ ID NO: 3204603 - RNA, 15 nt, Mycobacterium bovis subsp bovis AF2122/97
gcaccgccaggucga

SEQ ID NO: 3204604 - RNA, 16 nt, Mycobacterium bovis subsp bovis AF2122/97
gcaccgccaguuccgg

SEQ ID NO: 3204605 - RNA, 23 nt, Mycobacterium bovis subsp bovis AF2122/97
gcaccgcccccgucggccuuggg

SEQ ID NO: 3204606 - RNA, 15 nt, Mycobacterium bovis subsp bovis AF2122/97
gcaccgccccgccgu

SEQ ID NO: 3204607 - RNA, 15 nt, Mycobacterium bovis subsp bovis AF2122/97
gcaccgcccgccgaa

SEQ ID NO: 3204608 - RNA, 14 nt, Mycobacterium bovis subsp bovis AF2122/97
gcaccgccgagcag

SEQ ID NO: 3204609 - RNA, 12 nt, Mycobacterium bovis subsp bovis AF2122/97
gcaccgccgccc

SEQ ID NO: 3204610 - RNA, 16 nt, Mycobacterium bovis subsp bovis AF2122/97
gcaccgccgcccccgc

SEQ ID NO: 3204611 - RNA, 22 nt, Mycobacterium bovis subsp bovis AF2122/97
gcaccgccgcccccgccggccg

SEQ ID NO: 3204612 - RNA, 13 nt, Mycobacterium bovis subsp bovis AF2122/97
gcaccgccgcgcc

SEQ ID NO: 3204613 - RNA, 14 nt, Mycobacterium bovis subsp bovis AF2122/97
gcaccgccgcgccg

SEQ ID NO: 3204614 - RNA, 20 nt, Mycobacterium bovis subsp bovis AF2122/97
gcaccgccgcgccggcggcc

SEQ ID NO: 3204615 - RNA, 21 nt, Mycobacterium bovis subsp bovis AF2122/97
gcaccgccgcgccggcggcca

SEQ ID NO: 3204616 - RNA, 23 nt, Mycobacterium bovis subsp bovis AF2122/97
gcaccgccgcgccggcggccacc

SEQ ID NO: 3204617 - RNA, 13 nt, Mycobacterium bovis subsp bovis AF2122/97
gcaccgccggcaa

SEQ ID NO: 3204618 - RNA, 22 nt, Mycobacterium bovis subsp bovis AF2122/97
gcaccgccggcaauaccgccag

SEQ ID NO: 3204619 - RNA, 15 nt, Mycobacterium bovis subsp bovis AF2122/97
gcaccgccggcaccg

SEQ ID NO: 3204620 - RNA, 15 nt, Mycobacterium bovis subsp bovis AF2122/97
gcaccgccggccuug

SEQ ID NO: 3204621 - RNA, 14 nt, Mycobacterium bovis subsp bovis AF2122/97
gcaccgccggcgac

SEQ ID NO: 3204622 - RNA, 15 nt, Mycobacterium bovis subsp bovis AF2122/97
gcaccgccggcgcca

SEQ ID NO: 3204623 - RNA, 16 nt, Mycobacterium bovis subsp bovis AF2122/97
gcaccgccggcgccac

SEQ ID NO: 3204624 - RNA, 18 nt, Mycobacterium bovis subsp bovis AF2122/97
gcaccgccggcgccaccg

SEQ ID NO: 3204625 - RNA, 19 nt, Mycobacterium bovis subsp bovis AF2122/97
gcaccgccggcgcccaggc

SEQ ID NO: 3204626 - RNA, 20 nt, Mycobacterium bovis subsp bovis AF2122/97
gcaccgccggcgcccaggcc

SEQ ID NO: 3204627 - RNA, 14 nt, Mycobacterium bovis subsp bovis AF2122/97
gcaccgccgguggc

SEQ ID NO: 3204628 - RNA, 23 nt, Mycobacterium bovis subsp bovis AF2122/97
gcaccgccgguggcgccggggcc

SEQ ID NO: 3204629 - RNA, 16 nt, Mycobacterium bovis subsp bovis AF2122/97
gcaccgccugcgccuu

SEQ ID NO: 3204630 - RNA, 17 nt, Mycobacterium bovis subsp bovis AF2122/97
gcaccgccugcucggcg

SEQ ID NO: 3204631 - RNA, 13 nt, Mycobacterium bovis subsp bovis AF2122/97
gcaccgcgaccau

SEQ ID NO: 3204632 - RNA, 17 nt, Mycobacterium bovis subsp bovis AF2122/97
gcaccgcgaccaucgcg

SEQ ID NO: 3204633 - RNA, 20 nt, Mycobacterium bovis subsp bovis AF2122/97
gcaccgcgaccaucgcgacg

SEQ ID NO: 3204634 - RNA, 15 nt, Mycobacterium bovis subsp bovis AF2122/97
gcaccgcgaccgcgc

SEQ ID NO: 3204635 - RNA, 23 nt, Mycobacterium bovis subsp bovis AF2122/97
gcaccgcgcccaccagcggcggc

SEQ ID NO: 3204636 - RNA, 13 nt, Mycobacterium bovis subsp bovis AF2122/97
gcaccgcgccgaa

SEQ ID NO: 3204637 - RNA, 15 nt, Mycobacterium bovis subsp bovis AF2122/97
gcaccgcgccgcgcc

SEQ ID NO: 3204638 - RNA, 12 nt, Mycobacterium bovis subsp bovis AF2122/97
gcaccgcgccgg

SEQ ID NO: 3204639 - RNA, 14 nt, Mycobacterium bovis subsp bovis AF2122/97
gcaccgcgccggcg

SEQ ID NO: 3204640 - RNA, 17 nt, Mycobacterium bovis subsp bovis AF2122/97
gcaccgcgccggcggaa

SEQ ID NO: 3204641 - RNA, 15 nt, Mycobacterium bovis subsp bovis AF2122/97
gcaccgcgccgugga

SEQ ID NO: 3204642 - RNA, 19 nt, Mycobacterium bovis subsp bovis AF2122/97
gcaccgcggauaggccgcg

SEQ ID NO: 3204643 - RNA, 20 nt, Mycobacterium bovis subsp bovis AF2122/97
gcaccgcggauaggccgcgc

SEQ ID NO: 3204644 - RNA, 23 nt, Mycobacterium bovis subsp bovis AF2122/97
gcaccgcggauaggccgcgcggc

SEQ ID NO: 3204645 - RNA, 17 nt, Mycobacterium bovis subsp bovis AF2122/97
gcaccgcggccagcggg

SEQ ID NO: 3204646 - RNA, 19 nt, Mycobacterium bovis subsp bovis AF2122/97
gcaccgcggccagcgggaa

SEQ ID NO: 3204647 - RNA, 13 nt, Mycobacterium bovis subsp bovis AF2122/97
gcaccgcggccgc

SEQ ID NO: 3204648 - RNA, 23 nt, Mycobacterium bovis subsp bovis AF2122/97
gcaccgcgggaucgguggcggca

SEQ ID NO: 3204649 - RNA, 16 nt, Mycobacterium bovis subsp bovis AF2122/97
gcaccgcgguacgccg

SEQ ID NO: 3204650 - RNA, 17 nt, Mycobacterium bovis subsp bovis AF2122/97
gcaccgcgguacgccgg

SEQ ID NO: 3204651 - RNA, 18 nt, Mycobacterium bovis subsp bovis AF2122/97
gcaccgcgguacgccggu

SEQ ID NO: 3204652 - RNA, 20 nt, Mycobacterium bovis subsp bovis AF2122/97
gcaccgcgguacgccggucg

SEQ ID NO: 3204653 - RNA, 20 nt, Mycobacterium bovis subsp bovis AF2122/97
gcaccgcguugaugaccgcc

SEQ ID NO: 3204654 - RNA, 23 nt, Mycobacterium bovis subsp bovis AF2122/97
gcaccgcguugaugaccgccgcc

SEQ ID NO: 3204655 - RNA, 22 nt, Mycobacterium bovis subsp bovis AF2122/97
gcaccguuaccgccgucgccac

SEQ ID NO: 3204656 - RNA, 20 nt, Mycobacterium bovis subsp bovis AF2122/97
gcaccguuguaugcugcgcg

SEQ ID NO: 3204657 - RNA, 21 nt, Mycobacterium bovis subsp bovis AF2122/97
gcaccguuguaugcugcgcgc

SEQ ID NO: 3204658 - RNA, 20 nt, Mycobacterium bovis subsp bovis AF2122/97
gcaccguuuccggcgcuccg

SEQ ID NO: 3204659 - RNA, 21 nt, Mycobacterium bovis subsp bovis AF2122/97
gcaccguuuccggcgcuccgc

SEQ ID NO: 3204660 - RNA, 17 nt, Mycobacterium bovis subsp bovis AF2122/97
gcaccuagucgcggccg

SEQ ID NO: 3204661 - RNA, 21 nt, Mycobacterium bovis subsp bovis AF2122/97
gcaccuauggucaaccgcgcc

SEQ ID NO: 3204662 - RNA, 14 nt, Mycobacterium bovis subsp bovis AF2122/97
gcaccuccaccgcg

SEQ ID NO: 3204663 - RNA, 16 nt, Mycobacterium bovis subsp bovis AF2122/97
gcaccuccaccgcgcc

SEQ ID NO: 3204664 - RNA, 17 nt, Mycobacterium bovis subsp bovis AF2122/97
gcaccuccagcaccacc

SEQ ID NO: 3204665 - RNA, 18 nt, Mycobacterium bovis subsp bovis AF2122/97
gcaccuccagcaccaccg

SEQ ID NO: 3204666 - RNA, 14 nt, Mycobacterium bovis subsp bovis AF2122/97
gcaccucccgggcg

SEQ ID NO: 3204667 - RNA, 15 nt, Mycobacterium bovis subsp bovis AF2122/97
gcaccucccgggcga

SEQ ID NO: 3204668 - RNA, 18 nt, Mycobacterium bovis subsp bovis AF2122/97
gcaccuccgacggccgcg

SEQ ID NO: 3204669 - RNA, 21 nt, Mycobacterium bovis subsp bovis AF2122/97
gcaccuccgacggccgcggcg

SEQ ID NO: 3204670 - RNA, 13 nt, Mycobacterium bovis subsp bovis AF2122/97
gcaccuccguaac

SEQ ID NO: 3204671 - RNA, 14 nt, Mycobacterium bovis subsp bovis AF2122/97
gcaccucgaaggcc

SEQ ID NO: 3204672 - RNA, 18 nt, Mycobacterium bovis subsp bovis AF2122/97
gcaccucgaaggcccgcu

SEQ ID NO: 3204673 - RNA, 12 nt, Mycobacterium bovis subsp bovis AF2122/97
gcaccucgaccg

SEQ ID NO: 3204674 - RNA, 19 nt, Mycobacterium bovis subsp bovis AF2122/97
gcaccucgagcguggcaac

SEQ ID NO: 3204675 - RNA, 14 nt, Mycobacterium bovis subsp bovis AF2122/97
gcaccucgcccucc

SEQ ID NO: 3204676 - RNA, 20 nt, Mycobacterium bovis subsp bovis AF2122/97
gcaccucgcccucccgggcc

SEQ ID NO: 3204677 - RNA, 15 nt, Mycobacterium bovis subsp bovis AF2122/97
gcaccucggccagcu

SEQ ID NO: 3204678 - RNA, 12 nt, Mycobacterium bovis subsp bovis AF2122/97
gcaccucggcga

SEQ ID NO: 3204679 - RNA, 12 nt, Mycobacterium bovis subsp bovis AF2122/97
gcaccucgucga

SEQ ID NO: 3204680 - RNA, 17 nt, Mycobacterium bovis subsp bovis AF2122/97
gcaccucgucgaucgcc

SEQ ID NO: 3204681 - RNA, 20 nt, Mycobacterium bovis subsp bovis AF2122/97
gcaccucgucgaucgccgcg

SEQ ID NO: 3204682 - RNA, 21 nt, Mycobacterium bovis subsp bovis AF2122/97
gcaccucgucgaucgccgcgc

SEQ ID NO: 3204683 - RNA, 15 nt, Mycobacterium bovis subsp bovis AF2122/97
gcaccucguguccgg

SEQ ID NO: 3204684 - RNA, 15 nt, Mycobacterium bovis subsp bovis AF2122/97
gcaccugaucgguca

SEQ ID NO: 3204685 - RNA, 15 nt, Mycobacterium bovis subsp bovis AF2122/97
gcaccugcgcgcggc

SEQ ID NO: 3204686 - RNA, 18 nt, Mycobacterium bovis subsp bovis AF2122/97
gcaccugcgcgcggccgc

SEQ ID NO: 3204687 - RNA, 14 nt, Mycobacterium bovis subsp bovis AF2122/97
gcaccuggcgcagc

SEQ ID NO: 3204688 - RNA, 12 nt, Mycobacterium bovis subsp bovis AF2122/97
gcaccuggcgcg

SEQ ID NO: 3204689 - RNA, 14 nt, Mycobacterium bovis subsp bovis AF2122/97
gcaccuggcuugag

SEQ ID NO: 3204690 - RNA, 15 nt, Mycobacterium bovis subsp bovis AF2122/97
gcaccugggcgcgcu

SEQ ID NO: 3204691 - RNA, 18 nt, Mycobacterium bovis subsp bovis AF2122/97
gcaccugggcgcgcuggc

SEQ ID NO: 3204692 - RNA, 19 nt, Mycobacterium bovis subsp bovis AF2122/97
gcaccugggcgcgcuggcg

SEQ ID NO: 3204693 - RNA, 20 nt, Mycobacterium bovis subsp bovis AF2122/97
gcaccuggucggccgcaagg

SEQ ID NO: 3204694 - RNA, 13 nt, Mycobacterium bovis subsp bovis AF2122/97
gcaccuugaccgu

SEQ ID NO: 3204695 - RNA, 16 nt, Mycobacterium bovis subsp bovis AF2122/97
gcaccuuggccggccc

SEQ ID NO: 3204696 - RNA, 18 nt, Mycobacterium bovis subsp bovis AF2122/97
gcaccuuggccggccccg

SEQ ID NO: 3204697 - RNA, 20 nt, Mycobacterium bovis subsp bovis AF2122/97
gcacgaaaccgcagcgcgaa

SEQ ID NO: 3204698 - RNA, 23 nt, Mycobacterium bovis subsp bovis AF2122/97
gcacgaaauugggcgauucugcg

SEQ ID NO: 3204699 - RNA, 18 nt, Mycobacterium bovis subsp bovis AF2122/97
gcacgaacgccugcucgu

SEQ ID NO: 3204700 - RNA, 21 nt, Mycobacterium bovis subsp bovis AF2122/97
gcacgaacgccugcucgucgg

SEQ ID NO: 3204701 - RNA, 18 nt, Mycobacterium bovis subsp bovis AF2122/97
gcacgaagcuggcgugca

SEQ ID NO: 3204702 - RNA, 16 nt, Mycobacterium bovis subsp bovis AF2122/97
gcacgaaguccuggca

SEQ ID NO: 3204703 - RNA, 19 nt, Mycobacterium bovis subsp bovis AF2122/97
gcacgaaguccuggcagac

SEQ ID NO: 3204704 - RNA, 13 nt, Mycobacterium bovis subsp bovis AF2122/97
gcacgaauccccc

SEQ ID NO: 3204705 - RNA, 20 nt, Mycobacterium bovis subsp bovis AF2122/97
gcacgaaucccccggacggc

SEQ ID NO: 3204706 - RNA, 17 nt, Mycobacterium bovis subsp bovis AF2122/97
gcacgacaucgucgcga

SEQ ID NO: 3204707 - RNA, 18 nt, Mycobacterium bovis subsp bovis AF2122/97
gcacgacaucgucgcgac

SEQ ID NO: 3204708 - RNA, 22 nt, Mycobacterium bovis subsp bovis AF2122/97
gcacgacaucgucgcgacgacg

SEQ ID NO: 3204709 - RNA, 13 nt, Mycobacterium bovis subsp bovis AF2122/97
gcacgaccagcug

SEQ ID NO: 3204710 - RNA, 15 nt, Mycobacterium bovis subsp bovis AF2122/97
gcacgaccagcugag

SEQ ID NO: 3204711 - RNA, 12 nt, Mycobacterium bovis subsp bovis AF2122/97
gcacgacccggg

SEQ ID NO: 3204712 - RNA, 13 nt, Mycobacterium bovis subsp bovis AF2122/97
gcacgaccgcucc

SEQ ID NO: 3204713 - RNA, 14 nt, Mycobacterium bovis subsp bovis AF2122/97
gcacgaccugguua

SEQ ID NO: 3204714 - RNA, 15 nt, Mycobacterium bovis subsp bovis AF2122/97
gcacgacgacaaccg

SEQ ID NO: 3204715 - RNA, 19 nt, Mycobacterium bovis subsp bovis AF2122/97
gcacgacgacaaccggcca

SEQ ID NO: 3204716 - RNA, 20 nt, Mycobacterium bovis subsp bovis AF2122/97
gcacgacgacaaccggccag

SEQ ID NO: 3204717 - RNA, 15 nt, Mycobacterium bovis subsp bovis AF2122/97
gcacgacgccggccu

SEQ ID NO: 3204718 - RNA, 16 nt, Mycobacterium bovis subsp bovis AF2122/97
gcacgacgccggccug

SEQ ID NO: 3204719 - RNA, 22 nt, Mycobacterium bovis subsp bovis AF2122/97
gcacgacgccggccuggccgcc

SEQ ID NO: 3204720 - RNA, 15 nt, Mycobacterium bovis subsp bovis AF2122/97
gcacgacgcgacacg

SEQ ID NO: 3204721 - RNA, 20 nt, Mycobacterium bovis subsp bovis AF2122/97
gcacgacgcgacacgccggc

SEQ ID NO: 3204722 - RNA, 18 nt, Mycobacterium bovis subsp bovis AF2122/97
gcacgacgugcgucggcc

SEQ ID NO: 3204723 - RNA, 18 nt, Mycobacterium bovis subsp bovis AF2122/97
gcacgacugcaucgucga

SEQ ID NO: 3204724 - RNA, 23 nt, Mycobacterium bovis subsp bovis AF2122/97
gcacgacugugcgccgcagccug

SEQ ID NO: 3204725 - RNA, 15 nt, Mycobacterium bovis subsp bovis AF2122/97
gcacgagugcggcga

SEQ ID NO: 3204726 - RNA, 17 nt, Mycobacterium bovis subsp bovis AF2122/97
gcacgagugcggcgacc

SEQ ID NO: 3204727 - RNA, 18 nt, Mycobacterium bovis subsp bovis AF2122/97
gcacgaguuaccgguggu

SEQ ID NO: 3204728 - RNA, 19 nt, Mycobacterium bovis subsp bovis AF2122/97
gcacgauagccaccgacga

SEQ ID NO: 3204729 - RNA, 21 nt, Mycobacterium bovis subsp bovis AF2122/97
gcacgauagccaccgacgaca

SEQ ID NO: 3204730 - RNA, 14 nt, Mycobacterium bovis subsp bovis AF2122/97
gcacgauccagcug

SEQ ID NO: 3204731 - RNA, 16 nt, Mycobacterium bovis subsp bovis AF2122/97
gcacgauccgcacccg

SEQ ID NO: 3204732 - RNA, 23 nt, Mycobacterium bovis subsp bovis AF2122/97
gcacgauccgcacccggccgcgc

SEQ ID NO: 3204733 - RNA, 13 nt, Mycobacterium bovis subsp bovis AF2122/97
gcacgaucgccau

SEQ ID NO: 3204734 - RNA, 21 nt, Mycobacterium bovis subsp bovis AF2122/97
gcacgaucgcccgugagcgcc

SEQ ID NO: 3204735 - RNA, 13 nt, Mycobacterium bovis subsp bovis AF2122/97
gcacgaucgcggu

SEQ ID NO: 3204736 - RNA, 13 nt, Mycobacterium bovis subsp bovis AF2122/97
gcacgauggccgu

SEQ ID NO: 3204737 - RNA, 18 nt, Mycobacterium bovis subsp bovis AF2122/97
gcacgauggugugcagca

SEQ ID NO: 3204738 - RNA, 21 nt, Mycobacterium bovis subsp bovis AF2122/97
gcacgcaacaccgccaacucc

SEQ ID NO: 3204739 - RNA, 18 nt, Mycobacterium bovis subsp bovis AF2122/97
gcacgcaaugcgggcccu

SEQ ID NO: 3204740 - RNA, 21 nt, Mycobacterium bovis subsp bovis AF2122/97
gcacgcaaugucggcagggcc

SEQ ID NO: 3204741 - RNA, 13 nt, Mycobacterium bovis subsp bovis AF2122/97
gcacgcagccgau

SEQ ID NO: 3204742 - RNA, 23 nt, Mycobacterium bovis subsp bovis AF2122/97
gcacggcaaccagcgagcccagc

SEQ ID NO: 3204743 - RNA, 22 nt, Mycobacterium bovis subsp bovis AF2122/97
gcacggcacccacccguucggc

SEQ ID NO: 3204744 - RNA, 19 nt, Mycobacterium bovis subsp bovis AF2122/97
gcacggcagacacgcugca

SEQ ID NO: 3204745 - RNA, 19 nt, Mycobacterium bovis subsp bovis AF2122/97
gcacggccaccgcgcaacc

SEQ ID NO: 3204746 - RNA, 22 nt, Mycobacterium bovis subsp bovis AF2122/97
gcacggccaccgcgcaacccgg

SEQ ID NO: 3204747 - RNA, 23 nt, Mycobacterium bovis subsp bovis AF2122/97
gcacggccaugaucacaccgcug

SEQ ID NO: 3204748 - RNA, 14 nt, Mycobacterium bovis subsp bovis AF2122/97
gcacggccccugcc

SEQ ID NO: 3204749 - RNA, 16 nt, Mycobacterium bovis subsp bovis AF2122/97
gcacggccccugccac

SEQ ID NO: 3204750 - RNA, 19 nt, Mycobacterium bovis subsp bovis AF2122/97
gcacggccccugccacgac

SEQ ID NO: 3204751 - RNA, 20 nt, Mycobacterium bovis subsp bovis AF2122/97
gcacggccccugccacgacg

SEQ ID NO: 3204752 - RNA, 15 nt, Mycobacterium bovis subsp bovis AF2122/97
gcacggcccgagccg

SEQ ID NO: 3204753 - RNA, 16 nt, Mycobacterium bovis subsp bovis AF2122/97
gcacggcccgagccgc

SEQ ID NO: 3204754 - RNA, 19 nt, Mycobacterium bovis subsp bovis AF2122/97
gcacggccgggacggcgau

SEQ ID NO: 3204755 - RNA, 12 nt, Mycobacterium bovis subsp bovis AF2122/97
gcacggccgggu

SEQ ID NO: 3204756 - RNA, 14 nt, Mycobacterium bovis subsp bovis AF2122/97
gcacggccgggucg

SEQ ID NO: 3204757 - RNA, 18 nt, Mycobacterium bovis subsp bovis AF2122/97
gcacggccgggucgaaca

SEQ ID NO: 3204758 - RNA, 13 nt, Mycobacterium bovis subsp bovis AF2122/97
gcacggccgucga

SEQ ID NO: 3204759 - RNA, 20 nt, Mycobacterium bovis subsp bovis AF2122/97
gcacggccgucgacgaucag

SEQ ID NO: 3204760 - RNA, 17 nt, Mycobacterium bovis subsp bovis AF2122/97
gcacggcgacgaucucg

SEQ ID NO: 3204761 - RNA, 15 nt, Mycobacterium bovis subsp bovis AF2122/97
gcacggcgacgccag

SEQ ID NO: 3204762 - RNA, 18 nt, Mycobacterium bovis subsp bovis AF2122/97
gcacggcgaggccgaacu

SEQ ID NO: 3204763 - RNA, 15 nt, Mycobacterium bovis subsp bovis AF2122/97
gcacggcgaggugcu

SEQ ID NO: 3204764 - RNA, 17 nt, Mycobacterium bovis subsp bovis AF2122/97
gcacggcgaggugcucg

SEQ ID NO: 3204765 - RNA, 13 nt, Mycobacterium bovis subsp bovis AF2122/97
gcacggcgaucgg

SEQ ID NO: 3204766 - RNA, 14 nt, Mycobacterium bovis subsp bovis AF2122/97
gcacggcgccgacc

SEQ ID NO: 3204767 - RNA, 14 nt, Mycobacterium bovis subsp bovis AF2122/97
gcacggcgccgcca

SEQ ID NO: 3204768 - RNA, 16 nt, Mycobacterium bovis subsp bovis AF2122/97
gcacggcgccgccacg

SEQ ID NO: 3204769 - RNA, 15 nt, Mycobacterium bovis subsp bovis AF2122/97
gcacggcgcggcgga

SEQ ID NO: 3204770 - RNA, 18 nt, Mycobacterium bovis subsp bovis AF2122/97
gcacggcgcggcggagug

SEQ ID NO: 3204771 - RNA, 18 nt, Mycobacterium bovis subsp bovis AF2122/97
gcacggcgcuaccagcca

SEQ ID NO: 3204772 - RNA, 23 nt, Mycobacterium bovis subsp bovis AF2122/97
gcacggcggccacguccucagcc

SEQ ID NO: 3204773 - RNA, 13 nt, Mycobacterium bovis subsp bovis AF2122/97
gcacggcgucggc

SEQ ID NO: 3204774 - RNA, 19 nt, Mycobacterium bovis subsp bovis AF2122/97
gcacggcgucggccaccgc

SEQ ID NO: 3204775 - RNA, 13 nt, Mycobacterium bovis subsp bovis AF2122/97
gcacggcuggcgu

SEQ ID NO: 3204776 - RNA, 18 nt, Mycobacterium bovis subsp bovis AF2122/97
gcacggcuugggucuccg

SEQ ID NO: 3204777 - RNA, 18 nt, Mycobacterium bovis subsp bovis AF2122/97
gcacgggaaucgcucgcg

SEQ ID NO: 3204778 - RNA, 19 nt, Mycobacterium bovis subsp bovis AF2122/97
gcacgggaaucgcucgcgc

SEQ ID NO: 3204779 - RNA, 14 nt, Mycobacterium bovis subsp bovis AF2122/97
gcacgggccaccag

SEQ ID NO: 3204780 - RNA, 12 nt, Mycobacterium bovis subsp bovis AF2122/97
gcacgggcggcc

SEQ ID NO: 3204781 - RNA, 20 nt, Mycobacterium bovis subsp bovis AF2122/97
gcacgggcggggacggcggc

SEQ ID NO: 3204782 - RNA, 21 nt, Mycobacterium bovis subsp bovis AF2122/97
gcacgggcggggacggcggca

SEQ ID NO: 3204783 - RNA, 22 nt, Mycobacterium bovis subsp bovis AF2122/97
gcacgggcggggacggcggcaa

SEQ ID NO: 3204784 - RNA, 17 nt, Mycobacterium bovis subsp bovis AF2122/97
gcacggggaccgggcug

SEQ ID NO: 3204785 - RNA, 17 nt, Mycobacterium bovis subsp bovis AF2122/97
gcacggguaaucaccga

SEQ ID NO: 3204786 - RNA, 19 nt, Mycobacterium bovis subsp bovis AF2122/97
gcacggguaaucaccgaau

SEQ ID NO: 3204787 - RNA, 14 nt, Mycobacterium bovis subsp bovis AF2122/97
gcacgguaucggug

SEQ ID NO: 3204788 - RNA, 15 nt, Mycobacterium bovis subsp bovis AF2122/97
gcacggucaacgauc

SEQ ID NO: 3204789 - RNA, 17 nt, Mycobacterium bovis subsp bovis AF2122/97
gcacggucaacgauccc

SEQ ID NO: 3204790 - RNA, 18 nt, Mycobacterium bovis subsp bovis AF2122/97
gcacggucaacgaucccg

SEQ ID NO: 3204791 - RNA, 13 nt, Mycobacterium bovis subsp bovis AF2122/97
gcacggucaacgu

SEQ ID NO: 3204792 - RNA, 20 nt, Mycobacterium bovis subsp bovis AF2122/97
gcacggucacacgccagccg

SEQ ID NO: 3204793 - RNA, 21 nt, Mycobacterium bovis subsp bovis AF2122/97
gcacggucacacgccagccgg

SEQ ID NO: 3204794 - RNA, 18 nt, Mycobacterium bovis subsp bovis AF2122/97
gcacggucaugccgccgc

SEQ ID NO: 3204795 - RNA, 19 nt, Mycobacterium bovis subsp bovis AF2122/97
gcacggucaugccgccgcc

SEQ ID NO: 3204796 - RNA, 20 nt, Mycobacterium bovis subsp bovis AF2122/97
gcacggucgcccgaucggcg

SEQ ID NO: 3204797 - RNA, 22 nt, Mycobacterium bovis subsp bovis AF2122/97
gcacggucgcccgaucggcgga

SEQ ID NO: 3204798 - RNA, 18 nt, Mycobacterium bovis subsp bovis AF2122/97
gcacggugaacaauccga

SEQ ID NO: 3204799 - RNA, 18 nt, Mycobacterium bovis subsp bovis AF2122/97
gcacggugaacggcaagg

SEQ ID NO: 3204800 - RNA, 17 nt, Mycobacterium bovis subsp bovis AF2122/97
gcacggugagccggugg

SEQ ID NO: 3204801 - RNA, 18 nt, Mycobacterium bovis subsp bovis AF2122/97
gcacggugagccgguggc

SEQ ID NO: 3204802 - RNA, 14 nt, Mycobacterium bovis subsp bovis AF2122/97
gcacggugaucagc

SEQ ID NO: 3204803 - RNA, 17 nt, Mycobacterium bovis subsp bovis AF2122/97
gcacggugaucagcagc

SEQ ID NO: 3204804 - RNA, 15 nt, Mycobacterium bovis subsp bovis AF2122/97
gcacggugaugagga

SEQ ID NO: 3204805 - RNA, 20 nt, Mycobacterium bovis subsp bovis AF2122/97
gcacggugaugaggaucgcg

SEQ ID NO: 3204806 - RNA, 15 nt, Mycobacterium bovis subsp bovis AF2122/97
gcacggugcccaggg

SEQ ID NO: 3204807 - RNA, 15 nt, Mycobacterium bovis subsp bovis AF2122/97
gcacggugccgccgu

SEQ ID NO: 3204808 - RNA, 14 nt, Mycobacterium bovis subsp bovis AF2122/97
gcacgguggcaaug

SEQ ID NO: 3204809 - RNA, 17 nt, Mycobacterium bovis subsp bovis AF2122/97
gcacgguggccgagccg

SEQ ID NO: 3204810 - RNA, 13 nt, Mycobacterium bovis subsp bovis AF2122/97
gcacgguggcuuc

SEQ ID NO: 3204811 - RNA, 20 nt, Mycobacterium bovis subsp bovis AF2122/97
gcacgguggcuucgacggcg

SEQ ID NO: 3204812 - RNA, 22 nt, Mycobacterium bovis subsp bovis AF2122/97
gcacgguggcuucgacggcggc

SEQ ID NO: 3204813 - RNA, 16 nt, Mycobacterium bovis subsp bovis AF2122/97
gcacgguguacgcccg

SEQ ID NO: 3204814 - RNA, 19 nt, Mycobacterium bovis subsp bovis AF2122/97
gcacgguguacgcccgcuc

SEQ ID NO: 3204815 - RNA, 17 nt, Mycobacterium bovis subsp bovis AF2122/97
gcacgguguugcgcacc

SEQ ID NO: 3204816 - RNA, 18 nt, Mycobacterium bovis subsp bovis AF2122/97
gcacgguucuuggcgucu

SEQ ID NO: 3204817 - RNA, 17 nt, Mycobacterium bovis subsp bovis AF2122/97
gcacgguugccgucagg

SEQ ID NO: 3204818 - RNA, 22 nt, Mycobacterium bovis subsp bovis AF2122/97
gcacguaacgccgcucauccag

SEQ ID NO: 3204819 - RNA, 13 nt, Mycobacterium bovis subsp bovis AF2122/97
gcacguacgggca

SEQ ID NO: 3204820 - RNA, 21 nt, Mycobacterium bovis subsp bovis AF2122/97
gcacguagaaguaggcggcga

SEQ ID NO: 3204821 - RNA, 18 nt, Mycobacterium bovis subsp bovis AF2122/97
gcacguagacggugucac

SEQ ID NO: 3204822 - RNA, 19 nt, Mycobacterium bovis subsp bovis AF2122/97
gcacguauccacggucgac

SEQ ID NO: 3204823 - RNA, 17 nt, Mycobacterium bovis subsp bovis AF2122/97
gcacgucacgcaaccgg

SEQ ID NO: 3204824 - RNA, 17 nt, Mycobacterium bovis subsp bovis AF2122/97
gcacgucacgcgcggcg

SEQ ID NO: 3204825 - RNA, 18 nt, Mycobacterium bovis subsp bovis AF2122/97
gcacgucacgcgcggcgg

SEQ ID NO: 3204826 - RNA, 19 nt, Mycobacterium bovis subsp bovis AF2122/97
gcacgucaucggcuggccg

SEQ ID NO: 3204827 - RNA, 23 nt, Mycobacterium bovis subsp bovis AF2122/97
gcacgucaucggcuggccgcgcc

SEQ ID NO: 3204828 - RNA, 21 nt, Mycobacterium bovis subsp bovis AF2122/97
gcacugcgcgugcucgacgcg

SEQ ID NO: 3204829 - RNA, 14 nt, Mycobacterium bovis subsp bovis AF2122/97
gcacugcggcagcg

SEQ ID NO: 3204830 - RNA, 20 nt, Mycobacterium bovis subsp bovis AF2122/97
gcacugcugguugaugaagg

SEQ ID NO: 3204831 - RNA, 21 nt, Mycobacterium bovis subsp bovis AF2122/97
gcacuggauccgggagucgac

SEQ ID NO: 3204832 - RNA, 14 nt, Mycobacterium bovis subsp bovis AF2122/97
gcacuggcccccac

SEQ ID NO: 3204833 - RNA, 19 nt, Mycobacterium bovis subsp bovis AF2122/97
gcacuggcccccacaccac

SEQ ID NO: 3204834 - RNA, 22 nt, Mycobacterium bovis subsp bovis AF2122/97
gcacuggcccccacaccacgcu

SEQ ID NO: 3204835 - RNA, 15 nt, Mycobacterium bovis subsp bovis AF2122/97
gcacugggaugaguu

SEQ ID NO: 3204836 - RNA, 16 nt, Mycobacterium bovis subsp bovis AF2122/97
gcacugggcgaugacg

SEQ ID NO: 3204837 - RNA, 23 nt, Mycobacterium bovis subsp bovis AF2122/97
gcacugggcgaugacgccaucga

SEQ ID NO: 3204838 - RNA, 16 nt, Mycobacterium bovis subsp bovis AF2122/97
gcacugggcuggccag

SEQ ID NO: 3204839 - RNA, 22 nt, Mycobacterium bovis subsp bovis AF2122/97
gcacuggggucugauggcggcu

SEQ ID NO: 3204840 - RNA, 21 nt, Mycobacterium bovis subsp bovis AF2122/97
gcacuggguccacgcgcucgg

SEQ ID NO: 3204841 - RNA, 22 nt, Mycobacterium bovis subsp bovis AF2122/97
gcacugggugcgucgacccagc

SEQ ID NO: 3204842 - RNA, 23 nt, Mycobacterium bovis subsp bovis AF2122/97
gcacugggugcgucgacccagcu

SEQ ID NO: 3204843 - RNA, 13 nt, Mycobacterium bovis subsp bovis AF2122/97
gcacugguggcga

SEQ ID NO: 3204844 - RNA, 17 nt, Mycobacterium bovis subsp bovis AF2122/97
gcacugguggcgauccg

SEQ ID NO: 3204845 - RNA, 20 nt, Mycobacterium bovis subsp bovis AF2122/97
gcacugguugggcgagaccg

SEQ ID NO: 3204846 - RNA, 23 nt, Mycobacterium bovis subsp bovis AF2122/97
gcacugucgagguggucgacccg

SEQ ID NO: 3204847 - RNA, 14 nt, Mycobacterium bovis subsp bovis AF2122/97
gcacugugcccuca

SEQ ID NO: 3204848 - RNA, 19 nt, Mycobacterium bovis subsp bovis AF2122/97
gcacugugcccucaacguc

SEQ ID NO: 3204849 - RNA, 15 nt, Mycobacterium bovis subsp bovis AF2122/97
gcacugugcguccgc

SEQ ID NO: 3204850 - RNA, 19 nt, Mycobacterium bovis subsp bovis AF2122/97
gcacuguugcccaauucga

SEQ ID NO: 3204851 - RNA, 20 nt, Mycobacterium bovis subsp bovis AF2122/97
gcacuguugcguagcgcgcu

SEQ ID NO: 3204852 - RNA, 14 nt, Mycobacterium bovis subsp bovis AF2122/97
gcacuuaccgagcc

SEQ ID NO: 3204853 - RNA, 13 nt, Mycobacterium bovis subsp bovis AF2122/97
gcacuucagcuuc

SEQ ID NO: 3204854 - RNA, 14 nt, Mycobacterium bovis subsp bovis AF2122/97
gcacuucagcuucg

SEQ ID NO: 3204855 - RNA, 20 nt, Mycobacterium bovis subsp bovis AF2122/97
gcacuuccaagccgaccugc

SEQ ID NO: 3204856 - RNA, 16 nt, Mycobacterium bovis subsp bovis AF2122/97
gcacuuccagcccggc

SEQ ID NO: 3204857 - RNA, 17 nt, Mycobacterium bovis subsp bovis AF2122/97
gcacuuccagcccggca

SEQ ID NO: 3204858 - RNA, 20 nt, Mycobacterium bovis subsp bovis AF2122/97
gcacuucggugccgugaucg

SEQ ID NO: 3204859 - RNA, 21 nt, Mycobacterium bovis subsp bovis AF2122/97
gcacuucgucgaaccugucga

SEQ ID NO: 3204860 - RNA, 22 nt, Mycobacterium bovis subsp bovis AF2122/97
gcacuugaaauugagccggccc

SEQ ID NO: 3204861 - RNA, 16 nt, Mycobacterium bovis subsp bovis AF2122/97
gcacuugaucgacggc

SEQ ID NO: 3204862 - RNA, 20 nt, Mycobacterium bovis subsp bovis AF2122/97
gcacuugcguggcguuggug

SEQ ID NO: 3204863 - RNA, 16 nt, Mycobacterium bovis subsp bovis AF2122/97
gcacuuggcccccgac

SEQ ID NO: 3204864 - RNA, 23 nt, Mycobacterium bovis subsp bovis AF2122/97
gcacuuggcugcgagagcaccga

SEQ ID NO: 3204865 - RNA, 16 nt, Mycobacterium bovis subsp bovis AF2122/97
gcacuuuugcguggug

SEQ ID NO: 3204866 - RNA, 13 nt, Mycobacterium bovis subsp bovis AF2122/97
gcagaaaacccuc

SEQ ID NO: 3204867 - RNA, 22 nt, Mycobacterium bovis subsp bovis AF2122/97
gcagaaaaucugcuagcuuggc

SEQ ID NO: 3204868 - RNA, 21 nt, Mycobacterium bovis subsp bovis AF2122/97
gcagaaacaacgucgccgcgg

SEQ ID NO: 3204869 - RNA, 19 nt, Mycobacterium bovis subsp bovis AF2122/97
gcagaaacagccgcagcgg

SEQ ID NO: 3204870 - RNA, 22 nt, Mycobacterium bovis subsp bovis AF2122/97
gcagaaacaucgacagcaucac

SEQ ID NO: 3204871 - RNA, 19 nt, Mycobacterium bovis subsp bovis AF2122/97
gcagaaagucgcgcgcgaa

SEQ ID NO: 3204872 - RNA, 16 nt, Mycobacterium bovis subsp bovis AF2122/97
gcagaacaccaccgcc

SEQ ID NO: 3204873 - RNA, 12 nt, Mycobacterium bovis subsp bovis AF2122/97
gcagaacacgcu

SEQ ID NO: 3204874 - RNA, 19 nt, Mycobacterium bovis subsp bovis AF2122/97
gcagaacaguaucgccgga

SEQ ID NO: 3204875 - RNA, 14 nt, Mycobacterium bovis subsp bovis AF2122/97
gcagaaccgccaac

SEQ ID NO: 3204876 - RNA, 22 nt, Mycobacterium bovis subsp bovis AF2122/97
gcagaaccgccaacauugguga

SEQ ID NO: 3204877 - RNA, 14 nt, Mycobacterium bovis subsp bovis AF2122/97
gcagaacgaucgcg

SEQ ID NO: 3204878 - RNA, 20 nt, Mycobacterium bovis subsp bovis AF2122/97
gcagaacgaucgcgcuggcg

SEQ ID NO: 3204879 - RNA, 19 nt, Mycobacterium bovis subsp bovis AF2122/97
gcagaacggaccucggcgg

SEQ ID NO: 3204880 - RNA, 20 nt, Mycobacterium bovis subsp bovis AF2122/97
gcagaagcccccaaaccggc

SEQ ID NO: 3204881 - RNA, 13 nt, Mycobacterium bovis subsp bovis AF2122/97
gcagaaggccagc

SEQ ID NO: 3204882 - RNA, 15 nt, Mycobacterium bovis subsp bovis AF2122/97
gcagaaggccagcga

SEQ ID NO: 3204883 - RNA, 19 nt, Mycobacterium bovis subsp bovis AF2122/97
gcagaaguccucggcggac

SEQ ID NO: 3204884 - RNA, 20 nt, Mycobacterium bovis subsp bovis AF2122/97
gcagaauccggcaaccaccg

SEQ ID NO: 3204885 - RNA, 23 nt, Mycobacterium bovis subsp bovis AF2122/97
gcagaauccggcaaccaccggcc

SEQ ID NO: 3204886 - RNA, 15 nt, Mycobacterium bovis subsp bovis AF2122/97
gcagaauccggucgg

SEQ ID NO: 3204887 - RNA, 18 nt, Mycobacterium bovis subsp bovis AF2122/97
gcagaauccguucgacga

SEQ ID NO: 3204888 - RNA, 15 nt, Mycobacterium bovis subsp bovis AF2122/97
gcagaauccugcgcu

SEQ ID NO: 3204889 - RNA, 16 nt, Mycobacterium bovis subsp bovis AF2122/97
gcagaauccugcgcug

SEQ ID NO: 3204890 - RNA, 15 nt, Mycobacterium bovis subsp bovis AF2122/97
gcagaaucgcacgcg

SEQ ID NO: 3204891 - RNA, 15 nt, Mycobacterium bovis subsp bovis AF2122/97
gcagaaucgcccaau

SEQ ID NO: 3204892 - RNA, 13 nt, Mycobacterium bovis subsp bovis AF2122/97
gcagaaucgccua

SEQ ID NO: 3204893 - RNA, 22 nt, Mycobacterium bovis subsp bovis AF2122/97
gcagaauguucuccacgagguu

SEQ ID NO: 3204894 - RNA, 15 nt, Mycobacterium bovis subsp bovis AF2122/97
gcagaauucggcgcg

SEQ ID NO: 3204895 - RNA, 20 nt, Mycobacterium bovis subsp bovis AF2122/97
gcagacacagaaucgcacga

SEQ ID NO: 3204896 - RNA, 17 nt, Mycobacterium bovis subsp bovis AF2122/97
gcagacacgagucgcca

SEQ ID NO: 3204897 - RNA, 20 nt, Mycobacterium bovis subsp bovis AF2122/97
gcagacacgagucgccagac

SEQ ID NO: 3204898 - RNA, 20 nt, Mycobacterium bovis subsp bovis AF2122/97
gcagacacgcugcaggcggc

SEQ ID NO: 3204899 - RNA, 22 nt, Mycobacterium bovis subsp bovis AF2122/97
gcagacacgcugcaggcggccg

SEQ ID NO: 3204900 - RNA, 18 nt, Mycobacterium bovis subsp bovis AF2122/97
gcagacacuaaagcccuc

SEQ ID NO: 3204901 - RNA, 14 nt, Mycobacterium bovis subsp bovis AF2122/97
gcagacacugcugc

SEQ ID NO: 3204902 - RNA, 15 nt, Mycobacterium bovis subsp bovis AF2122/97
gcagacacugcugcg

SEQ ID NO: 3204903 - RNA, 20 nt, Mycobacterium bovis subsp bovis AF2122/97
gcagacacugcugcggcagc

SEQ ID NO: 3204904 - RNA, 22 nt, Mycobacterium bovis subsp bovis AF2122/97
gcagacacugcugcggcagcgc

SEQ ID NO: 3204905 - RNA, 18 nt, Mycobacterium bovis subsp bovis AF2122/97
gcagacaggcggcggccu

SEQ ID NO: 3204906 - RNA, 19 nt, Mycobacterium bovis subsp bovis AF2122/97
gcagacaggcggcggccug

SEQ ID NO: 3204907 - RNA, 21 nt, Mycobacterium bovis subsp bovis AF2122/97
gcagacaucggagaucauggc

SEQ ID NO: 3204908 - RNA, 13 nt, Mycobacterium bovis subsp bovis AF2122/97
gcagaccaccgcc

SEQ ID NO: 3204909 - RNA, 12 nt, Mycobacterium bovis subsp bovis AF2122/97
gcagacccgugc

SEQ ID NO: 3204910 - RNA, 20 nt, Mycobacterium bovis subsp bovis AF2122/97
gcagacccguucgccgucgg

SEQ ID NO: 3204911 - RNA, 23 nt, Mycobacterium bovis subsp bovis AF2122/97
gcagacccguucgccgucgguga

SEQ ID NO: 3204912 - RNA, 18 nt, Mycobacterium bovis subsp bovis AF2122/97
gcagaccgaccucggcga

SEQ ID NO: 3204913 - RNA, 16 nt, Mycobacterium bovis subsp bovis AF2122/97
gcagaccgaucggcag

SEQ ID NO: 3204914 - RNA, 17 nt, Mycobacterium bovis subsp bovis AF2122/97
gcagauuccucuucagg

SEQ ID NO: 3204915 - RNA, 23 nt, Mycobacterium bovis subsp bovis AF2122/97
gcagauuccucuucaggcccucg

SEQ ID NO: 3204916 - RNA, 18 nt, Mycobacterium bovis subsp bovis AF2122/97
gcagauucuucacccaac

SEQ ID NO: 3204917 - RNA, 16 nt, Mycobacterium bovis subsp bovis AF2122/97
gcagauuggcggcuuc

SEQ ID NO: 3204918 - RNA, 21 nt, Mycobacterium bovis subsp bovis AF2122/97
gcagauugucgacggucaccg

SEQ ID NO: 3204919 - RNA, 18 nt, Mycobacterium bovis subsp bovis AF2122/97
gcagcaaaaaccagcguc

SEQ ID NO: 3204920 - RNA, 18 nt, Mycobacterium bovis subsp bovis AF2122/97
gcagcaaaacccgagccu

SEQ ID NO: 3204921 - RNA, 19 nt, Mycobacterium bovis subsp bovis AF2122/97
gcagcaacaccucgucacc

SEQ ID NO: 3204922 - RNA, 22 nt, Mycobacterium bovis subsp bovis AF2122/97
gcagcaacaccucgucacccgg

SEQ ID NO: 3204923 - RNA, 13 nt, Mycobacterium bovis subsp bovis AF2122/97
gcagcaacacgau

SEQ ID NO: 3204924 - RNA, 23 nt, Mycobacterium bovis subsp bovis AF2122/97
gcagcaacaucuugccgucggcc

SEQ ID NO: 3204925 - RNA, 22 nt, Mycobacterium bovis subsp bovis AF2122/97
gcagcaacgacccgaagccgac

SEQ ID NO: 3204926 - RNA, 14 nt, Mycobacterium bovis subsp bovis AF2122/97
gcagcaacgacguc

SEQ ID NO: 3204927 - RNA, 14 nt, Mycobacterium bovis subsp bovis AF2122/97
gcagcaacggcggc

SEQ ID NO: 3204928 - RNA, 21 nt, Mycobacterium bovis subsp bovis AF2122/97
gcagcaacggcggcgucgcgg

SEQ ID NO: 3204929 - RNA, 16 nt, Mycobacterium bovis subsp bovis AF2122/97
gcagcaacugggcggc

SEQ ID NO: 3204930 - RNA, 18 nt, Mycobacterium bovis subsp bovis AF2122/97
gcagcaacugggcggccu

SEQ ID NO: 3204931 - RNA, 21 nt, Mycobacterium bovis subsp bovis AF2122/97
gcagcaacugggcggccuggu

SEQ ID NO: 3204932 - RNA, 14 nt, Mycobacterium bovis subsp bovis AF2122/97
gcagcaagaccgcg

SEQ ID NO: 3204933 - RNA, 17 nt, Mycobacterium bovis subsp bovis AF2122/97
gcagcaaucagccgccu

SEQ ID NO: 3204934 - RNA, 18 nt, Mycobacterium bovis subsp bovis AF2122/97
gcagcaaugcgguaccaa

SEQ ID NO: 3204935 - RNA, 14 nt, Mycobacterium bovis subsp bovis AF2122/97
gcagcaccacaucc

SEQ ID NO: 3204936 - RNA, 13 nt, Mycobacterium bovis subsp bovis AF2122/97
gcagcaccagcca

SEQ ID NO: 3204937 - RNA, 16 nt, Mycobacterium bovis subsp bovis AF2122/97
gcagcaccagcgccuu

SEQ ID NO: 3204938 - RNA, 21 nt, Mycobacterium bovis subsp bovis AF2122/97
gcagcaccagcgccuugacca

SEQ ID NO: 3204939 - RNA, 22 nt, Mycobacterium bovis subsp bovis AF2122/97
gcagcacccacaucagccgcac

SEQ ID NO: 3204940 - RNA, 15 nt, Mycobacterium bovis subsp bovis AF2122/97
gcagcacccgcacgg

SEQ ID NO: 3204941 - RNA, 13 nt, Mycobacterium bovis subsp bovis AF2122/97
gcagcacccgcgc

SEQ ID NO: 3204942 - RNA, 17 nt, Mycobacterium bovis subsp bovis AF2122/97
gcagcacccgcgccagu

SEQ ID NO: 3204943 - RNA, 18 nt, Mycobacterium bovis subsp bovis AF2122/97
gcagcacccgggccuggg

SEQ ID NO: 3204944 - RNA, 18 nt, Mycobacterium bovis subsp bovis AF2122/97
gcagcaccgcagcgacca

SEQ ID NO: 3204945 - RNA, 15 nt, Mycobacterium bovis subsp bovis AF2122/97
gcagcaccgcgacca

SEQ ID NO: 3204946 - RNA, 15 nt, Mycobacterium bovis subsp bovis AF2122/97
gcagcaccggcucga

SEQ ID NO: 3204947 - RNA, 13 nt, Mycobacterium bovis subsp bovis AF2122/97
gcagcaccgucgg

SEQ ID NO: 3204948 - RNA, 14 nt, Mycobacterium bovis subsp bovis AF2122/97
gcagcaccgucggc

SEQ ID NO: 3204949 - RNA, 23 nt, Mycobacterium bovis subsp bovis AF2122/97
gcagcaccgucggcaccagcagc

SEQ ID NO: 3204950 - RNA, 23 nt, Mycobacterium bovis subsp bovis AF2122/97
gcagcaccucagaaaguccccgc

SEQ ID NO: 3204951 - RNA, 15 nt, Mycobacterium bovis subsp bovis AF2122/97
gcagcaccucggucc

SEQ ID NO: 3204952 - RNA, 15 nt, Mycobacterium bovis subsp bovis AF2122/97
gcagcaccucgucga

SEQ ID NO: 3204953 - RNA, 14 nt, Mycobacterium bovis subsp bovis AF2122/97
gcagcaccugcacc

SEQ ID NO: 3204954 - RNA, 15 nt, Mycobacterium bovis subsp bovis AF2122/97
gcagcacgaccuggu

SEQ ID NO: 3204955 - RNA, 16 nt, Mycobacterium bovis subsp bovis AF2122/97
gcagcacgaccugguu

SEQ ID NO: 3204956 - RNA, 16 nt, Mycobacterium bovis subsp bovis AF2122/97
gcagcacgauccagcu

SEQ ID NO: 3204957 - RNA, 14 nt, Mycobacterium bovis subsp bovis AF2122/97
gcagcacggcgccg

SEQ ID NO: 3204958 - RNA, 13 nt, Mycobacterium bovis subsp bovis AF2122/97
gcagcacggcggc

SEQ ID NO: 3204959 - RNA, 21 nt, Mycobacterium bovis subsp bovis AF2122/97
gcagcacgggugagcaccacg

SEQ ID NO: 3204960 - RNA, 16 nt, Mycobacterium bovis subsp bovis AF2122/97
gcagcacggucugggu

SEQ ID NO: 3204961 - RNA, 16 nt, Mycobacterium bovis subsp bovis AF2122/97
gcagcacguccgcgga

SEQ ID NO: 3204962 - RNA, 18 nt, Mycobacterium bovis subsp bovis AF2122/97
gcagcacguccgcggagc

SEQ ID NO: 3204963 - RNA, 19 nt, Mycobacterium bovis subsp bovis AF2122/97
gcagcacuccggcgacgau

SEQ ID NO: 3204964 - RNA, 23 nt, Mycobacterium bovis subsp bovis AF2122/97
gcagcacuccggcgacgaucucg

SEQ ID NO: 3204965 - RNA, 15 nt, Mycobacterium bovis subsp bovis AF2122/97
gcagcacucgguguc

SEQ ID NO: 3204966 - RNA, 16 nt, Mycobacterium bovis subsp bovis AF2122/97
gcagcacugcggcagc

SEQ ID NO: 3204967 - RNA, 18 nt, Mycobacterium bovis subsp bovis AF2122/97
gcagcacuuggacccggc

SEQ ID NO: 3204968 - RNA, 21 nt, Mycobacterium bovis subsp bovis AF2122/97
gcagcacuuggacccggccgg

SEQ ID NO: 3204969 - RNA, 20 nt, Mycobacterium bovis subsp bovis AF2122/97
gcagcagaaacggcgacucg

SEQ ID NO: 3204970 - RNA, 15 nt, Mycobacterium bovis subsp bovis AF2122/97
gcagcagacccggug

SEQ ID NO: 3204971 - RNA, 19 nt, Mycobacterium bovis subsp bovis AF2122/97
gcagcagacccgguggcgu

SEQ ID NO: 3204972 - RNA, 22 nt, Mycobacterium bovis subsp bovis AF2122/97
gcagcagacgacgaucagcccc

SEQ ID NO: 3204973 - RNA, 19 nt, Mycobacterium bovis subsp bovis AF2122/97
gcagcagauugaugucagg

SEQ ID NO: 3204974 - RNA, 21 nt, Mycobacterium bovis subsp bovis AF2122/97
gcagcagcaucuggggguagc

SEQ ID NO: 3204975 - RNA, 13 nt, Mycobacterium bovis subsp bovis AF2122/97
gcagcagcccgac

SEQ ID NO: 3204976 - RNA, 16 nt, Mycobacterium bovis subsp bovis AF2122/97
gcagcagcccgggcag

SEQ ID NO: 3204977 - RNA, 17 nt, Mycobacterium bovis subsp bovis AF2122/97
gcagcagcccgggcagc

SEQ ID NO: 3204978 - RNA, 13 nt, Mycobacterium bovis subsp bovis AF2122/97
gcagcagccggcg

SEQ ID NO: 3204979 - RNA, 13 nt, Mycobacterium bovis subsp bovis AF2122/97
gcagcagcgcagu

SEQ ID NO: 3204980 - RNA, 14 nt, Mycobacterium bovis subsp bovis AF2122/97
gcagcagcgccgcg

SEQ ID NO: 3204981 - RNA, 15 nt, Mycobacterium bovis subsp bovis AF2122/97
gcagcagcgccgcgu

SEQ ID NO: 3204982 - RNA, 19 nt, Mycobacterium bovis subsp bovis AF2122/97
gcagcagcgccgcguggcu

SEQ ID NO: 3204983 - RNA, 23 nt, Mycobacterium bovis subsp bovis AF2122/97
gcagcagcgccgcguggcuggcg

SEQ ID NO: 3204984 - RNA, 16 nt, Mycobacterium bovis subsp bovis AF2122/97
gcagcagcgcgcgggu

SEQ ID NO: 3204985 - RNA, 16 nt, Mycobacterium bovis subsp bovis AF2122/97
gcagcagcgcuucggc

SEQ ID NO: 3204986 - RNA, 12 nt, Mycobacterium bovis subsp bovis AF2122/97
gcagcagcggca

SEQ ID NO: 3204987 - RNA, 14 nt, Mycobacterium bovis subsp bovis AF2122/97
gcagcagcggcggc

SEQ ID NO: 3204988 - RNA, 13 nt, Mycobacterium bovis subsp bovis AF2122/97
gcagcagcgggcg

SEQ ID NO: 3204989 - RNA, 13 nt, Mycobacterium bovis subsp bovis AF2122/97
gcagcagcgggcu

SEQ ID NO: 3204990 - RNA, 17 nt, Mycobacterium bovis subsp bovis AF2122/97
gcagcagcgggcuggcg

SEQ ID NO: 3204991 - RNA, 19 nt, Mycobacterium bovis subsp bovis AF2122/97
gcagcagcgggcuggcgaa

SEQ ID NO: 3204992 - RNA, 21 nt, Mycobacterium bovis subsp bovis AF2122/97
gcagcagcgugcacacccgca

SEQ ID NO: 3204993 - RNA, 13 nt, Mycobacterium bovis subsp bovis AF2122/97
gcagcagcugguc

SEQ ID NO: 3204994 - RNA, 20 nt, Mycobacterium bovis subsp bovis AF2122/97
gcagcaggaaguagccgagc

SEQ ID NO: 3204995 - RNA, 14 nt, Mycobacterium bovis subsp bovis AF2122/97
gcagcaggcccacc

SEQ ID NO: 3204996 - RNA, 18 nt, Mycobacterium bovis subsp bovis AF2122/97
gcagcaggggacgaccau

SEQ ID NO: 3204997 - RNA, 16 nt, Mycobacterium bovis subsp bovis AF2122/97
gcagcaggugagccag

SEQ ID NO: 3204998 - RNA, 21 nt, Mycobacterium bovis subsp bovis AF2122/97
gcagcaggugagccaguuggc

SEQ ID NO: 3204999 - RNA, 21 nt, Mycobacterium bovis subsp bovis AF2122/97
gcagcagguuguaguccgcgc

SEQ ID NO: 3205000 - RNA, 14 nt, Mycobacterium bovis subsp bovis AF2122/97
gcagcagugccacc

SEQ ID NO: 3205001 - RNA, 23 nt, Mycobacterium bovis subsp bovis AF2122/97
gcagccgaugcugcgggcggucc

SEQ ID NO: 3205002 - RNA, 14 nt, Mycobacterium bovis subsp bovis AF2122/97
gcagccgaugucgc

SEQ ID NO: 3205003 - RNA, 13 nt, Mycobacterium bovis subsp bovis AF2122/97
gcagccgcaccgg

SEQ ID NO: 3205004 - RNA, 12 nt, Mycobacterium bovis subsp bovis AF2122/97
gcagccgcagcc

SEQ ID NO: 3205005 - RNA, 14 nt, Mycobacterium bovis subsp bovis AF2122/97
gcagccgcagccgg

SEQ ID NO: 3205006 - RNA, 14 nt, Mycobacterium bovis subsp bovis AF2122/97
gcagccgcaggcca

SEQ ID NO: 3205007 - RNA, 15 nt, Mycobacterium bovis subsp bovis AF2122/97
gcagccgcagguggg

SEQ ID NO: 3205008 - RNA, 20 nt, Mycobacterium bovis subsp bovis AF2122/97
gcagccgcauaggccccgcc

SEQ ID NO: 3205009 - RNA, 13 nt, Mycobacterium bovis subsp bovis AF2122/97
gcagccgcccgcc

SEQ ID NO: 3205010 - RNA, 17 nt, Mycobacterium bovis subsp bovis AF2122/97
gcagccgcccgccagga

SEQ ID NO: 3205011 - RNA, 16 nt, Mycobacterium bovis subsp bovis AF2122/97
gcagccgcccgcccac

SEQ ID NO: 3205012 - RNA, 13 nt, Mycobacterium bovis subsp bovis AF2122/97
gcagccgccgcgc

SEQ ID NO: 3205013 - RNA, 17 nt, Mycobacterium bovis subsp bovis AF2122/97
gcagccgccgcgccccg

SEQ ID NO: 3205014 - RNA, 17 nt, Mycobacterium bovis subsp bovis AF2122/97
gcagccgcgacauccgc

SEQ ID NO: 3205015 - RNA, 13 nt, Mycobacterium bovis subsp bovis AF2122/97
gcagccgcgacgc

SEQ ID NO: 3205016 - RNA, 17 nt, Mycobacterium bovis subsp bovis AF2122/97
gcagccgcgacgcggcg

SEQ ID NO: 3205017 - RNA, 16 nt, Mycobacterium bovis subsp bovis AF2122/97
gcagccgcgaguccag

SEQ ID NO: 3205018 - RNA, 15 nt, Mycobacterium bovis subsp bovis AF2122/97
gcagccgcgccgcgg

SEQ ID NO: 3205019 - RNA, 20 nt, Mycobacterium bovis subsp bovis AF2122/97
gcagccgcgccgcggcccgc

SEQ ID NO: 3205020 - RNA, 13 nt, Mycobacterium bovis subsp bovis AF2122/97
gcagccgcgcggu

SEQ ID NO: 3205021 - RNA, 23 nt, Mycobacterium bovis subsp bovis AF2122/97
gcagccgcgcggugauggucacc

SEQ ID NO: 3205022 - RNA, 15 nt, Mycobacterium bovis subsp bovis AF2122/97
gcagccgcggucguu

SEQ ID NO: 3205023 - RNA, 15 nt, Mycobacterium bovis subsp bovis AF2122/97
gcagccgcucgacgg

SEQ ID NO: 3205024 - RNA, 19 nt, Mycobacterium bovis subsp bovis AF2122/97
gcagccgcucgacggcccg

SEQ ID NO: 3205025 - RNA, 21 nt, Mycobacterium bovis subsp bovis AF2122/97
gcagccgcucgacggcccgcc

SEQ ID NO: 3205026 - RNA, 18 nt, Mycobacterium bovis subsp bovis AF2122/97
gcagccgcugaucugccg

SEQ ID NO: 3205027 - RNA, 22 nt, Mycobacterium bovis subsp bovis AF2122/97
gcagccgcugaucugccgccgc

SEQ ID NO: 3205028 - RNA, 11 nt, Mycobacterium bovis subsp bovis AF2122/97
gcagccggcau

SEQ ID NO: 3205029 - RNA, 22 nt, Mycobacterium bovis subsp bovis AF2122/97
gcagccggcauagcggcccauc

SEQ ID NO: 3205030 - RNA, 15 nt, Mycobacterium bovis subsp bovis AF2122/97
gcagccggcggagaa

SEQ ID NO: 3205031 - RNA, 14 nt, Mycobacterium bovis subsp bovis AF2122/97
gcagccggcgggcc

SEQ ID NO: 3205032 - RNA, 11 nt, Mycobacterium bovis subsp bovis AF2122/97
gcagccgggca

SEQ ID NO: 3205033 - RNA, 12 nt, Mycobacterium bovis subsp bovis AF2122/97
gcagccgggcac

SEQ ID NO: 3205034 - RNA, 14 nt, Mycobacterium bovis subsp bovis AF2122/97
gcagccgggcacca

SEQ ID NO: 3205035 - RNA, 16 nt, Mycobacterium bovis subsp bovis AF2122/97
gcagccgggcaccacc

SEQ ID NO: 3205036 - RNA, 15 nt, Mycobacterium bovis subsp bovis AF2122/97
gcagccgggcaccga

SEQ ID NO: 3205037 - RNA, 16 nt, Mycobacterium bovis subsp bovis AF2122/97
gcagccgggccaaccg

SEQ ID NO: 3205038 - RNA, 17 nt, Mycobacterium bovis subsp bovis AF2122/97
gcagccgggcggcagcg

SEQ ID NO: 3205039 - RNA, 13 nt, Mycobacterium bovis subsp bovis AF2122/97
gcagccgggcguc

SEQ ID NO: 3205040 - RNA, 20 nt, Mycobacterium bovis subsp bovis AF2122/97
gcagccgggcgucgcuggug

SEQ ID NO: 3205041 - RNA, 15 nt, Mycobacterium bovis subsp bovis AF2122/97
gcagccguagcuggg

SEQ ID NO: 3205042 - RNA, 17 nt, Mycobacterium bovis subsp bovis AF2122/97
gcagccguagcugggca

SEQ ID NO: 3205043 - RNA, 20 nt, Mycobacterium bovis subsp bovis AF2122/97
gcagccguagcugggcaccc

SEQ ID NO: 3205044 - RNA, 13 nt, Mycobacterium bovis subsp bovis AF2122/97
gcagccugcagcg

SEQ ID NO: 3205045 - RNA, 15 nt, Mycobacterium bovis subsp bovis AF2122/97
gcagccugcgccgcg

SEQ ID NO: 3205046 - RNA, 13 nt, Mycobacterium bovis subsp bovis AF2122/97
gcagccugcugca

SEQ ID NO: 3205047 - RNA, 21 nt, Mycobacterium bovis subsp bovis AF2122/97
gcagccuggucgcgcagcucc

SEQ ID NO: 3205048 - RNA, 20 nt, Mycobacterium bovis subsp bovis AF2122/97
gcagcgaaaacccggucggc

SEQ ID NO: 3205049 - RNA, 23 nt, Mycobacterium bovis subsp bovis AF2122/97
gcagcgaaaacccggucggcgaa

SEQ ID NO: 3205050 - RNA, 20 nt, Mycobacterium bovis subsp bovis AF2122/97
gcagcgaaaaccgucgcaga

SEQ ID NO: 3205051 - RNA, 20 nt, Mycobacterium bovis subsp bovis AF2122/97
gcagcgaaacaccggccagc

SEQ ID NO: 3205052 - RNA, 16 nt, Mycobacterium bovis subsp bovis AF2122/97
gcagcgaaacgagccg

SEQ ID NO: 3205053 - RNA, 18 nt, Mycobacterium bovis subsp bovis AF2122/97
gcagcgaaacgagccggu

SEQ ID NO: 3205054 - RNA, 18 nt, Mycobacterium bovis subsp bovis AF2122/97
gcagcgaagaccagcggc

SEQ ID NO: 3205055 - RNA, 20 nt, Mycobacterium bovis subsp bovis AF2122/97
gcagcgaagaccagcggcgg

SEQ ID NO: 3205056 - RNA, 13 nt, Mycobacterium bovis subsp bovis AF2122/97
gcagcgacacguu

SEQ ID NO: 3205057 - RNA, 21 nt, Mycobacterium bovis subsp bovis AF2122/97
gcagcgacacguuggcggaug

SEQ ID NO: 3205058 - RNA, 19 nt, Mycobacterium bovis subsp bovis AF2122/97
gcagcgaccaccgucacga

SEQ ID NO: 3205059 - RNA, 14 nt, Mycobacterium bovis subsp bovis AF2122/97
gcagcgaccgucgu

SEQ ID NO: 3205060 - RNA, 14 nt, Mycobacterium bovis subsp bovis AF2122/97
gcagcgacgccggc

SEQ ID NO: 3205061 - RNA, 16 nt, Mycobacterium bovis subsp bovis AF2122/97
gcagcgacgcugccgc

SEQ ID NO: 3205062 - RNA, 19 nt, Mycobacterium bovis subsp bovis AF2122/97
gcagcgacgggaaagccac

SEQ ID NO: 3205063 - RNA, 20 nt, Mycobacterium bovis subsp bovis AF2122/97
gcagcgacuccagcgcccgg

SEQ ID NO: 3205064 - RNA, 21 nt, Mycobacterium bovis subsp bovis AF2122/97
gcagcgacuccagcgcccggu

SEQ ID NO: 3205065 - RNA, 16 nt, Mycobacterium bovis subsp bovis AF2122/97
gcagcgaggagcccgg

SEQ ID NO: 3205066 - RNA, 21 nt, Mycobacterium bovis subsp bovis AF2122/97
gcagcgaucuugguggccuca

SEQ ID NO: 3205067 - RNA, 13 nt, Mycobacterium bovis subsp bovis AF2122/97
gcagcgaugacga

SEQ ID NO: 3205068 - RNA, 15 nt, Mycobacterium bovis subsp bovis AF2122/97
gcagcgaugacgacc

SEQ ID NO: 3205069 - RNA, 16 nt, Mycobacterium bovis subsp bovis AF2122/97
gcagcgaugacgacca

SEQ ID NO: 3205070 - RNA, 17 nt, Mycobacterium bovis subsp bovis AF2122/97
gcagcgcaaacaucuug

SEQ ID NO: 3205071 - RNA, 13 nt, Mycobacterium bovis subsp bovis AF2122/97
gcagcgcaaccac

SEQ ID NO: 3205072 - RNA, 14 nt, Mycobacterium bovis subsp bovis AF2122/97
gcagcgcaaccacg

SEQ ID NO: 3205073 - RNA, 14 nt, Mycobacterium bovis subsp bovis AF2122/97
gcagcgcaacggcc

SEQ ID NO: 3205074 - RNA, 20 nt, Mycobacterium bovis subsp bovis AF2122/97
gcagcgcaacggccagcgcu

SEQ ID NO: 3205075 - RNA, 17 nt, Mycobacterium bovis subsp bovis AF2122/97
gcagcgcaaugcaucgc

SEQ ID NO: 3205076 - RNA, 20 nt, Mycobacterium bovis subsp bovis AF2122/97
gcagcgcaccaacucucgcg

SEQ ID NO: 3205077 - RNA, 23 nt, Mycobacterium bovis subsp bovis AF2122/97
gcagcgcacugcccggggugcug

SEQ ID NO: 3205078 - RNA, 14 nt, Mycobacterium bovis subsp bovis AF2122/97
gcagcgccacccga

SEQ ID NO: 3205079 - RNA, 15 nt, Mycobacterium bovis subsp bovis AF2122/97
gcagcgccacccgau

SEQ ID NO: 3205080 - RNA, 14 nt, Mycobacterium bovis subsp bovis AF2122/97
gcagcgccagcagc

SEQ ID NO: 3205081 - RNA, 14 nt, Mycobacterium bovis subsp bovis AF2122/97
gcagcgccaggccg

SEQ ID NO: 3205082 - RNA, 13 nt, Mycobacterium bovis subsp bovis AF2122/97
gcagcgccaucga

SEQ ID NO: 3205083 - RNA, 16 nt, Mycobacterium bovis subsp bovis AF2122/97
gcagcgccaucgaggu

SEQ ID NO: 3205084 - RNA, 19 nt, Mycobacterium bovis subsp bovis AF2122/97
gcagcgcccagaucgccga

SEQ ID NO: 3205085 - RNA, 13 nt, Mycobacterium bovis subsp bovis AF2122/97
gcagcgcccccgg

SEQ ID NO: 3205086 - RNA, 22 nt, Mycobacterium bovis subsp bovis AF2122/97
gcagcgcccuuggacgcgauga

SEQ ID NO: 3205087 - RNA, 12 nt, Mycobacterium bovis subsp bovis AF2122/97
gcagcgccgaca

SEQ ID NO: 3205088 - RNA, 17 nt, Mycobacterium bovis subsp bovis AF2122/97
gcagcgguguagccggc

SEQ ID NO: 3205089 - RNA, 18 nt, Mycobacterium bovis subsp bovis AF2122/97
gcagcgguguagccggcg

SEQ ID NO: 3205090 - RNA, 21 nt, Mycobacterium bovis subsp bovis AF2122/97
gcagcgguguagccggcgccg

SEQ ID NO: 3205091 - RNA, 23 nt, Mycobacterium bovis subsp bovis AF2122/97
gcagcgguguagccggcgccgcc

SEQ ID NO: 3205092 - RNA, 21 nt, Mycobacterium bovis subsp bovis AF2122/97
gcagcgguugaugcggccgcg

SEQ ID NO: 3205093 - RNA, 22 nt, Mycobacterium bovis subsp bovis AF2122/97
gcagcgguugaugcggccgcgg

SEQ ID NO: 3205094 - RNA, 18 nt, Mycobacterium bovis subsp bovis AF2122/97
gcagcguagugcugcgcg

SEQ ID NO: 3205095 - RNA, 20 nt, Mycobacterium bovis subsp bovis AF2122/97
gcagcgucacccugucgcgc

SEQ ID NO: 3205096 - RNA, 15 nt, Mycobacterium bovis subsp bovis AF2122/97
gcagcguccagcgcc

SEQ ID NO: 3205097 - RNA, 20 nt, Mycobacterium bovis subsp bovis AF2122/97
gcagcguccgaaccaccugu

SEQ ID NO: 3205098 - RNA, 11 nt, Mycobacterium bovis subsp bovis AF2122/97
gcagcgucggu

SEQ ID NO: 3205099 - RNA, 14 nt, Mycobacterium bovis subsp bovis AF2122/97
gcagcgucgucgac

SEQ ID NO: 3205100 - RNA, 17 nt, Mycobacterium bovis subsp bovis AF2122/97
gcagcgucgucgacgac

SEQ ID NO: 3205101 - RNA, 19 nt, Mycobacterium bovis subsp bovis AF2122/97
gcagcgucgucuagcggga

SEQ ID NO: 3205102 - RNA, 14 nt, Mycobacterium bovis subsp bovis AF2122/97
gcagcgugaccacc

SEQ ID NO: 3205103 - RNA, 19 nt, Mycobacterium bovis subsp bovis AF2122/97
gcagcgugaccaccgccga

SEQ ID NO: 3205104 - RNA, 21 nt, Mycobacterium bovis subsp bovis AF2122/97
gcagcgugaccaccgccgaca

SEQ ID NO: 3205105 - RNA, 14 nt, Mycobacterium bovis subsp bovis AF2122/97
gcagcgugagugca

SEQ ID NO: 3205106 - RNA, 22 nt, Mycobacterium bovis subsp bovis AF2122/97
gcagcgugagugcagcacgauc

SEQ ID NO: 3205107 - RNA, 18 nt, Mycobacterium bovis subsp bovis AF2122/97
gcagcgugaucuggccac

SEQ ID NO: 3205108 - RNA, 19 nt, Mycobacterium bovis subsp bovis AF2122/97
gcagcgugaucuggccacg

SEQ ID NO: 3205109 - RNA, 20 nt, Mycobacterium bovis subsp bovis AF2122/97
gcagcgugaucuggccacgg

SEQ ID NO: 3205110 - RNA, 21 nt, Mycobacterium bovis subsp bovis AF2122/97
gcagcgugcacacccgcaaug

SEQ ID NO: 3205111 - RNA, 18 nt, Mycobacterium bovis subsp bovis AF2122/97
gcagcgugcagcggcggg

SEQ ID NO: 3205112 - RNA, 20 nt, Mycobacterium bovis subsp bovis AF2122/97
gcagcgugcagcggcgggcg

SEQ ID NO: 3205113 - RNA, 23 nt, Mycobacterium bovis subsp bovis AF2122/97
gcagcgugcagcggcgggcgaug

SEQ ID NO: 3205114 - RNA, 18 nt, Mycobacterium bovis subsp bovis AF2122/97
gcagcgugcgaugcagcg

SEQ ID NO: 3205115 - RNA, 21 nt, Mycobacterium bovis subsp bovis AF2122/97
gcagcgugcgaugcagcgcgc

SEQ ID NO: 3205116 - RNA, 15 nt, Mycobacterium bovis subsp bovis AF2122/97
gcagcgugggcagcg

SEQ ID NO: 3205117 - RNA, 15 nt, Mycobacterium bovis subsp bovis AF2122/97
gcagcguguaaccga

SEQ ID NO: 3205118 - RNA, 22 nt, Mycobacterium bovis subsp bovis AF2122/97
gcagcgugugcucgugggcgac

SEQ ID NO: 3205119 - RNA, 15 nt, Mycobacterium bovis subsp bovis AF2122/97
gcagcguugacggcg

SEQ ID NO: 3205120 - RNA, 16 nt, Mycobacterium bovis subsp bovis AF2122/97
gcagcguugacggcgg

SEQ ID NO: 3205121 - RNA, 22 nt, Mycobacterium bovis subsp bovis AF2122/97
gcagcguugacggcggggcggc

SEQ ID NO: 3205122 - RNA, 23 nt, Mycobacterium bovis subsp bovis AF2122/97
gcagcguugacggcuucggcagc

SEQ ID NO: 3205123 - RNA, 16 nt, Mycobacterium bovis subsp bovis AF2122/97
gcagcguugacgguca

SEQ ID NO: 3205124 - RNA, 22 nt, Mycobacterium bovis subsp bovis AF2122/97
gcagcguugacggucagccgcg

SEQ ID NO: 3205125 - RNA, 14 nt, Mycobacterium bovis subsp bovis AF2122/97
gcagcguuggccgc

SEQ ID NO: 3205126 - RNA, 16 nt, Mycobacterium bovis subsp bovis AF2122/97
gcagcguuggccgcug

SEQ ID NO: 3205127 - RNA, 20 nt, Mycobacterium bovis subsp bovis AF2122/97
gcagcguuggccgcugucgu

SEQ ID NO: 3205128 - RNA, 19 nt, Mycobacterium bovis subsp bovis AF2122/97
gcagcuacggggcggucga

SEQ ID NO: 3205129 - RNA, 22 nt, Mycobacterium bovis subsp bovis AF2122/97
gcagcuacggggcggucgagcc

SEQ ID NO: 3205130 - RNA, 17 nt, Mycobacterium bovis subsp bovis AF2122/97
gcagcuagcccggcagc

SEQ ID NO: 3205131 - RNA, 16 nt, Mycobacterium bovis subsp bovis AF2122/97
gcagcuauuucgcgac

SEQ ID NO: 3205132 - RNA, 23 nt, Mycobacterium bovis subsp bovis AF2122/97
gcagcuauuucgcgacgcgcgag

SEQ ID NO: 3205133 - RNA, 21 nt, Mycobacterium bovis subsp bovis AF2122/97
gcagcucaccgacggagaucg

SEQ ID NO: 3205134 - RNA, 14 nt, Mycobacterium bovis subsp bovis AF2122/97
gcagcucacuggug

SEQ ID NO: 3205135 - RNA, 18 nt, Mycobacterium bovis subsp bovis AF2122/97
gcagcucaucgcgcacgc

SEQ ID NO: 3205136 - RNA, 14 nt, Mycobacterium bovis subsp bovis AF2122/97
gcagcuccaccagg

SEQ ID NO: 3205137 - RNA, 18 nt, Mycobacterium bovis subsp bovis AF2122/97
gcagcuccccgaccgaac

SEQ ID NO: 3205138 - RNA, 16 nt, Mycobacterium bovis subsp bovis AF2122/97
gcagcuccccgccgga

SEQ ID NO: 3205139 - RNA, 19 nt, Mycobacterium bovis subsp bovis AF2122/97
gcagcucccgccacgucgc

SEQ ID NO: 3205140 - RNA, 22 nt, Mycobacterium bovis subsp bovis AF2122/97
gcagcucccgccacgucgccgg

SEQ ID NO: 3205141 - RNA, 15 nt, Mycobacterium bovis subsp bovis AF2122/97
gcagcuccgccgccg

SEQ ID NO: 3205142 - RNA, 15 nt, Mycobacterium bovis subsp bovis AF2122/97
gcagcuccgggugca

SEQ ID NO: 3205143 - RNA, 14 nt, Mycobacterium bovis subsp bovis AF2122/97
gcagcuccguggug

SEQ ID NO: 3205144 - RNA, 16 nt, Mycobacterium bovis subsp bovis AF2122/97
gcagcuccucgcccag

SEQ ID NO: 3205145 - RNA, 14 nt, Mycobacterium bovis subsp bovis AF2122/97
gcagcucgaccagg

SEQ ID NO: 3205146 - RNA, 17 nt, Mycobacterium bovis subsp bovis AF2122/97
gcagcucgauacccagg

SEQ ID NO: 3205147 - RNA, 14 nt, Mycobacterium bovis subsp bovis AF2122/97
gcagcucgcacucg

SEQ ID NO: 3205148 - RNA, 11 nt, Mycobacterium bovis subsp bovis AF2122/97
gcagcucgccg

SEQ ID NO: 3205149 - RNA, 13 nt, Mycobacterium bovis subsp bovis AF2122/97
gcagcucgccgag

SEQ ID NO: 3205150 - RNA, 16 nt, Mycobacterium bovis subsp bovis AF2122/97
gcagcucgccggcacg

SEQ ID NO: 3205151 - RNA, 20 nt, Mycobacterium bovis subsp bovis AF2122/97
gcagcucgccggcacgcagc

SEQ ID NO: 3205152 - RNA, 22 nt, Mycobacterium bovis subsp bovis AF2122/97
gcagcucgccggcacgcagcca

SEQ ID NO: 3205153 - RNA, 14 nt, Mycobacterium bovis subsp bovis AF2122/97
gcagcucggccgag

SEQ ID NO: 3205154 - RNA, 16 nt, Mycobacterium bovis subsp bovis AF2122/97
gcagcucggccgaggc

SEQ ID NO: 3205155 - RNA, 14 nt, Mycobacterium bovis subsp bovis AF2122/97
gcagcucggggcga

SEQ ID NO: 3205156 - RNA, 22 nt, Mycobacterium bovis subsp bovis AF2122/97
gcagcucggggcgaugagccug

SEQ ID NO: 3205157 - RNA, 20 nt, Mycobacterium bovis subsp bovis AF2122/97
gcagcucggucagcgucagg

SEQ ID NO: 3205158 - RNA, 22 nt, Mycobacterium bovis subsp bovis AF2122/97
gcagcucggugacaagcggccc

SEQ ID NO: 3205159 - RNA, 18 nt, Mycobacterium bovis subsp bovis AF2122/97
gcagcucgugaccgccgu

SEQ ID NO: 3205160 - RNA, 22 nt, Mycobacterium bovis subsp bovis AF2122/97
gcagcugaaaauaggccgggca

SEQ ID NO: 3205161 - RNA, 15 nt, Mycobacterium bovis subsp bovis AF2122/97
gcagcugacgucacc

SEQ ID NO: 3205162 - RNA, 18 nt, Mycobacterium bovis subsp bovis AF2122/97
gcagcugacgucaccacg

SEQ ID NO: 3205163 - RNA, 13 nt, Mycobacterium bovis subsp bovis AF2122/97
gcagcugcaauag

SEQ ID NO: 3205164 - RNA, 13 nt, Mycobacterium bovis subsp bovis AF2122/97
gcagcugcccggc

SEQ ID NO: 3205165 - RNA, 14 nt, Mycobacterium bovis subsp bovis AF2122/97
gcagcugcccggcg

SEQ ID NO: 3205166 - RNA, 19 nt, Mycobacterium bovis subsp bovis AF2122/97
gcagcugccgcacccccuc

SEQ ID NO: 3205167 - RNA, 14 nt, Mycobacterium bovis subsp bovis AF2122/97
gcagcugcucgguc

SEQ ID NO: 3205168 - RNA, 17 nt, Mycobacterium bovis subsp bovis AF2122/97
gcagcugcucggucagg

SEQ ID NO: 3205169 - RNA, 22 nt, Mycobacterium bovis subsp bovis AF2122/97
gcagcugcucggucaggcggcu

SEQ ID NO: 3205170 - RNA, 20 nt, Mycobacterium bovis subsp bovis AF2122/97
gcagcugcucuccgucgcgc

SEQ ID NO: 3205171 - RNA, 21 nt, Mycobacterium bovis subsp bovis AF2122/97
gcagcugcuggaugucgucga

SEQ ID NO: 3205172 - RNA, 18 nt, Mycobacterium bovis subsp bovis AF2122/97
gcagcuggcgcagccugc

SEQ ID NO: 3205173 - RNA, 14 nt, Mycobacterium bovis subsp bovis AF2122/97
gcagcugggcagga

SEQ ID NO: 3205174 - RNA, 14 nt, Mycobacterium bovis subsp bovis AF2122/97
gcaggccgcccagc

SEQ ID NO: 3205175 - RNA, 19 nt, Mycobacterium bovis subsp bovis AF2122/97
gcaggccgcccagcuguca

SEQ ID NO: 3205176 - RNA, 14 nt, Mycobacterium bovis subsp bovis AF2122/97
gcaggccgccgcca

SEQ ID NO: 3205177 - RNA, 13 nt, Mycobacterium bovis subsp bovis AF2122/97
gcaggccgccggc

SEQ ID NO: 3205178 - RNA, 18 nt, Mycobacterium bovis subsp bovis AF2122/97
gcaggccgcgcucgucga

SEQ ID NO: 3205179 - RNA, 12 nt, Mycobacterium bovis subsp bovis AF2122/97
gcaggccgcgga

SEQ ID NO: 3205180 - RNA, 14 nt, Mycobacterium bovis subsp bovis AF2122/97
gcaggccgcguucg

SEQ ID NO: 3205181 - RNA, 16 nt, Mycobacterium bovis subsp bovis AF2122/97
gcaggccgcguucgug

SEQ ID NO: 3205182 - RNA, 14 nt, Mycobacterium bovis subsp bovis AF2122/97
gcaggccgcugggc

SEQ ID NO: 3205183 - RNA, 20 nt, Mycobacterium bovis subsp bovis AF2122/97
gcaggccggccaccgagucg

SEQ ID NO: 3205184 - RNA, 14 nt, Mycobacterium bovis subsp bovis AF2122/97
gcaggccggcggcg

SEQ ID NO: 3205185 - RNA, 19 nt, Mycobacterium bovis subsp bovis AF2122/97
gcaggccggcucgccgacc

SEQ ID NO: 3205186 - RNA, 15 nt, Mycobacterium bovis subsp bovis AF2122/97
gcaggccgggcacca

SEQ ID NO: 3205187 - RNA, 14 nt, Mycobacterium bovis subsp bovis AF2122/97
gcaggccgggcgca

SEQ ID NO: 3205188 - RNA, 21 nt, Mycobacterium bovis subsp bovis AF2122/97
gcaggccgguuugcacgcacc

SEQ ID NO: 3205189 - RNA, 12 nt, Mycobacterium bovis subsp bovis AF2122/97
gcaggccgucga

SEQ ID NO: 3205190 - RNA, 23 nt, Mycobacterium bovis subsp bovis AF2122/97
gcaggccgucgaguuccggccgg

SEQ ID NO: 3205191 - RNA, 21 nt, Mycobacterium bovis subsp bovis AF2122/97
gcaggccuccucuugggucca

SEQ ID NO: 3205192 - RNA, 14 nt, Mycobacterium bovis subsp bovis AF2122/97
gcaggccucggcgc

SEQ ID NO: 3205193 - RNA, 18 nt, Mycobacterium bovis subsp bovis AF2122/97
gcaggccucggcgccgcc

SEQ ID NO: 3205194 - RNA, 22 nt, Mycobacterium bovis subsp bovis AF2122/97
gcaggccucggcgccgcccagc

SEQ ID NO: 3205195 - RNA, 13 nt, Mycobacterium bovis subsp bovis AF2122/97
gcaggccuggcga

SEQ ID NO: 3205196 - RNA, 15 nt, Mycobacterium bovis subsp bovis AF2122/97
gcaggcgaacaccag

SEQ ID NO: 3205197 - RNA, 16 nt, Mycobacterium bovis subsp bovis AF2122/97
gcaggcgaacaccaga

SEQ ID NO: 3205198 - RNA, 14 nt, Mycobacterium bovis subsp bovis AF2122/97
gcaggcgagcaguc

SEQ ID NO: 3205199 - RNA, 12 nt, Mycobacterium bovis subsp bovis AF2122/97
gcaggcgaguga

SEQ ID NO: 3205200 - RNA, 19 nt, Mycobacterium bovis subsp bovis AF2122/97
gcaggcgaguuaggccgcc

SEQ ID NO: 3205201 - RNA, 23 nt, Mycobacterium bovis subsp bovis AF2122/97
gcaggcgaguuaggccgccagcc

SEQ ID NO: 3205202 - RNA, 17 nt, Mycobacterium bovis subsp bovis AF2122/97
gcaggcgaugcgccagg

SEQ ID NO: 3205203 - RNA, 13 nt, Mycobacterium bovis subsp bovis AF2122/97
gcaggcgcaaggu

SEQ ID NO: 3205204 - RNA, 16 nt, Mycobacterium bovis subsp bovis AF2122/97
gcaggcgcaccaggcg

SEQ ID NO: 3205205 - RNA, 17 nt, Mycobacterium bovis subsp bovis AF2122/97
gcaggcgcaccaggcgg

SEQ ID NO: 3205206 - RNA, 16 nt, Mycobacterium bovis subsp bovis AF2122/97
gcaggcgcagcugggu

SEQ ID NO: 3205207 - RNA, 17 nt, Mycobacterium bovis subsp bovis AF2122/97
gcaggcggccagcgaac

SEQ ID NO: 3205208 - RNA, 14 nt, Mycobacterium bovis subsp bovis AF2122/97
gcaggcggccgagc

SEQ ID NO: 3205209 - RNA, 15 nt, Mycobacterium bovis subsp bovis AF2122/97
gcaggcggccgccgg

SEQ ID NO: 3205210 - RNA, 11 nt, Mycobacterium bovis subsp bovis AF2122/97
gcaggcggccu

SEQ ID NO: 3205211 - RNA, 15 nt, Mycobacterium bovis subsp bovis AF2122/97
gcaggcggccuugcc

SEQ ID NO: 3205212 - RNA, 21 nt, Mycobacterium bovis subsp bovis AF2122/97
gcaggcggccuugccgggccg

SEQ ID NO: 3205213 - RNA, 16 nt, Mycobacterium bovis subsp bovis AF2122/97
gcaggcggcugaacgg

SEQ ID NO: 3205214 - RNA, 21 nt, Mycobacterium bovis subsp bovis AF2122/97
gcaggcgggaacgaucgauga

SEQ ID NO: 3205215 - RNA, 21 nt, Mycobacterium bovis subsp bovis AF2122/97
gcaggcgucccagccgaucac

SEQ ID NO: 3205216 - RNA, 21 nt, Mycobacterium bovis subsp bovis AF2122/97
gcaggcgugcuugaccgccug

SEQ ID NO: 3205217 - RNA, 23 nt, Mycobacterium bovis subsp bovis AF2122/97
gcaggcgugcuugaccgccugga

SEQ ID NO: 3205218 - RNA, 18 nt, Mycobacterium bovis subsp bovis AF2122/97
gcaggcuaaucagccagg

SEQ ID NO: 3205219 - RNA, 18 nt, Mycobacterium bovis subsp bovis AF2122/97
gcaggcucaccgagccga

SEQ ID NO: 3205220 - RNA, 16 nt, Mycobacterium bovis subsp bovis AF2122/97
gcaggcucagcuggug

SEQ ID NO: 3205221 - RNA, 19 nt, Mycobacterium bovis subsp bovis AF2122/97
gcaggcucagcugguggcg

SEQ ID NO: 3205222 - RNA, 16 nt, Mycobacterium bovis subsp bovis AF2122/97
gcaggcucgaaccgac

SEQ ID NO: 3205223 - RNA, 21 nt, Mycobacterium bovis subsp bovis AF2122/97
gcaggcucgggcaaggccacc

SEQ ID NO: 3205224 - RNA, 22 nt, Mycobacterium bovis subsp bovis AF2122/97
gcaggcugguuucggccgcauc

SEQ ID NO: 3205225 - RNA, 12 nt, Mycobacterium bovis subsp bovis AF2122/97
gcaggcugucga

SEQ ID NO: 3205226 - RNA, 22 nt, Mycobacterium bovis subsp bovis AF2122/97
gcaggcugucgagucgguccug

SEQ ID NO: 3205227 - RNA, 16 nt, Mycobacterium bovis subsp bovis AF2122/97
gcaggcuuagcuuccg

SEQ ID NO: 3205228 - RNA, 16 nt, Mycobacterium bovis subsp bovis AF2122/97
gcaggcuuccagccac

SEQ ID NO: 3205229 - RNA, 19 nt, Mycobacterium bovis subsp bovis AF2122/97
gcaggcuuccagccacagc

SEQ ID NO: 3205230 - RNA, 22 nt, Mycobacterium bovis subsp bovis AF2122/97
gcaggcuucugggguuggcucg

SEQ ID NO: 3205231 - RNA, 16 nt, Mycobacterium bovis subsp bovis AF2122/97
gcaggcuugccgaugg

SEQ ID NO: 3205232 - RNA, 19 nt, Mycobacterium bovis subsp bovis AF2122/97
gcaggcuuucauugacacu

SEQ ID NO: 3205233 - RNA, 22 nt, Mycobacterium bovis subsp bovis AF2122/97
gcagggaauagcggcgcccgcc

SEQ ID NO: 3205234 - RNA, 19 nt, Mycobacterium bovis subsp bovis AF2122/97
gcagggacugugggggcgc

SEQ ID NO: 3205235 - RNA, 22 nt, Mycobacterium bovis subsp bovis AF2122/97
gcagggaucaccccggccggcu

SEQ ID NO: 3205236 - RNA, 14 nt, Mycobacterium bovis subsp bovis AF2122/97
gcagggcagcccgg

SEQ ID NO: 3205237 - RNA, 20 nt, Mycobacterium bovis subsp bovis AF2122/97
gcagggcauugcggcccgcg

SEQ ID NO: 3205238 - RNA, 21 nt, Mycobacterium bovis subsp bovis AF2122/97
gcagggcauugcggcccgcga

SEQ ID NO: 3205239 - RNA, 13 nt, Mycobacterium bovis subsp bovis AF2122/97
gcagggccaccac

SEQ ID NO: 3205240 - RNA, 15 nt, Mycobacterium bovis subsp bovis AF2122/97
gcagggccaccacca

SEQ ID NO: 3205241 - RNA, 19 nt, Mycobacterium bovis subsp bovis AF2122/97
gcagggccaccaccacggc

SEQ ID NO: 3205242 - RNA, 15 nt, Mycobacterium bovis subsp bovis AF2122/97
gcagggccagaccga

SEQ ID NO: 3205243 - RNA, 17 nt, Mycobacterium bovis subsp bovis AF2122/97
gcagggccagcggcagc

SEQ ID NO: 3205244 - RNA, 13 nt, Mycobacterium bovis subsp bovis AF2122/97
gcagggccgccgc

SEQ ID NO: 3205245 - RNA, 17 nt, Mycobacterium bovis subsp bovis AF2122/97
gcagggccgccgcgaac

SEQ ID NO: 3205246 - RNA, 13 nt, Mycobacterium bovis subsp bovis AF2122/97
gcagggccgcgcg

SEQ ID NO: 3205247 - RNA, 15 nt, Mycobacterium bovis subsp bovis AF2122/97
gcagggccggcaccg

SEQ ID NO: 3205248 - RNA, 20 nt, Mycobacterium bovis subsp bovis AF2122/97
gcagggccggcaccgcagcg

SEQ ID NO: 3205249 - RNA, 17 nt, Mycobacterium bovis subsp bovis AF2122/97
gcagggccucggucgcc

SEQ ID NO: 3205250 - RNA, 20 nt, Mycobacterium bovis subsp bovis AF2122/97
gcagggccucggucgccaug

SEQ ID NO: 3205251 - RNA, 16 nt, Mycobacterium bovis subsp bovis AF2122/97
gcagggccuggccaca

SEQ ID NO: 3205252 - RNA, 21 nt, Mycobacterium bovis subsp bovis AF2122/97
gcagggcgcgcaucugcucgg

SEQ ID NO: 3205253 - RNA, 22 nt, Mycobacterium bovis subsp bovis AF2122/97
gcagggcgcgcaucugcucggc

SEQ ID NO: 3205254 - RNA, 13 nt, Mycobacterium bovis subsp bovis AF2122/97
gcagggcggcgaa

SEQ ID NO: 3205255 - RNA, 13 nt, Mycobacterium bovis subsp bovis AF2122/97
gcagggcggugcc

SEQ ID NO: 3205256 - RNA, 14 nt, Mycobacterium bovis subsp bovis AF2122/97
gcagggcggugcca

SEQ ID NO: 3205257 - RNA, 17 nt, Mycobacterium bovis subsp bovis AF2122/97
gcagggcgucggcgaau

SEQ ID NO: 3205258 - RNA, 22 nt, Mycobacterium bovis subsp bovis AF2122/97
gcagggcgucggcgaauuccuc

SEQ ID NO: 3205259 - RNA, 22 nt, Mycobacterium bovis subsp bovis AF2122/97
gcagggcuucgugcaccacauu

SEQ ID NO: 3205260 - RNA, 13 nt, Mycobacterium bovis subsp bovis AF2122/97
gcaggggacgacc

SEQ ID NO: 3205261 - RNA, 17 nt, Mycobacterium bovis subsp bovis AF2122/97
gcaguccaccgcgcggc

SEQ ID NO: 3205262 - RNA, 21 nt, Mycobacterium bovis subsp bovis AF2122/97
gcaguccaccgcgcggcgcag

SEQ ID NO: 3205263 - RNA, 16 nt, Mycobacterium bovis subsp bovis AF2122/97
gcaguccacgagcacg

SEQ ID NO: 3205264 - RNA, 19 nt, Mycobacterium bovis subsp bovis AF2122/97
gcaguccagccgggugccg

SEQ ID NO: 3205265 - RNA, 21 nt, Mycobacterium bovis subsp bovis AF2122/97
gcagucccagcacacccccgu

SEQ ID NO: 3205266 - RNA, 12 nt, Mycobacterium bovis subsp bovis AF2122/97
gcagucccagcg

SEQ ID NO: 3205267 - RNA, 22 nt, Mycobacterium bovis subsp bovis AF2122/97
gcaguccgagcuuggccgccgc

SEQ ID NO: 3205268 - RNA, 20 nt, Mycobacterium bovis subsp bovis AF2122/97
gcagucgagcaucucgucgg

SEQ ID NO: 3205269 - RNA, 23 nt, Mycobacterium bovis subsp bovis AF2122/97
gcagucgagcaucucgucgguga

SEQ ID NO: 3205270 - RNA, 19 nt, Mycobacterium bovis subsp bovis AF2122/97
gcagucgauuucggcggcg

SEQ ID NO: 3205271 - RNA, 19 nt, Mycobacterium bovis subsp bovis AF2122/97
gcagucgcaaaagccccca

SEQ ID NO: 3205272 - RNA, 15 nt, Mycobacterium bovis subsp bovis AF2122/97
gcagucgcacggugc

SEQ ID NO: 3205273 - RNA, 16 nt, Mycobacterium bovis subsp bovis AF2122/97
gcagucgcacggugcc

SEQ ID NO: 3205274 - RNA, 21 nt, Mycobacterium bovis subsp bovis AF2122/97
gcagucgcacggugccgccgu

SEQ ID NO: 3205275 - RNA, 15 nt, Mycobacterium bovis subsp bovis AF2122/97
gcagucgggcagcgc

SEQ ID NO: 3205276 - RNA, 20 nt, Mycobacterium bovis subsp bovis AF2122/97
gcagucgggcagcgcucuca

SEQ ID NO: 3205277 - RNA, 14 nt, Mycobacterium bovis subsp bovis AF2122/97
gcagugaccgcugg

SEQ ID NO: 3205278 - RNA, 13 nt, Mycobacterium bovis subsp bovis AF2122/97
gcagugaccucgu

SEQ ID NO: 3205279 - RNA, 17 nt, Mycobacterium bovis subsp bovis AF2122/97
gcagugaccucgucggc

SEQ ID NO: 3205280 - RNA, 14 nt, Mycobacterium bovis subsp bovis AF2122/97
gcagugacgccucg

SEQ ID NO: 3205281 - RNA, 23 nt, Mycobacterium bovis subsp bovis AF2122/97
gcagugacgccucgacacccagc

SEQ ID NO: 3205282 - RNA, 15 nt, Mycobacterium bovis subsp bovis AF2122/97
gcagugacguuccgc

SEQ ID NO: 3205283 - RNA, 19 nt, Mycobacterium bovis subsp bovis AF2122/97
gcagugacguuccgcucgc

SEQ ID NO: 3205284 - RNA, 20 nt, Mycobacterium bovis subsp bovis AF2122/97
gcagugacguuccgcucgcc

SEQ ID NO: 3205285 - RNA, 15 nt, Mycobacterium bovis subsp bovis AF2122/97
gcagugacucgauca

SEQ ID NO: 3205286 - RNA, 15 nt, Mycobacterium bovis subsp bovis AF2122/97
gcagugagcagccgg

SEQ ID NO: 3205287 - RNA, 17 nt, Mycobacterium bovis subsp bovis AF2122/97
gcagugcacccgggccg

SEQ ID NO: 3205288 - RNA, 16 nt, Mycobacterium bovis subsp bovis AF2122/97
gcagugcaccgcgucg

SEQ ID NO: 3205289 - RNA, 17 nt, Mycobacterium bovis subsp bovis AF2122/97
gcagugcagcgaucccg

SEQ ID NO: 3205290 - RNA, 18 nt, Mycobacterium bovis subsp bovis AF2122/97
gcagugcaggcggccgcc

SEQ ID NO: 3205291 - RNA, 16 nt, Mycobacterium bovis subsp bovis AF2122/97
gcagugccgcacccag

SEQ ID NO: 3205292 - RNA, 17 nt, Mycobacterium bovis subsp bovis AF2122/97
gcagugccgcacccaga

SEQ ID NO: 3205293 - RNA, 13 nt, Mycobacterium bovis subsp bovis AF2122/97
gcagugccgccgg

SEQ ID NO: 3205294 - RNA, 15 nt, Mycobacterium bovis subsp bovis AF2122/97
gcagugccgugcuga

SEQ ID NO: 3205295 - RNA, 13 nt, Mycobacterium bovis subsp bovis AF2122/97
gcagugccguguc

SEQ ID NO: 3205296 - RNA, 23 nt, Mycobacterium bovis subsp bovis AF2122/97
gcagugccguguccagcaugccc

SEQ ID NO: 3205297 - RNA, 15 nt, Mycobacterium bovis subsp bovis AF2122/97
gcagugccucggcga

SEQ ID NO: 3205298 - RNA, 19 nt, Mycobacterium bovis subsp bovis AF2122/97
gcagugccucggcgauggg

SEQ ID NO: 3205299 - RNA, 15 nt, Mycobacterium bovis subsp bovis AF2122/97
gcagugcgaacucau

SEQ ID NO: 3205300 - RNA, 13 nt, Mycobacterium bovis subsp bovis AF2122/97
gcagugcgccagc

SEQ ID NO: 3205301 - RNA, 20 nt, Mycobacterium bovis subsp bovis AF2122/97
gcagugcgcggcgucgucga

SEQ ID NO: 3205302 - RNA, 22 nt, Mycobacterium bovis subsp bovis AF2122/97
gcagugcgggggcgaccuggug

SEQ ID NO: 3205303 - RNA, 18 nt, Mycobacterium bovis subsp bovis AF2122/97
gcagugcugcagacccgu

SEQ ID NO: 3205304 - RNA, 17 nt, Mycobacterium bovis subsp bovis AF2122/97
gcaguggcagcccgucg

SEQ ID NO: 3205305 - RNA, 12 nt, Mycobacterium bovis subsp bovis AF2122/97
gcaguggccaga

SEQ ID NO: 3205306 - RNA, 14 nt, Mycobacterium bovis subsp bovis AF2122/97
gcaguggccgccgg

SEQ ID NO: 3205307 - RNA, 16 nt, Mycobacterium bovis subsp bovis AF2122/97
gcaguggccgccgggc

SEQ ID NO: 3205308 - RNA, 18 nt, Mycobacterium bovis subsp bovis AF2122/97
gcaguggccgccgggcag

SEQ ID NO: 3205309 - RNA, 12 nt, Mycobacterium bovis subsp bovis AF2122/97
gcaguggcgcgg

SEQ ID NO: 3205310 - RNA, 15 nt, Mycobacterium bovis subsp bovis AF2122/97
gcaguggcgcggcga

SEQ ID NO: 3205311 - RNA, 16 nt, Mycobacterium bovis subsp bovis AF2122/97
gcaguggcgcggcgag

SEQ ID NO: 3205312 - RNA, 22 nt, Mycobacterium bovis subsp bovis AF2122/97
gcaguggcguuacgcucggcga

SEQ ID NO: 3205313 - RNA, 23 nt, Mycobacterium bovis subsp bovis AF2122/97
gcagugggggugguaccggcggc

SEQ ID NO: 3205314 - RNA, 20 nt, Mycobacterium bovis subsp bovis AF2122/97
gcaguucaacgaggccgacg

SEQ ID NO: 3205315 - RNA, 19 nt, Mycobacterium bovis subsp bovis AF2122/97
gcaguucaucgggcaccaa

SEQ ID NO: 3205316 - RNA, 21 nt, Mycobacterium bovis subsp bovis AF2122/97
gcaguucaucgggcaccaacc

SEQ ID NO: 3205317 - RNA, 19 nt, Mycobacterium bovis subsp bovis AF2122/97
gcaguuccuugagacgccg

SEQ ID NO: 3205318 - RNA, 13 nt, Mycobacterium bovis subsp bovis AF2122/97
gcaguucgccgcg

SEQ ID NO: 3205319 - RNA, 15 nt, Mycobacterium bovis subsp bovis AF2122/97
gcaguucgccgcgca

SEQ ID NO: 3205320 - RNA, 17 nt, Mycobacterium bovis subsp bovis AF2122/97
gcaguucgccgcgcagc

SEQ ID NO: 3205321 - RNA, 16 nt, Mycobacterium bovis subsp bovis AF2122/97
gcaguucgcggccauc

SEQ ID NO: 3205322 - RNA, 22 nt, Mycobacterium bovis subsp bovis AF2122/97
gcaguucggcgaugcgcgggug

SEQ ID NO: 3205323 - RNA, 15 nt, Mycobacterium bovis subsp bovis AF2122/97
gcaguucggucagcg

SEQ ID NO: 3205324 - RNA, 15 nt, Mycobacterium bovis subsp bovis AF2122/97
gcaguucggucgucu

SEQ ID NO: 3205325 - RNA, 20 nt, Mycobacterium bovis subsp bovis AF2122/97
gcaguucucggucccgccgg

SEQ ID NO: 3205326 - RNA, 12 nt, Mycobacterium bovis subsp bovis AF2122/97
gcaguugaacuc

SEQ ID NO: 3205327 - RNA, 18 nt, Mycobacterium bovis subsp bovis AF2122/97
gcaguugaacucgaccac

SEQ ID NO: 3205328 - RNA, 19 nt, Mycobacterium bovis subsp bovis AF2122/97
gcaguugaacucgaccacc

SEQ ID NO: 3205329 - RNA, 20 nt, Mycobacterium bovis subsp bovis AF2122/97
gcaguugaacucgaccaccg

SEQ ID NO: 3205330 - RNA, 21 nt, Mycobacterium bovis subsp bovis AF2122/97
gcaguugauccugcaguacgg

SEQ ID NO: 3205331 - RNA, 15 nt, Mycobacterium bovis subsp bovis AF2122/97
gcaguuggccgagcg

SEQ ID NO: 3205332 - RNA, 23 nt, Mycobacterium bovis subsp bovis AF2122/97
gcaguuguucgaguucggccgcg

SEQ ID NO: 3205333 - RNA, 14 nt, Mycobacterium bovis subsp bovis AF2122/97
gcaguuuggcggca

SEQ ID NO: 3205334 - RNA, 16 nt, Mycobacterium bovis subsp bovis AF2122/97
gcaguuuggcggcagg

SEQ ID NO: 3205335 - RNA, 16 nt, Mycobacterium bovis subsp bovis AF2122/97
gcaguuuggcggcgcg

SEQ ID NO: 3205336 - RNA, 17 nt, Mycobacterium bovis subsp bovis AF2122/97
gcauaacccgcaccggg

SEQ ID NO: 3205337 - RNA, 21 nt, Mycobacterium bovis subsp bovis AF2122/97
gcauaacgaucccgugauccg

SEQ ID NO: 3205338 - RNA, 14 nt, Mycobacterium bovis subsp bovis AF2122/97
gcauaagcccccgc

SEQ ID NO: 3205339 - RNA, 18 nt, Mycobacterium bovis subsp bovis AF2122/97
gcauaagcccccgcacgc

SEQ ID NO: 3205340 - RNA, 23 nt, Mycobacterium bovis subsp bovis AF2122/97
gcauaagcccccgcacgcucgcc

SEQ ID NO: 3205341 - RNA, 14 nt, Mycobacterium bovis subsp bovis AF2122/97
gcauacaaccccgc

SEQ ID NO: 3205342 - RNA, 21 nt, Mycobacterium bovis subsp bovis AF2122/97
gcauacaaccccgcgcuguag

SEQ ID NO: 3205343 - RNA, 18 nt, Mycobacterium bovis subsp bovis AF2122/97
gcauacaccgugacguug

SEQ ID NO: 3205344 - RNA, 13 nt, Mycobacterium bovis subsp bovis AF2122/97
gcauacaucgccu

SEQ ID NO: 3205345 - RNA, 19 nt, Mycobacterium bovis subsp bovis AF2122/97
gcauacgcccacuccagca

SEQ ID NO: 3205346 - RNA, 23 nt, Mycobacterium bovis subsp bovis AF2122/97
gcauacgcccacuccagcagcuc

SEQ ID NO: 3205347 - RNA, 14 nt, Mycobacterium bovis subsp bovis AF2122/97
gcauacgcggcuuu

SEQ ID NO: 3205348 - RNA, 17 nt, Mycobacterium bovis subsp bovis AF2122/97
gcaucgcacgggccacc

SEQ ID NO: 3205349 - RNA, 14 nt, Mycobacterium bovis subsp bovis AF2122/97
gcaucgccacaguc

SEQ ID NO: 3205350 - RNA, 19 nt, Mycobacterium bovis subsp bovis AF2122/97
gcaucgccacagucgucga

SEQ ID NO: 3205351 - RNA, 15 nt, Mycobacterium bovis subsp bovis AF2122/97
gcaucgccaccaccg

SEQ ID NO: 3205352 - RNA, 15 nt, Mycobacterium bovis subsp bovis AF2122/97
gcaucgccaccauca

SEQ ID NO: 3205353 - RNA, 20 nt, Mycobacterium bovis subsp bovis AF2122/97
gcaucgccaccaucaccgcc

SEQ ID NO: 3205354 - RNA, 23 nt, Mycobacterium bovis subsp bovis AF2122/97
gcaucgcccaacaacgcuucggc

SEQ ID NO: 3205355 - RNA, 16 nt, Mycobacterium bovis subsp bovis AF2122/97
gcaucgccgacagcgc

SEQ ID NO: 3205356 - RNA, 15 nt, Mycobacterium bovis subsp bovis AF2122/97
gcaucgccgcgggug

SEQ ID NO: 3205357 - RNA, 13 nt, Mycobacterium bovis subsp bovis AF2122/97
gcaucgccgcugg

SEQ ID NO: 3205358 - RNA, 18 nt, Mycobacterium bovis subsp bovis AF2122/97
gcaucgccggcacgguga

SEQ ID NO: 3205359 - RNA, 21 nt, Mycobacterium bovis subsp bovis AF2122/97
gcaucgccgucaacgccucug

SEQ ID NO: 3205360 - RNA, 23 nt, Mycobacterium bovis subsp bovis AF2122/97
gcaucgccgucaacgccucugcu

SEQ ID NO: 3205361 - RNA, 20 nt, Mycobacterium bovis subsp bovis AF2122/97
gcaucgccuccaggcgccac

SEQ ID NO: 3205362 - RNA, 18 nt, Mycobacterium bovis subsp bovis AF2122/97
gcaucgccuccucgacgu

SEQ ID NO: 3205363 - RNA, 22 nt, Mycobacterium bovis subsp bovis AF2122/97
gcaucgccuccucgacgucggc

SEQ ID NO: 3205364 - RNA, 16 nt, Mycobacterium bovis subsp bovis AF2122/97
gcaucgccugcgccuu

SEQ ID NO: 3205365 - RNA, 22 nt, Mycobacterium bovis subsp bovis AF2122/97
gcaucgccugcgccuuggucgc

SEQ ID NO: 3205366 - RNA, 21 nt, Mycobacterium bovis subsp bovis AF2122/97
gcaucgcgaacucgggcaaug

SEQ ID NO: 3205367 - RNA, 16 nt, Mycobacterium bovis subsp bovis AF2122/97
gcaucgcgagccagcu

SEQ ID NO: 3205368 - RNA, 17 nt, Mycobacterium bovis subsp bovis AF2122/97
gcaucgcgagccagcug

SEQ ID NO: 3205369 - RNA, 21 nt, Mycobacterium bovis subsp bovis AF2122/97
gcaucgcgccuuugagcccgc

SEQ ID NO: 3205370 - RNA, 18 nt, Mycobacterium bovis subsp bovis AF2122/97
gcaucgcggaagcgggcg

SEQ ID NO: 3205371 - RNA, 15 nt, Mycobacterium bovis subsp bovis AF2122/97
gcaucgcggcggcgc

SEQ ID NO: 3205372 - RNA, 13 nt, Mycobacterium bovis subsp bovis AF2122/97
gcaucgcgguggu

SEQ ID NO: 3205373 - RNA, 22 nt, Mycobacterium bovis subsp bovis AF2122/97
gcaucgcugggcacucggcccg

SEQ ID NO: 3205374 - RNA, 18 nt, Mycobacterium bovis subsp bovis AF2122/97
gcaucggagauacgggcc

SEQ ID NO: 3205375 - RNA, 14 nt, Mycobacterium bovis subsp bovis AF2122/97
gcaucggcaaggcg

SEQ ID NO: 3205376 - RNA, 12 nt, Mycobacterium bovis subsp bovis AF2122/97
gcaucggcagcc

SEQ ID NO: 3205377 - RNA, 14 nt, Mycobacterium bovis subsp bovis AF2122/97
gcaucggcagcccc

SEQ ID NO: 3205378 - RNA, 18 nt, Mycobacterium bovis subsp bovis AF2122/97
gcaucggcagccccugcc

SEQ ID NO: 3205379 - RNA, 16 nt, Mycobacterium bovis subsp bovis AF2122/97
gcaucggccagcagcg

SEQ ID NO: 3205380 - RNA, 17 nt, Mycobacterium bovis subsp bovis AF2122/97
gcaucggccagcagcga

SEQ ID NO: 3205381 - RNA, 15 nt, Mycobacterium bovis subsp bovis AF2122/97
gcaucggccaucucg

SEQ ID NO: 3205382 - RNA, 13 nt, Mycobacterium bovis subsp bovis AF2122/97
gcaucggccccca

SEQ ID NO: 3205383 - RNA, 13 nt, Mycobacterium bovis subsp bovis AF2122/97
gcaucggcgacga

SEQ ID NO: 3205384 - RNA, 14 nt, Mycobacterium bovis subsp bovis AF2122/97
gcaucggcgacgaa

SEQ ID NO: 3205385 - RNA, 12 nt, Mycobacterium bovis subsp bovis AF2122/97
gcaucggcggca

SEQ ID NO: 3205386 - RNA, 14 nt, Mycobacterium bovis subsp bovis AF2122/97
gcaucggcggcaac

SEQ ID NO: 3205387 - RNA, 18 nt, Mycobacterium bovis subsp bovis AF2122/97
gcaucggcggcaacggcg

SEQ ID NO: 3205388 - RNA, 15 nt, Mycobacterium bovis subsp bovis AF2122/97
gcaucggcggcaagg

SEQ ID NO: 3205389 - RNA, 16 nt, Mycobacterium bovis subsp bovis AF2122/97
gcaucggcggggccca

SEQ ID NO: 3205390 - RNA, 22 nt, Mycobacterium bovis subsp bovis AF2122/97
gcaucggcgggucugggucagg

SEQ ID NO: 3205391 - RNA, 19 nt, Mycobacterium bovis subsp bovis AF2122/97
gcaucgggcgagcucgucg

SEQ ID NO: 3205392 - RNA, 21 nt, Mycobacterium bovis subsp bovis AF2122/97
gcaucgggcuugcgcagcagc

SEQ ID NO: 3205393 - RNA, 18 nt, Mycobacterium bovis subsp bovis AF2122/97
gcaucggguggcgaggca

SEQ ID NO: 3205394 - RNA, 20 nt, Mycobacterium bovis subsp bovis AF2122/97
gcaucggguggcgaggcagc

SEQ ID NO: 3205395 - RNA, 17 nt, Mycobacterium bovis subsp bovis AF2122/97
gcaucggucaaugccac

SEQ ID NO: 3205396 - RNA, 15 nt, Mycobacterium bovis subsp bovis AF2122/97
gcaucggucacaccg

SEQ ID NO: 3205397 - RNA, 17 nt, Mycobacterium bovis subsp bovis AF2122/97
gcaucggucagcgccga

SEQ ID NO: 3205398 - RNA, 18 nt, Mycobacterium bovis subsp bovis AF2122/97
gcaucggucagcgccgac

SEQ ID NO: 3205399 - RNA, 18 nt, Mycobacterium bovis subsp bovis AF2122/97
gcaucggucagcgcggca

SEQ ID NO: 3205400 - RNA, 21 nt, Mycobacterium bovis subsp bovis AF2122/97
gcaucggucagcgcggcaagc

SEQ ID NO: 3205401 - RNA, 14 nt, Mycobacterium bovis subsp bovis AF2122/97
gcaucgguccaaag

SEQ ID NO: 3205402 - RNA, 17 nt, Mycobacterium bovis subsp bovis AF2122/97
gcaucggucucgcacca

SEQ ID NO: 3205403 - RNA, 18 nt, Mycobacterium bovis subsp bovis AF2122/97
gcaucggucucgcaccag

SEQ ID NO: 3205404 - RNA, 14 nt, Mycobacterium bovis subsp bovis AF2122/97
gcaucggugcagcc

SEQ ID NO: 3205405 - RNA, 15 nt, Mycobacterium bovis subsp bovis AF2122/97
gcaucggugcagccc

SEQ ID NO: 3205406 - RNA, 18 nt, Mycobacterium bovis subsp bovis AF2122/97
gcaucggugcagcccgcc

SEQ ID NO: 3205407 - RNA, 22 nt, Mycobacterium bovis subsp bovis AF2122/97
gcaucggugccacggcaccgaa

SEQ ID NO: 3205408 - RNA, 21 nt, Mycobacterium bovis subsp bovis AF2122/97
gcaucggugcgguucgcugcg

SEQ ID NO: 3205409 - RNA, 23 nt, Mycobacterium bovis subsp bovis AF2122/97
gcaucggugcgguucgcugcggc

SEQ ID NO: 3205410 - RNA, 15 nt, Mycobacterium bovis subsp bovis AF2122/97
gcaucgguggggcgc

SEQ ID NO: 3205411 - RNA, 21 nt, Mycobacterium bovis subsp bovis AF2122/97
gcaucggugguaacaccggcg

SEQ ID NO: 3205412 - RNA, 19 nt, Mycobacterium bovis subsp bovis AF2122/97
gcaucgguucguagcgggc

SEQ ID NO: 3205413 - RNA, 21 nt, Mycobacterium bovis subsp bovis AF2122/97
gcaucgguucguagcgggcaa

SEQ ID NO: 3205414 - RNA, 18 nt, Mycobacterium bovis subsp bovis AF2122/97
gcaucgucagcgaccacg

SEQ ID NO: 3205415 - RNA, 12 nt, Mycobacterium bovis subsp bovis AF2122/97
gcaucguccacg

SEQ ID NO: 3205416 - RNA, 13 nt, Mycobacterium bovis subsp bovis AF2122/97
gcaucguccacgc

SEQ ID NO: 3205417 - RNA, 20 nt, Mycobacterium bovis subsp bovis AF2122/97
gcaucgucgaauccucgcga

SEQ ID NO: 3205418 - RNA, 24 nt, Mycobacterium bovis subsp bovis AF2122/97
gcaucgucgccaagcccaggcgau

SEQ ID NO: 3205419 - RNA, 12 nt, Mycobacterium bovis subsp bovis AF2122/97
gcaucgucgccg

SEQ ID NO: 3205420 - RNA, 14 nt, Mycobacterium bovis subsp bovis AF2122/97
gcaucgucgccgcg

SEQ ID NO: 3205421 - RNA, 22 nt, Mycobacterium bovis subsp bovis AF2122/97
gcaucgucgggucaaugcuggc

SEQ ID NO: 3205422 - RNA, 16 nt, Mycobacterium bovis subsp bovis AF2122/97
gcaucguuuucgccga

SEQ ID NO: 3205423 - RNA, 17 nt, Mycobacterium bovis subsp bovis AF2122/97
gcaucguuuucgccgau

SEQ ID NO: 3205424 - RNA, 23 nt, Mycobacterium bovis subsp bovis AF2122/97
gcaucuccaccgucgccgccggu

SEQ ID NO: 3205425 - RNA, 15 nt, Mycobacterium bovis subsp bovis AF2122/97
gcaucuccgucggcc

SEQ ID NO: 3205426 - RNA, 21 nt, Mycobacterium bovis subsp bovis AF2122/97
gcaucuccgucggccaggcca

SEQ ID NO: 3205427 - RNA, 15 nt, Mycobacterium bovis subsp bovis AF2122/97
gcaucucgacaucgg

SEQ ID NO: 3205428 - RNA, 21 nt, Mycobacterium bovis subsp bovis AF2122/97
gcaucucgacaucggccagcu

SEQ ID NO: 3205429 - RNA, 14 nt, Mycobacterium bovis subsp bovis AF2122/97
gcaucucgcaccgc

SEQ ID NO: 3205430 - RNA, 12 nt, Mycobacterium bovis subsp bovis AF2122/97
gcaucucggcgg

SEQ ID NO: 3205431 - RNA, 15 nt, Mycobacterium bovis subsp bovis AF2122/97
gcaucucggcggcca

SEQ ID NO: 3205432 - RNA, 18 nt, Mycobacterium bovis subsp bovis AF2122/97
gcaucugcgggucggcau

SEQ ID NO: 3205433 - RNA, 17 nt, Mycobacterium bovis subsp bovis AF2122/97
gcaucugcucggcaucg

SEQ ID NO: 3205434 - RNA, 14 nt, Mycobacterium bovis subsp bovis AF2122/97
gcaucugcuucugc

SEQ ID NO: 3205435 - RNA, 20 nt, Mycobacterium bovis subsp bovis AF2122/97
gcaugucucgggcgcgggug

SEQ ID NO: 3205436 - RNA, 22 nt, Mycobacterium bovis subsp bovis AF2122/97
gcaugugacaucgggccgccga

SEQ ID NO: 3205437 - RNA, 15 nt, Mycobacterium bovis subsp bovis AF2122/97
gcauguggccgccgu

SEQ ID NO: 3205438 - RNA, 20 nt, Mycobacterium bovis subsp bovis AF2122/97
gcauguucagcccgaacucg

SEQ ID NO: 3205439 - RNA, 15 nt, Mycobacterium bovis subsp bovis AF2122/97
gcauguuccuugcgg

SEQ ID NO: 3205440 - RNA, 22 nt, Mycobacterium bovis subsp bovis AF2122/97
gcauguuccuugcggccgcuga

SEQ ID NO: 3205441 - RNA, 16 nt, Mycobacterium bovis subsp bovis AF2122/97
gcauuaggccgggguc

SEQ ID NO: 3205442 - RNA, 11 nt, Mycobacterium bovis subsp bovis AF2122/97
gcauucccgcu

SEQ ID NO: 3205443 - RNA, 15 nt, Mycobacterium bovis subsp bovis AF2122/97
gcauucccgcucgca

SEQ ID NO: 3205444 - RNA, 19 nt, Mycobacterium bovis subsp bovis AF2122/97
gcauucccgcucgcaggcc

SEQ ID NO: 3205445 - RNA, 13 nt, Mycobacterium bovis subsp bovis AF2122/97
gcauuccggugug

SEQ ID NO: 3205446 - RNA, 24 nt, Mycobacterium bovis subsp bovis AF2122/97
gcauuccguaggccacagcccggc

SEQ ID NO: 3205447 - RNA, 20 nt, Mycobacterium bovis subsp bovis AF2122/97
gcauuccuugauaacgaccc

SEQ ID NO: 3205448 - RNA, 13 nt, Mycobacterium bovis subsp bovis AF2122/97
gcauucgauaccg

SEQ ID NO: 3205449 - RNA, 17 nt, Mycobacterium bovis subsp bovis AF2122/97
gcauucgauaccgcacc

SEQ ID NO: 3205450 - RNA, 17 nt, Mycobacterium bovis subsp bovis AF2122/97
gcauucgccgggcggca

SEQ ID NO: 3205451 - RNA, 18 nt, Mycobacterium bovis subsp bovis AF2122/97
gcauucgccgggcggcau

SEQ ID NO: 3205452 - RNA, 14 nt, Mycobacterium bovis subsp bovis AF2122/97
gcauucggcgagcc

SEQ ID NO: 3205453 - RNA, 17 nt, Mycobacterium bovis subsp bovis AF2122/97
gcauucggcgagccgcg

SEQ ID NO: 3205454 - RNA, 21 nt, Mycobacterium bovis subsp bovis AF2122/97
gcauucgggauucgggcgccg

SEQ ID NO: 3205455 - RNA, 22 nt, Mycobacterium bovis subsp bovis AF2122/97
gcauucguggagccggccguga

SEQ ID NO: 3205456 - RNA, 12 nt, Mycobacterium bovis subsp bovis AF2122/97
gcauugaagaag

SEQ ID NO: 3205457 - RNA, 14 nt, Mycobacterium bovis subsp bovis AF2122/97
gcauugaagaagcc

SEQ ID NO: 3205458 - RNA, 15 nt, Mycobacterium bovis subsp bovis AF2122/97
gcauugaagaagccc

SEQ ID NO: 3205459 - RNA, 16 nt, Mycobacterium bovis subsp bovis AF2122/97
gcauugaagaagcccg

SEQ ID NO: 3205460 - RNA, 16 nt, Mycobacterium bovis subsp bovis AF2122/97
gcauugaagaauggac

SEQ ID NO: 3205461 - RNA, 20 nt, Mycobacterium bovis subsp bovis AF2122/97
gcauugaccaauccacugau

SEQ ID NO: 3205462 - RNA, 15 nt, Mycobacterium bovis subsp bovis AF2122/97
gcauugacccgacga

SEQ ID NO: 3205463 - RNA, 12 nt, Mycobacterium bovis subsp bovis AF2122/97
gcauugagcugg

SEQ ID NO: 3205464 - RNA, 16 nt, Mycobacterium bovis subsp bovis AF2122/97
gcauugagcuggcgcc

SEQ ID NO: 3205465 - RNA, 21 nt, Mycobacterium bovis subsp bovis AF2122/97
gcauugagcuggcgcccgggu

SEQ ID NO: 3205466 - RNA, 22 nt, Mycobacterium bovis subsp bovis AF2122/97
gcauugagcuggcgcccggguc

SEQ ID NO: 3205467 - RNA, 14 nt, Mycobacterium bovis subsp bovis AF2122/97
gcauugaguucggc

SEQ ID NO: 3205468 - RNA, 13 nt, Mycobacterium bovis subsp bovis AF2122/97
gcauugaucggug

SEQ ID NO: 3205469 - RNA, 19 nt, Mycobacterium bovis subsp bovis AF2122/97
gcauugcccauagccaggu

SEQ ID NO: 3205470 - RNA, 19 nt, Mycobacterium bovis subsp bovis AF2122/97
gcauugccgccagcccagc

SEQ ID NO: 3205471 - RNA, 17 nt, Mycobacterium bovis subsp bovis AF2122/97
gcauugcggcgcgggug

SEQ ID NO: 3205472 - RNA, 20 nt, Mycobacterium bovis subsp bovis AF2122/97
gcauugcuccgguuggcgcg

SEQ ID NO: 3205473 - RNA, 15 nt, Mycobacterium bovis subsp bovis AF2122/97
gcauuggcgucgucg

SEQ ID NO: 3205474 - RNA, 16 nt, Mycobacterium bovis subsp bovis AF2122/97
gcauugguaccggcuu

SEQ ID NO: 3205475 - RNA, 20 nt, Mycobacterium bovis subsp bovis AF2122/97
gcauuggugaguagauugcu

SEQ ID NO: 3205476 - RNA, 13 nt, Mycobacterium bovis subsp bovis AF2122/97
gcauugucgccgg

SEQ ID NO: 3205477 - RNA, 13 nt, Mycobacterium bovis subsp bovis AF2122/97
gcauuucggaucu

SEQ ID NO: 3205478 - RNA, 20 nt, Mycobacterium bovis subsp bovis AF2122/97
gcauuucguggcacgggucg

SEQ ID NO: 3205479 - RNA, 23 nt, Mycobacterium bovis subsp bovis AF2122/97
gcauuucguggcgcgccgcaucg

SEQ ID NO: 3205480 - RNA, 20 nt, Mycobacterium bovis subsp bovis AF2122/97
gccaaaaacgccccggcgcg

SEQ ID NO: 3205481 - RNA, 16 nt, Mycobacterium bovis subsp bovis AF2122/97
gccaaaaacgcugccg

SEQ ID NO: 3205482 - RNA, 16 nt, Mycobacterium bovis subsp bovis AF2122/97
gccaaaacgagcagau

SEQ ID NO: 3205483 - RNA, 22 nt, Mycobacterium bovis subsp bovis AF2122/97
gccaaaacgagcagauggugaa

SEQ ID NO: 3205484 - RNA, 15 nt, Mycobacterium bovis subsp bovis AF2122/97
gccaaaagggcggca

SEQ ID NO: 3205485 - RNA, 21 nt, Mycobacterium bovis subsp bovis AF2122/97
gccaaaauggugccguccggc

SEQ ID NO: 3205486 - RNA, 19 nt, Mycobacterium bovis subsp bovis AF2122/97
gccaaaauuuugucggccg

SEQ ID NO: 3205487 - RNA, 23 nt, Mycobacterium bovis subsp bovis AF2122/97
gccaaacccaugucggcgcgccg

SEQ ID NO: 3205488 - RNA, 15 nt, Mycobacterium bovis subsp bovis AF2122/97
gccaaacccggcggg

SEQ ID NO: 3205489 - RNA, 24 nt, Mycobacterium bovis subsp bovis AF2122/97
gccaaacccggcgggcccgccggc

SEQ ID NO: 3205490 - RNA, 15 nt, Mycobacterium bovis subsp bovis AF2122/97
gccaaaccgauggga

SEQ ID NO: 3205491 - RNA, 13 nt, Mycobacterium bovis subsp bovis AF2122/97
gccaaaccugggu

SEQ ID NO: 3205492 - RNA, 18 nt, Mycobacterium bovis subsp bovis AF2122/97
gccaaacgccaucauggc

SEQ ID NO: 3205493 - RNA, 16 nt, Mycobacterium bovis subsp bovis AF2122/97
gccaaacgccgcccgc

SEQ ID NO: 3205494 - RNA, 17 nt, Mycobacterium bovis subsp bovis AF2122/97
gccaaacgccgcccgcc

SEQ ID NO: 3205495 - RNA, 14 nt, Mycobacterium bovis subsp bovis AF2122/97
gccaaacuaacggc

SEQ ID NO: 3205496 - RNA, 21 nt, Mycobacterium bovis subsp bovis AF2122/97
gccaaacuacccgcccacggc

SEQ ID NO: 3205497 - RNA, 18 nt, Mycobacterium bovis subsp bovis AF2122/97
gccaaagacccggcaccc

SEQ ID NO: 3205498 - RNA, 12 nt, Mycobacterium bovis subsp bovis AF2122/97
gccaaagcccac

SEQ ID NO: 3205499 - RNA, 21 nt, Mycobacterium bovis subsp bovis AF2122/97
gccaaagccgggauugccgcc

SEQ ID NO: 3205500 - RNA, 12 nt, Mycobacterium bovis subsp bovis AF2122/97
gccaaagcgcgg

SEQ ID NO: 3205501 - RNA, 15 nt, Mycobacterium bovis subsp bovis AF2122/97
gccaaaggacgacac

SEQ ID NO: 3205502 - RNA, 14 nt, Mycobacterium bovis subsp bovis AF2122/97
gccaaauaccguga

SEQ ID NO: 3205503 - RNA, 16 nt, Mycobacterium bovis subsp bovis AF2122/97
gccaaauccggcuugu

SEQ ID NO: 3205504 - RNA, 19 nt, Mycobacterium bovis subsp bovis AF2122/97
gccaaaucggccaaaugcc

SEQ ID NO: 3205505 - RNA, 19 nt, Mycobacterium bovis subsp bovis AF2122/97
gccaaaugaugacgaucag

SEQ ID NO: 3205506 - RNA, 19 nt, Mycobacterium bovis subsp bovis AF2122/97
gccaaaugcgcugucgccc

SEQ ID NO: 3205507 - RNA, 23 nt, Mycobacterium bovis subsp bovis AF2122/97
gccaacaacaucagcgacagcgg

SEQ ID NO: 3205508 - RNA, 21 nt, Mycobacterium bovis subsp bovis AF2122/97
gccaacaacccaacaaaaggc

SEQ ID NO: 3205509 - RNA, 22 nt, Mycobacterium bovis subsp bovis AF2122/97
gccaacaacccaacaaaaggcc

SEQ ID NO: 3205510 - RNA, 19 nt, Mycobacterium bovis subsp bovis AF2122/97
gccaacaacuucucgucga

SEQ ID NO: 3205511 - RNA, 21 nt, Mycobacterium bovis subsp bovis AF2122/97
gccaacaacuucucgucgaac

SEQ ID NO: 3205512 - RNA, 16 nt, Mycobacterium bovis subsp bovis AF2122/97
gccaacaccaaccagu

SEQ ID NO: 3205513 - RNA, 17 nt, Mycobacterium bovis subsp bovis AF2122/97
gccaacaccgccagcau

SEQ ID NO: 3205514 - RNA, 19 nt, Mycobacterium bovis subsp bovis AF2122/97
gccaacaccgccagcauga

SEQ ID NO: 3205515 - RNA, 15 nt, Mycobacterium bovis subsp bovis AF2122/97
gccaacaccggcauc

SEQ ID NO: 3205516 - RNA, 16 nt, Mycobacterium bovis subsp bovis AF2122/97
gccaacaccggcgauc

SEQ ID NO: 3205517 - RNA, 21 nt, Mycobacterium bovis subsp bovis AF2122/97
gccaacaccuguuugagcgca

SEQ ID NO: 3205518 - RNA, 18 nt, Mycobacterium bovis subsp bovis AF2122/97
gccaacagaugccaccca

SEQ ID NO: 3205519 - RNA, 19 nt, Mycobacterium bovis subsp bovis AF2122/97
gccaacagaugccacccag

SEQ ID NO: 3205520 - RNA, 19 nt, Mycobacterium bovis subsp bovis AF2122/97
gccaacagguccaccggcc

SEQ ID NO: 3205521 - RNA, 21 nt, Mycobacterium bovis subsp bovis AF2122/97
gccaagugagcgaucgggugc

SEQ ID NO: 3205522 - RNA, 18 nt, Mycobacterium bovis subsp bovis AF2122/97
gccaaguugcagcgggcc

SEQ ID NO: 3205523 - RNA, 14 nt, Mycobacterium bovis subsp bovis AF2122/97
gccaauagaagcac

SEQ ID NO: 3205524 - RNA, 13 nt, Mycobacterium bovis subsp bovis AF2122/97
gccaaucaccgua

SEQ ID NO: 3205525 - RNA, 18 nt, Mycobacterium bovis subsp bovis AF2122/97
gccaaucagcccgccgga

SEQ ID NO: 3205526 - RNA, 12 nt, Mycobacterium bovis subsp bovis AF2122/97
gccaaucauggu

SEQ ID NO: 3205527 - RNA, 16 nt, Mycobacterium bovis subsp bovis AF2122/97
gccaauccaccggugc

SEQ ID NO: 3205528 - RNA, 14 nt, Mycobacterium bovis subsp bovis AF2122/97
gccaauccggcggc

SEQ ID NO: 3205529 - RNA, 17 nt, Mycobacterium bovis subsp bovis AF2122/97
gccaauccggcggcgac

SEQ ID NO: 3205530 - RNA, 16 nt, Mycobacterium bovis subsp bovis AF2122/97
gccaaucgcccagugu

SEQ ID NO: 3205531 - RNA, 18 nt, Mycobacterium bovis subsp bovis AF2122/97
gccaaucgccgucagcac

SEQ ID NO: 3205532 - RNA, 16 nt, Mycobacterium bovis subsp bovis AF2122/97
gccaaugacgucgcgg

SEQ ID NO: 3205533 - RNA, 23 nt, Mycobacterium bovis subsp bovis AF2122/97
gccaaugacgucggaccagcugc

SEQ ID NO: 3205534 - RNA, 19 nt, Mycobacterium bovis subsp bovis AF2122/97
gccaaugacuuggccagca

SEQ ID NO: 3205535 - RNA, 20 nt, Mycobacterium bovis subsp bovis AF2122/97
gccaaugacuuggccagcag

SEQ ID NO: 3205536 - RNA, 16 nt, Mycobacterium bovis subsp bovis AF2122/97
gccaaugauucggcac

SEQ ID NO: 3205537 - RNA, 16 nt, Mycobacterium bovis subsp bovis AF2122/97
gccaaugcccaggugu

SEQ ID NO: 3205538 - RNA, 19 nt, Mycobacterium bovis subsp bovis AF2122/97
gccaaugcccuuggccagc

SEQ ID NO: 3205539 - RNA, 20 nt, Mycobacterium bovis subsp bovis AF2122/97
gccaaugcccuuggccagca

SEQ ID NO: 3205540 - RNA, 22 nt, Mycobacterium bovis subsp bovis AF2122/97
gccaaugcccuuggccagcagg

SEQ ID NO: 3205541 - RNA, 13 nt, Mycobacterium bovis subsp bovis AF2122/97
gccaaugccgcgg

SEQ ID NO: 3205542 - RNA, 15 nt, Mycobacterium bovis subsp bovis AF2122/97
gccaaugccgcggag

SEQ ID NO: 3205543 - RNA, 14 nt, Mycobacterium bovis subsp bovis AF2122/97
gccaauggccgcgg

SEQ ID NO: 3205544 - RNA, 15 nt, Mycobacterium bovis subsp bovis AF2122/97
gccaauggccgcggc

SEQ ID NO: 3205545 - RNA, 16 nt, Mycobacterium bovis subsp bovis AF2122/97
gccaauggccgcggca

SEQ ID NO: 3205546 - RNA, 12 nt, Mycobacterium bovis subsp bovis AF2122/97
gccaauggccug

SEQ ID NO: 3205547 - RNA, 15 nt, Mycobacterium bovis subsp bovis AF2122/97
gccaauggccugcag

SEQ ID NO: 3205548 - RNA, 21 nt, Mycobacterium bovis subsp bovis AF2122/97
gccaauggccugcagcgcgac

SEQ ID NO: 3205549 - RNA, 20 nt, Mycobacterium bovis subsp bovis AF2122/97
gccaauggcgcgaauggcgg

SEQ ID NO: 3205550 - RNA, 15 nt, Mycobacterium bovis subsp bovis AF2122/97
gccaauggugggcga

SEQ ID NO: 3205551 - RNA, 18 nt, Mycobacterium bovis subsp bovis AF2122/97
gccaauggugggcgagcu

SEQ ID NO: 3205552 - RNA, 23 nt, Mycobacterium bovis subsp bovis AF2122/97
gccaauggugucgcgcucagccg

SEQ ID NO: 3205553 - RNA, 20 nt, Mycobacterium bovis subsp bovis AF2122/97
gccaaugucuacgcaucccg

SEQ ID NO: 3205554 - RNA, 21 nt, Mycobacterium bovis subsp bovis AF2122/97
gccaaugucuacgcaucccga

SEQ ID NO: 3205555 - RNA, 14 nt, Mycobacterium bovis subsp bovis AF2122/97
gccaauuacagcuu

SEQ ID NO: 3205556 - RNA, 14 nt, Mycobacterium bovis subsp bovis AF2122/97
gccaauugcgccgc

SEQ ID NO: 3205557 - RNA, 17 nt, Mycobacterium bovis subsp bovis AF2122/97
gccaauugugcugaccg

SEQ ID NO: 3205558 - RNA, 12 nt, Mycobacterium bovis subsp bovis AF2122/97
gccacaaagaag

SEQ ID NO: 3205559 - RNA, 14 nt, Mycobacterium bovis subsp bovis AF2122/97
gccacaaccucguc

SEQ ID NO: 3205560 - RNA, 23 nt, Mycobacterium bovis subsp bovis AF2122/97
gccacaaccucgucgucaucgag

SEQ ID NO: 3205561 - RNA, 20 nt, Mycobacterium bovis subsp bovis AF2122/97
gccacaacgccucgauggcg

SEQ ID NO: 3205562 - RNA, 16 nt, Mycobacterium bovis subsp bovis AF2122/97
gccacaacggcggcgc

SEQ ID NO: 3205563 - RNA, 18 nt, Mycobacterium bovis subsp bovis AF2122/97
gccacaacggcggcgcag

SEQ ID NO: 3205564 - RNA, 16 nt, Mycobacterium bovis subsp bovis AF2122/97
gccacaaugcggccgu

SEQ ID NO: 3205565 - RNA, 15 nt, Mycobacterium bovis subsp bovis AF2122/97
gccacacacugccgg

SEQ ID NO: 3205566 - RNA, 12 nt, Mycobacterium bovis subsp bovis AF2122/97
gccacacaggcg

SEQ ID NO: 3205567 - RNA, 13 nt, Mycobacterium bovis subsp bovis AF2122/97
gccacacaggcgu

SEQ ID NO: 3205568 - RNA, 21 nt, Mycobacterium bovis subsp bovis AF2122/97
gccacacaggcguccaucgcc

SEQ ID NO: 3205569 - RNA, 22 nt, Mycobacterium bovis subsp bovis AF2122/97
gccacacaggcguccaucgcca

SEQ ID NO: 3205570 - RNA, 21 nt, Mycobacterium bovis subsp bovis AF2122/97
gccacaccaacgucgaugucc

SEQ ID NO: 3205571 - RNA, 12 nt, Mycobacterium bovis subsp bovis AF2122/97
gccacaccauga

SEQ ID NO: 3205572 - RNA, 22 nt, Mycobacterium bovis subsp bovis AF2122/97
gccacaccaugauugccaggac

SEQ ID NO: 3205573 - RNA, 12 nt, Mycobacterium bovis subsp bovis AF2122/97
gccacacccggc

SEQ ID NO: 3205574 - RNA, 15 nt, Mycobacterium bovis subsp bovis AF2122/97
gccacacccggcaca

SEQ ID NO: 3205575 - RNA, 13 nt, Mycobacterium bovis subsp bovis AF2122/97
gccacacccgugu

SEQ ID NO: 3205576 - RNA, 13 nt, Mycobacterium bovis subsp bovis AF2122/97
gccacaccgccgc

SEQ ID NO: 3205577 - RNA, 15 nt, Mycobacterium bovis subsp bovis AF2122/97
gccacaccgccgcca

SEQ ID NO: 3205578 - RNA, 23 nt, Mycobacterium bovis subsp bovis AF2122/97
gccacaccgccgccaagcucggc

SEQ ID NO: 3205579 - RNA, 18 nt, Mycobacterium bovis subsp bovis AF2122/97
gccacaccgucacgccac

SEQ ID NO: 3205580 - RNA, 21 nt, Mycobacterium bovis subsp bovis AF2122/97
gccacaccgucacgccaccgc

SEQ ID NO: 3205581 - RNA, 22 nt, Mycobacterium bovis subsp bovis AF2122/97
gccacaccgucacgccaccgca

SEQ ID NO: 3205582 - RNA, 16 nt, Mycobacterium bovis subsp bovis AF2122/97
gccacaccuuggccgc

SEQ ID NO: 3205583 - RNA, 17 nt, Mycobacterium bovis subsp bovis AF2122/97
gccacaccuuggccgcc

SEQ ID NO: 3205584 - RNA, 18 nt, Mycobacterium bovis subsp bovis AF2122/97
gccacaccuuggccgccg

SEQ ID NO: 3205585 - RNA, 19 nt, Mycobacterium bovis subsp bovis AF2122/97
gccacaccuuggccgccgg

SEQ ID NO: 3205586 - RNA, 14 nt, Mycobacterium bovis subsp bovis AF2122/97
gccacacggggccg

SEQ ID NO: 3205587 - RNA, 20 nt, Mycobacterium bovis subsp bovis AF2122/97
gccacacggggccgccagcu

SEQ ID NO: 3205588 - RNA, 21 nt, Mycobacterium bovis subsp bovis AF2122/97
gccacacucgccagggccauc

SEQ ID NO: 3205589 - RNA, 22 nt, Mycobacterium bovis subsp bovis AF2122/97
gccacagaccgaacagcaccga

SEQ ID NO: 3205590 - RNA, 16 nt, Mycobacterium bovis subsp bovis AF2122/97
gccacagcacccacgc

SEQ ID NO: 3205591 - RNA, 16 nt, Mycobacterium bovis subsp bovis AF2122/97
gccacagcccggcggc

SEQ ID NO: 3205592 - RNA, 17 nt, Mycobacterium bovis subsp bovis AF2122/97
gccacagcccggcggcg

SEQ ID NO: 3205593 - RNA, 18 nt, Mycobacterium bovis subsp bovis AF2122/97
gccacagcccggcggcgg

SEQ ID NO: 3205594 - RNA, 22 nt, Mycobacterium bovis subsp bovis AF2122/97
gccacagcccggcggcggucug

SEQ ID NO: 3205595 - RNA, 13 nt, Mycobacterium bovis subsp bovis AF2122/97
gccacagccguau

SEQ ID NO: 3205596 - RNA, 15 nt, Mycobacterium bovis subsp bovis AF2122/97
gccacagcgacagcg

SEQ ID NO: 3205597 - RNA, 17 nt, Mycobacterium bovis subsp bovis AF2122/97
gccacagcgacagcgug

SEQ ID NO: 3205598 - RNA, 17 nt, Mycobacterium bovis subsp bovis AF2122/97
gccacaggcguuuccgc

SEQ ID NO: 3205599 - RNA, 13 nt, Mycobacterium bovis subsp bovis AF2122/97
gccacaggugacc

SEQ ID NO: 3205600 - RNA, 18 nt, Mycobacterium bovis subsp bovis AF2122/97
gccacagucgucgagcgc

SEQ ID NO: 3205601 - RNA, 20 nt, Mycobacterium bovis subsp bovis AF2122/97
gccacagugcauacgguuga

SEQ ID NO: 3205602 - RNA, 16 nt, Mycobacterium bovis subsp bovis AF2122/97
gccacauacaccggcc

SEQ ID NO: 3205603 - RNA, 16 nt, Mycobacterium bovis subsp bovis AF2122/97
gccacauaccaccacg

SEQ ID NO: 3205604 - RNA, 15 nt, Mycobacterium bovis subsp bovis AF2122/97
gccacaucgccagca

SEQ ID NO: 3205605 - RNA, 17 nt, Mycobacterium bovis subsp bovis AF2122/97
gccacaucgccagcagc

SEQ ID NO: 3205606 - RNA, 17 nt, Mycobacterium bovis subsp bovis AF2122/97
gccacaucguggcgucg

SEQ ID NO: 3205607 - RNA, 20 nt, Mycobacterium bovis subsp bovis AF2122/97
gccacaucguucaugaucgg

SEQ ID NO: 3205608 - RNA, 15 nt, Mycobacterium bovis subsp bovis AF2122/97
gccaccccgagcuca

SEQ ID NO: 3205609 - RNA, 16 nt, Mycobacterium bovis subsp bovis AF2122/97
gccaccccgagcucac

SEQ ID NO: 3205610 - RNA, 22 nt, Mycobacterium bovis subsp bovis AF2122/97
gccaccccgagcucaccaaggu

SEQ ID NO: 3205611 - RNA, 19 nt, Mycobacterium bovis subsp bovis AF2122/97
gccaccccgcgcgccagcu

SEQ ID NO: 3205612 - RNA, 21 nt, Mycobacterium bovis subsp bovis AF2122/97
gccaccccgcgcgccagcucg

SEQ ID NO: 3205613 - RNA, 19 nt, Mycobacterium bovis subsp bovis AF2122/97
gccaccccgcguaugccag

SEQ ID NO: 3205614 - RNA, 22 nt, Mycobacterium bovis subsp bovis AF2122/97
gccaccccgcguaugccaggac

SEQ ID NO: 3205615 - RNA, 18 nt, Mycobacterium bovis subsp bovis AF2122/97
gccaccccugcgguccgc

SEQ ID NO: 3205616 - RNA, 22 nt, Mycobacterium bovis subsp bovis AF2122/97
gccaccccugcgguccgcugcc

SEQ ID NO: 3205617 - RNA, 22 nt, Mycobacterium bovis subsp bovis AF2122/97
gccacccgaaugccuucgauga

SEQ ID NO: 3205618 - RNA, 13 nt, Mycobacterium bovis subsp bovis AF2122/97
gccacccgcaacu

SEQ ID NO: 3205619 - RNA, 13 nt, Mycobacterium bovis subsp bovis AF2122/97
gccacccgcgccg

SEQ ID NO: 3205620 - RNA, 13 nt, Mycobacterium bovis subsp bovis AF2122/97
gccacccgcgcga

SEQ ID NO: 3205621 - RNA, 22 nt, Mycobacterium bovis subsp bovis AF2122/97
gccacccgcgcgaugcuggcga

SEQ ID NO: 3205622 - RNA, 18 nt, Mycobacterium bovis subsp bovis AF2122/97
gccacccgcgcuccaaca

SEQ ID NO: 3205623 - RNA, 18 nt, Mycobacterium bovis subsp bovis AF2122/97
gccacccgcggugccugc

SEQ ID NO: 3205624 - RNA, 21 nt, Mycobacterium bovis subsp bovis AF2122/97
gccacccgcggugccugcagc

SEQ ID NO: 3205625 - RNA, 22 nt, Mycobacterium bovis subsp bovis AF2122/97
gccacccgcggugccugcagcu

SEQ ID NO: 3205626 - RNA, 16 nt, Mycobacterium bovis subsp bovis AF2122/97
gccacccggacauagc

SEQ ID NO: 3205627 - RNA, 21 nt, Mycobacterium bovis subsp bovis AF2122/97
gccacccggacauagccgcgc

SEQ ID NO: 3205628 - RNA, 13 nt, Mycobacterium bovis subsp bovis AF2122/97
gccacccggccag

SEQ ID NO: 3205629 - RNA, 14 nt, Mycobacterium bovis subsp bovis AF2122/97
gccacccggccgcg

SEQ ID NO: 3205630 - RNA, 15 nt, Mycobacterium bovis subsp bovis AF2122/97
gccacccggccgcgc

SEQ ID NO: 3205631 - RNA, 16 nt, Mycobacterium bovis subsp bovis AF2122/97
gccacccggccgcgcg

SEQ ID NO: 3205632 - RNA, 23 nt, Mycobacterium bovis subsp bovis AF2122/97
gccacccucgguguccucgaccg

SEQ ID NO: 3205633 - RNA, 12 nt, Mycobacterium bovis subsp bovis AF2122/97
gccacccuugcc

SEQ ID NO: 3205634 - RNA, 15 nt, Mycobacterium bovis subsp bovis AF2122/97
gccacccuugccgcc

SEQ ID NO: 3205635 - RNA, 17 nt, Mycobacterium bovis subsp bovis AF2122/97
gccacccuugccgccgg

SEQ ID NO: 3205636 - RNA, 14 nt, Mycobacterium bovis subsp bovis AF2122/97
gccacccuuggccc

SEQ ID NO: 3205637 - RNA, 16 nt, Mycobacterium bovis subsp bovis AF2122/97
gccaccgaacagucga

SEQ ID NO: 3205638 - RNA, 16 nt, Mycobacterium bovis subsp bovis AF2122/97
gccaccgaacgcaccg

SEQ ID NO: 3205639 - RNA, 18 nt, Mycobacterium bovis subsp bovis AF2122/97
gccaccgaacgcaccgaa

SEQ ID NO: 3205640 - RNA, 19 nt, Mycobacterium bovis subsp bovis AF2122/97
gccaccgaacgcggccacc

SEQ ID NO: 3205641 - RNA, 23 nt, Mycobacterium bovis subsp bovis AF2122/97
gccaccgaacuugcggaccuggc

SEQ ID NO: 3205642 - RNA, 17 nt, Mycobacterium bovis subsp bovis AF2122/97
gccaccgaagccgccgg

SEQ ID NO: 3205643 - RNA, 14 nt, Mycobacterium bovis subsp bovis AF2122/97
gccaccgaccccgg

SEQ ID NO: 3205644 - RNA, 17 nt, Mycobacterium bovis subsp bovis AF2122/97
gccaccgaccgcaugau

SEQ ID NO: 3205645 - RNA, 14 nt, Mycobacterium bovis subsp bovis AF2122/97
gccaccgacgacau

SEQ ID NO: 3205646 - RNA, 22 nt, Mycobacterium bovis subsp bovis AF2122/97
gccaccgacgacaucgguggcc

SEQ ID NO: 3205647 - RNA, 20 nt, Mycobacterium bovis subsp bovis AF2122/97
gccaccgagaucaugccggc

SEQ ID NO: 3205648 - RNA, 21 nt, Mycobacterium bovis subsp bovis AF2122/97
gccaccgagaucaugccggcg

SEQ ID NO: 3205649 - RNA, 14 nt, Mycobacterium bovis subsp bovis AF2122/97
gccaccgauaccgu

SEQ ID NO: 3205650 - RNA, 13 nt, Mycobacterium bovis subsp bovis AF2122/97
gccaccgauggcg

SEQ ID NO: 3205651 - RNA, 17 nt, Mycobacterium bovis subsp bovis AF2122/97
gccaccgcaacucgccg

SEQ ID NO: 3205652 - RNA, 19 nt, Mycobacterium bovis subsp bovis AF2122/97
gccaccgcaagaaucagca

SEQ ID NO: 3205653 - RNA, 18 nt, Mycobacterium bovis subsp bovis AF2122/97
gccaccgcacgcacgcca

SEQ ID NO: 3205654 - RNA, 20 nt, Mycobacterium bovis subsp bovis AF2122/97
gccaccgcacgcuggcgggc

SEQ ID NO: 3205655 - RNA, 15 nt, Mycobacterium bovis subsp bovis AF2122/97
gccaccgcaucgccg

SEQ ID NO: 3205656 - RNA, 13 nt, Mycobacterium bovis subsp bovis AF2122/97
gccaccgccacca

SEQ ID NO: 3205657 - RNA, 18 nt, Mycobacterium bovis subsp bovis AF2122/97
gccaccgccaccacccag

SEQ ID NO: 3205658 - RNA, 17 nt, Mycobacterium bovis subsp bovis AF2122/97
gccaccgccaccgcggc

SEQ ID NO: 3205659 - RNA, 20 nt, Mycobacterium bovis subsp bovis AF2122/97
gccaccgccaccgcggccug

SEQ ID NO: 3205660 - RNA, 14 nt, Mycobacterium bovis subsp bovis AF2122/97
gccaccgccagcgu

SEQ ID NO: 3205661 - RNA, 18 nt, Mycobacterium bovis subsp bovis AF2122/97
gccaccgccagcgucgac

SEQ ID NO: 3205662 - RNA, 17 nt, Mycobacterium bovis subsp bovis AF2122/97
gccaccgcccagugcca

SEQ ID NO: 3205663 - RNA, 16 nt, Mycobacterium bovis subsp bovis AF2122/97
gccaccgccgccgcca

SEQ ID NO: 3205664 - RNA, 17 nt, Mycobacterium bovis subsp bovis AF2122/97
gccaccgccgccgccac

SEQ ID NO: 3205665 - RNA, 16 nt, Mycobacterium bovis subsp bovis AF2122/97
gccaccgccgccgccg

SEQ ID NO: 3205666 - RNA, 18 nt, Mycobacterium bovis subsp bovis AF2122/97
gccaccgccgccgccgac

SEQ ID NO: 3205667 - RNA, 23 nt, Mycobacterium bovis subsp bovis AF2122/97
gccaccgccgccgccgacgccgc

SEQ ID NO: 3205668 - RNA, 14 nt, Mycobacterium bovis subsp bovis AF2122/97
gccaccgccgccgg

SEQ ID NO: 3205669 - RNA, 15 nt, Mycobacterium bovis subsp bovis AF2122/97
gccaccgccgccggu

SEQ ID NO: 3205670 - RNA, 17 nt, Mycobacterium bovis subsp bovis AF2122/97
gccaccgccgccggugu

SEQ ID NO: 3205671 - RNA, 13 nt, Mycobacterium bovis subsp bovis AF2122/97
gccaccgccgccu

SEQ ID NO: 3205672 - RNA, 17 nt, Mycobacterium bovis subsp bovis AF2122/97
gccaccgccgccugccc

SEQ ID NO: 3205673 - RNA, 20 nt, Mycobacterium bovis subsp bovis AF2122/97
gccaccgccgcugccggugu

SEQ ID NO: 3205674 - RNA, 15 nt, Mycobacterium bovis subsp bovis AF2122/97
gccaccgccggcagc

SEQ ID NO: 3205675 - RNA, 19 nt, Mycobacterium bovis subsp bovis AF2122/97
gccaccgccggcagcaucg

SEQ ID NO: 3205676 - RNA, 21 nt, Mycobacterium bovis subsp bovis AF2122/97
gccaccgccggcagcaucggc

SEQ ID NO: 3205677 - RNA, 23 nt, Mycobacterium bovis subsp bovis AF2122/97
gccaccgccggcagcaucggcac

SEQ ID NO: 3205678 - RNA, 12 nt, Mycobacterium bovis subsp bovis AF2122/97
gccaccgcggcc

SEQ ID NO: 3205679 - RNA, 16 nt, Mycobacterium bovis subsp bovis AF2122/97
gccaccgcggccgcgg

SEQ ID NO: 3205680 - RNA, 19 nt, Mycobacterium bovis subsp bovis AF2122/97
gccaccgcggccgcggucg

SEQ ID NO: 3205681 - RNA, 13 nt, Mycobacterium bovis subsp bovis AF2122/97
gccaccgcggccu

SEQ ID NO: 3205682 - RNA, 14 nt, Mycobacterium bovis subsp bovis AF2122/97
gccaccgcggccug

SEQ ID NO: 3205683 - RNA, 21 nt, Mycobacterium bovis subsp bovis AF2122/97
gccaccgcggccugacgcugc

SEQ ID NO: 3205684 - RNA, 13 nt, Mycobacterium bovis subsp bovis AF2122/97
gccaccgcggcga

SEQ ID NO: 3205685 - RNA, 15 nt, Mycobacterium bovis subsp bovis AF2122/97
gccaccgcggcgauu

SEQ ID NO: 3205686 - RNA, 19 nt, Mycobacterium bovis subsp bovis AF2122/97
gccaccgcgggcggcaucg

SEQ ID NO: 3205687 - RNA, 20 nt, Mycobacterium bovis subsp bovis AF2122/97
gccaccgcgggcggcaucgc

SEQ ID NO: 3205688 - RNA, 23 nt, Mycobacterium bovis subsp bovis AF2122/97
gccaccgcgggcggcaucgccga

SEQ ID NO: 3205689 - RNA, 13 nt, Mycobacterium bovis subsp bovis AF2122/97
gccaccgcgguca

SEQ ID NO: 3205690 - RNA, 19 nt, Mycobacterium bovis subsp bovis AF2122/97
gccaccgcggucaccgacg

SEQ ID NO: 3205691 - RNA, 16 nt, Mycobacterium bovis subsp bovis AF2122/97
gccaccgcggucagcu

SEQ ID NO: 3205692 - RNA, 20 nt, Mycobacterium bovis subsp bovis AF2122/97
gccaccgcggucagcucggc

SEQ ID NO: 3205693 - RNA, 20 nt, Mycobacterium bovis subsp bovis AF2122/97
gccaccgcgguggcggcgag

SEQ ID NO: 3205694 - RNA, 17 nt, Mycobacterium bovis subsp bovis AF2122/97
gccaccgcugccggcac

SEQ ID NO: 3205695 - RNA, 14 nt, Mycobacterium bovis subsp bovis AF2122/97
gccaccugaaagcu

SEQ ID NO: 3205696 - RNA, 20 nt, Mycobacterium bovis subsp bovis AF2122/97
gccaccugacgugcggcgcg

SEQ ID NO: 3205697 - RNA, 15 nt, Mycobacterium bovis subsp bovis AF2122/97
gccaccugcuggccg

SEQ ID NO: 3205698 - RNA, 20 nt, Mycobacterium bovis subsp bovis AF2122/97
gccaccuggucggcaugauc

SEQ ID NO: 3205699 - RNA, 19 nt, Mycobacterium bovis subsp bovis AF2122/97
gccaccugugcgaacagcg

SEQ ID NO: 3205700 - RNA, 15 nt, Mycobacterium bovis subsp bovis AF2122/97
gccaccuguugcccu

SEQ ID NO: 3205701 - RNA, 22 nt, Mycobacterium bovis subsp bovis AF2122/97
gccaccuguugcccuugcgcaa

SEQ ID NO: 3205702 - RNA, 22 nt, Mycobacterium bovis subsp bovis AF2122/97
gccaccuguuggcaugccgccc

SEQ ID NO: 3205703 - RNA, 18 nt, Mycobacterium bovis subsp bovis AF2122/97
gccaccuuagcgcuugcc

SEQ ID NO: 3205704 - RNA, 19 nt, Mycobacterium bovis subsp bovis AF2122/97
gccaccuuggacaccacga

SEQ ID NO: 3205705 - RNA, 22 nt, Mycobacterium bovis subsp bovis AF2122/97
gccaccuuggacaccacgagcg

SEQ ID NO: 3205706 - RNA, 21 nt, Mycobacterium bovis subsp bovis AF2122/97
gccaccuuggcguugaccagc

SEQ ID NO: 3205707 - RNA, 22 nt, Mycobacterium bovis subsp bovis AF2122/97
gccaccuuggcguugaccagca

SEQ ID NO: 3205708 - RNA, 21 nt, Mycobacterium bovis subsp bovis AF2122/97
gccacgaacccucagccgcgc

SEQ ID NO: 3205709 - RNA, 22 nt, Mycobacterium bovis subsp bovis AF2122/97
gccacgaacccucagccgcgcc

SEQ ID NO: 3205710 - RNA, 21 nt, Mycobacterium bovis subsp bovis AF2122/97
gccacgaacgcuuccagcgug

SEQ ID NO: 3205711 - RNA, 21 nt, Mycobacterium bovis subsp bovis AF2122/97
gccacgaacugaucgaccgcc

SEQ ID NO: 3205712 - RNA, 16 nt, Mycobacterium bovis subsp bovis AF2122/97
gccacgaauccgauca

SEQ ID NO: 3205713 - RNA, 20 nt, Mycobacterium bovis subsp bovis AF2122/97
gccacgaaucgcccaucgca

SEQ ID NO: 3205714 - RNA, 14 nt, Mycobacterium bovis subsp bovis AF2122/97
gccacgacaggucg

SEQ ID NO: 3205715 - RNA, 16 nt, Mycobacterium bovis subsp bovis AF2122/97
gccacgacccagcaug

SEQ ID NO: 3205716 - RNA, 15 nt, Mycobacterium bovis subsp bovis AF2122/97
gccacgaccgccgau

SEQ ID NO: 3205717 - RNA, 22 nt, Mycobacterium bovis subsp bovis AF2122/97
gccacgaccucgggaucggcgg

SEQ ID NO: 3205718 - RNA, 16 nt, Mycobacterium bovis subsp bovis AF2122/97
gccacgacgaacacca

SEQ ID NO: 3205719 - RNA, 17 nt, Mycobacterium bovis subsp bovis AF2122/97
gccacgacgaacaccag

SEQ ID NO: 3205720 - RNA, 20 nt, Mycobacterium bovis subsp bovis AF2122/97
gccacgacgaacaccagcgc

SEQ ID NO: 3205721 - RNA, 14 nt, Mycobacterium bovis subsp bovis AF2122/97
gccacgacgcccac

SEQ ID NO: 3205722 - RNA, 22 nt, Mycobacterium bovis subsp bovis AF2122/97
gccacgaggacccgucgagcgu

SEQ ID NO: 3205723 - RNA, 16 nt, Mycobacterium bovis subsp bovis AF2122/97
gccacgagucgcacgu

SEQ ID NO: 3205724 - RNA, 12 nt, Mycobacterium bovis subsp bovis AF2122/97
gccacgauccgc

SEQ ID NO: 3205725 - RNA, 14 nt, Mycobacterium bovis subsp bovis AF2122/97
gccacgauccuugg

SEQ ID NO: 3205726 - RNA, 14 nt, Mycobacterium bovis subsp bovis AF2122/97
gccacgaucggcgg

SEQ ID NO: 3205727 - RNA, 15 nt, Mycobacterium bovis subsp bovis AF2122/97
gccacgaugauccca

SEQ ID NO: 3205728 - RNA, 16 nt, Mycobacterium bovis subsp bovis AF2122/97
gccacgaugaucccaa

SEQ ID NO: 3205729 - RNA, 17 nt, Mycobacterium bovis subsp bovis AF2122/97
gccacgaugcgcacacc

SEQ ID NO: 3205730 - RNA, 17 nt, Mycobacterium bovis subsp bovis AF2122/97
gccacgaugucgucgau

SEQ ID NO: 3205731 - RNA, 20 nt, Mycobacterium bovis subsp bovis AF2122/97
gccacgaugucgucgaugaa

SEQ ID NO: 3205732 - RNA, 16 nt, Mycobacterium bovis subsp bovis AF2122/97
gccacgcacaauacgg

SEQ ID NO: 3205733 - RNA, 17 nt, Mycobacterium bovis subsp bovis AF2122/97
gccacgcacccggcaau

SEQ ID NO: 3205734 - RNA, 15 nt, Mycobacterium bovis subsp bovis AF2122/97
gccacgcaccgggug

SEQ ID NO: 3205735 - RNA, 19 nt, Mycobacterium bovis subsp bovis AF2122/97
gccacgcagcacggcaccc

SEQ ID NO: 3205736 - RNA, 13 nt, Mycobacterium bovis subsp bovis AF2122/97
gccacgccaccgc

SEQ ID NO: 3205737 - RNA, 16 nt, Mycobacterium bovis subsp bovis AF2122/97
gccacgccaccgcggu

SEQ ID NO: 3205738 - RNA, 21 nt, Mycobacterium bovis subsp bovis AF2122/97
gccacgccaccgcggucaccg

SEQ ID NO: 3205739 - RNA, 14 nt, Mycobacterium bovis subsp bovis AF2122/97
gccacgccacgucc

SEQ ID NO: 3205740 - RNA, 17 nt, Mycobacterium bovis subsp bovis AF2122/97
gccacgccacguccaac

SEQ ID NO: 3205741 - RNA, 18 nt, Mycobacterium bovis subsp bovis AF2122/97
gccacgccagccaggcga

SEQ ID NO: 3205742 - RNA, 18 nt, Mycobacterium bovis subsp bovis AF2122/97
gccacgccagcucgccgg

SEQ ID NO: 3205743 - RNA, 13 nt, Mycobacterium bovis subsp bovis AF2122/97
gccacgcccacag

SEQ ID NO: 3205744 - RNA, 12 nt, Mycobacterium bovis subsp bovis AF2122/97
gccacgcccagc

SEQ ID NO: 3205745 - RNA, 12 nt, Mycobacterium bovis subsp bovis AF2122/97
gccacgcccgac

SEQ ID NO: 3205746 - RNA, 16 nt, Mycobacterium bovis subsp bovis AF2122/97
gccacgcccgacgcca

SEQ ID NO: 3205747 - RNA, 14 nt, Mycobacterium bovis subsp bovis AF2122/97
gccacgccgaggcg

SEQ ID NO: 3205748 - RNA, 17 nt, Mycobacterium bovis subsp bovis AF2122/97
gccacgccgaucaacau

SEQ ID NO: 3205749 - RNA, 22 nt, Mycobacterium bovis subsp bovis AF2122/97
gccacgccgaugauggacacca

SEQ ID NO: 3205750 - RNA, 14 nt, Mycobacterium bovis subsp bovis AF2122/97
gccacgccgaugcg

SEQ ID NO: 3205751 - RNA, 12 nt, Mycobacterium bovis subsp bovis AF2122/97
gccacgccgccg

SEQ ID NO: 3205752 - RNA, 16 nt, Mycobacterium bovis subsp bovis AF2122/97
gccacgccgccgguga

SEQ ID NO: 3205753 - RNA, 23 nt, Mycobacterium bovis subsp bovis AF2122/97
gccacgccgccggugaacgucac

SEQ ID NO: 3205754 - RNA, 19 nt, Mycobacterium bovis subsp bovis AF2122/97
gccacgccggucgcgguca

SEQ ID NO: 3205755 - RNA, 15 nt, Mycobacterium bovis subsp bovis AF2122/97
gccacgccugagcca

SEQ ID NO: 3205756 - RNA, 18 nt, Mycobacterium bovis subsp bovis AF2122/97
gccacgccugagccacca

SEQ ID NO: 3205757 - RNA, 21 nt, Mycobacterium bovis subsp bovis AF2122/97
gccacgcgucuucggucgcgg

SEQ ID NO: 3205758 - RNA, 17 nt, Mycobacterium bovis subsp bovis AF2122/97
gccacgcucggugcugc

SEQ ID NO: 3205759 - RNA, 18 nt, Mycobacterium bovis subsp bovis AF2122/97
gccacgcugucccgcggg

SEQ ID NO: 3205760 - RNA, 21 nt, Mycobacterium bovis subsp bovis AF2122/97
gccacgcuucuuccgcgcgcc

SEQ ID NO: 3205761 - RNA, 23 nt, Mycobacterium bovis subsp bovis AF2122/97
gccacgcuucuuccgcgcgccgg

SEQ ID NO: 3205762 - RNA, 19 nt, Mycobacterium bovis subsp bovis AF2122/97
gccacggaaguaucgccgg

SEQ ID NO: 3205763 - RNA, 20 nt, Mycobacterium bovis subsp bovis AF2122/97
gccacggaaguaucgccggc

SEQ ID NO: 3205764 - RNA, 23 nt, Mycobacterium bovis subsp bovis AF2122/97
gccacggaaguaucgccggccgc

SEQ ID NO: 3205765 - RNA, 12 nt, Mycobacterium bovis subsp bovis AF2122/97
gccacggcaccg

SEQ ID NO: 3205766 - RNA, 16 nt, Mycobacterium bovis subsp bovis AF2122/97
gccacggcagcgccca

SEQ ID NO: 3205767 - RNA, 22 nt, Mycobacterium bovis subsp bovis AF2122/97
gccacggcagcgcccagaucgc

SEQ ID NO: 3205768 - RNA, 15 nt, Mycobacterium bovis subsp bovis AF2122/97
gccacggcaucggcc

SEQ ID NO: 3205769 - RNA, 16 nt, Mycobacterium bovis subsp bovis AF2122/97
gccacggcaucggcca

SEQ ID NO: 3205770 - RNA, 17 nt, Mycobacterium bovis subsp bovis AF2122/97
gccacggcaucggccac

SEQ ID NO: 3205771 - RNA, 18 nt, Mycobacterium bovis subsp bovis AF2122/97
gccacggcaucggccacc

SEQ ID NO: 3205772 - RNA, 14 nt, Mycobacterium bovis subsp bovis AF2122/97
gccacggcgccuac

SEQ ID NO: 3205773 - RNA, 20 nt, Mycobacterium bovis subsp bovis AF2122/97
gccacggcgccuacaccggc

SEQ ID NO: 3205774 - RNA, 19 nt, Mycobacterium bovis subsp bovis AF2122/97
gccacggcgucggccaccc

SEQ ID NO: 3205775 - RNA, 20 nt, Mycobacterium bovis subsp bovis AF2122/97
gccacggcgucggccacccg

SEQ ID NO: 3205776 - RNA, 16 nt, Mycobacterium bovis subsp bovis AF2122/97
gccacggcugaccggg

SEQ ID NO: 3205777 - RNA, 23 nt, Mycobacterium bovis subsp bovis AF2122/97
gccacggcugaccggggucggcc

SEQ ID NO: 3205778 - RNA, 13 nt, Mycobacterium bovis subsp bovis AF2122/97
gccacggcugccc

SEQ ID NO: 3205779 - RNA, 14 nt, Mycobacterium bovis subsp bovis AF2122/97
gccacggcuguggc

SEQ ID NO: 3205780 - RNA, 17 nt, Mycobacterium bovis subsp bovis AF2122/97
gccacggcuguggccgc

SEQ ID NO: 3205781 - RNA, 21 nt, Mycobacterium bovis subsp bovis AF2122/97
gccacuguugaagaagcccga

SEQ ID NO: 3205782 - RNA, 20 nt, Mycobacterium bovis subsp bovis AF2122/97
gccacuucccccggguccgc

SEQ ID NO: 3205783 - RNA, 18 nt, Mycobacterium bovis subsp bovis AF2122/97
gccacuugaugccgcacc

SEQ ID NO: 3205784 - RNA, 19 nt, Mycobacterium bovis subsp bovis AF2122/97
gccacuugaugcucgaugc

SEQ ID NO: 3205785 - RNA, 22 nt, Mycobacterium bovis subsp bovis AF2122/97
gccacuugaugcucgaugcgac

SEQ ID NO: 3205786 - RNA, 22 nt, Mycobacterium bovis subsp bovis AF2122/97
gccacuuggacgaacacaccgg

SEQ ID NO: 3205787 - RNA, 22 nt, Mycobacterium bovis subsp bovis AF2122/97
gccagaaacccggcgaccacgg

SEQ ID NO: 3205788 - RNA, 22 nt, Mycobacterium bovis subsp bovis AF2122/97
gccagaaacucgaagcgguguu

SEQ ID NO: 3205789 - RNA, 22 nt, Mycobacterium bovis subsp bovis AF2122/97
gccagaaagaucgguugaucug

SEQ ID NO: 3205790 - RNA, 22 nt, Mycobacterium bovis subsp bovis AF2122/97
gccagaacggaauucagcgacg

SEQ ID NO: 3205791 - RNA, 16 nt, Mycobacterium bovis subsp bovis AF2122/97
gccagaacggcgucga

SEQ ID NO: 3205792 - RNA, 21 nt, Mycobacterium bovis subsp bovis AF2122/97
gccagaagaccuggcggugcc

SEQ ID NO: 3205793 - RNA, 16 nt, Mycobacterium bovis subsp bovis AF2122/97
gccagaaugccgaacg

SEQ ID NO: 3205794 - RNA, 15 nt, Mycobacterium bovis subsp bovis AF2122/97
gccagaaugggcggc

SEQ ID NO: 3205795 - RNA, 16 nt, Mycobacterium bovis subsp bovis AF2122/97
gccagaaugggcggca

SEQ ID NO: 3205796 - RNA, 18 nt, Mycobacterium bovis subsp bovis AF2122/97
gccagaauugccggcgau

SEQ ID NO: 3205797 - RNA, 15 nt, Mycobacterium bovis subsp bovis AF2122/97
gccagaccagggcag

SEQ ID NO: 3205798 - RNA, 22 nt, Mycobacterium bovis subsp bovis AF2122/97
gccagaccagggcagcggccag

SEQ ID NO: 3205799 - RNA, 15 nt, Mycobacterium bovis subsp bovis AF2122/97
gccagacccaccacc

SEQ ID NO: 3205800 - RNA, 24 nt, Mycobacterium bovis subsp bovis AF2122/97
gccagacccgaauccaccagcugg

SEQ ID NO: 3205801 - RNA, 13 nt, Mycobacterium bovis subsp bovis AF2122/97
gccagaccgcacc

SEQ ID NO: 3205802 - RNA, 19 nt, Mycobacterium bovis subsp bovis AF2122/97
gccagaccgcaccauugcu

SEQ ID NO: 3205803 - RNA, 13 nt, Mycobacterium bovis subsp bovis AF2122/97
gccagaccgccga

SEQ ID NO: 3205804 - RNA, 14 nt, Mycobacterium bovis subsp bovis AF2122/97
gccagaccgcgcgc

SEQ ID NO: 3205805 - RNA, 13 nt, Mycobacterium bovis subsp bovis AF2122/97
gccagaccgcggc

SEQ ID NO: 3205806 - RNA, 14 nt, Mycobacterium bovis subsp bovis AF2122/97
gccagacggugcag

SEQ ID NO: 3205807 - RNA, 17 nt, Mycobacterium bovis subsp bovis AF2122/97
gccagacggugcagcuc

SEQ ID NO: 3205808 - RNA, 13 nt, Mycobacterium bovis subsp bovis AF2122/97
gccagacucgcgg

SEQ ID NO: 3205809 - RNA, 16 nt, Mycobacterium bovis subsp bovis AF2122/97
gccagacucgcggucg

SEQ ID NO: 3205810 - RNA, 17 nt, Mycobacterium bovis subsp bovis AF2122/97
gccagacucgcggucga

SEQ ID NO: 3205811 - RNA, 15 nt, Mycobacterium bovis subsp bovis AF2122/97
gccagagaucgaggu

SEQ ID NO: 3205812 - RNA, 18 nt, Mycobacterium bovis subsp bovis AF2122/97
gccagagccgcgcgccgg

SEQ ID NO: 3205813 - RNA, 20 nt, Mycobacterium bovis subsp bovis AF2122/97
gccagagccgcgcgccgguu

SEQ ID NO: 3205814 - RNA, 15 nt, Mycobacterium bovis subsp bovis AF2122/97
gccagagguggauca

SEQ ID NO: 3205815 - RNA, 15 nt, Mycobacterium bovis subsp bovis AF2122/97
gccagagucgcccgc

SEQ ID NO: 3205816 - RNA, 16 nt, Mycobacterium bovis subsp bovis AF2122/97
gccagagucgcccgca

SEQ ID NO: 3205817 - RNA, 16 nt, Mycobacterium bovis subsp bovis AF2122/97
gccagaguuaccaggu

SEQ ID NO: 3205818 - RNA, 18 nt, Mycobacterium bovis subsp bovis AF2122/97
gccagaguuaccaggucg

SEQ ID NO: 3205819 - RNA, 20 nt, Mycobacterium bovis subsp bovis AF2122/97
gccagaguuaccaggucgga

SEQ ID NO: 3205820 - RNA, 15 nt, Mycobacterium bovis subsp bovis AF2122/97
gccagauaaccggcu

SEQ ID NO: 3205821 - RNA, 20 nt, Mycobacterium bovis subsp bovis AF2122/97
gccagauagguccgaucaug

SEQ ID NO: 3205822 - RNA, 20 nt, Mycobacterium bovis subsp bovis AF2122/97
gccagauagguuccaccggg

SEQ ID NO: 3205823 - RNA, 14 nt, Mycobacterium bovis subsp bovis AF2122/97
gccagaucacgcac

SEQ ID NO: 3205824 - RNA, 14 nt, Mycobacterium bovis subsp bovis AF2122/97
gccagaucagcacc

SEQ ID NO: 3205825 - RNA, 17 nt, Mycobacterium bovis subsp bovis AF2122/97
gccagaucagcaccgac

SEQ ID NO: 3205826 - RNA, 21 nt, Mycobacterium bovis subsp bovis AF2122/97
gccagaucagcaccgacagcc

SEQ ID NO: 3205827 - RNA, 15 nt, Mycobacterium bovis subsp bovis AF2122/97
gccagaucagccgcc

SEQ ID NO: 3205828 - RNA, 16 nt, Mycobacterium bovis subsp bovis AF2122/97
gccagaucagccgccg

SEQ ID NO: 3205829 - RNA, 17 nt, Mycobacterium bovis subsp bovis AF2122/97
gccagaucagccgccgc

SEQ ID NO: 3205830 - RNA, 19 nt, Mycobacterium bovis subsp bovis AF2122/97
gccagaucagccgccgccu

SEQ ID NO: 3205831 - RNA, 15 nt, Mycobacterium bovis subsp bovis AF2122/97
gccagaucgaacgca

SEQ ID NO: 3205832 - RNA, 16 nt, Mycobacterium bovis subsp bovis AF2122/97
gccagaucgaacgcag

SEQ ID NO: 3205833 - RNA, 17 nt, Mycobacterium bovis subsp bovis AF2122/97
gccagaucgaacgcagc

SEQ ID NO: 3205834 - RNA, 21 nt, Mycobacterium bovis subsp bovis AF2122/97
gccagaucgaagcgcagcacc

SEQ ID NO: 3205835 - RNA, 19 nt, Mycobacterium bovis subsp bovis AF2122/97
gccagaucuccccgaccgc

SEQ ID NO: 3205836 - RNA, 21 nt, Mycobacterium bovis subsp bovis AF2122/97
gccagaucuccccgaccgcgc

SEQ ID NO: 3205837 - RNA, 16 nt, Mycobacterium bovis subsp bovis AF2122/97
gccagaucucgcgcgc

SEQ ID NO: 3205838 - RNA, 23 nt, Mycobacterium bovis subsp bovis AF2122/97
gccagaucucgcgcgcggcgacg

SEQ ID NO: 3205839 - RNA, 17 nt, Mycobacterium bovis subsp bovis AF2122/97
gccagaugaugccaccc

SEQ ID NO: 3205840 - RNA, 15 nt, Mycobacterium bovis subsp bovis AF2122/97
gccagauuggcgcug

SEQ ID NO: 3205841 - RNA, 18 nt, Mycobacterium bovis subsp bovis AF2122/97
gccagauuucugggagcc

SEQ ID NO: 3205842 - RNA, 20 nt, Mycobacterium bovis subsp bovis AF2122/97
gccagauuucugggagccgg

SEQ ID NO: 3205843 - RNA, 14 nt, Mycobacterium bovis subsp bovis AF2122/97
gccagcaacccugc

SEQ ID NO: 3205844 - RNA, 19 nt, Mycobacterium bovis subsp bovis AF2122/97
gccagcaacugccgcaccc

SEQ ID NO: 3205845 - RNA, 16 nt, Mycobacterium bovis subsp bovis AF2122/97
gccagcaagacgauga

SEQ ID NO: 3205846 - RNA, 20 nt, Mycobacterium bovis subsp bovis AF2122/97
gccagcaaugcccgcaccgc

SEQ ID NO: 3205847 - RNA, 15 nt, Mycobacterium bovis subsp bovis AF2122/97
gccagcaccaccggc

SEQ ID NO: 3205848 - RNA, 20 nt, Mycobacterium bovis subsp bovis AF2122/97
gccagcaccaccggcucccg

SEQ ID NO: 3205849 - RNA, 13 nt, Mycobacterium bovis subsp bovis AF2122/97
gccagcaccacgg

SEQ ID NO: 3205850 - RNA, 15 nt, Mycobacterium bovis subsp bovis AF2122/97
gccagcaccacggcc

SEQ ID NO: 3205851 - RNA, 19 nt, Mycobacterium bovis subsp bovis AF2122/97
gccagcaccacggccagcg

SEQ ID NO: 3205852 - RNA, 20 nt, Mycobacterium bovis subsp bovis AF2122/97
gccagcaccacggccagcgg

SEQ ID NO: 3205853 - RNA, 21 nt, Mycobacterium bovis subsp bovis AF2122/97
gccagcaccacggccagcggg

SEQ ID NO: 3205854 - RNA, 12 nt, Mycobacterium bovis subsp bovis AF2122/97
gccagcaccagc

SEQ ID NO: 3205855 - RNA, 13 nt, Mycobacterium bovis subsp bovis AF2122/97
gccagcaccagcg

SEQ ID NO: 3205856 - RNA, 21 nt, Mycobacterium bovis subsp bovis AF2122/97
gccagcaccagcgucgcggcc

SEQ ID NO: 3205857 - RNA, 20 nt, Mycobacterium bovis subsp bovis AF2122/97
gccagcacccgcagccgcga

SEQ ID NO: 3205858 - RNA, 13 nt, Mycobacterium bovis subsp bovis AF2122/97
gccagcaccgggg

SEQ ID NO: 3205859 - RNA, 16 nt, Mycobacterium bovis subsp bovis AF2122/97
gccagcaccucggcca

SEQ ID NO: 3205860 - RNA, 21 nt, Mycobacterium bovis subsp bovis AF2122/97
gccagcacgcccgcgcugaca

SEQ ID NO: 3205861 - RNA, 14 nt, Mycobacterium bovis subsp bovis AF2122/97
gccagcacgccgcc

SEQ ID NO: 3205862 - RNA, 15 nt, Mycobacterium bovis subsp bovis AF2122/97
gccagcacgccgccg

SEQ ID NO: 3205863 - RNA, 17 nt, Mycobacterium bovis subsp bovis AF2122/97
gccagcacgccgccggc

SEQ ID NO: 3205864 - RNA, 21 nt, Mycobacterium bovis subsp bovis AF2122/97
gccagcacgccgccggccgcc

SEQ ID NO: 3205865 - RNA, 24 nt, Mycobacterium bovis subsp bovis AF2122/97
gccagcacgccgccggccgccagc

SEQ ID NO: 3205866 - RNA, 22 nt, Mycobacterium bovis subsp bovis AF2122/97
gccagcacgguguugcgcaccc

SEQ ID NO: 3205867 - RNA, 19 nt, Mycobacterium bovis subsp bovis AF2122/97
gccagccggcgcacucccg

SEQ ID NO: 3205868 - RNA, 18 nt, Mycobacterium bovis subsp bovis AF2122/97
gccagccgucaccgcgac

SEQ ID NO: 3205869 - RNA, 21 nt, Mycobacterium bovis subsp bovis AF2122/97
gccagccgucaccgcgacccc

SEQ ID NO: 3205870 - RNA, 14 nt, Mycobacterium bovis subsp bovis AF2122/97
gccagccgugccgg

SEQ ID NO: 3205871 - RNA, 17 nt, Mycobacterium bovis subsp bovis AF2122/97
gccagccguuuuccuga

SEQ ID NO: 3205872 - RNA, 21 nt, Mycobacterium bovis subsp bovis AF2122/97
gccagccguuuuccugaucgc

SEQ ID NO: 3205873 - RNA, 18 nt, Mycobacterium bovis subsp bovis AF2122/97
gccagccucaucugaggc

SEQ ID NO: 3205874 - RNA, 13 nt, Mycobacterium bovis subsp bovis AF2122/97
gccagccuccacc

SEQ ID NO: 3205875 - RNA, 16 nt, Mycobacterium bovis subsp bovis AF2122/97
gccagccugcuggccg

SEQ ID NO: 3205876 - RNA, 19 nt, Mycobacterium bovis subsp bovis AF2122/97
gccagccugcuggccgcgg

SEQ ID NO: 3205877 - RNA, 21 nt, Mycobacterium bovis subsp bovis AF2122/97
gccagccugcuggccgcggcc

SEQ ID NO: 3205878 - RNA, 23 nt, Mycobacterium bovis subsp bovis AF2122/97
gccagccuggccaucgagggcau

SEQ ID NO: 3205879 - RNA, 14 nt, Mycobacterium bovis subsp bovis AF2122/97
gccagccugugcug

SEQ ID NO: 3205880 - RNA, 23 nt, Mycobacterium bovis subsp bovis AF2122/97
gccagccuuggacgugcgcgcca

SEQ ID NO: 3205881 - RNA, 18 nt, Mycobacterium bovis subsp bovis AF2122/97
gccagcgaaucgcuggug

SEQ ID NO: 3205882 - RNA, 21 nt, Mycobacterium bovis subsp bovis AF2122/97
gccagcgaaucgcuggugaag

SEQ ID NO: 3205883 - RNA, 18 nt, Mycobacterium bovis subsp bovis AF2122/97
gccagcgaauggggcagc

SEQ ID NO: 3205884 - RNA, 19 nt, Mycobacterium bovis subsp bovis AF2122/97
gccagcgaauggggcagcu

SEQ ID NO: 3205885 - RNA, 22 nt, Mycobacterium bovis subsp bovis AF2122/97
gccagcgacgcggucaucgagc

SEQ ID NO: 3205886 - RNA, 17 nt, Mycobacterium bovis subsp bovis AF2122/97
gccagcgagcauaccgc

SEQ ID NO: 3205887 - RNA, 18 nt, Mycobacterium bovis subsp bovis AF2122/97
gccagcgauaucggcggc

SEQ ID NO: 3205888 - RNA, 17 nt, Mycobacterium bovis subsp bovis AF2122/97
gccagcgaugugaaccg

SEQ ID NO: 3205889 - RNA, 23 nt, Mycobacterium bovis subsp bovis AF2122/97
gccagcgaugugaaccgggcacc

SEQ ID NO: 3205890 - RNA, 19 nt, Mycobacterium bovis subsp bovis AF2122/97
gccagcgcaagguugccaa

SEQ ID NO: 3205891 - RNA, 14 nt, Mycobacterium bovis subsp bovis AF2122/97
gccagcgcacgaua

SEQ ID NO: 3205892 - RNA, 13 nt, Mycobacterium bovis subsp bovis AF2122/97
gccagcgcagcac

SEQ ID NO: 3205893 - RNA, 17 nt, Mycobacterium bovis subsp bovis AF2122/97
gccagcgcagccaggcu

SEQ ID NO: 3205894 - RNA, 14 nt, Mycobacterium bovis subsp bovis AF2122/97
gccagcgccaccgu

SEQ ID NO: 3205895 - RNA, 12 nt, Mycobacterium bovis subsp bovis AF2122/97
gccagcgccgcc

SEQ ID NO: 3205896 - RNA, 13 nt, Mycobacterium bovis subsp bovis AF2122/97
gccagcgccgcca

SEQ ID NO: 3205897 - RNA, 16 nt, Mycobacterium bovis subsp bovis AF2122/97
gccagcgccgccaccg

SEQ ID NO: 3205898 - RNA, 18 nt, Mycobacterium bovis subsp bovis AF2122/97
gccagcgccgccgagguc

SEQ ID NO: 3205899 - RNA, 21 nt, Mycobacterium bovis subsp bovis AF2122/97
gccagcgccgccgaggucggu

SEQ ID NO: 3205900 - RNA, 14 nt, Mycobacterium bovis subsp bovis AF2122/97
gccagcgccgccgc

SEQ ID NO: 3205901 - RNA, 15 nt, Mycobacterium bovis subsp bovis AF2122/97
gccagcgccgccgcc

SEQ ID NO: 3205902 - RNA, 18 nt, Mycobacterium bovis subsp bovis AF2122/97
gccagcgccgccgccgac

SEQ ID NO: 3205903 - RNA, 16 nt, Mycobacterium bovis subsp bovis AF2122/97
gccagcgccgccgcga

SEQ ID NO: 3205904 - RNA, 16 nt, Mycobacterium bovis subsp bovis AF2122/97
gccagcgccgccggag

SEQ ID NO: 3205905 - RNA, 17 nt, Mycobacterium bovis subsp bovis AF2122/97
gccagcgccgccggcgc

SEQ ID NO: 3205906 - RNA, 20 nt, Mycobacterium bovis subsp bovis AF2122/97
gccagcgccgccggcgccgg

SEQ ID NO: 3205907 - RNA, 13 nt, Mycobacterium bovis subsp bovis AF2122/97
gccagcgccggcc

SEQ ID NO: 3205908 - RNA, 18 nt, Mycobacterium bovis subsp bovis AF2122/97
gccagcgccggccaggcu

SEQ ID NO: 3205909 - RNA, 13 nt, Mycobacterium bovis subsp bovis AF2122/97
gccagcgccucgg

SEQ ID NO: 3205910 - RNA, 12 nt, Mycobacterium bovis subsp bovis AF2122/97
gccagcgcgacc

SEQ ID NO: 3205911 - RNA, 16 nt, Mycobacterium bovis subsp bovis AF2122/97
gccagcgcgaccaaug

SEQ ID NO: 3205912 - RNA, 10 nt, Mycobacterium bovis subsp bovis AF2122/97
gccagcgcgc

SEQ ID NO: 3205913 - RNA, 17 nt, Mycobacterium bovis subsp bovis AF2122/97
gccagcgcgccacgagc

SEQ ID NO: 3205914 - RNA, 18 nt, Mycobacterium bovis subsp bovis AF2122/97
gccagcgcgccacgagca

SEQ ID NO: 3205915 - RNA, 14 nt, Mycobacterium bovis subsp bovis AF2122/97
gccagcgcgcccgc

SEQ ID NO: 3205916 - RNA, 16 nt, Mycobacterium bovis subsp bovis AF2122/97
gccagcgcgcccgcgg

SEQ ID NO: 3205917 - RNA, 17 nt, Mycobacterium bovis subsp bovis AF2122/97
gccagcgcgcccgcggc

SEQ ID NO: 3205918 - RNA, 19 nt, Mycobacterium bovis subsp bovis AF2122/97
gccagcgcgcccgcggccg

SEQ ID NO: 3205919 - RNA, 12 nt, Mycobacterium bovis subsp bovis AF2122/97
gccagcgcgcgc

SEQ ID NO: 3205920 - RNA, 15 nt, Mycobacterium bovis subsp bovis AF2122/97
gccagcgcgcgcggg

SEQ ID NO: 3205921 - RNA, 19 nt, Mycobacterium bovis subsp bovis AF2122/97
gccagcgcgcgcgggugca

SEQ ID NO: 3205922 - RNA, 13 nt, Mycobacterium bovis subsp bovis AF2122/97
gccagcgcggcgc

SEQ ID NO: 3205923 - RNA, 23 nt, Mycobacterium bovis subsp bovis AF2122/97
gccagcgcggcgcgcggggccuc

SEQ ID NO: 3205924 - RNA, 13 nt, Mycobacterium bovis subsp bovis AF2122/97
gccagcgcggcgu

SEQ ID NO: 3205925 - RNA, 17 nt, Mycobacterium bovis subsp bovis AF2122/97
gccagcgcucaccggcg

SEQ ID NO: 3205926 - RNA, 21 nt, Mycobacterium bovis subsp bovis AF2122/97
gccagcgcucaccggcgucgu

SEQ ID NO: 3205927 - RNA, 20 nt, Mycobacterium bovis subsp bovis AF2122/97
gccagcgcuccuugugccug

SEQ ID NO: 3205928 - RNA, 22 nt, Mycobacterium bovis subsp bovis AF2122/97
gccagcgcuucgucggccggca

SEQ ID NO: 3205929 - RNA, 17 nt, Mycobacterium bovis subsp bovis AF2122/97
gccagcggaguaaacaa

SEQ ID NO: 3205930 - RNA, 17 nt, Mycobacterium bovis subsp bovis AF2122/97
gccagcggcaauggcca

SEQ ID NO: 3205931 - RNA, 19 nt, Mycobacterium bovis subsp bovis AF2122/97
gccagcggcaauggccagc

SEQ ID NO: 3205932 - RNA, 21 nt, Mycobacterium bovis subsp bovis AF2122/97
gccagcggcaauggccagcac

SEQ ID NO: 3205933 - RNA, 22 nt, Mycobacterium bovis subsp bovis AF2122/97
gccagcggcaauggccagcacc

SEQ ID NO: 3205934 - RNA, 23 nt, Mycobacterium bovis subsp bovis AF2122/97
gccagcggcaauggccagcacca

SEQ ID NO: 3205935 - RNA, 12 nt, Mycobacterium bovis subsp bovis AF2122/97
gccagcggcaca

SEQ ID NO: 3205936 - RNA, 15 nt, Mycobacterium bovis subsp bovis AF2122/97
gccagcggcacaccc

SEQ ID NO: 3205937 - RNA, 16 nt, Mycobacterium bovis subsp bovis AF2122/97
gccagcggcacaccca

SEQ ID NO: 3205938 - RNA, 21 nt, Mycobacterium bovis subsp bovis AF2122/97
gccagcggcacacccaucacc

SEQ ID NO: 3205939 - RNA, 19 nt, Mycobacterium bovis subsp bovis AF2122/97
gccagcggcacugaucugc

SEQ ID NO: 3205940 - RNA, 15 nt, Mycobacterium bovis subsp bovis AF2122/97
gccagcggcagccug

SEQ ID NO: 3205941 - RNA, 20 nt, Mycobacterium bovis subsp bovis AF2122/97
gccagcggccauccggcggc

SEQ ID NO: 3205942 - RNA, 19 nt, Mycobacterium bovis subsp bovis AF2122/97
gccagcggccgcuccaccu

SEQ ID NO: 3205943 - RNA, 15 nt, Mycobacterium bovis subsp bovis AF2122/97
gccagcggccgggcg

SEQ ID NO: 3205944 - RNA, 16 nt, Mycobacterium bovis subsp bovis AF2122/97
gccagcggccgggcgg

SEQ ID NO: 3205945 - RNA, 15 nt, Mycobacterium bovis subsp bovis AF2122/97
gccagcgggaacaca

SEQ ID NO: 3205946 - RNA, 15 nt, Mycobacterium bovis subsp bovis AF2122/97
gccagcgggcgauga

SEQ ID NO: 3205947 - RNA, 17 nt, Mycobacterium bovis subsp bovis AF2122/97
gccagcgggcgaugagc

SEQ ID NO: 3205948 - RNA, 19 nt, Mycobacterium bovis subsp bovis AF2122/97
gccagcgggcuguaggcga

SEQ ID NO: 3205949 - RNA, 19 nt, Mycobacterium bovis subsp bovis AF2122/97
gccagcggguccccgguca

SEQ ID NO: 3205950 - RNA, 22 nt, Mycobacterium bovis subsp bovis AF2122/97
gccagcgggugaaucgacaccg

SEQ ID NO: 3205951 - RNA, 19 nt, Mycobacterium bovis subsp bovis AF2122/97
gccagcgguaaugccagcg

SEQ ID NO: 3205952 - RNA, 21 nt, Mycobacterium bovis subsp bovis AF2122/97
gccagcgguagcugcccagcg

SEQ ID NO: 3205953 - RNA, 13 nt, Mycobacterium bovis subsp bovis AF2122/97
gccagcgguggac

SEQ ID NO: 3205954 - RNA, 14 nt, Mycobacterium bovis subsp bovis AF2122/97
gccaggcccggcuu

SEQ ID NO: 3205955 - RNA, 13 nt, Mycobacterium bovis subsp bovis AF2122/97
gccaggcccucga

SEQ ID NO: 3205956 - RNA, 20 nt, Mycobacterium bovis subsp bovis AF2122/97
gccaggccgacaaugucggc

SEQ ID NO: 3205957 - RNA, 16 nt, Mycobacterium bovis subsp bovis AF2122/97
gccaggccgaccgcgc

SEQ ID NO: 3205958 - RNA, 15 nt, Mycobacterium bovis subsp bovis AF2122/97
gccaggccgcacagc

SEQ ID NO: 3205959 - RNA, 18 nt, Mycobacterium bovis subsp bovis AF2122/97
gccaggccgcacagcacc

SEQ ID NO: 3205960 - RNA, 15 nt, Mycobacterium bovis subsp bovis AF2122/97
gccaggccgcgcgac

SEQ ID NO: 3205961 - RNA, 12 nt, Mycobacterium bovis subsp bovis AF2122/97
gccaggccggcg

SEQ ID NO: 3205962 - RNA, 13 nt, Mycobacterium bovis subsp bovis AF2122/97
gccaggccgucgg

SEQ ID NO: 3205963 - RNA, 21 nt, Mycobacterium bovis subsp bovis AF2122/97
gccaggccuuggugcggccgg

SEQ ID NO: 3205964 - RNA, 16 nt, Mycobacterium bovis subsp bovis AF2122/97
gccaggcgaagucgac

SEQ ID NO: 3205965 - RNA, 22 nt, Mycobacterium bovis subsp bovis AF2122/97
gccaggcgaagucgacucgcca

SEQ ID NO: 3205966 - RNA, 22 nt, Mycobacterium bovis subsp bovis AF2122/97
gccaggcgauugcccgcgcucg

SEQ ID NO: 3205967 - RNA, 13 nt, Mycobacterium bovis subsp bovis AF2122/97
gccaggcgcagcu

SEQ ID NO: 3205968 - RNA, 23 nt, Mycobacterium bovis subsp bovis AF2122/97
gccaggcgcauagggccaccgcc

SEQ ID NO: 3205969 - RNA, 16 nt, Mycobacterium bovis subsp bovis AF2122/97
gccaggcgcgaucgcg

SEQ ID NO: 3205970 - RNA, 12 nt, Mycobacterium bovis subsp bovis AF2122/97
gccaggcgcgcu

SEQ ID NO: 3205971 - RNA, 15 nt, Mycobacterium bovis subsp bovis AF2122/97
gccaggcgcuuggcc

SEQ ID NO: 3205972 - RNA, 14 nt, Mycobacterium bovis subsp bovis AF2122/97
gccaggcggcaagg

SEQ ID NO: 3205973 - RNA, 22 nt, Mycobacterium bovis subsp bovis AF2122/97
gccaggcggcaaggacggagcc

SEQ ID NO: 3205974 - RNA, 20 nt, Mycobacterium bovis subsp bovis AF2122/97
gccaggcggcaauucgggca

SEQ ID NO: 3205975 - RNA, 13 nt, Mycobacterium bovis subsp bovis AF2122/97
gccaggcggccgg

SEQ ID NO: 3205976 - RNA, 21 nt, Mycobacterium bovis subsp bovis AF2122/97
gccaggcucgauguccucgag

SEQ ID NO: 3205977 - RNA, 13 nt, Mycobacterium bovis subsp bovis AF2122/97
gccaggcugcgca

SEQ ID NO: 3205978 - RNA, 16 nt, Mycobacterium bovis subsp bovis AF2122/97
gccaggcugcgcagug

SEQ ID NO: 3205979 - RNA, 13 nt, Mycobacterium bovis subsp bovis AF2122/97
gccaggcuggcca

SEQ ID NO: 3205980 - RNA, 14 nt, Mycobacterium bovis subsp bovis AF2122/97
gccaggcuggccaa

SEQ ID NO: 3205981 - RNA, 15 nt, Mycobacterium bovis subsp bovis AF2122/97
gccaggcuggcguca

SEQ ID NO: 3205982 - RNA, 16 nt, Mycobacterium bovis subsp bovis AF2122/97
gccaggcuugcggcac

SEQ ID NO: 3205983 - RNA, 17 nt, Mycobacterium bovis subsp bovis AF2122/97
gccaggcuugcggcacc

SEQ ID NO: 3205984 - RNA, 23 nt, Mycobacterium bovis subsp bovis AF2122/97
gccaggcuugcggcacccagucg

SEQ ID NO: 3205985 - RNA, 15 nt, Mycobacterium bovis subsp bovis AF2122/97
gccagggaggggccg

SEQ ID NO: 3205986 - RNA, 18 nt, Mycobacterium bovis subsp bovis AF2122/97
gccagggaucagccgugc

SEQ ID NO: 3205987 - RNA, 19 nt, Mycobacterium bovis subsp bovis AF2122/97
gccagggaucagccgugcg

SEQ ID NO: 3205988 - RNA, 21 nt, Mycobacterium bovis subsp bovis AF2122/97
gccagggaucagccgugcggg

SEQ ID NO: 3205989 - RNA, 24 nt, Mycobacterium bovis subsp bovis AF2122/97
gccagggaucagccgugcgggccg

SEQ ID NO: 3205990 - RNA, 19 nt, Mycobacterium bovis subsp bovis AF2122/97
gccagggcccuagccggcg

SEQ ID NO: 3205991 - RNA, 20 nt, Mycobacterium bovis subsp bovis AF2122/97
gccagggcccuagccggcgc

SEQ ID NO: 3205992 - RNA, 22 nt, Mycobacterium bovis subsp bovis AF2122/97
gccagggcccuagccggcgcgc

SEQ ID NO: 3205993 - RNA, 14 nt, Mycobacterium bovis subsp bovis AF2122/97
gccagggccgccga

SEQ ID NO: 3205994 - RNA, 17 nt, Mycobacterium bovis subsp bovis AF2122/97
gccagggccgccgaagc

SEQ ID NO: 3205995 - RNA, 15 nt, Mycobacterium bovis subsp bovis AF2122/97
gccagggcgggcguc

SEQ ID NO: 3205996 - RNA, 15 nt, Mycobacterium bovis subsp bovis AF2122/97
gccagggcgguggcc

SEQ ID NO: 3205997 - RNA, 21 nt, Mycobacterium bovis subsp bovis AF2122/97
gccagggcgguggccacccgg

SEQ ID NO: 3205998 - RNA, 14 nt, Mycobacterium bovis subsp bovis AF2122/97
gccaggggacccgg

SEQ ID NO: 3205999 - RNA, 17 nt, Mycobacterium bovis subsp bovis AF2122/97
gccaggggacccggggc

SEQ ID NO: 3206000 - RNA, 18 nt, Mycobacterium bovis subsp bovis AF2122/97
gccaggggacccggggcc

SEQ ID NO: 3206001 - RNA, 23 nt, Mycobacterium bovis subsp bovis AF2122/97
gccaggggacccggggccguugg

SEQ ID NO: 3206002 - RNA, 18 nt, Mycobacterium bovis subsp bovis AF2122/97
gccaggggcgcagcgcgg

SEQ ID NO: 3206003 - RNA, 20 nt, Mycobacterium bovis subsp bovis AF2122/97
gccaggggcgcagcgcggca

SEQ ID NO: 3206004 - RNA, 20 nt, Mycobacterium bovis subsp bovis AF2122/97
gccagggucacaaacccagc

SEQ ID NO: 3206005 - RNA, 23 nt, Mycobacterium bovis subsp bovis AF2122/97
gccagggucacaaacccagcauc

SEQ ID NO: 3206006 - RNA, 17 nt, Mycobacterium bovis subsp bovis AF2122/97
gccagggucccgccgcc

SEQ ID NO: 3206007 - RNA, 17 nt, Mycobacterium bovis subsp bovis AF2122/97
gccagggugcccucggc

SEQ ID NO: 3206008 - RNA, 15 nt, Mycobacterium bovis subsp bovis AF2122/97
gccagggugcgccgg

SEQ ID NO: 3206009 - RNA, 16 nt, Mycobacterium bovis subsp bovis AF2122/97
gccaggucagccgcgc

SEQ ID NO: 3206010 - RNA, 20 nt, Mycobacterium bovis subsp bovis AF2122/97
gccaggucagccgcgcgggu

SEQ ID NO: 3206011 - RNA, 15 nt, Mycobacterium bovis subsp bovis AF2122/97
gccaggucagcucca

SEQ ID NO: 3206012 - RNA, 14 nt, Mycobacterium bovis subsp bovis AF2122/97
gccaggucagcucg

SEQ ID NO: 3206013 - RNA, 19 nt, Mycobacterium bovis subsp bovis AF2122/97
gccagguccccgacaacgg

SEQ ID NO: 3206014 - RNA, 18 nt, Mycobacterium bovis subsp bovis AF2122/97
gccagguccgccggugcc

SEQ ID NO: 3206015 - RNA, 22 nt, Mycobacterium bovis subsp bovis AF2122/97
gccagguccgccggugccgccg

SEQ ID NO: 3206016 - RNA, 23 nt, Mycobacterium bovis subsp bovis AF2122/97
gccagguccgccggugccgccgu

SEQ ID NO: 3206017 - RNA, 16 nt, Mycobacterium bovis subsp bovis AF2122/97
gccaggucgacaccgc

SEQ ID NO: 3206018 - RNA, 22 nt, Mycobacterium bovis subsp bovis AF2122/97
gccaggucgacaccgcggugcc

SEQ ID NO: 3206019 - RNA, 18 nt, Mycobacterium bovis subsp bovis AF2122/97
gccaggucgacgggcacg

SEQ ID NO: 3206020 - RNA, 20 nt, Mycobacterium bovis subsp bovis AF2122/97
gccaggucgagcaccggcug

SEQ ID NO: 3206021 - RNA, 17 nt, Mycobacterium bovis subsp bovis AF2122/97
gccaggucgaggcaggc

SEQ ID NO: 3206022 - RNA, 22 nt, Mycobacterium bovis subsp bovis AF2122/97
gccaggucgauaccggcgugca

SEQ ID NO: 3206023 - RNA, 22 nt, Mycobacterium bovis subsp bovis AF2122/97
gccaggucgcgauagccgccgc

SEQ ID NO: 3206024 - RNA, 17 nt, Mycobacterium bovis subsp bovis AF2122/97
gccaggucggccaccgu

SEQ ID NO: 3206025 - RNA, 21 nt, Mycobacterium bovis subsp bovis AF2122/97
gccaggucggccaccguggau

SEQ ID NO: 3206026 - RNA, 18 nt, Mycobacterium bovis subsp bovis AF2122/97
gccaggucggcgaugaug

SEQ ID NO: 3206027 - RNA, 16 nt, Mycobacterium bovis subsp bovis AF2122/97
gccaggucggcguuga

SEQ ID NO: 3206028 - RNA, 19 nt, Mycobacterium bovis subsp bovis AF2122/97
gccaggucuccuugggcga

SEQ ID NO: 3206029 - RNA, 15 nt, Mycobacterium bovis subsp bovis AF2122/97
gccaggugaugccgc

SEQ ID NO: 3206030 - RNA, 18 nt, Mycobacterium bovis subsp bovis AF2122/97
gccaggugaugccgccgu

SEQ ID NO: 3206031 - RNA, 14 nt, Mycobacterium bovis subsp bovis AF2122/97
gccaggugcagcac

SEQ ID NO: 3206032 - RNA, 18 nt, Mycobacterium bovis subsp bovis AF2122/97
gccaggugcagcaccagc

SEQ ID NO: 3206033 - RNA, 21 nt, Mycobacterium bovis subsp bovis AF2122/97
gccaggugcagggugagcacg

SEQ ID NO: 3206034 - RNA, 16 nt, Mycobacterium bovis subsp bovis AF2122/97
gccaggugcccaagca

SEQ ID NO: 3206035 - RNA, 16 nt, Mycobacterium bovis subsp bovis AF2122/97
gccagguggccgcauc

SEQ ID NO: 3206036 - RNA, 17 nt, Mycobacterium bovis subsp bovis AF2122/97
gccagguggccgcaucg

SEQ ID NO: 3206037 - RNA, 18 nt, Mycobacterium bovis subsp bovis AF2122/97
gccagguggccgcaucgc

SEQ ID NO: 3206038 - RNA, 15 nt, Mycobacterium bovis subsp bovis AF2122/97
gccaggugucgucga

SEQ ID NO: 3206039 - RNA, 21 nt, Mycobacterium bovis subsp bovis AF2122/97
gccaggugucgucgaucgcgg

SEQ ID NO: 3206040 - RNA, 22 nt, Mycobacterium bovis subsp bovis AF2122/97
gccaucacggucagcucgcuga

SEQ ID NO: 3206041 - RNA, 17 nt, Mycobacterium bovis subsp bovis AF2122/97
gccaucagaaccuccuc

SEQ ID NO: 3206042 - RNA, 16 nt, Mycobacterium bovis subsp bovis AF2122/97
gccaucagaccaauga

SEQ ID NO: 3206043 - RNA, 14 nt, Mycobacterium bovis subsp bovis AF2122/97
gccaucagcccggc

SEQ ID NO: 3206044 - RNA, 17 nt, Mycobacterium bovis subsp bovis AF2122/97
gccaucagcccggcgcg

SEQ ID NO: 3206045 - RNA, 21 nt, Mycobacterium bovis subsp bovis AF2122/97
gccaucagcccggcgcgccga

SEQ ID NO: 3206046 - RNA, 14 nt, Mycobacterium bovis subsp bovis AF2122/97
gccaucaucgacgg

SEQ ID NO: 3206047 - RNA, 12 nt, Mycobacterium bovis subsp bovis AF2122/97
gccaucaucgcu

SEQ ID NO: 3206048 - RNA, 13 nt, Mycobacterium bovis subsp bovis AF2122/97
gccaucauggcgg

SEQ ID NO: 3206049 - RNA, 15 nt, Mycobacterium bovis subsp bovis AF2122/97
gccaucauggcggcc

SEQ ID NO: 3206050 - RNA, 14 nt, Mycobacterium bovis subsp bovis AF2122/97
gccauccaccgcag

SEQ ID NO: 3206051 - RNA, 14 nt, Mycobacterium bovis subsp bovis AF2122/97
gccauccccgccgg

SEQ ID NO: 3206052 - RNA, 18 nt, Mycobacterium bovis subsp bovis AF2122/97
gccauccccgccggcgcc

SEQ ID NO: 3206053 - RNA, 20 nt, Mycobacterium bovis subsp bovis AF2122/97
gccauccccgccggcgccac

SEQ ID NO: 3206054 - RNA, 20 nt, Mycobacterium bovis subsp bovis AF2122/97
gccauccccggagcgauccg

SEQ ID NO: 3206055 - RNA, 19 nt, Mycobacterium bovis subsp bovis AF2122/97
gccauccccuggccagcag

SEQ ID NO: 3206056 - RNA, 15 nt, Mycobacterium bovis subsp bovis AF2122/97
gccaucccgccgccc

SEQ ID NO: 3206057 - RNA, 21 nt, Mycobacterium bovis subsp bovis AF2122/97
gccaucccgccgcccgcaucg

SEQ ID NO: 3206058 - RNA, 14 nt, Mycobacterium bovis subsp bovis AF2122/97
gccauccgauggcc

SEQ ID NO: 3206059 - RNA, 23 nt, Mycobacterium bovis subsp bovis AF2122/97
gccauccggucggucucggcgag

SEQ ID NO: 3206060 - RNA, 15 nt, Mycobacterium bovis subsp bovis AF2122/97
gccauccgugaaucg

SEQ ID NO: 3206061 - RNA, 15 nt, Mycobacterium bovis subsp bovis AF2122/97
gccauccucgagcug

SEQ ID NO: 3206062 - RNA, 22 nt, Mycobacterium bovis subsp bovis AF2122/97
gccaucgaccguccgggucacc

SEQ ID NO: 3206063 - RNA, 14 nt, Mycobacterium bovis subsp bovis AF2122/97
gccaucgacgccgc

SEQ ID NO: 3206064 - RNA, 15 nt, Mycobacterium bovis subsp bovis AF2122/97
gccaucgaguccacc

SEQ ID NO: 3206065 - RNA, 21 nt, Mycobacterium bovis subsp bovis AF2122/97
gccaucgaucgagcaggccgc

SEQ ID NO: 3206066 - RNA, 19 nt, Mycobacterium bovis subsp bovis AF2122/97
gccaucgaugcggugaauc

SEQ ID NO: 3206067 - RNA, 21 nt, Mycobacterium bovis subsp bovis AF2122/97
gccaucgccaugauggacagc

SEQ ID NO: 3206068 - RNA, 14 nt, Mycobacterium bovis subsp bovis AF2122/97
gccaucgcccgaug

SEQ ID NO: 3206069 - RNA, 20 nt, Mycobacterium bovis subsp bovis AF2122/97
gccaucgcccgaugcgccag

SEQ ID NO: 3206070 - RNA, 18 nt, Mycobacterium bovis subsp bovis AF2122/97
gccaucgccuccagccgg

SEQ ID NO: 3206071 - RNA, 14 nt, Mycobacterium bovis subsp bovis AF2122/97
gccaucgcgagcgg

SEQ ID NO: 3206072 - RNA, 14 nt, Mycobacterium bovis subsp bovis AF2122/97
gccaucgcgcggac

SEQ ID NO: 3206073 - RNA, 16 nt, Mycobacterium bovis subsp bovis AF2122/97
gccaucgcgcggacca

SEQ ID NO: 3206074 - RNA, 13 nt, Mycobacterium bovis subsp bovis AF2122/97
gccaucgcggaac

SEQ ID NO: 3206075 - RNA, 15 nt, Mycobacterium bovis subsp bovis AF2122/97
gccaucgcggaaccg

SEQ ID NO: 3206076 - RNA, 22 nt, Mycobacterium bovis subsp bovis AF2122/97
gccaucgcggcguugugaccgc

SEQ ID NO: 3206077 - RNA, 15 nt, Mycobacterium bovis subsp bovis AF2122/97
gccaucggacagcau

SEQ ID NO: 3206078 - RNA, 16 nt, Mycobacterium bovis subsp bovis AF2122/97
gccaucggcaccagcg

SEQ ID NO: 3206079 - RNA, 20 nt, Mycobacterium bovis subsp bovis AF2122/97
gccaucggcuaggccggccg

SEQ ID NO: 3206080 - RNA, 22 nt, Mycobacterium bovis subsp bovis AF2122/97
gccaucgggauggacaccaccu

SEQ ID NO: 3206081 - RNA, 20 nt, Mycobacterium bovis subsp bovis AF2122/97
gccaucgggcgcgguaacca

SEQ ID NO: 3206082 - RNA, 20 nt, Mycobacterium bovis subsp bovis AF2122/97
gccaucggugcgcacggcgg

SEQ ID NO: 3206083 - RNA, 22 nt, Mycobacterium bovis subsp bovis AF2122/97
gccaucggugcgcacggcggcc

SEQ ID NO: 3206084 - RNA, 15 nt, Mycobacterium bovis subsp bovis AF2122/97
gccaucggugguggc

SEQ ID NO: 3206085 - RNA, 17 nt, Mycobacterium bovis subsp bovis AF2122/97
gccaucggugguggcgu

SEQ ID NO: 3206086 - RNA, 19 nt, Mycobacterium bovis subsp bovis AF2122/97
gccaucgucaggaaccacc

SEQ ID NO: 3206087 - RNA, 21 nt, Mycobacterium bovis subsp bovis AF2122/97
gccaucgucaggaaccaccca

SEQ ID NO: 3206088 - RNA, 17 nt, Mycobacterium bovis subsp bovis AF2122/97
gccaucguccagcagga

SEQ ID NO: 3206089 - RNA, 17 nt, Mycobacterium bovis subsp bovis AF2122/97
gccaucgucgaagaccu

SEQ ID NO: 3206090 - RNA, 17 nt, Mycobacterium bovis subsp bovis AF2122/97
gccaucgucggaaugcu

SEQ ID NO: 3206091 - RNA, 13 nt, Mycobacterium bovis subsp bovis AF2122/97
gccaucgugcggc

SEQ ID NO: 3206092 - RNA, 19 nt, Mycobacterium bovis subsp bovis AF2122/97
gccaucguuucacccgggc

SEQ ID NO: 3206093 - RNA, 14 nt, Mycobacterium bovis subsp bovis AF2122/97
gccaucugccugcc

SEQ ID NO: 3206094 - RNA, 12 nt, Mycobacterium bovis subsp bovis AF2122/97
gccaucugcucg

SEQ ID NO: 3206095 - RNA, 13 nt, Mycobacterium bovis subsp bovis AF2122/97
gccaucugcucgu

SEQ ID NO: 3206096 - RNA, 11 nt, Mycobacterium bovis subsp bovis AF2122/97
gccaucuggcc

SEQ ID NO: 3206097 - RNA, 12 nt, Mycobacterium bovis subsp bovis AF2122/97
gccaucuggccg

SEQ ID NO: 3206098 - RNA, 12 nt, Mycobacterium bovis subsp bovis AF2122/97
gccaucuggguc

SEQ ID NO: 3206099 - RNA, 18 nt, Mycobacterium bovis subsp bovis AF2122/97
gccaucuggguccgucga

SEQ ID NO: 3206100 - RNA, 19 nt, Mycobacterium bovis subsp bovis AF2122/97
gccaucuucgggccgacgg

SEQ ID NO: 3206101 - RNA, 21 nt, Mycobacterium bovis subsp bovis AF2122/97
gccaugaacucgaacuggguc

SEQ ID NO: 3206102 - RNA, 22 nt, Mycobacterium bovis subsp bovis AF2122/97
gccaugaagccgggcgcuugca

SEQ ID NO: 3206103 - RNA, 15 nt, Mycobacterium bovis subsp bovis AF2122/97
gccaugagcgcgccc

SEQ ID NO: 3206104 - RNA, 21 nt, Mycobacterium bovis subsp bovis AF2122/97
gccaugagcgcgcccaaccug

SEQ ID NO: 3206105 - RNA, 23 nt, Mycobacterium bovis subsp bovis AF2122/97
gccaugagguaggucgccgccgc

SEQ ID NO: 3206106 - RNA, 19 nt, Mycobacterium bovis subsp bovis AF2122/97
gccaugaucacaccgcugc

SEQ ID NO: 3206107 - RNA, 16 nt, Mycobacterium bovis subsp bovis AF2122/97
gccaugccaagcucca

SEQ ID NO: 3206108 - RNA, 18 nt, Mycobacterium bovis subsp bovis AF2122/97
gccaugcccgcacgcucg

SEQ ID NO: 3206109 - RNA, 16 nt, Mycobacterium bovis subsp bovis AF2122/97
gccaugcccucggcgc

SEQ ID NO: 3206110 - RNA, 15 nt, Mycobacterium bovis subsp bovis AF2122/97
gccaugccgcucggc

SEQ ID NO: 3206111 - RNA, 18 nt, Mycobacterium bovis subsp bovis AF2122/97
gccaugccgcucggcaac

SEQ ID NO: 3206112 - RNA, 20 nt, Mycobacterium bovis subsp bovis AF2122/97
gccaugcgcaccaguccagc

SEQ ID NO: 3206113 - RNA, 21 nt, Mycobacterium bovis subsp bovis AF2122/97
gccaugcgcaccaguccagcg

SEQ ID NO: 3206114 - RNA, 14 nt, Mycobacterium bovis subsp bovis AF2122/97
gccaugcggcgcgu

SEQ ID NO: 3206115 - RNA, 14 nt, Mycobacterium bovis subsp bovis AF2122/97
gccaugcggguguc

SEQ ID NO: 3206116 - RNA, 21 nt, Mycobacterium bovis subsp bovis AF2122/97
gccaugcgguuugccggugcg

SEQ ID NO: 3206117 - RNA, 20 nt, Mycobacterium bovis subsp bovis AF2122/97
gccaugcuaggaccaccagc

SEQ ID NO: 3206118 - RNA, 21 nt, Mycobacterium bovis subsp bovis AF2122/97
gccaugcuaggaccaccagcg

SEQ ID NO: 3206119 - RNA, 18 nt, Mycobacterium bovis subsp bovis AF2122/97
gccaugcucgccaaaccc

SEQ ID NO: 3206120 - RNA, 20 nt, Mycobacterium bovis subsp bovis AF2122/97
gccaugcucgucuugggccg

SEQ ID NO: 3206121 - RNA, 19 nt, Mycobacterium bovis subsp bovis AF2122/97
gccaugcuggucagcggcg

SEQ ID NO: 3206122 - RNA, 20 nt, Mycobacterium bovis subsp bovis AF2122/97
gccaugcuggucagcggcgc

SEQ ID NO: 3206123 - RNA, 23 nt, Mycobacterium bovis subsp bovis AF2122/97
gccauggaagcagacuccggugu

SEQ ID NO: 3206124 - RNA, 19 nt, Mycobacterium bovis subsp bovis AF2122/97
gccauggacgccaugguga

SEQ ID NO: 3206125 - RNA, 19 nt, Mycobacterium bovis subsp bovis AF2122/97
gccauggcagcgccgcagc

SEQ ID NO: 3206126 - RNA, 14 nt, Mycobacterium bovis subsp bovis AF2122/97
cugacgguucgguc

SEQ ID NO: 3206127 - RNA, 22 nt, Mycobacterium bovis subsp bovis AF2122/97
cugacgguucggucggggagcu

SEQ ID NO: 3206128 - RNA, 19 nt, Mycobacterium bovis subsp bovis AF2122/97
cugacgucacguucggcgc

SEQ ID NO: 3206129 - RNA, 20 nt, Mycobacterium bovis subsp bovis AF2122/97
cugacgucacguucggcgca

SEQ ID NO: 3206130 - RNA, 21 nt, Mycobacterium bovis subsp bovis AF2122/97
cugacgucacguucggcgcaa

SEQ ID NO: 3206131 - RNA, 22 nt, Mycobacterium bovis subsp bovis AF2122/97
cugacgucuuggaacacggccg

SEQ ID NO: 3206132 - RNA, 15 nt, Mycobacterium bovis subsp bovis AF2122/97
cugacgugaagcaga

SEQ ID NO: 3206133 - RNA, 13 nt, Mycobacterium bovis subsp bovis AF2122/97
cugacgugucggc

SEQ ID NO: 3206134 - RNA, 17 nt, Mycobacterium bovis subsp bovis AF2122/97
cugacuagggucaccga

SEQ ID NO: 3206135 - RNA, 15 nt, Mycobacterium bovis subsp bovis AF2122/97
cugacucaucaccga

SEQ ID NO: 3206136 - RNA, 15 nt, Mycobacterium bovis subsp bovis AF2122/97
cugacuccugcggca

SEQ ID NO: 3206137 - RNA, 20 nt, Mycobacterium bovis subsp bovis AF2122/97
cugacuuuugucacugcggc

SEQ ID NO: 3206138 - RNA, 14 nt, Mycobacterium bovis subsp bovis AF2122/97
cugagacucgucga

SEQ ID NO: 3206139 - RNA, 15 nt, Mycobacterium bovis subsp bovis AF2122/97
cugagacucgucgau

SEQ ID NO: 3206140 - RNA, 17 nt, Mycobacterium bovis subsp bovis AF2122/97
cugagagaguaucgacc

SEQ ID NO: 3206141 - RNA, 20 nt, Mycobacterium bovis subsp bovis AF2122/97
cugagagauggucgggcggc

SEQ ID NO: 3206142 - RNA, 21 nt, Mycobacterium bovis subsp bovis AF2122/97
cugagagauggucgggcggcg

SEQ ID NO: 3206143 - RNA, 23 nt, Mycobacterium bovis subsp bovis AF2122/97
cugagauccagggagcggcugca

SEQ ID NO: 3206144 - RNA, 22 nt, Mycobacterium bovis subsp bovis AF2122/97
cugagaucgcuucccggaagcg

SEQ ID NO: 3206145 - RNA, 13 nt, Mycobacterium bovis subsp bovis AF2122/97
cugagaugaugcg

SEQ ID NO: 3206146 - RNA, 16 nt, Mycobacterium bovis subsp bovis AF2122/97
cugagaugaugcguga

SEQ ID NO: 3206147 - RNA, 18 nt, Mycobacterium bovis subsp bovis AF2122/97
cugagaugaugcgugacc

SEQ ID NO: 3206148 - RNA, 20 nt, Mycobacterium bovis subsp bovis AF2122/97
cugagcacgcggaucgcgcu

SEQ ID NO: 3206149 - RNA, 14 nt, Mycobacterium bovis subsp bovis AF2122/97
cugagcacggcgcg

SEQ ID NO: 3206150 - RNA, 18 nt, Mycobacterium bovis subsp bovis AF2122/97
cugagcacggcgcggcgg

SEQ ID NO: 3206151 - RNA, 13 nt, Mycobacterium bovis subsp bovis AF2122/97
cugagcacguuca

SEQ ID NO: 3206152 - RNA, 18 nt, Mycobacterium bovis subsp bovis AF2122/97
cugagcacguucaccgcg

SEQ ID NO: 3206153 - RNA, 23 nt, Mycobacterium bovis subsp bovis AF2122/97
cugagcacguucaccgcgcgcuc

SEQ ID NO: 3206154 - RNA, 23 nt, Mycobacterium bovis subsp bovis AF2122/97
cugagcacucaugaugccggacg

SEQ ID NO: 3206155 - RNA, 13 nt, Mycobacterium bovis subsp bovis AF2122/97
cugagcagcgccg

SEQ ID NO: 3206156 - RNA, 15 nt, Mycobacterium bovis subsp bovis AF2122/97
cugagcagcgcggcc

SEQ ID NO: 3206157 - RNA, 18 nt, Mycobacterium bovis subsp bovis AF2122/97
cugagcagcgcggccaga

SEQ ID NO: 3206158 - RNA, 23 nt, Mycobacterium bovis subsp bovis AF2122/97
cugagccacagggaagcaagggc

SEQ ID NO: 3206159 - RNA, 16 nt, Mycobacterium bovis subsp bovis AF2122/97
cugagccaccaacacc

SEQ ID NO: 3206160 - RNA, 13 nt, Mycobacterium bovis subsp bovis AF2122/97
cugagccaccccg

SEQ ID NO: 3206161 - RNA, 16 nt, Mycobacterium bovis subsp bovis AF2122/97
cugagccaccccgggu

SEQ ID NO: 3206162 - RNA, 11 nt, Mycobacterium bovis subsp bovis AF2122/97
cugagcccgcc

SEQ ID NO: 3206163 - RNA, 13 nt, Mycobacterium bovis subsp bovis AF2122/97
cugagcccgccgc

SEQ ID NO: 3206164 - RNA, 14 nt, Mycobacterium bovis subsp bovis AF2122/97
cugagcccgccgcg

SEQ ID NO: 3206165 - RNA, 24 nt, Mycobacterium bovis subsp bovis AF2122/97
cugagcccgccgcgaccacgcacc

SEQ ID NO: 3206166 - RNA, 17 nt, Mycobacterium bovis subsp bovis AF2122/97
cugagccgcaucuggcc

SEQ ID NO: 3206167 - RNA, 20 nt, Mycobacterium bovis subsp bovis AF2122/97
cugagccgcaucuggccggc

SEQ ID NO: 3206168 - RNA, 20 nt, Mycobacterium bovis subsp bovis AF2122/97
cugagccgcucaucgauccc

SEQ ID NO: 3206169 - RNA, 15 nt, Mycobacterium bovis subsp bovis AF2122/97
cugagccgucggcgc

SEQ ID NO: 3206170 - RNA, 18 nt, Mycobacterium bovis subsp bovis AF2122/97
cugagcgccaggccgcac

SEQ ID NO: 3206171 - RNA, 23 nt, Mycobacterium bovis subsp bovis AF2122/97
cugagcgccaggccgcacagcac

SEQ ID NO: 3206172 - RNA, 23 nt, Mycobacterium bovis subsp bovis AF2122/97
cugagcgcggguggcagcggcga

SEQ ID NO: 3206173 - RNA, 14 nt, Mycobacterium bovis subsp bovis AF2122/97
cugagcggccggca

SEQ ID NO: 3206174 - RNA, 15 nt, Mycobacterium bovis subsp bovis AF2122/97
cugagcggccucggg

SEQ ID NO: 3206175 - RNA, 17 nt, Mycobacterium bovis subsp bovis AF2122/97
cugagcggccucgggac

SEQ ID NO: 3206176 - RNA, 14 nt, Mycobacterium bovis subsp bovis AF2122/97
cugagcgggcgggc

SEQ ID NO: 3206177 - RNA, 13 nt, Mycobacterium bovis subsp bovis AF2122/97
cugagcgugcggu

SEQ ID NO: 3206178 - RNA, 17 nt, Mycobacterium bovis subsp bovis AF2122/97
cugagcgugcggugauc

SEQ ID NO: 3206179 - RNA, 20 nt, Mycobacterium bovis subsp bovis AF2122/97
cugagcuagccguucggcug

SEQ ID NO: 3206180 - RNA, 12 nt, Mycobacterium bovis subsp bovis AF2122/97
cugagcugccga

SEQ ID NO: 3206181 - RNA, 19 nt, Mycobacterium bovis subsp bovis AF2122/97
cugagcugcucgccggcca

SEQ ID NO: 3206182 - RNA, 16 nt, Mycobacterium bovis subsp bovis AF2122/97
cugagcuggcagcucc

SEQ ID NO: 3206183 - RNA, 21 nt, Mycobacterium bovis subsp bovis AF2122/97
cugagcuggcagcuccucgcg

SEQ ID NO: 3206184 - RNA, 11 nt, Mycobacterium bovis subsp bovis AF2122/97
cugagcuucca

SEQ ID NO: 3206185 - RNA, 17 nt, Mycobacterium bovis subsp bovis AF2122/97
cugagcuuggucgccgg

SEQ ID NO: 3206186 - RNA, 20 nt, Mycobacterium bovis subsp bovis AF2122/97
cugagcuuggucgccgggca

SEQ ID NO: 3206187 - RNA, 16 nt, Mycobacterium bovis subsp bovis AF2122/97
cugaggaaagucaccg

SEQ ID NO: 3206188 - RNA, 15 nt, Mycobacterium bovis subsp bovis AF2122/97
cugaggaacgccggc

SEQ ID NO: 3206189 - RNA, 15 nt, Mycobacterium bovis subsp bovis AF2122/97
cugaggaagcggcgg

SEQ ID NO: 3206190 - RNA, 17 nt, Mycobacterium bovis subsp bovis AF2122/97
cugaggaagcggcggca

SEQ ID NO: 3206191 - RNA, 19 nt, Mycobacterium bovis subsp bovis AF2122/97
cugaggaagcggcggcaac

SEQ ID NO: 3206192 - RNA, 17 nt, Mycobacterium bovis subsp bovis AF2122/97
cugaggcaccucggccu

SEQ ID NO: 3206193 - RNA, 15 nt, Mycobacterium bovis subsp bovis AF2122/97
cugaggcggcgacga

SEQ ID NO: 3206194 - RNA, 20 nt, Mycobacterium bovis subsp bovis AF2122/97
cugaggcggcgacgaccguc

SEQ ID NO: 3206195 - RNA, 17 nt, Mycobacterium bovis subsp bovis AF2122/97
cugaggcuuccagcucg

SEQ ID NO: 3206196 - RNA, 18 nt, Mycobacterium bovis subsp bovis AF2122/97
cugaggcuuccagcucgg

SEQ ID NO: 3206197 - RNA, 23 nt, Mycobacterium bovis subsp bovis AF2122/97
cugagggcggaaaaucggcuggc

SEQ ID NO: 3206198 - RNA, 18 nt, Mycobacterium bovis subsp bovis AF2122/97
cugagggugcucucgugg

SEQ ID NO: 3206199 - RNA, 20 nt, Mycobacterium bovis subsp bovis AF2122/97
cugaggguggaccggucgac

SEQ ID NO: 3206200 - RNA, 20 nt, Mycobacterium bovis subsp bovis AF2122/97
cugagguauugggcgcggca

SEQ ID NO: 3206201 - RNA, 22 nt, Mycobacterium bovis subsp bovis AF2122/97
cugagguauugggcgcggcagg

SEQ ID NO: 3206202 - RNA, 14 nt, Mycobacterium bovis subsp bovis AF2122/97
cugaggucaccggc

SEQ ID NO: 3206203 - RNA, 21 nt, Mycobacterium bovis subsp bovis AF2122/97
cugagguggcggugcggcgag

SEQ ID NO: 3206204 - RNA, 18 nt, Mycobacterium bovis subsp bovis AF2122/97
cugaguccccaggugggc

SEQ ID NO: 3206205 - RNA, 22 nt, Mycobacterium bovis subsp bovis AF2122/97
cugaguccccaggugggcagca

SEQ ID NO: 3206206 - RNA, 15 nt, Mycobacterium bovis subsp bovis AF2122/97
cugagucgguucagc

SEQ ID NO: 3206207 - RNA, 21 nt, Mycobacterium bovis subsp bovis AF2122/97
cugagucgguucagccacgca

SEQ ID NO: 3206208 - RNA, 18 nt, Mycobacterium bovis subsp bovis AF2122/97
cugagucugauggccucg

SEQ ID NO: 3206209 - RNA, 21 nt, Mycobacterium bovis subsp bovis AF2122/97
cugagucugauggccucgcga

SEQ ID NO: 3206210 - RNA, 15 nt, Mycobacterium bovis subsp bovis AF2122/97
cugaguggacggccg

SEQ ID NO: 3206211 - RNA, 17 nt, Mycobacterium bovis subsp bovis AF2122/97
cugaguuuaugcccggc

SEQ ID NO: 3206212 - RNA, 19 nt, Mycobacterium bovis subsp bovis AF2122/97
cugauaaagcccggcggca

SEQ ID NO: 3206213 - RNA, 16 nt, Mycobacterium bovis subsp bovis AF2122/97
cugauaccaauccggc

SEQ ID NO: 3206214 - RNA, 19 nt, Mycobacterium bovis subsp bovis AF2122/97
cugauagacccuggggucc

SEQ ID NO: 3206215 - RNA, 20 nt, Mycobacterium bovis subsp bovis AF2122/97
cugauagcggucggucacca

SEQ ID NO: 3206216 - RNA, 21 nt, Mycobacterium bovis subsp bovis AF2122/97
cugauaguggcgcgcggcgcc

SEQ ID NO: 3206217 - RNA, 20 nt, Mycobacterium bovis subsp bovis AF2122/97
cugauaugacuugcgcgcgg

SEQ ID NO: 3206218 - RNA, 12 nt, Mycobacterium bovis subsp bovis AF2122/97
cugaucaaggcg

SEQ ID NO: 3206219 - RNA, 15 nt, Mycobacterium bovis subsp bovis AF2122/97
cugaucaaggcgcuc

SEQ ID NO: 3206220 - RNA, 18 nt, Mycobacterium bovis subsp bovis AF2122/97
cugaucaagugccagcgu

SEQ ID NO: 3206221 - RNA, 23 nt, Mycobacterium bovis subsp bovis AF2122/97
cugaucaccgucguacucggcgg

SEQ ID NO: 3206222 - RNA, 18 nt, Mycobacterium bovis subsp bovis AF2122/97
cugaucacucacccgggc

SEQ ID NO: 3206223 - RNA, 12 nt, Mycobacterium bovis subsp bovis AF2122/97
cugaucagccca

SEQ ID NO: 3206224 - RNA, 15 nt, Mycobacterium bovis subsp bovis AF2122/97
cugaucccggccagg

SEQ ID NO: 3206225 - RNA, 16 nt, Mycobacterium bovis subsp bovis AF2122/97
cugaucccggccaggc

SEQ ID NO: 3206226 - RNA, 18 nt, Mycobacterium bovis subsp bovis AF2122/97
cugaucccggccaggccg

SEQ ID NO: 3206227 - RNA, 16 nt, Mycobacterium bovis subsp bovis AF2122/97
cugauccgccugccga

SEQ ID NO: 3206228 - RNA, 22 nt, Mycobacterium bovis subsp bovis AF2122/97
cugauccgccugccgacggcau

SEQ ID NO: 3206229 - RNA, 13 nt, Mycobacterium bovis subsp bovis AF2122/97
cugauccggccgg

SEQ ID NO: 3206230 - RNA, 15 nt, Mycobacterium bovis subsp bovis AF2122/97
cugauccgggcgccg

SEQ ID NO: 3206231 - RNA, 15 nt, Mycobacterium bovis subsp bovis AF2122/97
cugaucgaccgccuc

SEQ ID NO: 3206232 - RNA, 15 nt, Mycobacterium bovis subsp bovis AF2122/97
cugaucgccacccgg

SEQ ID NO: 3206233 - RNA, 19 nt, Mycobacterium bovis subsp bovis AF2122/97
cugaucgccucggacacgg

SEQ ID NO: 3206234 - RNA, 17 nt, Mycobacterium bovis subsp bovis AF2122/97
cugaucgcgaagcguuc

SEQ ID NO: 3206235 - RNA, 18 nt, Mycobacterium bovis subsp bovis AF2122/97
cugaucgcgauccacccg

SEQ ID NO: 3206236 - RNA, 15 nt, Mycobacterium bovis subsp bovis AF2122/97
cugaucgcgcagauu

SEQ ID NO: 3206237 - RNA, 23 nt, Mycobacterium bovis subsp bovis AF2122/97
cugaucggaaacggagccgagcc

SEQ ID NO: 3206238 - RNA, 21 nt, Mycobacterium bovis subsp bovis AF2122/97
cugaucggcaggguggccagc

SEQ ID NO: 3206239 - RNA, 15 nt, Mycobacterium bovis subsp bovis AF2122/97
cugaucggcgcggcc

SEQ ID NO: 3206240 - RNA, 18 nt, Mycobacterium bovis subsp bovis AF2122/97
cugaucggcgcggccgua

SEQ ID NO: 3206241 - RNA, 23 nt, Mycobacterium bovis subsp bovis AF2122/97
cugaucgguccggcgaacugcga

SEQ ID NO: 3206242 - RNA, 20 nt, Mycobacterium bovis subsp bovis AF2122/97
cugaucguuggcaucggcgg

SEQ ID NO: 3206243 - RNA, 14 nt, Mycobacterium bovis subsp bovis AF2122/97
cugaucugccgccg

SEQ ID NO: 3206244 - RNA, 18 nt, Mycobacterium bovis subsp bovis AF2122/97
cugaucugccgccgcggc

SEQ ID NO: 3206245 - RNA, 19 nt, Mycobacterium bovis subsp bovis AF2122/97
cugaucugcgcaaccgagc

SEQ ID NO: 3206246 - RNA, 22 nt, Mycobacterium bovis subsp bovis AF2122/97
cugaucuggggcaccacgcugu

SEQ ID NO: 3206247 - RNA, 21 nt, Mycobacterium bovis subsp bovis AF2122/97
cugaucuuccccucggccgcc

SEQ ID NO: 3206248 - RNA, 23 nt, Mycobacterium bovis subsp bovis AF2122/97
cugaucuuccccucggccgcccg

SEQ ID NO: 3206249 - RNA, 18 nt, Mycobacterium bovis subsp bovis AF2122/97
cugaucuucgagccggcg

SEQ ID NO: 3206250 - RNA, 22 nt, Mycobacterium bovis subsp bovis AF2122/97
cugaucuucgagccggcggccu

SEQ ID NO: 3206251 - RNA, 17 nt, Mycobacterium bovis subsp bovis AF2122/97
cugaucuuggcaagcca

SEQ ID NO: 3206252 - RNA, 18 nt, Mycobacterium bovis subsp bovis AF2122/97
cugaucuuggcccgggcc

SEQ ID NO: 3206253 - RNA, 16 nt, Mycobacterium bovis subsp bovis AF2122/97
cugaugaaacgccguc

SEQ ID NO: 3206254 - RNA, 22 nt, Mycobacterium bovis subsp bovis AF2122/97
cugaugaagaugauuucgccga

SEQ ID NO: 3206255 - RNA, 14 nt, Mycobacterium bovis subsp bovis AF2122/97
cugaugacggugug

SEQ ID NO: 3206256 - RNA, 19 nt, Mycobacterium bovis subsp bovis AF2122/97
cugaugacgguguggaaac

SEQ ID NO: 3206257 - RNA, 14 nt, Mycobacterium bovis subsp bovis AF2122/97
cugaugagggacga

SEQ ID NO: 3206258 - RNA, 14 nt, Mycobacterium bovis subsp bovis AF2122/97
cugaugcgcugggc

SEQ ID NO: 3206259 - RNA, 18 nt, Mycobacterium bovis subsp bovis AF2122/97
cugaugcgcugggccagg

SEQ ID NO: 3206260 - RNA, 13 nt, Mycobacterium bovis subsp bovis AF2122/97
cugaugcuggcca

SEQ ID NO: 3206261 - RNA, 19 nt, Mycobacterium bovis subsp bovis AF2122/97
cugauggcggcgacccguc

SEQ ID NO: 3206262 - RNA, 19 nt, Mycobacterium bovis subsp bovis AF2122/97
cugauggugcugcggcguc

SEQ ID NO: 3206263 - RNA, 18 nt, Mycobacterium bovis subsp bovis AF2122/97
cugauguacccggcgacg

SEQ ID NO: 3206264 - RNA, 14 nt, Mycobacterium bovis subsp bovis AF2122/97
cugaugucacccgc

SEQ ID NO: 3206265 - RNA, 13 nt, Mycobacterium bovis subsp bovis AF2122/97
cugauugaagccc

SEQ ID NO: 3206266 - RNA, 22 nt, Mycobacterium bovis subsp bovis AF2122/97
cugauugaagccccccgagcug

SEQ ID NO: 3206267 - RNA, 16 nt, Mycobacterium bovis subsp bovis AF2122/97
cugauugcgaccgcgc

SEQ ID NO: 3206268 - RNA, 21 nt, Mycobacterium bovis subsp bovis AF2122/97
cugauuguguuccaccagcgc

SEQ ID NO: 3206269 - RNA, 16 nt, Mycobacterium bovis subsp bovis AF2122/97
cugcaaccagcggcac

SEQ ID NO: 3206270 - RNA, 23 nt, Mycobacterium bovis subsp bovis AF2122/97
cugcaacgauugaacucugguga

SEQ ID NO: 3206271 - RNA, 15 nt, Mycobacterium bovis subsp bovis AF2122/97
cugcaacgccgcgga

SEQ ID NO: 3206272 - RNA, 19 nt, Mycobacterium bovis subsp bovis AF2122/97
cugcaacgucacucccugg

SEQ ID NO: 3206273 - RNA, 18 nt, Mycobacterium bovis subsp bovis AF2122/97
cugcaacucuucccauuu

SEQ ID NO: 3206274 - RNA, 18 nt, Mycobacterium bovis subsp bovis AF2122/97
cugcaagaaccacugcau

SEQ ID NO: 3206275 - RNA, 22 nt, Mycobacterium bovis subsp bovis AF2122/97
cugcaagacaaagccgucgacg

SEQ ID NO: 3206276 - RNA, 14 nt, Mycobacterium bovis subsp bovis AF2122/97
cugcaagacgccga

SEQ ID NO: 3206277 - RNA, 19 nt, Mycobacterium bovis subsp bovis AF2122/97
cugcaagacgccgauccgg

SEQ ID NO: 3206278 - RNA, 20 nt, Mycobacterium bovis subsp bovis AF2122/97
cugcaagcuaagcgccugau

SEQ ID NO: 3206279 - RNA, 21 nt, Mycobacterium bovis subsp bovis AF2122/97
cugcaaggaauuccggcugcu

SEQ ID NO: 3206280 - RNA, 22 nt, Mycobacterium bovis subsp bovis AF2122/97
cugcaaggaauuccggcugcuu

SEQ ID NO: 3206281 - RNA, 13 nt, Mycobacterium bovis subsp bovis AF2122/97
cugcacaccaccg

SEQ ID NO: 3206282 - RNA, 15 nt, Mycobacterium bovis subsp bovis AF2122/97
cugcacaccaccgcc

SEQ ID NO: 3206283 - RNA, 22 nt, Mycobacterium bovis subsp bovis AF2122/97
cugcacagcaggcucgaaccga

SEQ ID NO: 3206284 - RNA, 19 nt, Mycobacterium bovis subsp bovis AF2122/97
cugcacagugcggccccga

SEQ ID NO: 3206285 - RNA, 20 nt, Mycobacterium bovis subsp bovis AF2122/97
cugcacauaguccgagcggu

SEQ ID NO: 3206286 - RNA, 17 nt, Mycobacterium bovis subsp bovis AF2122/97
cugcaccacggcggcca

SEQ ID NO: 3206287 - RNA, 19 nt, Mycobacterium bovis subsp bovis AF2122/97
cugcaccacggcggccacc

SEQ ID NO: 3206288 - RNA, 20 nt, Mycobacterium bovis subsp bovis AF2122/97
cugcacccaggcaucgguga

SEQ ID NO: 3206289 - RNA, 17 nt, Mycobacterium bovis subsp bovis AF2122/97
cugcacccgacccgaug

SEQ ID NO: 3206290 - RNA, 14 nt, Mycobacterium bovis subsp bovis AF2122/97
cugcacccgccagg

SEQ ID NO: 3206291 - RNA, 16 nt, Mycobacterium bovis subsp bovis AF2122/97
cugcacccgccagggc

SEQ ID NO: 3206292 - RNA, 18 nt, Mycobacterium bovis subsp bovis AF2122/97
cugcacccgccagggcgg

SEQ ID NO: 3206293 - RNA, 18 nt, Mycobacterium bovis subsp bovis AF2122/97
cugcacccggagaaucgg

SEQ ID NO: 3206294 - RNA, 17 nt, Mycobacterium bovis subsp bovis AF2122/97
cugcaccgauucgggcu

SEQ ID NO: 3206295 - RNA, 15 nt, Mycobacterium bovis subsp bovis AF2122/97
cugcaccgccgccgc

SEQ ID NO: 3206296 - RNA, 20 nt, Mycobacterium bovis subsp bovis AF2122/97
cugcaccgggucaacgccau

SEQ ID NO: 3206297 - RNA, 23 nt, Mycobacterium bovis subsp bovis AF2122/97
cugcaccguagugaacggcucgg

SEQ ID NO: 3206298 - RNA, 17 nt, Mycobacterium bovis subsp bovis AF2122/97
cugcaccgucacgucgu

SEQ ID NO: 3206299 - RNA, 19 nt, Mycobacterium bovis subsp bovis AF2122/97
cugcaccguuuccggcgcu

SEQ ID NO: 3206300 - RNA, 21 nt, Mycobacterium bovis subsp bovis AF2122/97
cugcaccguuuccggcgcucc

SEQ ID NO: 3206301 - RNA, 18 nt, Mycobacterium bovis subsp bovis AF2122/97
cugcaccuggccgcccgc

SEQ ID NO: 3206302 - RNA, 20 nt, Mycobacterium bovis subsp bovis AF2122/97
cugcaccuggccgcccgcuc

SEQ ID NO: 3206303 - RNA, 15 nt, Mycobacterium bovis subsp bovis AF2122/97
cugcaccuggcgcag

SEQ ID NO: 3206304 - RNA, 23 nt, Mycobacterium bovis subsp bovis AF2122/97
cugcaccuggcgcagcaacucga

SEQ ID NO: 3206305 - RNA, 21 nt, Mycobacterium bovis subsp bovis AF2122/97
cugcacgacaucgucgcgacg

SEQ ID NO: 3206306 - RNA, 19 nt, Mycobacterium bovis subsp bovis AF2122/97
cugcacgagugcggcgacc

SEQ ID NO: 3206307 - RNA, 14 nt, Mycobacterium bovis subsp bovis AF2122/97
cugcacgucggccc

SEQ ID NO: 3206308 - RNA, 21 nt, Mycobacterium bovis subsp bovis AF2122/97
cugcacuugaaauugagccgg

SEQ ID NO: 3206309 - RNA, 22 nt, Mycobacterium bovis subsp bovis AF2122/97
cugcacuugaaauugagccggc

SEQ ID NO: 3206310 - RNA, 23 nt, Mycobacterium bovis subsp bovis AF2122/97
cugcacuugaaauugagccggcc

SEQ ID NO: 3206311 - RNA, 16 nt, Mycobacterium bovis subsp bovis AF2122/97
cugcagaaacagccgc

SEQ ID NO: 3206312 - RNA, 15 nt, Mycobacterium bovis subsp bovis AF2122/97
cugcagaaaggccaa

SEQ ID NO: 3206313 - RNA, 13 nt, Mycobacterium bovis subsp bovis AF2122/97
cugcagacgcccc

SEQ ID NO: 3206314 - RNA, 15 nt, Mycobacterium bovis subsp bovis AF2122/97
cugcagacgguccgc

SEQ ID NO: 3206315 - RNA, 18 nt, Mycobacterium bovis subsp bovis AF2122/97
cugcagauaggacccagc

SEQ ID NO: 3206316 - RNA, 19 nt, Mycobacterium bovis subsp bovis AF2122/97
cugcagauaggacccagcc

SEQ ID NO: 3206317 - RNA, 14 nt, Mycobacterium bovis subsp bovis AF2122/97
cugcagaucggccg

SEQ ID NO: 3206318 - RNA, 22 nt, Mycobacterium bovis subsp bovis AF2122/97
cugcagaucguagugcgcgcca

SEQ ID NO: 3206319 - RNA, 15 nt, Mycobacterium bovis subsp bovis AF2122/97
cugcagcacgacgug

SEQ ID NO: 3206320 - RNA, 17 nt, Mycobacterium bovis subsp bovis AF2122/97
cugcagcacgcgugguu

SEQ ID NO: 3206321 - RNA, 21 nt, Mycobacterium bovis subsp bovis AF2122/97
cugcagcacucggugucggcc

SEQ ID NO: 3206322 - RNA, 23 nt, Mycobacterium bovis subsp bovis AF2122/97
cugcagcagacccgguggcgugg

SEQ ID NO: 3206323 - RNA, 19 nt, Mycobacterium bovis subsp bovis AF2122/97
cugcagcauggcccuggcg

SEQ ID NO: 3206324 - RNA, 20 nt, Mycobacterium bovis subsp bovis AF2122/97
cugcagcauggcccuggcga

SEQ ID NO: 3206325 - RNA, 16 nt, Mycobacterium bovis subsp bovis AF2122/97
cugcagcccaugggcg

SEQ ID NO: 3206326 - RNA, 16 nt, Mycobacterium bovis subsp bovis AF2122/97
cugcagcccgggcagc

SEQ ID NO: 3206327 - RNA, 17 nt, Mycobacterium bovis subsp bovis AF2122/97
cugcagcccgggcagca

SEQ ID NO: 3206328 - RNA, 18 nt, Mycobacterium bovis subsp bovis AF2122/97
cugcagcccgggcagcac

SEQ ID NO: 3206329 - RNA, 19 nt, Mycobacterium bovis subsp bovis AF2122/97
cugcagcccgggcagcacc

SEQ ID NO: 3206330 - RNA, 20 nt, Mycobacterium bovis subsp bovis AF2122/97
cugcagcccgggcagcacca

SEQ ID NO: 3206331 - RNA, 19 nt, Mycobacterium bovis subsp bovis AF2122/97
cugcagcgaaacaccggcc

SEQ ID NO: 3206332 - RNA, 15 nt, Mycobacterium bovis subsp bovis AF2122/97
cugcagcgagaccuc

SEQ ID NO: 3206333 - RNA, 13 nt, Mycobacterium bovis subsp bovis AF2122/97
cugcagcgcaucc

SEQ ID NO: 3206334 - RNA, 16 nt, Mycobacterium bovis subsp bovis AF2122/97
cugcagcgcauccggu

SEQ ID NO: 3206335 - RNA, 16 nt, Mycobacterium bovis subsp bovis AF2122/97
cugcagcgcgacccgu

SEQ ID NO: 3206336 - RNA, 18 nt, Mycobacterium bovis subsp bovis AF2122/97
cugcagcgcggauucggu

SEQ ID NO: 3206337 - RNA, 13 nt, Mycobacterium bovis subsp bovis AF2122/97
cugcagcgcggcc

SEQ ID NO: 3206338 - RNA, 16 nt, Mycobacterium bovis subsp bovis AF2122/97
cugcagcgcggccgga

SEQ ID NO: 3206339 - RNA, 14 nt, Mycobacterium bovis subsp bovis AF2122/97
cugcagcgcggugg

SEQ ID NO: 3206340 - RNA, 21 nt, Mycobacterium bovis subsp bovis AF2122/97
cugcagcggcuugcccaggcg

SEQ ID NO: 3206341 - RNA, 20 nt, Mycobacterium bovis subsp bovis AF2122/97
cugcagcgucaagggcuggg

SEQ ID NO: 3206342 - RNA, 21 nt, Mycobacterium bovis subsp bovis AF2122/97
cugcagcgucaagggcugggu

SEQ ID NO: 3206343 - RNA, 16 nt, Mycobacterium bovis subsp bovis AF2122/97
cugcagcucgggcagg

SEQ ID NO: 3206344 - RNA, 13 nt, Mycobacterium bovis subsp bovis AF2122/97
cugcaggcggccg

SEQ ID NO: 3206345 - RNA, 20 nt, Mycobacterium bovis subsp bovis AF2122/97
cugcaggcggccgagcuggu

SEQ ID NO: 3206346 - RNA, 16 nt, Mycobacterium bovis subsp bovis AF2122/97
cugcaggcggccuugc

SEQ ID NO: 3206347 - RNA, 11 nt, Mycobacterium bovis subsp bovis AF2122/97
cugcaggcugu

SEQ ID NO: 3206348 - RNA, 22 nt, Mycobacterium bovis subsp bovis AF2122/97
cugcagggccaauuccaugacg

SEQ ID NO: 3206349 - RNA, 16 nt, Mycobacterium bovis subsp bovis AF2122/97
cugcagggccuggcca

SEQ ID NO: 3206350 - RNA, 18 nt, Mycobacterium bovis subsp bovis AF2122/97
cugcagggccuggccaca

SEQ ID NO: 3206351 - RNA, 19 nt, Mycobacterium bovis subsp bovis AF2122/97
cugcagggccuggccacac

SEQ ID NO: 3206352 - RNA, 20 nt, Mycobacterium bovis subsp bovis AF2122/97
cugcagggccuggccacacu

SEQ ID NO: 3206353 - RNA, 21 nt, Mycobacterium bovis subsp bovis AF2122/97
cugcagguuaggguccagguc

SEQ ID NO: 3206354 - RNA, 16 nt, Mycobacterium bovis subsp bovis AF2122/97
cugcagguuccacgcg

SEQ ID NO: 3206355 - RNA, 21 nt, Mycobacterium bovis subsp bovis AF2122/97
cugcagguuuccggccugcac

SEQ ID NO: 3206356 - RNA, 21 nt, Mycobacterium bovis subsp bovis AF2122/97
cugcagucgagcaucucgucg

SEQ ID NO: 3206357 - RNA, 18 nt, Mycobacterium bovis subsp bovis AF2122/97
cugcagugaucgugaccg

SEQ ID NO: 3206358 - RNA, 14 nt, Mycobacterium bovis subsp bovis AF2122/97
cugcagugccgcac

SEQ ID NO: 3206359 - RNA, 21 nt, Mycobacterium bovis subsp bovis AF2122/97
cugcaguguuuuugcagacuc

SEQ ID NO: 3206360 - RNA, 20 nt, Mycobacterium bovis subsp bovis AF2122/97
cugcauaggcgcggucaccg

SEQ ID NO: 3206361 - RNA, 14 nt, Mycobacterium bovis subsp bovis AF2122/97
cugcaucaccacug

SEQ ID NO: 3206362 - RNA, 15 nt, Mycobacterium bovis subsp bovis AF2122/97
cugcaucgucgacga

SEQ ID NO: 3206363 - RNA, 23 nt, Mycobacterium bovis subsp bovis AF2122/97
cugcaucgucgccaagcccaggc

SEQ ID NO: 3206364 - RNA, 15 nt, Mycobacterium bovis subsp bovis AF2122/97
cugcaugcccagaaa

SEQ ID NO: 3206365 - RNA, 16 nt, Mycobacterium bovis subsp bovis AF2122/97
cugcaugguggcgccg

SEQ ID NO: 3206366 - RNA, 16 nt, Mycobacterium bovis subsp bovis AF2122/97
cugccaaaagggcggc

SEQ ID NO: 3206367 - RNA, 17 nt, Mycobacterium bovis subsp bovis AF2122/97
cugccaaaagggcggca

SEQ ID NO: 3206368 - RNA, 19 nt, Mycobacterium bovis subsp bovis AF2122/97
cugccaaaagggcggcagc

SEQ ID NO: 3206369 - RNA, 19 nt, Mycobacterium bovis subsp bovis AF2122/97
cugccaaacuaacggcagc

SEQ ID NO: 3206370 - RNA, 19 nt, Mycobacterium bovis subsp bovis AF2122/97
cugccaacgcccguguuga

SEQ ID NO: 3206371 - RNA, 20 nt, Mycobacterium bovis subsp bovis AF2122/97
cugccaacgcccguguugaa

SEQ ID NO: 3206372 - RNA, 15 nt, Mycobacterium bovis subsp bovis AF2122/97
cugccaacgggccau

SEQ ID NO: 3206373 - RNA, 14 nt, Mycobacterium bovis subsp bovis AF2122/97
cugccaaggccuuc

SEQ ID NO: 3206374 - RNA, 23 nt, Mycobacterium bovis subsp bovis AF2122/97
cugccaaucugcacgcgcucgcg

SEQ ID NO: 3206375 - RNA, 16 nt, Mycobacterium bovis subsp bovis AF2122/97
cugccaaugcugcagg

SEQ ID NO: 3206376 - RNA, 14 nt, Mycobacterium bovis subsp bovis AF2122/97
cugccacagcgaca

SEQ ID NO: 3206377 - RNA, 16 nt, Mycobacterium bovis subsp bovis AF2122/97
cugccacagcgacagc

SEQ ID NO: 3206378 - RNA, 15 nt, Mycobacterium bovis subsp bovis AF2122/97
cugccacaggcguuu

SEQ ID NO: 3206379 - RNA, 20 nt, Mycobacterium bovis subsp bovis AF2122/97
cugccaccagacaacgccgu

SEQ ID NO: 3206380 - RNA, 16 nt, Mycobacterium bovis subsp bovis AF2122/97
cugccacccagcacgc

SEQ ID NO: 3206381 - RNA, 21 nt, Mycobacterium bovis subsp bovis AF2122/97
cugccacccagcacgcgcgcg

SEQ ID NO: 3206382 - RNA, 16 nt, Mycobacterium bovis subsp bovis AF2122/97
cugccacccggccagg

SEQ ID NO: 3206383 - RNA, 15 nt, Mycobacterium bovis subsp bovis AF2122/97
cugccaccgcagacg

SEQ ID NO: 3206384 - RNA, 22 nt, Mycobacterium bovis subsp bovis AF2122/97
cugccaccgcgagggggguguu

SEQ ID NO: 3206385 - RNA, 17 nt, Mycobacterium bovis subsp bovis AF2122/97
cugccaccggccggcgc

SEQ ID NO: 3206386 - RNA, 18 nt, Mycobacterium bovis subsp bovis AF2122/97
cugccaccggccggcgca

SEQ ID NO: 3206387 - RNA, 24 nt, Mycobacterium bovis subsp bovis AF2122/97
cugccacgaggcaucguccacgca

SEQ ID NO: 3206388 - RNA, 20 nt, Mycobacterium bovis subsp bovis AF2122/97
cugccacgcgugacucggcc

SEQ ID NO: 3206389 - RNA, 20 nt, Mycobacterium bovis subsp bovis AF2122/97
cugccacgcguuccuccagc

SEQ ID NO: 3206390 - RNA, 18 nt, Mycobacterium bovis subsp bovis AF2122/97
cugccacguugaucccga

SEQ ID NO: 3206391 - RNA, 14 nt, Mycobacterium bovis subsp bovis AF2122/97
cugccacuuggacg

SEQ ID NO: 3206392 - RNA, 23 nt, Mycobacterium bovis subsp bovis AF2122/97
cugccacuuggacgaacacaccg

SEQ ID NO: 3206393 - RNA, 19 nt, Mycobacterium bovis subsp bovis AF2122/97
cugccagaucggucggcca

SEQ ID NO: 3206394 - RNA, 23 nt, Mycobacterium bovis subsp bovis AF2122/97
cugccagaucggucggccaaagc

SEQ ID NO: 3206395 - RNA, 12 nt, Mycobacterium bovis subsp bovis AF2122/97
cugccagcaccc

SEQ ID NO: 3206396 - RNA, 14 nt, Mycobacterium bovis subsp bovis AF2122/97
cugccagcacccug

SEQ ID NO: 3206397 - RNA, 17 nt, Mycobacterium bovis subsp bovis AF2122/97
cugccagcacccugaug

SEQ ID NO: 3206398 - RNA, 20 nt, Mycobacterium bovis subsp bovis AF2122/97
cugccagcacccugauguga

SEQ ID NO: 3206399 - RNA, 15 nt, Mycobacterium bovis subsp bovis AF2122/97
cugccagccauggcc

SEQ ID NO: 3206400 - RNA, 19 nt, Mycobacterium bovis subsp bovis AF2122/97
cugccagccauggccgcca

SEQ ID NO: 3206401 - RNA, 15 nt, Mycobacterium bovis subsp bovis AF2122/97
cugccagcgccgccg

SEQ ID NO: 3206402 - RNA, 17 nt, Mycobacterium bovis subsp bovis AF2122/97
cugccagcgccgccgcc

SEQ ID NO: 3206403 - RNA, 20 nt, Mycobacterium bovis subsp bovis AF2122/97
cugccagcgccgccgccgac

SEQ ID NO: 3206404 - RNA, 14 nt, Mycobacterium bovis subsp bovis AF2122/97
cugccagcgccgcg

SEQ ID NO: 3206405 - RNA, 15 nt, Mycobacterium bovis subsp bovis AF2122/97
cugccagcgccgcgg

SEQ ID NO: 3206406 - RNA, 16 nt, Mycobacterium bovis subsp bovis AF2122/97
cugccagcgccgcggc

SEQ ID NO: 3206407 - RNA, 15 nt, Mycobacterium bovis subsp bovis AF2122/97
cugccagcggccggg

SEQ ID NO: 3206408 - RNA, 18 nt, Mycobacterium bovis subsp bovis AF2122/97
cugccagcggccgggcgg

SEQ ID NO: 3206409 - RNA, 16 nt, Mycobacterium bovis subsp bovis AF2122/97
cugccagcguugcgga

SEQ ID NO: 3206410 - RNA, 21 nt, Mycobacterium bovis subsp bovis AF2122/97
cugccaggcccgugccuggcc

SEQ ID NO: 3206411 - RNA, 17 nt, Mycobacterium bovis subsp bovis AF2122/97
cugccagugccgcccac

SEQ ID NO: 3206412 - RNA, 18 nt, Mycobacterium bovis subsp bovis AF2122/97
cugccagugggccgacgu

SEQ ID NO: 3206413 - RNA, 17 nt, Mycobacterium bovis subsp bovis AF2122/97
cugccaguucuuggcga

SEQ ID NO: 3206414 - RNA, 20 nt, Mycobacterium bovis subsp bovis AF2122/97
cugccaguucuuggcgaccu

SEQ ID NO: 3206415 - RNA, 15 nt, Mycobacterium bovis subsp bovis AF2122/97
cugccauaggcccac

SEQ ID NO: 3206416 - RNA, 22 nt, Mycobacterium bovis subsp bovis AF2122/97
cugccauaggcccacggcagcg

SEQ ID NO: 3206417 - RNA, 15 nt, Mycobacterium bovis subsp bovis AF2122/97
cugccaucacgcgcu

SEQ ID NO: 3206418 - RNA, 16 nt, Mycobacterium bovis subsp bovis AF2122/97
cugccaucccgauccc
